United States Patent 11,332,783 (SAMPLE ANALYSIS, PRESENCE DETERMINATION OF A TARGET SEQUENCE) - sequence listing, part 21

SEQ ID NO: 407711 - DNA, 140 bp, Artificial Sequence
  Synthetic
aggccctggctgctgatatggatttagaaaaacatggagcaatcacaagcagtaatataaatcatcctagctgtgtctggctggaagcgcaagaagaagaggaggtaggctttccagtcagaccttttgggacagcggtg

SEQ ID NO: 407712 - DNA, 140 bp, Artificial Sequence
  Synthetic
caccgctgtcccaaaaggtctgactggaaagcctacctcctcttcttcttgcgcttccagccagacacagctaggatgatttatattactgcttgtgattgctccatgtttttctaaatccatatcagcagccagggcct

SEQ ID NO: 407713 - DNA, 140 bp, Artificial Sequence
  Synthetic
aggccctggctgctgatatgaacatatagtatgggcaagcagggagctggaaagatttgcacttaaccccagccttttagaaacagcagaaggatgccaacagataatggaacagatacagaccttttgggacagcggtg

SEQ ID NO: 407714 - DNA, 140 bp, Artificial Sequence
  Synthetic
caccgctgtcccaaaaggtctgtatctgttccattatctgttggcatccttctgctgtttctaaaaggctggggttaagtgcaaatctttccagctccctgcttgcccatactatatgttcatatcagcagccagggcct

SEQ ID NO: 407715 - DNA, 140 bp, Artificial Sequence
  Synthetic
aggccctggctgctgatatgatgtgacagaaaattttaacatgtggaaaaataacatggtagaacagatgcatgaggatataatcagtttatgggatcaaagcctaaagccatgtgtaaagaccttttgggacagcggtg

SEQ ID NO: 407716 - DNA, 140 bp, Artificial Sequence
  Synthetic
caccgctgtcccaaaaggtctttacacatggctttaggctttgatcccataaactgattatatcctcatgcatctgttctaccatgttatttttccacatgttaaaattttctgtcacatcatatcagcagccagggcct

SEQ ID NO: 407717 - DNA, 140 bp, Artificial Sequence
  Synthetic
atacgccatgctgggtctccatagcacggtaaccaatagtagtagtggggaagaaataagaaactgctctttcaatgtcaccacagaaagaagagataagatgaggaaagaatatgcattcgtacttgggagtcggccat

SEQ ID NO: 407718 - DNA, 140 bp, Artificial Sequence
  Synthetic
atggccgactcccaagtacgaatgcatattctttcctcatcttatctcttctttctgtggtgacattgaaagagcagtttcttatttcttccccactactactattggttaccgtgctatggagacccagcatggcgtat

SEQ ID NO: 407719 - DNA, 140 bp, Artificial Sequence
  Synthetic
atacgccatgctgggtctccaatctgtagcaattaattgtacaagacccaactacattgaaagaagaagaataccacatataggaccagggagagcattttatacagcacacataagaggcgtacttgggagtcggccat

SEQ ID NO: 407720 - DNA, 140 bp, Artificial Sequence
  Synthetic
atggccgactcccaagtacgcctcttatgtgtgctgtataaaatgctctccctggtcctatatgtggtattcttcttctttcaatgtagttgggtcttgtacaattaattgctacagattggagacccagcatggcgtat

SEQ ID NO: 407721 - DNA, 140 bp, Artificial Sequence
  Synthetic
atacgccatgctgggtctccttttaacaaaggtagctgaaaaattaagagaacaatttgggaataaaacaatagtctttaaaaattcctcaggaggggatccagaaattgtaacgcacagcgtacttgggagtcggccat

SEQ ID NO: 407722 - DNA, 140 bp, Artificial Sequence
  Synthetic
atggccgactcccaagtacgctgtgcgttacaatttctggatcccctcctgaggaatttttaaagactattgttttattcccaaattgttctcttaatttttcagctacctttgttaaaaggagacccagcatggcgtat

SEQ ID NO: 407723 - DNA, 140 bp, Artificial Sequence
  Synthetic
aggccctggctgctgatatgatagtctttaaaaattcctcaggaggggatccagaaattgtaacgcacagttttaattgtagaggggaatccttctattgtaatacaacacgactattcagaccttttgggacagcggtg

SEQ ID NO: 407724 - DNA, 140 bp, Artificial Sequence
  Synthetic
caccgctgtcccaaaaggtctgaatagtcgtgttgtattacaatagaaggattcccctctacaattaaaactgtgcgttacaatttctggatcccctcctgaggaatttttaaagactatcatatcagcagccagggcct

SEQ ID NO: 407725 - DNA, 140 bp, Artificial Sequence
  Synthetic
aggccctggctgctgatatggactgtcaatgatatacagaagttagtgggaaaattaaactgggcaagtcagatttacccagggattaaagtaaagcaactgtgtaaactccttaggggagaccttttgggacagcggtg

SEQ ID NO: 407726 - DNA, 140 bp, Artificial Sequence
  Synthetic
caccgctgtcccaaaaggtctcccctaaggagtttacacagttgctttactttaatccctgggtaaatctgacttgcccagtttaattttcccactaacttctgtatatcattgacagtccatatcagcagccagggcct

SEQ ID NO: 407727 - DNA, 140 bp, Artificial Sequence
  Synthetic
aggccctggctgctgatatgtatagattaggagtaggagctctgataatagcactaatcatagcaatagttgtgtggatcatagcatacatagaatataggaaattgttaagacaaaaaagaccttttgggacagcggtg

SEQ ID NO: 407728 - DNA, 140 bp, Artificial Sequence
  Synthetic
caccgctgtcccaaaaggtcttttttgtcttaacaatttcctatattctatgtatgctatgatccacacaactattgctatgattagtgctattatcagagctcctactcctaatctatacatatcagcagccagggcct

SEQ ID NO: 407729 - DNA, 140 bp, Artificial Sequence
  Synthetic
aggccctggctgctgatatgttgtgggtcacagtctattatggggtacctgtgtggaaagaagcaaaaactactttattctgtgcatcagatgctaaagcatatgagagagaggtgcatagaccttttgggacagcggtg

SEQ ID NO: 407730 - DNA, 140 bp, Artificial Sequence
  Synthetic
caccgctgtcccaaaaggtctatgcacctctctctcatatgctttagcatctgatgcacagaataaagtagtttttgcttctttccacacaggtaccccataatagactgtgacccacaacatatcagcagccagggcct

SEQ ID NO: 407731 - DNA, 140 bp, Artificial Sequence
  Synthetic
atacgccatgctgggtctccgttagaaataatacctataataataccataactgataataataataaaatgagaaattgctctttcaatataaccacagaagtaagagataaaaaacagacgtacttgggagtcggccat

SEQ ID NO: 407732 - DNA, 140 bp, Artificial Sequence
  Synthetic
atggccgactcccaagtacgtctgttttttatctcttacttctgtggttatattgaaagagcaatttctcattttattattattatcagttatggtattattataggtattatttctaacggagacccagcatggcgtat

SEQ ID NO: 407733 - DNA, 140 bp, Artificial Sequence
  Synthetic
aggccctggctgctgatatggaccttcaggcctggaggaggagacatgagggacaattggagaagtgagctgtataaatataaagtaataaaaattgaaccgctaggagtagcacctaccgaccttttgggacagcggtg

SEQ ID NO: 407734 - DNA, 140 bp, Artificial Sequence
  Synthetic
caccgctgtcccaaaaggtcggtaggtgctactcctagcggttcaatttttattactttatatttatacagctcacttctccaattgtccctcatgtctcctcctccaggcctgaaggtccatatcagcagccagggcct

SEQ ID NO: 407735 - DNA, 140 bp, Artificial Sequence
  Synthetic
aggccctggctgctgatatgtaatacaagaaaaagtataaggataggaccaggacaagcattctatgcaacaggagacataataggagacataagacaagcatattgtaatattagtgaagaccttttgggacagcggtg

SEQ ID NO: 407736 - DNA, 140 bp, Artificial Sequence
  Synthetic
caccgctgtcccaaaaggtcttcactaatattacaatatgcttgtcttatgtctcctattatgtctcctgttgcatagaatgcttgtcctggtcctatccttatactttttcttgtattacatatcagcagccagggcct

SEQ ID NO: 407737 - DNA, 140 bp, Artificial Sequence
  Synthetic
aggccctggctgctgatatgtactgtgccttggaactccagttggagtaataaatctcaaacagatatttgggataacatgacctggatgcagtgggatagagaaattagtaattacacagaccttttgggacagcggtg

SEQ ID NO: 407738 - DNA, 140 bp, Artificial Sequence
  Synthetic
caccgctgtcccaaaaggtctgtgtaattactaatttctctatcccactgcatccaggtcatgttatcccaaatatctgtttgagatttattactccaactggagttccaaggcacagtacatatcagcagccagggcct

SEQ ID NO: 407739 - DNA, 140 bp, Artificial Sequence
  Synthetic
atacgccatgctgggtctccctacaatatttggcactgaaagcattaacaacaccaaaaaggataaagccacctctgcctagtgttaagaaattaacagaagatagatggaacaagcccccgtacttgggagtcggccat

SEQ ID NO: 407740 - DNA, 140 bp, Artificial Sequence
  Synthetic
atggccgactcccaagtacgggggcttgttccatctatcttctgttaatttcttaacactaggcagaggtggctttatcctttttggtgttgttaatgctttcagtgccaaatattgtagggagacccagcatggcgtat

SEQ ID NO: 407741 - DNA, 140 bp, Artificial Sequence
  Synthetic
aggccctggctgctgatatggacacaatatacaggttgcttgaagactcgcaaaaccagcaggaacaaaatgaaaaggatttattagcattggacagttggaaaaatctgtggagttggtgaccttttgggacagcggtg

SEQ ID NO: 407742 - DNA, 140 bp, Artificial Sequence
  Synthetic
caccgctgtcccaaaaggtcaccaactccacagatttttccaactgtccaatgctaataaatccttttcattttgttcctgctggttttgcgagtcttcaagcaacctgtatattgtgtccatatcagcagccagggcct

SEQ ID NO: 407743 - DNA, 140 bp, Artificial Sequence
  Synthetic
aggccctggctgctgatatgggcttaggcatctcctatggcaggaagaagcggagacagcgacgaggaacttctcagagccatcaggatcatcaaaatcctgtaccaaagcagtaagtaagaccttttgggacagcggtg

SEQ ID NO: 407744 - DNA, 140 bp, Artificial Sequence
  Synthetic
caccgctgtcccaaaaggtcttacttactgctttggtacaggattttgatgatcctgatggctctgagaagttcctcgtcgctgtctccgcttcttcctgccataggagatgcctaagcccatatcagcagccagggcct

SEQ ID NO: 407745 - DNA, 140 bp, Artificial Sequence
  Synthetic
aggccctggctgctgatatgtatatgtgatgcaatctttacaaatagctgcaatagtaggactagtagtagcattcatagcagccataattgtgtggaccatagtgtatatagaatataggaccttttgggacagcggtg

SEQ ID NO: 407746 - DNA, 140 bp, Artificial Sequence
  Synthetic
caccgctgtcccaaaaggtcctatattctatatacactatggtccacacaattatggctgctatgaatgctactactagtcctactattgcagctatttgtaaagattgcatcacatatacatatcagcagccagggcct

SEQ ID NO: 407747 - DNA, 140 bp, Artificial Sequence
  Synthetic
aggccctggctgctgatatgcccactctgtgtcactttaaactgtacagatgttaaaagtgctaatagtaccagtgaagatatgagaaattgctctttcaatgtaaccacagagaggaaagaccttttgggacagcggtg

SEQ ID NO: 407748 - DNA, 140 bp, Artificial Sequence
  Synthetic
caccgctgtcccaaaaggtctttcctctctgtggttacattgaaagagcaatttctcatatcttcactggtactattagcacttttaacatctgtacagtttaaagtgacacagagtgggcatatcagcagccagggcct

SEQ ID NO: 407749 - DNA, 140 bp, Artificial Sequence
  Synthetic
atacgccatgctgggtctccaaagagcagaagacagtggcaatgagagggagggggatacggaggaattatccacccttatggaattgggggattttgatccttgggttggtgataatttcgtacttgggagtcggccat

SEQ ID NO: 407750 - DNA, 140 bp, Artificial Sequence
  Synthetic
atggccgactcccaagtacgaaattatcaccaacccaaggatcaaaatcccccaattccataagggtggataattcctccgtatccccctccctctcattgccactgtcttctgctctttggagacccagcatggcgtat

SEQ ID NO: 407751 - DNA, 140 bp, Artificial Sequence
  Synthetic
aggccctggctgctgatatggctgttagacattttcctaggccatggcttcatggattaggacaacatatttataacacctatggggatacttgggcaggagttgaagctataataagaagaccttttgggacagcggtg

SEQ ID NO: 407752 - DNA, 140 bp, Artificial Sequence
  Synthetic
caccgctgtcccaaaaggtcttcttattatagcttcaactcctgcccaagtatccccataggtgttataaatatgttgtcctaatccatgaagccatggcctaggaaaatgtctaacagccatatcagcagccagggcct

SEQ ID NO: 407753 - DNA, 140 bp, Artificial Sequence
  Synthetic
atacgccatgctgggtctccagaataggcattattcgagggagaagagtcagggatggatctggtagaccctgacctagatccctggaaccacccgggaagtcagcctgcaacgccttgtcgtacttgggagtcggccat

SEQ ID NO: 407754 - DNA, 140 bp, Artificial Sequence
  Synthetic
atggccgactcccaagtacgacaaggcgttgcaggctgacttcccgggtggttccagggatctaggtcagggtctaccagatccatccctgactcttctccctcgaataatgcctattctggagacccagcatggcgtat

SEQ ID NO: 407755 - DNA, 140 bp, Artificial Sequence
  Synthetic
  misc_feature (118)..(118): n is a, c, g, or t
atacgccatgctgggtctccctttaaattgcactcataatatcactgacataaagcaccacccaaatggaaacatatctgtagctcaagaggaaataagaaactgctctttcaatgtnaccgtacttgggagtcggccat

SEQ ID NO: 407756 - DNA, 140 bp, Artificial Sequence
  Synthetic
  misc_feature (23)..(23): n is a, c, g, or t
atggccgactcccaagtacggtnacattgaaagagcagtttcttatttcctcttgagctacagatatgtttccatttgggtggtgctttatgtcagtgatattatgagtgcaatttaaagggagacccagcatggcgtat

SEQ ID NO: 407757 - DNA, 140 bp, Artificial Sequence
  Synthetic
aggccctggctgctgatatgtgggcaagtttgtggaattggtttgacataacaaactggctgtggtatataaaaatattcataatgatagtaggaggcttaataggtttaagaatagtttgaccttttgggacagcggtg

SEQ ID NO: 407758 - DNA, 140 bp, Artificial Sequence
  Synthetic
caccgctgtcccaaaaggtcaaactattcttaaacctattaagcctcctactatcattatgaatatttttatataccacagccagtttgttatgtcaaaccaattccacaaacttgcccacatatcagcagccagggcct

SEQ ID NO: 407759 - DNA, 140 bp, Artificial Sequence
  Synthetic
atacgccatgctgggtctcctagtaggactggtagtggcgctaatcctagcaatagttgtgtggactatagtaggtatacaaattaagggattgctgagacaaagaaaaatagacaggatcgtacttgggagtcggccat

SEQ ID NO: 407760 - DNA, 140 bp, Artificial Sequence
  Synthetic
atggccgactcccaagtacgatcctgtctatttttctttgtctcagcaatcccttaatttgtatacctactatagtccacacaactattgctaggattagcgccactaccagtcctactaggagacccagcatggcgtat

SEQ ID NO: 407761 - DNA, 140 bp, Artificial Sequence
  Synthetic
aggccctggctgctgatatgatataacagatgaagtaagaaactgttcttttaatgtgaccacagaactaagagataagaagcagaaggtctatgcacttttttataagcttgatatagtgaccttttgggacagcggtg

SEQ ID NO: 407762 - DNA, 140 bp, Artificial Sequence
  Synthetic
caccgctgtcccaaaaggtcactatatcaagcttataaaaaagtgcatagaccttctgcttcttatctcttagttctgtggtcacattaaaagaacagtttcttacttcatctgttatatcatatcagcagccagggcct

SEQ ID NO: 407763 - DNA, 140 bp, Artificial Sequence
  Synthetic
aggccctggctgctgatatgaccagacctaacaacaatacaagaacaagtgtacgtataggaccaggacaagtattctatggaacaggtgatataataggggatataagacaggcacattgaccttttgggacagcggtg

SEQ ID NO: 407764 - DNA, 140 bp, Artificial Sequence
  Synthetic
caccgctgtcccaaaaggtcaatgtgcctgtcttatatcccctattatatcacctgttccatagaatacttgtcctggtcctatacgtacacttgttcttgtattgttgttaggtctggtcatatcagcagccagggcct

SEQ ID NO: 407765 - DNA, 140 bp, Artificial Sequence
  Synthetic
aggccctggctgctgatatgagtattctatggaacaggtgatataataggggatataagacaggcacattgtaatgtcagtagaacagaatggaataaaactttacaacaggtagccacagaccttttgggacagcggtg

SEQ ID NO: 407766 - DNA, 140 bp, Artificial Sequence
  Synthetic
caccgctgtcccaaaaggtctgtggctacctgttgtaaagttttattccattctgttctactgacattacaatgtgcctgtcttatatcccctattatatcacctgttccatagaatactcatatcagcagccagggcct

SEQ ID NO: 407767 - DNA, 140 bp, Artificial Sequence
  Synthetic
aggccctggctgctgatatgaggaggagatgtagaaattacaacacctagttttaattgtgcaggagaatttttctattgcaatacaacagccctgtttaatagtacttggaatagcagtgaccttttgggacagcggtg

SEQ ID NO: 407768 - DNA, 140 bp, Artificial Sequence
  Synthetic
caccgctgtcccaaaaggtcactgctattccaagtactattaaacagggctgttgtattgcaatagaaaaattctcctgcacaattaaaactaggtgttgtaatttctacatctcctcctcatatcagcagccagggcct

SEQ ID NO: 407769 - DNA, 140 bp, Artificial Sequence
  Synthetic
atacgccatgctgggtctccatgttaccaatgctaatgctaccaatgctaatgctaccacagctaccaacataacgaatgacatgagagaagaaataaaaaactgctctttcaatacgaccgtacttgggagtcggccat

SEQ ID NO: 407770 - DNA, 140 bp, Artificial Sequence
  Synthetic
atggccgactcccaagtacggtcgtattgaaagagcagttttttatttcttctctcatgtcattcgttatgttggtagctgtggtagcattagcattggtagcattagcattggtaacatggagacccagcatggcgtat

SEQ ID NO: 407771 - DNA, 140 bp, Artificial Sequence
  Synthetic
atacgccatgctgggtctcccagaataaaacaaattgtaaacatgtggcagagagtaggacaggcaatgtatgcccctcccatcaaaggaggaataaggtggggatcaaacatcacaggacgtacttgggagtcggccat

SEQ ID NO: 407772 - DNA, 140 bp, Artificial Sequence
  Synthetic
atggccgactcccaagtacgtcctgtgatgtttgatccccaccttattcctcctttgatgggaggggcatacattgcctgtcctactctctgccacatgtttacaatttgttttattctgggagacccagcatggcgtat

SEQ ID NO: 407773 - DNA, 140 bp, Artificial Sequence
  Synthetic
aggccctggctgctgatatgccagaccctccaacaatacaagaacaagtacacatataggaccaggacaagtattctatagaacaggagacataataggagatataagaaaagcatattggaccttttgggacagcggtg

SEQ ID NO: 407774 - DNA, 140 bp, Artificial Sequence
  Synthetic
caccgctgtcccaaaaggtccaatatgcttttcttatatctcctattatgtctcctgttctatagaatacttgtcctggtcctatatgtgtacttgttcttgtattgttggagggtctggcatatcagcagccagggcct

SEQ ID NO: 407775 - DNA, 140 bp, Artificial Sequence
  Synthetic
atacgccatgctgggtctccaattaaaagagcactttaataagacaataatctttcaaccaccctcaggaggagatctagaaattacaatgcatcattttaattgtagaggggaatttttcgtacttgggagtcggccat

SEQ ID NO: 407776 - DNA, 140 bp, Artificial Sequence
  Synthetic
atggccgactcccaagtacgaaaaattcccctctacaattaaaatgatgcattgtaatttctagatctcctcctgagggtggttgaaagattattgtcttattaaagtgctcttttaattggagacccagcatggcgtat

SEQ ID NO: 407777 - DNA, 140 bp, Artificial Sequence
  Synthetic
aggccctggctgctgatatgagaaaaacataatgtctgggctacacatgcctgtgtacccacagaccccaacccacaagaaatacatttggaaaatgtaacagaaaattttaacatgtgggaccttttgggacagcggtg

SEQ ID NO: 407778 - DNA, 140 bp, Artificial Sequence
  Synthetic
caccgctgtcccaaaaggtcccacatgttaaaattttctgttacattttccaaatgtatttcttgtgggttggggtctgtgggtacacaggcatgtgtagcccagacattatgtttttctcatatcagcagccagggcct

SEQ ID NO: 407779 - DNA, 140 bp, Artificial Sequence
  Synthetic
atacgccatgctgggtctcctgatgaaatatgggacagcatgacatggctacaatgggataaggaaattagcaattacacacaggtaatatatcagctaatagaagaatcgcagaatcagcgtacttgggagtcggccat

SEQ ID NO: 407780 - DNA, 140 bp, Artificial Sequence
  Synthetic
atggccgactcccaagtacgctgattctgcgattcttctattagctgatatattacctgtgtgtaattgctaatttccttatcccattgtagccatgtcatgctgtcccatatttcatcaggagacccagcatggcgtat

SEQ ID NO: 407781 - DNA, 140 bp, Artificial Sequence
  Synthetic
aggccctggctgctgatatggtctagagctaaaaaagagtgctattagtctgcttgataccacagcaatagcagtagctgaaggaacagatagaattataaaattaatacaaagaatttggaccttttgggacagcggtg

SEQ ID NO: 407782 - DNA, 140 bp, Artificial Sequence
  Synthetic
caccgctgtcccaaaaggtccaaattctttgtattaattttataattctatctgttccttcagctactgctattgctgtggtatcaagcagactaatagcactcttttttagctctagaccatatcagcagccagggcct

SEQ ID NO: 407783 - DNA, 140 bp, Artificial Sequence
  Synthetic
atacgccatgctgggtctccaaaaaactgctcttttaatatcaccacagggataagagataaggtgcagaaagaatatgcacttttgtataaatttgatatagtaccaatagataatgatcgtacttgggagtcggccat

SEQ ID NO: 407784 - DNA, 140 bp, Artificial Sequence
  Synthetic
atggccgactcccaagtacgatcattatctattggtactatatcaaatttatacaaaagtgcatattctttctgcaccttatctcttatccctgtggtgatattaaaagagcagttttttggagacccagcatggcgtat

SEQ ID NO: 407785 - DNA, 140 bp, Artificial Sequence
  Synthetic
aggccctggctgctgatatgtagagctatctgcaacatacctagaagaataagacagggctttgaagcagctttgcaataaaatggggggcaagtggtcaaaaagcagtatagttggatggaccttttgggacagcggtg

SEQ ID NO: 407786 - DNA, 140 bp, Artificial Sequence
  Synthetic
caccgctgtcccaaaaggtccatccaactatactgctttttgaccacttgccccccattttattgcaaagctgcttcaaagccctgtcttattcttctaggtatgttgcagatagctctacatatcagcagccagggcct

SEQ ID NO: 407787 - DNA, 140 bp, Artificial Sequence
  Synthetic
aggccctggctgctgatatggacacagcagtctcaagggactgagactggggtgggagagcctcaaatatctgtggaatcttctgttgtattggggtcaggaactgaaacttagtgctatgaccttttgggacagcggtg

SEQ ID NO: 407788 - DNA, 140 bp, Artificial Sequence
  Synthetic
caccgctgtcccaaaaggtcatagcactaagtttcagttcctgaccccaatacaacagaagattccacagatatttgaggctctcccaccccagtctcagtcccttgagactgctgtgtccatatcagcagccagggcct

SEQ ID NO: 407789 - DNA, 140 bp, Artificial Sequence
  Synthetic
atacgccatgctgggtctcctgacggtacaggccagacaattattgtctggcatagtgcaacagcaaagcaatttgctgagggctatagaggctcaacagcatatgttgaaactcacggtcgtacttgggagtcggccat

SEQ ID NO: 407790 - DNA, 140 bp, Artificial Sequence
  Synthetic
atggccgactcccaagtacgaccgtgagtttcaacatatgctgttgagcctctatagccctcagcaaattgctttgctgttgcactatgccagacaataattgtctggcctgtaccgtcaggagacccagcatggcgtat

SEQ ID NO: 407791 - DNA, 140 bp, Artificial Sequence
  Synthetic
aggccctggctgctgatatgagaatcagacagggcttagaaaggcttttgctataaaatgggtggcaaatggtcaaaaaataaaatagttggatggcctaagttaagggaaagaatgcaagaccttttgggacagcggtg

SEQ ID NO: 407792 - DNA, 140 bp, Artificial Sequence
  Synthetic
caccgctgtcccaaaaggtcttgcattctttcccttaacttaggccatccaactattttattttttgaccatttgccacccattttatagcaaaagcctttctaagccctgtctgattctcatatcagcagccagggcct

SEQ ID NO: 407793 - DNA, 140 bp, Artificial Sequence
  Synthetic
aggccctggctgctgatatgggagaaaattagtagatttcagggaactcaataaaagaactcaagacttttgggaagttcaattaggaataccacatccagcagggttaaaaaagaaaaagaccttttgggacagcggtg

SEQ ID NO: 407794 - DNA, 140 bp, Artificial Sequence
  Synthetic
caccgctgtcccaaaaggtctttttcttttttaaccctgctggatgtggtattcctaattgaacttcccaaaagtcttgagttcttttattgagttccctgaaatctactaattttctcccatatcagcagccagggcct

SEQ ID NO: 407795 - DNA, 140 bp, Artificial Sequence
  Synthetic
atacgccatgctgggtctccaaaacacggggcagtcacaagtagcaatacaacagctactaatgctgactgtgcctggctggaagcacaagaagaagatggggatgtaggttttccagtccgtacttgggagtcggccat

SEQ ID NO: 407796 - DNA, 140 bp, Artificial Sequence
  Synthetic
atggccgactcccaagtacggactggaaaacctacatccccatcttcttcttgtgcttccagccaggcacagtcagcattagtagctgttgtattgctacttgtgactgccccgtgttttggagacccagcatggcgtat

SEQ ID NO: 407797 - DNA, 140 bp, Artificial Sequence
  Synthetic
aggccctggctgctgatatgtagtagcaaaagaaatagtagccagctgtgataaatgtcagctaaaaggggaagccatgcatggacaagtagactgtagtccaggaatatggcaactagagaccttttgggacagcggtg

SEQ ID NO: 407798 - DNA, 140 bp, Artificial Sequence
  Synthetic
caccgctgtcccaaaaggtctctagttgccatattcctggactacagtctacttgtccatgcatggcttccccttttagctgacatttatcacagctggctactatttcttttgctactacatatcagcagccagggcct

SEQ ID NO: 407799 - DNA, 140 bp, Artificial Sequence
  Synthetic
aggccctggctgctgatatgtacagacaatggcagcaatttcaccagtgctacagttaaggccgcctgttggtgggcagggatcaagcaggaatttggcattccctacaatccccaaagtgaccttttgggacagcggtg

SEQ ID NO: 407800 - DNA, 140 bp, Artificial Sequence
  Synthetic
caccgctgtcccaaaaggtcactttggggattgtagggaatgccaaattcctgcttgatccctgcccaccaacaggcggccttaactgtagcactggtgaaattgctgccattgtctgtacatatcagcagccagggcct

SEQ ID NO: 407801 - DNA, 140 bp, Artificial Sequence
  Synthetic
atacgccatgctgggtctccatgtaaaagacaccaaggaagctttagataaaatagaggaagcacagaataagagcaagcaaaagaaacagcaggcaacagctgacacaggaaacagcagcgtacttgggagtcggccat

SEQ ID NO: 407802 - DNA, 140 bp, Artificial Sequence
  Synthetic
atggccgactcccaagtacgctgctgtttcctgtgtcagctgttgcctgctgtttcttttgcttgctcttattctgtgcttcctctattttatctaaagcttccttggtgtcttttacatggagacccagcatggcgtat

SEQ ID NO: 407803 - DNA, 140 bp, Artificial Sequence
  Synthetic
atacgccatgctgggtctccgatggggtgggctttccagtcaggccacaagtaccattgaggcctatgacttacaagggagctatagatctaagccactttttaagagaaaaggggggaccgtacttgggagtcggccat

SEQ ID NO: 407804 - DNA, 140 bp, Artificial Sequence
  Synthetic
atggccgactcccaagtacggtccccccttttctcttaaaaagtggcttagatctatagctcccttgtaagtcataggcctcaatggtacttgtggcctgactggaaagcccaccccatcggagacccagcatggcgtat

SEQ ID NO: 407805 - DNA, 140 bp, Artificial Sequence
  Synthetic
aggccctggctgctgatatgagctatgcaaatgttaaaagataccatcaatgaggaagctgcagaatgggacaggttacatccagtacaggcagggcctattccaccaggccagataagagaccttttgggacagcggtg

SEQ ID NO: 407806 - DNA, 140 bp, Artificial Sequence
  Synthetic
caccgctgtcccaaaaggtctcttatctggcctggtggaataggccctgcctgtactggatgtaacctgtcccattctgcagcttcctcattgatggtatcttttaacatttgcatagctcatatcagcagccagggcct

SEQ ID NO: 407807 - DNA, 140 bp, Artificial Sequence
  Synthetic
atacgccatgctgggtctcctggggagatggagatcactttatgtaacaggagacataataggagatataagacaagcacattgtaaccttagcaaaaaagattgggaaaccactttaaacgtacttgggagtcggccat

SEQ ID NO: 407808 - DNA, 140 bp, Artificial Sequence
  Synthetic
atggccgactcccaagtacgtttaaagtggtttcccaatcttttttgctaaggttacaatgtgcttgtcttatatctcctattatgtctcctgttacataaagtgatctccatctccccaggagacccagcatggcgtat

SEQ ID NO: 407809 - DNA, 140 bp, Artificial Sequence
  Synthetic
aggccctggctgctgatatgaccactctattttgtgcatcagatgctaaagcatatgatacagaggtacataatgtttgggccacacatgcctgtgtacccacagaccccaacccacaaggaccttttgggacagcggtg

SEQ ID NO: 407810 - DNA, 140 bp, Artificial Sequence
  Synthetic
caccgctgtcccaaaaggtccttgtgggttggggtctgtgggtacacaggcatgtgtggcccaaacattatgtacctctgtatcatatgctttagcatctgatgcacaaaatagagtggtcatatcagcagccagggcct

SEQ ID NO: 407811 - DNA, 140 bp, Artificial Sequence
  Synthetic
aggccctggctgctgatatgtggaaaatgatggagaaaggagaaataaaaaactgctctttcaatatcacagcaggcataagagataaagttcagaaagcatttgcatttttttataagcgaccttttgggacagcggtg

SEQ ID NO: 407812 - DNA, 140 bp, Artificial Sequence
  Synthetic
caccgctgtcccaaaaggtcgcttataaaaaaatgcaaatgctttctgaactttatctcttatgcctgctgtgatattgaaagagcagttttttatttctcctttctccatcattttccacatatcagcagccagggcct

SEQ ID NO: 407813 - DNA, 140 bp, Artificial Sequence
  Synthetic
aggccctggctgctgatatggctctggaaaactcatctgccccactgctgtgccttggaatgctagttggagtaataaatcttacaatgatatttgggacaacatgacctggatgcagtggaccttttgggacagcggtg

SEQ ID NO: 407814 - DNA, 140 bp, Artificial Sequence
  Synthetic
caccgctgtcccaaaaggtccactgcatccaggtcatgttgtcccaaatatcattgtaagatttattactccaactagcattccaaggcacagcagtggggcagatgagttttccagagccatatcagcagccagggcct

SEQ ID NO: 407815 - DNA, 140 bp, Artificial Sequence
  Synthetic
aggccctggctgctgatatgtgtgggtcacagtttattatggggtacctgtgtggaaagaagcaaccaccactctattttgtgcatcagatgctaaagcatatgacacagaggtacataagaccttttgggacagcggtg

SEQ ID NO: 407816 - DNA, 140 bp, Artificial Sequence
  Synthetic
caccgctgtcccaaaaggtcttatgtacctctgtgtcatatgctttagcatctgatgcacaaaatagagtggtggttgcttctttccacacaggtaccccataataaactgtgacccacacatatcagcagccagggcct

SEQ ID NO: 407817 - DNA, 140 bp, Artificial Sequence
  Synthetic
atacgccatgctgggtctccaagcgcaaaaccagcaagaaaagaatgagcaagacttattgcaattggattcatgggcaagtttatggagctggtttagcttatcaaaatggctgtggtacgtacttgggagtcggccat

SEQ ID NO: 407818 - DNA, 140 bp, Artificial Sequence
  Synthetic
atggccgactcccaagtacgtaccacagccattttgataagctaaaccagctccataaacttgcccatgaatccaattgcaataagtcttgctcattcttttcttgctggttttgcgcttggagacccagcatggcgtat

SEQ ID NO: 407819 - DNA, 140 bp, Artificial Sequence
  Synthetic
aggccctggctgctgatatgacctctgcctagtgttaagaaattaacagaagatagatggaacaagccccagaagatcaggggccacagagagaaccctacaatgaatggacattagaacgaccttttgggacagcggtg

SEQ ID NO: 407820 - DNA, 140 bp, Artificial Sequence
  Synthetic
caccgctgtcccaaaaggtcgttctaatgtccattcattgtagggttctctctgtggcccctgatcttctggggcttgttccatctatcttctgttaatttcttaacactaggcagaggtcatatcagcagccagggcct

SEQ ID NO: 407821 - DNA, 140 bp, Artificial Sequence
  Synthetic
aggccctggctgctgatatgtcagaattgggtgtcaacatagcagaataggcattatgccagggagaagaggcaggaatggagccggtagatcctaacctagagccctggaatcatccgggaccttttgggacagcggtg

SEQ ID NO: 407822 - DNA, 140 bp, Artificial Sequence
  Synthetic
caccgctgtcccaaaaggtcccggatgattccagggctctaggttaggatctaccggctccattcctgcctcttctccctggcataatgcctattctgctatgttgacacccaattctgacatatcagcagccagggcct

SEQ ID NO: 407823 - DNA, 140 bp, Artificial Sequence
  Synthetic
aggccctggctgctgatatggacagggcttagagagggctttgctataaaatgggtggcaagtggtcaaaatgtagtatgggtggatggactgcagtaagggaaagaatgagaaaaactcgaccttttgggacagcggtg

SEQ ID NO: 407824 - DNA, 140 bp, Artificial Sequence
  Synthetic
caccgctgtcccaaaaggtcgagtttttctcattctttcccttactgcagtccatccacccatactacattttgaccacttgccacccattttatagcaaagccctctctaagccctgtccatatcagcagccagggcct

SEQ ID NO: 407825 - DNA, 140 bp, Artificial Sequence
  Synthetic
atacgccatgctgggtctcctggagagtatagagaaataaaaaattgctctttcaatatgaccacagaaataagagataagaaacaaaaagtgtctgcacttttttataaaactgatgtacgtacttgggagtcggccat

SEQ ID NO: 407826 - DNA, 140 bp, Artificial Sequence
  Synthetic
atggccgactcccaagtacgtacatcagttttataaaaaagtgcagacactttttgtttcttatctcttatttctgtggtcatattgaaagagcaattttttatttctctatactctccaggagacccagcatggcgtat

SEQ ID NO: 407827 - DNA, 140 bp, Artificial Sequence
  Synthetic
aggccctggctgctgatatgaatgtctgggccacacatgcctgtgtacccacagaccccaacccacaagaaatacacctggaaaatgtaacagaaaattttaacatgtggaaaaataacagaccttttgggacagcggtg

SEQ ID NO: 407828 - DNA, 140 bp, Artificial Sequence
  Synthetic
caccgctgtcccaaaaggtctgttatttttccacatgttaaaattttctgttacattttccaggtgtatttcttgtgggttggggtctgtgggtacacaggcatgtgtggcccagacattcatatcagcagccagggcct

SEQ ID NO: 407829 - DNA, 140 bp, Artificial Sequence
  Synthetic
aggccctggctgctgatatgaatgggaaaaaattcggttaaggccaggaggaaagaaaaaatataaattaaaacatatagtatgggcaagcagggagctagaacgattcgcagtcaacccgaccttttgggacagcggtg

SEQ ID NO: 407830 - DNA, 140 bp, Artificial Sequence
  Synthetic
caccgctgtcccaaaaggtcgggttgactgcgaatcgttctagctccctgcttgcccatactatatgttttaatttatattttttctttcctcctggccttaaccgaattttttcccattcatatcagcagccagggcct

SEQ ID NO: 407831 - DNA, 140 bp, Artificial Sequence
  Synthetic
aggccctggctgctgatatgtagaatataggaaaatattaagacagagaaaaatagacaggttaattgatagaataagagaaagagcagaagacagtggcaatgagagtgacggggatcagaccttttgggacagcggtg

SEQ ID NO: 407832 - DNA, 140 bp, Artificial Sequence
  Synthetic
caccgctgtcccaaaaggtctgatccccgtcactctcattgccactgtcttctgctctttctcttattctatcaattaacctgtctatttttctctgtcttaatattttcctatattctacatatcagcagccagggcct

SEQ ID NO: 407833 - DNA, 140 bp, Artificial Sequence
  Synthetic
aggccctggctgctgatatgtggtttgacataacaaattggctgtggtatataaaaatatttataatgatagtaggaggtttaataggtttaagaataatttttgctgtgctttctataggaccttttgggacagcggtg

SEQ ID NO: 407834 - DNA, 140 bp, Artificial Sequence
  Synthetic
caccgctgtcccaaaaggtcctatagaaagcacagcaaaaattattcttaaacctattaaacctcctactatcattataaatatttttatataccacagccaatttgttatgtcaaaccacatatcagcagccagggcct

SEQ ID NO: 407835 - DNA, 140 bp, Artificial Sequence
  Synthetic
atacgccatgctgggtctccctaagggtaccaataatagtagtgttcccatggaagaagaaatgaaaaattgctctttcaatataaccacagagctaagagataaaaaacagcaaggaagcgtacttgggagtcggccat

SEQ ID NO: 407836 - DNA, 140 bp, Artificial Sequence
  Synthetic
atggccgactcccaagtacgcttccttgctgttttttatctcttagctctgtggttatattgaaagagcaatttttcatttcttcttccatgggaacactactattattggtacccttagggagacccagcatggcgtat

SEQ ID NO: 407837 - DNA, 140 bp, Artificial Sequence
  Synthetic
aggccctggctgctgatatgaccttctgcagtattggagccaggaactaaagaatagtgctattagcttgtacaatactatagctattgcagtagctgaagggacagatagggttatagagaccttttgggacagcggtg

SEQ ID NO: 407838 - DNA, 140 bp, Artificial Sequence
  Synthetic
caccgctgtcccaaaaggtctctataaccctatctgtcccttcagctactgcaatagctatagtattgtacaagctaatagcactattctttagttcctggctccaatactgcagaaggtcatatcagcagccagggcct

SEQ ID NO: 407839 - DNA, 140 bp, Artificial Sequence
  Synthetic
aggccctggctgctgatatgaggataggaccaggacaaacattctatgcaacaggagaaatagtaggagacataagacaagcacattgtaacattagtgaaaaggactggcataaaacttgaccttttgggacagcggtg

SEQ ID NO: 407840 - DNA, 140 bp, Artificial Sequence
  Synthetic
caccgctgtcccaaaaggtcaagttttatgccagtccttttcactaatgttacaatgtgcttgtcttatgtctcctactatttctcctgttgcatagaatgtttgtcctggtcctatcctcatatcagcagccagggcct

SEQ ID NO: 407841 - DNA, 140 bp, Artificial Sequence
  Synthetic
aggccctggctgctgatatgtttaaaccatcctcaggaggggacatagaaattacaacacatagctttaattgtggaggagaatttttctattgtaatacatcaagattgtttaatgagagaccttttgggacagcggtg

SEQ ID NO: 407842 - DNA, 140 bp, Artificial Sequence
  Synthetic
caccgctgtcccaaaaggtctctcattaaacaatcttgatgtattacaatagaaaaattctcctccacaattaaagctatgtgttgtaatttctatgtcccctcctgaggatggtttaaacatatcagcagccagggcct

SEQ ID NO: 407843 - DNA, 140 bp, Artificial Sequence
  Synthetic
  misc_feature (52)..(52): n is a, c, g, or t
atacgccatgctgggtctccctttgaattgcaccaatatctatacacttctngctcaagagataataagtaatgaggaaataagaaactgctctttcactatgaccacagcactaagagacgtacttgggagtcggccat

SEQ ID NO: 407844 - DNA, 140 bp, Artificial Sequence
  Synthetic
  misc_feature (89)..(89): n is a, c, g, or t
atggccgactcccaagtacgtctcttagtgctgtggtcatagtgaaagagcagtttcttatttcctcattacttattatctcttgagcnagaagtgtatagatattggtgcaattcaaagggagacccagcatggcgtat

SEQ ID NO: 407845 - DNA, 140 bp, Artificial Sequence
  Synthetic
aggccctggctgctgatatgatcattatttaatacagtagcaaccctctggtgcgtacaccaaaggatagatgtaaaagacaccaaggaagctttagataaaatagaggaagtacaaaatgaccttttgggacagcggtg

SEQ ID NO: 407846 - DNA, 140 bp, Artificial Sequence
  Synthetic
caccgctgtcccaaaaggtcattttgtacttcctctattttatctaaagcttccttggtgtcttttacatctatcctttggtgtacgcaccagagggttgctactgtattaaataatgatcatatcagcagccagggcct

SEQ ID NO: 407847 - DNA, 140 bp, Artificial Sequence
  Synthetic
aggccctggctgctgatatgtgatcttggggattataataatctgtagtgctgcagacaacttgtgggttactgtttactatggggtacctgtgtggaaagatgcagagaccaccttattgaccttttgggacagcggtg

SEQ ID NO: 407848 - DNA, 140 bp, Artificial Sequence
  Synthetic
caccgctgtcccaaaaggtcaataaggtggtctctgcatctttccacacaggtaccccatagtaaacagtaacccacaagttgtctgcagcactacagattattataatccccaagatcacatatcagcagccagggcct

SEQ ID NO: 407849 - DNA, 140 bp, Artificial Sequence
  Synthetic
aggccctggctgctgatatggaacagggaaatgcaggaatgtcagcacagtacaatgcacacatggaatcaacccagtagtgtcaactcaactgctgttaaatggcagtctagcagaagagaccttttgggacagcggtg

SEQ ID NO: 407850 - DNA, 140 bp, Artificial Sequence
  Synthetic
caccgctgtcccaaaaggtctcttctgctagactgccatttaacagcagttgagttgacactactgggttgattccatgtgtgcattgtactgtgctgacattcctgcatttccctgttccatatcagcagccagggcct

SEQ ID NO: 407851 - DNA, 140 bp, Artificial Sequence
  Synthetic
aggccctggctgctgatatggaagccttagacaagatagaggaagaacaaaacaaaagtcagcaaaaaacacagcaggcaaaagcggctgacggaaaggtcagtcaaaattatcctataggaccttttgggacagcggtg

SEQ ID NO: 407852 - DNA, 140 bp, Artificial Sequence
  Synthetic
caccgctgtcccaaaaggtcctataggataattttgactgacctttccgtcagccgcttttgcctgctgtgttttttgctgacttttgttttgttcttcctctatcttgtctaaggcttccatatcagcagccagggcct

SEQ ID NO: 407853 - DNA, 140 bp, Artificial Sequence
  Synthetic
atacgccatgctgggtctccaccagtaatactgtcaatagcacaggtggtaggaaagtggaccaggaagaaatgaaaaacttaaaaaactgctctttcaatataactacagagctaagggcgtacttgggagtcggccat

SEQ ID NO: 407854 - DNA, 140 bp, Artificial Sequence
  Synthetic
atggccgactcccaagtacgcccttagctctgtagttatattgaaagagcagttttttaagtttttcatttcttcctggtccactttcctaccacctgtgctattgacagtattactggtggagacccagcatggcgtat

SEQ ID NO: 407855 - DNA, 140 bp, Artificial Sequence
  Synthetic
atacgccatgctgggtctcctttgggaacaaaacaataatttttactaactcctcaggaggagatgtagaaattacaacacatagttttaattgtgcaggagaattcttctattgcaatacgtacttgggagtcggccat

SEQ ID NO: 407856 - DNA, 140 bp, Artificial Sequence
  Synthetic
atggccgactcccaagtacgtattgcaatagaagaattctcctgcacaattaaaactatgtgttgtaatttctacatctcctcctgaggagttagtaaaaattattgttttgttcccaaaggagacccagcatggcgtat

SEQ ID NO: 407857 - DNA, 140 bp, Artificial Sequence
  Synthetic
atacgccatgctgggtctccggaattttcctcagagcagaccagagccaacagccccaccagcagaaaactgggggatgggggaagagataacctccttaccgaagcaggagcagaaagacgtacttgggagtcggccat

SEQ ID NO: 407858 - DNA, 140 bp, Artificial Sequence
  Synthetic
atggccgactcccaagtacgtctttctgctcctgcttcggtaaggaggttatctcttcccccatcccccagttttctgctggtggggctgttggctctggtctgctctgaggaaaattccggagacccagcatggcgtat

SEQ ID NO: 407859 - DNA, 140 bp, Artificial Sequence
  Synthetic
atacgccatgctgggtctcccagacctaataacaatacaaggacaagtgtacgtataggaccaggacaaacattctttacaaatgatataataggggatataagacaggcatattgtgtgcgtacttgggagtcggccat

SEQ ID NO: 407860 - DNA, 140 bp, Artificial Sequence
  Synthetic
atggccgactcccaagtacgcacacaatatgcctgtcttatatcccctattatatcatttgtaaagaatgtttgtcctggtcctatacgtacacttgtccttgtattgttattaggtctgggagacccagcatggcgtat

SEQ ID NO: 407861 - DNA, 140 bp, Artificial Sequence
  Synthetic
aggccctggctgctgatatgcattctttacaaatgatataataggggatataagacaggcatattgtgtggtcaatagaacacaatggaatgaaacattatacaatgtatctgtgcaattgaccttttgggacagcggtg

SEQ ID NO: 407862 - DNA, 140 bp, Artificial Sequence
  Synthetic
caccgctgtcccaaaaggtcaattgcacagatacattgtataatgtttcattccattgtgttctattgaccacacaatatgcctgtcttatatcccctattatatcatttgtaaagaatgcatatcagcagccagggcct

SEQ ID NO: 407863 - DNA, 140 bp, Artificial Sequence
  Synthetic
aggccctggctgctgatatggagatctagagatcacaacacatagttttaattgtagaggagaatttttctattgtaatacatcaagactgtttaatagcacttggttccctaacggcacgaccttttgggacagcggtg

SEQ ID NO: 407864 - DNA, 140 bp, Artificial Sequence
  Synthetic
caccgctgtcccaaaaggtcgtgccgttagggaaccaagtgctattaaacagtcttgatgtattacaatagaaaaattctcctctacaattaaaactatgtgttgtgatctctagatctccatatcagcagccagggcct

SEQ ID NO: 407865 - DNA, 140 bp, Artificial Sequence
  Synthetic
atacgccatgctgggtctcctatgggataacatgacctggctagaatgggatagagaaattagcaattacacagacataatatatagattaattgaagactcacaaaaccagcaggaaaacgtacttgggagtcggccat

SEQ ID NO: 407866 - DNA, 140 bp, Artificial Sequence
  Synthetic
atggccgactcccaagtacgttttcctgctggttttgtgagtcttcaattaatctatatattatgtctgtgtaattgctaatttctctatcccattctagccaggtcatgttatcccataggagacccagcatggcgtat

SEQ ID NO: 407867 - DNA, 140 bp, Artificial Sequence
  Synthetic
atacgccatgctgggtctcctaatacaaagaacttgcagagctattatccacatacctagaagaatcagacaaggcttagaaaggcttttgctctaaaatgggtggcaaattgtcaaaaacgtacttgggagtcggccat

SEQ ID NO: 407868 - DNA, 140 bp, Artificial Sequence
  Synthetic
atggccgactcccaagtacgtttttgacaatttgccacccattttagagcaaaagcctttctaagccttgtctgattcttctaggtatgtggataatagctctgcaagttctttgtattaggagacccagcatggcgtat

SEQ ID NO: 407869 - DNA, 140 bp, Artificial Sequence
  Synthetic
atacgccatgctgggtctccccagcagctgagccagcagcagaaggggtaggagcagcatctcaagacctggaaaaatatggggcaatcacaagtagcaatacaaaacatactaatgctgcgtacttgggagtcggccat

SEQ ID NO: 407870 - DNA, 140 bp, Artificial Sequence
  Synthetic
atggccgactcccaagtacgcagcattagtatgttttgtattgctacttgtgattgccccatatttttccaggtcttgagatgctgctcctaccccttctgctgctggctcagctgctggggagacccagcatggcgtat

SEQ ID NO: 407871 - DNA, 140 bp, Artificial Sequence
  Synthetic
atacgccatgctgggtctccgtggcgcccgaacagggacttgaaagtgaaagttaatagggactcgaaagcggaagttcccagaggagatctctcgacgcaggactcggcttgctgcagccgtacttgggagtcggccat

SEQ ID NO: 407872 - DNA, 140 bp, Artificial Sequence
  Synthetic
atggccgactcccaagtacggctgcagcaagccgagtcctgcgtcgagagatctcctctgggaacttccgctttcgagtccctattaactttcactttcaagtccctgttcgggcgccacggagacccagcatggcgtat

SEQ ID NO: 407873 - DNA, 140 bp, Artificial Sequence
  Synthetic
  misc_feature (118)..(118): n is a, c, g, or t
atacgccatgctgggtctccaacaatatggggacaaaacaatattctttaaaaactcctcaggaggggaccaagaggttacaatgcacagttttaattgtggaggggaatttttctantgcgtacttgggagtcggccat

SEQ ID NO: 407874 - DNA, 140 bp, Artificial Sequence
  Synthetic
  misc_feature (23)..(23): n is a, c, g, or t
atggccgactcccaagtacgcantagaaaaattcccctccacaattaaaactgtgcattgtaacctcttggtcccctcctgaggagtttttaaagaatattgttttgtccccatattgttggagacccagcatggcgtat

SEQ ID NO: 407875 - DNA, 140 bp, Artificial Sequence
  Synthetic
atacgccatgctgggtctccgagattagggaaagaatgagacgtgctcctccagcagcaccagcagcagaaccaggagcagcagcaccaggagtaggggcagtatctcaagatttagctacgtacttgggagtcggccat

SEQ ID NO: 407876 - DNA, 140 bp, Artificial Sequence
  Synthetic
atggccgactcccaagtacgtagctaaatcttgagatactgcccctactcctggtgctgctgctcctggttctgctgctggtgctgctggaggagcacgtctcattctttccctaatctcggagacccagcatggcgtat

SEQ ID NO: 407877 - DNA, 140 bp, Artificial Sequence
  Synthetic
atacgccatgctgggtctccatcactctataatacaatagcagtcctctattgcgtacatcaaaaaatagatgtaaaggacaccaaggaagctctagataaaatagaggaaatgcaaaatcgtacttgggagtcggccat

SEQ ID NO: 407878 - DNA, 140 bp, Artificial Sequence
  Synthetic
atggccgactcccaagtacgattttgcatttcctctattttatctagagcttccttggtgtcctttacatctattttttgatgtacgcaatagaggactgctattgtattatagagtgatggagacccagcatggcgtat

SEQ ID NO: 407879 - DNA, 140 bp, Artificial Sequence
  Synthetic
aggccctggctgctgatatgacacatgggaaacatggtggacagagtattggcaagccacctggattcctgaatgggaatttgtcaatacccctcccttagtaaaattatggtaccagttgaccttttgggacagcggtg

SEQ ID NO: 407880 - DNA, 140 bp, Artificial Sequence
  Synthetic
caccgctgtcccaaaaggtcaactggtaccataattttactaagggaggggtattgacaaattcccattcaggaatccaggtggcttgccaatactctgtccaccatgtttcccatgtgtcatatcagcagccagggcct

SEQ ID NO: 407881 - DNA, 140 bp, Artificial Sequence
  Synthetic
atacgccatgctgggtctccctaataataataatactgccagtaatagttctgattgggaaaagatggagggagaaataaaaaactgctctttcaatgtcaccccaagcataagagatagcgtacttgggagtcggccat

SEQ ID NO: 407882 - DNA, 140 bp, Artificial Sequence
  Synthetic
atggccgactcccaagtacgctatctcttatgcttggggtgacattgaaagagcagttttttatttctccctccatcttttcccaatcagaactattactggcagtattattattattagggagacccagcatggcgtat

SEQ ID NO: 407883 - DNA, 140 bp, Artificial Sequence
  Synthetic
aggccctggctgctgatatgggctaattttttagggaaaatatggccttcccacaaggggaggccgggaaacttccctcagggcagactagagccgacagccccaccagcagagagcttcgaccttttgggacagcggtg

SEQ ID NO: 407884 - DNA, 140 bp, Artificial Sequence
  Synthetic
caccgctgtcccaaaaggtcgaagctctctgctggtggggctgtcggctctagtctgccctgagggaagtttcccggcctccccttgtgggaaggccatattttccctaaaaaattagcccatatcagcagccagggcct

SEQ ID NO: 407885 - DNA, 140 bp, Artificial Sequence
  Synthetic
aggccctggctgctgatatgtagtgcaatagtaggactgatagtagcgctaatcttagcaatagtagtgtggactatagtagctatagaatataagaaaatactaaggcaaagaaaaatagaccttttgggacagcggtg

SEQ ID NO: 407886 - DNA, 140 bp, Artificial Sequence
  Synthetic
caccgctgtcccaaaaggtctatttttctttgccttagtattttcttatattctatagctactatagtccacactactattgctaagattagcgctactatcagtcctactattgcactacatatcagcagccagggcct

SEQ ID NO: 407887 - DNA, 140 bp, Artificial Sequence
  Synthetic
aggccctggctgctgatatgtcactcctcaggaggggacccagaaattgtaatgcacagttttaattgtggaggggaatttttctactgtaattcaacacaactgtttaatagtacttgggaccttttgggacagcggtg

SEQ ID NO: 407888 - DNA, 140 bp, Artificial Sequence
  Synthetic
caccgctgtcccaaaaggtcccaagtactattaaacagttgtgttgaattacagtagaaaaattcccctccacaattaaaactgtgcattacaatttctgggtcccctcctgaggagtgacatatcagcagccagggcct

SEQ ID NO: 407889 - DNA, 140 bp, Artificial Sequence
  Synthetic
aggccctggctgctgatatgaacaataatacaagaaaaagtataaatataggaccaggggcagcgatgtatgcaacaggagccataataggagatataagacaagcacattgtaacattagaccttttgggacagcggtg

SEQ ID NO: 407890 - DNA, 140 bp, Artificial Sequence
  Synthetic
caccgctgtcccaaaaggtctaatgttacaatgtgcttgtcttatatctcctattatggctcctgttgcatacatcgctgcccctggtcctatatttatactttttcttgtattattgttcatatcagcagccagggcct

SEQ ID NO: 407891 - DNA, 140 bp, Artificial Sequence
  Synthetic
atacgccatgctgggtctccaaatatcacactcccatgcagaataaaacaaattataaacatgtggcaggaagtaggaaaagcaatgtatgcccctcccatcaaaggacaaattagctgtcgtacttgggagtcggccat

SEQ ID NO: 407892 - DNA, 140 bp, Artificial Sequence
  Synthetic
atggccgactcccaagtacgacagctaatttgtcctttgatgggaggggcatacattgcttttcctacttcctgccacatgtttataatttgttttattctgcatgggagtgtgatatttggagacccagcatggcgtat

SEQ ID NO: 407893 - DNA, 140 bp, Artificial Sequence
  Synthetic
aggccctggctgctgatatgagatgcaggaggatgtaatcagtttatgggatcaaagtctaaagccatgtgtaaagttaactcctctctgcgttactttaaattgtaccaatgctaatttgaccttttgggacagcggtg

SEQ ID NO: 407894 - DNA, 140 bp, Artificial Sequence
  Synthetic
caccgctgtcccaaaaggtcaaattagcattggtacaatttaaagtaacgcagagaggagttaactttacacatggctttagactttgatcccataaactgattacatcctcctgcatctcatatcagcagccagggcct

SEQ ID NO: 407895 - DNA, 140 bp, Artificial Sequence
  Synthetic
aggccctggctgctgatatggaagaagagataataatcagatctgaaaatctcacagacaatgccaaaaccataatagtgcaccttaataaatctgtagaaatcaattgtaccagaccctgaccttttgggacagcggtg

SEQ ID NO: 407896 - DNA, 140 bp, Artificial Sequence
  Synthetic
caccgctgtcccaaaaggtcagggtctggtacaattgatttctacagatttattaaggtgcactattatggttttggcattgtctgtgagattttcagatctgattattatctcttcttccatatcagcagccagggcct

SEQ ID NO: 407897 - DNA, 140 bp, Artificial Sequence
  Synthetic
aggccctggctgctgatatgtggaaagatacctaaaggatcaacagctcctagggatttggggttgctctggaaaactcatctgcaccactaatgtgccttggaatgctagttggagtaagaccttttgggacagcggtg

SEQ ID NO: 407898 - DNA, 140 bp, Artificial Sequence
  Synthetic
caccgctgtcccaaaaggtcttactccaactagcattccaaggcacattagtggtgcagatgagttttccagagcaaccccaaatccctaggagctgttgatcctttaggtatctttccacatatcagcagccagggcct

SEQ ID NO: 407899 - DNA, 140 bp, Artificial Sequence
  Synthetic
aggccctggctgctgatatggaccatagtatatatagaatataggaaattgttaagacaaaaaaggatagactggttaattaaaagaattagggaaagagcagaagacagtggcaatgaggaccttttgggacagcggtg

SEQ ID NO: 407900 - DNA, 140 bp, Artificial Sequence
  Synthetic
caccgctgtcccaaaaggtcctcattgccactgtcttctgctctttccctaattcttttaattaaccagtctatccttttttgtcttaacaatttcctatattctatatatactatggtccatatcagcagccagggcct

SEQ ID NO: 407901 - DNA, 140 bp, Artificial Sequence
  Synthetic
aggccctggctgctgatatggggttatagaagtagtacaaagagcttatagagctattctacacatacctagaagaataagacagggcttggaaaggcttttgctataagatgggtggcagaccttttgggacagcggtg

SEQ ID NO: 407902 - DNA, 140 bp, Artificial Sequence
  Synthetic
caccgctgtcccaaaaggtctgccacccatcttatagcaaaagcctttccaagccctgtcttattcttctaggtatgtgtagaatagctctataagctctttgtactacttctataaccccatatcagcagccagggcct

SEQ ID NO: 407903 - DNA, 140 bp, Artificial Sequence
  Synthetic
atacgccatgctgggtctccatgttaatgttagcaatagtaatgatacctacaatgggccctaccaggaagtaaaaaattgctctttcaatatgaccacagaactaagagataagaagcacgtacttgggagtcggccat

SEQ ID NO: 407904 - DNA, 140 bp, Artificial Sequence
  Synthetic
atggccgactcccaagtacgtgcttcttatctcttagttctgtggtcatattgaaagagcaattttttacttcctggtagggcccattgtaggtatcattactattgctaacattaacatggagacccagcatggcgtat

SEQ ID NO: 407905 - DNA, 140 bp, Artificial Sequence
  Synthetic
atacgccatgctgggtctcctgcaaagagcctttagggctattctccacatccctacaagaataagacaaggcttggaaagggctttactataagatgggtggcaagtggtcaaaacgcgcgtacttgggagtcggccat

SEQ ID NO: 407906 - DNA, 140 bp, Artificial Sequence
  Synthetic
atggccgactcccaagtacgcgcgttttgaccacttgccacccatcttatagtaaagccctttccaagccttgtcttattcttgtagggatgtggagaatagccctaaaggctctttgcaggagacccagcatggcgtat

SEQ ID NO: 407907 - DNA, 140 bp, Artificial Sequence
  Synthetic
atacgccatgctgggtctccaatatatgggatacttacagaatcgcagaaccagcaggacaggaatgaaaaagagttgttagaattggataaatgggcaagtctgtggaattggtttgaccgtacttgggagtcggccat

SEQ ID NO: 407908 - DNA, 140 bp, Artificial Sequence
  Synthetic
atggccgactcccaagtacggtcaaaccaattccacagacttgcccatttatccaattctaacaactctttttcattcctgtcctgctggttctgcgattctgtaagtatcccatatattggagacccagcatggcgtat

SEQ ID NO: 407909 - DNA, 140 bp, Artificial Sequence
  Synthetic
atacgccatgctgggtctccagtaatatcaactcaattacttttgaatggcagtttagcagaaagagaaataatgattagatctaaaaatatcacagacaataccaaaatcataatagtgcgtacttgggagtcggccat

SEQ ID NO: 407910 - DNA, 140 bp, Artificial Sequence
  Synthetic
atggccgactcccaagtacgcactattatgattttggtattgtctgtgatatttttagatctaatcattatttctctttctgctaaactgccattcaaaagtaattgagttgatattactggagacccagcatggcgtat

SEQ ID NO: 407911 - DNA, 140 bp, Artificial Sequence
  Synthetic
aggccctggctgctgatatgaatgaaagtgatggggatacagaggaattatcaaaacttgtggggatggggcatgatgctccttggaatgttgatgacctgtagtattgcagaacagttggaccttttgggacagcggtg

SEQ ID NO: 407912 - DNA, 140 bp, Artificial Sequence
  Synthetic
caccgctgtcccaaaaggtccaactgttctgcaatactacaggtcatcaacattccaaggagcatcatgccccatccccacaagttttgataattcctctgtatccccatcactttcattcatatcagcagccagggcct

SEQ ID NO: 407913 - DNA, 140 bp, Artificial Sequence
  Synthetic
atacgccatgctgggtctccgattctacaattggacacgccatggaataaaacacatcctaacagcaccacccttagaccaggagggggagatatgaaagatatatggagaactcaattgcgtacttgggagtcggccat

SEQ ID NO: 407914 - DNA, 140 bp, Artificial Sequence
  Synthetic
atggccgactcccaagtacgcaattgagttctccatatatctttcatatctccccctcctggtctaagggtggtgctgttaggatgtgttttattccatggcgtgtccaattgtagaatcggagacccagcatggcgtat

SEQ ID NO: 407915 - DNA, 140 bp, Artificial Sequence
  Synthetic
atacgccatgctgggtctcccaaaacattactgagaatactgatgatgcatatggagacatgaaaaactgctctttcaatgtaaccacaatattaagagatcagagggagaaagtatctgcgtacttgggagtcggccat

SEQ ID NO: 407916 - DNA, 140 bp, Artificial Sequence
  Synthetic
atggccgactcccaagtacgcagatactttctccctctgatctcttaatattgtggttacattgaaagagcagtttttcatgtctccatatgcatcatcagtattctcagtaatgttttgggagacccagcatggcgtat

SEQ ID NO: 407917 - DNA, 140 bp, Artificial Sequence
  Synthetic
aggccctggctgctgatatgcatgcagaataaaacaaattataaacatgtggcaggaggtaggaagagcaatatatgcccctcccattgcaggaaacataacatgtatatcaaatatcacgaccttttgggacagcggtg

SEQ ID NO: 407918 - DNA, 140 bp, Artificial Sequence
  Synthetic
caccgctgtcccaaaaggtcgtgatatttgatatacatgttatgtttcctgcaatgggaggggcatatattgctcttcctacctcctgccacatgtttataatttgttttattctgcatgcatatcagcagccagggcct

SEQ ID NO: 407919 - DNA, 140 bp, Artificial Sequence
  Synthetic
aggccctggctgctgatatgtcaactgctgttaaatggcagtctatcagaagaaggcataataattagatctgaaaatctcacaagcaatcataaaacaataatagtacaatttaatgaagaccttttgggacagcggtg

SEQ ID NO: 407920 - DNA, 140 bp, Artificial Sequence
  Synthetic
caccgctgtcccaaaaggtcttcattaaattgtactattattgttttatgattgcttgtgagattttcagatctaattattatgccttcttctgatagactgccatttaacagcagttgacatatcagcagccagggcct

SEQ ID NO: 407921 - DNA, 140 bp, Artificial Sequence
  Synthetic
aggccctggctgctgatatgaatcagtttatgggatcaaagcctaaagccatgtgtaaagttgaccccactctgtgtcactttaaactgtacagaggttaatggtaccagtgatagtagtgaccttttgggacagcggtg

SEQ ID NO: 407922 - DNA, 140 bp, Artificial Sequence
  Synthetic
caccgctgtcccaaaaggtcactactatcactggtaccattaacctctgtacagtttaaagtgacacagagtggggtcaactttacacatggctttaggctttgatcccataaactgattcatatcagcagccagggcct

SEQ ID NO: 407923 - DNA, 140 bp, Artificial Sequence
  Synthetic
atacgccatgctgggtctccatctataggacaagggcaagcactcgttacaacaaaacaggtaacaggaagaaaagcacaatgtacaattgatggaggaaaatggaataaaactctaggccgtacttgggagtcggccat

SEQ ID NO: 407924 - DNA, 140 bp, Artificial Sequence
  Synthetic
atggccgactcccaagtacggcctagagttttattccattttcctccatcaattgtacattgtgcttttcttcctgttacctgttttgttgtaacgagtgcttgcccttgtcctatagatggagacccagcatggcgtat

SEQ ID NO: 407925 - DNA, 140 bp, Artificial Sequence
  Synthetic
atacgccatgctgggtctccgagaaattgctctttcaatataaccacagagctaagagataaaaacaagcaagaaagagcacgtttttatagactggatatagtacaacttaataataaccgtacttgggagtcggccat

SEQ ID NO: 407926 - DNA, 140 bp, Artificial Sequence
  Synthetic
atggccgactcccaagtacggttattattaagttgtactatatccagtctataaaaacgtgctctttcttgcttgtttttatctcttagctctgtggttatattgaaagagcaatttctcggagacccagcatggcgtat

SEQ ID NO: 407927 - DNA, 140 bp, Artificial Sequence
  Synthetic
atacgccatgctgggtctccgtggaggggaatttttctactgcaacacatcatccctgtttaatgggacatggactaataatacatggcacaatattacatggaacacaaatatgacaatcgtacttgggagtcggccat

SEQ ID NO: 407928 - DNA, 140 bp, Artificial Sequence
  Synthetic
atggccgactcccaagtacgattgtcatatttgtgttccatgtaatattgtgccatgtattattagtccatgtcccattaaacagggatgatgtgttgcagtagaaaaattcccctccacggagacccagcatggcgtat

SEQ ID NO: 407929 - DNA, 140 bp, Artificial Sequence
  Synthetic
aggccctggctgctgatatgcacctgtagtagcaaaagaaatagtagccagctgtgataaatgtcagctaaaaggagaagccatgcatggacaagtagactgtagtccaggaatatggcagaccttttgggacagcggtg

SEQ ID NO: 407930 - DNA, 140 bp, Artificial Sequence
  Synthetic
caccgctgtcccaaaaggtctgccatattcctggactacagtctacttgtccatgcatggcttctccttttagctgacatttatcacagctggctactatttcttttgctactacaggtgcatatcagcagccagggcct

SEQ ID NO: 407931 - DNA, 140 bp, Artificial Sequence
  Synthetic
aggccctggctgctgatatgacagcagtcaggtcagccaaaattaccctatagtgcagaatatccaggggcaaatggtacatcaggccatatcacctagaactttaaatgcatgggtaaagaccttttgggacagcggtg

SEQ ID NO: 407932 - DNA, 140 bp, Artificial Sequence
  Synthetic
caccgctgtcccaaaaggtctttacccatgcatttaaagttctaggtgatatggcctgatgtaccatttgcccctggatattctgcactatagggtaattttggctgacctgactgctgtcatatcagcagccagggcct

SEQ ID NO: 407933 - DNA, 140 bp, Artificial Sequence
  Synthetic
atacgccatgctgggtctcccattaattgtaccagacctaacaacaacacaagagaaagtgtacgtataggaccaggacaaacattctatacaagtaacataataggggatataagacagcgtacttgggagtcggccat

SEQ ID NO: 407934 - DNA, 140 bp, Artificial Sequence
  Synthetic
atggccgactcccaagtacgctgtcttatatcccctattatgttacttgtatagaatgtttgtcctggtcctatacgtacactttctcttgtgttgttgttaggtctggtacaattaatgggagacccagcatggcgtat

SEQ ID NO: 407935 - DNA, 140 bp, Artificial Sequence
  Synthetic
aggccctggctgctgatatgccctaataaaacaatagaatttaaaccatcctcaggaggggacctagaaattacaacacatagctttaattgtagaggagaatttttctattgtaatacagaccttttgggacagcggtg

SEQ ID NO: 407936 - DNA, 140 bp, Artificial Sequence
  Synthetic
caccgctgtcccaaaaggtctgtattacaatagaaaaattctcctctacaattaaagctatgtgttgtaatttctaggtcccctcctgaggatggtttaaattctattgttttattagggcatatcagcagccagggcct

SEQ ID NO: 407937 - DNA, 140 bp, Artificial Sequence
  Synthetic
aggccctggctgctgatatggacccacaggaggggatctagaaatcacaacacatagttttaattgtggaggagaatttttctattgtaatacatcagaactgtttaatagcacttggaagaccttttgggacagcggtg

SEQ ID NO: 407938 - DNA, 140 bp, Artificial Sequence
  Synthetic
caccgctgtcccaaaaggtcttccaagtgctattaaacagttctgatgtattacaatagaaaaattctcctccacaattaaaactatgtgttgtgatttctagatcccctcctgtgggtccatatcagcagccagggcct

SEQ ID NO: 407939 - DNA, 140 bp, Artificial Sequence
  Synthetic
atacgccatgctgggtctccataatagaacagttacagtcaactctcaagacaggatcagaagaacttaaatcattatttaatacagtagcagtcctctggtgcgtacaccaaaggatagcgtacttgggagtcggccat

SEQ ID NO: 407940 - DNA, 140 bp, Artificial Sequence
  Synthetic
atggccgactcccaagtacgctatcctttggtgtacgcaccagaggactgctactgtattaaataatgatttaagttcttctgatcctgtcttgagagttgactgtaactgttctattatggagacccagcatggcgtat

SEQ ID NO: 407941 - DNA, 140 bp, Artificial Sequence
  Synthetic
atacgccatgctgggtctccggttgctctggaaaacatatttgcaccactaatgtgccttggaactctagttggagtaatagatcactagatgatatttgggagaacatgacgtggatgccgtacttgggagtcggccat

SEQ ID NO: 407942 - DNA, 140 bp, Artificial Sequence
  Synthetic
atggccgactcccaagtacggcatccacgtcatgttctcccaaatatcatctagtgatctattactccaactagagttccaaggcacattagtggtgcaaatatgttttccagagcaaccggagacccagcatggcgtat

SEQ ID NO: 407943 - DNA, 140 bp, Artificial Sequence
  Synthetic
aggccctggctgctgatatgctctggaaaactcatctgcaccactaatgtgccctggaactctagttggagtaataaaactcaagaggagatatgggggaacatgacctggctgcaatgggaccttttgggacagcggtg

SEQ ID NO: 407944 - DNA, 140 bp, Artificial Sequence
  Synthetic
caccgctgtcccaaaaggtcccattgcagccaggtcatgttcccccatatctcctcttgagttttattactccaactagagttccagggcacattagtggtgcagatgagttttccagagcatatcagcagccagggcct

SEQ ID NO: 407945 - DNA, 140 bp, Artificial Sequence
  Synthetic
atacgccatgctgggtctcctggaatctcctgaggttttggggccaggaactaaagaagagtgctattagcttgtttgatgccacagcaatagcagtagctgagggaacagatagagtgacgtacttgggagtcggccat

SEQ ID NO: 407946 - DNA, 140 bp, Artificial Sequence
  Synthetic
atggccgactcccaagtacgtcactctatctgttccctcagctactgctattgctgtggcatcaaacaagctaatagcactcttctttagttcctggccccaaaacctcaggagattccaggagacccagcatggcgtat

SEQ ID NO: 407947 - DNA, 140 bp, Artificial Sequence
  Synthetic
aggccctggctgctgatatgacaatatacaggttgcttgaagactcgcaaaaccagcaggaaaaaaatgaaaaggatttactagcattggacagttggaacaatctgtggaattggtttggaccttttgggacagcggtg

SEQ ID NO: 407948 - DNA, 140 bp, Artificial Sequence
  Synthetic
caccgctgtcccaaaaggtccaaaccaattccacagattgttccaactgtccaatgctagtaaatccttttcatttttttcctgctggttttgcgagtcttcaagcaacctgtatattgtcatatcagcagccagggcct

SEQ ID NO: 407949 - DNA, 140 bp, Artificial Sequence
  Synthetic
atacgccatgctgggtctccataagacagggcttagagagggctttgctataaaatgggtggcaaattgacaaaaagcaagatagctggatggcctgaagtaagggaaagaataagaagacgtacttgggagtcggccat

SEQ ID NO: 407950 - DNA, 140 bp, Artificial Sequence
  Synthetic
atggccgactcccaagtacgtcttcttattctttcccttacttcaggccatccagctatcttgctttttgtcaatttgccacccattttatagcaaagccctctctaagccctgtcttatggagacccagcatggcgtat

SEQ ID NO: 407951 - DNA, 140 bp, Artificial Sequence
  Synthetic
aggccctggctgctgatatgcaaaaagcaagatagctggatggcctgaagtaagggaaagaataagaagaactgaggcagcagcagaaggggtaggagcagtatctaaagacctagaaaagaccttttgggacagcggtg

SEQ ID NO: 407952 - DNA, 140 bp, Artificial Sequence
  Synthetic
caccgctgtcccaaaaggtcttttctaggtctttagatactgctcctaccccttctgctgctgcctcagttcttcttattctttcccttacttcaggccatccagctatcttgctttttgcatatcagcagccagggcct

SEQ ID NO: 407953 - DNA, 140 bp, Artificial Sequence
  Synthetic
aggccctggctgctgatatgatagcaatagttgtgtggaccatagtaggcatagaatatagaagaatattaagacaaagaaaaatagacaggttaattgagagaataagtgaaagagcaggaccttttgggacagcggtg

SEQ ID NO: 407954 - DNA, 140 bp, Artificial Sequence
  Synthetic
caccgctgtcccaaaaggtcctgctctttcacttattctctcaattaacctgtctatttttctttgtcttaatattcttctatattctatgcctactatggtccacacaactattgctatcatatcagcagccagggcct

SEQ ID NO: 407955 - DNA, 140 bp, Artificial Sequence
  Synthetic
aggccctggctgctgatatgaattataaacatgtggcagagggtaggacgagccatgtatgcccctcccattgcaggaaacataacatgtaaatcaaatatcacaggactactattggtagaccttttgggacagcggtg

SEQ ID NO: 407956 - DNA, 140 bp, Artificial Sequence
  Synthetic
caccgctgtcccaaaaggtctaccaatagtagtcctgtgatatttgatttacatgttatgtttcctgcaatgggaggggcatacatggctcgtcctaccctctgccacatgtttataattcatatcagcagccagggcct

SEQ ID NO: 407957 - DNA, 140 bp, Artificial Sequence
  Synthetic
aggccctggctgctgatatgaataacatggtagaacagatgcatgaggatataatcagtttatgggatcaaagcctaaagccatgtgtaaaattaaccccactctgtgttactttaaattgaccttttgggacagcggtg

SEQ ID NO: 407958 - DNA, 140 bp, Artificial Sequence
  Synthetic
caccgctgtcccaaaaggtcaatttaaagtaacacagagtggggttaattttacacatggctttaggctttgatcccataaactgattatatcctcatgcatctgttctaccatgttattcatatcagcagccagggcct

SEQ ID NO: 407959 - DNA, 140 bp, Artificial Sequence
  Synthetic
atacgccatgctgggtctccgcactgatttgaggaatgatactaataccaatactactaataccactagtagtggttggaaaatgatggagaaaggagaaataaaaaactgctctttcaacgtacttgggagtcggccat

SEQ ID NO: 407960 - DNA, 140 bp, Artificial Sequence
  Synthetic
atggccgactcccaagtacgttgaaagagcagttttttatttctcctttctccatcattttccaaccactactagtggtattagtagtattggtattagtatcattcctcaaatcagtgcggagacccagcatggcgtat

SEQ ID NO: 407961 - DNA, 140 bp, Artificial Sequence
  Synthetic
aggccctggctgctgatatgaccaggccatatcacctagaactttgaatgcatgggtaaaagtaatagaggagaaggctttcagcccagaagtaatacccatgtttacagcattatcagagaccttttgggacagcggtg

SEQ ID NO: 407962 - DNA, 140 bp, Artificial Sequence
  Synthetic
caccgctgtcccaaaaggtctctgataatgctgtaaacatgggtattacttctgggctgaaagccttctcctctattacttttacccatgcattcaaagttctaggtgatatggcctggtcatatcagcagccagggcct

SEQ ID NO: 407963 - DNA, 140 bp, Artificial Sequence
  Synthetic
aggccctggctgctgatatgtctagataaaatagaggaaatacagaataagagcaaacaaaaacagatagcagctgacacaaaaaacagcagccaggtcagccaaaattaccctatagtagaccttttgggacagcggtg

SEQ ID NO: 407964 - DNA, 140 bp, Artificial Sequence
  Synthetic
caccgctgtcccaaaaggtctactatagggtaattttggctgacctggctgctgttttttgtgtcagctgctatctgtttttgtttgctcttattctgtatttcctctattttatctagacatatcagcagccagggcct

SEQ ID NO: 407965 - DNA, 140 bp, Artificial Sequence
  Synthetic
aggccctggctgctgatatgggcaggaagtaggaaaagcaatgtatgcccctcccatccaaggacaaattagctgttcatcaaatattacagggctgctattaacaagagatggtggtaagaccttttgggacagcggtg

SEQ ID NO: 407966 - DNA, 140 bp, Artificial Sequence
  Synthetic
caccgctgtcccaaaaggtcttaccaccatctcttgttaatagcagccctgtaatatttgatgaacagctaatttgtccttggatgggaggggcatacattgcttttcctacttcctgcccatatcagcagccagggcct

SEQ ID NO: 407967 - DNA, 140 bp, Artificial Sequence
  Synthetic
aggccctggctgctgatatggtgacatagcaggaactactagtacccttcaggaacaaatagcatggatgacaagtaacccacctatcccagtaggagacatctataaaagatggataatgaccttttgggacagcggtg

SEQ ID NO: 407968 - DNA, 140 bp, Artificial Sequence
  Synthetic
caccgctgtcccaaaaggtcattatccatcttttatagatgtctcctactgggataggtgggttacttgtcatccatgctatttgttcctgaagggtactagtagttcctgctatgtcaccatatcagcagccagggcct

SEQ ID NO: 407969 - DNA, 140 bp, Artificial Sequence
  Synthetic
aggccctggctgctgatatgcagatgaagtaagaaactgttcttttaatatgaccacagaactaagagataagcagcagaaggtccatgcacttttttataggcttgatatagtaccaatgaccttttgggacagcggtg

SEQ ID NO: 407970 - DNA, 140 bp, Artificial Sequence
  Synthetic
caccgctgtcccaaaaggtcattggtactatatcaagcctataaaaaagtgcatggaccttctgctgcttatctcttagttctgtggtcatattaaaagaacagtttcttacttcatctgcatatcagcagccagggcct

SEQ ID NO: 407971 - DNA, 140 bp, Artificial Sequence
  Synthetic
aggccctggctgctgatatgtgatatacagaaattagtgggaaaactaaattgggcaagtcagatttatgcagggattaaagtaaagcaattgtgtaaactcctcaggggagccaaagcagaccttttgggacagcggtg

SEQ ID NO: 407972 - DNA, 140 bp, Artificial Sequence
  Synthetic
caccgctgtcccaaaaggtctgctttggctcccctgaggagtttacacaattgctttactttaatccctgcataaatctgacttgcccaatttagttttcccactaatttctgtatatcacatatcagcagccagggcct

SEQ ID NO: 407973 - DNA, 140 bp, Artificial Sequence
  Synthetic
atacgccatgctgggtctcccagagaagatctctcgacgcaggactcggcttgctgactgaagtgcacacagcaagaggcgagagcggcgactggtgagtacgccattttttgactagcgcgtacttgggagtcggccat

SEQ ID NO: 407974 - DNA, 140 bp, Artificial Sequence
  Synthetic
atggccgactcccaagtacgcgctagtcaaaaaatggcgtactcaccagtcgccgctctcgcctcttgctgtgtgcacttcagtcagcaagccgagtcctgcgtcgagagatcttctctgggagacccagcatggcgtat

SEQ ID NO: 407975 - DNA, 140 bp, Artificial Sequence
  Synthetic
aggccctggctgctgatatgaatttgcacaatcctcaggaggggacttagaagttacaacacatagttttaattgtagaggagaatttttctattgcaatacaacaaaactgtttaatgagaccttttgggacagcggtg

SEQ ID NO: 407976 - DNA, 140 bp, Artificial Sequence
  Synthetic
caccgctgtcccaaaaggtctcattaaacagttttgttgtattgcaatagaaaaattctcctctacaattaaaactatgtgttgtaacttctaagtcccctcctgaggattgtgcaaattcatatcagcagccagggcct

SEQ ID NO: 407977 - DNA, 140 bp, Artificial Sequence
  Synthetic
aggccctggctgctgatatgagcaggagaaaaatgaaaaagatttattagcattagacagttggaacaatctgtggaattggtttagcatatcaaattggctgtggtatataagaatattgaccttttgggacagcggtg

SEQ ID NO: 407978 - DNA, 140 bp, Artificial Sequence
  Synthetic
caccgctgtcccaaaaggtcaatattcttatataccacagccaatttgatatgctaaaccaattccacagattgttccaactgtctaatgctaataaatctttttcatttttctcctgctcatatcagcagccagggcct

SEQ ID NO: 407979 - DNA, 140 bp, Artificial Sequence
  Synthetic
aggccctggctgctgatatgacaagccccagaggaccaagggccacagagggagccatacaatgaatggacattagaacttttagaggagcttaagagtgaagctgttagacactttcctgaccttttgggacagcggtg

SEQ ID NO: 407980 - DNA, 140 bp, Artificial Sequence
  Synthetic
caccgctgtcccaaaaggtcaggaaagtgtctaacagcttcactcttaagctcctctaaaagttctaatgtccattcattgtatggctccctctgtggcccttggtcctctggggcttgtcatatcagcagccagggcct

SEQ ID NO: 407981 - DNA, 140 bp, Artificial Sequence
  Synthetic
atacgccatgctgggtctccgattattggagtaatacaaagcatctttagagctatctgcaatatacctagaagaatatgacagggctttgaagcatctttgctataaaatggggagcaacgtacttgggagtcggccat

SEQ ID NO: 407982 - DNA, 140 bp, Artificial Sequence
  Synthetic
atggccgactcccaagtacgttgctccccattttatagcaaagatgcttcaaagccctgtcatattcttctaggtatattgcagatagctctaaagatgctttgtattactccaataatcggagacccagcatggcgtat

SEQ ID NO: 407983 - DNA, 140 bp, Artificial Sequence
  Synthetic
  misc_feature (70)..(70): n is a, c, g, or t
  misc_feature (106)..(106): n is a, c, g, or t
atacgccatgctgggtctccatcagagtcatcaagatcctataccaaagcagtaagtagtacatgtaatncaacctttagtgatattagcaatagtagcattagtngtagcatttataatcgtacttgggagtcggccat

SEQ ID NO: 407984 - DNA, 140 bp, Artificial Sequence
  Synthetic
  misc_feature (35)..(35): n is a, c, g, or t
  misc_feature (71)..(71): n is a, c, g, or t
atggccgactcccaagtacgattataaatgctacnactaatgctactattgctaatatcactaaaggttgnattacatgtactacttactgctttggtataggatcttgatgactctgatggagacccagcatggcgtat

SEQ ID NO: 407985 - DNA, 140 bp, Artificial Sequence
  Synthetic
  misc_feature (26)..(26): n is a, c, g, or t
  misc_feature (68)..(68): n is a, c, g, or t
  misc_feature (111)..(111): n is a, c, g, or t
  misc_feature (114)..(114): n is a, c, g, or t
atacgccatgctgggtctccggaaanttgtgggtcacagtgtattatggggtacctgtgtggaaagangcaaatactactctattttgtgcatcagatgccaaagcctatnaancagaagcgtacttgggagtcggccat

SEQ ID NO: 407986 - DNA, 140 bp, Artificial Sequence
  Synthetic
  misc_feature (27)..(27): n is a, c, g, or t
  misc_feature (30)..(30): n is a, c, g, or t
  misc_feature (73)..(73): n is a, c, g, or t
  misc_feature (115)..(115): n is a, c, g, or t
atggccgactcccaagtacgcttctgnttnataggctttggcatctgatgcacaaaatagagtagtatttgcntctttccacacaggtaccccataatacactgtgacccacaantttccggagacccagcatggcgtat

SEQ ID NO: 407987 - DNA, 140 bp, Artificial Sequence
  Synthetic
aggccctggctgctgatatgcgaagaactcctcaacgcaataagaatcatcaaaatcctatatcaaagcagtaagtagtagtagttagtatatgtaatgagtcctttagaaatctgggcagaccttttgggacagcggtg

SEQ ID NO: 407988 - DNA, 140 bp, Artificial Sequence
  Synthetic
caccgctgtcccaaaaggtctgcccagatttctaaaggactcattacatatactaactactactacttactgctttgatataggattttgatgattcttattgcgttgaggagttcttcgcatatcagcagccagggcct

SEQ ID NO: 407989 - DNA, 140 bp, Artificial Sequence
  Synthetic
aggccctggctgctgatatgcgatctgaggagcctgtgcctcttcctctaccaccgcttgagagacttagtcttgattgtaacgaggacggtggaacttctgacacgcagcagcctacaggaccttttgggacagcggtg

SEQ ID NO: 407990 - DNA, 140 bp, Artificial Sequence
  Synthetic
caccgctgtcccaaaaggtcctgtaggctgctgcgtgtcagaagttccaccgtcctcgttacaatcaagactaagtctctcaagcggtggtagaggaagaggcacaggctcctcagatcgcatatcagcagccagggcct

SEQ ID NO: 407991 - DNA, 140 bp, Artificial Sequence
  Synthetic
atacgccatgctgggtctcctactagtactgctattggtactactgctactggtagtactgctactactgaggacccgggaatgaaaaactgctctttcaatatggccacagaggtaacacgtacttgggagtcggccat

SEQ ID NO: 407992 - DNA, 140 bp, Artificial Sequence
  Synthetic
atggccgactcccaagtacgtgttacctctgtggccatattgaaagagcagtttttcattcccgggtcctcagtagtagcagtactaccagtagcagtagtaccaatagcagtactagtaggagacccagcatggcgtat

SEQ ID NO: 407993 - DNA, 140 bp, Artificial Sequence
  Synthetic
aggccctggctgctgatatgaggacccgggaatgaaaaactgctctttcaatatggccacagaggtaacagataagaaaaaggtagtaaatgcacttttttataaccttgatgtagaacagaccttttgggacagcggtg

SEQ ID NO: 407994 - DNA, 140 bp, Artificial Sequence
  Synthetic
caccgctgtcccaaaaggtctgttctacatcaaggttataaaaaagtgcatttactacctttttcttatctgttacctctgtggccatattgaaagagcagtttttcattcccgggtcctcatatcagcagccagggcct

SEQ ID NO: 407995 - DNA, 140 bp, Artificial Sequence
  Synthetic
aggccctggctgctgatatgattcaatgggacaggtccatgtaaaaatgtcagcacagtacagtgtacacatggcatcaggccagtagtgtccactcaactgttgttgaatggtagtctggaccttttgggacagcggtg

SEQ ID NO: 407996 - DNA, 140 bp, Artificial Sequence
  Synthetic
caccgctgtcccaaaaggtccagactaccattcaacaacagttgagtggacactactggcctgatgccatgtgtacactgtactgtgctgacatttttacatggacctgtcccattgaatcatatcagcagccagggcct

SEQ ID NO: 407997 - DNA, 140 bp, Artificial Sequence
  Synthetic
atacgccatgctgggtctccatcaccaataatgaaatgacaaactgctcttacagtattaccacagaactgaaggataagaaacagaaagtatattcacttttttataaacttgatgtagcgtacttgggagtcggccat

SEQ ID NO: 407998 - DNA, 140 bp, Artificial Sequence
  Synthetic
atggccgactcccaagtacgctacatcaagtttataaaaaagtgaatatactttctgtttcttatccttcagttctgtggtaatactgtaagagcagtttgtcatttcattattggtgatggagacccagcatggcgtat

SEQ ID NO: 407999 - DNA, 140 bp, Artificial Sequence
  Synthetic
  misc_feature (94)..(94): n is a, c, g, or t
aggccctggctgctgatatgcctccaacaatacaagacaaagtgtacatatgggaccagggcaagcgctctatacaacaaaggtaataggaganataagaaaagcatattgcaacgttaggaccttttgggacagcggtg

SEQ ID NO: 408000 - DNA, 140 bp, Artificial Sequence
  Synthetic
  misc_feature (47)..(47): n is a, c, g, or t
caccgctgtcccaaaaggtcctaacgttgcaatatgcttttcttatntctcctattacctttgttgtatagagcgcttgccctggtcccatatgtacactttgtcttgtattgttggaggcatatcagcagccagggcct

SEQ ID NO: 408001 - DNA, 140 bp, Artificial Sequence
  Synthetic
atacgccatgctgggtctccagttttttaacaagacaataatatttaactcatccgcgggaggggacccagaaattacaacacacagttttaattgtggaggggaatttttttactgcaacgtacttgggagtcggccat

SEQ ID NO: 408002 - DNA, 140 bp, Artificial Sequence
  Synthetic
atggccgactcccaagtacgttgcagtaaaaaaattcccctccacaattaaaactgtgtgttgtaatttctgggtcccctcccgcggatgagttaaatattattgtcttgttaaaaaactggagacccagcatggcgtat

SEQ ID NO: 408003 - DNA, 140 bp, Artificial Sequence
  Synthetic
atacgccatgctgggtctccatcagacctagcaacaatacaaggaaaagtgtacgtataggacctggacaaacattctatgcaacagacataataggggatataagacaagcacattgtacgtacttgggagtcggccat

SEQ ID NO: 408004 - DNA, 140 bp, Artificial Sequence
  Synthetic
atggccgactcccaagtacgtacaatgtgcttgtcttatatcccctattatgtctgttgcatagaatgtttgtccaggtcctatacgtacacttttccttgtattgttgctaggtctgatggagacccagcatggcgtat

SEQ ID NO: 408005 - DNA, 140 bp, Artificial Sequence
  Synthetic
aggccctggctgctgatatgaacattctatgcaacagacataataggggatataagacaagcacattgtaatgttactagaacagcttggaatacagttttgcaaaacgtatcccttcaagaccttttgggacagcggtg

SEQ ID NO: 408006 - DNA, 140 bp, Artificial Sequence
  Synthetic
caccgctgtcccaaaaggtcttgaagggatacgttttgcaaaactgtattccaagctgttctagtaacattacaatgtgcttgtcttatatcccctattatgtctgttgcatagaatgttcatatcagcagccagggcct

SEQ ID NO: 408007 - DNA, 140 bp, Artificial Sequence
  Synthetic
aggccctggctgctgatatgaccttcagacctgcaggaggaaatatgaaggacaattggagaagtgaactatacaaatataaagtagtaaagattgaaccactaggagtagcacccactagaccttttgggacagcggtg

SEQ ID NO: 408008 - DNA, 140 bp, Artificial Sequence
  Synthetic
caccgctgtcccaaaaggtctagtgggtgctactcctagtggttcaatctttactactttatatttgtatagttcacttctccaattgtccttcatatttcctcctgcaggtctgaaggtcatatcagcagccagggcct

SEQ ID NO: 408009 - DNA, 140 bp, Artificial Sequence
  Synthetic
atacgccatgctgggtctccgcttttagaggagcttaagagtgaagctgttagacattttcctaggatatggctccatggcttagggcaacatatctatgaaacttatggggatacttggcgtacttgggagtcggccat

SEQ ID NO: 408010 - DNA, 140 bp, Artificial Sequence
  Synthetic
atggccgactcccaagtacgccaagtatccccataagtttcatagatatgttgccctaagccatggagccatatcctaggaaaatgtctaacagcttcactcttaagctcctctaaaagcggagacccagcatggcgtat

SEQ ID NO: 408011 - DNA, 140 bp, Artificial Sequence
  Synthetic
aggccctggctgctgatatggcaccactaatgtgccctggaactccacttggagtaataaatctctaaatgagatttggaataacatgacctggatggattgggaaagagaaattgataagaccttttgggacagcggtg

SEQ ID NO: 408012 - DNA, 140 bp, Artificial Sequence
  Synthetic
caccgctgtcccaaaaggtcttatcaatttctctttcccaatccatccaggtcatgttattccaaatctcatttagagatttattactccaagtggagttccagggcacattagtggtgccatatcagcagccagggcct

SEQ ID NO: 408013 - DNA, 140 bp, Artificial Sequence
  Synthetic
aggccctggctgctgatatgtataacagatgaagtaagaaactgttcttttaatatgaccacagaaataagagataagaagcagaaggtccatgcacttttttataagcttgatatagtagaccttttgggacagcggtg

SEQ ID NO: 408014 - DNA, 140 bp, Artificial Sequence
  Synthetic
caccgctgtcccaaaaggtctactatatcaagcttataaaaaagtgcatggaccttctgcttcttatctcttatttctgtggtcatattaaaagaacagtttcttacttcatctgttatacatatcagcagccagggcct

SEQ ID NO: 408015 - DNA, 140 bp, Artificial Sequence
  Synthetic
aggccctggctgctgatatgaagacagtggcaatgagagtgaaggggaccaggaagagttatcggcgcttatggagatggggcaccatgctccttgggatgttgatgatctgtagtgctggaccttttgggacagcggtg

SEQ ID NO: 408016 - DNA, 140 bp, Artificial Sequence
  Synthetic
caccgctgtcccaaaaggtccagcactacagatcatcaacatcccaaggagcatggtgccccatctccataagcgccgataactcttcctggtccccttcactctcattgccactgtcttcatatcagcagccagggcct

SEQ ID NO: 408017 - DNA, 140 bp, Artificial Sequence
  Synthetic
aggccctggctgctgatatggcactgatttgaggaatgctactaataccactgggaatgctactaataccactagtagtagcgggatggagatggagggaggagaaataaaaaactgctcgaccttttgggacagcggtg

SEQ ID NO: 408018 - DNA, 140 bp, Artificial Sequence
  Synthetic
caccgctgtcccaaaaggtcgagcagttttttatttctcctccctccatctccatcccgctactactagtggtattagtagcattcccagtggtattagtagcattcctcaaatcagtgccatatcagcagccagggcct

SEQ ID NO: 408019 - DNA, 140 bp, Artificial Sequence
  Synthetic
aggccctggctgctgatatggtcagcacagtacaatgtacacatggaattaggccagtagtgtcaactcaactactgttaaatggcagtttagcagaagaagaggtagtaattagatctggaccttttgggacagcggtg

SEQ ID NO: 408020 - DNA, 140 bp, Artificial Sequence
  Synthetic
caccgctgtcccaaaaggtccagatctaattactacctcttcttctgctaaactgccatttaacagtagttgagttgacactactggcctaattccatgtgtacattgtactgtgctgaccatatcagcagccagggcct

SEQ ID NO: 408021 - DNA, 140 bp, Artificial Sequence
  Synthetic
atacgccatgctgggtctcctagcgactggtgagtacgctaaaaattttttgactagcagaggctagaaggggaaagatgggtgcaagagcgtctgtattaagcgggggaaaattagatacgtacttgggagtcggccat

SEQ ID NO: 408022 - DNA, 140 bp, Artificial Sequence
  Synthetic
atggccgactcccaagtacgtatctaattttcccccgcttaatacagacgctcttgcacccatctttccccttctagcctctgctagtcaaaaaatttttagcgtactcaccagtcgctaggagacccagcatggcgtat

SEQ ID NO: 408023 - DNA, 140 bp, Artificial Sequence
  Synthetic
aggccctggctgctgatatgagtggtcaaaaagtagcatagtgggatggcctgagattagggaaagaataagacaaactcctccagcagcaacaggagtaggagcagtatctcaagatttgaccttttgggacagcggtg

SEQ ID NO: 408024 - DNA, 140 bp, Artificial Sequence
  Synthetic
caccgctgtcccaaaaggtcaaatcttgagatactgctcctactcctgttgctgctggaggagtttgtcttattctttccctaatctcaggccatcccactatgctactttttgaccactcatatcagcagccagggcct

SEQ ID NO: 408025 - DNA, 140 bp, Artificial Sequence
  Synthetic
aggccctggctgctgatatggaggaggtaggctttccagtcaggccacaggtacctgtaagaccaatgacttacaaggcagctttagatctcagccactttttaaaagaaaaggggggacgaccttttgggacagcggtg

SEQ ID NO: 408026 - DNA, 140 bp, Artificial Sequence
  Synthetic
caccgctgtcccaaaaggtcgtccccccttttcttttaaaaagtggctgagatctaaagctgccttgtaagtcattggtcttacaggtacctgtggcctgactggaaagcctacctcctccatatcagcagccagggcct

SEQ ID NO: 408027 - DNA, 140 bp, Artificial Sequence
  Synthetic
aggccctggctgctgatatgcctaaaatctctttggaacgcaatagcagtactctggtgcgttcacaacagatttgaggttcaaaatacacagcaggcaatacaaaagctaaaagaagtagaccttttgggacagcggtg

SEQ ID NO: 408028 - DNA, 140 bp, Artificial Sequence
  Synthetic
caccgctgtcccaaaaggtctacttcttttagcttttgtattgcctgctgtgtattttgaacctcaaatctgttgtgaacgcaccagagtactgctattgcgttccaaagagattttaggcatatcagcagccagggcct

SEQ ID NO: 408029 - DNA, 140 bp, Artificial Sequence
  Synthetic
aggccctggctgctgatatggaatgaaaaggatttgttagaattggataaatgggcaagtctgtggaattggtttgacataacaaattggctgtggtatataaaaatatttataatgatagaccttttgggacagcggtg

SEQ ID NO: 408030 - DNA, 140 bp, Artificial Sequence
  Synthetic
caccgctgtcccaaaaggtctatcattataaatatttttatataccacagccaatttgttatgtcaaaccaattccacagacttgcccatttatccaattctaacaaatccttttcattccatatcagcagccagggcct

SEQ ID NO: 408031 - DNA, 140 bp, Artificial Sequence
  Synthetic
aggccctggctgctgatatgctatagtgcaaaatgcacaagggcaaatgatacaccagcccttatcaccaaggactttgaatgcatgggtaaaagtaatagaagaaaggggtttcagcccgaccttttgggacagcggtg

SEQ ID NO: 408032 - DNA, 140 bp, Artificial Sequence
  Synthetic
caccgctgtcccaaaaggtcgggctgaaacccctttcttctattacttttacccatgcattcaaagtccttggtgataagggctggtgtatcatttgcccttgtgcattttgcactatagcatatcagcagccagggcct

SEQ ID NO: 408033 - DNA, 140 bp, Artificial Sequence
  Synthetic
aggccctggctgctgatatgcacatacctacaagaataagacagggcttggaaaggcttttgctataagatgggtggcaagttgtcaaaacgtatgagagaatggactgctgtgagggaagaccttttgggacagcggtg

SEQ ID NO: 408034 - DNA, 140 bp, Artificial Sequence
  Synthetic
caccgctgtcccaaaaggtcttccctcacagcagtccattctctcatacgttttgacaacttgccacccatcttatagcaaaagcctttccaagccctgtcttattcttgtaggtatgtgcatatcagcagccagggcct

SEQ ID NO: 408035 - DNA, 140 bp, Artificial Sequence
  Synthetic
atacgccatgctgggtctccgataacctccccttcgaagcaggagcagaaggacagggaacaggccccacccttagtttccctcaaatcactctttggcaacgaccccttgtcacagtaacgtacttgggagtcggccat

SEQ ID NO: 408036 - DNA, 140 bp, Artificial Sequence
  Synthetic
atggccgactcccaagtacgttactgtgacaaggggtcgttgccaaagagtgatttgagggaaactaagggtggggcctgttccctgtccttctgctcctgcttcgaaggggaggttatcggagacccagcatggcgtat

SEQ ID NO: 408037 - DNA, 140 bp, Artificial Sequence
  Synthetic
aggccctggctgctgatatgatacctagaagaataagacagggcttggaaagggctttgcaataaaatgggtagcaagttgtcaaagaatagaataagtgggtggtctgatataagggaagaccttttgggacagcggtg

SEQ ID NO: 408038 - DNA, 140 bp, Artificial Sequence
  Synthetic
caccgctgtcccaaaaggtcttcccttatatcagaccacccacttattctattctttgacaacttgctacccattttattgcaaagccctttccaagccctgtcttattcttctaggtatcatatcagcagccagggcct

SEQ ID NO: 408039 - DNA, 140 bp, Artificial Sequence
  Synthetic
atacgccatgctgggtctcctagctacaatgatagccttagaataagggaagaaataaaaaattgctctttcaatacaaccacagaaataagagataagaagcagaacgcgtatgcacttcgtacttgggagtcggccat

SEQ ID NO: 408040 - DNA, 140 bp, Artificial Sequence
  Synthetic
atggccgactcccaagtacgaagtgcatacgcgttctgcttcttatctcttatttctgtggttgtattgaaagagcaattttttatttcttcccttattctaaggctatcattgtagctaggagacccagcatggcgtat

SEQ ID NO: 408041 - DNA, 140 bp, Artificial Sequence
  Synthetic
atacgccatgctgggtctccaatgttacctacaatagtacccacaatgaaatgaaaaattgctctttcaatgcaaccacagaattaaaagataagaagcagacagtgcatgcacttttttcgtacttgggagtcggccat

SEQ ID NO: 408042 - DNA, 140 bp, Artificial Sequence
  Synthetic
atggccgactcccaagtacgaaaaaagtgcatgcactgtctgcttcttatcttttaattctgtggttgcattgaaagagcaatttttcatttcattgtgggtactattgtaggtaacattggagacccagcatggcgtat

SEQ ID NO: 408043 - DNA, 140 bp, Artificial Sequence
  Synthetic
aggccctggctgctgatatgcaaattataaacatgtggcagggaacaggacaagcaatgtatgctcctcccatcgatggaaaaattaattgtgtatcaaatattacaggaatactattgagaccttttgggacagcggtg

SEQ ID NO: 408044 - DNA, 140 bp, Artificial Sequence
  Synthetic
caccgctgtcccaaaaggtctcaatagtattcctgtaatatttgatacacaattaatttttccatcgatgggaggagcatacattgcttgtcctgttccctgccacatgtttataatttgcatatcagcagccagggcct

SEQ ID NO: 408045 - DNA, 140 bp, Artificial Sequence
  Synthetic
aggccctggctgctgatatgagcaactctctattgtgtacataaagggatagaggtacgagacaccaaggaagccttagacaagatagaggaagaacaaaacaaatgtcagcaaaaagcagaccttttgggacagcggtg

SEQ ID NO: 408046 - DNA, 140 bp, Artificial Sequence
  Synthetic
caccgctgtcccaaaaggtctgctttttgctgacatttgttttgttcttcctctatcttgtctaaggcttccttggtgtctcgtacctctatccctttatgtacacaatagagagttgctcatatcagcagccagggcct

SEQ ID NO: 408047 - DNA, 140 bp, Artificial Sequence
  Synthetic
aggccctggctgctgatatgatatttgggacaacatgacctggatgcagtgggatagagaaattagtaattacacagacacaatatacaagttgcttgaagcctcgcaaacccagcaggagaccttttgggacagcggtg

SEQ ID NO: 408048 - DNA, 140 bp, Artificial Sequence
  Synthetic
caccgctgtcccaaaaggtctcctgctgggtttgcgaggcttcaagcaacttgtatattgtgtctgtgtaattactaatttctctatcccactgcatccaggtcatgttgtcccaaatatcatatcagcagccagggcct

SEQ ID NO: 408049 - DNA, 140 bp, Artificial Sequence
  Synthetic
atacgccatgctgggtctccgaaactaataccactatcagtaactgggaaaagatggacataagtgagataaaaaactgctctttcaatatcaccacaaccgctaacgaagggaaaaggacgtacttgggagtcggccat

SEQ ID NO: 408050 - DNA, 140 bp, Artificial Sequence
  Synthetic
atggccgactcccaagtacgtccttttcccttcgttagcggttgtggtgatattgaaagagcagttttttatctcacttatgtccatcttttcccagttactgatagtggtattagtttcggagacccagcatggcgtat

SEQ ID NO: 408051 - DNA, 140 bp, Artificial Sequence
  Synthetic
aggccctggctgctgatatgtaaatttaaactacccatacaaaaagaaacatgggaagcatggtggacagagtattggcaagccacctggattcctgagtgggagtttgtcaatacccctgaccttttgggacagcggtg

SEQ ID NO: 408052 - DNA, 140 bp, Artificial Sequence
  Synthetic
caccgctgtcccaaaaggtcaggggtattgacaaactcccactcaggaatccaggtggcttgccaatactctgtccaccatgcttcccatgtttctttttgtatgggtagtttaaatttacatatcagcagccagggcct

SEQ ID NO: 408053 - DNA, 140 bp, Artificial Sequence
  Synthetic
aggccctggctgctgatatgaggagcagcgtctcaagacttagataaacatggggcacttacaagcagcaacacagcccacaataatgctgattgtgcctggctgcaagcacaagaggaggaccttttgggacagcggtg

SEQ ID NO: 408054 - DNA, 140 bp, Artificial Sequence
  Synthetic
caccgctgtcccaaaaggtcctcctcttgtgcttgcagccaggcacaatcagcattattgtgggctgtgttgctgcttgtaagtgccccatgtttatctaagtcttgagacgctgctcctcatatcagcagccagggcct

SEQ ID NO: 408055 - DNA, 140 bp, Artificial Sequence
  Synthetic
aggccctggctgctgatatgcctaataaaacaataaaatttaactcatcctcaggaggggacctagaaattacaacacatagctttaattgtagaggagaatttttctattgtaatacatgaccttttgggacagcggtg

SEQ ID NO: 408056 - DNA, 140 bp, Artificial Sequence
  Synthetic
caccgctgtcccaaaaggtcatgtattacaatagaaaaattctcctctacaattaaagctatgtgttgtaatttctaggtcccctcctgaggatgagttaaattttattgttttattaggcatatcagcagccagggcct

SEQ ID NO: 408057 - DNA, 140 bp, Artificial Sequence
  Synthetic
atacgccatgctgggtctccgttttcatagagtgctgtagattaagaaagcaaagaaagatagacaggttaattaatagaataagagaaagagcagaagatagtggcaatgagagtgaggcgtacttgggagtcggccat

SEQ ID NO: 408058 - DNA, 140 bp, Artificial Sequence
  Synthetic
atggccgactcccaagtacgcctcactctcattgccactatcttctgctctttctcttattctattaattaacctgtctatctttctttgctttcttaatctacagcactctatgaaaacggagacccagcatggcgtat

SEQ ID NO: 408059 - DNA, 140 bp, Artificial Sequence
  Synthetic
atacgccatgctgggtctccagatggtggtcgtcagaatgatactaatgctactgacaccttaacagctggaggaggaaatatgaacgactgttggagaggtgaattttattattataaacgtacttgggagtcggccat

SEQ ID NO: 408060 - DNA, 140 bp, Artificial Sequence
  Synthetic
atggccgactcccaagtacgtttataataataaaattcacctctccaacagtcgttcatatttcctcctccagctgttaaggtgtcagtagcattagtatcattctgacgaccaccatctggagacccagcatggcgtat

SEQ ID NO: 408061 - DNA, 140 bp, Artificial Sequence
  Synthetic
aggccctggctgctgatatgttcatagagtgtagaagagtgcaaaagcaaagaaaaatagataggttaattaagaaaataagtgagagagcggaagacagtggcaatgagagcgatgggggaccttttgggacagcggtg

SEQ ID NO: 408062 - DNA, 140 bp, Artificial Sequence
  Synthetic
caccgctgtcccaaaaggtcccccatcgctctcattgccactgtcttccgctctctcacttattttcttaattaacctatctatttttctttgcttttgcactcttctacactctatgaacatatcagcagccagggcct

SEQ ID NO: 408063 - DNA, 140 bp, Artificial Sequence
  Synthetic
atacgccatgctgggtctcctcaacaacaacagcactggcgaaatgaaaaactgctctttcaatgtaactacagtggtaagggataagaagaagcaagaatatgcacttttttatagactcgtacttgggagtcggccat

SEQ ID NO: 408064 - DNA, 140 bp, Artificial Sequence
  Synthetic
atggccgactcccaagtacgagtctataaaaaagtgcatattcttgcttcttcttatcccttaccactgtagttacattgaaagagcagtttttcatttcgccagtgctgttgttgttgaggagacccagcatggcgtat

SEQ ID NO: 408065 - DNA, 140 bp, Artificial Sequence
  Synthetic
atacgccatgctgggtctccatgccacaaatgccactattgaggacataggaatgaaaaactgctctttcaatgtaaccacagaagtaagagataagaagaagcaagtacatgcacttttcgtacttgggagtcggccat

SEQ ID NO: 408066 - DNA, 140 bp, Artificial Sequence
  Synthetic
atggccgactcccaagtacgaaaagtgcatgtacttgcttcttcttatctcttacttctgtggttacattgaaagagcagtttttcattcctatgtcctcaatagtggcatttgtggcatggagacccagcatggcgtat

SEQ ID NO: 408067 - DNA, 140 bp, Artificial Sequence
  Synthetic
atacgccatgctgggtctcccaagcactctttgcaacaacaaatgtaataggagatataagaagagcacattgtaatatcagtagcacaaaatggaatgaaactttacaacagttagcaacgtacttgggagtcggccat

SEQ ID NO: 408068 - DNA, 140 bp, Artificial Sequence
  Synthetic
atggccgactcccaagtacgttgctaactgttgtaaagtttcattccattttgtgctactgatattacaatgtgctcttcttatatctcctattacatttgttgttgcaaagagtgcttgggagacccagcatggcgtat

SEQ ID NO: 408069 - DNA, 140 bp, Artificial Sequence
  Synthetic
atacgccatgctgggtctcctcaggaggggacctagagattacaacacacagttttgtttgtggaggggaatttttctactgcaatacatcaggactgtttaatagtacctggatggttacgtacttgggagtcggccat

SEQ ID NO: 408070 - DNA, 140 bp, Artificial Sequence
  Synthetic
atggccgactcccaagtacgtaaccatccaggtactattaaacagtcctgatgtattgcagtagaaaaattcccctccacaaacaaaactgtgtgttgtaatctctaggtcccctcctgaggagacccagcatggcgtat

SEQ ID NO: 408071 - DNA, 140 bp, Artificial Sequence
  Synthetic
atacgccatgctgggtctcctgcagaataaaacaaattataaacatgtggcaagaagtaggaagagcaatgtatgcccctcccattgaaggagtaatcaaatgttcatcaaacattacagcgtacttgggagtcggccat

SEQ ID NO: 408072 - DNA, 140 bp, Artificial Sequence
  Synthetic
atggccgactcccaagtacgctgtaatgtttgatgaacatttgattactccttcaatgggaggggcatacattgctcttcctacttcttgccacatgtttataatttgttttattctgcaggagacccagcatggcgtat

SEQ ID NO: 408073 - DNA, 140 bp, Artificial Sequence
  Synthetic
aggccctggctgctgatatggagaccttcagacctggaggaggagatatgagggacaattggagaagtgaattatacaaatataaagtagtaagagttgaaccactaggtctagcacccagaccttttgggacagcggtg

SEQ ID NO: 408074 - DNA, 140 bp, Artificial Sequence
  Synthetic
caccgctgtcccaaaaggtctgggtgctagacctagtggttcaactcttactactttatatttgtataattcacttctccaattgtccctcatatctcctcctccaggtctgaaggtctccatatcagcagccagggcct

SEQ ID NO: 408075 - DNA, 140 bp, Artificial Sequence
  Synthetic
aggccctggctgctgatatgtgtggaaagctacctaagggatcaacagctcctaggaatttggggttgctctggaaaacacatttgcaccactactgtgccctggaactctagctggagtgaccttttgggacagcggtg

SEQ ID NO: 408076 - DNA, 140 bp, Artificial Sequence
  Synthetic
caccgctgtcccaaaaggtcactccagctagagttccagggcacagtagtggtgcaaatgtgttttccagagcaaccccaaattcctaggagctgttgatcccttaggtagctttccacacatatcagcagccagggcct

SEQ ID NO: 408077 - DNA, 140 bp, Artificial Sequence
  Synthetic
aggccctggctgctgatatggaaatataacagatgaagtaagaaactgttcttttaatatgaccacagaactaagagataagaagcagaaggtccatgcacttttttataagcttgatatgaccttttgggacagcggtg

SEQ ID NO: 408078 - DNA, 140 bp, Artificial Sequence
  Synthetic
caccgctgtcccaaaaggtcatatcaagcttataaaaaagtgcatggaccttctgcttcttatctcttagttctgtggtcatattaaaagaacagtttcttacttcatctgttatatttccatatcagcagccagggcct

SEQ ID NO: 408079 - DNA, 140 bp, Artificial Sequence
  Synthetic
aggccctggctgctgatatgctgaaaaattaaaagagcactttaataataagacaataatctttcaaccaccctcaggaggagatctagaaattacaatgcatcattttaattgtagagggaccttttgggacagcggtg

SEQ ID NO: 408080 - DNA, 140 bp, Artificial Sequence
  Synthetic
caccgctgtcccaaaaggtccctctacaattaaaatgatgcattgtaatttctagatctcctcctgagggtggttgaaagattattgtcttattattaaagtgctcttttaatttttcagcatatcagcagccagggcct

SEQ ID NO: 408081 - DNA, 140 bp, Artificial Sequence
  Synthetic
atacgccatgctgggtctccgaggaagtgggttttccagtcaggcctcaggtgcctacaagaccaatgacttacaaggcagctctagatcttagccattttttaaaagataaggggggaccgtacttgggagtcggccat

SEQ ID NO: 408082 - DNA, 140 bp, Artificial Sequence
  Synthetic
atggccgactcccaagtacggtccccccttatcttttaaaaaatggctaagatctagagctgccttgtaagtcattggtcttgtaggcacctgaggcctgactggaaaacccacttcctcggagacccagcatggcgtat

SEQ ID NO: 408083 - DNA, 140 bp, Artificial Sequence
  Synthetic
atacgccatgctgggtctccaaagaatgagacaaactcctccagcagcaaaaggagtaggagcagtatctcaagatttagatacacatggagcagtcacaagcagcaatgtaaatcaccccgtacttgggagtcggccat

SEQ ID NO: 408084 - DNA, 140 bp, Artificial Sequence
  Synthetic
atggccgactcccaagtacggggtgatttacattgctgcttgtgactgctccatgtgtatctaaatcttgagatactgctcctactccttttgctgctggaggagtttgtctcattctttggagacccagcatggcgtat

SEQ ID NO: 408085 - DNA, 140 bp, Artificial Sequence
  Synthetic
atacgccatgctgggtctcctagttgcgtctggctggaagcgcaagaggaagaggaggtaggctttccagtcaaaccacaggtacctctaagaccaatgacttacaagcaagcttttgatcgtacttgggagtcggccat

SEQ ID NO: 408086 - DNA, 140 bp, Artificial Sequence
  Synthetic
atggccgactcccaagtacgatcaaaagcttgcttgtaagtcattggtcttagaggtacctgtggtttgactggaaagcctacctcctcttcctcttgcgcttccagccagacgcaactaggagacccagcatggcgtat

SEQ ID NO: 408087 - DNA, 140 bp, Artificial Sequence
  Synthetic
aggccctggctgctgatatggctgacggtacaggccagacaattattgtctggtatagtgcaacagcaaagcaatttgctgagggctatagaggcgcaacagcatctgttgcaactcacagaccttttgggacagcggtg

SEQ ID NO: 408088 - DNA, 140 bp, Artificial Sequence
  Synthetic
caccgctgtcccaaaaggtctgtgagttgcaacagatgctgttgcgcctctatagccctcagcaaattgctttgctgttgcactataccagacaataattgtctggcctgtaccgtcagccatatcagcagccagggcct

SEQ ID NO: 408089 - DNA, 140 bp, Artificial Sequence
  Synthetic
aggccctggctgctgatatgaagctctattagatacaggagcagatgatacagtattagaagaaatggatttgccaggaagatggaaaccaaaaatgatagggggaattggaggttttatgaccttttgggacagcggtg

SEQ ID NO: 408090 - DNA, 140 bp, Artificial Sequence
  Synthetic
caccgctgtcccaaaaggtcataaaacctccaattccccctatcatttttggtttccatcttcctggcaaatccatttcttctaatactgtatcatctgctcctgtatctaatagagcttcatatcagcagccagggcct

SEQ ID NO: 408091 - DNA, 140 bp, Artificial Sequence
  Synthetic
aggccctggctgctgatatgaggacaggaatgaaaaggatttgttagaattggataaatgggcaagtctgtggaattggtttgacataacaaattggctgtggtatataaaaatatttatgaccttttgggacagcggtg

SEQ ID NO: 408092 - DNA, 140 bp, Artificial Sequence
  Synthetic
caccgctgtcccaaaaggtcataaatatttttatataccacagccaatttgttatgtcaaaccaattccacagacttgcccatttatccaattctaacaaatccttttcattcctgtcctcatatcagcagccagggcct

SEQ ID NO: 408093 - DNA, 140 bp, Artificial Sequence
  Synthetic
aggccctggctgctgatatggtcagccaaaattaccctatagtgcagaacctacaggggcaaatggtacatcaggccctatcacctagaactttaaatgcatgggtaaaagtagtagaaggaccttttgggacagcggtg

SEQ ID NO: 408094 - DNA, 140 bp, Artificial Sequence
  Synthetic
caccgctgtcccaaaaggtccttctactacttttacccatgcatttaaagttctaggtgatagggcctgatgtaccatttgcccctgtaggttctgcactatagggtaattttggctgaccatatcagcagccagggcct

SEQ ID NO: 408095 - DNA, 140 bp, Artificial Sequence
  Synthetic
aggccctggctgctgatatgtatagaagtagcacaaggagcttggagagccattctccacatacctagaagaatcagacagggcttcgaaagggctttgctataacatgggaggcaagtggaccttttgggacagcggtg

SEQ ID NO: 408096 - DNA, 140 bp, Artificial Sequence
  Synthetic
caccgctgtcccaaaaggtccacttgcctcccatgttatagcaaagccctttcgaagccctgtctgattcttctaggtatgtggagaatggctctccaagctccttgtgctacttctatacatatcagcagccagggcct

SEQ ID NO: 408097 - DNA, 140 bp, Artificial Sequence
  Synthetic
aggccctggctgctgatatgcaaaagttagtgggaaaattgaattgggcaagtcagatttacccagggattaaagtaaggcaattatgtaaactccttaggggaaccaaagcactaacaggaccttttgggacagcggtg

SEQ ID NO: 408098 - DNA, 140 bp, Artificial Sequence
  Synthetic
caccgctgtcccaaaaggtcctgttagtgctttggttcccctaaggagtttacataattgccttactttaatccctgggtaaatctgacttgcccaattcaattttcccactaacttttgcatatcagcagccagggcct

SEQ ID NO: 408099 - DNA, 140 bp, Artificial Sequence
  Synthetic
aggccctggctgctgatatggataatagcattaatcatagcaataattgtgtggatctgggtatatatagaatataggaaattgttaagacaaagaaaaatagactggttaattaaaagagaccttttgggacagcggtg

SEQ ID NO: 408100 - DNA, 140 bp, Artificial Sequence
  Synthetic
caccgctgtcccaaaaggtctcttttaattaaccagtctatttttctttgtcttaacaatttcctatattctatatatacccagatccacacaattattgctatgattaatgctattatccatatcagcagccagggcct

SEQ ID NO: 408101 - DNA, 140 bp, Artificial Sequence
  Synthetic
aggccctggctgctgatatgtaaaaaagaaaaaatcagtaacagtactggatgtgggggacgcatatttttcagttcctttatatgaagactttagaaagtatactgcgttcaccataccgaccttttgggacagcggtg

SEQ ID NO: 408102 - DNA, 140 bp, Artificial Sequence
  Synthetic
caccgctgtcccaaaaggtcggtatggtgaacgcagtatactttctaaagtcttcatataaaggaactgaaaaatatgcgtcccccacatccagtactgttactgattttttcttttttacatatcagcagccagggcct

SEQ ID NO: 408103 - DNA, 140 bp, Artificial Sequence
  Synthetic
aggccctggctgctgatatgatcttagaaccttttagaaaacaaaatccagaaatggtcatctatcaatacatggatgatttgtatgtaagatctgacttagaaataaggcagcatagaagaccttttgggacagcggtg

SEQ ID NO: 408104 - DNA, 140 bp, Artificial Sequence
  Synthetic
caccgctgtcccaaaaggtcttctatgctgccttatttctaagtcagatcttacatacaaatcatccatgtattgatagatgaccatttctggattttgttttctaaaaggttctaagatcatatcagcagccagggcct

SEQ ID NO: 408105 - DNA, 140 bp, Artificial Sequence
  Synthetic
atacgccatgctgggtctcctaataatactatcgacaacagtgacatgaagggagaaataaaaaattgttctttcaatacaaccacagaaataatagataagagacagaaagcttattcacgtacttgggagtcggccat

SEQ ID NO: 408106 - DNA, 140 bp, Artificial Sequence
  Synthetic
atggccgactcccaagtacgtgaataagctttctgtctcttatctattatttctgtggttgtattgaaagaacaattttttatttctcccttcatgtcactgttgtcgatagtattattaggagacccagcatggcgtat

SEQ ID NO: 408107 - DNA, 140 bp, Artificial Sequence
  Synthetic
atacgccatgctgggtctccaaggatcctcctcctttagtttccctcaaatcactctttggcaacgaccccttgtcacagtaaaaataggaggacagctgaaagaagctctattagataccgtacttgggagtcggccat

SEQ ID NO: 408108 - DNA, 140 bp, Artificial Sequence
  Synthetic
atggccgactcccaagtacggtatctaatagagcttctttcagctgtcctcctatttttactgtgacaaggggtcgttgccaaagagtgatttgagggaaactaaaggaggaggatccttggagacccagcatggcgtat

SEQ ID NO: 408109 - DNA, 140 bp, Artificial Sequence
  Synthetic
atacgccatgctgggtctcctcataccctcctctatggaaattatggtaccagttagagaaaggacccatagtaggagcagagaccttttatgtagatgggcagccaatagggaaactaacgtacttgggagtcggccat

SEQ ID NO: 408110 - DNA, 140 bp, Artificial Sequence
  Synthetic
atggccgactcccaagtacgttagtttccctattggctgcccatctacataaaaggtctctgctcctactatgggtcctttctctaactggtaccataatttccatagaggagggtatgaggagacccagcatggcgtat

SEQ ID NO: 408111 - DNA, 140 bp, Artificial Sequence
  Synthetic
atacgccatgctgggtctccgggataataattagatctgaaaatctgacagacaatgtcaaaacaataatagtacaccttaatgaatctatagaaattgtgtgtacaagacccaacaatacgtacttgggagtcggccat

SEQ ID NO: 408112 - DNA, 140 bp, Artificial Sequence
  Synthetic
atggccgactcccaagtacgtattgttgggtcttgtacacacaatttctatagattcattaaggtgtactattattgttttgacattgtctgtcagattttcagatctaattattatcccggagacccagcatggcgtat

SEQ ID NO: 408113 - DNA, 140 bp, Artificial Sequence
  Synthetic
aggccctggctgctgatatgagccttgcaggattcaggatcagaagtaagtatagtaacagactcacaatatgcattaggaatcattcaggcacaaccagataagagtgaatcagagttagaccttttgggacagcggtg

SEQ ID NO: 408114 - DNA, 140 bp, Artificial Sequence
  Synthetic
caccgctgtcccaaaaggtctaactctgattcactcttatctggttgtgcctgaatgattcctaatgcatattgtgagtctgttactatacttacttctgatcctgaatcctgcaaggctcatatcagcagccagggcct

SEQ ID NO: 408115 - DNA, 140 bp, Artificial Sequence
  Synthetic
aggccctggctgctgatatgctaataaaacaatagtctttaagtcatcctcaggaggggacctagaaattacaacacatagttttaattgtagaggagaatttttctattgcaatacaacgaccttttgggacagcggtg

SEQ ID NO: 408116 - DNA, 140 bp, Artificial Sequence
  Synthetic
caccgctgtcccaaaaggtcgttgtattgcaatagaaaaattctcctctacaattaaaactatgtgttgtaatttctaggtcccctcctgaggatgacttaaagactattgttttattagcatatcagcagccagggcct

SEQ ID NO: 408117 - DNA, 140 bp, Artificial Sequence
  Synthetic
aggccctggctgctgatatgaatgagaccccaggagtgagataccagtacaatgtcctcccgcaagggtggaaaggctcaccagccatatttcagagttcaatgataaagattctagaacgaccttttgggacagcggtg

SEQ ID NO: 408118 - DNA, 140 bp, Artificial Sequence
  Synthetic
caccgctgtcccaaaaggtcgttctagaatctttatcattgaactctgaaatatggctggtgagcctttccacccttgcgggaggacattgtactggtatctcactcctggggtctcattcatatcagcagccagggcct

SEQ ID NO: 408119 - DNA, 140 bp, Artificial Sequence
  Synthetic
atacgccatgctgggtctccagggtgcaaatgctactggagaaatgaaaaattgcactttcaatataaccacagaagtaagagataaaagtaaaaaggaaagtgcacttttttataaactcgtacttgggagtcggccat

SEQ ID NO: 408120 - DNA, 140 bp, Artificial Sequence
  Synthetic
atggccgactcccaagtacgagtttataaaaaagtgcactttcctttttacttttatctcttacttctgtggttatattgaaagtgcaatttttcatttctccagtagcatttgcaccctggagacccagcatggcgtat

SEQ ID NO: 408121 - DNA, 140 bp, Artificial Sequence
  Synthetic
atacgccatgctgggtctcctacacatcccgctaggaaacgctagactggtagtgaaaacatattggggtctgcatacaggagaaagagaatggcatttgggtcatggagtctccatagacgtacttgggagtcggccat

SEQ ID NO: 408122 - DNA, 140 bp, Artificial Sequence
  Synthetic
atggccgactcccaagtacgtctatggagactccatgacccaaatgccattctctttctcctgtatgcagaccccaatatgttttcactaccagtctagcgtttcctagcgggatgtgtaggagacccagcatggcgtat

SEQ ID NO: 408123 - DNA, 140 bp, Artificial Sequence
  Synthetic
aggccctggctgctgatatgacacaaccaggtaggatctttacaatatttggcactaactgcattaataacaccaaaaaagacaaaaccacctttgcctagtgttaggaagctgacagaagaccttttgggacagcggtg

SEQ ID NO: 408124 - DNA, 140 bp, Artificial Sequence
  Synthetic
caccgctgtcccaaaaggtcttctgtcagcttcctaacactaggcaaaggtggttttgtcttttttggtgttattaatgcagttagtgccaaatattgtaaagatcctacctggttgtgtcatatcagcagccagggcct

SEQ ID NO: 408125 - DNA, 140 bp, Artificial Sequence
  Synthetic
aggccctggctgctgatatgaatgaatgggcattagagctcttagaggagctcaagagtgaagctgttagacactttcctagggtttggcttcatagcctaggacaacatatctatgaaagaccttttgggacagcggtg

SEQ ID NO: 408126 - DNA, 140 bp, Artificial Sequence
  Synthetic
caccgctgtcccaaaaggtctttcatagatatgttgtcctaggctatgaagccaaaccctaggaaagtgtctaacagcttcactcttgagctcctctaagagctctaatgcccattcattcatatcagcagccagggcct

SEQ ID NO: 408127 - DNA, 140 bp, Artificial Sequence
  Synthetic
aggccctggctgctgatatgatatttaatcaatcctcaggaggggatctagaaattacaacacatagctttaattgtagaggagaatttttctattgcaatacatcaggcctgtttaatggaccttttgggacagcggtg

SEQ ID NO: 408128 - DNA, 140 bp, Artificial Sequence
  Synthetic
caccgctgtcccaaaaggtccattaaacaggcctgatgtattgcaatagaaaaattctcctctacaattaaagctatgtgttgtaatttctagatcccctcctgaggattgattaaatatcatatcagcagccagggcct

SEQ ID NO: 408129 - DNA, 140 bp, Artificial Sequence
  Synthetic
aggccctggctgctgatatgggttaatcaaaagaattagggaaagagcagaagacagtggcaatgagagcgagggggatacagaggaattgtcaaaagtggtggatatggggcatcttaggaccttttgggacagcggtg

SEQ ID NO: 408130 - DNA, 140 bp, Artificial Sequence
  Synthetic
caccgctgtcccaaaaggtcctaagatgccccatatccaccacttttgacaattcctctgtatccccctcgctctcattgccactgtcttctgctctttccctaattcttttgattaacccatatcagcagccagggcct

SEQ ID NO: 408131 - DNA, 140 bp, Artificial Sequence
  Synthetic
aggccctggctgctgatatgtagcaactctctattgtgtacatgaaaggatagatgtacgagacaccaaggaagccttagacaagatagaggaagaacaaaacaaatgtcagcaaaaaacgaccttttgggacagcggtg

SEQ ID NO: 408132 - DNA, 140 bp, Artificial Sequence
  Synthetic
caccgctgtcccaaaaggtcgttttttgctgacatttgttttgttcttcctctatcttgtctaaggcttccttggtgtctcgtacatctatcctttcatgtacacaatagagagttgctacatatcagcagccagggcct

SEQ ID NO: 408133 - DNA, 140 bp, Artificial Sequence
  Synthetic
aggccctggctgctgatatgcaagaggcgaggggcggcgactggtgagtacgccaaaaattttgactagcggaggctagaaggagagagatgggtgcgagagcgtcagtattaagcgggggaccttttgggacagcggtg

SEQ ID NO: 408134 - DNA, 140 bp, Artificial Sequence
  Synthetic
caccgctgtcccaaaaggtcccccgcttaatactgacgctctcgcacccatctctctccttctagcctccgctagtcaaaatttttggcgtactcaccagtcgccgcccctcgcctcttgcatatcagcagccagggcct

SEQ ID NO: 408135 - DNA, 140 bp, Artificial Sequence
  Synthetic
aggccctggctgctgatatgtttaacatgtggaagaataatatggtagagcagatgcatacagacataatcagtctatgggaccaaggcctaaagccatgtgtaaagttaacccctctctgaccttttgggacagcggtg

SEQ ID NO: 408136 - DNA, 140 bp, Artificial Sequence
  Synthetic
caccgctgtcccaaaaggtcagagaggggttaactttacacatggctttaggccttggtcccatagactgattatgtctgtatgcatctgctctaccatattattcttccacatgttaaacatatcagcagccagggcct

SEQ ID NO: 408137 - DNA, 140 bp, Artificial Sequence
  Synthetic
atacgccatgctgggtctccaatatcaccgagagcatgagaggagaaataaaaaactgctctttcaatgtgaccacagtattaagggataagagtcagaaagtacattcgcttttttatacgtacttgggagtcggccat

SEQ ID NO: 408138 - DNA, 140 bp, Artificial Sequence
  Synthetic
atggccgactcccaagtacgtataaaaaagcgaatgtactttctgactcttatcccttaatactgtggtcacattgaaagagcagttttttatttctcctctcatgctctcggtgatattggagacccagcatggcgtat

SEQ ID NO: 408139 - DNA, 140 bp, Artificial Sequence
  Synthetic
aggccctggctgctgatatggtgtccaaaggtaacctttgagccaattcccatacattattgtgccccagctggatttgcgattctaaaatgcaatgataagaagttcaatgggacgggtgaccttttgggacagcggtg

SEQ ID NO: 408140 - DNA, 140 bp, Artificial Sequence
  Synthetic
caccgctgtcccaaaaggtcacccgtcccattgaacttcttatcattgcattttagaatcgcaaatccagctggggcacaataatgtatgggaattggctcaaaggttacctttggacaccatatcagcagccagggcct

SEQ ID NO: 408141 - DNA, 140 bp, Artificial Sequence
  Synthetic
aggccctggctgctgatatgactgctgttaaatggcagtctagcagaaaaagagataacaattagatccgaaaatatcacagacaatgctaaaaacatactagtacaatttgacacacctgaccttttgggacagcggtg

SEQ ID NO: 408142 - DNA, 140 bp, Artificial Sequence
  Synthetic
caccgctgtcccaaaaggtcaggtgtgtcaaattgtactagtatgtttttagcattgtctgtgatattttcggatctaattgttatctctttttctgctagactgccatttaacagcagtcatatcagcagccagggcct

SEQ ID NO: 408143 - DNA, 140 bp, Artificial Sequence
  Synthetic
atacgccatgctgggtctccaatgggggccaaatggtcaaaaagcagtatagttggatggcccgctgtaagagagagaataagaagagctagtccagcagcagagggagtaggagcagcacgtacttgggagtcggccat

SEQ ID NO: 408144 - DNA, 140 bp, Artificial Sequence
  Synthetic
atggccgactcccaagtacgtgctgctcctactccctctgctgctggactagctcttcttattctctctcttacagcgggccatccaactatactgctttttgaccatttggcccccattggagacccagcatggcgtat

SEQ ID NO: 408145 - DNA, 140 bp, Artificial Sequence
  Synthetic
atacgccatgctgggtctcctataggaccaggacaagcattctttaaaatgggtggcataacaggggatataagaaaagcatattgtgagattaataaaacagagtggaatgcaactctgcgtacttgggagtcggccat

SEQ ID NO: 408146 - DNA, 140 bp, Artificial Sequence
  Synthetic
atggccgactcccaagtacgcagagttgcattccactctgttttattaatctcacaatatgcttttcttatatcccctgttatgccacccattttaaagaatgcttgtcctggtcctataggagacccagcatggcgtat

SEQ ID NO: 408147 - DNA, 140 bp, Artificial Sequence
  Synthetic
aggccctggctgctgatatgattgtggaacttctgggacgcagggggtgggagacactcaagtattggtggaacatcctgcagtattggggtcaggagctaaagaatagtgctattagctgaccttttgggacagcggtg

SEQ ID NO: 408148 - DNA, 140 bp, Artificial Sequence
  Synthetic
caccgctgtcccaaaaggtcagctaatagcactattctttagctcctgaccccaatactgcaggatgttccaccaatacttgagtgtctcccaccccctgcgtcccagaagttccacaatcatatcagcagccagggcct

SEQ ID NO: 408149 - DNA, 140 bp, Artificial Sequence
  Synthetic
atacgccatgctgggtctccatgcagaataaaacaaattataaacatgtggcagggagtaggaaaagcaatatatgcccctcccattgcaggaataatcaattgtacatcaaatattacacgtacttgggagtcggccat

SEQ ID NO: 408150 - DNA, 140 bp, Artificial Sequence
  Synthetic
atggccgactcccaagtacgtgtaatatttgatgtacaattgattattcctgcaatgggaggggcatatattgcttttcctactccctgccacatgtttataatttgttttattctgcatggagacccagcatggcgtat

SEQ ID NO: 408151 - DNA, 140 bp, Artificial Sequence
  Synthetic
aggccctggctgctgatatgcaatataactctcccatgcagaataaagcaaattataaatatgtggcagagagtaggacaagcaatgtatgccccgcccatccaaggggtaataaggtgtgaccttttgggacagcggtg

SEQ ID NO: 408152 - DNA, 140 bp, Artificial Sequence
  Synthetic
caccgctgtcccaaaaggtcacaccttattaccccttggatgggcggggcatacattgcttgtcctactctctgccacatatttataatttgctttattctgcatgggagagttatattgcatatcagcagccagggcct

SEQ ID NO: 408153 - DNA, 140 bp, Artificial Sequence
  Synthetic
atacgccatgctgggtctccaagaagagtgggaataaatggcctgctgtaagggaaagaatgagacaaactgagccagcagcagagggggtgggagcagtgtctcaagacctggcaaaaccgtacttgggagtcggccat

SEQ ID NO: 408154 - DNA, 140 bp, Artificial Sequence
  Synthetic
atggccgactcccaagtacggttttgccaggtcttgagacactgctcccaccccctctgctgctggctcagtttgtctcattctttcccttacagcaggccatttattcccactcttcttggagacccagcatggcgtat

SEQ ID NO: 408155 - DNA, 140 bp, Artificial Sequence
  Synthetic
aggccctggctgctgatatggaggaggtgggttttccagttagacctcaggtacctttaagaccaatgacttacaagggagctttagacattagccactttttaaaagaaaaggggggacgaccttttgggacagcggtg

SEQ ID NO: 408156 - DNA, 140 bp, Artificial Sequence
  Synthetic
caccgctgtcccaaaaggtcgtccccccttttcttttaaaaagtggctaatgtctaaagctcccttgtaagtcattggtcttaaaggtacctgaggtctaactggaaaacccacctcctccatatcagcagccagggcct

SEQ ID NO: 408157 - DNA, 140 bp, Artificial Sequence
  Synthetic
atacgccatgctgggtctccaattgacaattacacagatttaatatacagcttgcttgaggaaacgcaaaaccagcaagaaaggaatgaacaagaattattgcaataggataaataggcacgtacttgggagtcggccat

SEQ ID NO: 408158 - DNA, 140 bp, Artificial Sequence
  Synthetic
atggccgactcccaagtacgtgcctatttatcctattgcaataattcttgttcattcctttcttgctggttttgcgtttcctcaagcaagctgtatattaaatctgtgtaattgtcaattggagacccagcatggcgtat

SEQ ID NO: 408159 - DNA, 140 bp, Artificial Sequence
  Synthetic
aggccctggctgctgatatgaccagcaagaaaggaatgaacaagaattattgcaataggataaataggcaagtttgtagaattagtttagcataacaaactggctgtggtacataaaaatgaccttttgggacagcggtg

SEQ ID NO: 408160 - DNA, 140 bp, Artificial Sequence
  Synthetic
caccgctgtcccaaaaggtcatttttatgtaccacagccagtttgttatgctaaactaattctacaaacttgcctatttatcctattgcaataattcttgttcattcctttcttgctggtcatatcagcagccagggcct

SEQ ID NO: 408161 - DNA, 140 bp, Artificial Sequence
  Synthetic
atacgccatgctgggtctcccaccaatgtgccctggaactctagttggagtaataaatccttggataagatatgggacaaaatgacctggctagactgggataaagaaattagcaattaccgtacttgggagtcggccat

SEQ ID NO: 408162 - DNA, 140 bp, Artificial Sequence
  Synthetic
atggccgactcccaagtacggtaattgctaatttctttatcccagtctagccaggtcattttgtcccatatcttatccaaggatttattactccaactagagttccagggcacattggtgggagacccagcatggcgtat

SEQ ID NO: 408163 - DNA, 140 bp, Artificial Sequence
  Synthetic
atacgccatgctgggtctcctgatttctttagtgaatagagttaggcaaagatattcacctatgtcgtttcagaccctcttcccagccccgaggggaccacccgacaggcccgaaggaatcgtacttgggagtcggccat

SEQ ID NO: 408164 - DNA, 140 bp, Artificial Sequence
  Synthetic
atggccgactcccaagtacgattccttcgggcctgtcgggtggtcccctcggggctgggaagagggtctgaaacgacataggtgaatatctttgcctaactctattcactaaagaaatcaggagacccagcatggcgtat

SEQ ID NO: 408165 - DNA, 140 bp, Artificial Sequence
  Synthetic
atacgccatgctgggtctccacataataggagatataagaaaagcatattgtgagattaatggaacaaaatggaatgaagttttaaaacaggtagctggaaaattaaaagagcactttaacgtacttgggagtcggccat

SEQ ID NO: 408166 - DNA, 140 bp, Artificial Sequence
  Synthetic
atggccgactcccaagtacgttaaagtgctcttttaattttccagctacctgttttaaaacttcattccattttgttccattaatctcacaatatgcttttcttatatctcctattatgtggagacccagcatggcgtat

SEQ ID NO: 408167 - DNA, 140 bp, Artificial Sequence
  Synthetic
aggccctggctgctgatatgagctaccaccgcttgagagacttaatcttaattgcaacgaggattgtggaacttctgggacgcagggggtgggaagcaaccaaatatctgtggaatctccgaccttttgggacagcggtg

SEQ ID NO: 408168 - DNA, 140 bp, Artificial Sequence
  Synthetic
caccgctgtcccaaaaggtcggagattccacagatatttggttgcttcccaccccctgcgtcccagaagttccacaatcctcgttgcaattaagattaagtctctcaagcggtggtagctcatatcagcagccagggcct

SEQ ID NO: 408169 - DNA, 140 bp, Artificial Sequence
  Synthetic
aggccctggctgctgatatgtaataagacaataatctttaaaccaccctcaggaggagatctagaaattacaatgcatcattttaattgtagaggggaatttttctattgcaatacaacagaccttttgggacagcggtg

SEQ ID NO: 408170 - DNA, 140 bp, Artificial Sequence
  Synthetic
caccgctgtcccaaaaggtctgttgtattgcaatagaaaaattcccctctacaattaaaatgatgcattgtaatttctagatctcctcctgagggtggtttaaagattattgtcttattacatatcagcagccagggcct

SEQ ID NO: 408171 - DNA, 140 bp, Artificial Sequence
  Synthetic
aggccctggctgctgatatgacaaagagctgttagagctattcttaacatacccagacgaataagacagggcttggaaagggctttactataaaatgggtggcaaatggtcaaaaagtaggaccttttgggacagcggtg

SEQ ID NO: 408172 - DNA, 140 bp, Artificial Sequence
  Synthetic
caccgctgtcccaaaaggtcctactttttgaccatttgccacccattttatagtaaagccctttccaagccctgtcttattcgtctgggtatgttaagaatagctctaacagctctttgtcatatcagcagccagggcct

SEQ ID NO: 408173 - DNA, 140 bp, Artificial Sequence
  Synthetic
aggccctggctgctgatatgctcaagtatctgtggaatctcctggtgtattggggtcgggaactaagaattagtgctattagtttgcttgataccatagcaatagccgtagcgggttggagaccttttgggacagcggtg

SEQ ID NO: 408174 - DNA, 140 bp, Artificial Sequence
  Synthetic
caccgctgtcccaaaaggtctccaacccgctacggctattgctatggtatcaagcaaactaatagcactaattcttagttcccgaccccaatacaccaggagattccacagatacttgagcatatcagcagccagggcct

SEQ ID NO: 408175 - DNA, 140 bp, Artificial Sequence
  Synthetic
atacgccatgctgggtctccgaaaaacatggggcaataacaagtagtaacacagcacagaataatcctgactgtgcctggctggaggcacaagaagaaaatgaggaagtaggctttccagcgtacttgggagtcggccat

SEQ ID NO: 408176 - DNA, 140 bp, Artificial Sequence
  Synthetic
atggccgactcccaagtacgctggaaagcctacttcctcattttcttcttgtgcctccagccaggcacagtcaggattattctgtgctgtgttactacttgttattgccccatgtttttcggagacccagcatggcgtat

SEQ ID NO: 408177 - DNA, 140 bp, Artificial Sequence
  Synthetic
aggccctggctgctgatatgagcagcagcaggagtaggagcagtatctcaagatttagataaacatggagcagtcacaagcagcaatgtaaatcaccctagctgcgcctggctggaggcagaccttttgggacagcggtg

SEQ ID NO: 408178 - DNA, 140 bp, Artificial Sequence
  Synthetic
caccgctgtcccaaaaggtctgcctccagccaggcgcagctagggtgatttacattgctgcttgtgactgctccatgtttatctaaatcttgagatactgctcctactcctgctgctgctcatatcagcagccagggcct

SEQ ID NO: 408179 - DNA, 140 bp, Artificial Sequence
  Synthetic
aggccctggctgctgatatgaagaacttaaatcattatttaatacagtagcagtcctctattgtgtacatcaaaggatagaggtaaaagacaccaaggaagctgtagataaaatagaggagaccttttgggacagcggtg

SEQ ID NO: 408180 - DNA, 140 bp, Artificial Sequence
  Synthetic
caccgctgtcccaaaaggtctcctctattttatctacagcttccttggtgtcttttacctctatcctttgatgtacacaatagaggactgctactgtattaaataatgatttaagttcttcatatcagcagccagggcct

SEQ ID NO: 408181 - DNA, 140 bp, Artificial Sequence
  Synthetic
aggccctggctgctgatatgagacgggggtgggaaggcctcaaatatctggggaatcttctgttatattggggtcaggaactaaaaattagtgctatttctttgcttgatgctacagcaagaccttttgggacagcggtg

SEQ ID NO: 408182 - DNA, 140 bp, Artificial Sequence
  Synthetic
caccgctgtcccaaaaggtcttgctgtagcatcaagcaaagaaatagcactaatttttagttcctgaccccaatataacagaagattccccagatatttgaggccttcccacccccgtctcatatcagcagccagggcct

SEQ ID NO: 408183 - DNA, 140 bp, Artificial Sequence
  Synthetic
aggccctggctgctgatatggagacaggctaattttttagggaaaatttggccttccaacaagggaaggccggggaattttcctcagagcagaccagagccaacagccccaccagcagaagaccttttgggacagcggtg

SEQ ID NO: 408184 - DNA, 140 bp, Artificial Sequence
  Synthetic
caccgctgtcccaaaaggtcttctgctggtggggctgttggctctggtctgctctgaggaaaattccccggccttcccttgttggaaggccaaattttccctaaaaaattagcctgtctccatatcagcagccagggcct

SEQ ID NO: 408185 - DNA, 140 bp, Artificial Sequence
  Synthetic
aggccctggctgctgatatgggaagttcaattaggaataccacatccagcgggcctaaaaaagaaaaaatcagtaacagtactagatgtgggggacgcatatttttcagttcctttagatgaccttttgggacagcggtg

SEQ ID NO: 408186 - DNA, 140 bp, Artificial Sequence
  Synthetic
caccgctgtcccaaaaggtcatctaaaggaactgaaaaatatgcgtcccccacatctagtactgttactgattttttcttttttaggcccgctggatgtggtattcctaattgaacttcccatatcagcagccagggcct

SEQ ID NO: 408187 - DNA, 140 bp, Artificial Sequence
  Synthetic
aggccctggctgctgatatgactccttgtaataagtgctattgtaaacactgtagctaccattgtctagtttgctttcagacaaaaggcttaggcatttcctatggcaggaagaagcggagaccttttgggacagcggtg

SEQ ID NO: 408188 - DNA, 140 bp, Artificial Sequence
  Synthetic
caccgctgtcccaaaaggtctccgcttcttcctgccataggaaatgcctaagccttttgtctgaaagcaaactagacaatggtagctacagtgtttacaatagcacttattacaaggagtcatatcagcagccagggcct

SEQ ID NO: 408189 - DNA, 140 bp, Artificial Sequence
  Synthetic
aggccctggctgctgatatgtgtagaaattatgtgtacaagacccggcaataatacaaggagaagtataaggataggaccaggacaagcattctatacaaataaaataataggagacatagaccttttgggacagcggtg

SEQ ID NO: 408190 - DNA, 140 bp, Artificial Sequence
  Synthetic
caccgctgtcccaaaaggtctatgtctcctattattttatttgtatagaatgcttgtcctggtcctatccttatacttctccttgtattattgccgggtcttgtacacataatttctacacatatcagcagccagggcct

SEQ ID NO: 408191 - DNA, 140 bp, Artificial Sequence
  Synthetic
atacgccatgctgggtctccggatggagacatgagaaactgctctttcaatatttccacagatgtggtagataaggtgaagaaagaatatgcatctttttataaacttgatatagtacaacgtacttgggagtcggccat

SEQ ID NO: 408192 - DNA, 140 bp, Artificial Sequence
  Synthetic
atggccgactcccaagtacgttgtactatatcaagtttataaaaagatgcatattctttcttcaccttatctaccacatctgtggaaatattgaaagagcagtttctcatgtctccatccggagacccagcatggcgtat

SEQ ID NO: 408193 - DNA, 140 bp, Artificial Sequence
  Synthetic
aggccctggctgctgatatgtttatcaagagccatttaaaaatctgaaaacaggaaaatatgcaagaatgaggggtgcccacactaatgatgtaaaacaattaacagaggcagtgcaaaagaccttttgggacagcggtg

SEQ ID NO: 408194 - DNA, 140 bp, Artificial Sequence
  Synthetic
caccgctgtcccaaaaggtcttttgcactgcctctgttaattgttttacatcattagtgtgggcacccctcattcttgcatattttcctgttttcagatttttaaatggctcttgataaacatatcagcagccagggcct

SEQ ID NO: 408195 - DNA, 140 bp, Artificial Sequence
  Synthetic
aggccctggctgctgatatgaaaactgctcttttaatatcaccacaagcagaagaaataaattgcggaaagaatatgcacttttttataagcttgatatagtaccaatagataatgataagaccttttgggacagcggtg

SEQ ID NO: 408196 - DNA, 140 bp, Artificial Sequence
  Synthetic
caccgctgtcccaaaaggtcttatcattatctattggtactatatcaagcttataaaaaagtgcatattctttccgcaatttatttcttctgcttgtggtgatattaaaagagcagttttcatatcagcagccagggcct

SEQ ID NO: 408197 - DNA, 140 bp, Artificial Sequence
  Synthetic
atacgccatgctgggtctcctcataagtaccagcacataaaaaaattagaagaaatgaacaagtagataaattagtaagtaatagaattaaaaaagtactgtttctagatagaatagatacgtacttgggagtcggccat

SEQ ID NO: 408198 - DNA, 140 bp, Artificial Sequence
  Synthetic
atggccgactcccaagtacgtatctattctatctagaaacagtacttttttaattctattacttactaatttatctacttgttcatttcttctaatttttttatgtgctggtacttatgaggagacccagcatggcgtat

SEQ ID NO: 408199 - DNA, 140 bp, Artificial Sequence
  Synthetic
aggccctggctgctgatatgattatggtaccagttagagaaagaacccatagtaggagcagaaactttctatgtagatggggcagctaatagggagactaaattaggaaaagcaggatatgaccttttgggacagcggtg

SEQ ID NO: 408200 - DNA, 140 bp, Artificial Sequence
  Synthetic
caccgctgtcccaaaaggtcatatcctgcttttcctaatttagtctccctattagctgccccatctacatagaaagtttctgctcctactatgggttctttctctaactggtaccataatcatatcagcagccagggcct

SEQ ID NO: 408201 - DNA, 140 bp, Artificial Sequence
  Synthetic
aggccctggctgctgatatgatggggtacctgtatggaaagaagcaaaaactactctattttgtgcatcagatgctaaagcatatgaggaagaggtacataatgtctgggctacacatgcgaccttttgggacagcggtg

SEQ ID NO: 408202 - DNA, 140 bp, Artificial Sequence
  Synthetic
caccgctgtcccaaaaggtcgcatgtgtagcccagacattatgtacctcttcctcatatgctttagcatctgatgcacaaaatagagtagtttttgcttctttccatacaggtaccccatcatatcagcagccagggcct

SEQ ID NO: 408203 - DNA, 140 bp, Artificial Sequence
  Synthetic
atacgccatgctgggtctccctaatacaaatgttaccgttgataaaaatatggaaggagaaatacaaaactgttctttcaatataaccacagaattgggagataagagacggaaagaaaacgtacttgggagtcggccat

SEQ ID NO: 408204 - DNA, 140 bp, Artificial Sequence
  Synthetic
atggccgactcccaagtacgttttctttccgtctcttatctcccaattctgtggttatattgaaagaacagttttgtatttctccttccatatttttatcaacggtaacatttgtattagggagacccagcatggcgtat

SEQ ID NO: 408205 - DNA, 140 bp, Artificial Sequence
  Synthetic
atacgccatgctgggtctcctgcactgattgggataatgctactcttgcaaatatgacgggagaaataaaaaactgcactttcaatatcaccacaaccatgagagataaggtgcaaaaagcgtacttgggagtcggccat

SEQ ID NO: 408206 - DNA, 140 bp, Artificial Sequence
  Synthetic
atggccgactcccaagtacgctttttgcaccttatctctcatggttgtggtgatattgaaagtgcagttttttatttctcccgtcatatttgcaagagtagcattatcccaatcagtgcaggagacccagcatggcgtat

SEQ ID NO: 408207 - DNA, 140 bp, Artificial Sequence
  Synthetic
aggccctggctgctgatatgaaaatgttgctatcattgccaagcttgctttctgaacaaaggcttaggcatctcctatggcaggaagaagcggagacagcgacgaagaactcctcagagcgaccttttgggacagcggtg

SEQ ID NO: 408208 - DNA, 140 bp, Artificial Sequence
  Synthetic
caccgctgtcccaaaaggtcgctctgaggagttcttcgtcgctgtctccgcttcttcctgccataggagatgcctaagcctttgttcagaaagcaagcttggcaatgatagcaacattttcatatcagcagccagggcct

SEQ ID NO: 408209 - DNA, 140 bp, Artificial Sequence
  Synthetic
atacgccatgctgggtctccaagacaaagtatacatatagcaccaggaagagcattttatgcaacaggtgcaataacaggaaatataagaaaagcacattgtaacattagtatagtaagtcgtacttgggagtcggccat

SEQ ID NO: 408210 - DNA, 140 bp, Artificial Sequence
  Synthetic
atggccgactcccaagtacgacttactatactaatgttacaatgtgcttttcttatatttcctgttattgcacctgttgcataaaatgctcttcctggtgctatatgtatactttgtcttggagacccagcatggcgtat

SEQ ID NO: 408211 - DNA, 140 bp, Artificial Sequence
  Synthetic
atacgccatgctgggtctccaataaggatcatcaaactcctataccaaagcagtaagtattagtagttacatgtaatgtctcctttgtatatctgggcaatagtaggactggtagtggcacgtacttgggagtcggccat

SEQ ID NO: 408212 - DNA, 140 bp, Artificial Sequence
  Synthetic
atggccgactcccaagtacgtgccactaccagtcctactattgcccagatatacaaaggagacattacatgtaactactaatacttactgctttggtataggagtttgatgatccttattggagacccagcatggcgtat

SEQ ID NO: 408213 - DNA, 140 bp, Artificial Sequence
  Synthetic
atacgccatgctgggtctccaaataaaacaatagcctttaaaaattcctcaggaggagacccagaaattgtaatgcacaggtttaattgcggaggggaatttttctactgtaatacaacacgtacttgggagtcggccat

SEQ ID NO: 408214 - DNA, 140 bp, Artificial Sequence
  Synthetic
atggccgactcccaagtacgtgttgtattacagtagaaaaattcccctccgcaattaaacctgtgcattacaatttctgggtctcctcctgaggaatttttaaaggctattgttttatttggagacccagcatggcgtat

SEQ ID NO: 408215 - DNA, 140 bp, Artificial Sequence
  Synthetic
aggccctggctgctgatatgagtgctaaagcaaagaaaaatagacaggctaattgaaagaataagagaaagagcagaagacagtggcaatgagagcgaaggggatacagaggaactctcagaccttttgggacagcggtg

SEQ ID NO: 408216 - DNA, 140 bp, Artificial Sequence
  Synthetic
caccgctgtcccaaaaggtctgagagttcctctgtatccccttcgctctcattgccactgtcttctgctctttctcttattctttcaattagcctgtctatttttctttgctttagcactcatatcagcagccagggcct

SEQ ID NO: 408217 - DNA, 140 bp, Artificial Sequence
  Synthetic
aggccctggctgctgatatgaatggcagtctagcagaaggagagatagtaattagatctgaaaatttcacggacaatgctaaaaccataatagtacagctgaatgaatctgtagtaattagaccttttgggacagcggtg

SEQ ID NO: 408218 - DNA, 140 bp, Artificial Sequence
  Synthetic
caccgctgtcccaaaaggtctaattactacagattcattcagctgtactattatggttttagcattgtccgtgaaattttcagatctaattactatctctccttctgctagactgccattcatatcagcagccagggcct

SEQ ID NO: 408219 - DNA, 140 bp, Artificial Sequence
  Synthetic
aggccctggctgctgatatgaaaatggaatgaagttttaaaacaggtagctggaaaattaaaagagcactttaataataagacaataatctttaaaccaccctcaggaggagatctagaagaccttttgggacagcggtg

SEQ ID NO: 408220 - DNA, 140 bp, Artificial Sequence
  Synthetic
caccgctgtcccaaaaggtcttctagatctcctcctgagggtggtttaaagattattgtcttattattaaagtgctcttttaattttccagctacctgttttaaaacttcattccattttcatatcagcagccagggcct

SEQ ID NO: 408221 - DNA, 140 bp, Artificial Sequence
  Synthetic
aggccctggctgctgatatggtggcaatgagagtgaaggagaccaggaagaattatcggcacttgtggagatggggcaccatgctccttgggatgttaatgatttgtagtgctgcagaacgaccttttgggacagcggtg

SEQ ID NO: 408222 - DNA, 140 bp, Artificial Sequence
  Synthetic
caccgctgtcccaaaaggtcgttctgcagcactacaaatcattaacatcccaaggagcatggtgccccatctccacaagtgccgataattcttcctggtctccttcactctcattgccaccatatcagcagccagggcct

SEQ ID NO: 408223 - DNA, 140 bp, Artificial Sequence
  Synthetic
  misc_feature (53)..(53): n is a, c, g, or t
atacgccatgctgggtctcctaaactgtggccataatgacaccctcactaatnacactgcccccgtcaataacaccatgagagaagaagtaagaaactgctcttacaatatgaccacagacgtacttgggagtcggccat

SEQ ID NO: 408224 - DNA, 140 bp, Artificial Sequence
  Synthetic
  misc_feature (88)..(88): n is a, c, g, or t
atggccgactcccaagtacgtctgtggtcatattgtaagagcagtttcttacttcttctctcatggtgttattgacgggggcagtgtnattagtgagggtgtcattatggccacagtttaggagacccagcatggcgtat

SEQ ID NO: 408225 - DNA, 140 bp, Artificial Sequence
  Synthetic
atacgccatgctgggtctccaaaaatgaaaaactgctctttcaatataaccacagaggtaagagataagacgaggaaagaatatgcacttttttataggcttgatgtagtacaaataaatcgtacttgggagtcggccat

SEQ ID NO: 408226 - DNA, 140 bp, Artificial Sequence
  Synthetic
atggccgactcccaagtacgatttatttgtactacatcaagcctataaaaaagtgcatattctttcctcgtcttatctcttacctctgtggttatattgaaagagcagtttttcatttttggagacccagcatggcgtat

SEQ ID NO: 408227 - DNA, 140 bp, Artificial Sequence
  Synthetic
aggccctggctgctgatatgagataaagttcagaaagaatatgcacttttttataaacttgatgtagtaccaatagataatgataataccagctataggttgataagttgtaacacctcagaccttttgggacagcggtg

SEQ ID NO: 408228 - DNA, 140 bp, Artificial Sequence
  Synthetic
caccgctgtcccaaaaggtctgaggtgttacaacttatcaacctatagctggtattatcattatctattggtactacatcaagtttataaaaaagtgcatattctttctgaactttatctcatatcagcagccagggcct

SEQ ID NO: 408229 - DNA, 140 bp, Artificial Sequence
  Synthetic
aggccctggctgctgatatgaggaacagataggattatagaaataatacaaagaatttgtagagctatctgcaacatacctacaagaataagacagggctttgaagcagctttgcaataagaccttttgggacagcggtg

SEQ ID NO: 408230 - DNA, 140 bp, Artificial Sequence
  Synthetic
caccgctgtcccaaaaggtcttattgcaaagctgcttcaaagccctgtcttattcttgtaggtatgttgcagatagctctacaaattctttgtattatttctataatcctatctgttcctcatatcagcagccagggcct

SEQ ID NO: 408231 - DNA, 140 bp, Artificial Sequence
  Synthetic
aggccctggctgctgatatggggaaagaataagaagaactagtccaacagcagagggagtaggagcagcgtctagagacctagataaacacggggcactaacaactagcaacacagccaggaccttttgggacagcggtg

SEQ ID NO: 408232 - DNA, 140 bp, Artificial Sequence
  Synthetic
caccgctgtcccaaaaggtcctggctgtgttgctagttgttagtgccccgtgtttatctaggtctctagacgctgctcctactccctctgctgttggactagttcttcttattctttccccatatcagcagccagggcct

SEQ ID NO: 408233 - DNA, 140 bp, Artificial Sequence
  Synthetic
aggccctggctgctgatatgctaaaagatcaacagctcctaggaatttggggctgctctggaaaactcatctgcaccactaatgtgccctggaactctagttggagccataataggtctagaccttttgggacagcggtg

SEQ ID NO: 408234 - DNA, 140 bp, Artificial Sequence
  Synthetic
caccgctgtcccaaaaggtctagacctattatggctccaactagagttccagggcacattagtggtgcagatgagttttccagagcagccccaaattcctaggagctgttgatcttttagcatatcagcagccagggcct

SEQ ID NO: 408235 - DNA, 140 bp, Artificial Sequence
  Synthetic
aggccctggctgctgatatgaaagataccatcaatgaagaggctgcagaatgggatagattacatccagtacatgcggggcctgttgcaccaggccaaatgagagaaccaaggggaagtggaccttttgggacagcggtg

SEQ ID NO: 408236 - DNA, 140 bp, Artificial Sequence
  Synthetic
caccgctgtcccaaaaggtccacttccccttggttctctcatttggcctggtgcaacaggccccgcatgtactggatgtaatctatcccattctgcagcctcttcattgatggtatctttcatatcagcagccagggcct

SEQ ID NO: 408237 - DNA, 140 bp, Artificial Sequence
  Synthetic
atacgccatgctgggtctcctctccaatgcagaataaagcaaattataaatctgtggcagagagcaggaaaagcaatatatgcccctcccatccaaggagcaatacagtgtatatcaaaccgtacttgggagtcggccat

SEQ ID NO: 408238 - DNA, 140 bp, Artificial Sequence
  Synthetic
atggccgactcccaagtacggtttgatatacactgtattgctccttggatgggaggggcatatattgcttttcctgctctctgccacagatttataatttgctttattctgcattggagaggagacccagcatggcgtat

SEQ ID NO: 408239 - DNA, 140 bp, Artificial Sequence
  Synthetic
atacgccatgctgggtctccgctgagccaagaatgagacgagctgagccagcagcaggggtgggagcagcatctcgagacctgggaaaacatggggcaatcacaagtagcaatacagcagcgtacttgggagtcggccat

SEQ ID NO: 408240 - DNA, 140 bp, Artificial Sequence
  Synthetic
atggccgactcccaagtacgctgctgtattgctacttgtgattgccccatgttttcccaggtctcgagatgctgctcccacccctgctgctggctcagctcgtctcattcttggctcagcggagacccagcatggcgtat

SEQ ID NO: 408241 - DNA, 140 bp, Artificial Sequence
  Synthetic
atacgccatgctgggtctcctgctctgggaaaatcatctgccccactgctgttccctggaactatacttggagtaataataaatcctatgacgagatatggaaaaacatgacctggctgccgtacttgggagtcggccat

SEQ ID NO: 408242 - DNA, 140 bp, Artificial Sequence
  Synthetic
atggccgactcccaagtacggcagccaggtcatgtttttccatatctcgtcataggatttattattactccaagtatagttccagggaacagcagtggggcagatgattttcccagagcaggagacccagcatggcgtat

SEQ ID NO: 408243 - DNA, 140 bp, Artificial Sequence
  Synthetic
aggccctggctgctgatatggggataacatgacctggatgcagtgggatagagaaattagtaattacacagacacaatatacaggttgcttgaagactcgcaaaaccagcaggaacaaaagaccttttgggacagcggtg

SEQ ID NO: 408244 - DNA, 140 bp, Artificial Sequence
  Synthetic
caccgctgtcccaaaaggtcttttgttcctgctggttttgcgagtcttcaagcaacctgtatattgtgtctgtgtaattactaatttctctatcccactgcatccaggtcatgttatccccatatcagcagccagggcct

SEQ ID NO: 408245 - DNA, 140 bp, Artificial Sequence
  Synthetic
aggccctggctgctgatatgacatacaagagatgagaataggtccaatggcctggtacagcatgggaatagggggaacagcaggaaacagctcaagggcagcttattgcaagtataatgcgaccttttgggacagcggtg

SEQ ID NO: 408246 - DNA, 140 bp, Artificial Sequence
  Synthetic
caccgctgtcccaaaaggtcgcattatacttgcaataagctgcccttgagctgtttcctgctgttccccctattcccatgctgtaccaggccattggacctattctcatctcttgtatgtcatatcagcagccagggcct

SEQ ID NO: 408247 - DNA, 140 bp, Artificial Sequence
  Synthetic
aggccctggctgctgatatgaagaatgaacaagaattattggaattagataagtgggcaagtttgtggaattggtttatcataacaaactggctgtggtatataagattattcataatgagaccttttgggacagcggtg

SEQ ID NO: 408248 - DNA, 140 bp, Artificial Sequence
  Synthetic
caccgctgtcccaaaaggtctcattatgaataatcttatataccacagccagtttgttatgataaaccaattccacaaacttgcccacttatctaattccaataattcttgttcattcttcatatcagcagccagggcct

SEQ ID NO: 408249 - DNA, 140 bp, Artificial Sequence
  Synthetic
atacgccatgctgggtctccaatagtgctattagcttgcttaataccacagcaatagtagtagctgaaggaacagataagattatagaaacagtacaaagagctgttagagctattcttacgtacttgggagtcggccat

SEQ ID NO: 408250 - DNA, 140 bp, Artificial Sequence
  Synthetic
atggccgactcccaagtacgtaagaatagctctaacagctctttgtactgtttctataatcttatctgttccttcagctactactattgctgtggtattaagcaagctaatagcactattggagacccagcatggcgtat

SEQ ID NO: 408251 - DNA, 140 bp, Artificial Sequence
  Synthetic
atacgccatgctgggtctccctggctggacagataggattatagaaataggacaaggaattggtagagctatcctcaacgtacctagaagaatcagacagggcctagaaaggtcgttgttcgtacttgggagtcggccat

SEQ ID NO: 408252 - DNA, 140 bp, Artificial Sequence
  Synthetic
atggccgactcccaagtacgaacaacgacctttctaggccctgtctgattcttctaggtacgttgaggatagctctaccaattccttgtcctatttctataatcctatctgtccagccagggagacccagcatggcgtat

SEQ ID NO: 408253 - DNA, 140 bp, Artificial Sequence
  Synthetic
aggccctggctgctgatatgtatgtagatggagcagctaatagggaaactaaaataggaaaagcagggtatgttactgacagaggaaggcagaaaattgttactctaaatgaaacaacaagaccttttgggacagcggtg

SEQ ID NO: 408254 - DNA, 140 bp, Artificial Sequence
  Synthetic
caccgctgtcccaaaaggtcttgttgtttcatttagagtaacaattttctgccttcctctgtcagtaacataccctgcttttcctattttagtttccctattagctgctccatctacatacatatcagcagccagggcct

SEQ ID NO: 408255 - DNA, 140 bp, Artificial Sequence
  Synthetic
aggccctggctgctgatatggaagaggtaggttttccagtcaaacctcaggtacctttaagaccaatgacttacaaggcagctgtagatcttagccactttttaaaagaaaaggggggacgaccttttgggacagcggtg

SEQ ID NO: 408256 - DNA, 140 bp, Artificial Sequence
  Synthetic
caccgctgtcccaaaaggtcgtccccccttttcttttaaaaagtggctaagatctacagctgccttgtaagtcattggtcttaaaggtacctgaggtttgactggaaaacctacctcttccatatcagcagccagggcct

SEQ ID NO: 408257 - DNA, 140 bp, Artificial Sequence
  Synthetic
atacgccatgctgggtctcccgcatttcctatggcaggaagaagcggagccagcgacgaagagctcctaaaagcagtccggatcatcaaaatcttgtaccaaagcagtaagtatctaaatcgtacttgggagtcggccat

SEQ ID NO: 408258 - DNA, 140 bp, Artificial Sequence
  Synthetic
atggccgactcccaagtacgatttagatacttactgctttggtacaagattttgatgatccggactgcttttaggagctcttcgtcgctggctccgcttcttcctgccataggaaatgcgggagacccagcatggcgtat

SEQ ID NO: 408259 - DNA, 140 bp, Artificial Sequence
  Synthetic
aggccctggctgctgatatgaaccagctattcagacaggatcagaggaaattaaatcattatataatacagtagcaaccctctattgtgtacatgaaaggataaaggtagcagacaccaagaccttttgggacagcggtg

SEQ ID NO: 408260 - DNA, 140 bp, Artificial Sequence
  Synthetic
caccgctgtcccaaaaggtcttggtgtctgctacctttatcctttcatgtacacaatagagggttgctactgtattatataatgatttaatttcctctgatcctgtctgaatagctggttcatatcagcagccagggcct

SEQ ID NO: 408261 - DNA, 140 bp, Artificial Sequence
  Synthetic
aggccctggctgctgatatgggaagctttagacaagatagaggaagaacaaaccaaaagtaagaaaaaggcacagcaagcaacagctgacacaggaaacagcagccaggtcagccaaaatgaccttttgggacagcggtg

SEQ ID NO: 408262 - DNA, 140 bp, Artificial Sequence
  Synthetic
caccgctgtcccaaaaggtcattttggctgacctggctgctgtttcctgtgtcagctgttgcttgctgtgcctttttcttacttttggtttgttcttcctctatcttgtctaaagcttcccatatcagcagccagggcct

SEQ ID NO: 408263 - DNA, 140 bp, Artificial Sequence
  Synthetic
aggccctggctgctgatatgatgacccatcaaaagacttgatagctgaaatacagaaacagggggatgaccaatggacatatcaaatttaccaagaaccattcaaaaatctgaagacagggaccttttgggacagcggtg

SEQ ID NO: 408264 - DNA, 140 bp, Artificial Sequence
  Synthetic
caccgctgtcccaaaaggtccctgtcttcagatttttgaatggttcttggtaaatttgatatgtccattggtcatccccctgtttctgtatttcagctatcaagtcttttgatgggtcatcatatcagcagccagggcct

SEQ ID NO: 408265 - DNA, 140 bp, Artificial Sequence
  Synthetic
aggccctggctgctgatatggattgtaagtccattttaagagcattaggagcaggggctacattagaagaaatgatgacagcatgccagggagtgggaggacccggccataaagcaaggggaccttttgggacagcggtg

SEQ ID NO: 408266 - DNA, 140 bp, Artificial Sequence
  Synthetic
caccgctgtcccaaaaggtccccttgctttatggccgggtcctcccactccctggcatgctgtcatcatttcttctaatgtagcccctgctcctaatgctcttaaaatggacttacaatccatatcagcagccagggcct

SEQ ID NO: 408267 - DNA, 140 bp, Artificial Sequence
  Synthetic
aggccctggctgctgatatggctaattttttagggaaaatttggccttccaacaaaggaaggccagggaacttccttcagagcagaccagagccaacagctccaccagcagagagcttcggaccttttgggacagcggtg

SEQ ID NO: 408268 - DNA, 140 bp, Artificial Sequence
  Synthetic
caccgctgtcccaaaaggtccgaagctctctgctggtggagctgttggctctggtctgctctgaaggaagttccctggccttcctttgttggaaggccaaattttccctaaaaaattagccatatcagcagccagggcct

SEQ ID NO: 408269 - DNA, 140 bp, Artificial Sequence
  Synthetic
aggccctggctgctgatatgtcagtttatgggatcaaagcctaaaaccatgtgtaaagttgaccccactctgtgtcactttaaattgtacaaatgcaagacttaatagtactgcagatgcgaccttttgggacagcggtg

SEQ ID NO: 408270 - DNA, 140 bp, Artificial Sequence
  Synthetic
caccgctgtcccaaaaggtcgcatctgcagtactattaagtcttgcatttgtacaatttaaagtgacacagagtggggtcaactttacacatggttttaggctttgatcccataaactgacatatcagcagccagggcct

SEQ ID NO: 408271 - DNA, 140 bp, Artificial Sequence
  Synthetic
aggccctggctgctgatatgaaatagggcagcatagagcaaaaatagaagagttaagagctcatttattgagctggggatttactacaccagacaaaaagcatcagaaagaacctccattgaccttttgggacagcggtg

SEQ ID NO: 408272 - DNA, 140 bp, Artificial Sequence
  Synthetic
caccgctgtcccaaaaggtcaatggaggttctttctgatgctttttgtctggtgtagtaaatccccagctcaataaatgagctcttaactcttctatttttgctctatgctgccctatttcatatcagcagccagggcct

SEQ ID NO: 408273 - DNA, 140 bp, Artificial Sequence
  Synthetic
aggccctggctgctgatatgacctttcaaccaccctcaggaggagatctagaaattacaatgcatcattttaattgtagaggggaatttttctattgcaatacaacaagactgtttaatagaccttttgggacagcggtg

SEQ ID NO: 408274 - DNA, 140 bp, Artificial Sequence
  Synthetic
caccgctgtcccaaaaggtctattaaacagtcttgttgtattgcaatagaaaaattcccctctacaattaaaatgatgcattgtaatttctagatctcctcctgagggtggttgaaaggtcatatcagcagccagggcct

SEQ ID NO: 408275 - DNA, 140 bp, Artificial Sequence
  Synthetic
atacgccatgctgggtctccatgtcacagatattgataatagcacaattggagaaataaagaactgcactttcaatgtaactacagaattaagagataaggaaaagaaagaaaatgcactcgtacttgggagtcggccat

SEQ ID NO: 408276 - DNA, 140 bp, Artificial Sequence
  Synthetic
atggccgactcccaagtacgagtgcattttctttcttttccttatctcttaattctgtagttacattgaaagtgcagttctttatttctccaattgtgctattatcaatatctgtgacatggagacccagcatggcgtat

SEQ ID NO: 408277 - DNA, 140 bp, Artificial Sequence
  Synthetic
aggccctggctgctgatatgaggtggcgagcaaggcagagacagatccgtgcgattagtgagcggattcttagcacttgcctgggacgatctacggagcctgtgcctcttcagctaccacgaccttttgggacagcggtg

SEQ ID NO: 408278 - DNA, 140 bp, Artificial Sequence
  Synthetic
caccgctgtcccaaaaggtcgtggtagctgaagaggcacaggctccgtagatcgtcccaggcaagtgctaagaatccgctcactaatcgcacggatctgtctctgccttgctcgccacctcatatcagcagccagggcct

SEQ ID NO: 408279 - DNA, 140 bp, Artificial Sequence
  Synthetic
aggccctggctgctgatatgtagcacttgcctgggacgatctacggagcctgtgcctcttcagctaccaccgcttgagagacttcatcttgattgcagcgaggactgtggaacttctggggaccttttgggacagcggtg

SEQ ID NO: 408280 - DNA, 140 bp, Artificial Sequence
  Synthetic
caccgctgtcccaaaaggtccccagaagttccacagtcctcgctgcaatcaagatgaagtctctcaagcggtggtagctgaagaggcacaggctccgtagatcgtcccaggcaagtgctacatatcagcagccagggcct

SEQ ID NO: 408281 - DNA, 140 bp, Artificial Sequence
  Synthetic
aggccctggctgctgatatgaggagaaagagactggcatttgggtcagggagtctccatagaatggaggaaaaagagatatagcacacaagtagaccctgacctagcagaccaactaattgaccttttgggacagcggtg

SEQ ID NO: 408282 - DNA, 140 bp, Artificial Sequence
  Synthetic
caccgctgtcccaaaaggtcaattagttggtctgctaggtcagggtctacttgtgtgctatatctctttttcctccattctatggagactccctgacccaaatgccagtctctttctcctcatatcagcagccagggcct

SEQ ID NO: 408283 - DNA, 140 bp, Artificial Sequence
  Synthetic
aggccctggctgctgatatggggaatgggtaaataaagaaatgacaaactgctctttcaatgtcaccacaggtataagaaataagagaaagaaagaatatgcacttttttataaacatgagaccttttgggacagcggtg

SEQ ID NO: 408284 - DNA, 140 bp, Artificial Sequence
  Synthetic
caccgctgtcccaaaaggtctcatgtttataaaaaagtgcatattctttctttctcttatttcttatacctgtggtgacattgaaagagcagtttgtcatttctttatttacccattccccatatcagcagccagggcct

SEQ ID NO: 408285 - DNA, 140 bp, Artificial Sequence
  Synthetic
aggccctggctgctgatatgaaaatggggggcaagtggtcaaaaagcagcatagttggatggcctaatgtaagagaaagaatgagacgaactgaaccagcagcagagggagtaggagcaggaccttttgggacagcggtg

SEQ ID NO: 408286 - DNA, 140 bp, Artificial Sequence
  Synthetic
caccgctgtcccaaaaggtcctgctcctactccctctgctgctggttcagttcgtctcattctttctcttacattaggccatccaactatgctgctttttgaccacttgccccccattttcatatcagcagccagggcct

SEQ ID NO: 408287 - DNA, 140 bp, Artificial Sequence
  Synthetic
aggccctggctgctgatatgaagagaaagaatgagacgaactgaaccagcagcagagggagtaggagcagcatctcaagacttagataaatatggggcacttacaagcagcaacacagccgaccttttgggacagcggtg

SEQ ID NO: 408288 - DNA, 140 bp, Artificial Sequence
  Synthetic
caccgctgtcccaaaaggtcggctgtgttgctgcttgtaagtgccccatatttatctaagtcttgagatgctgctcctactccctctgctgctggttcagttcgtctcattctttctcttcatatcagcagccagggcct

SEQ ID NO: 408289 - DNA, 140 bp, Artificial Sequence
  Synthetic
atacgccatgctgggtctcctggtttggagagagagacgacgggagaaataaagaactgctctttcaatatcaccacagacatgaaagataaggtgcaggaaaaatatgcacttttttatcgtacttgggagtcggccat

SEQ ID NO: 408290 - DNA, 140 bp, Artificial Sequence
  Synthetic
atggccgactcccaagtacgataaaaaagtgcatatttttcctgcaccttatctttcatgtctgtggtgatattgaaagagcagttctttatttctcccgtcgtctctctctccaaaccaggagacccagcatggcgtat

SEQ ID NO: 408291 - DNA, 140 bp, Artificial Sequence
  Synthetic
aggccctggctgctgatatgggcatctcctatggcaggaagaagcggagacagcgacgaagagctcctcaagacagtgagactcatcaagtttctctatcaaagcagtaagtagtacatggaccttttgggacagcggtg

SEQ ID NO: 408292 - DNA, 140 bp, Artificial Sequence
  Synthetic
caccgctgtcccaaaaggtccatgtactacttactgctttgatagagaaacttgatgagtctcactgtcttgaggagctcttcgtcgctgtctccgcttcttcctgccataggagatgcccatatcagcagccagggcct

SEQ ID NO: 408293 - DNA, 140 bp, Artificial Sequence
  Synthetic
aggccctggctgctgatatggatgacagaaaccttgctagtccaaaatgcgaatccagactgtaagtccatcttaaaagcattaggaatgggagctacattagaagaaatgatgacagcagaccttttgggacagcggtg

SEQ ID NO: 408294 - DNA, 140 bp, Artificial Sequence
  Synthetic
caccgctgtcccaaaaggtctgctgtcatcatttcttctaatgtagctcccattcctaatgcttttaagatggacttacagtctggattcgcattttggactagcaaggtttctgtcatccatatcagcagccagggcct

SEQ ID NO: 408295 - DNA, 140 bp, Artificial Sequence
  Synthetic
atacgccatgctgggtctcccttgtggagatggggcaccatgctccttgggatgttaatgatctgtagtgctgcagaacaattgtgggtcacagtctattatggggtacctgtgtggaaacgtacttgggagtcggccat

SEQ ID NO: 408296 - DNA, 140 bp, Artificial Sequence
  Synthetic
atggccgactcccaagtacgtttccacacaggtaccccataatagactgtgacccacaattgttctgcagcactacagatcattaacatcccaaggagcatggtgccccatctccacaagggagacccagcatggcgtat

SEQ ID NO: 408297 - DNA, 140 bp, Artificial Sequence
  Synthetic
atacgccatgctgggtctcctatatcaaagcagtaagtgctaaatagtaaatgtaatgttaagtttactagcaagagtatattataaattacgagtaggagcattaatagtagcactaatcgtacttgggagtcggccat

SEQ ID NO: 408298 - DNA, 140 bp, Artificial Sequence
  Synthetic
atggccgactcccaagtacgattagtgctactattaatgctcctactcgtaatttataatatactcttgctagtaaacttaacattacatttactatttagcacttactgctttgatataggagacccagcatggcgtat

SEQ ID NO: 408299 - DNA, 140 bp, Artificial Sequence
  Synthetic
aggccctggctgctgatatgggaggagaatttttcttctgtaatacaacaaaactgtttgggggtacttgggatggtagtacttggaattggagtgataatgaaaataataccatcactagaccttttgggacagcggtg

SEQ ID NO: 408300 - DNA, 140 bp, Artificial Sequence
  Synthetic
caccgctgtcccaaaaggtctagtgatggtattattttcattatcactccaattccaagtactaccatcccaagtacccccaaacagttttgttgtattacagaagaaaaattctcctcccatatcagcagccagggcct

SEQ ID NO: 408301 - DNA, 140 bp, Artificial Sequence
  Synthetic
atacgccatgctgggtctccgaaaaagcaacgtatgccaatacaattagaggaccaattaaatcagcatcaaatataacagggctgttaaaaacaagagatggtggtgaggaggacaatgcgtacttgggagtcggccat

SEQ ID NO: 408302 - DNA, 140 bp, Artificial Sequence
  Synthetic
atggccgactcccaagtacgcattgtcctcctcaccaccatctcttgtttttaacagccctgttatatttgatgctgatttaattggtcctctaattgtattggcatacgttgctttttcggagacccagcatggcgtat

SEQ ID NO: 408303 - DNA, 140 bp, Artificial Sequence
  Synthetic
atacgccatgctgggtctcccgagtgagaccttcagacctggaggaggagacatgagggacaattggagaagtgaattatataaatataagagtagtaaaagtggtaccattaggagtagcgtacttgggagtcggccat

SEQ ID NO: 408304 - DNA, 140 bp, Artificial Sequence
  Synthetic
atggccgactcccaagtacgctactcctaatggtaccacttttactactcttatatttatataattcacttctccaattgtccctcatgtctcctcctccaggtctgaaggtctcactcgggagacccagcatggcgtat

SEQ ID NO: 408305 - DNA, 140 bp, Artificial Sequence
  Synthetic
aggccctggctgctgatatgaaaaagagtgctattagtctgcttgataccttagcaatagcagtagctgaaggaacagataggattatagaattcatacaaagaatttgtagagctatccgaccttttgggacagcggtg

SEQ ID NO: 408306 - DNA, 140 bp, Artificial Sequence
  Synthetic
caccgctgtcccaaaaggtcggatagctctacaaattctttgtatgaattctataatcctatctgttccttcagctactgctattgctaaggtatcaagcagactaatagcactctttttcatatcagcagccagggcct

SEQ ID NO: 408307 - DNA, 140 bp, Artificial Sequence
  Synthetic
atacgccatgctgggtctccgaggaactgctcttacaatatgaccacagagctaagggataagaaacggaaggtttattcacttttctataggcctgatatagtaccaattaatcaagatcgtacttgggagtcggccat

SEQ ID NO: 408308 - DNA, 140 bp, Artificial Sequence
  Synthetic
atggccgactcccaagtacgatcttgattaattggtactatatcaggcctatagaaaagtgaataaaccttccgtttcttatcccttagctctgtggtcatattgtaagagcagttcctcggagacccagcatggcgtat

SEQ ID NO: 408309 - DNA, 140 bp, Artificial Sequence
  Synthetic
aggccctggctgctgatatgaggaggggacccagaaattgtaatgcacagttttaattgtggaggggaatttttctactgtaatacaacacagctgtttaatagtacatgggttaatggtgaccttttgggacagcggtg

SEQ ID NO: 408310 - DNA, 140 bp, Artificial Sequence
  Synthetic
caccgctgtcccaaaaggtcaccattaacccatgtactattaaacagctgtgttgtattacagtagaaaaattcccctccacaattaaaactgtgcattacaatttctgggtcccctcctcatatcagcagccagggcct

SEQ ID NO: 408311 - DNA, 140 bp, Artificial Sequence
  Synthetic
aggccctggctgctgatatggctgaagtgcactcggcaagaggcgagagcggcgactggtgagtacgccaaattttatttgactagcggaggctagaaggagagagatgggtgcgagagcgaccttttgggacagcggtg

SEQ ID NO: 408312 - DNA, 140 bp, Artificial Sequence
  Synthetic
caccgctgtcccaaaaggtcgctctcgcacccatctctctccttctagcctccgctagtcaaataaaatttggcgtactcaccagtcgccgctctcgcctcttgccgagtgcacttcagccatatcagcagccagggcct

SEQ ID NO: 408313 - DNA, 140 bp, Artificial Sequence
  Synthetic
aggccctggctgctgatatggaaggaatcgaagaagaaggtggagagcaagacagaggcagctccataagattagtggatggattcttagcccttatctgggacgacctggggagcctgggaccttttgggacagcggtg

SEQ ID NO: 408314 - DNA, 140 bp, Artificial Sequence
  Synthetic
caccgctgtcccaaaaggtcccaggctccccaggtcgtcccagataagggctaagaatccatccactaatcttatggagctgcctctgtcttgctctccaccttcttcttcgattccttccatatcagcagccagggcct

SEQ ID NO: 408315 - DNA, 140 bp, Artificial Sequence
  Synthetic
atacgccatgctgggtctccatgaatcctcaggaggggatctagaagtcacaacacatagtttcaattgtggaggagaatttttctattgtaacacatcaggtctgtttaatagcacttgcgtacttgggagtcggccat

SEQ ID NO: 408316 - DNA, 140 bp, Artificial Sequence
  Synthetic
atggccgactcccaagtacgcaagtgctattaaacagacctgatgtgttacaatagaaaaattctcctccacaattgaaactatgtgttgtgacttctagatcccctcctgaggattcatggagacccagcatggcgtat

SEQ ID NO: 408317 - DNA, 140 bp, Artificial Sequence
  Synthetic
atacgccatgctgggtctccattggggaacttctgggacgcagggggtgggaactcctcaaactttggtggagccttctacagtattggagccaagaactaaagaagagtgctgttagctcgtacttgggagtcggccat

SEQ ID NO: 408318 - DNA, 140 bp, Artificial Sequence
  Synthetic
atggccgactcccaagtacgagctaacagcactcttctttagttcttggctccaatactgtagaaggctccaccaaagtttgaggagttcccaccccctgcgtcccagaagttccccaatggagacccagcatggcgtat

SEQ ID NO: 408319 - DNA, 140 bp, Artificial Sequence
  Synthetic
aggccctggctgctgatatggaagtagtacaaagattttgtagggctatcctccacatacctgtacgaataagacagggtttggaaagagctttgctataaaatgggtggcaagtggtcagaccttttgggacagcggtg

SEQ ID NO: 408320 - DNA, 140 bp, Artificial Sequence
  Synthetic
caccgctgtcccaaaaggtctgaccacttgccacccattttatagcaaagctctttccaaaccctgtcttattcgtacaggtatgtggaggatagccctacaaaatctttgtactacttccatatcagcagccagggcct

SEQ ID NO: 408321 - DNA, 140 bp, Artificial Sequence
  Synthetic
aggccctggctgctgatatgctcgacgcaggactcggcttgctgaagtgcgcacagcaagaggcgaggggcggcgactggtgagtacgccaaaaaattttttttgactagcggaggctaggaccttttgggacagcggtg

SEQ ID NO: 408322 - DNA, 140 bp, Artificial Sequence
  Synthetic
caccgctgtcccaaaaggtcctagcctccgctagtcaaaaaaaattttttggcgtactcaccagtcgccgcccctcgcctcttgctgtgcgcacttcagcaagccgagtcctgcgtcgagcatatcagcagccagggcct

SEQ ID NO: 408323 - DNA, 140 bp, Artificial Sequence
  Synthetic
atacgccatgctgggtctcctggggatgctctggaagacacatttgcaccactaatgtgccctggaactctagctggagtaataaatctctaggggaaatttgggataacatgacctggacgtacttgggagtcggccat

SEQ ID NO: 408324 - DNA, 140 bp, Artificial Sequence
  Synthetic
atggccgactcccaagtacgtccaggtcatgttatcccaaatttcccctagagatttattactccagctagagttccagggcacattagtggtgcaaatgtgtcttccagagcatccccaggagacccagcatggcgtat

SEQ ID NO: 408325 - DNA, 140 bp, Artificial Sequence
  Synthetic
aggccctggctgctgatatgaaaatgcgaacccagattgtaagaccattttaagagcattaggaccaggggcttcattagaagaaatgatgacagcatgtcagggagtgggaggacctaggaccttttgggacagcggtg

SEQ ID NO: 408326 - DNA, 140 bp, Artificial Sequence
  Synthetic
caccgctgtcccaaaaggtcctaggtcctcccactccctgacatgctgtcatcatttcttctaatgaagcccctggtcctaatgctcttaaaatggtcttacaatctgggttcgcattttcatatcagcagccagggcct

SEQ ID NO: 408327 - DNA, 140 bp, Artificial Sequence
  Synthetic
aggccctggctgctgatatggcaagacagaaccagatcgattcgattagtgagcggattcttagctcttgcctgggacgatctgcggagcctgtgcctcttcagctaccaccgcttgagagaccttttgggacagcggtg

SEQ ID NO: 408328 - DNA, 140 bp, Artificial Sequence
  Synthetic
caccgctgtcccaaaaggtctctcaagcggtggtagctgaagaggcacaggctccgcagatcgtcccaggcaagagctaagaatccgctcactaatcgaatcgatctggttctgtcttgccatatcagcagccagggcct

SEQ ID NO: 408329 - DNA, 140 bp, Artificial Sequence
  Synthetic
aggccctggctgctgatatggataccatagctatagcagtagctgggtggacagatagggttatagaagcaggacaaatattattaggaagggcttagaaagggctttgctataacatgggaccttttgggacagcggtg

SEQ ID NO: 408330 - DNA, 140 bp, Artificial Sequence
  Synthetic
caccgctgtcccaaaaggtcccatgttatagcaaagccctttctaagcccttcctaataatatttgtcctgcttctataaccctatctgtccacccagctactgctatagctatggtatccatatcagcagccagggcct

SEQ ID NO: 408331 - DNA, 140 bp, Artificial Sequence
  Synthetic
aggccctggctgctgatatggatgggtgcgagagcgtcagtgttaagtgggggaaaattagatgaatgggaaagaatccggttacggccagggggacgcaaaaaatataaactaaaacatgaccttttgggacagcggtg

SEQ ID NO: 408332 - DNA, 140 bp, Artificial Sequence
  Synthetic
caccgctgtcccaaaaggtcatgttttagtttatattttttgcgtccccctggccgtaaccggattctttcccattcatctaattttcccccacttaacactgacgctctcgcacccatccatatcagcagccagggcct

SEQ ID NO: 408333 - DNA, 140 bp, Artificial Sequence
  Synthetic
aggccctggctgctgatatggtttatgggatcaaagtttaaagccttgtgtgcaaatgactttcttatgtgtacaaatgaactgtacagagctaaagaatagtacgagaagaacagaaaagaccttttgggacagcggtg

SEQ ID NO: 408334 - DNA, 140 bp, Artificial Sequence
  Synthetic
caccgctgtcccaaaaggtcttttctgttcttctcgtactattctttagctctgtacagttcatttgtacacataagaaagtcatttgcacacaaggctttaaactttgatcccataaaccatatcagcagccagggcct

SEQ ID NO: 408335 - DNA, 140 bp, Artificial Sequence
  Synthetic
aggccctggctgctgatatgatgcagagaggcaattttaggaaccaaagaaagactgttaagtgtttcaattgtggcaaagaagggcacatagccaaaaattgcagggctcctaggaaaagaccttttgggacagcggtg

SEQ ID NO: 408336 - DNA, 140 bp, Artificial Sequence
  Synthetic
caccgctgtcccaaaaggtcttttcctaggagccctgcaatttttggctatgtgcccttctttgccacaattgaaacacttaacagtctttctttggttcctaaaattgcctctctgcatcatatcagcagccagggcct

SEQ ID NO: 408337 - DNA, 140 bp, Artificial Sequence
  Synthetic
aggccctggctgctgatatgttagctgaggcaatgagccaagtaacaagtacaactgtaatgatgcagaaaagtaactttaagggccaaagaagaattgttaaatgctttaattgtggcagaccttttgggacagcggtg

SEQ ID NO: 408338 - DNA, 140 bp, Artificial Sequence
  Synthetic
caccgctgtcccaaaaggtctgccacaattaaagcatttaacaattcttctttggcccttaaagttacttttctgcatcattacagttgtacttgttacttggctcattgcctcagctaacatatcagcagccagggcct

SEQ ID NO: 408339 - DNA, 140 bp, Artificial Sequence
  Synthetic
atacgccatgctgggtctcctaataatgatactgctgacaccctccaggacgaaataagaaactgctctttcaatataaccacagaaataagagataggaaaaaggaagcatacgcacttcgtacttgggagtcggccat

SEQ ID NO: 408340 - DNA, 140 bp, Artificial Sequence
  Synthetic
atggccgactcccaagtacgaagtgcgtatgcttcctttttcctatctcttatttctgtggttatattgaaagagcagtttcttatttcgtcctggagggtgtcagcagtatcattattaggagacccagcatggcgtat

SEQ ID NO: 408341 - DNA, 140 bp, Artificial Sequence
  Synthetic
atacgccatgctgggtctccattctattctgtgcatctgatgctaaatcatatagttctgagaaacataatgtctgggctacacatgcttgtgtacccacagaccccagcccacaagaaacgtacttgggagtcggccat

SEQ ID NO: 408342 - DNA, 140 bp, Artificial Sequence
  Synthetic
atggccgactcccaagtacgtttcttgtgggctggggtctgtgggtacacaagcatgtgtagcccagacattatgtttctcagaactatatgatttagcatcagatgcacagaatagaatggagacccagcatggcgtat

SEQ ID NO: 408343 - DNA, 140 bp, Artificial Sequence
  Synthetic
aggccctggctgctgatatgagagatagtgtgtacaagacccaacaataatacaagaaaaagtataaggataggaccaggacaagcattctatgcaacaaatgaaataataggagacatagaccttttgggacagcggtg

SEQ ID NO: 408344 - DNA, 140 bp, Artificial Sequence
  Synthetic
caccgctgtcccaaaaggtctatgtctcctattatttcatttgttgcatagaatgcttgtcctggtcctatccttatactttttcttgtattattgttgggtcttgtacacactatctctcatatcagcagccagggcct

SEQ ID NO: 408345 - DNA, 140 bp, Artificial Sequence
  Synthetic
atacgccatgctgggtctccaaagaaaaaattaggagaacacttccctaataaaacaataaactttgcaccatcctcaggaggggacctagaagttacaacacatagttttaattgtagacgtacttgggagtcggccat

SEQ ID NO: 408346 - DNA, 140 bp, Artificial Sequence
  Synthetic
atggccgactcccaagtacgtctacaattaaaactatgtgttgtaacttctaggtcccctcctgaggatggtgcaaagtttattgttttattagggaagtgttctcctaattttttctttggagacccagcatggcgtat

SEQ ID NO: 408347 - DNA, 140 bp, Artificial Sequence
  Synthetic
atacgccatgctgggtctccacaagtattctatgcaagggagataataggggatataagacaagcatattgtaatgtcagtgaatcagaatggaataaaactttaggacgggtagtcgaacgtacttgggagtcggccat

SEQ ID NO: 408348 - DNA, 140 bp, Artificial Sequence
  Synthetic
atggccgactcccaagtacgttcgactacccgtcctaaagttttattccattctgattcactgacattacaatatgcttgtcttatatcccctattatctcccttgcatagaatacttgtggagacccagcatggcgtat

SEQ ID NO: 408349 - DNA, 140 bp, Artificial Sequence
  Synthetic
atacgccatgctgggtctcccaaaatcctctaccaaagcagtaagtacccaatagtagatgtaatgttaaatctatatgcaagagtggattatagagtaggagcaggagcattgataatacgtacttgggagtcggccat

SEQ ID NO: 408350 - DNA, 140 bp, Artificial Sequence
  Synthetic
atggccgactcccaagtacgtattatcaatgctcctgctcctactctataatccactcttgcatatagatttaacattacatctactattgggtacttactgctttggtagaggattttgggagacccagcatggcgtat

SEQ ID NO: 408351 - DNA, 140 bp, Artificial Sequence
  Synthetic
  misc_feature (47)..(47): n is a, c, g, or t
aggccctggctgctgatatgcctagtgttgcaaaactagcagagganagatggaacaagccccagaaaaccaggggccacagagagaaccatacaatgaatggacactagaaattttagagaccttttgggacagcggtg

SEQ ID NO: 408352 - DNA, 140 bp, Artificial Sequence
  Synthetic
  misc_feature (94)..(94): n is a, c, g, or t
caccgctgtcccaaaaggtctctaaaatttctagtgtccattcattgtatggttctctctgtggcccctggttttctggggcttgttccatctntcctctgctagttttgcaacactaggcatatcagcagccagggcct

SEQ ID NO: 408353 - DNA, 140 bp, Artificial Sequence
  Synthetic
aggccctggctgctgatatgcatctgctgaagtgggggtttaccacaccagacaaaaaacatcagaaagaacctccattcctttggatgggttatgaactccatcctgataaatggacaggaccttttgggacagcggtg

SEQ ID NO: 408354 - DNA, 140 bp, Artificial Sequence
  Synthetic
caccgctgtcccaaaaggtcctgtccatttatcaggatggagttcataacccatccaaaggaatggaggttctttctgatgttttttgtctggtgtggtaaacccccacttcagcagatgcatatcagcagccagggcct

SEQ ID NO: 408355 - DNA, 140 bp, Artificial Sequence
  Synthetic
atacgccatgctgggtctcctaaactgtagcaatgctaccgtcaataatagcataaaggaagaaatgaaaaattgctctttcaatataaccacagaagtaagtgataagaaaaagaaagacgtacttgggagtcggccat

SEQ ID NO: 408356 - DNA, 140 bp, Artificial Sequence
  Synthetic
atggccgactcccaagtacgtctttctttttcttatcacttacttctgtggttatattgaaagagcaatttttcatttcttcctttatgctattattgacggtagcattgctacagtttaggagacccagcatggcgtat

SEQ ID NO: 408357 - DNA, 140 bp, Artificial Sequence
  Synthetic
atacgccatgctgggtctcccaggtccactgcgatgggtcagtatggcagctaaaacagagtcacagaacacagggtcaaggatagcttattgtatgtataataacactgaatggataaacgtacttgggagtcggccat

SEQ ID NO: 408358 - DNA, 140 bp, Artificial Sequence
  Synthetic
atggccgactcccaagtacgtttatccattcagtgttattatacatacaataagctatccttgaccctgtgttctgtgactctgttttagctgccatactgacccatcgcagtggacctgggagacccagcatggcgtat

SEQ ID NO: 408359 - DNA, 140 bp, Artificial Sequence
  Synthetic
aggccctggctgctgatatgagtgtttcaactgtggcaaagaaggacacctagccagaaattgcagggcccctagaaaaaagggctgttggaaatgtggaaaggagggacaccaaatgaagaccttttgggacagcggtg

SEQ ID NO: 408360 - DNA, 140 bp, Artificial Sequence
  Synthetic
caccgctgtcccaaaaggtcttcatttggtgtccctcctttccacatttccaacagcccttttttctaggggccctgcaatttctggctaggtgtccttctttgccacagttgaaacactcatatcagcagccagggcct

SEQ ID NO: 408361 - DNA, 140 bp, Artificial Sequence
  Synthetic
aggccctggctgctgatatggttcagaagtacacatcccactaggggatgctaaattagtagtaagaacatattggggtctgcatacaggagaaaaagactggcaattggggcatggggtgaccttttgggacagcggtg

SEQ ID NO: 408362 - DNA, 140 bp, Artificial Sequence
  Synthetic
caccgctgtcccaaaaggtcaccccatgccccaattgccagtctttttctcctgtatgcagaccccaatatgttcttactactaatttagcatcccctagtgggatgtgtacttctgaaccatatcagcagccagggcct

SEQ ID NO: 408363 - DNA, 140 bp, Artificial Sequence
  Synthetic
aggccctggctgctgatatgaattaacagaagatagatggaacaagccccaggagatcaggggccacagagagaaccctacaatgaatggacactagaactgttagaggagcttaaaaatgaccttttgggacagcggtg

SEQ ID NO: 408364 - DNA, 140 bp, Artificial Sequence
  Synthetic
caccgctgtcccaaaaggtcatttttaagctcctctaacagttctagtgtccattcattgtagggttctctctgtggcccctgatctcctggggcttgttccatctatcttctgttaattcatatcagcagccagggcct

SEQ ID NO: 408365 - DNA, 140 bp, Artificial Sequence
  Synthetic
atacgccatgctgggtctccgtactacggacaatactactaataatagtacaataatggggaaagaagaaataaaaaactgctctttcaatactaccacaaacataagaaataaaatgcacgtacttgggagtcggccat

SEQ ID NO: 408366 - DNA, 140 bp, Artificial Sequence
  Synthetic
atggccgactcccaagtacgtgcattttatttcttatgtttgtggtagtattgaaagagcagttttttatttcttctttccccattattgtactattattagtagtattgtccgtagtacggagacccagcatggcgtat

SEQ ID NO: 408367 - DNA, 140 bp, Artificial Sequence
  Synthetic
atacgccatgctgggtctccttagcagaggacagatggaacaagccccagaagaccaggggccctcgagggaaccatacgctgaatggacattagaactgttagaagagcttaagcaggacgtacttgggagtcggccat

SEQ ID NO: 408368 - DNA, 140 bp, Artificial Sequence
  Synthetic
atggccgactcccaagtacgtcctgcttaagctcttctaacagttctaatgtccattcagcgtatggttccctcgagggcccctggtcttctggggcttgttccatctgtcctctgctaaggagacccagcatggcgtat

SEQ ID NO: 408369 - DNA, 140 bp, Artificial Sequence
  Synthetic
aggccctggctgctgatatggtggaattggtttggcataacaaattggctgtggtatataagaatatttataatgatagtaggaggtttaataggtttaagaatagtctttgctgtgcttgaccttttgggacagcggtg

SEQ ID NO: 408370 - DNA, 140 bp, Artificial Sequence
  Synthetic
caccgctgtcccaaaaggtcaagcacagcaaagactattcttaaacctattaaacctcctactatcattataaatattcttatataccacagccaatttgttatgccaaaccaattccaccatatcagcagccagggcct

SEQ ID NO: 408371 - DNA, 140 bp, Artificial Sequence
  Synthetic
aggccctggctgctgatatgtagcaagtgttactgtaaaaagtgttgctatcattgtccagtttgctttttgaacaaaggcttaggcatctcctatggcaggaagaagcggagacagcgagaccttttgggacagcggtg

SEQ ID NO: 408372 - DNA, 140 bp, Artificial Sequence
  Synthetic
caccgctgtcccaaaaggtctcgctgtctccgcttcttcctgccataggagatgcctaagcctttgttcaaaaagcaaactggacaatgatagcaacactttttacagtaacacttgctacatatcagcagccagggcct

SEQ ID NO: 408373 - DNA, 140 bp, Artificial Sequence
  Synthetic
aggccctggctgctgatatgttgagagaataagagaaagagcagaagacagtggcaatgagagtgatggggatacagaggaattgtcagcacttgttgagatggggaactatgatcttgggaccttttgggacagcggtg

SEQ ID NO: 408374 - DNA, 140 bp, Artificial Sequence
  Synthetic
caccgctgtcccaaaaggtcccaagatcatagttccccatctcaacaagtgctgacaattcctctgtatccccatcactctcattgccactgtcttctgctctttctcttattctctcaacatatcagcagccagggcct

SEQ ID NO: 408375 - DNA, 140 bp, Artificial Sequence
  Synthetic
aggccctggctgctgatatgaaattaagagaacaatttaagaataaaacaatagtctttaatcactcctcaggaggggacccagaaattgtaatgcacagttttaattgtggaggggaatgaccttttgggacagcggtg

SEQ ID NO: 408376 - DNA, 140 bp, Artificial Sequence
  Synthetic
caccgctgtcccaaaaggtcattcccctccacaattaaaactgtgcattacaatttctgggtcccctcctgaggagtgattaaagactattgttttattcttaaattgttctcttaatttcatatcagcagccagggcct

SEQ ID NO: 408377 - DNA, 140 bp, Artificial Sequence
  Synthetic
aggccctggctgctgatatgttatagattaggagtaggagcattaataatagcactaatcatagcaataattgtgtggaccatagtatatatagaatataggaaattggtaagacaaagagaccttttgggacagcggtg

SEQ ID NO: 408378 - DNA, 140 bp, Artificial Sequence
  Synthetic
caccgctgtcccaaaaggtctctttgtcttaccaatttcctatattctatatatactatggtccacacaattattgctatgattagtgctattattaatgctcctactcctaatctataacatatcagcagccagggcct

SEQ ID NO: 408379 - DNA, 140 bp, Artificial Sequence
  Synthetic
  misc_feature (105)..(105): n is a, c, g, or t
aggccctggctgctgatatgagcaggaagcactatgggcgcagcgtcaatgacgctgacggtacaggccagacaattattgtctggtatagtgcaacagcaaaanaatttgctgagggctgaccttttgggacagcggtg

SEQ ID NO: 408380 - DNA, 140 bp, Artificial Sequence
  Synthetic
  misc_feature (36)..(36): n is a, c, g, or t
caccgctgtcccaaaaggtcagccctcagcaaattnttttgctgttgcactataccagacaataattgtctggcctgtaccgtcagcgtcattgacgctgcgcccatagtgcttcctgctcatatcagcagccagggcct

SEQ ID NO: 408381 - DNA, 140 bp, Artificial Sequence
  Synthetic
aggccctggctgctgatatgagatataattagtctatgggatcaaagcctaaagccatgtgtaaagttaacccctctctgcgttactttaaattgtaacgatgacatcactattaccaatgaccttttgggacagcggtg

SEQ ID NO: 408382 - DNA, 140 bp, Artificial Sequence
  Synthetic
caccgctgtcccaaaaggtcattggtaatagtgatgtcatcgttacaatttaaagtaacgcagagaggggttaactttacacatggctttaggctttgatcccatagactaattatatctcatatcagcagccagggcct

SEQ ID NO: 408383 - DNA, 140 bp, Artificial Sequence
  Synthetic
aggccctggctgctgatatgtatacaacttacttgaagaatcgcaaaaccagcaagaaaagaatgaacaagaattattggaattggataaatgggcaagtttgtggaattggtttgacatgaccttttgggacagcggtg

SEQ ID NO: 408384 - DNA, 140 bp, Artificial Sequence
  Synthetic
caccgctgtcccaaaaggtcatgtcaaaccaattccacaaacttgcccatttatccaattccaataattcttgttcattcttttcttgctggttttgcgattcttcaagtaagttgtatacatatcagcagccagggcct

SEQ ID NO: 408385 - DNA, 140 bp, Artificial Sequence
  Synthetic
atacgccatgctgggtctccgaatgcgactaaccatgagggtaggactgtcaatgccactaacaatgtcggaatgaaaaactgctctttcaatataaccacagaaataagagataagaaacgtacttgggagtcggccat

SEQ ID NO: 408386 - DNA, 140 bp, Artificial Sequence
  Synthetic
atggccgactcccaagtacgtttcttatctcttatttctgtggttatattgaaagagcagtttttcattccgacattgttagtggcattgacagtcctaccctcatggttagtcgcattcggagacccagcatggcgtat

SEQ ID NO: 408387 - DNA, 140 bp, Artificial Sequence
  Synthetic
aggccctggctgctgatatggaggaagtagggtttccagtcaaaccccaggtacctttaagaccaatgacttataagggagcgttcgatctcagcttctttttaaaagaaaaggggggacgaccttttgggacagcggtg

SEQ ID NO: 408388 - DNA, 140 bp, Artificial Sequence
  Synthetic
caccgctgtcccaaaaggtcgtccccccttttcttttaaaaagaagctgagatcgaacgctcccttataagtcattggtcttaaaggtacctggggtttgactggaaaccctacttcctccatatcagcagccagggcct

SEQ ID NO: 408389 - DNA, 140 bp, Artificial Sequence
  Synthetic
atacgccatgctgggtctccatggtagtctagcagaaggaggggtaaaaattagatctgaaaatatcagcaacaatgccaaaaacataatagtacaatttgatgagcctgtaagcattagcgtacttgggagtcggccat

SEQ ID NO: 408390 - DNA, 140 bp, Artificial Sequence
  Synthetic
atggccgactcccaagtacgctaatgcttacaggctcatcaaattgtactattatgtttttggcattgttgctgatattttcagatctaatttttacccctccttctgctagactaccatggagacccagcatggcgtat

SEQ ID NO: 408391 - DNA, 140 bp, Artificial Sequence
  Synthetic
aggccctggctgctgatatgaacaatgccaaaaacataatagtacaatttgatgagcctgtaagcattagttgtatcagacctaacaacaatacaataacaagcatacgtataggacccggaccttttgggacagcggtg

SEQ ID NO: 408392 - DNA, 140 bp, Artificial Sequence
  Synthetic
caccgctgtcccaaaaggtccgggtcctatacgtatgcttgttattgtattgttgttaggtctgatacaactaatgcttacaggctcatcaaattgtactattatgtttttggcattgttcatatcagcagccagggcct

SEQ ID NO: 408393 - DNA, 140 bp, Artificial Sequence
  Synthetic
atacgccatgctgggtctcccattgtactgtcaatggaacaaaatggaatgaaactttaggaaaagtagctacagaattaggaagccactttgggaacaaaacaataatatttgctaactcgtacttgggagtcggccat

SEQ ID NO: 408394 - DNA, 140 bp, Artificial Sequence
  Synthetic
atggccgactcccaagtacgagttagcaaatattattgttttgttcccaaagtggcttcctaattctgtagctacttttcctaaagtttcattccattttgttccattgacagtacaatgggagacccagcatggcgtat

SEQ ID NO: 408395 - DNA, 140 bp, Artificial Sequence
  Synthetic
aggccctggctgctgatatgtacagaattaggaagccactttgggaacaaaacaataatatttgctaactcctcaggtggggatctagaaatcataacacatagctttaactgtggaggagaccttttgggacagcggtg

SEQ ID NO: 408396 - DNA, 140 bp, Artificial Sequence
  Synthetic
caccgctgtcccaaaaggtctcctccacagttaaagctatgtgttatgatttctagatccccacctgaggagttagcaaatattattgttttgttcccaaagtggcttcctaattctgtacatatcagcagccagggcct

SEQ ID NO: 408397 - DNA, 140 bp, Artificial Sequence
  Synthetic
aggccctggctgctgatatgcagctaccaccgcttgagagacttactcttgattgtaacgaggattgtggaacttctgggacgcagggggtgggaagccctcaagtattggtggaatctcgaccttttgggacagcggtg

SEQ ID NO: 408398 - DNA, 140 bp, Artificial Sequence
  Synthetic
caccgctgtcccaaaaggtcgagattccaccaatacttgagggcttcccaccccctgcgtcccagaagttccacaatcctcgttacaatcaagagtaagtctctcaagcggtggtagctgcatatcagcagccagggcct

SEQ ID NO: 408399 - DNA, 140 bp, Artificial Sequence
  Synthetic
atacgccatgctgggtctccagaatggaataaaactttacaacaggtagctaacaaattaggaaaacttcttaacaaaacaacaatacattttcgaccatcctcgggaggagacccagagcgtacttgggagtcggccat

SEQ ID NO: 408400 - DNA, 140 bp, Artificial Sequence
  Synthetic
atggccgactcccaagtacgctctgggtctcctcccgaggatggtcgaaaatgtattgttgttttgttaagaagttttcctaatttgttagctacctgttgtaaagttttattccattctggagacccagcatggcgtat

SEQ ID NO: 408401 - DNA, 140 bp, Artificial Sequence
  Synthetic
aggccctggctgctgatatgttaacaaaacaacaatacattttcgaccatcctcgggaggagacccagagattacagaacatacctttaattgtggaggggaatttttctactgcaatacgaccttttgggacagcggtg

SEQ ID NO: 408402 - DNA, 140 bp, Artificial Sequence
  Synthetic
caccgctgtcccaaaaggtcgtattgcagtagaaaaattcccctccacaattaaaggtatgttctgtaatctctgggtctcctcccgaggatggtcgaaaatgtattgttgttttgttaacatatcagcagccagggcct

SEQ ID NO: 408403 - DNA, 140 bp, Artificial Sequence
  Synthetic
aggccctggctgctgatatgtgctgattgtgcctggctagcagcacaagaggaggaggaggaagtgggttttccagtcagacctcaagtacctttaagaccaatgacttacaaggcagctgaccttttgggacagcggtg

SEQ ID NO: 408404 - DNA, 140 bp, Artificial Sequence
  Synthetic
caccgctgtcccaaaaggtcagctgccttgtaagtcattggtcttaaaggtacttgaggtctgactggaaaacccacttcctcctcctcctcttgtgctgctagccaggcacaatcagcacatatcagcagccagggcct

SEQ ID NO: 408405 - DNA, 140 bp, Artificial Sequence
  Synthetic
aggccctggctgctgatatggcagatggggtgggagcagtatctcgagacctggaaaaacatggagcaatcacaagtagtaatacagcagctactaatgctgattgtgcctggctagaaggaccttttgggacagcggtg

SEQ ID NO: 408406 - DNA, 140 bp, Artificial Sequence
  Synthetic
caccgctgtcccaaaaggtccttctagccaggcacaatcagcattagtagctgctgtattactacttgtgattgctccatgtttttccaggtctcgagatactgctcccaccccatctgccatatcagcagccagggcct

SEQ ID NO: 408407 - DNA, 140 bp, Artificial Sequence
  Synthetic
aggccctggctgctgatatgtgcaacaaatgatatcataggagacataagacaagcatattgtaatgttagtaaaataaaatggtatcagatgttaaagagggtccaaacacatctaaaggaccttttgggacagcggtg

SEQ ID NO: 408408 - DNA, 140 bp, Artificial Sequence
  Synthetic
caccgctgtcccaaaaggtcctttagatgtgtttggaccctctttaacatctgataccattttattttactaacattacaatatgcttgtcttatgtctcctatgatatcatttgttgcacatatcagcagccagggcct

SEQ ID NO: 408409 - DNA, 140 bp, Artificial Sequence
  Synthetic
aggccctggctgctgatatgtattgtaaacgctgtagctaccattgtctagtttgctttcagaaaaaaggcttaggcatttcctatggcaggaagaagcggagacagcgacgaagcgctcgaccttttgggacagcggtg

SEQ ID NO: 408410 - DNA, 140 bp, Artificial Sequence
  Synthetic
caccgctgtcccaaaaggtcgagcgcttcgtcgctgtctccgcttcttcctgccataggaaatgcctaagccttttttctgaaagcaaactagacaatggtagctacagcgtttacaatacatatcagcagccagggcct

SEQ ID NO: 408411 - DNA, 140 bp, Artificial Sequence
  Synthetic
aggccctggctgctgatatgaggtcagccaaaattaccctatagtgcagaaccttcaggggcaaatggtacatcaggccatatcacctagaactttaaatgcatgggtaaaagtaatagagaccttttgggacagcggtg

SEQ ID NO: 408412 - DNA, 140 bp, Artificial Sequence
  Synthetic
caccgctgtcccaaaaggtctctattacttttacccatgcatttaaagttctaggtgatatggcctgatgtaccatttgcccctgaaggttctgcactatagggtaattttggctgacctcatatcagcagccagggcct

SEQ ID NO: 408413 - DNA, 140 bp, Artificial Sequence
  Synthetic
atacgccatgctgggtctccacccacagaagaaaaagagcagtaggattgggaatgctattcttaggggttctaagtgcagcaggtagcactatgggcgcagcggcaacaacgctggcggcgtacttgggagtcggccat

SEQ ID NO: 408414 - DNA, 140 bp, Artificial Sequence
  Synthetic
atggccgactcccaagtacgccgccagcgttgttgccgctgcgcccatagtgctacctgctgcacttagaacccctaagaatagcattcccaatcctactgctctttttcttctgtgggtggagacccagcatggcgtat

SEQ ID NO: 408415 - DNA, 140 bp, Artificial Sequence
  Synthetic
aggccctggctgctgatatgttcttagcacttgcctgggacgacctacggagcctgtgcctcttcagctaccaccgcttgagagacttcatcttgattgcagcgaggactgtggaacttcgaccttttgggacagcggtg

SEQ ID NO: 408416 - DNA, 140 bp, Artificial Sequence
  Synthetic
caccgctgtcccaaaaggtcgaagttccacagtcctcgctgcaatcaagatgaagtctctcaagcggtggtagctgaagaggcacaggctccgtaggtcgtcccaggcaagtgctaagaacatatcagcagccagggcct

SEQ ID NO: 408417 - DNA, 140 bp, Artificial Sequence
  Synthetic
aggccctggctgctgatatgtcgcttagtggatggattcttagcacttatctgggtcgacctgcggagcctgtgcctcttcagctaccaccgcttgagagacttactcttgattgtaacggaccttttgggacagcggtg

SEQ ID NO: 408418 - DNA, 140 bp, Artificial Sequence
  Synthetic
caccgctgtcccaaaaggtccgttacaatcaagagtaagtctctcaagcggtggtagctgaagaggcacaggctccgcaggtcgacccagataagtgctaagaatccatccactaagcgacatatcagcagccagggcct

SEQ ID NO: 408419 - DNA, 140 bp, Artificial Sequence
  Synthetic
aggccctggctgctgatatgacatttagtatgggcaagcagggaactagaacgatttgcacttaatcctggccttttagaaacatcagaaggctgtaaacaaataataggacagctacaagaccttttgggacagcggtg

SEQ ID NO: 408420 - DNA, 140 bp, Artificial Sequence
  Synthetic
caccgctgtcccaaaaggtcttgtagctgtcctattatttgtttacagccttctgatgtttctaaaaggccaggattaagtgcaaatcgttctagttccctgcttgcccatactaaatgtcatatcagcagccagggcct

SEQ ID NO: 408421 - DNA, 140 bp, Artificial Sequence
  Synthetic
aggccctggctgctgatatgtgagatatgggataatatgacctggctgcaatgggataaggaaattagcaattacacaaacacaatatacactctacttgaagtagcacagaaccagcaggaccttttgggacagcggtg

SEQ ID NO: 408422 - DNA, 140 bp, Artificial Sequence
  Synthetic
caccgctgtcccaaaaggtcctgctggttctgtgctacttcaagtagagtgtatattgtgtttgtgtaattgctaatttccttatcccattgcagccaggtcatattatcccatatctcacatatcagcagccagggcct

SEQ ID NO: 408423 - DNA, 140 bp, Artificial Sequence
  Synthetic
atacgccatgctgggtctccagcaaccctctattgtgtacatgaaaggatacaggtaaaagacaccaaggaagcgttagacaagataggggaagaacaaaccaaaagtaagaaaaaggcacgtacttgggagtcggccat

SEQ ID NO: 408424 - DNA, 140 bp, Artificial Sequence
  Synthetic
atggccgactcccaagtacgtgcctttttcttacttttggtttgttcttcccctatcttgtctaacgcttccttggtgtcttttacctgtatcctttcatgtacacaatagagggttgctggagacccagcatggcgtat

SEQ ID NO: 408425 - DNA, 140 bp, Artificial Sequence
  Synthetic
aggccctggctgctgatatgataacatgacctggatgcagtgggatagagaaattaataattacacaaacacaatatacaggttgcttgaagaatcacaaagccagcaggaacaaaatgagaccttttgggacagcggtg

SEQ ID NO: 408426 - DNA, 140 bp, Artificial Sequence
  Synthetic
caccgctgtcccaaaaggtctcattttgttcctgctggctttgtgattcttcaagcaacctgtatattgtgtttgtgtaattattaatttctctatcccactgcatccaggtcatgttatcatatcagcagccagggcct

SEQ ID NO: 408427 - DNA, 140 bp, Artificial Sequence
  Synthetic
atacgccatgctgggtctccctttgataatagcacgggtacaaatgttacccataataatagcaggtgggaagaaatgaaaaattgctctttcaatacaaccacagaattaagagataagcgtacttgggagtcggccat

SEQ ID NO: 408428 - DNA, 140 bp, Artificial Sequence
  Synthetic
atggccgactcccaagtacgcttatctcttaattctgtggttgtattgaaagagcaatttttcatttcttcccacctgctattattatgggtaacatttgtacccgtgctattatcaaagggagacccagcatggcgtat

SEQ ID NO: 408429 - DNA, 140 bp, Artificial Sequence
  Synthetic
aggccctggctgctgatatgtcaatacatggatgacttgtatgtaggatctgatttagaaatagggcagcacagagcaaaaatagaagagttgagagctcatctattgagctggggatttgaccttttgggacagcggtg

SEQ ID NO: 408430 - DNA, 140 bp, Artificial Sequence
  Synthetic
caccgctgtcccaaaaggtcaaatccccagctcaatagatgagctctcaactcttctatttttgctctgtgctgccctatttctaaatcagatcctacatacaagtcatccatgtattgacatatcagcagccagggcct

SEQ ID NO: 408431 - DNA, 140 bp, Artificial Sequence
  Synthetic
aggccctggctgctgatatgctaataaaacaataatctttaaaccacatgcaggaggggacttagaaattacaacacatagttttaattgtagaggagaatttttctattgcaatacaacgaccttttgggacagcggtg

SEQ ID NO: 408432 - DNA, 140 bp, Artificial Sequence
  Synthetic
caccgctgtcccaaaaggtcgttgtattgcaatagaaaaattctcctctacaattaaaactatgtgttgtaatttctaagtcccctcctgcatgtggtttaaagattattgttttattagcatatcagcagccagggcct

SEQ ID NO: 408433 - DNA, 140 bp, Artificial Sequence
  Synthetic
aggccctggctgctgatatgctccaagcagtgaggatcatcaaaatcctgtatcaaagcagtaagtatatgtaatgttaaatttaatagcaagagtagattatagattaggagtaggagcgaccttttgggacagcggtg

SEQ ID NO: 408434 - DNA, 140 bp, Artificial Sequence
  Synthetic
caccgctgtcccaaaaggtcgctcctactcctaatctataatctactcttgctattaaatttaacattacatatacttactgctttgatacaggattttgatgatcctcactgcttggagcatatcagcagccagggcct

SEQ ID NO: 408435 - DNA, 140 bp, Artificial Sequence
  Synthetic
atacgccatgctgggtctcctaagataaatataaccaataacagtacagataaggcaaatgtaaccaataatgatgcagagatgagaaactgctctttcaatataaccacagaaataagacgtacttgggagtcggccat

SEQ ID NO: 408436 - DNA, 140 bp, Artificial Sequence
  Synthetic
atggccgactcccaagtacgtcttatttctgtggttatattgaaagagcagtttctcatctctgcatcattattggttacatttgccttatctgtactgttattggttatatttatcttaggagacccagcatggcgtat

SEQ ID NO: 408437 - DNA, 140 bp, Artificial Sequence
  Synthetic
aggccctggctgctgatatgagactcgcaaacccagcaggaaaagaatgaaaaggatttactagcattagacagttggaaaaatctgtggaattggtttgacataacaaattggctgtgggaccttttgggacagcggtg

SEQ ID NO: 408438 - DNA, 140 bp, Artificial Sequence
  Synthetic
caccgctgtcccaaaaggtcccacagccaatttgttatgtcaaaccaattccacagatttttccaactgtctaatgctagtaaatccttttcattcttttcctgctgggtttgcgagtctcatatcagcagccagggcct

SEQ ID NO: 408439 - DNA, 140 bp, Artificial Sequence
  Synthetic
aggccctggctgctgatatgtaagttcagaagtacacatcccactaggggatgctaaattggtaataacaacatattggggtctacatacaggagaaagagactggcatttgggtcaggggaccttttgggacagcggtg

SEQ ID NO: 408440 - DNA, 140 bp, Artificial Sequence
  Synthetic
caccgctgtcccaaaaggtcccctgacccaaatgccagtctctttctcctgtatgtagaccccaatatgttgttattaccaatttagcatcccctagtgggatgtgtacttctgaacttacatatcagcagccagggcct

SEQ ID NO: 408441 - DNA, 140 bp, Artificial Sequence
  Synthetic
atacgccatgctgggtctcctggagaaataaaaaattgctctttcaatataaccacagaaataagagataagaaaaagaaagagaatgcactcttttatagtcttgatatagtaccacttcgtacttgggagtcggccat

SEQ ID NO: 408442 - DNA, 140 bp, Artificial Sequence
  Synthetic
atggccgactcccaagtacgaagtggtactatatcaagactataaaagagtgcattctctttctttttcttatctcttatttctgtggttatattgaaagagcaattttttatttctccaggagacccagcatggcgtat

SEQ ID NO: 408443 - DNA, 140 bp, Artificial Sequence
  Synthetic
atacgccatgctgggtctcccaaattatagggatggggcgggaagaaggacgagcaacgtatgcccctcctactgatggaaacattacctgtagttcgaatattacaggtttactatggacgtacttgggagtcggccat

SEQ ID NO: 408444 - DNA, 140 bp, Artificial Sequence
  Synthetic
atggccgactcccaagtacgtccatagtaaacctgtaatattcgaactacaggtaatgtttccatcagtaggaggggcatacgttgctcgtccttcttcccgccccatccctataatttgggagacccagcatggcgtat

SEQ ID NO: 408445 - DNA, 140 bp, Artificial Sequence
  Synthetic
aggccctggctgctgatatggtggaatctcctgcagtattggagtcaggaactaaagaatagtgctgttagcttgctcaatgccacagccatagcagtagctgaggggacagataggattgaccttttgggacagcggtg

SEQ ID NO: 408446 - DNA, 140 bp, Artificial Sequence
  Synthetic
caccgctgtcccaaaaggtcaatcctatctgtcccctcagctactgctatggctgtggcattgagcaagctaacagcactattctttagttcctgactccaatactgcaggagattccaccatatcagcagccagggcct

SEQ ID NO: 408447 - DNA, 140 bp, Artificial Sequence
  Synthetic
aggccctggctgctgatatggacattcagacctggaggaggagatatgagggacaattggagaagtgaattatataaatataaagtggtagaaattaagccattaggaatagcacccactgaccttttgggacagcggtg

SEQ ID NO: 408448 - DNA, 140 bp, Artificial Sequence
  Synthetic
caccgctgtcccaaaaggtcagtgggtgctattcctaatggcttaatttctaccactttatatttatataattcacttctccaattgtccctcatatctcctcctccaggtctgaatgtccatatcagcagccagggcct

SEQ ID NO: 408449 - DNA, 140 bp, Artificial Sequence
  Synthetic
atacgccatgctgggtctccactctgtgttactttaaattgcactaatactaacatgactactattaataatgagacaaaggttggagaaataaaaaattgcactttcaatattaccacacgtacttgggagtcggccat

SEQ ID NO: 408450 - DNA, 140 bp, Artificial Sequence
  Synthetic
atggccgactcccaagtacgtgtggtaatattgaaagtgcaattttttatttctccaacctttgtctcattattaatagtagtcatgttagtattagtgcaatttaaagtaacacagagtggagacccagcatggcgtat

SEQ ID NO: 408451 - DNA, 140 bp, Artificial Sequence
  Synthetic
aggccctggctgctgatatgttctgaacaaaggcttaggcatctcctatggcaggaagaagcggagacagcgacgaggaactcctcagagcagtaaggatcatcaaaatcctataccaaagaccttttgggacagcggtg

SEQ ID NO: 408452 - DNA, 140 bp, Artificial Sequence
  Synthetic
caccgctgtcccaaaaggtctttggtataggattttgatgatccttactgctctgaggagttcctcgtcgctgtctccgcttcttcctgccataggagatgcctaagcctttgttcagaacatatcagcagccagggcct

SEQ ID NO: 408453 - DNA, 140 bp, Artificial Sequence
  Synthetic
atacgccatgctgggtctccgtacaagacctaataacaatacaagcacaagtatacatatgggaccagggcaagcatatcatgcaataggaagaataataggagatataagacaagcacacgtacttgggagtcggccat

SEQ ID NO: 408454 - DNA, 140 bp, Artificial Sequence
  Synthetic
atggccgactcccaagtacgtgtgcttgtcttatatctcctattattcttcctattgcatgatatgcttgccctggtcccatatgtatacttgtgcttgtattgttattaggtcttgtacggagacccagcatggcgtat

SEQ ID NO: 408455 - DNA, 140 bp, Artificial Sequence
  Synthetic
aggccctggctgctgatatgcaagcatatcatgcaataggaagaataataggagatataagacaagcacattgtaatgttagcaaaacaaaatggaaaaacactttagaaaaggtagctagaccttttgggacagcggtg

SEQ ID NO: 408456 - DNA, 140 bp, Artificial Sequence
  Synthetic
caccgctgtcccaaaaggtctagctaccttttctaaagtgtttttccattttgttttgctaacattacaatgtgcttgtcttatatctcctattattcttcctattgcatgatatgcttgcatatcagcagccagggcct

SEQ ID NO: 408457 - DNA, 140 bp, Artificial Sequence
  Synthetic
atacgccatgctgggtctccctgctctttcaatatgacaacagaattaacggacaggcaacagaaagtacattcacttttttatagccttgatctagcacaaatgggtaatagtagttatcgtacttgggagtcggccat

SEQ ID NO: 408458 - DNA, 140 bp, Artificial Sequence
  Synthetic
atggccgactcccaagtacgataactactattacccatttgtgctagatcaaggctataaaaaagtgaatgtactttctgttgcctgtccgttaattctgttgtcatattgaaagagcagggagacccagcatggcgtat

SEQ ID NO: 408459 - DNA, 140 bp, Artificial Sequence
  Synthetic
atacgccatgctgggtctccgcaggagtcgaaggacagggaaacacctttaacttccctcaaatcactctttggcagcgaccccttgtctcaataaaagtagggggtcagataaaggaagcgtacttgggagtcggccat

SEQ ID NO: 408460 - DNA, 140 bp, Artificial Sequence
  Synthetic
atggccgactcccaagtacgcttcctttatctgaccccctacttttattgagacaaggggtcgctgccaaagagtgatttgagggaagttaaaggtgtttccctgtccttcgactcctgcggagacccagcatggcgtat

SEQ ID NO: 408461 - DNA, 140 bp, Artificial Sequence
  Synthetic
aggccctggctgctgatatgggtagatcagatgcatgaggatataatcagtttatgggatcaaagcctaaaaccatgtgtaaaattaaccccactctgtgtcactttaaactgcagtgatgaccttttgggacagcggtg

SEQ ID NO: 408462 - DNA, 140 bp, Artificial Sequence
  Synthetic
caccgctgtcccaaaaggtcatcactgcagtttaaagtgacacagagtggggttaattttacacatggttttaggctttgatcccataaactgattatatcctcatgcatctgatctacccatatcagcagccagggcct

SEQ ID NO: 408463 - DNA, 140 bp, Artificial Sequence
  Synthetic
aggccctggctgctgatatgaaccatgtgtaaaattaaccccactctgtgtcactttaaactgcagtgatgttgcctctaacgccaacgtcactagtggcactaacagcactgatagtgagaccttttgggacagcggtg

SEQ ID NO: 408464 - DNA, 140 bp, Artificial Sequence
  Synthetic
caccgctgtcccaaaaggtctcactatcagtgctgttagtgccactagtgacgttggcgttagaggcaacatcactgcagtttaaagtgacacagagtggggttaattttacacatggttcatatcagcagccagggcct

SEQ ID NO: 408465 - DNA, 140 bp, Artificial Sequence
  Synthetic
atacgccatgctgggtctccagcagaagaaagaacatgcacttttttataaacttgatgtggtacaaatagatggtagtaataccagctatagactaataaattgtaatacctcagccatcgtacttgggagtcggccat

SEQ ID NO: 408466 - DNA, 140 bp, Artificial Sequence
  Synthetic
atggccgactcccaagtacgatggctgaggtattacaatttattagtctatagctggtattactaccatctatttgtaccacatcaagtttataaaaaagtgcatgttctttcttctgctggagacccagcatggcgtat

SEQ ID NO: 408467 - DNA, 140 bp, Artificial Sequence
  Synthetic
atacgccatgctgggtctcctacgtataggaccaggaagaacactctatgcagcagataaaataatagggaatataagacaagcacactgtaatgtcagcagaacacaatggaataaaaccgtacttgggagtcggccat

SEQ ID NO: 408468 - DNA, 140 bp, Artificial Sequence
  Synthetic
atggccgactcccaagtacggttttattccattgtgttctgctgacattacagtgtgcttgtcttatattccctattattttatctgctgcatagagtgttcttcctggtcctatacgtaggagacccagcatggcgtat

SEQ ID NO: 408469 - DNA, 140 bp, Artificial Sequence
  Synthetic
aggccctggctgctgatatggggacgggtccatgcgacaatgtcagtacagtacaatgtatacatgggattaagccagtagtgtcaactcaactgttattgaatggcagtctagcagaaggaccttttgggacagcggtg

SEQ ID NO: 408470 - DNA, 140 bp, Artificial Sequence
  Synthetic
caccgctgtcccaaaaggtccttctgctagactgccattcaataacagttgagttgacactactggcttaatcccatgtatacattgtactgtactgacattgtcgcatggacccgtccccatatcagcagccagggcct

SEQ ID NO: 408471 - DNA, 140 bp, Artificial Sequence
  Synthetic
aggccctggctgctgatatgtgatgacagcatgtcagggagtgggaggacccggccataaagcaagagttttggcagaagcaatgagccaagtaacaaattcagctaccataatgatgcagaccttttgggacagcggtg

SEQ ID NO: 408472 - DNA, 140 bp, Artificial Sequence
  Synthetic
caccgctgtcccaaaaggtctgcatcattatggtagctgaatttgttacttggctcattgcttctgccaaaactcttgctttatggccgggtcctcccactccctgacatgctgtcatcacatatcagcagccagggcct

SEQ ID NO: 408473 - DNA, 140 bp, Artificial Sequence
  Synthetic
atacgccatgctgggtctccctataactctcccatgcaaaataaagcaagttgtaagaatgtggcagagagtaggacaagcagtatatgcccctcccatcacaggagcaataagttgtaacgtacttgggagtcggccat

SEQ ID NO: 408474 - DNA, 140 bp, Artificial Sequence
  Synthetic
atggccgactcccaagtacgttacaacttattgctcctgtgatgggaggggcatatactgcttgtcctactctctgccacattcttacaacttgctttattttgcatgggagagttatagggagacccagcatggcgtat

SEQ ID NO: 408475 - DNA, 140 bp, Artificial Sequence
  Synthetic
atacgccatgctgggtctccacagaatggaataaaactttacaacaggtagctaaaaaactaagagaccttcttaacaaaacaaaaataatttttaaaccttcttcgggaggggacccagcgtacttgggagtcggccat

SEQ ID NO: 408476 - DNA, 140 bp, Artificial Sequence
  Synthetic
atggccgactcccaagtacgctgggtcccctcccgaagaaggtttaaaaattatttttgttttgttaagaaggtctcttagttttttagctacctgttgtaaagttttattccattctgtggagacccagcatggcgtat

SEQ ID NO: 408477 - DNA, 140 bp, Artificial Sequence
  Synthetic
aggccctggctgctgatatgacaggctaattttttagggaagatctggccttcccacaagggaaggccagggaattttcttcagagcagaccagagccaacagccccaccagaagagagcgaccttttgggacagcggtg

SEQ ID NO: 408478 - DNA, 140 bp, Artificial Sequence
  Synthetic
caccgctgtcccaaaaggtcgctctcttctggtggggctgttggctctggtctgctctgaagaaaattccctggccttcccttgtgggaaggccagatcttccctaaaaaattagcctgtcatatcagcagccagggcct

SEQ ID NO: 408479 - DNA, 140 bp, Artificial Sequence
  Synthetic
atacgccatgctgggtctccacaacaatactgtttaataatagtgaatggacatcaaataatacaggtaatacaagttcaggggtaaatgatagtacaatcataatcccatgcagaataacgtacttgggagtcggccat

SEQ ID NO: 408480 - DNA, 140 bp, Artificial Sequence
  Synthetic
atggccgactcccaagtacgttattctgcatgggattatgattgtactatcatttacccctgaacttgtattacctgtattatttgatgtccattcactattattaaacagtattgttgtggagacccagcatggcgtat

SEQ ID NO: 408481 - DNA, 140 bp, Artificial Sequence
  Synthetic
  misc_feature (64)..(64): n is a, c, g, or t
  misc_feature (66)..(66): n is a, c, g, or t
atacgccatgctgggtctccaaagaataggaagaggaattcttaacatcccaagaagaattagncngggcttagaaagaagcttattgtaacatgggaaacgttttgggaaaaggtaaatcgtacttgggagtcggccat

SEQ ID NO: 408482 - DNA, 140 bp, Artificial Sequence
  Synthetic
  misc_feature (75)..(75): n is a, c, g, or t
  misc_feature (77)..(77): n is a, c, g, or t
atggccgactcccaagtacgatttaccttttcccaaaacgtttcccatgttacaataagcttctttctaagcccngnctaattcttcttgggatgttaagaattcctcttcctattctttggagacccagcatggcgtat

SEQ ID NO: 408483 - DNA, 140 bp, Artificial Sequence
  Synthetic
atacgccatgctgggtctccaacaaattgtaaacatgtggcagaaagtaggaaaagcaatatatgcccctcccattgcaggactaatcagctgttcatcaaacataacaggactattgttcgtacttgggagtcggccat

SEQ ID NO: 408484 - DNA, 140 bp, Artificial Sequence
  Synthetic
atggccgactcccaagtacgaacaatagtcctgttatgtttgatgaacagctgattagtcctgcaatgggaggggcatatattgcttttcctactttctgccacatgtttacaatttgttggagacccagcatggcgtat

SEQ ID NO: 408485 - DNA, 140 bp, Artificial Sequence
  Synthetic
aggccctggctgctgatatgtacctagaagaattagacagggcttggaaaggattttgctgtaaagatgggtaacaaatggtcaaaaagttggcctgctgtaagggatagaatgagaagagaccttttgggacagcggtg

SEQ ID NO: 408486 - DNA, 140 bp, Artificial Sequence
  Synthetic
caccgctgtcccaaaaggtctcttctcattctatcccttacagcaggccaactttttgaccatttgttacccatctttacagcaaaatcctttccaagccctgtctaattcttctaggtacatatcagcagccagggcct

SEQ ID NO: 408487 - DNA, 140 bp, Artificial Sequence
  Synthetic
  misc_feature (46)..(46): n is a, c, g, or t
  misc_feature (50)..(50): n is a, c, g, or t
  misc_feature (52)..(52): n is a, c, g, or t
atacgccatgctgggtctccggaactctagttggagtaataaaacncatnancagatatgggagaacatgacctggctgcaatgggatagggaaattagcaattacacagagataatatacgtacttgggagtcggccat

SEQ ID NO: 408488 - DNA, 140 bp, Artificial Sequence
  Synthetic
  misc_feature (89)..(89): n is a, c, g, or t
  misc_feature (91)..(91): n is a, c, g, or t
  misc_feature (95)..(95): n is a, c, g, or t
atggccgactcccaagtacgtatattatctctgtgtaattgctaatttccctatcccattgcagccaggtcatgttctcccatatctgntnatgngttttattactccaactagagttccggagacccagcatggcgtat

SEQ ID NO: 408489 - DNA, 140 bp, Artificial Sequence
  Synthetic
aggccctggctgctgatatggaggaggtgggctttccagtcagacctcaggtgcctttaagaccaatgacttacaaggcagctttggatcttagccactttttaaaagaaaaggggggacgaccttttgggacagcggtg

SEQ ID NO: 408490 - DNA, 140 bp, Artificial Sequence
  Synthetic
caccgctgtcccaaaaggtcgtccccccttttcttttaaaaagtggctaagatccaaagctgccttgtaagtcattggtcttaaaggcacctgaggtctgactggaaagcccacctcctccatatcagcagccagggcct

SEQ ID NO: 408491 - DNA, 140 bp, Artificial Sequence
  Synthetic
aggccctggctgctgatatgagacatagtaccactgactgaagaagcagaattggaattggcagagaacagggaaattctaagaacccctgtgcatggagtatattatgacccatcaaaagaccttttgggacagcggtg

SEQ ID NO: 408492 - DNA, 140 bp, Artificial Sequence
  Synthetic
caccgctgtcccaaaaggtcttttgatgggtcataatatactccatgcacaggggttcttagaatttccctgttctctgccaattccaattctgcttcttcagtcagtggtactatgtctcatatcagcagccagggcct

SEQ ID NO: 408493 - DNA, 140 bp, Artificial Sequence
  Synthetic
aggccctggctgctgatatggagacaacatctgttgaggtggggatttaccacaccagacaaaaaacatcagaaagaacctccattcctttggatgggttatgaactccatcctgataaagaccttttgggacagcggtg

SEQ ID NO: 408494 - DNA, 140 bp, Artificial Sequence
  Synthetic
caccgctgtcccaaaaggtctttatcaggatggagttcataacccatccaaaggaatggaggttctttctgatgttttttgtctggtgtggtaaatccccacctcaacagatgttgtctccatatcagcagccagggcct

SEQ ID NO: 408495 - DNA, 140 bp, Artificial Sequence
  Synthetic
aggccctggctgctgatatgagcagtcctctattgtgtacatcaaaaaatagatgtaaaagacaccaaagaagctttagataagatagaggaagagcaaaacaaaagtaagaaaaaggcagaccttttgggacagcggtg

SEQ ID NO: 408496 - DNA, 140 bp, Artificial Sequence
  Synthetic
caccgctgtcccaaaaggtctgcctttttcttacttttgttttgctcttcctctatcttatctaaagcttctttggtgtcttttacatctattttttgatgtacacaatagaggactgctcatatcagcagccagggcct

SEQ ID NO: 408497 - DNA, 140 bp, Artificial Sequence
  Synthetic
  misc_feature (52)..(52): n is a, c, g, or t
atacgccatgctgggtctccatggcctgaaattagggacagaataagacganctcctccagcaccagcagcaagtggagtaggagcagtatctcaagatctagataaacgtggagcagtccgtacttgggagtcggccat

SEQ ID NO: 408498 - DNA, 140 bp, Artificial Sequence
  Synthetic
  misc_feature (89)..(89): n is a, c, g, or t
atggccgactcccaagtacggactgctccacgtttatctagatcttgagatactgctcctactccacttgctgctggtgctggaggagntcgtcttattctgtccctaatttcaggccatggagacccagcatggcgtat

SEQ ID NO: 408499 - DNA, 140 bp, Artificial Sequence
  Synthetic
atacgccatgctgggtctccttggatccaggaactaaagaatagtgctattagcttgcttgataccacagcagtagcagtagctgaggggacagatagggctatagaaatagtacaaagacgtacttgggagtcggccat

SEQ ID NO: 408500 - DNA, 140 bp, Artificial Sequence
  Synthetic
atggccgactcccaagtacgtctttgtactatttctatagccctatctgtcccctcagctactgctactgctgtggtatcaagcaagctaatagcactattctttagttcctggatccaaggagacccagcatggcgtat

SEQ ID NO: 408501 - DNA, 140 bp, Artificial Sequence
  Synthetic
atacgccatgctgggtctcctgagccagcagcagaaggggtgggagcagcatctcgggacctagaaaaatatggggcaatcacaagtagcaacacagcacagaccaatcctgactgtgcccgtacttgggagtcggccat

SEQ ID NO: 408502 - DNA, 140 bp, Artificial Sequence
  Synthetic
atggccgactcccaagtacgggcacagtcaggattggtctgtgctgtgttgctacttgtgattgccccatatttttctaggtcccgagatgctgctcccaccccttctgctgctggctcaggagacccagcatggcgtat

SEQ ID NO: 408503 - DNA, 140 bp, Artificial Sequence
  Synthetic
aggccctggctgctgatatggggcaatagtaggactgatagtagcgctaatcttagcaatagtagtgtggactatagtagctatagaatttaagaaaatactaaagcaaagaaaaatagagaccttttgggacagcggtg

SEQ ID NO: 408504 - DNA, 140 bp, Artificial Sequence
  Synthetic
caccgctgtcccaaaaggtctctatttttctttgctttagtattttcttaaattctatagctactatagtccacactactattgctaagattagcgctactatcagtcctactattgccccatatcagcagccagggcct

SEQ ID NO: 408505 - DNA, 140 bp, Artificial Sequence
  Synthetic
atacgccatgctgggtctccgcagacaagtcaaaattaccctgtagtagcaaatgcgcagggacaaatggtacatcaagccctctcccccaggactttaaatgcatgggtaaaggcagtacgtacttgggagtcggccat

SEQ ID NO: 408506 - DNA, 140 bp, Artificial Sequence
  Synthetic
atggccgactcccaagtacgtactgcctttacccatgcatttaaagtcctgggggagagggcttgatgtaccatttgtccctgcgcatttgctactacagggtaattttgacttgtctgcggagacccagcatggcgtat

SEQ ID NO: 408507 - DNA, 140 bp, Artificial Sequence
  Synthetic
atacgccatgctgggtctcctagtacttgggaaaatatggagggagaaataaaaaactgctctttcaatgtctccacaaaaataggaaataagatgcaaaaagaatatgcacttttttatcgtacttgggagtcggccat

SEQ ID NO: 408508 - DNA, 140 bp, Artificial Sequence
  Synthetic
atggccgactcccaagtacgataaaaaagtgcatattctttttgcatcttatttcctatttttgtggagacattgaaagagcagttttttatttctccctccatattttcccaagtactaggagacccagcatggcgtat

SEQ ID NO: 408509 - DNA, 140 bp, Artificial Sequence
  Synthetic
atacgccatgctgggtctccttacactgtacaaatgctacctttaagaataatgttaccaatgacatgaataaagaaataagaaattgctcttttaatacaaccacagaaataagagatacgtacttgggagtcggccat

SEQ ID NO: 408510 - DNA, 140 bp, Artificial Sequence
  Synthetic
atggccgactcccaagtacgtatctcttatttctgtggttgtattaaaagagcaatttcttatttctttattcatgtcattggtaacattattcttaaaggtagcatttgtacagtgtaaggagacccagcatggcgtat

SEQ ID NO: 408511 - DNA, 140 bp, Artificial Sequence
  Synthetic
atacgccatgctgggtctccagttgagagctcatctattgagctggggatttactacaccagacaaaaagcatcagaaagaacctccattcctttggatgggatatgaactccatcctgacgtacttgggagtcggccat

SEQ ID NO: 408512 - DNA, 140 bp, Artificial Sequence
  Synthetic
atggccgactcccaagtacgtcaggatggagttcatatcccatccaaaggaatggaggttctttctgatgctttttgtctggtgtagtaaatccccagctcaatagatgagctctcaactggagacccagcatggcgtat

SEQ ID NO: 408513 - DNA, 140 bp, Artificial Sequence
  Synthetic
atacgccatgctgggtctccgacagtggcaatgagagtgatagagatcaggaagaattggcagcgttggtggaaatggggcatgatgctccttgggatgttaatgatctgtaaggctacacgtacttgggagtcggccat

SEQ ID NO: 408514 - DNA, 140 bp, Artificial Sequence
  Synthetic
atggccgactcccaagtacgtgtagccttacagatcattaacatcccaaggagcatcatgccccatttccaccaacgctgccaattcttcctgatctctatcactctcattgccactgtcggagacccagcatggcgtat

SEQ ID NO: 408515 - DNA, 140 bp, Artificial Sequence
  Synthetic
atacgccatgctgggtctcctaacatagtagaacagatgcatgaagatataattagtttaaaagatcaaagccgaaagccatgtgtacaattaatctcactctgtgttacttttaattgccgtacttgggagtcggccat

SEQ ID NO: 408516 - DNA, 140 bp, Artificial Sequence
  Synthetic
atggccgactcccaagtacggcaattaaaagtaacacagagtgagattaattgtacacatggctttcggctttgatcttttaaactaattatatcttcatgcatctgttctactatgttaggagacccagcatggcgtat

SEQ ID NO: 408517 - DNA, 140 bp, Artificial Sequence
  Synthetic
atacgccatgctgggtctccagatgaaaccatcacactcccatgcagaataaaacaaattataaacatgtggcagggggtaggacgagcaatgtatgcccctcccattgcaggaaacatacgtacttgggagtcggccat

SEQ ID NO: 408518 - DNA, 140 bp, Artificial Sequence
  Synthetic
atggccgactcccaagtacgtatgtttcctgcaatgggaggggcatacattgctcgtcctaccccctgccacatgtttataatttgttttattctgcatgggagtgtgatggtttcatctggagacccagcatggcgtat

SEQ ID NO: 408519 - DNA, 140 bp, Artificial Sequence
  Synthetic
atacgccatgctgggtctccaaggatggaggggggagaagtaaaaaataagtctttcaagattgacactatcataagagaaaaggtgaagaaagagtatgcacttttttatgaacttgatcgtacttgggagtcggccat

SEQ ID NO: 408520 - DNA, 140 bp, Artificial Sequence
  Synthetic
atggccgactcccaagtacgatcaagttcataaaaaagtgcatactctttcttcaccttttctcttatgatagtgtcaatcttgaaagacttattttttacttctcccccctccatccttggagacccagcatggcgtat

SEQ ID NO: 408521 - DNA, 140 bp, Artificial Sequence
  Synthetic
atacgccatgctgggtctcctagctatatattgagaagttgtaacacacagtcacacacaggcctgtccaaagagacctttgagccaattcccatacattattgtaccccggctggttatcgtacttgggagtcggccat

SEQ ID NO: 408522 - DNA, 140 bp, Artificial Sequence
  Synthetic
atggccgactcccaagtacgataaccagccggggtacaataatgtatgggaattggctcaaaggtctctttggacaggcctgtgtgtgactgtgtgttacaacttctcaatatatagctaggagacccagcatggcgtat

SEQ ID NO: 408523 - DNA, 140 bp, Artificial Sequence
  Synthetic
aggccctggctgctgatatgaaacagggaaattctaaaagaaccagtacatggagtgtattatgacccatcaaaagacttaatagcagaaatacagaaacaagggcaagaccaatggacagaccttttgggacagcggtg

SEQ ID NO: 408524 - DNA, 140 bp, Artificial Sequence
  Synthetic
caccgctgtcccaaaaggtctgtccattggtcttgcccttgtttctgtatttctgctattaagtcttttgatgggtcataatacactccatgtactggttcttttagaatttccctgtttcatatcagcagccagggcct

SEQ ID NO: 408525 - DNA, 140 bp, Artificial Sequence
  Synthetic
atacgccatgctgggtctccactaatggtagcaggggaatgatggagaaaggagaaataaaaaattgcactttcaatatcaccacaggcatgggagataaggtgcagaaagaatctgcatcgtacttgggagtcggccat

SEQ ID NO: 408526 - DNA, 140 bp, Artificial Sequence
  Synthetic
atggccgactcccaagtacgatgcagattctttctgcaccttatctcccatgcctgtggtgatattgaaagtgcaattttttatttctcctttctccatcattcccctgctaccattagtggagacccagcatggcgtat

SEQ ID NO: 408527 - DNA, 140 bp, Artificial Sequence
  Synthetic
aggccctggctgctgatatgattagcattggacagttggaaaaatttgtggagttggtttgacatatcaaattggctgtggtatataaaaatattcatcatgatagtaggaggcttaatagaccttttgggacagcggtg

SEQ ID NO: 408528 - DNA, 140 bp, Artificial Sequence
  Synthetic
caccgctgtcccaaaaggtctattaagcctcctactatcatgatgaatatttttatataccacagccaatttgatatgtcaaaccaactccacaaatttttccaactgtccaatgctaatcatatcagcagccagggcct

SEQ ID NO: 408529 - DNA, 140 bp, Artificial Sequence
  Synthetic
aggccctggctgctgatatgcagagagggtgggaagcccttaagtatctgggaaatcttgtgcagtattggggtctggaactaaaaaagagtgctattagtctgcttgataccatagcaagaccttttgggacagcggtg

SEQ ID NO: 408530 - DNA, 140 bp, Artificial Sequence
  Synthetic
caccgctgtcccaaaaggtcttgctatggtatcaagcagactaatagcactcttttttagttccagaccccaatactgcacaagatttcccagatacttaagggcttcccaccctctctgcatatcagcagccagggcct

SEQ ID NO: 408531 - DNA, 140 bp, Artificial Sequence
  Synthetic
aggccctggctgctgatatggacaaatggacagtacagcctatacagctgccagacaaggatagctggactgtcaatgatatacagaagttagtaggaaaattaaactgggcaagtcagagaccttttgggacagcggtg

SEQ ID NO: 408532 - DNA, 140 bp, Artificial Sequence
  Synthetic
caccgctgtcccaaaaggtctctgacttgcccagtttaattttcctactaacttctgtatatcattgacagtccagctatccttgtctggcagctgtataggctgtactgtccatttgtccatatcagcagccagggcct

SEQ ID NO: 408533 - DNA, 140 bp, Artificial Sequence
  Synthetic
aggccctggctgctgatatgtagcattggacagttggaacaatctgtggaattggtttagcataacaaaatggctgtggtatataaaaatattcataatgatagtaggaggcttgatagggaccttttgggacagcggtg

SEQ ID NO: 408534 - DNA, 140 bp, Artificial Sequence
  Synthetic
caccgctgtcccaaaaggtccctatcaagcctcctactatcattatgaatatttttatataccacagccattttgttatgctaaaccaattccacagattgttccaactgtccaatgctacatatcagcagccagggcct

SEQ ID NO: 408535 - DNA, 140 bp, Artificial Sequence
  Synthetic
aggccctggctgctgatatggcatctcctatggcaggaagaagcggagacagcgacgagggactcctcacagcagtaaggatcatcaaaatcttgtaccaaagcagtgagtattagtaaagaccttttgggacagcggtg

SEQ ID NO: 408536 - DNA, 140 bp, Artificial Sequence
  Synthetic
caccgctgtcccaaaaggtctttactaatactcactgctttggtacaagattttgatgatccttactgctgtgaggagtccctcgtcgctgtctccgcttcttcctgccataggagatgccatatcagcagccagggcct

SEQ ID NO: 408537 - DNA, 140 bp, Artificial Sequence
  Synthetic
aggccctggctgctgatatgtgataataatctgtagtgttgcagaaaacttgtgggttactgtctactatggggtacctgtgtggaaagatgcagacaccaccttattttgtgcatcagagaccttttgggacagcggtg

SEQ ID NO: 408538 - DNA, 140 bp, Artificial Sequence
  Synthetic
caccgctgtcccaaaaggtctctgatgcacaaaataaggtggtgtctgcatctttccacacaggtaccccatagtagacagtaacccacaagttttctgcaacactacagattattatcacatatcagcagccagggcct

SEQ ID NO: 408539 - DNA, 140 bp, Artificial Sequence
  Synthetic
atacgccatgctgggtctccaaaacaaattgtaaatatgtggcaaggagtggggcaagcaatgtatgccgctcccattgcaggaaatattacctgcagatcaaatattacaggtatactacgtacttgggagtcggccat

SEQ ID NO: 408540 - DNA, 140 bp, Artificial Sequence
  Synthetic
atggccgactcccaagtacgtagtatacctgtaatatttgatctgcaggtaatatttcctgcaatgggagcggcatacattgcttgccccactccttgccacatatttacaatttgttttggagacccagcatggcgtat

SEQ ID NO: 408541 - DNA, 140 bp, Artificial Sequence
  Synthetic
atacgccatgctgggtctccaacagcacgatcaaggaagaaataaaaaactgctctttcagtgtaaccacagagctaaaagataagaaacggaaggtatattcacttttttataaacttgcgtacttgggagtcggccat

SEQ ID NO: 408542 - DNA, 140 bp, Artificial Sequence
  Synthetic
atggccgactcccaagtacgcaagtttataaaaaagtgaatataccttccgtttcttatcttttagctctgtggttacactgaaagagcagttttttatttcttccttgatcgtgctgttggagacccagcatggcgtat

SEQ ID NO: 408543 - DNA, 140 bp, Artificial Sequence
  Synthetic
  misc_feature (81)..(81): n is a, c, g, or t
atacgccatgctgggtctccgttgacagggacatgcaaggagaaataaaaaactgctctttcaatatgaccacagaaatanaggataagaaacagaaaatacatgcattgttttataaaccgtacttgggagtcggccat

SEQ ID NO: 408544 - DNA, 140 bp, Artificial Sequence
  Synthetic
  misc_feature (60)..(60): n is a, c, g, or t
atggccgactcccaagtacggtttataaaacaatgcatgtattttctgtttcttatcctntatttctgtggtcatattgaaagagcagttttttatttctccttgcatgtccctgtcaacggagacccagcatggcgtat

SEQ ID NO: 408545 - DNA, 140 bp, Artificial Sequence
  Synthetic
atacgccatgctgggtctccttagatctgaaaatatcacaaacaatgccaaaaatataatagtacaacttgtcaagcctgtagaaattaattgtaccagacctagcaacaatacaagaaccgtacttgggagtcggccat

SEQ ID NO: 408546 - DNA, 140 bp, Artificial Sequence
  Synthetic
atggccgactcccaagtacggttcttgtattgttgctaggtctggtacaattaatttctacaggcttgacaagttgtactattatatttttggcattgtttgtgatattttcagatctaaggagacccagcatggcgtat

SEQ ID NO: 408547 - DNA, 140 bp, Artificial Sequence
  Synthetic
aggccctggctgctgatatgtctggaaaactcatctgcaccactactgtaccttggaatactagttggagtaataaatcttatgataagatttggaataacatgacctggatgcagtggggaccttttgggacagcggtg

SEQ ID NO: 408548 - DNA, 140 bp, Artificial Sequence
  Synthetic
caccgctgtcccaaaaggtccccactgcatccaggtcatgttattccaaatcttatcataagatttattactccaactagtattccaaggtacagtagtggtgcagatgagttttccagacatatcagcagccagggcct

SEQ ID NO: 408549 - DNA, 140 bp, Artificial Sequence
  Synthetic
atacgccatgctgggtctccagcagctatagattaataaattgtaatacctcagccattacacaggcttgtccaaaggtatcctttgagccaattcccatacattattgtgccccagctgcgtacttgggagtcggccat

SEQ ID NO: 408550 - DNA, 140 bp, Artificial Sequence
  Synthetic
atggccgactcccaagtacgcagctggggcacaataatgtatgggaattggctcaaaggatacctttggacaagcctgtgtaatggctgaggtattacaatttattaatctatagctgctggagacccagcatggcgtat

SEQ ID NO: 408551 - DNA, 140 bp, Artificial Sequence
  Synthetic
atacgccatgctgggtctccaataatatttaatgaatcttcaggaggggatatggaaatcacaacacatagttttaattgtggaggagaattcttttattgtaatacatcaggcctgtttcgtacttgggagtcggccat

SEQ ID NO: 408552 - DNA, 140 bp, Artificial Sequence
  Synthetic
atggccgactcccaagtacgaaacaggcctgatgtattacaataaaagaattctcctccacaattaaaactatgtgttgtgatttccatatcccctcctgaagattcattaaatattattggagacccagcatggcgtat

SEQ ID NO: 408553 - DNA, 140 bp, Artificial Sequence
  Synthetic
atacgccatgctgggtctccacggaggctgtgacaattaattgtaccagacctggcaacaatacaagaaaaggtatacatatgggaccaggaaaagtattctatgcagcagatgacatagcgtacttgggagtcggccat

SEQ ID NO: 408554 - DNA, 140 bp, Artificial Sequence
  Synthetic
atggccgactcccaagtacgctatgtcatctgctgcatagaatacttttcctggtcccatatgtataccttttcttgtattgttgccaggtctggtacaattaattgtcacagcctccgtggagacccagcatggcgtat

SEQ ID NO: 408555 - DNA, 140 bp, Artificial Sequence
  Synthetic
aggccctggctgctgatatgtgtggcagagagtaggacaagcaatatatgcccctcctatccaaggaacaataaggtgtgaatcaaacattacaggactaatattaacaagagatggtgggaccttttgggacagcggtg

SEQ ID NO: 408556 - DNA, 140 bp, Artificial Sequence
  Synthetic
caccgctgtcccaaaaggtcccaccatctcttgttaatattagtcctgtaatgtttgattcacaccttattgttccttggataggaggggcatatattgcttgtcctactctctgccacacatatcagcagccagggcct

SEQ ID NO: 408557 - DNA, 140 bp, Artificial Sequence
  Synthetic
  misc_feature (89)..(89): n is a, c, g, or t
atacgccatgctgggtctccgcaactttacaacaggtagctaaaaaattaggagaacactttaccaatgcaacaataatttttaaaccntcctcgggaggggacccagaaattacaacaccgtacttgggagtcggccat

SEQ ID NO: 408558 - DNA, 140 bp, Artificial Sequence
  Synthetic
  misc_feature (52)..(52): n is a, c, g, or t
atggccgactcccaagtacggtgttgtaatttctgggtcccctcccgagganggtttaaaaattattgttgcattggtaaagtgttctcctaattttttagctacctgttgtaaagttgcggagacccagcatggcgtat

SEQ ID NO: 408559 - DNA, 140 bp, Artificial Sequence
  Synthetic
aggccctggctgctgatatgtgaaggacaattggagaagtgaattatataaatataaagtagtaaaaattgaaccactaggagtagcaccctccagggcaaggagaagagtggtgggaaggaccttttgggacagcggtg

SEQ ID NO: 408560 - DNA, 140 bp, Artificial Sequence
  Synthetic
caccgctgtcccaaaaggtccttcccaccactcttctccttgccctggagggtgctactcctagtggttcaatttttactactttatatttatataattcacttctccaattgtccttcacatatcagcagccagggcct

SEQ ID NO: 408561 - DNA, 140 bp, Artificial Sequence
  Synthetic
  misc_feature (81)..(81): n is a, c, g, or t
atacgccatgctgggtctcccatttgcaccactgctgtgccctggaactctacctggagtaataaatcttabgaggagatntggaataacatgacctggatggagtgggaaagggaaattcgtacttgggagtcggccat

SEQ ID NO: 408562 - DNA, 140 bp, Artificial Sequence
  Synthetic
  misc_feature (60)..(60): n is a, c, g, or t
atggccgactcccaagtacgaatttccctttcccactccatccaggtcatgttattccanatctcctcbtaagatttattactccaggtagagttccagggcacagcagtggtgcaaatgggagacccagcatggcgtat

SEQ ID NO: 408563 - DNA, 140 bp, Artificial Sequence
  Synthetic
atacgccatgctgggtctccaatggtactagcaacaatactaaggattgggaaaagatgaaggagggagaaataaaaaactgttctttcaatgccaccacaagcataagagataaggtgccgtacttgggagtcggccat

SEQ ID NO: 408564 - DNA, 140 bp, Artificial Sequence
  Synthetic
atggccgactcccaagtacggcaccttatctcttatgcttgtggtggcattgaaagaacagttttttatttctccctccttcatcttttcccaatccttagtattgttgctagtaccattggagacccagcatggcgtat

SEQ ID NO: 408565 - DNA, 140 bp, Artificial Sequence
  Synthetic
atacgccatgctgggtctccagaattggtagagctattatcaacataccaagaagaatcagacagggcgctgaaagagctttgctataacatggggggcaagtggtcaaaaagcagcatacgtacttgggagtcggccat

SEQ ID NO: 408566 - DNA, 140 bp, Artificial Sequence
  Synthetic
atggccgactcccaagtacgtatgctgctttttgaccacttgccccccatgttatagcaaagctctttcagcgccctgtctgattcttcttggtatgttgataatagctctaccaattctggagacccagcatggcgtat

SEQ ID NO: 408567 - DNA, 140 bp, Artificial Sequence
  Synthetic
aggccctggctgctgatatgcatctattgaaatggggatttaccacaccagataaaaaacatcagaaagaacctccatttctttggatgggatatgagctccatcctgacaaatggacaggaccttttgggacagcggtg

SEQ ID NO: 408568 - DNA, 140 bp, Artificial Sequence
  Synthetic
caccgctgtcccaaaaggtcctgtccatttgtcaggatggagctcatatcccatccaaagaaatggaggttctttctgatgttttttatctggtgtggtaaatccccatttcaatagatgcatatcagcagccagggcct

SEQ ID NO: 408569 - DNA, 140 bp, Artificial Sequence
  Synthetic
aggccctggctgctgatatgttcaaaattttcgggtttattacagggacagcagagacccaatttggaaaggaccagcaaaactactctggaaaggtgaaggggcagtagtaatacaagagaccttttgggacagcggtg

SEQ ID NO: 408570 - DNA, 140 bp, Artificial Sequence
  Synthetic
caccgctgtcccaaaaggtctcttgtattactactgccccttcacctttccagagtagttttgctggtcctttccaaattgggtctctgctgtccctgtaataaacccgaaaattttgaacatatcagcagccagggcct

SEQ ID NO: 408571 - DNA, 140 bp, Artificial Sequence
  Synthetic
aggccctggctgctgatatgaaatttggccttcccacaagggaaggccagggaatttccttcagagcagaccagagccaacagccccaccagcagagagcttcgggtttggggaggagatgaccttttgggacagcggtg

SEQ ID NO: 408572 - DNA, 140 bp, Artificial Sequence
  Synthetic
caccgctgtcccaaaaggtcatctcctccccaaacccgaagctctctgctggtggggctgttggctctggtctgctctgaaggaaattccctggccttcccttgtgggaaggccaaatttcatatcagcagccagggcct

SEQ ID NO: 408573 - DNA, 140 bp, Artificial Sequence
  Synthetic
aggccctggctgctgatatgatcagatgcatgaggatataatcagtttatgggatcaaagtctaaaaccatgtgtaaagttgaccccactctgtgtcactttaaattgtacaaatgtaacgaccttttgggacagcggtg

SEQ ID NO: 408574 - DNA, 140 bp, Artificial Sequence
  Synthetic
caccgctgtcccaaaaggtcgttacatttgtacaatttaaagtgacacagagtggggtcaactttacacatggttttagactttgatcccataaactgattatatcctcatgcatctgatcatatcagcagccagggcct

SEQ ID NO: 408575 - DNA, 140 bp, Artificial Sequence
  Synthetic
atacgccatgctgggtctccagtagttaatgctacacatactaataagagcatgaatggagaaattgacatgaaagaagaaatgaaaaattgctctttcaagacaaccacaggaataagacgtacttgggagtcggccat

SEQ ID NO: 408576 - DNA, 140 bp, Artificial Sequence
  Synthetic
atggccgactcccaagtacgtcttattcctgtggttgtcttgaaagagcaatttttcatttcttctttcatgtcaatttctccattcatgctcttattagtatgtgtagcattaactactggagacccagcatggcgtat

SEQ ID NO: 408577 - DNA, 140 bp, Artificial Sequence
  Synthetic
aggccctggctgctgatatggcaataatacaagaaaaagtataaggatagggccaggacaagcattctatgcaacaaatgccataacaggagatctaagacaagcacattgtaacattacgaccttttgggacagcggtg

SEQ ID NO: 408578 - DNA, 140 bp, Artificial Sequence
  Synthetic
caccgctgtcccaaaaggtcgtaatgttacaatgtgcttgtcttagatctcctgttatggcatttgttgcatagaatgcttgtcctggccctatccttatactttttcttgtattattgccatatcagcagccagggcct

SEQ ID NO: 408579 - DNA, 140 bp, Artificial Sequence
  Synthetic
atacgccatgctgggtctccaattagatctgaaaatttcacgaacaatgctaaaaccatactagtacagctgaatgaaactgtagaaattaattgtacaagacccaacaacaatacaagacgtacttgggagtcggccat

SEQ ID NO: 408580 - DNA, 140 bp, Artificial Sequence
  Synthetic
atggccgactcccaagtacgtcttgtattgttgttgggtcttgtacaattaatttctacagtttcattcagctgtactagtatggttttagcattgttcgtgaaattttcagatctaattggagacccagcatggcgtat

SEQ ID NO: 408581 - DNA, 140 bp, Artificial Sequence
  Synthetic
atacgccatgctgggtctccggtaaaaatacaactgtcgatgagagcatgaaaggagaaatacagaattgctctttcaatgtaaccacagaagtaagagataaggaaaagaaagaaagggcgtacttgggagtcggccat

SEQ ID NO: 408582 - DNA, 140 bp, Artificial Sequence
  Synthetic
atggccgactcccaagtacgccctttctttcttttccttatctcttacttctgtggttacattgaaagagcaattctgtatttctcctttcatgctctcatcgacagttgtatttttaccggagacccagcatggcgtat

SEQ ID NO: 408583 - DNA, 140 bp, Artificial Sequence
  Synthetic
aggccctggctgctgatatgatagtaggagcagaaactttctatgtagatggggcagctaatagagaaactagattaggaaaagcaggatatgttactgacagaggaagacagaaagttggaccttttgggacagcggtg

SEQ ID NO: 408584 - DNA, 140 bp, Artificial Sequence
  Synthetic
caccgctgtcccaaaaggtccaactttctgtcttcctctgtcagtaacatatcctgcttttcctaatctagtttctctattagctgccccatctacatagaaagtttctgctcctactatcatatcagcagccagggcct

SEQ ID NO: 408585 - DNA, 140 bp, Artificial Sequence
  Synthetic
aggccctggctgctgatatgacagcgagagcggtggaacttctgggacgcagcagtctcaggggactacagagggggtgggaagcccttaagtatctgggaagtcttgtgcagtattggggaccttttgggacagcggtg

SEQ ID NO: 408586 - DNA, 140 bp, Artificial Sequence
  Synthetic
caccgctgtcccaaaaggtccccaatactgcacaagacttcccagatacttaagggcttcccaccccctctgtagtcccctgagactgctgcgtcccagaagttccaccgctctcgctgtcatatcagcagccagggcct

SEQ ID NO: 408587 - DNA, 140 bp, Artificial Sequence
  Synthetic
aggccctggctgctgatatgaactctcaagacaggatcagaagaacttaaatcattatttaatacaatagtaaccctctggtgcgtacaccaaaggatagaggtaaaagacaccaaggaagaccttttgggacagcggtg

SEQ ID NO: 408588 - DNA, 140 bp, Artificial Sequence
  Synthetic
caccgctgtcccaaaaggtcttccttggtgtcttttacctctatcctttggtgtacgcaccagagggttactattgtattaaataatgatttaagttcttctgatcctgtcttgagagttcatatcagcagccagggcct

SEQ ID NO: 408589 - DNA, 140 bp, Artificial Sequence
  Synthetic
aggccctggctgctgatatgtaggagcagcgtctcaagacctagatagacatggagcacttacaaccagcaatacagcccacaataatgctgattgtgcctggctgcaagcacaagaggagaccttttgggacagcggtg

SEQ ID NO: 408590 - DNA, 140 bp, Artificial Sequence
  Synthetic
caccgctgtcccaaaaggtctcctcttgtgcttgcagccaggcacaatcagcattattgtgggctgtattgctggttgtaagtgctccatgtctatctaggtcttgagacgctgctcctacatatcagcagccagggcct

SEQ ID NO: 408591 - DNA, 140 bp, Artificial Sequence
  Synthetic
atacgccatgctgggtctccaccagctcttcagacaggaacagaggaaattaaatcactattcaacacagtagcagttctcttttgtgtgcatgaagggatagaggtaagagacaccaagcgtacttgggagtcggccat

SEQ ID NO: 408592 - DNA, 140 bp, Artificial Sequence
  Synthetic
atggccgactcccaagtacgcttggtgtctcttacctctatcccttcatgcacacaaaagagaactgctactgtgttgaatagtgatttaatttcctctgttcctgtctgaagagctggtggagacccagcatggcgtat

SEQ ID NO: 408593 - DNA, 140 bp, Artificial Sequence
  Synthetic
aggccctggctgctgatatgagctgtcagacattttcctagaccatggctacatggattaggacaatatatctataacacctatggggatacttgggaaggagttgaagctataataagagaccttttgggacagcggtg

SEQ ID NO: 408594 - DNA, 140 bp, Artificial Sequence
  Synthetic
caccgctgtcccaaaaggtctcttattatagcttcaactccttcccaagtatccccataggtgttatagatatattgtcctaatccatgtagccatggtctaggaaaatgtctgacagctcatatcagcagccagggcct

SEQ ID NO: 408595 - DNA, 140 bp, Artificial Sequence
  Synthetic
aggccctggctgctgatatgtctataacacctatggggatacttgggaaggagttgaagctataataagaattctgcaacaactactgtttgttcatttcagaattgggtgccaacataggaccttttgggacagcggtg

SEQ ID NO: 408596 - DNA, 140 bp, Artificial Sequence
  Synthetic
caccgctgtcccaaaaggtcctatgttggcacccaattctgaaatgaacaaacagtagttgttgcagaattcttattatagcttcaactccttcccaagtatccccataggtgttatagacatatcagcagccagggcct

SEQ ID NO: 408597 - DNA, 140 bp, Artificial Sequence
  Synthetic
aggccctggctgctgatatgatgaggatataatcaatttatgggatcaaagcctgaagccatgtgcaaaattaaccccaatctgtgttgttttaaattgcacttatgtgaacattacgcagaccttttgggacagcggtg

SEQ ID NO: 408598 - DNA, 140 bp, Artificial Sequence
  Synthetic
caccgctgtcccaaaaggtctgcgtaatgttcacataagtgcaatttaaaacaacacagattggggttaattttgcacatggcttcaggctttgatcccataaattgattatatcctcatcatatcagcagccagggcct

SEQ ID NO: 408599 - DNA, 140 bp, Artificial Sequence
  Synthetic
atacgccatgctgggtctccattgctcttttaatatcaccacaagcatgcaagataagaagcagaaagtatatgcagctttttatatgtctgatatcataccaatagatagtaataataacgtacttgggagtcggccat

SEQ ID NO: 408600 - DNA, 140 bp, Artificial Sequence
  Synthetic
atggccgactcccaagtacgttattattactatctattggtatgatatcagacatataaaaagctgcatatactttctgcttcttatcttgcatgcttgtggtgatattaaaagagcaatggagacccagcatggcgtat

SEQ ID NO: 408601 - DNA, 140 bp, Artificial Sequence
  Synthetic
atacgccatgctgggtctcctatagtaggtatagaatatagaaaaatacttaaacaaagaaaaatagacaggctaattgagaaaataagtgaaagagcagaagatagtggcaatgagagtcgtacttgggagtcggccat

SEQ ID NO: 408602 - DNA, 140 bp, Artificial Sequence
  Synthetic
atggccgactcccaagtacgactctcattgccactatcttctgctctttcacttattttctcaattagcctgtctatttttctttgtttaagtatttttctatattctatacctactataggagacccagcatggcgtat

SEQ ID NO: 408603 - DNA, 140 bp, Artificial Sequence
  Synthetic
atacgccatgctgggtctcctgtaataaaaaaaatttcactggaacacgcccatgtacaaaattcagtacattacaatttacacatggaattagcccattattatcaactcaactgctttcgtacttgggagtcggccat

SEQ ID NO: 408604 - DNA, 140 bp, Artificial Sequence
  Synthetic
atggccgactcccaagtacgaaagcagttgagttgataataatgggctaattccatgtgtaaattgtaatgtactgaattttgtacatgggcgtgttccagtgaaattttttttattacaggagacccagcatggcgtat

SEQ ID NO: 408605 - DNA, 140 bp, Artificial Sequence
  Synthetic
atacgccatgctgggtctccaagcacaacttgggagtaaaacaatagcaatagcctttaatcagtcctcaggaggggatccagaaattgtaatgcacagttttaattgtggaggagaattcgtacttgggagtcggccat

SEQ ID NO: 408606 - DNA, 140 bp, Artificial Sequence
  Synthetic
atggccgactcccaagtacgaattctcctccacaattaaaactgtgcattacaatttctggatcccctcctgaggactgattaaaggctattgctattgttttactcccaagttgtgcttggagacccagcatggcgtat

SEQ ID NO: 408607 - DNA, 140 bp, Artificial Sequence
  Synthetic
aggccctggctgctgatatgggaggggatccagaaattgtaatgcacagttttaattgtggaggagaatttttctattgtaatacatcaaaattgtttaacagtacttgggatgacaatagaccttttgggacagcggtg

SEQ ID NO: 408608 - DNA, 140 bp, Artificial Sequence
  Synthetic
caccgctgtcccaaaaggtctattgtcatcccaagtactgttaaacaattttgatgtattacaatagaaaaattctcctccacaattaaaactgtgcattacaatttctggatcccctcccatatcagcagccagggcct

SEQ ID NO: 408609 - DNA, 140 bp, Artificial Sequence
  Synthetic
aggccctggctgctgatatgagaataaaacaaattataaacatgtggcaggaagtaggaaaagcaatgtatgcccctcccatcagtggactaattaaatgttcatcaaatattacagggcgaccttttgggacagcggtg

SEQ ID NO: 408610 - DNA, 140 bp, Artificial Sequence
  Synthetic
caccgctgtcccaaaaggtcgccctgtaatatttgatgaacatttaattagtccactgatgggaggggcatacattgcttttcctacttcctgccacatgtttataatttgttttattctcatatcagcagccagggcct

SEQ ID NO: 408611 - DNA, 140 bp, Artificial Sequence
  Synthetic
aggccctggctgctgatatgaatcatagtaggggcactaataggggtgagaattgttatgatagtacttaatctagtgagaaacattaggcatggatatcaacccctctcatttcagaccgaccttttgggacagcggtg

SEQ ID NO: 408612 - DNA, 140 bp, Artificial Sequence
  Synthetic
caccgctgtcccaaaaggtcggtctgaaatgagaggggttgatatccatgcctaatgtttctcactagattaagtactatcataacaattctcacccctattagtgcccctactatgattcatatcagcagccagggcct

SEQ ID NO: 408613 - DNA, 140 bp, Artificial Sequence
  Synthetic
aggccctggctgctgatatgactatggggtacctgtgtggagagacgcagagaccaccctattttgtgcatcagatgctaaagcatataagacagaagtgcataatgtctgggctacacagaccttttgggacagcggtg

SEQ ID NO: 408614 - DNA, 140 bp, Artificial Sequence
  Synthetic
caccgctgtcccaaaaggtctgtgtagcccagacattatgcacttctgtcttatatgctttagcatctgatgcacaaaatagggtggtctctgcgtctctccacacaggtaccccatagtcatatcagcagccagggcct

SEQ ID NO: 408615 - DNA, 140 bp, Artificial Sequence
  Synthetic
atacgccatgctgggtctcctgattagatctgaaaatatcacaaacaatgccaagaacataatagtacaatttaccaaacctgtaaggattaattgtaccagacctaacaacaatacaagcgtacttgggagtcggccat

SEQ ID NO: 408616 - DNA, 140 bp, Artificial Sequence
  Synthetic
atggccgactcccaagtacgcttgtattgttgttaggtctggtacaattaatccttacaggtttggtaaattgtactattatgttcttggcattgtttgtgatattttcagatctaatcaggagacccagcatggcgtat

SEQ ID NO: 408617 - DNA, 140 bp, Artificial Sequence
  Synthetic
atacgccatgctgggtctccaacccctctctgcgttactttagattgtagctataacatcactaaggtcaacaatacgtataatgaaatgaaaaactgctcttataatatgacaacagaacgtacttgggagtcggccat

SEQ ID NO: 408618 - DNA, 140 bp, Artificial Sequence
  Synthetic
atggccgactcccaagtacgttctgttgtcatattataagagcagtttttcatttcattatacgtattgttgaccttagtgatgttatagctacaatctaaagtaacgcagagaggggttggagacccagcatggcgtat

SEQ ID NO: 408619 - DNA, 140 bp, Artificial Sequence
  Synthetic
atacgccatgctgggtctcctaataggggatatacgacaagcacattgtaatgtcaattacactgaatggaatgacactttgaaagaagtagcccaacaattaggaacatactttaataacgtacttgggagtcggccat

SEQ ID NO: 408620 - DNA, 140 bp, Artificial Sequence
  Synthetic
atggccgactcccaagtacgttattaaagtatgttcctaattgttgggctacttctttcaaagtgtcattccattcagtgtaattgacattacaatgtgcttgtcgtatatcccctattaggagacccagcatggcgtat

SEQ ID NO: 408621 - DNA, 140 bp, Artificial Sequence
  Synthetic
aggccctggctgctgatatgaatgacactttgaaagaagtagcccaacaattaggaacatactttaataacaaaacaataatatttaagagctccgcaggaggggatccagagatcacaagaccttttgggacagcggtg

SEQ ID NO: 408622 - DNA, 140 bp, Artificial Sequence
  Synthetic
caccgctgtcccaaaaggtcttgtgatctctggatcccctcctgcggagctcttaaatattattgttttgttattaaagtatgttcctaattgttgggctacttctttcaaagtgtcattcatatcagcagccagggcct

SEQ ID NO: 408623 - DNA, 140 bp, Artificial Sequence
  Synthetic
aggccctggctgctgatatggtaatacctcagccattacacaggcttgtccaaaggtatcctttgagccaattcccatacattattgtgctccagctggttttgcgattctaaagtgtaagaccttttgggacagcggtg

SEQ ID NO: 408624 - DNA, 140 bp, Artificial Sequence
  Synthetic
caccgctgtcccaaaaggtcttacactttagaatcgcaaaaccagctggagcacaataatgtatgggaattggctcaaaggatacctttggacaagcctgtgtaatggctgaggtattaccatatcagcagccagggcct

SEQ ID NO: 408625 - DNA, 140 bp, Artificial Sequence
  Synthetic
atacgccatgctgggtctccctgtttaatggtacttggaataatagcactttgaatggcactgccaagcaggaggtaaatgacagcactataacgatctcatgcaggataaagcaatttacgtacttgggagtcggccat

SEQ ID NO: 408626 - DNA, 140 bp, Artificial Sequence
  Synthetic
atggccgactcccaagtacgtaaattgctttatcctgcatgagatcgttatagtgctgtcatttacctcctgcttggcagtgccattcaaagtgctattattccaagtaccattaaacagggagacccagcatggcgtat

SEQ ID NO: 408627 - DNA, 140 bp, Artificial Sequence
  Synthetic
aggccctggctgctgatatgggaggtaaatgacagcactataacgatctcatgcaggataaagcaatttataaatatgtggcagagaacaggacgagcaatgtatgcccctcccattccagaccttttgggacagcggtg

SEQ ID NO: 408628 - DNA, 140 bp, Artificial Sequence
  Synthetic
caccgctgtcccaaaaggtctggaatgggaggggcatacattgctcgtcctgttctctgccacatatttataaattgctttatcctgcatgagatcgttatagtgctgtcatttacctcccatatcagcagccagggcct

SEQ ID NO: 408629 - DNA, 140 bp, Artificial Sequence
  Synthetic
atacgccatgctgggtctcccaataccaaaaccataatagtacaacttaagaagcatgtagtaattaattgcacccgacctagcaacaatacaagaaaaagtgtacatataggaccaggacgtacttgggagtcggccat

SEQ ID NO: 408630 - DNA, 140 bp, Artificial Sequence
  Synthetic
atggccgactcccaagtacgtcctggtcctatatgtacactttttcttgtattgttgctaggtcgggtgcaattaattactacatgcttcttaagttgtactattatggttttggtattgggagacccagcatggcgtat

SEQ ID NO: 408631 - DNA, 140 bp, Artificial Sequence
  Synthetic
aggccctggctgctgatatgttgtagagctattatcaatatacctacaagaataagacagggcttggaaagagctttgctataagatgggtggcatatggtcaaaaagcagtgtgagggggaccttttgggacagcggtg

SEQ ID NO: 408632 - DNA, 140 bp, Artificial Sequence
  Synthetic
caccgctgtcccaaaaggtccccctcacactgctttttgaccatatgccacccatcttatagcaaagctctttccaagccctgtcttattcttgtaggtatattgataatagctctacaacatatcagcagccagggcct

SEQ ID NO: 408633 - DNA, 140 bp, Artificial Sequence
  Synthetic
aggccctggctgctgatatgatccagaaatagtgatctaccaatacatggatgatttatatgtaggatctgacttagaaatagggcagcatagagcaaaaatagaggagttaagagaacagaccttttgggacagcggtg

SEQ ID NO: 408634 - DNA, 140 bp, Artificial Sequence
  Synthetic
caccgctgtcccaaaaggtctgttctcttaactcctctatttttgctctatgctgccctatttctaagtcagatcctacatataaatcatccatgtattggtagatcactatttctggatcatatcagcagccagggcct

SEQ ID NO: 408635 - DNA, 140 bp, Artificial Sequence
  Synthetic
aggccctggctgctgatatgggcgcaacagcatctgttgcaactcacagtctggggcatcaagcagctccaggcaagagtcctggctgtagaaagatacctaagggatcaacagctcctagaccttttgggacagcggtg

SEQ ID NO: 408636 - DNA, 140 bp, Artificial Sequence
  Synthetic
caccgctgtcccaaaaggtctaggagctgttgatcccttaggtatctttctacagccaggactcttgcctggagctgcttgatgccccagactgtgagttgcaacagatgctgttgcgcccatatcagcagccagggcct

SEQ ID NO: 408637 - DNA, 140 bp, Artificial Sequence
  Synthetic
aggccctggctgctgatatgcagcgctgtgacagacattagagaaataaaaaactgctctttcaacatgaccacagaattaaaggatagacagaagcaagaatacgcgcttttctataaagaccttttgggacagcggtg

SEQ ID NO: 408638 - DNA, 140 bp, Artificial Sequence
  Synthetic
caccgctgtcccaaaaggtctttatagaaaagcgcgtattcttgcttctgtctatcctttaattctgtggtcatgttgaaagagcagttttttatttctctaatgtctgtcacagcgctgcatatcagcagccagggcct

SEQ ID NO: 408639 - DNA, 140 bp, Artificial Sequence
  Synthetic
aggccctggctgctgatatgggaacttctgggacgcagggggtgggaagccatcaaatacctgtggaatctcctacagtattggattcaggagctaaagaatagtgctgttagcttgcttgaccttttgggacagcggtg

SEQ ID NO: 408640 - DNA, 140 bp, Artificial Sequence
  Synthetic
caccgctgtcccaaaaggtcaagcaagctaacagcactattctttagctcctgaatccaatactgtaggagattccacaggtatttgatggcttcccaccccctgcgtcccagaagttcccatatcagcagccagggcct

SEQ ID NO: 408641 - DNA, 140 bp, Artificial Sequence
  Synthetic
aggccctggctgctgatatgaattttttagggagagtctggccttcccacaaggggaggccagggaacttccttcagagcagaccagaaccaacagccccaccagctccatcagaggagagaccttttgggacagcggtg

SEQ ID NO: 408642 - DNA, 140 bp, Artificial Sequence
  Synthetic
caccgctgtcccaaaaggtctctcctctgatggagctggtggggctgttggttctggtctgctctgaaggaagttccctggcctccccttgtgggaaggccagactctccctaaaaaattcatatcagcagccagggcct

SEQ ID NO: 408643 - DNA, 140 bp, Artificial Sequence
  Synthetic
atacgccatgctgggtctccggagaggaaataatggagggaggagaaatgaaaaactgctctttctatatcaccacaagcataagagataaggtgcagaaagaatatgcaattttttatacgtacttgggagtcggccat

SEQ ID NO: 408644 - DNA, 140 bp, Artificial Sequence
  Synthetic
atggccgactcccaagtacgtataaaaaattgcatattctttctgcaccttatctcttatgcttgtggtgatatagaaagagcagtttttcatttctcctccctccattatttcctctccggagacccagcatggcgtat

SEQ ID NO: 408645 - DNA, 140 bp, Artificial Sequence
  Synthetic
aggccctggctgctgatatgacaagacccaacaacaatacaagaaaaagtatacatataggaccagggagagcattttatacaacaggagaagtaataggaaatataagacaagcatattgaccttttgggacagcggtg

SEQ ID NO: 408646 - DNA, 140 bp, Artificial Sequence
  Synthetic
caccgctgtcccaaaaggtcaatatgcttgtcttatatttcctattacttctcctgttgtataaaatgctctccctggtcctatatgtatactttttcttgtattgttgttgggtcttgtcatatcagcagccagggcct

SEQ ID NO: 408647 - DNA, 140 bp, Artificial Sequence
  Synthetic
atacgccatgctgggtctccatgtaactaaaaatgccacttcaaatggtaatgccattttaaatagtacagacataactaaagaaataagaaattgctctttcgagataaccacagaaatcgtacttgggagtcggccat

SEQ ID NO: 408648 - DNA, 140 bp, Artificial Sequence
  Synthetic
atggccgactcccaagtacgatttctgtggttatctcgaaagagcaatttcttatttctttagttatgtctgtactatttaaaatggcattaccatttgaagtggcatttttagttacatggagacccagcatggcgtat

SEQ ID NO: 408649 - DNA, 140 bp, Artificial Sequence
  Synthetic
aggccctggctgctgatatgcctcagagcagtgaggatcatcaaaattctataccaaagcagtaagtattagaaaatagtatatggaccccttagtaatattggcaatagtaggactgatgaccttttgggacagcggtg

SEQ ID NO: 408650 - DNA, 140 bp, Artificial Sequence
  Synthetic
caccgctgtcccaaaaggtcatcagtcctactattgccaatattactaaggggtccatatactattttctaatacttactgctttggtatagaattttgatgatcctcactgctctgaggcatatcagcagccagggcct

SEQ ID NO: 408651 - DNA, 140 bp, Artificial Sequence
  Synthetic
aggccctggctgctgatatgggacaagcattttatgcaacaggtgacgtaataggggatataagacaagcatattgtactgtcaatggaacaaaatggaatagaactttacaaaaggtaggaccttttgggacagcggtg

SEQ ID NO: 408652 - DNA, 140 bp, Artificial Sequence
  Synthetic
caccgctgtcccaaaaggtcctaccttttgtaaagttctattccattttgttccattgacagtacaatatgcttgtcttatatcccctattacgtcacctgttgcataaaatgcttgtcccatatcagcagccagggcct

SEQ ID NO: 408653 - DNA, 140 bp, Artificial Sequence
  Synthetic
aggccctggctgctgatatgcatattggggtctgcagacaggagaaaaggactggcatttgggtcatggagtctccatagaatggaggcagagagaatatagcacacaaatagatcctgagaccttttgggacagcggtg

SEQ ID NO: 408654 - DNA, 140 bp, Artificial Sequence
  Synthetic
caccgctgtcccaaaaggtctcaggatctatttgtgtgctatattctctctgcctccattctatggagactccatgacccaaatgccagtccttttctcctgtctgcagaccccaatatgcatatcagcagccagggcct

SEQ ID NO: 408655 - DNA, 140 bp, Artificial Sequence
  Synthetic
atacgccatgctgggtctccaaataataatagtgcaccttaatgaatctctagaaattgtgtgtacaagaccaggcaataatacaagaaaaggtataaggataggaccaggacaagcagtcgtacttgggagtcggccat

SEQ ID NO: 408656 - DNA, 140 bp, Artificial Sequence
  Synthetic
atggccgactcccaagtacgactgcttgtcctggtcctatccttataccttttcttgtattattgcctggtcttgtacacacaatttctagagattcattaaggtgcactattattatttggagacccagcatggcgtat

SEQ ID NO: 408657 - DNA, 140 bp, Artificial Sequence
  Synthetic
atacgccatgctgggtctccttactgaaggaaaatggaacataactttagaaaggataaagaagaagttagaaaaactcttccctaatagaacaatactctttaactcatcctcaggaggcgtacttgggagtcggccat

SEQ ID NO: 408658 - DNA, 140 bp, Artificial Sequence
  Synthetic
atggccgactcccaagtacgcctcctgaggatgagttaaagagtattgttctattagggaagagtttttctaacttcttctttatcctttctaaagttatgttccattttccttcagtaaggagacccagcatggcgtat

SEQ ID NO: 408659 - DNA, 140 bp, Artificial Sequence
  Synthetic
aggccctggctgctgatatggaaaaactcttccctaatagaacaatactctttaactcatcctcaggaggggacctagaagtcacaacacatagttttaactgtagaggagaattcttctgaccttttgggacagcggtg

SEQ ID NO: 408660 - DNA, 140 bp, Artificial Sequence
  Synthetic
caccgctgtcccaaaaggtcagaagaattctcctctacagttaaaactatgtgttgtgacttctaggtcccctcctgaggatgagttaaagagtattgttctattagggaagagtttttccatatcagcagccagggcct

SEQ ID NO: 408661 - DNA, 140 bp, Artificial Sequence
  Synthetic
aggccctggctgctgatatggacaacgacgaagcgctccttctagcagtaagagccatcaagatcttataccaaagcagtaagtatatgtaatgttggacttactagcaaaagtagattagaccttttgggacagcggtg

SEQ ID NO: 408662 - DNA, 140 bp, Artificial Sequence
  Synthetic
caccgctgtcccaaaaggtctaatctacttttgctagtaagtccaacattacatatacttactgctttggtataagatcttgatggctcttactgctagaaggagcgcttcgtcgttgtccatatcagcagccagggcct

SEQ ID NO: 408663 - DNA, 140 bp, Artificial Sequence
  Synthetic
  misc_feature (67)..(67): n is a, c, g, or t
  misc_feature (120)..(120): n is a, c, g, or t
atacgccatgctgggtctcctttggacaatgcaacagaatattttaacatgtggaaaaatgacatgntagatcaatgcttgaggacatcaatcagtttatgggatcaaagcctaaagccncgtacttgggagtcggccat

SEQ ID NO: 408664 - DNA, 140 bp, Artificial Sequence
  Synthetic
  misc_feature (21)..(21): n is a, c, g, or t
  misc_feature (74)..(74): n is a, c, g, or t
atggccgactcccaagtacgnggctttaggctttgatcccataaactgattgatgtcctcaagcattgatctancatgtcatttttccacatgttaaaatattctgttgcattgtccaaaggagacccagcatggcgtat

SEQ ID NO: 408665 - DNA, 140 bp, Artificial Sequence
  Synthetic
aggccctggctgctgatatggatgggtgcgagagcgtcagtattaagtgggggaaaattagataaatgggaaaaaattcggttacggccagggggaaagaaaaaatataagatgaaacatgaccttttgggacagcggtg

SEQ ID NO: 408666 - DNA, 140 bp, Artificial Sequence
  Synthetic
caccgctgtcccaaaaggtcatgtttcatcttatattttttctttccccctggccgtaaccgaattttttcccatttatctaattttcccccacttaatactgacgctctcgcacccatccatatcagcagccagggcct

SEQ ID NO: 408667 - DNA, 140 bp, Artificial Sequence
  Synthetic
  misc_feature (41)..(41): n is a, c, g, or t
atacgccatgctgggtctccaataccaccaactattaatantaccataacaccaacaaacatgccaaatataaatgagactggaaacatgaaggaagaaatgaaaaactgctctttcaatcgtacttgggagtcggccat

SEQ ID NO: 408668 - DNA, 140 bp, Artificial Sequence
  Synthetic
  misc_feature (100)..(100): n is a, c, g, or t
atggccgactcccaagtacgattgaaagagcagtttttcatttcttccttcatgtttccagtctcatttatatttggcatgtttgttggtgttatggtantattaatagttggtggtattggagacccagcatggcgtat

SEQ ID NO: 408669 - DNA, 140 bp, Artificial Sequence
  Synthetic
atacgccatgctgggtctccatagtgagtataggttaataaattgtaatacttcagtcattaagcaggcttgtccaaagatatcctttgatccaattcctatacattattgtactccagccgtacttgggagtcggccat

SEQ ID NO: 408670 - DNA, 140 bp, Artificial Sequence
  Synthetic
atggccgactcccaagtacggctggagtacaataatgtataggaattggatcaaaggatatctttggacaagcctgcttaatgactgaagtattacaatttattaacctatactcactatggagacccagcatggcgtat

SEQ ID NO: 408671 - DNA, 140 bp, Artificial Sequence
  Synthetic
aggccctggctgctgatatgaacaaattataaacatgtggcagggggtaggacgagcaatgtatgcccctcccattgaaggaaacataacatgtaactcaagtatcacaggactactattgaccttttgggacagcggtg

SEQ ID NO: 408672 - DNA, 140 bp, Artificial Sequence
  Synthetic
caccgctgtcccaaaaggtcaatagtagtcctgtgatacttgagttacatgttatgtttccttcaatgggaggggcatacattgctcgtcctaccccctgccacatgtttataatttgttcatatcagcagccagggcct

SEQ ID NO: 408673 - DNA, 140 bp, Artificial Sequence
  Synthetic
aggccctggctgctgatatgagaggagggagaagaggtaggatttccagtcagaccccaggcacctttaagaccaatgacttataaggaagcgtttgatctcggcttctttttaaaagaagaccttttgggacagcggtg

SEQ ID NO: 408674 - DNA, 140 bp, Artificial Sequence
  Synthetic
caccgctgtcccaaaaggtcttcttttaaaaagaagccgagatcaaacgcttccttataagtcattggtcttaaaggtgcctggggtctgactggaaatcctacctcttctccctcctctcatatcagcagccagggcct

SEQ ID NO: 408675 - DNA, 140 bp, Artificial Sequence
  Synthetic
aggccctggctgctgatatgacaatagtatttaattcatcctcaggaggggacctagagattacaacacatacctttaattgtggaggagaatttttctactgcaatacaacaaaactgtgaccttttgggacagcggtg

SEQ ID NO: 408676 - DNA, 140 bp, Artificial Sequence
  Synthetic
caccgctgtcccaaaaggtcacagttttgttgtattgcagtagaaaaattctcctccacaattaaaggtatgtgttgtaatctctaggtcccctcctgaggatgaattaaatactattgtcatatcagcagccagggcct

SEQ ID NO: 408677 - DNA, 140 bp, Artificial Sequence
  Synthetic
aggccctggctgctgatatgtttatgggatcaaagactaaagccatgtgtaaaattaaccccactctgtgttactttaaattgcactgatgatgtgaagaatcttactaaaagtactaatgaccttttgggacagcggtg

SEQ ID NO: 408678 - DNA, 140 bp, Artificial Sequence
  Synthetic
caccgctgtcccaaaaggtcattagtacttttagtaagattcttcacatcatcagtgcaatttaaagtaacacagagtggggttaattttacacatggctttagtctttgatcccataaacatatcagcagccagggcct

SEQ ID NO: 408679 - DNA, 140 bp, Artificial Sequence
  Synthetic
aggccctggctgctgatatggcttaggcatctcctatggcaggaagaagcggagacagcgacgaggacctcctcaaaacagtaaggatcatcaaaatcctgtaccaaagcagtaagtatcgaccttttgggacagcggtg

SEQ ID NO: 408680 - DNA, 140 bp, Artificial Sequence
  Synthetic
caccgctgtcccaaaaggtcgatacttactgctttggtacaggattttgatgatccttactgttttgaggaggtcctcgtcgctgtctccgcttcttcctgccataggagatgcctaagccatatcagcagccagggcct

SEQ ID NO: 408681 - DNA, 140 bp, Artificial Sequence
  Synthetic
aggccctggctgctgatatgcctcaaaacagtaaggatcatcaaaatcctgtaccaaagcagtaagtatcagtaattagtacatgtaatgcagcctttggaaatttgggcaatagtaggagaccttttgggacagcggtg

SEQ ID NO: 408682 - DNA, 140 bp, Artificial Sequence
  Synthetic
caccgctgtcccaaaaggtctcctactattgcccaaatttccaaaggctgcattacatgtactaattactgatacttactgctttggtacaggattttgatgatccttactgttttgaggcatatcagcagccagggcct

SEQ ID NO: 408683 - DNA, 140 bp, Artificial Sequence
  Synthetic
aggccctggctgctgatatgctggaactaaaaaagagtgctattagtttgcttgataccatagcaatagcagtagctgagggaacagataggattatagaattcatacaaagaatttgtagaccttttgggacagcggtg

SEQ ID NO: 408684 - DNA, 140 bp, Artificial Sequence
  Synthetic
caccgctgtcccaaaaggtctacaaattctttgtatgaattctataatcctatctgttccctcagctactgctattgctatggtatcaagcaaactaatagcactcttttttagttccagcatatcagcagccagggcct

SEQ ID NO: 408685 - DNA, 140 bp, Artificial Sequence
  Synthetic
atacgccatgctgggtctcctataataagaatcctgcaacaactactgtttattcatttcagaattgggtgtcaacatagcagaataggcattactccacagagaagaataagaaatggacgtacttgggagtcggccat

SEQ ID NO: 408686 - DNA, 140 bp, Artificial Sequence
  Synthetic
atggccgactcccaagtacgtccatttcttattcttctctgtggagtaatgcctattctgctatgttgacacccaattctgaaatgaataaacagtagttgttgcaggattcttattataggagacccagcatggcgtat

SEQ ID NO: 408687 - DNA, 140 bp, Artificial Sequence
  Synthetic
atacgccatgctgggtctccgactgggtaggctttccagtcgagccgctggtaccgctaagaccaatgacttttaaggcagcttttgatcttagcttctttttaaaagaaaaggggggaccgtacttgggagtcggccat

SEQ ID NO: 408688 - DNA, 140 bp, Artificial Sequence
  Synthetic
atggccgactcccaagtacggtccccccttttcttttaaaaagaagctaagatcaaaagctgccttaaaagtcattggtcttagcggtaccagcggctcgactggaaagcctacccagtcggagacccagcatggcgtat

SEQ ID NO: 408689 - DNA, 140 bp, Artificial Sequence
  Synthetic
atacgccatgctgggtctccctgaagtaagagaaagaatgagaagaactaagccagcagcagagccagcagtagagccagcagcagtgggagtagggccagcgtctcaagacctagataacgtacttgggagtcggccat

SEQ ID NO: 408690 - DNA, 140 bp, Artificial Sequence
  Synthetic
atggccgactcccaagtacgttatctaggtcttgagacgctggccctactcccactgctgctggctctactgctggctctgctgctggcttagttcttctcattctttctcttacttcagggagacccagcatggcgtat

SEQ ID NO: 408691 - DNA, 140 bp, Artificial Sequence
  Synthetic
aggccctggctgctgatatgtaccaaaacagtaagtaatatatgtaatgcagtctttagaaatattagcaatagcagcaattgtagtagcgctaatactagccatagttgtgtggaccatgaccttttgggacagcggtg

SEQ ID NO: 408692 - DNA, 140 bp, Artificial Sequence
  Synthetic
caccgctgtcccaaaaggtcatggtccacacaactatggctagtattagcgctactacaattgctgctattgctaatatttctaaagactgcattacatatattacttactgttttggtacatatcagcagccagggcct

SEQ ID NO: 408693 - DNA, 140 bp, Artificial Sequence
  Synthetic
atacgccatgctgggtctccaataaaaaactgctctttcaatatgaccacagagctaagggataagaaacagaaggtatatgcacttttttatagacttgatgtagtacaaattaataatcgtacttgggagtcggccat

SEQ ID NO: 408694 - DNA, 140 bp, Artificial Sequence
  Synthetic
atggccgactcccaagtacgattattaatttgtactacatcaagtctataaaaaagtgcatataccttctgtttcttatcccttagctctgtggtcatattgaaagagcagttttttattggagacccagcatggcgtat

SEQ ID NO: 408695 - DNA, 140 bp, Artificial Sequence
  Synthetic
aggccctggctgctgatatgttgagccaattcccatacattattgtgccccagctggttttgcgatcctaaagtgtaatgataagaagttcaatggaacagggccatgcaagaatgtcaggaccttttgggacagcggtg

SEQ ID NO: 408696 - DNA, 140 bp, Artificial Sequence
  Synthetic
caccgctgtcccaaaaggtcctgacattcttgcatggccctgttccattgaacttcttatcattacactttaggatcgcaaaaccagctggggcacaataatgtatgggaattggctcaacatatcagcagccagggcct

SEQ ID NO: 408697 - DNA, 140 bp, Artificial Sequence
  Synthetic
atacgccatgctgggtctcctgttaaatggcagtctagcagaagaagagataaaaattagatctgaaaatatcacaagtaatagcaaaaatatcatagtccaatttgtcaagcctgtgaacgtacttgggagtcggccat

SEQ ID NO: 408698 - DNA, 140 bp, Artificial Sequence
  Synthetic
atggccgactcccaagtacgttcacaggcttgacaaattggactatgatatttttgctattacttgtgatattttcagatctaatttttatctcttcttctgctagactgccatttaacaggagacccagcatggcgtat

SEQ ID NO: 408699 - DNA, 140 bp, Artificial Sequence
  Synthetic
atacgccatgctgggtctccgaccaggacaagcattttatacaacagagataataggggacataagacaagcatattgtactatcaatggatcagaatggaataacactttacgagaggtcgtacttgggagtcggccat

SEQ ID NO: 408700 - DNA, 140 bp, Artificial Sequence
  Synthetic
atggccgactcccaagtacgacctctcgtaaagtgttattccattctgatccattgatagtacaatatgcttgtcttatgtcccctattatctctgttgtataaaatgcttgtcctggtcggagacccagcatggcgtat

SEQ ID NO: 408701 - DNA, 140 bp, Artificial Sequence
  Synthetic
atacgccatgctgggtctccaatgcaaaactgttctttcaatataaccacagaaataagaaataaaagacagaatgtatattcacttttttataaacttgatttagtaccaataggcaatcgtacttgggagtcggccat

SEQ ID NO: 408702 - DNA, 140 bp, Artificial Sequence
  Synthetic
atggccgactcccaagtacgattgcctattggtactaaatcaagtttataaaaaagtgaatatacattctgtcttttatttcttatttctgtggttatattgaaagaacagttttgcattggagacccagcatggcgtat

SEQ ID NO: 408703 - DNA, 140 bp, Artificial Sequence
  Synthetic
aggccctggctgctgatatgacccctcaggaggggatctagaaatcatgacacatacttttaattgtggaggagaattcttctattgtaatacatcaagactgtttaatagcacttggaagaccttttgggacagcggtg

SEQ ID NO: 408704 - DNA, 140 bp, Artificial Sequence
  Synthetic
caccgctgtcccaaaaggtcttccaagtgctattaaacagtcttgatgtattacaatagaagaattctcctccacaattaaaagtatgtgtcatgatttctagatcccctcctgaggggtcatatcagcagccagggcct

SEQ ID NO: 408705 - DNA, 140 bp, Artificial Sequence
  Synthetic
aggccctggctgctgatatgccatacattattgtgccccagctggttttgcaattctaaagtgtaaagataagaagttcaatggaacaggcccatgcaaaaatgttagcacagtacaatggaccttttgggacagcggtg

SEQ ID NO: 408706 - DNA, 140 bp, Artificial Sequence
  Synthetic
caccgctgtcccaaaaggtccattgtactgtgctaacatttttgcatgggcctgttccattgaacttcttatctttacactttagaattgcaaaaccagctggggcacaataatgtatggcatatcagcagccagggcct

SEQ ID NO: 408707 - DNA, 140 bp, Artificial Sequence
  Synthetic
aggccctggctgctgatatgatgtggcagagaacaggacaagcaatgtatgcccctcccatccgaggagtaataagatgtgaatcaaacattacaggactaatattaacaagagatagtggaccttttgggacagcggtg

SEQ ID NO: 408708 - DNA, 140 bp, Artificial Sequence
  Synthetic
caccgctgtcccaaaaggtccactatctcttgttaatattagtcctgtaatgtttgattcacatcttattactcctcggatgggaggggcatacattgcttgtcctgttctctgccacatcatatcagcagccagggcct

SEQ ID NO: 408709 - DNA, 140 bp, Artificial Sequence
  Synthetic
atacgccatgctgggtctccaaggccttacaacaataaaagacaaaggacacctataggactagggcaggtactccatacaacaagggtaaaaggagatataagacaagcacattgtaaccgtacttgggagtcggccat

SEQ ID NO: 408710 - DNA, 140 bp, Artificial Sequence
  Synthetic
atggccgactcccaagtacggttacaatgtgcttgtcttatatctccttttacccttgttgtatggagtacctgccctagtcctataggtgtcctttgtcttttattgttgtaaggccttggagacccagcatggcgtat

SEQ ID NO: 408711 - DNA, 140 bp, Artificial Sequence
  Synthetic
aggccctggctgctgatatgcattaggaccaggggcttcattagaagaaatgatgacagcatgtcagggagtgggaggacctagccacaaagcaagagtgttggctgaggcaatgagccagaccttttgggacagcggtg

SEQ ID NO: 408712 - DNA, 140 bp, Artificial Sequence
  Synthetic
caccgctgtcccaaaaggtctggctcattgcctcagccaacactcttgctttgtggctaggtcctcccactccctgacatgctgtcatcatttcttctaatgaagcccctggtcctaatgcatatcagcagccagggcct

SEQ ID NO: 408713 - DNA, 140 bp, Artificial Sequence
  Synthetic
atacgccatgctgggtctcctaatattacactcccatgcagaataaaacagattataaacctgtggcagagagtaggaaaagcaatgtatgcccctcccattgagggagtgatcagctgtcgtacttgggagtcggccat

SEQ ID NO: 408714 - DNA, 140 bp, Artificial Sequence
  Synthetic
atggccgactcccaagtacgacagctgatcactccctcaatgggaggggcatacattgcttttcctactctctgccacaggtttataatctgttttattctgcatgggagtgtaatattaggagacccagcatggcgtat

SEQ ID NO: 408715 - DNA, 140 bp, Artificial Sequence
  Synthetic
aggccctggctgctgatatggaggaagtgggctttccagtcagacctcaggtacctttaagaccaatgacttacaaaggagctttagatcttagccactttttaaaagaaaaggggggacgaccttttgggacagcggtg

SEQ ID NO: 408716 - DNA, 140 bp, Artificial Sequence
  Synthetic
caccgctgtcccaaaaggtcgtccccccttttcttttaaaaagtggctaagatctaaagctcctttgtaagtcattggtcttaaaggtacctgaggtctgactggaaagcccacttcctccatatcagcagccagggcct

SEQ ID NO: 408717 - DNA, 140 bp, Artificial Sequence
  Synthetic
aggccctggctgctgatatgacaccaaatgaaagactgtactgagaggcaggctaattttttagggaaaatttggccttcccacaaggggaggccagggaatttccttcagaacagaccagaccttttgggacagcggtg

SEQ ID NO: 408718 - DNA, 140 bp, Artificial Sequence
  Synthetic
caccgctgtcccaaaaggtctggtctgttctgaaggaaattccctggcctccccttgtgggaaggccaaattttccctaaaaaattagcctgcctctcagtacagtctttcatttggtgtcatatcagcagccagggcct

SEQ ID NO: 408719 - DNA, 140 bp, Artificial Sequence
  Synthetic
atacgccatgctgggtctccaagtatctgtggagtctcctgcagtattggatacaggaactgaaaaatagtgctattagcttgcttgataccatagcaatagcagtagctgaggggacagcgtacttgggagtcggccat

SEQ ID NO: 408720 - DNA, 140 bp, Artificial Sequence
  Synthetic
atggccgactcccaagtacgctgtcccctcagctactgctattgctatggtatcaagcaagctaatagcactatttttcagttcctgtatccaatactgcaggagactccacagatacttggagacccagcatggcgtat

SEQ ID NO: 408721 - DNA, 140 bp, Artificial Sequence
  Synthetic
aggccctggctgctgatatgagtagtgtcaactcaactgctgttaaatggcagtctagcagaagaagagatagtaattagatctgaaaatttcacaaacaatgctaaaaccataatagtagaccttttgggacagcggtg

SEQ ID NO: 408722 - DNA, 140 bp, Artificial Sequence
  Synthetic
caccgctgtcccaaaaggtctactattatggttttagcattgtttgtgaaattttcagatctaattactatctcttcttctgctagactgccatttaacagcagttgagttgacactactcatatcagcagccagggcct

SEQ ID NO: 408723 - DNA, 140 bp, Artificial Sequence
  Synthetic
atacgccatgctgggtctccggagcagaaagacaaggaactgtatcctttagcttccctcaaatcactctttggcaacgacccgttgtcgcagtaaagatagggggacagctaaaggaagcgtacttgggagtcggccat

SEQ ID NO: 408724 - DNA, 140 bp, Artificial Sequence
  Synthetic
atggccgactcccaagtacgcttcctttagctgtccccctatctttactgcgacaacgggtcgttgccaaagagtgatttgagggaagctaaaggatacagttccttgtctttctgctccggagacccagcatggcgtat

SEQ ID NO: 408725 - DNA, 140 bp, Artificial Sequence
  Synthetic
atacgccatgctgggtctccagtactgctaacgccactatagatgaagaaatgaagggagaaataaagaagtgctctttcaataccaccacagaagtaggagataagaaacagcaagtgtcgtacttgggagtcggccat

SEQ ID NO: 408726 - DNA, 140 bp, Artificial Sequence
  Synthetic
atggccgactcccaagtacgacacttgctgtttcttatctcctacttctgtggtggtattgaaagagcacttctttatttctcccttcatttcttcatctatagtggcgttagcagtactggagacccagcatggcgtat

SEQ ID NO: 408727 - DNA, 140 bp, Artificial Sequence
  Synthetic
atacgccatgctgggtctcccctataaacattgtgtgtataagacccggcaataacacaagaaaaagtgtaaggataggaccaggaccagggcaaacattctatgcaacagacatagtagcgtacttgggagtcggccat

SEQ ID NO: 408728 - DNA, 140 bp, Artificial Sequence
  Synthetic
atggccgactcccaagtacgctactatgtctgttgcatagaatgtttgccctggtcctggtcctatccttacactttttcttgtgttattgccgggtcttatacacacaatgtttataggggagacccagcatggcgtat

SEQ ID NO: 408729 - DNA, 140 bp, Artificial Sequence
  Synthetic
aggccctggctgctgatatggtttcaaccatcctcaggaggagacctagaagttacaacacatagttttaattgtagaggagaatttttctattgcaatacaacaaaactgttcactagtgaccttttgggacagcggtg

SEQ ID NO: 408730 - DNA, 140 bp, Artificial Sequence
  Synthetic
caccgctgtcccaaaaggtcactagtgaacagttttgttgtattgcaatagaaaaattctcctctacaattaaaactatgtgttgtaacttctaggtctcctcctgaggatggttgaaaccatatcagcagccagggcct

SEQ ID NO: 408731 - DNA, 140 bp, Artificial Sequence
  Synthetic
aggccctggctgctgatatgattatggggtacctgtgtggagagaagcaaccactactctattttgtgcatcagatgctaaatcatataaagcagaggcacataatatctgggctacacagaccttttgggacagcggtg

SEQ ID NO: 408732 - DNA, 140 bp, Artificial Sequence
  Synthetic
caccgctgtcccaaaaggtctgtgtagcccagatattatgtgcctctgctttatatgatttagcatctgatgcacaaaatagagtagtggttgcttctctccacacaggtaccccataatcatatcagcagccagggcct

SEQ ID NO: 408733 - DNA, 140 bp, Artificial Sequence
  Synthetic
aggccctggctgctgatatgttgtaaggatgtggcagagggtaggacgagcaatgtatgctcctcccatcccaggagtaataaggtgtgaatcaaacattacaggaatactattaacaaggaccttttgggacagcggtg

SEQ ID NO: 408734 - DNA, 140 bp, Artificial Sequence
  Synthetic
caccgctgtcccaaaaggtccttgttaatagtattcctgtaatgtttgattcacaccttattactcctgggatgggaggagcatacattgctcgtcctaccctctgccacatccttacaacatatcagcagccagggcct

SEQ ID NO: 408735 - DNA, 140 bp, Artificial Sequence
  Synthetic
aggccctggctgctgatatgctgttgttgaatggcagtctagcagaggaagagataataattagaactgaaaatatcacaagaaatgataaaaatataatagtgcagcttaatgagtctggaccttttgggacagcggtg

SEQ ID NO: 408736 - DNA, 140 bp, Artificial Sequence
  Synthetic
caccgctgtcccaaaaggtccagactcattaagctgcactattatatttttatcatttcttgtgatattttcagttctaattattatctcttcctctgctagactgccattcaacaacagcatatcagcagccagggcct

SEQ ID NO: 408737 - DNA, 140 bp, Artificial Sequence
  Synthetic
atacgccatgctgggtctccataggactagggcaagcattatatacaacaagaataataggagatataagacaagcacattgtaacattagtagaggggaatggaataaaactttagaaccgtacttgggagtcggccat

SEQ ID NO: 408738 - DNA, 140 bp, Artificial Sequence
  Synthetic
atggccgactcccaagtacggttctaaagttttattccattcccctctactaatgttacaatgtgcttgtcttatatctcctattattcttgttgtatataatgcttgccctagtcctatggagacccagcatggcgtat

SEQ ID NO: 408739 - DNA, 140 bp, Artificial Sequence
  Synthetic
atacgccatgctgggtctccaaaccagccgcgggaggggacctagaaattacaacacacacctttaattgtggaggggaatttttctactgtaacacatcaggactgtttaatagtataacgtacttgggagtcggccat

SEQ ID NO: 408740 - DNA, 140 bp, Artificial Sequence
  Synthetic
atggccgactcccaagtacgttatactattaaacagtcctgatgtgttacagtagaaaaattcccctccacaattaaaggtgtgtgttgtaatttctaggtcccctcccgcggctggtttggagacccagcatggcgtat

SEQ ID NO: 408741 - DNA, 140 bp, Artificial Sequence
  Synthetic
atacgccatgctgggtctccgtgccctagaactctagttggagtaataaatcttataatgagatttgggaaaacatgacctggagggactgggagagggaaattgacaagtatacagacacgtacttgggagtcggccat

SEQ ID NO: 408742 - DNA, 140 bp, Artificial Sequence
  Synthetic
atggccgactcccaagtacgtgtctgtatacttgtcaatttccctctcccagtccctccaggtcatgttttcccaaatctcattataagatttattactccaactagagttctagggcacggagacccagcatggcgtat

SEQ ID NO: 408743 - DNA, 140 bp, Artificial Sequence
  Synthetic
aggccctggctgctgatatgccagcaacacagcccacaataatgctgattgtgcctggctgcaagcacaagaggaggaagaagaagtaggctttccagtcagacctcaggtgcctttaaggaccttttgggacagcggtg

SEQ ID NO: 408744 - DNA, 140 bp, Artificial Sequence
  Synthetic
caccgctgtcccaaaaggtccttaaaggcacctgaggtctgactggaaagcctacttcttcttcctcctcttgtgcttgcagccaggcacaatcagcattattgtgggctgtgttgctggcatatcagcagccagggcct

SEQ ID NO: 408745 - DNA, 140 bp, Artificial Sequence
  Synthetic
  misc_feature (22)..(22): n is a, c, g, or t
atacgccatgctgggtctccgnagtgagtattagtaataagtatatgtaatgttatcctctttgcatatctggtcaatagtagggctgatagtatcgctaatcctagcaataattgtgtgcgtacttgggagtcggccat

SEQ ID NO: 408746 - DNA, 140 bp, Artificial Sequence
  Synthetic
  misc_feature (119)..(119): n is a, c, g, or t
atggccgactcccaagtacgcacacaattattgctaggattagcgatactatcagccctactattgaccagatatgcaaagaggataacattacatatacttattactaatactcactncggagacccagcatggcgtat

SEQ ID NO: 408747 - DNA, 140 bp, Artificial Sequence
  Synthetic
aggccctggctgctgatatgctgtgctttctttagtgaatagagttaggcagggatactcacctctgtcgtttcagaccctcttcccagccccgaggggacccgacaggcccgaaggaacgaccttttgggacagcggtg

SEQ ID NO: 408748 - DNA, 140 bp, Artificial Sequence
  Synthetic
caccgctgtcccaaaaggtcgttccttcgggcctgtcgggtcccctcggggctgggaagagggtctgaaacgacagaggtgagtatccctgcctaactctattcactaaagaaagcacagcatatcagcagccagggcct

SEQ ID NO: 408749 - DNA, 140 bp, Artificial Sequence
  Synthetic
aggccctggctgctgatatgtggggtgggaaggcctcaaatatctggggaatcttctgatatattggagccaggaactaaaaactagtgctatttctttgcttgatgctacagcaatagcgaccttttgggacagcggtg

SEQ ID NO: 408750 - DNA, 140 bp, Artificial Sequence
  Synthetic
caccgctgtcccaaaaggtcgctattgctgtagcatcaagcaaagaaatagcactagtttttagttcctggctccaatatatcagaagattccccagatatttgaggccttcccaccccacatatcagcagccagggcct

SEQ ID NO: 408751 - DNA, 140 bp, Artificial Sequence
  Synthetic
aggccctggctgctgatatggtctacctgtcatgggtaccagcacacaaggggattggaggaaatgaacaagtagataaattagtcagttcaggaatcaggaaggtgctatttttagatggaccttttgggacagcggtg

SEQ ID NO: 408752 - DNA, 140 bp, Artificial Sequence
  Synthetic
caccgctgtcccaaaaggtccatctaaaaatagcaccttcctgattcctgaactgactaatttatctacttgttcatttcctccaatccccttgtgtgctggtacccatgacaggtagaccatatcagcagccagggcct

SEQ ID NO: 408753 - DNA, 140 bp, Artificial Sequence
  Synthetic
atacgccatgctgggtctccgccgcaaacagcacggaagaaatgatgaaaaactgctctttcaatataaccacagagataagggataagagaaagaaggtctattcacttttttatagaccgtacttgggagtcggccat

SEQ ID NO: 408754 - DNA, 140 bp, Artificial Sequence
  Synthetic
atggccgactcccaagtacggtctataaaaaagtgaatagaccttctttctcttatcccttatctctgtggttatattgaaagagcagtttttcatcatttcttccgtgctgtttgcggcggagacccagcatggcgtat

SEQ ID NO: 408755 - DNA, 140 bp, Artificial Sequence
  Synthetic
aggccctggctgctgatatgtataggaccaggacaggcattctatgcaataggtgacataatagggaaaataagacaagcacattgcaatgtcagtaggtcaaaatggaataaaactttagaccttttgggacagcggtg

SEQ ID NO: 408756 - DNA, 140 bp, Artificial Sequence
  Synthetic
caccgctgtcccaaaaggtctaaagttttattccattttgacctactgacattgcaatgtgcttgtcttattttccctattatgtcacctattgcatagaatgcctgtcctggtcctatacatatcagcagccagggcct

SEQ ID NO: 408757 - DNA, 140 bp, Artificial Sequence
  Synthetic
atacgccatgctgggtctccaatatttgataaaccctcaggaggggacctagaaatcacaacacatagttttaattgtggaggagaatttttttactgtgatacatcaggcctgtttaatcgtacttgggagtcggccat

SEQ ID NO: 408758 - DNA, 140 bp, Artificial Sequence
  Synthetic
atggccgactcccaagtacgattaaacaggcctgatgtatcacagtaaaaaaattctcctccacaattaaaactatgtgttgtgatttctaggtcccctcctgagggtttatcaaatattggagacccagcatggcgtat

SEQ ID NO: 408759 - DNA, 140 bp, Artificial Sequence
  Synthetic
aggccctggctgctgatatgttattcaagcacaaccagataaaagtgaatcagagttagtcaatcaaataatagaacagttaataaaaaaggaaaaggtctacctgtcatgggtaccagcgaccttttgggacagcggtg

SEQ ID NO: 408760 - DNA, 140 bp, Artificial Sequence
  Synthetic
caccgctgtcccaaaaggtcgctggtacccatgacaggtagaccttttccttttttattaactgttctattatttgattgactaactctgattcacttttatctggttgtgcttgaataacatatcagcagccagggcct

SEQ ID NO: 408761 - DNA, 140 bp, Artificial Sequence
  Synthetic
aggccctggctgctgatatgtttggatggggtatgaactccatcctgacaaatggacagtacagcctatacagctgccagaaaaggatagctggactgtcaatgatatacagaagttagtgaccttttgggacagcggtg

SEQ ID NO: 408762 - DNA, 140 bp, Artificial Sequence
  Synthetic
caccgctgtcccaaaaggtcactaacttctgtatatcattgacagtccagctatccttttctggcagctgtataggctgtactgtccatttgtcaggatggagttcataccccatccaaacatatcagcagccagggcct

SEQ ID NO: 408763 - DNA, 140 bp, Artificial Sequence
  Synthetic
aggccctggctgctgatatgaaagaagggcttaggcatttccaatggcaggaagaagaggagaccaagacgaacaactccttacggcagtaagaatcatcaagatcctataccagagcaggaccttttgggacagcggtg

SEQ ID NO: 408764 - DNA, 140 bp, Artificial Sequence
  Synthetic
caccgctgtcccaaaaggtcctgctctggtataggatcttgatgattcttactgccgtaaggagttgttcgtcttggtctcctcttcttcctgccattggaaatgcctaagcccttctttcatatcagcagccagggcct

SEQ ID NO: 408765 - DNA, 140 bp, Artificial Sequence
  Synthetic
atacgccatgctgggtctccggagagggagaactaaaaaactgctctttcaatgtcaccacaggtataaaaaataaggtaaaaaaggagtatgcaatttttaatagacttgatgtagtaccgtacttgggagtcggccat

SEQ ID NO: 408766 - DNA, 140 bp, Artificial Sequence
  Synthetic
atggccgactcccaagtacggtactacatcaagtctattaaaaattgcatactccttttttaccttattttttatacctgtggtgacattgaaagagcagttttttagttctccctctccggagacccagcatggcgtat

SEQ ID NO: 408767 - DNA, 140 bp, Artificial Sequence
  Synthetic
atacgccatgctgggtctccaggcaatcagccaagcaacaaattcagctactataatgatgctgcagagaggcaatttttacggccaaagaaaaattgttcagtgtttcaactgtggcaacgtacttgggagtcggccat

SEQ ID NO: 408768 - DNA, 140 bp, Artificial Sequence
  Synthetic
atggccgactcccaagtacgttgccacagttgaaacactgaacaatttttctttggccgtaaaaattgcctctctgcagcatcattatagtagctgaatttgttgcttggctgattgcctggagacccagcatggcgtat

SEQ ID NO: 408769 - DNA, 140 bp, Artificial Sequence
  Synthetic
aggccctggctgctgatatgactgacacaacaaatcagaagactgagttacaagcaattcatctagctttgcaggattcgggattagaagtaaacatagtaacagactcacaatatgcatgaccttttgggacagcggtg

SEQ ID NO: 408770 - DNA, 140 bp, Artificial Sequence
  Synthetic
caccgctgtcccaaaaggtcatgcatattgtgagtctgttactatgtttacttctaatcccgaatcctgcaaagctagatgaattgcttgtaactcagtcttctgatttgttgtgtcagtcatatcagcagccagggcct

SEQ ID NO: 408771 - DNA, 140 bp, Artificial Sequence
  Synthetic
atacgccatgctgggtctccagacccaacaacaatacaagaaaaagtatacatttcgcacctgggcaggcattttatgcaacaggagatataataggagatataagacaagcacactgtacgtacttgggagtcggccat

SEQ ID NO: 408772 - DNA, 140 bp, Artificial Sequence
  Synthetic
atggccgactcccaagtacgtacagtgtgcttgtcttatatctcctattatatctcctgttgcataaaatgcctgcccaggtgcgaaatgtatactttttcttgtattgttgttgggtctggagacccagcatggcgtat

SEQ ID NO: 408773 - DNA, 140 bp, Artificial Sequence
  Synthetic
atacgccatgctgggtctccttaaaagaacaatttaataaatcaatacaatttacaaaacactcaggaggagacccagaaattgaaatgcatagttttaattgtggaggggaatttttctcgtacttgggagtcggccat

SEQ ID NO: 408774 - DNA, 140 bp, Artificial Sequence
  Synthetic
atggccgactcccaagtacgagaaaaattcccctccacaattaaaactatgcatttcaatttctgggtctcctcctgagtgttttgtaaattgtattgatttattaaattgttcttttaaggagacccagcatggcgtat

SEQ ID NO: 408775 - DNA, 140 bp, Artificial Sequence
  Synthetic
aggccctggctgctgatatgggtgccagcatagcagaataggaatcatgcgacagagaagagcaagaaatggagccagtagatcctaacctagagccctggaaccatccaggaagtcagcgaccttttgggacagcggtg

SEQ ID NO: 408776 - DNA, 140 bp, Artificial Sequence
  Synthetic
caccgctgtcccaaaaggtcgctgacttcctggatggttccagggctctaggttaggatctactggctccatttcttgctcttctctgtcgcatgattcctattctgctatgctggcacccatatcagcagccagggcct

SEQ ID NO: 408777 - DNA, 140 bp, Artificial Sequence
  Synthetic
aggccctggctgctgatatgggctgttggaaatgtgggaaggagggacaccaaatgaaagactgtactgaaagacaggctaattttttagggaaaatttggccttcccacaaggggaggcgaccttttgggacagcggtg

SEQ ID NO: 408778 - DNA, 140 bp, Artificial Sequence
  Synthetic
caccgctgtcccaaaaggtcgcctccccttgtgggaaggccaaattttccctaaaaaattagcctgtctttcagtacagtctttcatttggtgtccctccttcccacatttccaacagcccatatcagcagccagggcct

SEQ ID NO: 408779 - DNA, 140 bp, Artificial Sequence
  Synthetic
aggccctggctgctgatatgtactctattctgtgcatcagatgctaaagcatatgagagagaagtgcataatgtctgggctacacatgcctgtgtacccacagaccccaacccacaagaagaccttttgggacagcggtg

SEQ ID NO: 408780 - DNA, 140 bp, Artificial Sequence
  Synthetic
caccgctgtcccaaaaggtcttcttgtgggttggggtctgtgggtacacaggcatgtgtagcccagacattatgcacttctctctcatatgctttagcatctgatgcacagaatagagtacatatcagcagccagggcct

SEQ ID NO: 408781 - DNA, 140 bp, Artificial Sequence
  Synthetic
aggccctggctgctgatatgttatagacatcactatgaaagcactcatccaagaataagttcagaagtacacatcccactaggggatgctagattggtagtaacaacatattggggtctggaccttttgggacagcggtg

SEQ ID NO: 408782 - DNA, 140 bp, Artificial Sequence
  Synthetic
caccgctgtcccaaaaggtccagaccccaatatgttgttactaccaatctagcatcccctagtgggatgtgtacttctgaacttattcttggatgagtgctttcatagtgatgtctataacatatcagcagccagggcct

SEQ ID NO: 408783 - DNA, 140 bp, Artificial Sequence
  Synthetic
aggccctggctgctgatatgaagaatgaacaagaattattacaattagactcatgggcaaatttgtggagttggttggacatatcaaactggctgaagtatataaaaatattcataataagaccttttgggacagcggtg

SEQ ID NO: 408784 - DNA, 140 bp, Artificial Sequence
  Synthetic
caccgctgtcccaaaaggtcttattatgaatatttttatatacttcagccagtttgatatgtccaaccaactccacaaatttgcccatgagtctaattgtaataattcttgttcattcttcatatcagcagccagggcct

SEQ ID NO: 408785 - DNA, 140 bp, Artificial Sequence
  Synthetic
atacgccatgctgggtctccctatacaactgccagaaaaagaagactggactgtcaatgctatacagaagttattacggaaattatactgggcaagccagatttatccaggaatcaaagtcgtacttgggagtcggccat

SEQ ID NO: 408786 - DNA, 140 bp, Artificial Sequence
  Synthetic
atggccgactcccaagtacgactttgattcctggataaatctggcttgcccagtataatttccgtaataacttctgtatagcattgacagtccagtcttctttttctggcagttgtatagggagacccagcatggcgtat

SEQ ID NO: 408787 - DNA, 140 bp, Artificial Sequence
  Synthetic
aggccctggctgctgatatgtaattcatctgtattactttgattgtttttcagaatctgctataagaaatgccatattaggacatagagttagtcctaggtgtgaatatcaagcaggacagaccttttgggacagcggtg

SEQ ID NO: 408788 - DNA, 140 bp, Artificial Sequence
  Synthetic
caccgctgtcccaaaaggtctgtcctgcttgatattcacacctaggactaactctatgtcctaatatggcatttcttatagcagattctgaaaaacaatcaaagtaatacagatgaattacatatcagcagccagggcct

SEQ ID NO: 408789 - DNA, 140 bp, Artificial Sequence
  Synthetic
aggccctggctgctgatatgagatggaacaagccccagaagaccaagggccacagagggagccatacaatgaatggacactagagcttttagaggagcttaagagtgaagctgttagacagaccttttgggacagcggtg

SEQ ID NO: 408790 - DNA, 140 bp, Artificial Sequence
  Synthetic
caccgctgtcccaaaaggtctgtctaacagcttcactcttaagctcctctaaaagctctagtgtccattcattgtatggctccctctgtggcccttggtcttctggggcttgttccatctcatatcagcagccagggcct

SEQ ID NO: 408791 - DNA, 140 bp, Artificial Sequence
  Synthetic
atacgccatgctgggtctccgtaaaggagaaattaagagaatacttccccaataacacaataaaatttaacccatcgtcaggaggggacctagaagttacaacacatagttttaattgtacgtacttgggagtcggccat

SEQ ID NO: 408792 - DNA, 140 bp, Artificial Sequence
  Synthetic
atggccgactcccaagtacgtacaattaaaactatgtgttgtaacttctaggtcccctcctgacgatgggttaaattttattgtgttattggggaagtattctcttaatttctcctttacggagacccagcatggcgtat

SEQ ID NO: 408793 - DNA, 140 bp, Artificial Sequence
  Synthetic
aggccctggctgctgatatgaagatctctcgacgcaggactcggcttgctgaagcgcgcacggcaagaggcgaggggcggcgactggtgagtacgccaaaatttttgactagcggaggctgaccttttgggacagcggtg

SEQ ID NO: 408794 - DNA, 140 bp, Artificial Sequence
  Synthetic
caccgctgtcccaaaaggtcagcctccgctagtcaaaaattttggcgtactcaccagtcgccgcccctcgcctcttgccgtgcgcgcttcagcaagccgagtcctgcgtcgagagatcttcatatcagcagccagggcct

SEQ ID NO: 408795 - DNA, 140 bp, Artificial Sequence
  Synthetic
atacgccatgctgggtctccctttcaatgcaaccacagaagtaagagataagataagaaaagaatatgcacttttttatagacttgatatagtgtcacttaatggcaactctagctctagcgtacttgggagtcggccat

SEQ ID NO: 408796 - DNA, 140 bp, Artificial Sequence
  Synthetic
atggccgactcccaagtacgctagagctagagttgccattaagtgacactatatcaagtctataaaaaagtgcatattcttttcttatcttatctcttacttctgtggttgcattgaaagggagacccagcatggcgtat

SEQ ID NO: 408797 - DNA, 140 bp, Artificial Sequence
  Synthetic
aggccctggctgctgatatgagaataatttttgctgtgctatctatagtaaatagagttaggcagggatactcacctttgtcgtttcagacccttgtcccaaacccgaggggactcgacagaccttttgggacagcggtg

SEQ ID NO: 408798 - DNA, 140 bp, Artificial Sequence
  Synthetic
caccgctgtcccaaaaggtctgtcgagtcccctcgggtttgggacaagggtctgaaacgacaaaggtgagtatccctgcctaactctatttactatagatagcacagcaaaaattattctcatatcagcagccagggcct

SEQ ID NO: 408799 - DNA, 140 bp, Artificial Sequence
  Synthetic
aggccctggctgctgatatgcaatggctagtgattttaatctgccacctatagtagcaaaggaaatagtagccagctgtgataaatgtcagctaaaaggggaagccatgcatggacaagtgaccttttgggacagcggtg

SEQ ID NO: 408800 - DNA, 140 bp, Artificial Sequence
  Synthetic
caccgctgtcccaaaaggtcacttgtccatgcatggcttccccttttagctgacatttatcacagctggctactatttcctttgctactataggtggcagattaaaatcactagccattgcatatcagcagccagggcct

SEQ ID NO: 408801 - DNA, 140 bp, Artificial Sequence
  Synthetic
aggccctggctgctgatatgaaattaattgtacaagacccaacaacaatacaagaaaaagtatacatataggaccagggagagcattttatgcaacaggagaaataataggaaatataaggaccttttgggacagcggtg

SEQ ID NO: 408802 - DNA, 140 bp, Artificial Sequence
  Synthetic
caccgctgtcccaaaaggtccttatatttcctattatttctcctgttgcataaaatgctctccctggtcctatatgtatactttttcttgtattgttgttgggtcttgtacaattaatttcatatcagcagccagggcct

SEQ ID NO: 408803 - DNA, 140 bp, Artificial Sequence
  Synthetic
atacgccatgctgggtctcctgaccaatagcaatgacacaaccgatggccctaacgaaataggaaatataacagatgaagtaaaaaactgtacttttaatatgaccacagaactaaaagacgtacttgggagtcggccat

SEQ ID NO: 408804 - DNA, 140 bp, Artificial Sequence
  Synthetic
atggccgactcccaagtacgtcttttagttctgtggtcatattaaaagtacagttttttacttcatctgttatatttcctatttcgttagggccatcggttgtgtcattgctattggtcaggagacccagcatggcgtat

SEQ ID NO: 408805 - DNA, 140 bp, Artificial Sequence
  Synthetic
  misc_feature (23)..(23): n is a, c, g, or t
aggccctggctgctgatatgatntgcaccactgatgtgccttgggatactagttggagtaataaaactctggatgatatttggggtagtaacatgacctggatggagtgggaaagagaaagaccttttgggacagcggtg

SEQ ID NO: 408806 - DNA, 140 bp, Artificial Sequence
  Synthetic
  misc_feature (118)..(118): n is a, c, g, or t
caccgctgtcccaaaaggtctttctctttcccactccatccaggtcatgttactaccccaaatatcatccagagttttattactccaactagtatcccaaggcacatcagtggtgcanatcatatcagcagccagggcct

SEQ ID NO: 408807 - DNA, 140 bp, Artificial Sequence
  Synthetic
aggccctggctgctgatatggaccatagtattcatagaatataggagaataaaaaggcaaagaaaaatagactgtttaattgatagaataagagaaagagcagaagacagtggcaatgaggaccttttgggacagcggtg

SEQ ID NO: 408808 - DNA, 140 bp, Artificial Sequence
  Synthetic
caccgctgtcccaaaaggtcctcattgccactgtcttctgctctttctcttattctatcaattaaacagtctatttttctttgcctttttattctcctatattctatgaatactatggtccatatcagcagccagggcct

SEQ ID NO: 408809 - DNA, 140 bp, Artificial Sequence
  Synthetic
atacgccatgctgggtctcctagccccatcaccaccaccaatggccccatggaaaaaatgaaaaactgctcttacaacatgtcaacagaagtaaaagataagaaaaagcaggtctattcacgtacttgggagtcggccat

SEQ ID NO: 408810 - DNA, 140 bp, Artificial Sequence
  Synthetic
atggccgactcccaagtacgtgaatagacctgctttttcttatcttttacttctgttgacatgttgtaagagcagtttttcattttttccatggggccattggtggtggtgatggggctaggagacccagcatggcgtat

SEQ ID NO: 408811 - DNA, 140 bp, Artificial Sequence
  Synthetic
aggccctggctgctgatatgcagtaaggaccatcaagatcctataccaaagcagtaagtaattaatatatgtaatgagtcctttagaaatctgggcaatagtaggactgatagtagcactgaccttttgggacagcggtg

SEQ ID NO: 408812 - DNA, 140 bp, Artificial Sequence
  Synthetic
caccgctgtcccaaaaggtcagtgctactatcagtcctactattgcccagatttctaaaggactcattacatatattaattacttactgctttggtataggatcttgatggtccttactgcatatcagcagccagggcct

SEQ ID NO: 408813 - DNA, 140 bp, Artificial Sequence
  Synthetic
atacgccatgctgggtctccaagttgtcaaaacgcaatatggctggatggcctgcaataagggatagaatgagaagagctaatgcagcagcagcagagggagtagaaaggagaagaactgcgtacttgggagtcggccat

SEQ ID NO: 408814 - DNA, 140 bp, Artificial Sequence
  Synthetic
atggccgactcccaagtacgcagttcttctcctttctactccctctgctgctgctgcattagctcttctcattctatcccttattgcaggccatccagccatattgcgttttgacaacttggagacccagcatggcgtat

SEQ ID NO: 408815 - DNA, 140 bp, Artificial Sequence
  Synthetic
aggccctggctgctgatatggagaagagctaatgcagcagcagcagagggagtagaaaggagaagaactgatgcagcagcagaaggagtaggagcagcatcccgagacttggatagacatgaccttttgggacagcggtg

SEQ ID NO: 408816 - DNA, 140 bp, Artificial Sequence
  Synthetic
caccgctgtcccaaaaggtcatgtctatccaagtctcgggatgctgctcctactccttctgctgctgcatcagttcttctcctttctactccctctgctgctgctgcattagctcttctccatatcagcagccagggcct

SEQ ID NO: 408817 - DNA, 140 bp, Artificial Sequence
  Synthetic
atacgccatgctgggtctcccataatgtcacctcaaacagcattgtggagccaaaactggaggtgaaaaactgctctttcaggaaaactacagaaggaagagagaagaaaaagaaagcaacgtacttgggagtcggccat

SEQ ID NO: 408818 - DNA, 140 bp, Artificial Sequence
  Synthetic
atggccgactcccaagtacgttgctttctttttcttctctcttccttctgtagttttcctgaaagagcagtttttcacctccagttttggctccacaatgctgtttgaggtgacattatgggagacccagcatggcgtat

SEQ ID NO: 408819 - DNA, 140 bp, Artificial Sequence
  Synthetic
aggccctggctgctgatatgatgggaaaaaattcggttaaggccagggggaaagaaaaaatataggctaaaacacatagtatgggcaagcagggagatggaaagatttgcacttaaccctgaccttttgggacagcggtg

SEQ ID NO: 408820 - DNA, 140 bp, Artificial Sequence
  Synthetic
caccgctgtcccaaaaggtcagggttaagtgcaaatctttccatctccctgcttgcccatactatgtgttttagcctatattttttctttccccctggccttaaccgaattttttcccatcatatcagcagccagggcct

SEQ ID NO: 408821 - DNA, 140 bp, Artificial Sequence
  Synthetic
atacgccatgctgggtctcccacggatagcgtgaaaggagaaatgagaaactgctctttcaatattaccacagaactaagggataagaaaaagaaagtatactcacttttttataaacttcgtacttgggagtcggccat

SEQ ID NO: 408822 - DNA, 140 bp, Artificial Sequence
  Synthetic
atggccgactcccaagtacgaagtttataaaaaagtgagtatactttctttttcttatcccttagttctgtggtaatattgaaagagcagtttctcatttctcctttcacgctatccgtgggagacccagcatggcgtat

SEQ ID NO: 408823 - DNA, 140 bp, Artificial Sequence
  Synthetic
atacgccatgctgggtctccatatgcaagacaaaagacatcaagaggacaagggcaaacactctatacaagcaagaagattattggagacataagacaagcatattgtaacattagtggacgtacttgggagtcggccat

SEQ ID NO: 408824 - DNA, 140 bp, Artificial Sequence
  Synthetic
atggccgactcccaagtacgtccactaatgttacaatatgcttgtcttatgtctccaataatcttcttgcttgtatagagtgtttgcccttgtcctcttgatgtcttttgtcttgcatatggagacccagcatggcgtat

SEQ ID NO: 408825 - DNA, 140 bp, Artificial Sequence
  Synthetic
aggccctggctgctgatatgacaattaggtgttcatcaaatattacagggctaatattgacaagagatggtggtaataatagttctaacaacgagaccttcagacctggcggaggagatagaccttttgggacagcggtg

SEQ ID NO: 408826 - DNA, 140 bp, Artificial Sequence
  Synthetic
caccgctgtcccaaaaggtctatctcctccgccaggtctgaaggtctcgttgttagaactattattaccaccatctcttgtcaatattagccctgtaatatttgatgaacacctaattgtcatatcagcagccagggcct

SEQ ID NO: 408827 - DNA, 140 bp, Artificial Sequence
  Synthetic
atacgccatgctgggtctccatgggtgcgagagcgtcagtattaagcggcggaaaattagatcaatgggaaagaattcggttgaggccagggggaaacaaaagatataaattaaagcatacgtacttgggagtcggccat

SEQ ID NO: 408828 - DNA, 140 bp, Artificial Sequence
  Synthetic
atggccgactcccaagtacgtatgctttaatttatatcttttgtttccccctggcctcaaccgaattctttcccattgatctaattttccgccgcttaatactgacgctctcgcacccatggagacccagcatggcgtat

SEQ ID NO: 408829 - DNA, 140 bp, Artificial Sequence
  Synthetic
aggccctggctgctgatatgcaaattataaatatgtggcagagaacaggacaagcaacgtatgcccctcccatcccaggggtaatacagtgtagatcaaacattacaggactactattaagaccttttgggacagcggtg

SEQ ID NO: 408830 - DNA, 140 bp, Artificial Sequence
  Synthetic
caccgctgtcccaaaaggtcttaatagtagtcctgtaatgtttgatctacactgtattacccctgggatgggaggggcatacgttgcttgtcctgttctctgccacatatttataatttgcatatcagcagccagggcct

SEQ ID NO: 408831 - DNA, 140 bp, Artificial Sequence
  Synthetic
atacgccatgctgggtctccgccctggaactcttcttggagtaataaatccttagatgagatttggcaaaacttgccctggaagaaagtgggaagagaaatcgacaattacacaggactacgtacttgggagtcggccat

SEQ ID NO: 408832 - DNA, 140 bp, Artificial Sequence
  Synthetic
atggccgactcccaagtacgtagtcctgtgtaattgtcgatttctcttcccactttcttccagggcaagttttgccaaatctcatctaaggatttattactccaagaagagttccagggcggagacccagcatggcgtat

SEQ ID NO: 408833 - DNA, 140 bp, Artificial Sequence
  Synthetic
aggccctggctgctgatatgaggagccgaaagacagggaacccttaacttccctcaaatcactctttggcagcgaccccttgtctcaataaaagtagggggccaaataaaggaggctctcgaccttttgggacagcggtg

SEQ ID NO: 408834 - DNA, 140 bp, Artificial Sequence
  Synthetic
caccgctgtcccaaaaggtcgagagcctcctttatttggccccctacttttattgagacaaggggtcgctgccaaagagtgatttgagggaagttaagggttccctgtctttcggctcctcatatcagcagccagggcct

SEQ ID NO: 408835 - DNA, 140 bp, Artificial Sequence
  Synthetic
atacgccatgctgggtctccgccctcaagtatctgtggaatttcctgcagtattggagtcaggaactcaggaatagtgcttcttccttgcttgctaccatagcaatagcaacagctgcggcgtacttgggagtcggccat

SEQ ID NO: 408836 - DNA, 140 bp, Artificial Sequence
  Synthetic
atggccgactcccaagtacgccgcagctgttgctattgctatggtagcaagcaaggaagaagcactattcctgagttcctgactccaatactgcaggaaattccacagatacttgagggcggagacccagcatggcgtat

SEQ ID NO: 408837 - DNA, 140 bp, Artificial Sequence
  Synthetic
aggccctggctgctgatatgatacccacaagaataagacagggcttggaaaggcttttgctataaaatgggtggcaaatggtcaaaaagtagtatagttggatggcctgctataagggaagaccttttgggacagcggtg

SEQ ID NO: 408838 - DNA, 140 bp, Artificial Sequence
  Synthetic
caccgctgtcccaaaaggtcttcccttatagcaggccatccaactatactactttttgaccatttgccacccattttatagcaaaagcctttccaagccctgtcttattcttgtgggtatcatatcagcagccagggcct

SEQ ID NO: 408839 - DNA, 140 bp, Artificial Sequence
  Synthetic
aggccctggctgctgatatgcgcttgcctgggacgatctgaggagcctgtgccgcttcagctaccaccgcttgagagacttcatatcgattgccacgaggattgtggaacttctgggacagaccttttgggacagcggtg

SEQ ID NO: 408840 - DNA, 140 bp, Artificial Sequence
  Synthetic
caccgctgtcccaaaaggtctgtcccagaagttccacaatcctcgtggcaatcgatatgaagtctctcaagcggtggtagctgaagcggcacaggctcctcagatcgtcccaggcaagcgcatatcagcagccagggcct

SEQ ID NO: 408841 - DNA, 140 bp, Artificial Sequence
  Synthetic
atacgccatgctgggtctccggaaatataacagatgaagtaaaaaactgtacttttaatatgaccacagaactaaaagataagaagcagaaggtccatgcacttttttataggcttgatacgtacttgggagtcggccat

SEQ ID NO: 408842 - DNA, 140 bp, Artificial Sequence
  Synthetic
atggccgactcccaagtacgtatcaagcctataaaaaagtgcatggaccttctgcttcttatcttttagttctgtggtcatattaaaagtacagttttttacttcatctgttatatttccggagacccagcatggcgtat

SEQ ID NO: 408843 - DNA, 140 bp, Artificial Sequence
  Synthetic
aggccctggctgctgatatgtggacagatagggttatagaaataggacaaagaattggtagagctattctccatatacctagaagaattagacagggctttgaaagggctttactataacgaccttttgggacagcggtg

SEQ ID NO: 408844 - DNA, 140 bp, Artificial Sequence
  Synthetic
caccgctgtcccaaaaggtcgttatagtaaagccctttcaaagccctgtctaattcttctaggtatatggagaatagctctaccaattctttgtcctatttctataaccctatctgtccacatatcagcagccagggcct

SEQ ID NO: 408845 - DNA, 140 bp, Artificial Sequence
  Synthetic
atacgccatgctgggtctccacaagctcgagctccagctcatactccagctcctacagcagcaacaggagtaggagcagtatctcaagatttagaaaaacatggagcaatcacaagcagtcgtacttgggagtcggccat

SEQ ID NO: 408846 - DNA, 140 bp, Artificial Sequence
  Synthetic
atggccgactcccaagtacgactgcttgtgattgctccatgtttttctaaatcttgagatactgctcctactcctgttgctgctgtaggagctggagtatgagctggagctcgagcttgtggagacccagcatggcgtat

SEQ ID NO: 408847 - DNA, 140 bp, Artificial Sequence
  Synthetic
atacgccatgctgggtctcccgagggaggagaagagtcagggatggatccggtagatcctaacctagagccctggaaccatccgggaagtcagcctgcaactgcttgtaacaactgttaccgtacttgggagtcggccat

SEQ ID NO: 408848 - DNA, 140 bp, Artificial Sequence
  Synthetic
atggccgactcccaagtacggtaacagttgttacaagcagttgcaggctgacttcccggatggttccagggctctaggttaggatctaccggatccatccctgactcttctcctccctcgggagacccagcatggcgtat

SEQ ID NO: 408849 - DNA, 140 bp, Artificial Sequence
  Synthetic
atacgccatgctgggtctcctacaaataccaccaggactaatagtactagtattgggaaaaacatgcaaggagaaataaaaaactgctctttcaatatcaccacaggcataggagagaaacgtacttgggagtcggccat

SEQ ID NO: 408850 - DNA, 140 bp, Artificial Sequence
  Synthetic
atggccgactcccaagtacgtttctctcctatgcctgtggtgatattgaaagagcagttttttatttctccttgcatgtttttcccaatactagtactattagtcctggtggtatttgtaggagacccagcatggcgtat

SEQ ID NO: 408851 - DNA, 140 bp, Artificial Sequence
  Synthetic
aggccctggctgctgatatgtgccagaaaaggacagctggactgtcaatgatatacagaagttagtgggaaaattaaattgggcaagtcagatttatgcagggattaaagtaaagcaattgaccttttgggacagcggtg

SEQ ID NO: 408852 - DNA, 140 bp, Artificial Sequence
  Synthetic
caccgctgtcccaaaaggtcaattgctttactttaatccctgcataaatctgacttgcccaatttaattttcccactaacttctgtatatcattgacagtccagctgtccttttctggcacatatcagcagccagggcct

SEQ ID NO: 408853 - DNA, 140 bp, Artificial Sequence
  Synthetic
aggccctggctgctgatatgttaataaaacaataatctttaatcaatcctcaggaggggacccagaaattgtaatgcacacttttaattgtggaggggaatttttctactgtaatacagcgaccttttgggacagcggtg

SEQ ID NO: 408854 - DNA, 140 bp, Artificial Sequence
  Synthetic
caccgctgtcccaaaaggtcgctgtattacagtagaaaaattcccctccacaattaaaagtgtgcattacaatttctgggtcccctcctgaggattgattaaagattattgttttattaacatatcagcagccagggcct

SEQ ID NO: 408855 - DNA, 140 bp, Artificial Sequence
  Synthetic
aggccctggctgctgatatgtttactagaaagagtagattatagattaggagtaggagcactgataatagcattaatcatagcaatagttgtgtggatctgggcatatatagaatatagggaccttttgggacagcggtg

SEQ ID NO: 408856 - DNA, 140 bp, Artificial Sequence
  Synthetic
caccgctgtcccaaaaggtccctatattctatatatgcccagatccacacaactattgctatgattaatgctattatcagtgctcctactcctaatctataatctactctttctagtaaacatatcagcagccagggcct

SEQ ID NO: 408857 - DNA, 140 bp, Artificial Sequence
  Synthetic
aggccctggctgctgatatgtgcctgggacgacctccggagcctgtgccttttcagctaccaccgcttgagagacttcatattgattgtgggacacagcagtctcagggggctgagactggaccttttgggacagcggtg

SEQ ID NO: 408858 - DNA, 140 bp, Artificial Sequence
  Synthetic
caccgctgtcccaaaaggtccagtctcagccccctgagactgctgtgtcccacaatcaatatgaagtctctcaagcggtggtagctgaaaaggcacaggctccggaggtcgtcccaggcacatatcagcagccagggcct

SEQ ID NO: 408859 - DNA, 140 bp, Artificial Sequence
  Synthetic
aggccctggctgctgatatgaaaaattcggttaaggccagggggaaagaaaaaatatagattaaaacatatagtatgggcaagcagggaactagaacgattcgcagttaatcctggcctggaccttttgggacagcggtg

SEQ ID NO: 408860 - DNA, 140 bp, Artificial Sequence
  Synthetic
caccgctgtcccaaaaggtccaggccaggattaactgcgaatcgttctagttccctgcttgcccatactatatgttttaatctatattttttctttccccctggccttaaccgaatttttcatatcagcagccagggcct

SEQ ID NO: 408861 - DNA, 140 bp, Artificial Sequence
  Synthetic
atacgccatgctgggtctcctaatgttaatgttacccacaacagtacctacaacaatacagagggtgaacaaataaaaaattgctctttcaatataactacagagctaagagataagaaacgtacttgggagtcggccat

SEQ ID NO: 408862 - DNA, 140 bp, Artificial Sequence
  Synthetic
atggccgactcccaagtacgtttcttatctcttagctctgtagttatattgaaagagcaattttttatttgttcaccctctgtattgttgtaggtactgttgtgggtaacattaacattaggagacccagcatggcgtat

SEQ ID NO: 408863 - DNA, 140 bp, Artificial Sequence
  Synthetic
aggccctggctgctgatatgtgatagaataagagaaagagcagaagacagtggcaatgagagtgaaggggatcaggaagaattgtcagcacttgtggaaatggggcatcatgctccttgggaccttttgggacagcggtg

SEQ ID NO: 408864 - DNA, 140 bp, Artificial Sequence
  Synthetic
caccgctgtcccaaaaggtcccaaggagcatgatgccccatttccacaagtgctgacaattcttcctgatccccttcactctcattgccactgtcttctgctctttctcttattctatcacatatcagcagccagggcct

SEQ ID NO: 408865 - DNA, 140 bp, Artificial Sequence
  Synthetic
atacgccatgctgggtctccaaaagtagtacacacagacaatggcagcaatttcaccagtgctgcagttaaagcagcctgttggtgggcagatatcaaacaggaatttgggattccctaccgtacttgggagtcggccat

SEQ ID NO: 408866 - DNA, 140 bp, Artificial Sequence
  Synthetic
atggccgactcccaagtacggtagggaatcccaaattcctgtttgatatctgcccaccaacaggctgctttaactgcagcactggtgaaattgctgccattgtctgtgtgtactacttttggagacccagcatggcgtat

SEQ ID NO: 408867 - DNA, 140 bp, Artificial Sequence
  Synthetic
atacgccatgctgggtctccattataaacatgtggcagggggtaggacgagcaatgtatgctccccccattgaaggaagcataacatgtaactcaactattacaggattgctattgacaccgtacttgggagtcggccat

SEQ ID NO: 408868 - DNA, 140 bp, Artificial Sequence
  Synthetic
atggccgactcccaagtacggtgtcaatagcaatcctgtaatagttgagttacatgttatgcttccttcaatggggggagcatacattgctcgtcctaccccctgccacatgtttataatggagacccagcatggcgtat

SEQ ID NO: 408869 - DNA, 140 bp, Artificial Sequence
  Synthetic
atacgccatgctgggtctcccccggcaacaagataagaagaaggatacatataggaccagggagagcattttatacagatagagtaggagacataaggcaagcatattgtaacattagtgcgtacttgggagtcggccat

SEQ ID NO: 408870 - DNA, 140 bp, Artificial Sequence
  Synthetic
atggccgactcccaagtacgcactaatgttacaatatgcttgccttatgtctcctactctatctgtataaaatgctctccctggtcctatatgtatccttcttcttatcttgttgccgggggagacccagcatggcgtat

SEQ ID NO: 408871 - DNA, 140 bp, Artificial Sequence
  Synthetic
aggccctggctgctgatatgcttctgtgccttggaacaccagttggagtaataagtctaaagcagaaatttgggataatatgacctggatgcagtgggataaagaaattagtaattatacgaccttttgggacagcggtg

SEQ ID NO: 408872 - DNA, 140 bp, Artificial Sequence
  Synthetic
caccgctgtcccaaaaggtcgtataattactaatttctttatcccactgcatccaggtcatattatcccaaatttctgctttagacttattactccaactggtgttccaaggcacagaagcatatcagcagccagggcct

SEQ ID NO: 408873 - DNA, 140 bp, Artificial Sequence
  Synthetic
aggccctggctgctgatatggaaatggatccagtagatcctaacatagatccctggaaccatccaggaagtcagcctaggactgcttgtaacaattgttattgtaaaaagtgttgctatcgaccttttgggacagcggtg

SEQ ID NO: 408874 - DNA, 140 bp, Artificial Sequence
  Synthetic
caccgctgtcccaaaaggtcgatagcaacactttttacaataacaattgttacaagcagtcctaggctgacttcctggatggttccagggatctatgttaggatctactggatccatttccatatcagcagccagggcct

SEQ ID NO: 408875 - DNA, 140 bp, Artificial Sequence
  Synthetic
aggccctggctgctgatatgcctgggaagacctacggaacctgtgcctcttcttctaccaccgcttgagagacttcatcttgattgcagcgaggactgtggagctgctgagacagatcaggaccttttgggacagcggtg

SEQ ID NO: 408876 - DNA, 140 bp, Artificial Sequence
  Synthetic
caccgctgtcccaaaaggtcctgatctgtctcagcagctccacagtcctcgctgcaatcaagatgaagtctctcaagcggtggtagaagaagaggcacaggttccgtaggtcttcccaggcatatcagcagccagggcct

SEQ ID NO: 408877 - DNA, 140 bp, Artificial Sequence
  Synthetic
aggccctggctgctgatatggtaaaaagtgttgctatcattgtcaagcttgctttttgaacaaaggcttaggcatctcctatggcaggaagaagcggagacagcgacgaggaactcctcagaccttttgggacagcggtg

SEQ ID NO: 408878 - DNA, 140 bp, Artificial Sequence
  Synthetic
caccgctgtcccaaaaggtctgaggagttcctcgtcgctgtctccgcttcttcctgccataggagatgcctaagcctttgttcaaaaagcaagcttgacaatgatagcaacactttttaccatatcagcagccagggcct

SEQ ID NO: 408879 - DNA, 140 bp, Artificial Sequence
  Synthetic
aggccctggctgctgatatggggtcacagtttattatggggtacctgtatggaaagaagcaaccaccacgctattttgtgcatcagatgctaaatcatataaaacagaggcacataatatgaccttttgggacagcggtg

SEQ ID NO: 408880 - DNA, 140 bp, Artificial Sequence
  Synthetic
caccgctgtcccaaaaggtcatattatgtgcctctgttttatatgatttagcatctgatgcacaaaatagcgtggtggttgcttctttccatacaggtaccccataataaactgtgaccccatatcagcagccagggcct

SEQ ID NO: 408881 - DNA, 140 bp, Artificial Sequence
  Synthetic
aggccctggctgctgatatgctattttgtgcatcagatgctaaatcatataaaacagaggcacataatatctgggctacacatgcctgtgtacccacagaccccaacccacaagaaataggaccttttgggacagcggtg

SEQ ID NO: 408882 - DNA, 140 bp, Artificial Sequence
  Synthetic
caccgctgtcccaaaaggtcctatttcttgtgggttggggtctgtgggtacacaggcatgtgtagcccagatattatgtgcctctgttttatatgatttagcatctgatgcacaaaatagcatatcagcagccagggcct

SEQ ID NO: 408883 - DNA, 140 bp, Artificial Sequence
  Synthetic
aggccctggctgctgatatgcaatgacagagagagcagcagcgggagtaggagcagtgtctcaagacttggatagatttggagcagtcacaagcagcaatacagcagccactaatgctgagaccttttgggacagcggtg

SEQ ID NO: 408884 - DNA, 140 bp, Artificial Sequence
  Synthetic
caccgctgtcccaaaaggtctcagcattagtggctgctgtattgctgcttgtgactgctccaaatctatccaagtcttgagacactgctcctactcccgctgctgctctctctgtcattgcatatcagcagccagggcct

SEQ ID NO: 408885 - DNA, 140 bp, Artificial Sequence
  Synthetic
atacgccatgctgggtctccgaaatgaaaaactgctctttcaatataaccacagtagtaacggataagaggaagcaagtacatgcacttttttatagacttgatgtagtacaaatagatacgtacttgggagtcggccat

SEQ ID NO: 408886 - DNA, 140 bp, Artificial Sequence
  Synthetic
atggccgactcccaagtacgtatctatttgtactacatcaagtctataaaaaagtgcatgtacttgcttcctcttatccgttactactgtggttatattgaaagagcagtttttcatttcggagacccagcatggcgtat

SEQ ID NO: 408887 - DNA, 140 bp, Artificial Sequence
  Synthetic
atacgccatgctgggtctccaggggagagaggagaaaatgaaaagtgaaatgaaaaattgctctttcaatattaccacagacctaagagataaggtaaagaaagaatatgcattgctttacgtacttgggagtcggccat

SEQ ID NO: 408888 - DNA, 140 bp, Artificial Sequence
  Synthetic
atggccgactcccaagtacgtaaagcaatgcatattctttctttaccttatctcttaggtctgtggtaatattgaaagagcaatttttcatttcacttttcattttctcctctctcccctggagacccagcatggcgtat

SEQ ID NO: 408889 - DNA, 140 bp, Artificial Sequence
  Synthetic
  misc_feature (111)..(111): n is a, c, g, or t
atacgccatgctgggtctcctagtagtaaacataatgccaccagtaatgggacacactcctacaatatctccgcagaaatgctaggagaaataaaaaactgctcttacaanatgaccacacgtacttgggagtcggccat

SEQ ID NO: 408890 - DNA, 140 bp, Artificial Sequence
  Synthetic
  misc_feature (30)..(30): n is a, c, g, or t
atggccgactcccaagtacgtgtggtcatnttgtaagagcagttttttatttctcctagcatttctgcggagatattgtaggagtgtgtcccattactggtggcattatgtttactactaggagacccagcatggcgtat

SEQ ID NO: 408891 - DNA, 140 bp, Artificial Sequence
  Synthetic
  misc_feature (61)..(61): n is a, c, g, or t
aggccctggctgctgatatgccgcagaaatgctaggagaaataaaaaactgctcttacaanatgaccacagaactaagggataagacaaagaaagtatattcacttttttatagacctgagaccttttgggacagcggtg

SEQ ID NO: 408892 - DNA, 140 bp, Artificial Sequence
  Synthetic
  misc_feature (80)..(80): n is a, c, g, or t
caccgctgtcccaaaaggtctcaggtctataaaaaagtgaatatactttctttgtcttatcccttagttctgtggtcatnttgtaagagcagttttttatttctcctagcatttctgcggcatatcagcagccagggcct

SEQ ID NO: 408893 - DNA, 140 bp, Artificial Sequence
  Synthetic
aggccctggctgctgatatgagatggcaggtgatgattgtgtggcaggtagacaggatgaggattagaacatggaacagtttagtaaaacatcatatgtatatctcaaagaaagctaaaagaccttttgggacagcggtg

SEQ ID NO: 408894 - DNA, 140 bp, Artificial Sequence
  Synthetic
caccgctgtcccaaaaggtcttttagctttctttgagatatacatatgatgttttactaaactgttccatgttctaatcctcatcctgtctacctgccacacaatcatcacctgccatctcatatcagcagccagggcct

SEQ ID NO: 408895 - DNA, 140 bp, Artificial Sequence
  Synthetic
atacgccatgctgggtctccagggcaagcgctctatacaacaaggtatacaacaaggataataggacaagcatattgtaatattagtggagtaaaatggaataacaccttacgacaggtacgtacttgggagtcggccat

SEQ ID NO: 408896 - DNA, 140 bp, Artificial Sequence
  Synthetic
atggccgactcccaagtacgtacctgtcgtaaggtgttattccattttactccactaatattacaatatgcttgtcctattatccttgttgtataccttgttgtatagagcgcttgccctggagacccagcatggcgtat

SEQ ID NO: 408897 - DNA, 140 bp, Artificial Sequence
  Synthetic
aggccctggctgctgatatggcaggactcggcttgctgaagcgcgcacggcaagaggcgaggggcggcgactggtgagtacgccaaaatttttgactagcggaggctagaaggagagagagaccttttgggacagcggtg

SEQ ID NO: 408898 - DNA, 140 bp, Artificial Sequence
  Synthetic
caccgctgtcccaaaaggtctctctctccttctagcctccgctagtcaaaaattttggcgtactcaccagtcgccgcccctcgcctcttgccgtgcgcgcttcagcaagccgagtcctgccatatcagcagccagggcct

SEQ ID NO: 408899 - DNA, 140 bp, Artificial Sequence
  Synthetic
aggccctggctgctgatatgggccaagcattctatgcaacaggtgacataataggggatataagacaagcacattgtaatatcagtcaagcagagtggaatgaaactttgggaaadctaagaccttttgggacagcggtg

SEQ ID NO: 408900 - DNA, 140 bp, Artificial Sequence
  Synthetic
caccgctgtcccaaaaggtcttagdtttcccaaagtttcattccactctgcttgactgatattacaatgtgcttgtcttatatcccctattatgtcacctgttgcatagaatgcttggcccatatcagcagccagggcct

SEQ ID NO: 408901 - DNA, 140 bp, Artificial Sequence
  Synthetic
atacgccatgctgggtctccgcctcaggaggggatctagaaataacaacacatagttttaactgtagaggagaatttttctattgtaacacatcacgcctgtttaatagcacctggtgggcgtacttgggagtcggccat

SEQ ID NO: 408902 - DNA, 140 bp, Artificial Sequence
  Synthetic
atggccgactcccaagtacgcccaccaggtgctattaaacaggcgtgatgtgttacaatagaaaaattctcctctacagttaaaactatgtgttgttatttctagatcccctcctgaggcggagacccagcatggcgtat

SEQ ID NO: 408903 - DNA, 140 bp, Artificial Sequence
  Synthetic
aggccctggctgctgatatgaaaggcttaggcatctcctatggcaggaagaagcggaagcaccgacgaggaactcctcagagcagtaaggatcatcaaaatcctataccaaagcagtaaggaccttttgggacagcggtg

SEQ ID NO: 408904 - DNA, 140 bp, Artificial Sequence
  Synthetic
caccgctgtcccaaaaggtccttactgctttggtataggattttgatgatccttactgctctgaggagttcctcgtcggtgcttccgcttcttcctgccataggagatgcctaagcctttcatatcagcagccagggcct

SEQ ID NO: 408905 - DNA, 140 bp, Artificial Sequence
  Synthetic
atacgccatgctgggtctccgtcaaagagtagtatagttggatggcctgctgtaagagaaagaatcagaagaactaatccaatgacagagagagcagcagcgggagtaggagcagtgtctcgtacttgggagtcggccat

SEQ ID NO: 408906 - DNA, 140 bp, Artificial Sequence
  Synthetic
atggccgactcccaagtacgagacactgctcctactcccgctgctgctctctctgtcattggattagttcttctgattctttctcttacagcaggccatccaactatactactctttgacggagacccagcatggcgtat

SEQ ID NO: 408907 - DNA, 140 bp, Artificial Sequence
  Synthetic
atacgccatgctgggtctcctgaggattaaaacatggaacagtttagtaaaataccatatgtataagtcaagaaaaactaggggatgggtttatagacatcactacgaaagcacccatcccgtacttgggagtcggccat

SEQ ID NO: 408908 - DNA, 140 bp, Artificial Sequence
  Synthetic
atggccgactcccaagtacgggatgggtgctttcgtagtgatgtctataaacccatcccctagtttttcttgacttatacatatggtattttactaaactgttccatgttttaatcctcaggagacccagcatggcgtat

SEQ ID NO: 408909 - DNA, 140 bp, Artificial Sequence
  Synthetic
aggccctggctgctgatatgtccagcaggaaaagaatgaacaagacttattggcattggacaagtgggcaagtctgtggaattggtttgacatatcaaaatggctgtggtatataagaatgaccttttgggacagcggtg

SEQ ID NO: 408910 - DNA, 140 bp, Artificial Sequence
  Synthetic
caccgctgtcccaaaaggtcattcttatataccacagccattttgatatgtcaaaccaattccacagacttgcccacttgtccaatgccaataagtcttgttcattcttttcctgctggacatatcagcagccagggcct

SEQ ID NO: 408911 - DNA, 140 bp, Artificial Sequence
  Synthetic
atacgccatgctgggtctcctgggacgcagggggtgggaagccctcaaatatctgtggaatctcctgcaatattggagtcgagaactgaagaatagtgctattagcttggttgatgcaaccgtacttgggagtcggccat

SEQ ID NO: 408912 - DNA, 140 bp, Artificial Sequence
  Synthetic
atggccgactcccaagtacggttgcatcaaccaagctaatagcactattcttcagttctcgactccaatattgcaggagattccacagatatttgagggcttcccaccccctgcgtcccaggagacccagcatggcgtat

SEQ ID NO: 408913 - DNA, 140 bp, Artificial Sequence
  Synthetic
atacgccatgctgggtctccctaactgaaacaacaaatcagaagactgaattacaagcaattcagctagctttgcaagattcaggattagaagtaaacatagtaacagactcacagtatgcgtacttgggagtcggccat

SEQ ID NO: 408914 - DNA, 140 bp, Artificial Sequence
  Synthetic
atggccgactcccaagtacgcatactgtgagtctgttactatgtttacttctaatcctgaatcttgcaaagctagctgaattgcttgtaattcagtcttctgatttgttgtttcagttagggagacccagcatggcgtat

SEQ ID NO: 408915 - DNA, 140 bp, Artificial Sequence
  Synthetic
aggccctggctgctgatatgcttaataaatctgtagaaatcaattgtaccagaccctccaacaatacaagaacaagtataagtataggaccaggacaagtattctatagaacaggagacagaccttttgggacagcggtg

SEQ ID NO: 408916 - DNA, 140 bp, Artificial Sequence
  Synthetic
caccgctgtcccaaaaggtctgtctcctgttctatagaatacttgtcctggtcctatacttatacttgttcttgtattgttggagggtctggtacaattgatttctacagatttattaagcatatcagcagccagggcct

SEQ ID NO: 408917 - DNA, 140 bp, Artificial Sequence
  Synthetic
  misc_feature (48)..(48): n is a, c, g, or t
  misc_feature (68)..(68): n is a, c, g, or t
atacgccatgctgggtctcctgagacgtgctcctccagcagcaccaanagcagaaccagtatctcaanatgcagcaaatcgccctagtggcgctgggctggaagcagaagaggaagaggacgtacttgggagtcggccat

SEQ ID NO: 408918 - DNA, 140 bp, Artificial Sequence
  Synthetic
  misc_feature (73)..(73): n is a, c, g, or t
  misc_feature (93)..(93): n is a, c, g, or t
atggccgactcccaagtacgtcctcttcctcttctgcttccagcccagcgccactagggcgatttgctgcatnttgagatactggttctgctnttggtgctgctggaggagcacgtctcaggagacccagcatggcgtat

SEQ ID NO: 408919 - DNA, 140 bp, Artificial Sequence
  Synthetic
atacgccatgctgggtctccattgatagaatagcagaaagagcagaagacagtggcaatgaaagtgaaggagaccaagaagacttggccatgcttgtggaaatggggcatcatgctccttcgtacttgggagtcggccat

SEQ ID NO: 408920 - DNA, 140 bp, Artificial Sequence
  Synthetic
atggccgactcccaagtacgaaggagcatgatgccccatttccacaagcatggccaagtcttcttggtctccttcactttcattgccactgtcttctgctctttctgctattctatcaatggagacccagcatggcgtat

SEQ ID NO: 408921 - DNA, 140 bp, Artificial Sequence
  Synthetic
aggccctggctgctgatatgtatcatacttccatgcaagataaaacaaattataaacatgtggcaaggagtaggacaagcaatgtatgctcctcccatcagtggaagaattaattgtgtagaccttttgggacagcggtg

SEQ ID NO: 408922 - DNA, 140 bp, Artificial Sequence
  Synthetic
caccgctgtcccaaaaggtctacacaattaattcttccactgatgggaggagcatacattgcttgtcctactccttgccacatgtttataatttgttttatcttgcatggaagtatgatacatatcagcagccagggcct

SEQ ID NO: 408923 - DNA, 140 bp, Artificial Sequence
  Synthetic
  misc_feature (22)..(22): n is a, c, g, or t
atacgccatgctgggtctccgnattagtgagaaggagaaaggagaaatgaaaaactgctctttcaatgttaccacaaacataagagataagataaagaaagaacatgcacttttttatgccgtacttgggagtcggccat

SEQ ID NO: 408924 - DNA, 140 bp, Artificial Sequence
  Synthetic
  misc_feature (119)..(119): n is a, c, g, or t
atggccgactcccaagtacggcataaaaaagtgcatgttctttctttatcttatctcttatgtttgtggtaacattgaaagagcagtttttcatttctcctttctccttctcactaatncggagacccagcatggcgtat

SEQ ID NO: 408925 - DNA, 140 bp, Artificial Sequence
  Synthetic
atacgccatgctgggtctccagacaatgctaaagtcataatagtacagctgaataaaactatatcaattaattgtacaagacccaacaacaatacaagaaaaagtatacatataggaccacgtacttgggagtcggccat

SEQ ID NO: 408926 - DNA, 140 bp, Artificial Sequence
  Synthetic
atggccgactcccaagtacgtggtcctatatgtatactttttcttgtattgttgttgggtcttgtacaattaattgatatagttttattcagctgtactattatgactttagcattgtctggagacccagcatggcgtat

SEQ ID NO: 408927 - DNA, 140 bp, Artificial Sequence
  Synthetic
aggccctggctgctgatatgtttagcttccctcaaatcactctttggcaacgacccctcgtcacaataaagatagggggacagctaaaggaagctctattagatacaggagcagatgatagaccttttgggacagcggtg

SEQ ID NO: 408928 - DNA, 140 bp, Artificial Sequence
  Synthetic
caccgctgtcccaaaaggtctatcatctgctcctgtatctaatagagcttcctttagctgtccccctatctttattgtgacgaggggtcgttgccaaagagtgatttgagggaagctaaacatatcagcagccagggcct

SEQ ID NO: 408929 - DNA, 140 bp, Artificial Sequence
  Synthetic
atacgccatgctgggtctccaagaagagataaaaaattgctctttcaatacaaccacagaaataagagataagaaacagaaagtgtatgcacttttttataaacctgatgtagtaccactcgtacttgggagtcggccat

SEQ ID NO: 408930 - DNA, 140 bp, Artificial Sequence
  Synthetic
atggccgactcccaagtacgagtggtactacatcaggtttataaaaaagtgcatacactttctgtttcttatctcttatttctgtggttgtattgaaagagcaattttttatctcttcttggagacccagcatggcgtat

SEQ ID NO: 408931 - DNA, 140 bp, Artificial Sequence
  Synthetic
aggccctggctgctgatatgaatagtacaccttaatgattctatagaaattgtgtgtacaagacccaacaataatacaaggaaaagtataaggataggaccaggacaagcattctatgcagaccttttgggacagcggtg

SEQ ID NO: 408932 - DNA, 140 bp, Artificial Sequence
  Synthetic
caccgctgtcccaaaaggtctgcatagaatgcttgtcctggtcctatccttatacttttccttgtattattgttgggtcttgtacacacaatttctatagaatcattaaggtgtactattcatatcagcagccagggcct

SEQ ID NO: 408933 - DNA, 140 bp, Artificial Sequence
  Synthetic
aggccctggctgctgatatgataatacaaggaaaagtataaggataggaccaggacaagcattctatgcaacagatggcataataggaaacataagacaagcatcttgtaacttcactacgaccttttgggacagcggtg

SEQ ID NO: 408934 - DNA, 140 bp, Artificial Sequence
  Synthetic
caccgctgtcccaaaaggtcgtagtgaagttacaagatgcttgtcttatgtttcctattatgccatctgttgcatagaatgcttgtcctggtcctatccttatacttttccttgtattatcatatcagcagccagggcct

SEQ ID NO: 408935 - DNA, 140 bp, Artificial Sequence
  Synthetic
aggccctggctgctgatatgagccatgcatggacaagtagactgtagtccagggatatggcaattagattgtacacatttagaaggaaaagtcatcctggtagcagtccatgtagccagtgaccttttgggacagcggtg

SEQ ID NO: 408936 - DNA, 140 bp, Artificial Sequence
  Synthetic
caccgctgtcccaaaaggtcactggctacatggactgctaccaggatgacttttccttctaaatgtgtacaatctaattgccatatccctggactacagtctacttgtccatgcatggctcatatcagcagccagggcct

SEQ ID NO: 408937 - DNA, 140 bp, Artificial Sequence
  Synthetic
aggccctggctgctgatatgttataaacctgtggcaggaagtaggaaaagcaatgtatgcccctcccatcagaggacaaattagatgtacatcaaatattacagggctgatattaacaaggaccttttgggacagcggtg

SEQ ID NO: 408938 - DNA, 140 bp, Artificial Sequence
  Synthetic
caccgctgtcccaaaaggtccttgttaatatcagccctgtaatatttgatgtacatctaatttgtcctctgatgggaggggcatacattgcttttcctacttcctgccacaggtttataacatatcagcagccagggcct

SEQ ID NO: 408939 - DNA, 140 bp, Artificial Sequence
  Synthetic
aggccctggctgctgatatgaattctgcaacaactactgtttattcatttcagaattgggtgtcaacatagcagaataagtattactcgacagagaagagcaagaaatggatccagtagagaccttttgggacagcggtg

SEQ ID NO: 408940 - DNA, 140 bp, Artificial Sequence
  Synthetic
caccgctgtcccaaaaggtctctactggatccatttcttgctcttctctgtcgagtaatacttattctgctatgttgacacccaattctgaaatgaataaacagtagttgttgcagaattcatatcagcagccagggcct

SEQ ID NO: 408941 - DNA, 140 bp, Artificial Sequence
  Synthetic
aggccctggctgctgatatggggagccatacaatgaatggacattagaactgttagaagagcttaagcaggaagctgttagacattttcctaggccatggctccatggattaggacaatagaccttttgggacagcggtg

SEQ ID NO: 408942 - DNA, 140 bp, Artificial Sequence
  Synthetic
caccgctgtcccaaaaggtctattgtcctaatccatggagccatggcctaggaaaatgtctaacagcttcctgcttaagctcttctaacagttctaatgtccattcattgtatggctccccatatcagcagccagggcct

SEQ ID NO: 408943 - DNA, 140 bp, Artificial Sequence
  Synthetic
aggccctggctgctgatatgataacgaaaggcttaggcatctcctatggcaggaagaagcggagacagcgacgaaaacctcctcaaggcgatcaggctcatcaagttcctataccagagcgaccttttgggacagcggtg

SEQ ID NO: 408944 - DNA, 140 bp, Artificial Sequence
  Synthetic
caccgctgtcccaaaaggtcgctctggtataggaacttgatgagcctgatcgccttgaggaggttttcgtcgctgtctccgcttcttcctgccataggagatgcctaagcctttcgttatcatatcagcagccagggcct

SEQ ID NO: 408945 - DNA, 140 bp, Artificial Sequence
  Synthetic
atacgccatgctgggtctccgaataagagaaagagcagaagacagtggcaatgagagcgagggagaaagagaggaattgtcaaaacttgtggaaatggggcatcatgctccttgggatgtcgtacttgggagtcggccat

SEQ ID NO: 408946 - DNA, 140 bp, Artificial Sequence
  Synthetic
atggccgactcccaagtacgacatcccaaggagcatgatgccccatttccacaagttttgacaattcctctctttctccctcgctctcattgccactgtcttctgctctttctcttattcggagacccagcatggcgtat

SEQ ID NO: 408947 - DNA, 140 bp, Artificial Sequence
  Synthetic
  misc_feature (107)..(107): n is a, c, g, or t
atacgccatgctgggtctcctctgaacaagggcttaggcatctcctatggcaggaagaagcggagacagcgacgaggacctcctcaaggcaataagaattatcaaantcctgtaccaaagcgtacttgggagtcggccat

SEQ ID NO: 408948 - DNA, 140 bp, Artificial Sequence
  Synthetic
  misc_feature (34)..(34): n is a, c, g, or t
atggccgactcccaagtacgctttggtacaggantttgataattcttattgccttgaggaggtcctcgtcgctgtctccgcttcttcctgccataggagatgcctaagcccttgttcagaggagacccagcatggcgtat

SEQ ID NO: 408949 - DNA, 140 bp, Artificial Sequence
  Synthetic
atacgccatgctgggtctcccaatagtaggactggtagttgcgctaatcatagcaatagttgtgtggactatagtaggtatagaatataagaaattgctaaagcaaagaaaaatagacagcgtacttgggagtcggccat

SEQ ID NO: 408950 - DNA, 140 bp, Artificial Sequence
  Synthetic
atggccgactcccaagtacgctgtctatttttctttgctttagcaatttcttatattctatacctactatagtccacacaactattgctatgattagcgcaactaccagtcctactattgggagacccagcatggcgtat

SEQ ID NO: 408951 - DNA, 140 bp, Artificial Sequence
  Synthetic
aggccctggctgctgatatgatggaaaacagatggcaggtgctgattgtgtggcaggtagacaggatgaagattagaacatggaatagtttagtaaagcaccatatgtatgtttcaaggagaccttttgggacagcggtg

SEQ ID NO: 408952 - DNA, 140 bp, Artificial Sequence
  Synthetic
caccgctgtcccaaaaggtctccttgaaacatacatatggtgctttactaaactattccatgttctaatcttcatcctgtctacctgccacacaatcagcacctgccatctgttttccatcatatcagcagccagggcct

SEQ ID NO: 408953 - DNA, 140 bp, Artificial Sequence
  Synthetic
atacgccatgctgggtctccgggaaggtagaagaggaggaaaaaaggaaaaactgctctttcaatgtaagggataagagggagcaagtatatgcacttttttataaacttgatatagtgccgtacttgggagtcggccat

SEQ ID NO: 408954 - DNA, 140 bp, Artificial Sequence
  Synthetic
atggccgactcccaagtacggcactatatcaagtttataaaaaagtgcatatacttgctccctcttatcccttacattgaaagagcagtttttccttttttcctcctcttctaccttcccggagacccagcatggcgtat

SEQ ID NO: 408955 - DNA, 140 bp, Artificial Sequence
  Synthetic
atacgccatgctgggtctccaccattgaaatgaaagaagaagtgaggaactgctcttacaacgtgaccacagtactaagagataagaaacagaaaatatattcacttttttatagacttgcgtacttgggagtcggccat

SEQ ID NO: 408956 - DNA, 140 bp, Artificial Sequence
  Synthetic
atggccgactcccaagtacgcaagtctataaaaaagtgaatatattttctgtttcttatctcttagtactgtggtcacgttgtaagagcagttcctcacttcttctttcatttcaatggtggagacccagcatggcgtat

SEQ ID NO: 408957 - DNA, 140 bp, Artificial Sequence
  Synthetic
atacgccatgctgggtctccacaatgttaaaaccataatagtacagcttaatgcatctatagtaattaattgtacaaggccctacaaatatacaaggcaaaggacatcgataggactaagcgtacttgggagtcggccat

SEQ ID NO: 408958 - DNA, 140 bp, Artificial Sequence
  Synthetic
atggccgactcccaagtacgcttagtcctatcgatgtcctttgccttgtatatttgtagggccttgtacaattaattactatagatgcattaagctgtactattatggttttaacattgtggagacccagcatggcgtat

SEQ ID NO: 408959 - DNA, 140 bp, Artificial Sequence
  Synthetic
atacgccatgctgggtctccgacaagcacattgtaaaattagcagagcagaatggaataaagctttacaacaggtagctacaaaactaggaaaccttcttaacaaaacaacaataactttcgtacttgggagtcggccat

SEQ ID NO: 408960 - DNA, 140 bp, Artificial Sequence
  Synthetic
atggccgactcccaagtacgaaagttattgttgttttgttaagaaggtttcctagttttgtagctacctgttgtaaagctttattccattctgctctgctaattttacaatgtgcttgtcggagacccagcatggcgtat

SEQ ID NO: 408961 - DNA, 140 bp, Artificial Sequence
  Synthetic
atacgccatgctgggtctcctaagccatcctcaggaggggacccagaaattacatcacacatgcttaattgtggaggggacttcttctactgtaatacatcaagactgtttaatagtacacgtacttgggagtcggccat

SEQ ID NO: 408962 - DNA, 140 bp, Artificial Sequence
  Synthetic
atggccgactcccaagtacgtgtactattaaacagtcttgatgtattacagtagaagaagtcccctccacaattaagcatgtgtgatgtaatttctgggtcccctcctgaggatggcttaggagacccagcatggcgtat

SEQ ID NO: 408963 - DNA, 140 bp, Artificial Sequence
  Synthetic
atacgccatgctgggtctccggagctaaaagagagtgctattaatttgctgaataccatagcaatagcagtagctgaaggaacagataggattatagaagtagtacaaagaggttttagacgtacttgggagtcggccat

SEQ ID NO: 408964 - DNA, 140 bp, Artificial Sequence
  Synthetic
atggccgactcccaagtacgtctaaaacctctttgtactacttctataatcctatctgttccttcagctactgctattgctatggtattcagcaaattaatagcactctcttttagctccggagacccagcatggcgtat

SEQ ID NO: 408965 - DNA, 140 bp, Artificial Sequence
  Synthetic
aggccctggctgctgatatgacaaacattctatgcaacaggtgaaataataggggatattagaaaagcacattgtgtggtcaataaaacagaatggaataaaaatttgaaaaaggtagttgaccttttgggacagcggtg

SEQ ID NO: 408966 - DNA, 140 bp, Artificial Sequence
  Synthetic
caccgctgtcccaaaaggtcaactacctttttcaaatttttattccattctgttttattgaccacacaatgtgcttttctaatatcccctattatttcacctgttgcatagaatgtttgtcatatcagcagccagggcct

SEQ ID NO: 408967 - DNA, 140 bp, Artificial Sequence
  Synthetic
aggccctggctgctgatatgtaaaacaatagtctttaatcaatcctcaggaggggacccagaaattgtaatgcacagttttaattgtggaggggaatttttctactgtaatacaacaaaagaccttttgggacagcggtg

SEQ ID NO: 408968 - DNA, 140 bp, Artificial Sequence
  Synthetic
caccgctgtcccaaaaggtcttttgttgtattacagtagaaaaattcccctccacaattaaaactgtgcattacaatttctgggtcccctcctgaggattgattaaagactattgttttacatatcagcagccagggcct

SEQ ID NO: 408969 - DNA, 140 bp, Artificial Sequence
  Synthetic
atacgccatgctgggtctccttcaggaggggatccagaagttacaacacatagttttaattgtggaggagaatttttctattgtaacacatcagaactgtttaataggacttggaatgcccgtacttgggagtcggccat

SEQ ID NO: 408970 - DNA, 140 bp, Artificial Sequence
  Synthetic
atggccgactcccaagtacgggcattccaagtcctattaaacagttctgatgtgttacaatagaaaaattctcctccacaattaaaactatgtgttgtaacttctggatcccctcctgaaggagacccagcatggcgtat

SEQ ID NO: 408971 - DNA, 140 bp, Artificial Sequence
  Synthetic
aggccctggctgctgatatgaatttttctattgtaacacatcagaactgtttaataggacttggaatgccactgaccagttaaatagcacagaagatagcacagcgctaaacgagactatgaccttttgggacagcggtg

SEQ ID NO: 408972 - DNA, 140 bp, Artificial Sequence
  Synthetic
caccgctgtcccaaaaggtcatagtctcgtttagcgctgtgctatcttctgtgctatttaactggtcagtggcattccaagtcctattaaacagttctgatgtgttacaatagaaaaattcatatcagcagccagggcct

SEQ ID NO: 408973 - DNA, 140 bp, Artificial Sequence
  Synthetic
aggccctggctgctgatatgaatataacagatgaagtaaaaaactgtacttttaatatgaccacagaactaaaagataagaagcagaaggtccatgcacttttttataagcttgatataggaccttttgggacagcggtg

SEQ ID NO: 408974 - DNA, 140 bp, Artificial Sequence
  Synthetic
caccgctgtcccaaaaggtcctatatcaagcttataaaaaagtgcatggaccttctgcttcttatcttttagttctgtggtcatattaaaagtacagttttttacttcatctgttatattcatatcagcagccagggcct

SEQ ID NO: 408975 - DNA, 140 bp, Artificial Sequence
  Synthetic
aggccctggctgctgatatgattgtacaagacccaacaacaatacaagaaaaagtatacatataggaccagggagagcattttatgcaacaggagacataataggagatataagacaagcgaccttttgggacagcggtg

SEQ ID NO: 408976 - DNA, 140 bp, Artificial Sequence
  Synthetic
caccgctgtcccaaaaggtcgcttgtcttatatctcctattatgtctcctgttgcataaaatgctctccctggtcctatatgtatactttttcttgtattgttgttgggtcttgtacaatcatatcagcagccagggcct

SEQ ID NO: 408977 - DNA, 140 bp, Artificial Sequence
  Synthetic
aggccctggctgctgatatgaattaaaagaattagggaaagagcagaagacagtggcaatgagagtgatggggatactgaggaattgtcaaccatggtggatatggagcatcttaggcttgaccttttgggacagcggtg

SEQ ID NO: 408978 - DNA, 140 bp, Artificial Sequence
  Synthetic
caccgctgtcccaaaaggtcaagcctaagatgctccatatccaccatggttgacaattcctcagtatccccatcactctcattgccactgtcttctgctctttccctaattcttttaattcatatcagcagccagggcct

SEQ ID NO: 408979 - DNA, 140 bp, Artificial Sequence
  Synthetic
atacgccatgctgggtctccttggagtaataaaaacaagagtgagatatgggacaaaatgacctggctgcaatgggataaggaaattagcaattatacacaaataatatataatctaattcgtacttgggagtcggccat

SEQ ID NO: 408980 - DNA, 140 bp, Artificial Sequence
  Synthetic
atggccgactcccaagtacgaattagattatatattatttgtgtataattgctaatttccttatcccattgcagccaggtcattttgtcccatatctcactcttgtttttattactccaaggagacccagcatggcgtat

SEQ ID NO: 408981 - DNA, 140 bp, Artificial Sequence
  Synthetic
atacgccatgctgggtctccaaagagcttgcagagctattcttaacgtacccagaagaataagacagggcttggaaaggcttttgctataaaatgggtggcaaatggtcaaaaagtagttcgtacttgggagtcggccat

SEQ ID NO: 408982 - DNA, 140 bp, Artificial Sequence
  Synthetic
atggccgactcccaagtacgaactactttttgaccatttgccacccattttatagcaaaagcctttccaagccctgtcttattcttctgggtacgttaagaatagctctgcaagctctttggagacccagcatggcgtat

SEQ ID NO: 408983 - DNA, 140 bp, Artificial Sequence
  Synthetic
  misc_feature (97)..(97): n is a, c, g, or t
aggccctggctgctgatatgctggctggacagatagggttatagaaataggacaaggaatttgtagagctattttaaacatacctagaagaatcagncagggcctcgaaagagctttgctgaccttttgggacagcggtg

SEQ ID NO: 408984 - DNA, 140 bp, Artificial Sequence
  Synthetic
  misc_feature (44)..(44): n is a, c, g, or t
caccgctgtcccaaaaggtcagcaaagctctttcgaggccctgnctgattcttctaggtatgtttaaaatagctctacaaattccttgtcctatttctataaccctatctgtccagccagcatatcagcagccagggcct

SEQ ID NO: 408985 - DNA, 140 bp, Artificial Sequence
  Synthetic
aggccctggctgctgatatgtggagacacttgggaaggagttatggcaattataagaatcttacaacaactactgtttacccattatagaattggatgccaacatagtagaataggaattgaccttttgggacagcggtg

SEQ ID NO: 408986 - DNA, 140 bp, Artificial Sequence
  Synthetic
caccgctgtcccaaaaggtcaattcctattctactatgttggcatccaattctataatgggtaaacagtagttgttgtaagattcttataattgccataactccttcccaagtgtctccacatatcagcagccagggcct

SEQ ID NO: 408987 - DNA, 140 bp, Artificial Sequence
  Synthetic
aggccctggctgctgatatgagcaaccctctattgtgtacatgaaaggatagaggtaaaagacaccaaggaagctttagaaaagatggaggaagaacaaaacaaaagtaagaacaaaaaggaccttttgggacagcggtg

SEQ ID NO: 408988 - DNA, 140 bp, Artificial Sequence
  Synthetic
caccgctgtcccaaaaggtcctttttgttcttacttttgttttgttcttcctccatcttttctaaagcttccttggtgtcttttacctctatcctttcatgtacacaatagagggttgctcatatcagcagccagggcct

SEQ ID NO: 408989 - DNA, 140 bp, Artificial Sequence
  Synthetic
atacgccatgctgggtctccggaaaaagagattaacaattacacagacttaatatacaacttacttgaaaaatcgcagaaccaacaagaaaagaatgaacaagaattattggaattagaccgtacttgggagtcggccat

SEQ ID NO: 408990 - DNA, 140 bp, Artificial Sequence
  Synthetic
atggccgactcccaagtacggtctaattccaataattcttgttcattcttttcttgttggttctgcgatttttcaagtaagttgtatattaagtctgtgtaattgttaatctctttttccggagacccagcatggcgtat

SEQ ID NO: 408991 - DNA, 140 bp, Artificial Sequence
  Synthetic
aggccctggctgctgatatgcacctagaactttgaacgcatgggtaaaagtaatagaagaaaaggctttcagcccagaagtaatacccatgttttcagcattatcagaaggagccaccccgaccttttgggacagcggtg

SEQ ID NO: 408992 - DNA, 140 bp, Artificial Sequence
  Synthetic
caccgctgtcccaaaaggtcggggtggctccttctgataatgctgaaaacatgggtattacttctgggctgaaagccttttcttctattacttttacccatgcgttcaaagttctaggtgcatatcagcagccagggcct

SEQ ID NO: 408993 - DNA, 140 bp, Artificial Sequence
  Synthetic
  misc_feature (82)..(82): n is a, c, g, or t
atacgccatgctgggtctcccaaaagtgagactgaattagatggcatttggactaatctaacatggcaggaatgggacaaantggtggataattacactgacacaatttatttagaaatacgtacttgggagtcggccat

SEQ ID NO: 408994 - DNA, 140 bp, Artificial Sequence
  Synthetic
  misc_feature (59)..(59): n is a, c, g, or t
atggccgactcccaagtacgtatttctaaataaattgtgtcagtgtaattatccaccantttgtcccattcctgccatgttagattagtccaaatgccatctaattcagtctcacttttgggagacccagcatggcgtat

SEQ ID NO: 408995 - DNA, 140 bp, Artificial Sequence
  Synthetic
atacgccatgctgggtctccacaaatgttaatactctaaatgatactactctcaaagatgaaatgaaaaactgctctttcaatataaccacagaaataagagataagaaacagaaagcatcgtacttgggagtcggccat

SEQ ID NO: 408996 - DNA, 140 bp, Artificial Sequence
  Synthetic
atggccgactcccaagtacgatgctttctgtttcttatctcttatttctgtggttatattgaaagagcagtttttcatttcatctttgagagtagtatcatttagagtattaacatttgtggagacccagcatggcgtat

SEQ ID NO: 408997 - DNA, 140 bp, Artificial Sequence
  Synthetic
aggccctggctgctgatatgcaataatacaagaagaggtatagggataggaccaggacaaacattctttgcaacagatgccataataggagacataagaaaagcatattgtaatattagtgaccttttgggacagcggtg

SEQ ID NO: 408998 - DNA, 140 bp, Artificial Sequence
  Synthetic
caccgctgtcccaaaaggtcactaatattacaatatgcttttcttatgtctcctattatggcatctgttgcaaagaatgtttgtcctggtcctatccctatacctcttcttgtattattgcatatcagcagccagggcct

SEQ ID NO: 408999 - DNA, 140 bp, Artificial Sequence
  Synthetic
aggccctggctgctgatatgtgtacaagacccaacaacaatacaagaaaaagtataccaatgggaccggggagagccatgtatgcaacaggaggcatagtaggaaatataagactagcacgaccttttgggacagcggtg

SEQ ID NO: 409000 - DNA, 140 bp, Artificial Sequence
  Synthetic
caccgctgtcccaaaaggtcgtgctagtcttatatttcctactatgcctcctgttgcatacatggctctccccggtcccattggtatactttttcttgtattgttgttgggtcttgtacacatatcagcagccagggcct

SEQ ID NO: 409001 - DNA, 140 bp, Artificial Sequence
  Synthetic
atacgccatgctgggtctcctatagcacacaaatagatcctgacctagcagaccaactgattcatctacactattttgactgtttttcagactctgccataaggaaagccatattaggaccgtacttgggagtcggccat

SEQ ID NO: 409002 - DNA, 140 bp, Artificial Sequence
  Synthetic
atggccgactcccaagtacggtcctaatatggctttccttatggcagagtctgaaaaacagtcaaaatagtgtagatgaatcagttggtctgctaggtcaggatctatttgtgtgctataggagacccagcatggcgtat

SEQ ID NO: 409003 - DNA, 140 bp, Artificial Sequence
  Synthetic
aggccctggctgctgatatgcagaacaattgtgggtcacagtctattatggggtacctgtgtggaaagaagcaaccaccactctattttgtgcatcagatgctaaagcatatgatacagagaccttttgggacagcggtg

SEQ ID NO: 409004 - DNA, 140 bp, Artificial Sequence
  Synthetic
caccgctgtcccaaaaggtctctgtatcatatgctttagcatctgatgcacaaaatagagtggtggttgcttctttccacacaggtaccccataatagactgtgacccacaattgttctgcatatcagcagccagggcct

SEQ ID NO: 409005 - DNA, 140 bp, Artificial Sequence
  Synthetic
atacgccatgctgggtctccatcggggaaaagatggacaggggggaaataaaaaactgctctttcaatatcaccacaaacataagaaataagatgcaaagcacatatgcacttttttatacgtacttgggagtcggccat

SEQ ID NO: 409006 - DNA, 140 bp, Artificial Sequence
  Synthetic
atggccgactcccaagtacgtataaaaaagtgcatatgtgctttgcatcttatttcttatgtttgtggtgatattgaaagagcagttttttatttcccccctgtccatcttttccccgatggagacccagcatggcgtat

SEQ ID NO: 409007 - DNA, 140 bp, Artificial Sequence
  Synthetic
atacgccatgctgggtctccgaaattaattgtacaagacccaacaacaaggcaagaagacgtatacgtataggaccagggagaacattttatacaggaaaaatagtaggagatataagaccgtacttgggagtcggccat

SEQ ID NO: 409008 - DNA, 140 bp, Artificial Sequence
  Synthetic
atggccgactcccaagtacggtcttatatctcctactatttttcctgtataaaatgttctccctggtcctatacgtatacgtcttcttgccttgttgttgggtcttgtacaattaatttcggagacccagcatggcgtat

SEQ ID NO: 409009 - DNA, 140 bp, Artificial Sequence
  Synthetic
aggccctggctgctgatatgcaagtttgcttcataacgaaaggcttaggcatctcctatggcaggaagaagcggagacagagacgaagaccttctcaaggcggtcagactcatcaagatcgaccttttgggacagcggtg

SEQ ID NO: 409010 - DNA, 140 bp, Artificial Sequence
  Synthetic
caccgctgtcccaaaaggtcgatcttgatgagtctgaccgccttgagaaggtcttcgtctctgtctccgcttcttcctgccataggagatgcctaagcctttcgttatgaagcaaacttgcatatcagcagccagggcct

SEQ ID NO: 409011 - DNA, 140 bp, Artificial Sequence
  Synthetic
aggccctggctgctgatatgccaacaacaatacaagaaaaagtatacatataggaccagggagagcattttatgcaacaggagacataataggagatataagacaagcacattgtaacctgaccttttgggacagcggtg

SEQ ID NO: 409012 - DNA, 140 bp, Artificial Sequence
  Synthetic
caccgctgtcccaaaaggtcaggttacaatgtgcttgtcttatatctcctattatgtctcctgttgcataaaatgctctccctggtcctatatgtatactttttcttgtattgttgttggcatatcagcagccagggcct

SEQ ID NO: 409013 - DNA, 140 bp, Artificial Sequence
  Synthetic
aggccctggctgctgatatgagtgggaaagagaaattgacaattacacaggcttaatatacaccttaattgaagaatcgcaaaaccaacaagaaaagaatgaacaagaattattggaattgaccttttgggacagcggtg

SEQ ID NO: 409014 - DNA, 140 bp, Artificial Sequence
  Synthetic
caccgctgtcccaaaaggtcaattccaataattcttgttcattcttttcttgttggttttgcgattcttcaattaaggtgtatattaagcctgtgtaattgtcaatttctctttcccactcatatcagcagccagggcct

SEQ ID NO: 409015 - DNA, 140 bp, Artificial Sequence
  Synthetic
aggccctggctgctgatatgggattgtggaacttctgggacgcagggggtgggaaatcctcaaatattggtggaatctcctgcagtattggagtcaggaactaaagaatagtgctgttaggaccttttgggacagcggtg

SEQ ID NO: 409016 - DNA, 140 bp, Artificial Sequence
  Synthetic
caccgctgtcccaaaaggtcctaacagcactattctttagttcctgactccaatactgcaggagattccaccaatatttgaggatttcccaccccctgcgtcccagaagttccacaatcccatatcagcagccagggcct

SEQ ID NO: 409017 - DNA, 140 bp, Artificial Sequence
  Synthetic
atacgccatgctgggtctccatgcacttttttatagacttgatatagtacccatagacaatgataatagtaccaatagtaccaattatagattaataaattgtaatacctcagccattaccgtacttgggagtcggccat

SEQ ID NO: 409018 - DNA, 140 bp, Artificial Sequence
  Synthetic
atggccgactcccaagtacggtaatggctgaggtattacaatttattaatctataattggtactattggtactattatcattgtctatgggtactatatcaagtctataaaaaagtgcatggagacccagcatggcgtat

SEQ ID NO: 409019 - DNA, 140 bp, Artificial Sequence
  Synthetic
aggccctggctgctgatatggccagtggtgtcaactcaactgctgttgaatggcagtctagcagaagaagagatcataattagatctgaaaacctcacaaacaatgctaaaatcataatagaccttttgggacagcggtg

SEQ ID NO: 409020 - DNA, 140 bp, Artificial Sequence
  Synthetic
caccgctgtcccaaaaggtctattatgattttagcattgtttgtgaggttttcagatctaattatgatctcttcttctgctagactgccattcaacagcagttgagttgacaccactggccatatcagcagccagggcct

SEQ ID NO: 409021 - DNA, 140 bp, Artificial Sequence
  Synthetic
atacgccatgctgggtctcctataagacaaaggacatctataggattagggcaagcgctctatacaacaaaaacaagaagtataataggacaagcatattgtaatattagtaaaaatgaacgtacttgggagtcggccat

SEQ ID NO: 409022 - DNA, 140 bp, Artificial Sequence
  Synthetic
atggccgactcccaagtacgttcatttttactaatattacaatatgcttgtcctattatacttcttgtttttgttgtatagagcgcttgccctaatcctatagatgtcctttgtcttataggagacccagcatggcgtat

SEQ ID NO: 409023 - DNA, 140 bp, Artificial Sequence
  Synthetic
atacgccatgctgggtctccggtacataaagattttcattatgatagtaggaggaataataggactaagaatcttgttagctataattaatgtagtcaggagaatcaggcagggatactccgtacttgggagtcggccat

SEQ ID NO: 409024 - DNA, 140 bp, Artificial Sequence
  Synthetic
atggccgactcccaagtacggagtatccctgcctgattctcctgactacattaattatagctaacaagattcttagtcctattattcctcctactatcataatgaaaatctttatgtaccggagacccagcatggcgtat

SEQ ID NO: 409025 - DNA, 140 bp, Artificial Sequence
  Synthetic
aggccctggctgctgatatgtagagttaggcagggatattcacctctgtcatttcagaccctcctcccagccccgaggggacccgacaggcccgaaggaatagaagaagaaggtggagaggaccttttgggacagcggtg

SEQ ID NO: 409026 - DNA, 140 bp, Artificial Sequence
  Synthetic
caccgctgtcccaaaaggtcctctccaccttcttcttctattccttcgggcctgtcgggtcccctcggggctgggaggagggtctgaaatgacagaggtgaatatccctgcctaactctacatatcagcagccagggcct

SEQ ID NO: 409027 - DNA, 140 bp, Artificial Sequence
  Synthetic
atacgccatgctgggtctccactgaagaacagtgctagtagcttgcttgataccatagcaatagcagtagctgaggggacagatagggttatagaaatagtacgaagagcttgcagagctcgtacttgggagtcggccat

SEQ ID NO: 409028 - DNA, 140 bp, Artificial Sequence
  Synthetic
atggccgactcccaagtacgagctctgcaagctcttcgtactatttctataaccctatctgtcccctcagctactgctattgctatggtatcaagcaagctactagcactgttcttcagtggagacccagcatggcgtat

SEQ ID NO: 409029 - DNA, 140 bp, Artificial Sequence
  Synthetic
atacgccatgctgggtctcctgacagcaggcaggagtcaaatagcagcgacactataactcttccatgcagaataaaacaaattataaatatgtggcagagggtaggacaagcaatatatcgtacttgggagtcggccat

SEQ ID NO: 409030 - DNA, 140 bp, Artificial Sequence
  Synthetic
atggccgactcccaagtacgatatattgcttgtcctaccctctgccacatatttataatttgttttattctgcatggaagagttatagtgtcgctgctatttgactcctgcctgctgtcaggagacccagcatggcgtat

SEQ ID NO: 409031 - DNA, 140 bp, Artificial Sequence
  Synthetic
aggccctggctgctgatatgagatggaacaagccccagaagaccaggggccccagagagagccatacaatgaatggatgttagagctgttagaagatcttaagaatgaagccgttagacagaccttttgggacagcggtg

SEQ ID NO: 409032 - DNA, 140 bp, Artificial Sequence
  Synthetic
caccgctgtcccaaaaggtctgtctaacggcttcattcttaagatcttctaacagctctaacatccattcattgtatggctctctctggggcccctggtcttctggggcttgttccatctcatatcagcagccagggcct

SEQ ID NO: 409033 - DNA, 140 bp, Artificial Sequence
  Synthetic
aggccctggctgctgatatgagaatataagagattgctaaaacaaagaaaaatagacaggttaattgagagaataagagaaagagcagaagacagtggcaatgagagtgatggggatacagaccttttgggacagcggtg

SEQ ID NO: 409034 - DNA, 140 bp, Artificial Sequence
  Synthetic
caccgctgtcccaaaaggtctgtatccccatcactctcattgccactgtcttctgctctttctcttattctctcaattaacctgtctatttttctttgttttagcaatctcttatattctcatatcagcagccagggcct

SEQ ID NO: 409035 - DNA, 140 bp, Artificial Sequence
  Synthetic
atacgccatgctgggtctccaaccatgacaatgccactgaagaaatgagaaactgctcttacagtgtaaccacagaaataagggataagaaaaagaaggtatattcacttttttatagaccgtacttgggagtcggccat

SEQ ID NO: 409036 - DNA, 140 bp, Artificial Sequence
  Synthetic
atggccgactcccaagtacggtctataaaaaagtgaatataccttctttttcttatcccttatttctgtggttacactgtaagagcagtttctcatttcttcagtggcattgtcatggttggagacccagcatggcgtat

SEQ ID NO: 409037 - DNA, 140 bp, Artificial Sequence
  Synthetic
aggccctggctgctgatatgaaagtataaggataggaccaggacaagcattctttgcaacaaatgacataataggagacataagacaagcacattgtaacattagtaaaacacaatggaagaccttttgggacagcggtg

SEQ ID NO: 409038 - DNA, 140 bp, Artificial Sequence
  Synthetic
caccgctgtcccaaaaggtcttccattgtgttttactaatgttacaatgtgcttgtcttatgtctcctattatgtcatttgttgcaaagaatgcttgtcctggtcctatccttatactttcatatcagcagccagggcct

SEQ ID NO: 409039 - DNA, 140 bp, Artificial Sequence
  Synthetic
aggccctggctgctgatatgacagggccatgcaaaaatgttagctcagtacaatgcacacatggaattaagccagtagtatcaactcaactgctgttaaatggcagtctagcagaaaaaggaccttttgggacagcggtg

SEQ ID NO: 409040 - DNA, 140 bp, Artificial Sequence
  Synthetic
caccgctgtcccaaaaggtcctttttctgctagactgccatttaacagcagttgagttgatactactggcttaattccatgtgtgcattgtactgagctaacatttttgcatggccctgtcatatcagcagccagggcct

SEQ ID NO: 409041 - DNA, 140 bp, Artificial Sequence
  Synthetic
aggccctggctgctgatatgtgcactttaaattttccaattagtcctattgaaactgtaccagtaaaattaaagccaggaatggatggcccaaaagttaaacaatggccattgacagaaggaccttttgggacagcggtg

SEQ ID NO: 409042 - DNA, 140 bp, Artificial Sequence
  Synthetic
caccgctgtcccaaaaggtccttctgtcaatggccattgtttaacttttgggccatccattcctggctttaattttactggtacagtttcaataggactaattggaaaatttaaagtgcacatatcagcagccagggcct

SEQ ID NO: 409043 - DNA, 140 bp, Artificial Sequence
  Synthetic
atacgccatgctgggtctcccaatgacagcatatatgtagaaataaaaaactgctctttcaatacaaccacagaaataagagataggcaacagaaagcgtatgcactcttttatagatctcgtacttgggagtcggccat

SEQ ID NO: 409044 - DNA, 140 bp, Artificial Sequence
  Synthetic
atggccgactcccaagtacgagatctataaaagagtgcatacgctttctgttgcctatctcttatttctgtggttgtattgaaagagcagttttttatttctacatatatgctgtcattgggagacccagcatggcgtat

SEQ ID NO: 409045 - DNA, 140 bp, Artificial Sequence
  Synthetic
aggccctggctgctgatatgtagcatgacaaaaatcttagagccctttagaaaacaaaatccagaaatggttatctatcaatacatggatgatttgtatgtaggatctgacttagaaatagaccttttgggacagcggtg

SEQ ID NO: 409046 - DNA, 140 bp, Artificial Sequence
  Synthetic
caccgctgtcccaaaaggtctatttctaagtcagatcctacatacaaatcatccatgtattgatagataaccatttctggattttgttttctaaagggctctaagatttttgtcatgctacatatcagcagccagggcct

SEQ ID NO: 409047 - DNA, 140 bp, Artificial Sequence
  Synthetic
aggccctggctgctgatatgattgtagtgagagcagtggagcttctgggacgcagcagtctcaggggactacagagggggtgggaagttctgaaatatctgagaggtcttatacagtattgaccttttgggacagcggtg

SEQ ID NO: 409048 - DNA, 140 bp, Artificial Sequence
  Synthetic
caccgctgtcccaaaaggtcaatactgtataagacctctcagatatttcagaacttcccaccccctctgtagtcccctgagactgctgcgtcccagaagctccactgctctcactacaatcatatcagcagccagggcct

SEQ ID NO: 409049 - DNA, 140 bp, Artificial Sequence
  Synthetic
aggccctggctgctgatatggcaagacttattggcattggacaaatgggcaagtctgtggagttggtttgacataacaaagtggctgtggtatataaaaatatttataatgatagtaggagaccttttgggacagcggtg

SEQ ID NO: 409050 - DNA, 140 bp, Artificial Sequence
  Synthetic
caccgctgtcccaaaaggtctcctactatcattataaatatttttatataccacagccactttgttatgtcaaaccaactccacagacttgcccatttgtccaatgccaataagtcttgccatatcagcagccagggcct

SEQ ID NO: 409051 - DNA, 140 bp, Artificial Sequence
  Synthetic
aggccctggctgctgatatgacagacaatgccaaaacaataatagtacatcttaatgaatctgtagaaattgtgtgtacaagacccggcaataatacaagaaaaagtataaggatagggcgaccttttgggacagcggtg

SEQ ID NO: 409052 - DNA, 140 bp, Artificial Sequence
  Synthetic
caccgctgtcccaaaaggtcgccctatccttatactttttcttgtattattgccgggtcttgtacacacaatttctacagattcattaagatgtactattattgttttggcattgtctgtcatatcagcagccagggcct

SEQ ID NO: 409053 - DNA, 140 bp, Artificial Sequence
  Synthetic
aggccctggctgctgatatgcagctttgctataaaatgggagacaagttgtcaaaaagcagcatagtaggatggtctgctataagggaaagactaagaagaactgaaccagcagcagagggaccttttgggacagcggtg

SEQ ID NO: 409054 - DNA, 140 bp, Artificial Sequence
  Synthetic
caccgctgtcccaaaaggtccctctgctgctggttcagttcttcttagtctttcccttatagcagaccatcctactatgctgctttttgacaacttgtctcccattttatagcaaagctgcatatcagcagccagggcct

SEQ ID NO: 409055 - DNA, 140 bp, Artificial Sequence
  Synthetic
aggccctggctgctgatatgggcagaggcagatcgattcgattagtgagcggattcttagcgcttgcctgggacgatctgcggagcctgtgcctcttcagctaccaccgattgagagactgaccttttgggacagcggtg

SEQ ID NO: 409056 - DNA, 140 bp, Artificial Sequence
  Synthetic
caccgctgtcccaaaaggtcagtctctcaatcggtggtagctgaagaggcacaggctccgcagatcgtcccaggcaagcgctaagaatccgctcactaatcgaatcgatctgcctctgcccatatcagcagccagggcct

SEQ ID NO: 409057 - DNA, 140 bp, Artificial Sequence
  Synthetic
atacgccatgctgggtctcccaatgtcgagagcgataacataaccactgtaaaaaatacaacagatgaagtaagaaactgttcttttaatacaaccacagaaatgagagataagcagcagcgtacttgggagtcggccat

SEQ ID NO: 409058 - DNA, 140 bp, Artificial Sequence
  Synthetic
atggccgactcccaagtacgctgctgcttatctctcatttctgtggttgtattaaaagaacagtttcttacttcatctgttgtattttttacagtggttatgttatcgctctcgacattgggagacccagcatggcgtat

SEQ ID NO: 409059 - DNA, 140 bp, Artificial Sequence
  Synthetic
aggccctggctgctgatatgaaggggttgagattggggtgggaaggcctcaagtacctgtggaatctcctgttatactggagtcaggagttaaagattagtgctataagtttggttgatagaccttttgggacagcggtg

SEQ ID NO: 409060 - DNA, 140 bp, Artificial Sequence
  Synthetic
caccgctgtcccaaaaggtctatcaaccaaacttatagcactaatctttaactcctgactccagtataacaggagattccacaggtacttgaggccttcccaccccaatctcaaccccttcatatcagcagccagggcct

SEQ ID NO: 409061 - DNA, 140 bp, Artificial Sequence
  Synthetic
aggccctggctgctgatatggagcgtcagtattaagcgggggagaattggatagatgggagaaaattcggttaaggccaggaggaaagaaacaatataaattaaaacatatagtatgggcgaccttttgggacagcggtg

SEQ ID NO: 409062 - DNA, 140 bp, Artificial Sequence
  Synthetic
caccgctgtcccaaaaggtcgcccatactatatgttttaatttatattgtttctttcctcctggccttaaccgaattttctcccatctatccaattctcccccgcttaatactgacgctccatatcagcagccagggcct

SEQ ID NO: 409063 - DNA, 140 bp, Artificial Sequence
  Synthetic
aggccctggctgctgatatgcaattgctattgtaaaaagtgttgctttcattgccaagtttgtttcataacaaaaggcttaggcatctcctatggcaggaagaagcggagacagcgacgagaccttttgggacagcggtg

SEQ ID NO: 409064 - DNA, 140 bp, Artificial Sequence
  Synthetic
caccgctgtcccaaaaggtctcgtcgctgtctccgcttcttcctgccataggagatgcctaagccttttgttatgaaacaaacttggcaatgaaagcaacactttttacaatagcaattgcatatcagcagccagggcct

SEQ ID NO: 409065 - DNA, 140 bp, Artificial Sequence
  Synthetic
aggccctggctgctgatatggcacacagcaagaggcgagagcggcggctggtgagtacgccaaattttttgactagcggaggctagaaggagagagatgggtgcgagagcgtcagtattagaccttttgggacagcggtg

SEQ ID NO: 409066 - DNA, 140 bp, Artificial Sequence
  Synthetic
caccgctgtcccaaaaggtctaatactgacgctctcgcacccatctctctccttctagcctccgctagtcaaaaaatttggcgtactcaccagccgccgctctcgcctcttgctgtgtgccatatcagcagccagggcct

SEQ ID NO: 409067 - DNA, 140 bp, Artificial Sequence
  Synthetic
  misc_feature (34)..(34): n is a, c, g, or t
  misc_feature (37)..(37): n is a, c, g, or t
atacgccatgctgggtctccataggaaattgttnagncaaagaagaatagacagattaattaagagaataagtgaaagagcagaagacagtggcaatgagagcgatggggatacagaggacgtacttgggagtcggccat

SEQ ID NO: 409068 - DNA, 140 bp, Artificial Sequence
  Synthetic
  misc_feature (104)..(104): n is a, c, g, or t
  misc_feature (107)..(107): n is a, c, g, or t
atggccgactcccaagtacgtcctctgtatccccatcgctctcattgccactgtcttctgctctttcacttattctcttaattaatctgtctattcttctttgnctnaacaatttcctatggagacccagcatggcgtat

SEQ ID NO: 409069 - DNA, 140 bp, Artificial Sequence
  Synthetic
aggccctggctgctgatatggatctgtagtgctgcagaacaattgtgggtcacagtctattatggggtacctgtgtggaaagaagcaaccaccactctattttgtgcatcagatgctaaagaccttttgggacagcggtg

SEQ ID NO: 409070 - DNA, 140 bp, Artificial Sequence
  Synthetic
caccgctgtcccaaaaggtctttagcatctgatgcacaaaatagagtggtggttgcttctttccacacaggtaccccataatagactgtgacccacaattgttctgcagcactacagatccatatcagcagccagggcct

SEQ ID NO: 409071 - DNA, 140 bp, Artificial Sequence
  Synthetic
atacgccatgctgggtctccaaaattagcaggaagatggccagtaaaagtagtacatacagacaatggcagcaatttcaccagtgctgcagttaaggccgcctgttggtgggcaggtatccgtacttgggagtcggccat

SEQ ID NO: 409072 - DNA, 140 bp, Artificial Sequence
  Synthetic
atggccgactcccaagtacggatacctgcccaccaacaggcggccttaactgcagcactggtgaaattgctgccattgtctgtatgtactacttttactggccatcttcctgctaattttggagacccagcatggcgtat

SEQ ID NO: 409073 - DNA, 140 bp, Artificial Sequence
  Synthetic
aggccctggctgctgatatggcaatttcaccagtgctgcagttaaggccgcctgttggtgggcaggtatcaaacaggaatttggaattccctacaatccccaaagtcaaggagtagtagagaccttttgggacagcggtg

SEQ ID NO: 409074 - DNA, 140 bp, Artificial Sequence
  Synthetic
caccgctgtcccaaaaggtctctactactccttgactttggggattgtagggaattccaaattcctgtttgatacctgcccaccaacaggcggccttaactgcagcactggtgaaattgccatatcagcagccagggcct

SEQ ID NO: 409075 - DNA, 140 bp, Artificial Sequence
  Synthetic
aggccctggctgctgatatgcagtaagtaataagtatatgtaatgtcacctttggaaatttgtgcaatagtaggactgatagtagcgctaatcatagcaatagtagtgtggactatagtagaccttttgggacagcggtg

SEQ ID NO: 409076 - DNA, 140 bp, Artificial Sequence
  Synthetic
caccgctgtcccaaaaggtctactatagtccacactactattgctatgattagcgctactatcagtcctactattgcacaaatttccaaaggtgacattacatatacttattacttactgcatatcagcagccagggcct

SEQ ID NO: 409077 - DNA, 140 bp, Artificial Sequence
  Synthetic
aggccctggctgctgatatgtggggagcaagtggtcaaaaagcagcatagttggatggcctgctgtaagagaaagaatgagacaaactgagccagcagcagtgggaagagaaagaatgaggaccttttgggacagcggtg

SEQ ID NO: 409078 - DNA, 140 bp, Artificial Sequence
  Synthetic
caccgctgtcccaaaaggtcctcattctttctcttcccactgctgctggctcagtttgtctcattctttctcttacagcaggccatccaactatgctgctttttgaccacttgctccccacatatcagcagccagggcct

SEQ ID NO: 409079 - DNA, 140 bp, Artificial Sequence
  Synthetic
aggccctggctgctgatatgaataaaaacatattggggtctgcatacaggagaaagagaatggcatctgggtcagggagtctccatagaatggaggaaaaggagatatagcacacaagtagaccttttgggacagcggtg

SEQ ID NO: 409080 - DNA, 140 bp, Artificial Sequence
  Synthetic
caccgctgtcccaaaaggtctacttgtgtgctatatctccttttcctccattctatggagactccctgacccagatgccattctctttctcctgtatgcagaccccaatatgtttttattcatatcagcagccagggcct

SEQ ID NO: 409081 - DNA, 140 bp, Artificial Sequence
  Synthetic
aggccctggctgctgatatgaaatgaaagactgcactgaaagacaggctaattttttagggagaatttggccttccagcaaggggaggccaggaaattttcctcagaacagattggagccgaccttttgggacagcggtg

SEQ ID NO: 409082 - DNA, 140 bp, Artificial Sequence
  Synthetic
caccgctgtcccaaaaggtcggctccaatctgttctgaggaaaatttcctggcctccccttgctggaaggccaaattctccctaaaaaattagcctgtctttcagtgcagtctttcatttcatatcagcagccagggcct

SEQ ID NO: 409083 - DNA, 140 bp, Artificial Sequence
  Synthetic
atacgccatgctgggtctcctaatatcactaacaatgggactaatatcactagcagtggggacacaggaatgacaaactgctctttcaatattaccacaggtataaaagataaggtgcaacgtacttgggagtcggccat

SEQ ID NO: 409084 - DNA, 140 bp, Artificial Sequence
  Synthetic
atggccgactcccaagtacgttgcaccttatcttttatacctgtggtaatattgaaagagcagtttgtcattcctgtgtccccactgctagtgatattagtcccattgttagtgatattaggagacccagcatggcgtat

SEQ ID NO: 409085 - DNA, 140 bp, Artificial Sequence
  Synthetic
aggccctggctgctgatatgcatgacctggatgcagtgggaaagagaaattgacaattacacaggcttaatatacaccttaattgaagaatcgcaaaaccaacaagaaaagaatgaacaagaccttttgggacagcggtg

SEQ ID NO: 409086 - DNA, 140 bp, Artificial Sequence
  Synthetic
caccgctgtcccaaaaggtcttgttcattcttttcttgttggttttgcgattcttcaattaaggtgtatattaagcctgtgtaattgtcaatttctctttcccactgcatccaggtcatgcatatcagcagccagggcct

SEQ ID NO: 409087 - DNA, 140 bp, Artificial Sequence
  Synthetic
aggccctggctgctgatatgtaagacaagggccaaaagaaccctttagagactatgtagatcggttctttaaaactctaagagctgaacaagctacacaagaagtaaaaaattggatgacgaccttttgggacagcggtg

SEQ ID NO: 409088 - DNA, 140 bp, Artificial Sequence
  Synthetic
caccgctgtcccaaaaggtcgtcatccaattttttacttcttgtgtagcttgttcagctcttagagttttaaagaaccgatctacatagtctctaaagggttcttttggcccttgtcttacatatcagcagccagggcct

SEQ ID NO: 409089 - DNA, 140 bp, Artificial Sequence
  Synthetic
atacgccatgctgggtctcctaaccccactctgtgtcactttaaactgtagtgatgaattgaggaacaatggcactatggggaacaatgtcactacagaggagaaaggaatgaaaaactgcgtacttgggagtcggccat

SEQ ID NO: 409090 - DNA, 140 bp, Artificial Sequence
  Synthetic
atggccgactcccaagtacgcagtttttcattcctttctcctctgtagtgacattgttccccatagtgccattgttcctcaattcatcactacagtttaaagtgacacagagtggggttaggagacccagcatggcgtat

SEQ ID NO: 409091 - DNA, 140 bp, Artificial Sequence
  Synthetic
aggccctggctgctgatatgggcttgtccaaaggtatcctttgagccaattcccatacattattgtgccccagctggttttgcgattctaaagtgtagagataagaagttcaatggaacagaccttttgggacagcggtg

SEQ ID NO: 409092 - DNA, 140 bp, Artificial Sequence
  Synthetic
caccgctgtcccaaaaggtctgttccattgaacttcttatctctacactttagaatcgcaaaaccagctggggcacaataatgtatgggaattggctcaaaggatacctttggacaagcccatatcagcagccagggcct

SEQ ID NO: 409093 - DNA, 140 bp, Artificial Sequence
  Synthetic
atacgccatgctgggtctccaagacaaagaacacctataggactagggcaatcactctatactacaagatcaagatcaataataggacaagcacattgtaatattagtagagcacaatggcgtacttgggagtcggccat

SEQ ID NO: 409094 - DNA, 140 bp, Artificial Sequence
  Synthetic
atggccgactcccaagtacgccattgtgctctactaatattacaatgtgcttgtcctattattgatcttgatcttgtagtatagagtgattgccctagtcctataggtgttctttgtcttggagacccagcatggcgtat

SEQ ID NO: 409095 - DNA, 140 bp, Artificial Sequence
  Synthetic
aggccctggctgctgatatgatgacctggatggagtgggagagagaaattgacaattacacaaacttaatatacaccttacttgaagaatcgcagaaccagcaagaaaagaatgaacaaggaccttttgggacagcggtg

SEQ ID NO: 409096 - DNA, 140 bp, Artificial Sequence
  Synthetic
caccgctgtcccaaaaggtccttgttcattcttttcttgctggttctgcgattcttcaagtaaggtgtatattaagtttgtgtaattgtcaatttctctctcccactccatccaggtcatcatatcagcagccagggcct

SEQ ID NO: 409097 - DNA, 140 bp, Artificial Sequence
  Synthetic
aggccctggctgctgatatgagaaaaatagacaggttaattaaaagaattagggaaagagcagaagacagtggcaatgagagtgagggagatactgaggaattggcaacaatggtggatagaccttttgggacagcggtg

SEQ ID NO: 409098 - DNA, 140 bp, Artificial Sequence
  Synthetic
caccgctgtcccaaaaggtctatccaccattgttgccaattcctcagtatctccctcactctcattgccactgtcttctgctctttccctaattcttttaattaacctgtctatttttctcatatcagcagccagggcct

SEQ ID NO: 409099 - DNA, 140 bp, Artificial Sequence
  Synthetic
atacgccatgctgggtctccaaataatagcacaaacacaaacatcacactccaatgcagaataaaacaaattataaagatggtggcaggcaggaaagcaatatatgcccctcctatcgaacgtacttgggagtcggccat

SEQ ID NO: 409100 - DNA, 140 bp, Artificial Sequence
  Synthetic
atggccgactcccaagtacgttcgataggaggggcatatattgctttcctgcctgccaccatctttataatttgttttattctgcattggagtgtgatgtttgtgtttgtgctattatttggagacccagcatggcgtat

SEQ ID NO: 409101 - DNA, 140 bp, Artificial Sequence
  Synthetic
atacgccatgctgggtctccagccctaaagtattggtggagcatcctgcaatattggagtcaggagctaaagaatagtgctgtcagcttattcaacgccacagctatagcagtagctgagcgtacttgggagtcggccat

SEQ ID NO: 409102 - DNA, 140 bp, Artificial Sequence
  Synthetic
atggccgactcccaagtacgctcagctactgctatagctgtggcgttgaataagctgacagcactattctttagctcctgactccaatattgcaggatgctccaccaatactttagggctggagacccagcatggcgtat

SEQ ID NO: 409103 - DNA, 140 bp, Artificial Sequence
  Synthetic
atacgccatgctgggtctcccaacatacctagaagaataagacagggcttggaaagggctttgcaataagatgggtggcaagtggtcaaaaagtagtcttggtgcatggcctagagtaagcgtacttgggagtcggccat

SEQ ID NO: 409104 - DNA, 140 bp, Artificial Sequence
  Synthetic
atggccgactcccaagtacgcttactctaggccatgcaccaagactactttttgaccacttgccacccatcttattgcaaagccctttccaagccctgtcttattcttctaggtatgttgggagacccagcatggcgtat

SEQ ID NO: 409105 - DNA, 140 bp, Artificial Sequence
  Synthetic
atacgccatgctgggtctccggaaagaatgagacgagctgagccagcagcggaaggggtgggaccagcatctcaagacctggcacaacgtggagcaatcacaactagcaatacaccagctcgtacttgggagtcggccat

SEQ ID NO: 409106 - DNA, 140 bp, Artificial Sequence
  Synthetic
atggccgactcccaagtacgagctggtgtattgctagttgtgattgctccacgttgtgccaggtcttgagatgctggtcccaccccttccgctgctggctcagctcgtctcattctttccggagacccagcatggcgtat

SEQ ID NO: 409107 - DNA, 140 bp, Artificial Sequence
  Synthetic
aggccctggctgctgatatgcagctcctaggaatttggggttgctctggaaaacacatttgcaccactaatgtgccctggaactctagttggagtaatagatctctaaatgagatttggcgaccttttgggacagcggtg

SEQ ID NO: 409108 - DNA, 140 bp, Artificial Sequence
  Synthetic
caccgctgtcccaaaaggtcgccaaatctcatttagagatctattactccaactagagttccagggcacattagtggtgcaaatgtgttttccagagcaaccccaaattcctaggagctgcatatcagcagccagggcct

SEQ ID NO: 409109 - DNA, 140 bp, Artificial Sequence
  Synthetic
aggccctggctgctgatatgagtttgttaatacccctcccctagtaaaattatggtaccagctggagaaagaacccatagcaggagcagaaactttctatgtagatggagcagctaataggaccttttgggacagcggtg

SEQ ID NO: 409110 - DNA, 140 bp, Artificial Sequence
  Synthetic
caccgctgtcccaaaaggtcctattagctgctccatctacatagaaagtttctgctcctgctatgggttctttctccagctggtaccataattttactaggggaggggtattaacaaactcatatcagcagccagggcct

SEQ ID NO: 409111 - DNA, 140 bp, Artificial Sequence
  Synthetic
aggccctggctgctgatatgatcagtacaatgtgcttccacagggatggaaaggatcaccagcaatattccaaagtagcatgacaaaaatcttagagccttttagaaaacaaaatccagagaccttttgggacagcggtg

SEQ ID NO: 409112 - DNA, 140 bp, Artificial Sequence
  Synthetic
caccgctgtcccaaaaggtctctggattttgttttctaaaaggctctaagatttttgtcatgctactttggaatattgctggtgatcctttccatccctgtggaagcacattgtactgatcatatcagcagccagggcct

SEQ ID NO: 409113 - DNA, 140 bp, Artificial Sequence
  Synthetic
aggccctggctgctgatatgcagcagcagccaggtcagccaaaattaccctatagtgcagaacctacaggggcaaatggtacatcaggccatatcacctagaactttaaatgcatgggtagaccttttgggacagcggtg

SEQ ID NO: 409114 - DNA, 140 bp, Artificial Sequence
  Synthetic
caccgctgtcccaaaaggtctacccatgcatttaaagttctaggtgatatggcctgatgtaccatttgcccctgtaggttctgcactatagggtaattttggctgacctggctgctgctgcatatcagcagccagggcct

SEQ ID NO: 409115 - DNA, 140 bp, Artificial Sequence
  Synthetic
atacgccatgctgggtctccaaatttttgactagcggaggctagaggagagagatgggtgcgcgagcgtcggttttaagcgggggagaattagataggtgggaaaaaattcgtttaaggccgtacttgggagtcggccat

SEQ ID NO: 409116 - DNA, 140 bp, Artificial Sequence
  Synthetic
atggccgactcccaagtacggccttaaacgaattttttcccacctatctaattctcccccgcttaaaaccgacgctcgcgcacccatctctctcctctagcctccgctagtcaaaaatttggagacccagcatggcgtat

SEQ ID NO: 409117 - DNA, 140 bp, Artificial Sequence
  Synthetic
aggccctggctgctgatatgggttttaagcgggggagaattagataggtgggaaaaaattcgtttaaggccgggagggaagaaaaaatataaacttaaacatatactatgggcaagcagggaccttttgggacagcggtg

SEQ ID NO: 409118 - DNA, 140 bp, Artificial Sequence
  Synthetic
caccgctgtcccaaaaggtccctgcttgcccatagtatatgtttaagtttatattttttcttccctcccggccttaaacgaattttttcccacctatctaattctcccccgcttaaaacccatatcagcagccagggcct

SEQ ID NO: 409119 - DNA, 140 bp, Artificial Sequence
  Synthetic
atacgccatgctgggtctcccgggagggaagaaaaaatataaacttaaacatatactatgggcaagcagggagctggaacgatttgcacttaatcctagccttctagagtacagcgaaggcgtacttgggagtcggccat

SEQ ID NO: 409120 - DNA, 140 bp, Artificial Sequence
  Synthetic
atggccgactcccaagtacgccttcgctgtactctagaaggctaggattaagtgcaaatcgttccagctccctgcttgcccatagtatatgtttaagtttatattttttcttccctcccgggagacccagcatggcgtat

SEQ ID NO: 409121 - DNA, 140 bp, Artificial Sequence
  Synthetic
atacgccatgctgggtctccaagaacttaaatcattatatattacagtagtaaccctctattgtgtacaagaaaggatagaggtaaaggacaccaaggaagctttcagaaagatggaggacgtacttgggagtcggccat

SEQ ID NO: 409122 - DNA, 140 bp, Artificial Sequence
  Synthetic
atggccgactcccaagtacgtcctccatctttctgaaagcttccttggtgtcctttacctctatcctttcttgtacacaatagagggttactactgtaatatataatgatttaagttcttggagacccagcatggcgtat

SEQ ID NO: 409123 - DNA, 140 bp, Artificial Sequence
  Synthetic
aggccctggctgctgatatggaaaggatagaggtaaaggacaccaaggaagctttcagaaagatggaggaagaacaaaacaaatgtaagaaaaagaaggcacagcaagcagcggctgacagaccttttgggacagcggtg

SEQ ID NO: 409124 - DNA, 140 bp, Artificial Sequence
  Synthetic
caccgctgtcccaaaaggtctgtcagccgctgcttgctgtgccttctttttcttacatttgttttgttcttcctccatctttctgaaagcttccttggtgtcctttacctctatcctttccatatcagcagccagggcct

SEQ ID NO: 409125 - DNA, 140 bp, Artificial Sequence
  Synthetic
atacgccatgctgggtctccaacagaagcgaagaaatgaaaaattgctcttttaactcaaccacagaactaagagataagaaaaggaaagaatatgcacttttttatagacttgatatagcgtacttgggagtcggccat

SEQ ID NO: 409126 - DNA, 140 bp, Artificial Sequence
  Synthetic
atggccgactcccaagtacgctatatcaagtctataaaaaagtgcatattctttccttttcttatctcttagttctgtggttgagttaaaagagcaatttttcatttcttcgcttctgttggagacccagcatggcgtat

SEQ ID NO: 409127 - DNA, 140 bp, Artificial Sequence
  Synthetic
atacgccatgctgggtctccgtacctgtatggaaagatgcgaagaccatcttattttgtgcatcagatactaaagcatatgaggtagaaatgcataatgtctgggctacacgtgcctgtgcgtacttgggagtcggccat

SEQ ID NO: 409128 - DNA, 140 bp, Artificial Sequence
  Synthetic
atggccgactcccaagtacgcacaggcacgtgtagcccagacattatgcatttctacctcatatgctttagtatctgatgcacaaaataagatggtcttcgcatctttccatacaggtacggagacccagcatggcgtat

SEQ ID NO: 409129 - DNA, 140 bp, Artificial Sequence
  Synthetic
atacgccatgctgggtctccactgtcaatggcacggatgaaatgaaaaactgctctttcaacatgaccacagagctaagggataagagaaagaaggaatattcacttttttatagacttgcgtacttgggagtcggccat

SEQ ID NO: 409130 - DNA, 140 bp, Artificial Sequence
  Synthetic
atggccgactcccaagtacgcaagtctataaaaaagtgaatattccttctttctcttatcccttagctctgtggtcatgttgaaagagcagtttttcatttcatccgtgccattgacagtggagacccagcatggcgtat

SEQ ID NO: 409131 - DNA, 140 bp, Artificial Sequence
  Synthetic
atacgccatgctgggtctccgtaaagtgtttcaactgtggcaagaaggcacatagcaaaaaattgcagggccccaaggaaaagggctgttggaaatgtggaagggaaggacaccaaatgacgtacttgggagtcggccat

SEQ ID NO: 409132 - DNA, 140 bp, Artificial Sequence
  Synthetic
atggccgactcccaagtacgtcatttggtgtccttcccttccacatttccaacagcccttttccttggggccctgcaattttttgctatgtgccttcttgccacagttgaaacactttacggagacccagcatggcgtat

SEQ ID NO: 409133 - DNA, 140 bp, Artificial Sequence
  Synthetic
atacgccatgctgggtctcctcagctgctgttaaatggcagcctagcagaaagagaagtaaaaattagatctcaaaatatcacaaacaatgccaaaaatataatagtacaacttgtcacgcgtacttgggagtcggccat

SEQ ID NO: 409134 - DNA, 140 bp, Artificial Sequence
  Synthetic
atggccgactcccaagtacgcgtgacaagttgtactattatatttttggcattgtttgtgatattttgagatctaatttttacttctctttctgctaggctgccatttaacagcagctgaggagacccagcatggcgtat

SEQ ID NO: 409135 - DNA, 140 bp, Artificial Sequence
  Synthetic
atacgccatgctgggtctccacatataggaccaggaaaagtattctatgcaagtgacataataggggatataagaaaagcacattgtattgtcaataggtcagaatggaataagacgttacgtacttgggagtcggccat

SEQ ID NO: 409136 - DNA, 140 bp, Artificial Sequence
  Synthetic
atggccgactcccaagtacgtaacgtcttattccattctgacctattgacaatacaatgtgcttttcttatatcccctattatgtcacttgcatagaatacttttcctggtcctatatgtggagacccagcatggcgtat

SEQ ID NO: 409137 - DNA, 140 bp, Artificial Sequence
  Synthetic
atacgccatgctgggtctcctcaaagtcagacagtatgatcaaatacccctacaaatctgtgggcataaagctaaaggtacagtactcgttggggctacgcctgtcaacataattggaagcgtacttgggagtcggccat

SEQ ID NO: 409138 - DNA, 140 bp, Artificial Sequence
  Synthetic
atggccgactcccaagtacgcttccaattatgttgacaggcgtagccccaacgagtactgtacctttagctttatgcccacagatttgtaggggtatttgatcatactgtctgactttgaggagacccagcatggcgtat

SEQ ID NO: 409139 - DNA, 140 bp, Artificial Sequence
  Synthetic
atacgccatgctgggtctccaaatgaaaccttcaggcctggaggaggagatatgagggacaattggagaagtgaattatataagtataaagtagtaagaattgaaccactaggagtagcacgtacttgggagtcggccat

SEQ ID NO: 409140 - DNA, 140 bp, Artificial Sequence
  Synthetic
atggccgactcccaagtacgtgctactcctagtggttcaattcttactactttatacttatataattcacttctccaattgtccctcatatctcctcctccaggcctgaaggtttcatttggagacccagcatggcgtat

SEQ ID NO: 409141 - DNA, 140 bp, Artificial Sequence
  Synthetic
atacgccatgctgggtctccggggagcaagtggtcaaaaggcagcatagttgggtggcctgaaataagagacagaatgagaagaactagaaatagaaatgatccagcagcagaaggagatcgtacttgggagtcggccat

SEQ ID NO: 409142 - DNA, 140 bp, Artificial Sequence
  Synthetic
atggccgactcccaagtacgatctccttctgctgctggatcatttctatttctagttcttctcattctgtctcttatttcaggccacccaactatgctgccttttgaccacttgctccccggagacccagcatggcgtat

SEQ ID NO: 409143 - DNA, 140 bp, Artificial Sequence
  Synthetic
aggccctggctgctgatatgacagaatgagaagaactagaaatagaaatgatccagcagcagaaggagatccagcagcagaaggagtaggagcagcatctcgagacttagagtgacatgggaccttttgggacagcggtg

SEQ ID NO: 409144 - DNA, 140 bp, Artificial Sequence
  Synthetic
caccgctgtcccaaaaggtcccatgtcactctaagtctcgagatgctgctcctactccttctgctgctggatctccttctgctgctggatcatttctatttctagttcttctcattctgtcatatcagcagccagggcct

SEQ ID NO: 409145 - DNA, 140 bp, Artificial Sequence
  Synthetic
atacgccatgctgggtctccttcagaagttagtagggaaattagtgggaagccagatttatcaggaattgaaagtaaagcaattatgtaaacccttaggggaacccaaagcactaacagacgtacttgggagtcggccat

SEQ ID NO: 409146 - DNA, 140 bp, Artificial Sequence
  Synthetic
atggccgactcccaagtacgtctgttagtgctttgggttcccctaagggtttacataattgctttactttcaattcctgataaatctggcttcccactaatttccctactaacttctgaaggagacccagcatggcgtat

SEQ ID NO: 409147 - DNA, 140 bp, Artificial Sequence
  Synthetic
atacgccatgctgggtctccagcatattgtaacattagtgttagtagttggaccaacactttagaacgggtaaaggaaaaattaaaagaacattacaatggaacaatacaatttcaaccacgtacttgggagtcggccat

SEQ ID NO: 409148 - DNA, 140 bp, Artificial Sequence
  Synthetic
atggccgactcccaagtacgtggttgaaattgtattgttccattgtaatgttcttttaatttttcctttacccgttctaaagtgttggtccaactactaacactaatgttacaatatgctggagacccagcatggcgtat

SEQ ID NO: 409149 - DNA, 140 bp, Artificial Sequence
  Synthetic
atacgccatgctgggtctcccgcgcaggaggagatctagaagttacagcacatagctttaattgtagaggagaatttttctattgcaacacaacacaactgtttaatactactactgatacgtacttgggagtcggccat

SEQ ID NO: 409150 - DNA, 140 bp, Artificial Sequence
  Synthetic
atggccgactcccaagtacgtatcagtagtagtattaaacagttgtgttgtgttgcaatagaaaaattctcctctacaattaaagctatgtgctgtaacttctagatctcctcctgcgcgggagacccagcatggcgtat

SEQ ID NO: 409151 - DNA, 140 bp, Artificial Sequence
  Synthetic
aggccctggctgctgatatggaaaagcacaatgtacaattgatggaggaaaatggaataaaactctaggccaggtagctaagaaattaataagcctctttgacaaaacaagcatagagttgaccttttgggacagcggtg

SEQ ID NO: 409152 - DNA, 140 bp, Artificial Sequence
  Synthetic
caccgctgtcccaaaaggtcaactctatgcttgttttgtcaaagaggcttattaatttcttagctacctggcctagagttttattccattttcctccatcaattgtacattgtgcttttccatatcagcagccagggcct

SEQ ID NO: 409153 - DNA, 140 bp, Artificial Sequence
  Synthetic
atacgccatgctgggtctcctaatgttaatgttaccaataacaatgatacactggaaaagccagacatgagaaattgctctttcaatgtaacaacagaaataagagataaacagcgcaaacgtacttgggagtcggccat

SEQ ID NO: 409154 - DNA, 140 bp, Artificial Sequence
  Synthetic
atggccgactcccaagtacgtttgcgctgtttatctcttatttctgttgttacattgaaagagcaatttctcatgtctggcttttccagtgtatcattgttattggtaacattaacattaggagacccagcatggcgtat

SEQ ID NO: 409155 - DNA, 140 bp, Artificial Sequence
  Synthetic
atacgccatgctgggtctcccagaagactgagttacatgcagttaatctacctttgcaggattcgggatttgaagttaacagcgtaccagattcacaatatgtatttggaatcattcaagcgtacttgggagtcggccat

SEQ ID NO: 409156 - DNA, 140 bp, Artificial Sequence
  Synthetic
atggccgactcccaagtacgcttgaatgattccaaatacatattgtgaatctggtacgctgttaacttcaaatcccgaatcctgcaaaggtagattaactgcatgtaactcagtcttctgggagacccagcatggcgtat

SEQ ID NO: 409157 - DNA, 140 bp, Artificial Sequence
  Synthetic
aggccctggctgctgatatggacgcaggactcggcttgctgaggtgcacacagcaagaggcgagagcggcgactggtgagtacgccaaaaaattttttgactagcggaggctagaaggaggaccttttgggacagcggtg

SEQ ID NO: 409158 - DNA, 140 bp, Artificial Sequence
  Synthetic
caccgctgtcccaaaaggtcctccttctagcctccgctagtcaaaaaattttttggcgtactcaccagtcgccgctctcgcctcttgctgtgtgcacctcagcaagccgagtcctgcgtccatatcagcagccagggcct

SEQ ID NO: 409159 - DNA, 140 bp, Artificial Sequence
  Synthetic
atacgccatgctgggtctccaagtactatttttggatggaatagacaaggctcaagaagaacatgtgaaatatcacaacaattggagagcaatggctagtgattttagcctaccacctgtcgtacttgggagtcggccat

SEQ ID NO: 409160 - DNA, 140 bp, Artificial Sequence
  Synthetic
atggccgactcccaagtacgacaggtggtaggctaaaatcactagccattgctctccaattgttgtgatatttcacatgttcttcttgagccttgtctattccatccaaaaatagtacttggagacccagcatggcgtat

SEQ ID NO: 409161 - DNA, 140 bp, Artificial Sequence
  Synthetic
aggccctggctgctgatatgcctatagtgcaaaatgcacaagggcagatgatacaccagtccatatcacctaggactttgaatgcatgggtaaaagtaatagaagaaaaggctttcagccgaccttttgggacagcggtg

SEQ ID NO: 409162 - DNA, 140 bp, Artificial Sequence
  Synthetic
caccgctgtcccaaaaggtcggctgaaagccttttcttctattacttttacccatgcattcaaagtcctaggtgatatggactggtgtatcatctgcccttgtgcattttgcactataggcatatcagcagccagggcct

SEQ ID NO: 409163 - DNA, 140 bp, Artificial Sequence
  Synthetic
aggccctggctgctgatatgattaggacatagagttatccataggtgtgaatatcaatcaggacataaaaaggtagggtcgctacagtacttggcactagcagcactaacaaaaccaaaagaccttttgggacagcggtg

SEQ ID NO: 409164 - DNA, 140 bp, Artificial Sequence
  Synthetic
caccgctgtcccaaaaggtcttttggttttgttagtgctgctagtgccaagtactgtagcgaccctacctttttatgtcctgattgatattcacacctatggataactctatgtcctaatcatatcagcagccagggcct

SEQ ID NO: 409165 - DNA, 140 bp, Artificial Sequence
  Synthetic
aggccctggctgctgatatgaagtacacaggacgaggattagcacatggaaaagtttagtaaaataccatatgtatgtttcaaaaaaggctaaaggatggttttatagacaccatggcaggaccttttgggacagcggtg

SEQ ID NO: 409166 - DNA, 140 bp, Artificial Sequence
  Synthetic
caccgctgtcccaaaaggtcctgccatggtgtctataaaaccatcctttagccttttttgaaacatacatatggtattttactaaacttttccatgtgctaatcctcgtcctgtgtacttcatatcagcagccagggcct

SEQ ID NO: 409167 - DNA, 140 bp, Artificial Sequence
  Synthetic
aggccctggctgctgatatgaaaaagagtgctattaatctgcttgataccttagcaatagcagtagctgaaggaacagataggattattgaagtaatacaaagaatttgtagagctatccgaccttttgggacagcggtg

SEQ ID NO: 409168 - DNA, 140 bp, Artificial Sequence
  Synthetic
caccgctgtcccaaaaggtcggatagctctacaaattctttgtattacttcaataatcctatctgttccttcagctactgctattgctaaggtatcaagcagattaatagcactctttttcatatcagcagccagggcct

SEQ ID NO: 409169 - DNA, 140 bp, Artificial Sequence
  Synthetic
aggccctggctgctgatatgaacacaaagaaaaatagatagattacttgatagaataagtgaaagagcagaagacagtggcaatgagagtgaaggggaccaggaggaattatcagcacttgaccttttgggacagcggtg

SEQ ID NO: 409170 - DNA, 140 bp, Artificial Sequence
  Synthetic
caccgctgtcccaaaaggtcaagtgctgataattcctcctggtccccttcactctcattgccactgtcttctgctctttcacttattctatcaagtaatctatctatttttctttgtgttcatatcagcagccagggcct

SEQ ID NO: 409171 - DNA, 140 bp, Artificial Sequence
  Synthetic
aggccctggctgctgatatggcactaatactactaatattaatggcactgataggggtatgataggagaaataaaaaactgctctttcaatatcaccacagcagtaagagatagggtgcagaccttttgggacagcggtg

SEQ ID NO: 409172 - DNA, 140 bp, Artificial Sequence
  Synthetic
caccgctgtcccaaaaggtctgcaccctatctcttactgctgtggtgatattgaaagagcagttttttatttctcctatcatacccctatcagtgccattaatattagtagtattagtgccatatcagcagccagggcct

SEQ ID NO: 409173 - DNA, 140 bp, Artificial Sequence
  Synthetic
aggccctggctgctgatatgccatagtattcatagaatataggagaataaaaaggcaaagaaaaatacactgtttacttgatagaattatagaagacagcaagaccagtggcaatgagaggaccttttgggacagcggtg

SEQ ID NO: 409174 - DNA, 140 bp, Artificial Sequence
  Synthetic
caccgctgtcccaaaaggtcctctcattgccactggtcttgctgtcttctataattctatcaagtaaacagtgtatttttctttgcctttttattctcctatattctatgaatactatggcatatcagcagccagggcct

SEQ ID NO: 409175 - DNA, 140 bp, Artificial Sequence
  Synthetic
aggccctggctgctgatatgcatggaattaggccagtagtatcaactcaactactgttaaatggcagtttagcagaagaggtagtagttagatctgaaaatttcacaaataatgccaaaagaccttttgggacagcggtg

SEQ ID NO: 409176 - DNA, 140 bp, Artificial Sequence
  Synthetic
caccgctgtcccaaaaggtcttttggcattatttgtgaaattttcagatctaactactacctcttctgctaaactgccatttaacagtagttgagttgatactactggcctaattccatgcatatcagcagccagggcct

SEQ ID NO: 409177 - DNA, 140 bp, Artificial Sequence
  Synthetic
atacgccatgctgggtctccatgctccttgggatgttgacgatctgtagcgctgcaagaaatttgtgggtcacagtttattatgggggtgcctgtattggactctctttttgtgatcagacgtacttgggagtcggccat

SEQ ID NO: 409178 - DNA, 140 bp, Artificial Sequence
  Synthetic
atggccgactcccaagtacgtctgatcacaaaaagagagtccaatacaggcacccccataataaactgtgacccacaaatttcttgcagcgctacagatcgtcaacatcccaaggagcatggagacccagcatggcgtat

SEQ ID NO: 409179 - DNA, 140 bp, Artificial Sequence
  Synthetic
aggccctggctgctgatatggagaaaataaaagcattaacagcaatttgtgaagaaatggagaaggaaggaaaaattacaaaaattgggcctgaaaatccatataacactccagtatttggaccttttgggacagcggtg

SEQ ID NO: 409180 - DNA, 140 bp, Artificial Sequence
  Synthetic
caccgctgtcccaaaaggtccaaatactggagtgttatatggattttcaggcccaatttttgtaatttttccttccttctccatttcttcacaaattgctgttaatgcttttattttctccatatcagcagccagggcct

SEQ ID NO: 409181 - DNA, 140 bp, Artificial Sequence
  Synthetic
atacgccatgctgggtctccaacaacaatacaagaaaaagtatacatataggaccagggagagcattttatgcacaagacataataggagatataagacaagcacattgtaacattagtacgtacttgggagtcggccat

SEQ ID NO: 409182 - DNA, 140 bp, Artificial Sequence
  Synthetic
atggccgactcccaagtacgtactaatgttacaatgtgcttgtcttatatctcctattatgtcttgtgcataaaatgctctccctggtcctatatgtatactttttcttgtattgttgttggagacccagcatggcgtat

SEQ ID NO: 409183 - DNA, 140 bp, Artificial Sequence
  Synthetic
atacgccatgctgggtctccaatcagtttatgggatcaaagccctaaagccatgtgtaaaattaaccccactctgtgtcactttaaactgcagtaataatattaccaccttaaacagcaccgtacttgggagtcggccat

SEQ ID NO: 409184 - DNA, 140 bp, Artificial Sequence
  Synthetic
atggccgactcccaagtacggtgctgtttaaggtggtaatattattactgcagtttaaagtgacacagagtggggttaattttacacatggctttagggctttgatcccataaactgattggagacccagcatggcgtat

SEQ ID NO: 409185 - DNA, 140 bp, Artificial Sequence
  Synthetic
aggccctggctgctgatatgtcccttcagacaggatcggaagagcttagatcattatataatacaatagcagtcctctattatgtacatcaaaaggtagaggtaaaagacaccaaggaaggaccttttgggacagcggtg

SEQ ID NO: 409186 - DNA, 140 bp, Artificial Sequence
  Synthetic
caccgctgtcccaaaaggtccttccttggtgtcttttacctctaccttttgatgtacataatagaggactgctattgtattatataatgatctaagctcttccgatcctgtctgaagggacatatcagcagccagggcct

SEQ ID NO: 409187 - DNA, 140 bp, Artificial Sequence
  Synthetic
aggccctggctgctgatatgccataaagaaaaaagacagtactaaatggagaaaattagtagatttcagagaacttaataaaagaactcaagacttctgggaagttcaattaggaataccgaccttttgggacagcggtg

SEQ ID NO: 409188 - DNA, 140 bp, Artificial Sequence
  Synthetic
caccgctgtcccaaaaggtcggtattcctaattgaacttcccagaagtcttgagttcttttattaagttctctgaaatctactaattttctccatttagtactgtcttttttctttatggcatatcagcagccagggcct

SEQ ID NO: 409189 - DNA, 140 bp, Artificial Sequence
  Synthetic
atacgccatgctgggtctccatataagacaaaaaacgtcaataggacaagggcaaacattacatacaagcaagaggataataggagacataagacaagcacattgtaacattagtggaagcgtacttgggagtcggccat

SEQ ID NO: 409190 - DNA, 140 bp, Artificial Sequence
  Synthetic
atggccgactcccaagtacgcttccactaatgttacaatgtgcttgtcttatgtctcctattatcctcttgcttgtatgtaatgtttgcccttgtcctattgacgttttttgtcttatatggagacccagcatggcgtat

SEQ ID NO: 409191 - DNA, 140 bp, Artificial Sequence
  Synthetic
atacgccatgctgggtctccactgctgtgccttggaatgctagctggagtaataaatcttatgagcagatatggaataacatgacatggatggagtgggaaagggaaattgacaattacacgtacttgggagtcggccat

SEQ ID NO: 409192 - DNA, 140 bp, Artificial Sequence
  Synthetic
atggccgactcccaagtacgtgtaattgtcaatttccctttcccactccatccatgtcatgttattccatatctgctcataagatttattactccagctagcattccaaggcacagcagtggagacccagcatggcgtat

SEQ ID NO: 409193 - DNA, 140 bp, Artificial Sequence
  Synthetic
aggccctggctgctgatatgagggacaattggagaagtgaattatataaatacaaagtagtacaaattgaaccaataggagtagtgcccaccagggcaaagagaagagtggtggaaaggggaccttttgggacagcggtg

SEQ ID NO: 409194 - DNA, 140 bp, Artificial Sequence
  Synthetic
caccgctgtcccaaaaggtcccctttccaccactcttctctttgccctggtgggcactactcctattggttcaatttgtactactttgtatttatataattcacttctccaattgtccctcatatcagcagccagggcct

SEQ ID NO: 409195 - DNA, 140 bp, Artificial Sequence
  Synthetic
aggccctggctgctgatatgggaactctagttggagtaataaatcaagatgcgatttgcataccatgacctggatgcggggaaagaaaattcacaattacacggactattatacagcttagaccttttgggacagcggtg

SEQ ID NO: 409196 - DNA, 140 bp, Artificial Sequence
  Synthetic
caccgctgtcccaaaaggtctaagctgtataatagtccgtgtaattgtgaattttctttccccgcatccaggtcatggtatgcaaatcgcatcttgatttattactccaactagagttcccatatcagcagccagggcct

SEQ ID NO: 409197 - DNA, 140 bp, Artificial Sequence
  Synthetic
aggccctggctgctgatatgcgcagagggaaccatacaatgaatggacactagagcttctagaggaactcaagcaggaagctgtcagacactttcctagaccatggcttcatggcttagggaccttttgggacagcggtg

SEQ ID NO: 409198 - DNA, 140 bp, Artificial Sequence
  Synthetic
caccgctgtcccaaaaggtccctaagccatgaagccatggtctaggaaagtgtctgacagcttcctgcttgagttcctctagaagctctagtgtccattcattgtatggttccctctgcgcatatcagcagccagggcct

SEQ ID NO: 409199 - DNA, 140 bp, Artificial Sequence
  Synthetic
atacgccatgctgggtctccagctaatagggaaactaaattaggaaaagcaggatatgttactgacagaggaagacaaaaagttgtccccctaactgatacaacaaatcagaagactgagcgtacttgggagtcggccat

SEQ ID NO: 409200 - DNA, 140 bp, Artificial Sequence
  Synthetic
atggccgactcccaagtacgctcagtcttctgatttgttgtatcagttagggggacaactttttgtcttcctctgtcagtaacatatcctgcttttcctaatttagtttccctattagctggagacccagcatggcgtat

SEQ ID NO: 409201 - DNA, 140 bp, Artificial Sequence
  Synthetic
aggccctggctgctgatatgtaataagaatactgcaacaactactgtttattcatttcagaattgggtgccagcatagcagaataggcattgtgagacagagaagagcaagaaatggagcgaccttttgggacagcggtg

SEQ ID NO: 409202 - DNA, 140 bp, Artificial Sequence
  Synthetic
caccgctgtcccaaaaggtcgctccatttcttgctcttctctgtctcacaatgcctattctgctatgctggcacccaattctgaaatgaataaacagtagttgttgcagtattcttattacatatcagcagccagggcct

SEQ ID NO: 409203 - DNA, 140 bp, Artificial Sequence
  Synthetic
aggccctggctgctgatatgcagcatagcagaataggcattgtgagacagagaagagcaagaaatggagccagtagatcctaacctagagccctggaaccatccaggaagtcagcctaaagaccttttgggacagcggtg

SEQ ID NO: 409204 - DNA, 140 bp, Artificial Sequence
  Synthetic
caccgctgtcccaaaaggtctttaggctgacttcctggatggttccagggctctaggttaggatctactggctccatttcttgctcttctctgtctcacaatgcctattctgctatgctgcatatcagcagccagggcct

SEQ ID NO: 409205 - DNA, 140 bp, Artificial Sequence
  Synthetic
aggccctggctgctgatatgctcgacgcaggactcggcttgctgaagcgcgcacggcaagaggcgaggggcggcgactggtgagtacgccgaaaatttttgactagcggaggctagaagggaccttttgggacagcggtg

SEQ ID NO: 409206 - DNA, 140 bp, Artificial Sequence
  Synthetic
caccgctgtcccaaaaggtcccttctagcctccgctagtcaaaaattttcggcgtactcaccagtcgccgcccctcgcctcttgccgtgcgcgcttcagcaagccgagtcctgcgtcgagcatatcagcagccagggcct

SEQ ID NO: 409207 - DNA, 140 bp, Artificial Sequence
  Synthetic
aggccctggctgctgatatgaggattgtggaccttctgggacgcagggggtgggaatcaagtatctgtggatcctcctgcagtattggagtcaggaatgacgaaatagagctattaacttgaccttttgggacagcggtg

SEQ ID NO: 409208 - DNA, 140 bp, Artificial Sequence
  Synthetic
caccgctgtcccaaaaggtcaagttaatagctctatttcgtcattcctgactccaatactgcaggaggatccacagatacttgattcccaccccctgcgtcccagaaggtccacaatcctcatatcagcagccagggcct

SEQ ID NO: 409209 - DNA, 140 bp, Artificial Sequence
  Synthetic
atacgccatgctgggtctcccagaattaagagataagaagcagaaagtgtatgcacttttttataaacttgatatagtaccacttgagaataaaaattctagtgagaactttagtgattacgtacttgggagtcggccat

SEQ ID NO: 409210 - DNA, 140 bp, Artificial Sequence
  Synthetic
atggccgactcccaagtacgtaatcactaaagttctcactagaatttttattctcaagtggtactatatcaagtttataaaaaagtgcatacactttctgcttcttatctcttaattctgggagacccagcatggcgtat

SEQ ID NO: 409211 - DNA, 140 bp, Artificial Sequence
  Synthetic
aggccctggctgctgatatggatcctaacctagagccctggaaccatccgggaagtcagcctacaactccttgtaacaagtgttactgtaaaaagtgttgctatcattgcctagtttgctgaccttttgggacagcggtg

SEQ ID NO: 409212 - DNA, 140 bp, Artificial Sequence
  Synthetic
caccgctgtcccaaaaggtcagcaaactaggcaatgatagcaacactttttacagtaacacttgttacaaggagttgtaggctgacttcccggatggttccagggctctaggttaggatccatatcagcagccagggcct

SEQ ID NO: 409213 - DNA, 140 bp, Artificial Sequence
  Synthetic
atacgccatgctgggtctccggtaagtgaaaaattacaagaacacttccctgagaaagcaatatactttgcaccagcctcaggaggagatctagaaattacaacacatagctttaactgtcgtacttgggagtcggccat

SEQ ID NO: 409214 - DNA, 140 bp, Artificial Sequence
  Synthetic
atggccgactcccaagtacgacagttaaagctatgtgttgtaatttctagatctcctcctgaggctggtgcaaagtatattgctttctcagggaagtgttcttgtaatttttcacttaccggagacccagcatggcgtat

SEQ ID NO: 409215 - DNA, 140 bp, Artificial Sequence
  Synthetic
atacgccatgctgggtctccgcagcagtgacatcagcataaatgccaccagcatgaatgtggatgaaataaaaaactgctcttacaatataaccacagaactaagggataagaaaaagaacgtacttgggagtcggccat

SEQ ID NO: 409216 - DNA, 140 bp, Artificial Sequence
  Synthetic
atggccgactcccaagtacgttctttttcttatcccttagttctgtggttatattgtaagagcagttttttatttcatccacattcatgctggtggcatttatgctgatgtcactgctgcggagacccagcatggcgtat

SEQ ID NO: 409217 - DNA, 140 bp, Artificial Sequence
  Synthetic
aggccctggctgctgatatgtcttaaaagcattaggaccacaggctacactagaagaaatgatgacagcatgtcagggagtgggggggcccggccataaagcaagagttttggctgaggcgaccttttgggacagcggtg

SEQ ID NO: 409218 - DNA, 140 bp, Artificial Sequence
  Synthetic
caccgctgtcccaaaaggtcgcctcagccaaaactcttgctttatggccgggcccccccactccctgacatgctgtcatcatttcttctagtgtagcctgtggtcctaatgcttttaagacatatcagcagccagggcct

SEQ ID NO: 409219 - DNA, 140 bp, Artificial Sequence
  Synthetic
atacgccatgctgggtctccaaaactgctctttcaatatcaccacaaacataagagataggatgcagagagaatatgcacttttttataaacttgatgtagaaccaatagataaaagtaacgtacttgggagtcggccat

SEQ ID NO: 409220 - DNA, 140 bp, Artificial Sequence
  Synthetic
atggccgactcccaagtacgttacttttatctattggttctacatcaagtttataaaaaagtgcatattctctctgcatcctatctcttatgtttgtggtgatattgaaagagcagttttggagacccagcatggcgtat

SEQ ID NO: 409221 - DNA, 140 bp, Artificial Sequence
  Synthetic
aggccctggctgctgatatgaggggacagatagggttatagaagtagtacaaagagcttatagagctattctccacatacctacaagaataagacagggcttagaaagggctttgctatagaccttttgggacagcggtg

SEQ ID NO: 409222 - DNA, 140 bp, Artificial Sequence
  Synthetic
caccgctgtcccaaaaggtctatagcaaagccctttctaagccctgtcttattcttgtaggtatgtggagaatagctctataagctctttgtactacttctataaccctatctgtcccctcatatcagcagccagggcct

SEQ ID NO: 409223 - DNA, 140 bp, Artificial Sequence
  Synthetic
atacgccatgctgggtctccataaaacaatagtctttaatcaatcctcaggaggggacccagaaattgtaaggcaccagtttatttgtggaggggagtttttctactgtgattcagtaaacgtacttgggagtcggccat

SEQ ID NO: 409224 - DNA, 140 bp, Artificial Sequence
  Synthetic
atggccgactcccaagtacgtttactgaatcacagtagaaaaactcccctccacaaataaactggtgccttacaatttctgggtcccctcctgaggattgattaaagactattgttttatggagacccagcatggcgtat

SEQ ID NO: 409225 - DNA, 140 bp, Artificial Sequence
  Synthetic
atacgccatgctgggtctccctacattaattctacctacactaatagcacggtgagaatgggggaagaaataaaaaattgctctttcaatacaaccacaggactaagagataagaaacaacgtacttgggagtcggccat

SEQ ID NO: 409226 - DNA, 140 bp, Artificial Sequence
  Synthetic
atggccgactcccaagtacgttgtttcttatctcttagtcctgtggttgtattgaaagagcaattttttatttcttcccccattctcaccgtgctattagtgtaggtagaattaatgtagggagacccagcatggcgtat

SEQ ID NO: 409227 - DNA, 140 bp, Artificial Sequence
  Synthetic
atacgccatgctgggtctccatgggtgcgagagcgtccgtattaagcgggggagaattagataggtgggaaaaaatcggcttaggcccgggagtaagaaaaaataccagattaaaacatacgtacttgggagtcggccat

SEQ ID NO: 409228 - DNA, 140 bp, Artificial Sequence
  Synthetic
atggccgactcccaagtacgtatgttttaatctggtattttttcttactcccgggcctaagccgattttttcccacctatctaattctcccccgcttaatacggacgctctcgcacccatggagacccagcatggcgtat

SEQ ID NO: 409229 - DNA, 140 bp, Artificial Sequence
  Synthetic
atacgccatgctgggtctcccccatgcaaaataaggcaaattgtaaacatgtggcaaggagtaggaaaagcaatgtatgcccctcccatcgaaggacacatcaactgttcatcaaatattcgtacttgggagtcggccat

SEQ ID NO: 409230 - DNA, 140 bp, Artificial Sequence
  Synthetic
atggccgactcccaagtacgaatatttgatgaacagttgatgtgtccttcgatgggaggggcatacattgcttttcctactccttgccacatgtttacaatttgccttattttgcatgggggagacccagcatggcgtat

SEQ ID NO: 409231 - DNA, 140 bp, Artificial Sequence
  Synthetic
aggccctggctgctgatatgcaagacttattggcattggacaagtgggcaagtctgtggaattggtttgacatatcaagctggctgtggtatataaaaatatttataatgatagtaggaggaccttttgggacagcggtg

SEQ ID NO: 409232 - DNA, 140 bp, Artificial Sequence
  Synthetic
caccgctgtcccaaaaggtcctcctactatcattataaatatttttatataccacagccagcttgatatgtcaaaccaattccacagacttgcccacttgtccaatgccaataagtcttgcatatcagcagccagggcct

SEQ ID NO: 409233 - DNA, 140 bp, Artificial Sequence
  Synthetic
aggccctggctgctgatatgcaaacgttctatgcaacaggagacataataggagacataagaaaagcacattgtaatattaatagaacagaatggaaggcaactttaacaaaggtagtaagaccttttgggacagcggtg

SEQ ID NO: 409234 - DNA, 140 bp, Artificial Sequence
  Synthetic
caccgctgtcccaaaaggtcttactacctttgttaaagttgccttccattctgttctattaatattacaatgtgcttttcttatgtctcctattatgtctcctgttgcatagaacgtttgcatatcagcagccagggcct

SEQ ID NO: 409235 - DNA, 140 bp, Artificial Sequence
  Synthetic
atacgccatgctgggtctcctactcaggaggggacctagaaattacaacacacagctttaattgtagaggagaatttttctattgcaatacaacaaatctgttcaatacaacagatctgtcgtacttgggagtcggccat

SEQ ID NO: 409236 - DNA, 140 bp, Artificial Sequence
  Synthetic
atggccgactcccaagtacgacagatctgttgtattgaacagatttgttgtattgcaatagaaaaattctcctctacaattaaagctgtgtgttgtaatttctaggtcccctcctgagtaggagacccagcatggcgtat

SEQ ID NO: 409237 - DNA, 140 bp, Artificial Sequence
  Synthetic
aggccctggctgctgatatgtagtgggatggcctcaggttagggaaagaataagacaaactcctccaacaccaaaaggagtaggagcagtatctcaagatttaaaaaataatgaagcagcgaccttttgggacagcggtg

SEQ ID NO: 409238 - DNA, 140 bp, Artificial Sequence
  Synthetic
caccgctgtcccaaaaggtcgctgcttcattattttttaaatcttgagatactgctcctactccttttggtgttggaggagtttgtcttattctttccctaacctgaggccatcccactacatatcagcagccagggcct

SEQ ID NO: 409239 - DNA, 140 bp, Artificial Sequence
  Synthetic
aggccctggctgctgatatggagaaaattcggttaaggccggggggaaaaaaaaaatataaaatgaaacatataatatgggcaagcagggagctagaacaatttgcacttaaacctggccgaccttttgggacagcggtg

SEQ ID NO: 409240 - DNA, 140 bp, Artificial Sequence
  Synthetic
caccgctgtcccaaaaggtcggccaggtttaagtgcaaattgttctagctccctgcttgcccatattatatgtttcattttatattttttttttccccccggccttaaccgaattttctccatatcagcagccagggcct

SEQ ID NO: 409241 - DNA, 140 bp, Artificial Sequence
  Synthetic
aggccctggctgctgatatggggtacctgtgtggagagatgcagagaccaccctattttgtgcatcagatgctaaagcatatgatacagaagtgcataatgtctgggctacacatgcctggaccttttgggacagcggtg

SEQ ID NO: 409242 - DNA, 140 bp, Artificial Sequence
  Synthetic
caccgctgtcccaaaaggtccaggcatgtgtagcccagacattatgcacttctgtatcatatgctttagcatctgatgcacaaaatagggtggtctctgcatctctccacacaggtaccccatatcagcagccagggcct

SEQ ID NO: 409243 - DNA, 140 bp, Artificial Sequence
  Synthetic
atacgccatgctgggtctccccacatacctagaagattaaggcagggcttggaaagagttttgctataagatgggtggcaagtggtcaaaaagtagtatgtttggatggtctactgtaagcgtacttgggagtcggccat

SEQ ID NO: 409244 - DNA, 140 bp, Artificial Sequence
  Synthetic
atggccgactcccaagtacgcttacagtagaccatccaaacatactactttttgaccacttgccacccatcttatagcaaaactctttccaagccctgccttaatcttctaggtatgtggggagacccagcatggcgtat

SEQ ID NO: 409245 - DNA, 140 bp, Artificial Sequence
  Synthetic
aggccctggctgctgatatgtaacagaaaattttaacatgtggaaaaataacatggtagaacagatgcatgaggatataatcagtttatgggatgaaagcctaaagccatgtgtaaagctgaccttttgggacagcggtg

SEQ ID NO: 409246 - DNA, 140 bp, Artificial Sequence
  Synthetic
caccgctgtcccaaaaggtcagctttacacatggctttaggctttcatcccataaactgattatatcctcatgcatctgttctaccatgttatttttccacatgttaaaattttctgttacatatcagcagccagggcct

SEQ ID NO: 409247 - DNA, 140 bp, Artificial Sequence
  Synthetic
atacgccatgctgggtctccgattatggaaaacagatggcaggtgttgtttgtgtggcaagtatacaggatggggattaacacatggaaaagccttgtaaaaaaataccatatgcatgttcgtacttgggagtcggccat

SEQ ID NO: 409248 - DNA, 140 bp, Artificial Sequence
  Synthetic
atggccgactcccaagtacgaacatgcatatggtatttttttacaaggcttttccatgtgttaatccccatcctgtatacttgccacacaaacaacacctgccatctgttttccataatcggagacccagcatggcgtat

SEQ ID NO: 409249 - DNA, 140 bp, Artificial Sequence
  Synthetic
aggccctggctgctgatatgaaactcatctgcaccactaatgtgccttggaactccagttggagtaatagatccgctgacatatgggataacttgacatggatgcagtgggagaaagaaagaccttttgggacagcggtg

SEQ ID NO: 409250 - DNA, 140 bp, Artificial Sequence
  Synthetic
caccgctgtcccaaaaggtctttctttctcccactgcatccatgtcaagttatcccatatgtcagcggatctattactccaactggagttccaaggcacattagtggtgcagatgagtttcatatcagcagccagggcct

SEQ ID NO: 409251 - DNA, 140 bp, Artificial Sequence
  Synthetic
aggccctggctgctgatatgagtatacgtataggaccaggacaagcattctatgcaacaggtgacataataggggatataagacaagcatattgtaatgtcagtaaatcagaatggaatagaccttttgggacagcggtg

SEQ ID NO: 409252 - DNA, 140 bp, Artificial Sequence
  Synthetic
caccgctgtcccaaaaggtctattccattctgatttactgacattacaatatgcttgtcttatatcccctattatgtcacctgttgcatagaatgcttgtcctggtcctatacgtatactcatatcagcagccagggcct

SEQ ID NO: 409253 - DNA, 140 bp, Artificial Sequence
  Synthetic
aggccctggctgctgatatggtttttcagactctgctataagaaaagccatattaggacatatagttagacctaggtgtgaatatcaagcaggacataaccaggtaggatccttacagtagaccttttgggacagcggtg

SEQ ID NO: 409254 - DNA, 140 bp, Artificial Sequence
  Synthetic
caccgctgtcccaaaaggtctactgtaaggatcctacctggttatgtcctgcttgatattcacacctaggtctaactatatgtcctaatatggcttttcttatagcagagtctgaaaaaccatatcagcagccagggcct

SEQ ID NO: 409255 - DNA, 140 bp, Artificial Sequence
  Synthetic
aggccctggctgctgatatgaagggccacagaggaagccacacaacgaatggacattagaacttttggaagagcttcagaaggaagctgttacacactttccaagcatatggctcctcaggaccttttgggacagcggtg

SEQ ID NO: 409256 - DNA, 140 bp, Artificial Sequence
  Synthetic
caccgctgtcccaaaaggtcctgaggagccatatgcttggaaagtgtgtaacagcttccttctgaagctcttccaaaagttctaatgtccattcgttgtgtggcttcctctgtggcccttcatatcagcagccagggcct

SEQ ID NO: 409257 - DNA, 140 bp, Artificial Sequence
  Synthetic
atacgccatgctgggtctccaatgctgattgtgcctggctgcaagcacaagaggaggacgaggaagtaggctttccagtcagacctcaggtgccttaagaccaatgacttttaaagaagccgtacttgggagtcggccat

SEQ ID NO: 409258 - DNA, 140 bp, Artificial Sequence
  Synthetic
atggccgactcccaagtacggcttctttaaaagtcattggtcttaaggcacctgaggtctgactggaaagcctacttcctcgtcctcctcttgtgcttgcagccaggcacaatcagcattggagacccagcatggcgtat

SEQ ID NO: 409259 - DNA, 140 bp, Artificial Sequence
  Synthetic
aggccctggctgctgatatggacagcgacgaagatctcctcaaggcgatcaggctcatcaagttcctataccagagcagtaagtagttcatgaaatgcaacctttacagatattatcaatgaccttttgggacagcggtg

SEQ ID NO: 409260 - DNA, 140 bp, Artificial Sequence
  Synthetic
caccgctgtcccaaaaggtcattgataatatctgtaaaggttgcatttcatgaactacttactgctctggtataggaacttgatgagcctgatcgccttgaggagatcttcgtcgctgtccatatcagcagccagggcct

SEQ ID NO: 409261 - DNA, 140 bp, Artificial Sequence
  Synthetic
atacgccatgctgggtctccgcctgtgtacccacggaccccagcccacaagaaatagaactggtaaatgtgaccgaaaactttaacatgtggaaaaataacatggtagaccagatgcatgcgtacttgggagtcggccat

SEQ ID NO: 409262 - DNA, 140 bp, Artificial Sequence
  Synthetic
atggccgactcccaagtacgcatgcatctggtctaccatgttatttttccacatgttaaagttttcggtcacatttaccagttctatttcttgtgggctggggtccgtgggtacacaggcggagacccagcatggcgtat

SEQ ID NO: 409263 - DNA, 140 bp, Artificial Sequence
  Synthetic
atacgccatgctgggtctcctgggagcaacgccctatgggagccaacaaaggaggtgaaaaactgctctttcaatgtaactacagtagtaagagataagaaaaagcaagtatatgcgcttcgtacttgggagtcggccat

SEQ ID NO: 409264 - DNA, 140 bp, Artificial Sequence
  Synthetic
atggccgactcccaagtacgaagcgcatatacttgctttttcttatctcttactactgtagttacattgaaagagcagtttttcacctcctttgttggctcccatagggcgttgctcccaggagacccagcatggcgtat

SEQ ID NO: 409265 - DNA, 140 bp, Artificial Sequence
  Synthetic
aggccctggctgctgatatgtagaagaatcaggcagggcttcgaaagggctttactataacatgggtaacaagtggtcaaaaagttgcatagtgggatggcctgaggttagggaaagaatgaccttttgggacagcggtg

SEQ ID NO: 409266 - DNA, 140 bp, Artificial Sequence
  Synthetic
caccgctgtcccaaaaggtcattctttccctaacctcaggccatcccactatgcaactttttgaccacttgttacccatgttatagtaaagccctttcgaagccctgcctgattcttctacatatcagcagccagggcct

SEQ ID NO: 409267 - DNA, 140 bp, Artificial Sequence
  Synthetic
atacgccatgctgggtctccatctgttaaaattaattgtacaaggccctacgaaattagaatacaaaagacatcaataggacaagggcaagcactcaatacaaacaagaggattatacgacgtacttgggagtcggccat

SEQ ID NO: 409268 - DNA, 140 bp, Artificial Sequence
  Synthetic
atggccgactcccaagtacgtcgtataatcctcttgtttgtattgagtgcttgcccttgtcctattgatgtcttttgtattctaatttcgtagggccttgtacaattaattttaacagatggagacccagcatggcgtat

SEQ ID NO: 409269 - DNA, 140 bp, Artificial Sequence
  Synthetic
  misc_feature (94)..(94): n is a, c, g, or t
atacgccatgctgggtctcctttacctgtcatgggtaccagcacataaaaggattagaagaaatgaacaggtagataaattagtcagtgctagnatcagaaaaatactgtttttagataacgtacttgggagtcggccat

SEQ ID NO: 409270 - DNA, 140 bp, Artificial Sequence
  Synthetic
  misc_feature (47)..(47): n is a, c, g, or t
atggccgactcccaagtacgttatctaaaaacagtatttttctgatnctagcactgactaatttatctacctgttcatttcttctaatccttttatgtgctggtacccatgacaggtaaaggagacccagcatggcgtat

SEQ ID NO: 409271 - DNA, 140 bp, Artificial Sequence
  Synthetic
atacgccatgctgggtctccaagtaatacccatgttctcagcattatcagaaggagccaccccacaagatttaaatatgatgctaaacatagtggggggacaccaggcagctatgcaaatcgtacttgggagtcggccat

SEQ ID NO: 409272 - DNA, 140 bp, Artificial Sequence
  Synthetic
atggccgactcccaagtacgatttgcatagctgcctggtgtccccccactatgtttagcatcatatttaaatcttgtggggtggctccttctgataatgctgagaacatgggtattacttggagacccagcatggcgtat

SEQ ID NO: 409273 - DNA, 140 bp, Artificial Sequence
  Synthetic
atacgccatgctgggtctccatgcctttggggttgctctggaaaacacatttgcaccactactgtgccctggaactctagttggagtaataaaactcaaactgagatttggcagaacattcgtacttgggagtcggccat

SEQ ID NO: 409274 - DNA, 140 bp, Artificial Sequence
  Synthetic
atggccgactcccaagtacgaatgttctgccaaatctcagtttgagttttattactccaactagagttccagggcacagtagtggtgcaaatgtgttttccagagcaaccccaaaggcatggagacccagcatggcgtat

SEQ ID NO: 409275 - DNA, 140 bp, Artificial Sequence
  Synthetic
aggccctggctgctgatatgagctggctgtggtatagaaaaatattcattatgctactacgaggtttgctacgttttagaatattttttgctgtgctttctgtattatacagagttaggcgaccttttgggacagcggtg

SEQ ID NO: 409276 - DNA, 140 bp, Artificial Sequence
  Synthetic
caccgctgtcccaaaaggtcgcctaactctgtataatacagaaagcacagcaaaaaatattctaaaacgtagcaaacctcgtagtagcataatgaatatttttctataccacagccagctcatatcagcagccagggcct

SEQ ID NO: 409277 - DNA, 140 bp, Artificial Sequence
  Synthetic
  misc_feature (47)..(47): n is a, c, g, or t
aggccctggctgctgatatgacagcattaatagctccaaagaagacnaagccgcctttgcctagtgtccagaaactagtagaagacagatgggacaagccccaggagaccaggggccacagaccttttgggacagcggtg

SEQ ID NO: 409278 - DNA, 140 bp, Artificial Sequence
  Synthetic
  misc_feature (94)..(94): n is a, c, g, or t
caccgctgtcccaaaaggtctgtggcccctggtctcctggggcttgtcccatctgtcttctactagtttctggacactaggcaaaggcggcttngtcttctttggagctattaatgctgtcatatcagcagccagggcct

SEQ ID NO: 409279 - DNA, 140 bp, Artificial Sequence
  Synthetic
atacgccatgctgggtctccagaagaagtgtagcaattggaccaggacaagcattctatacaacaggagaagtaataggagacataagaaaggcacattgtaatgttagttggacaaaatcgtacttgggagtcggccat

SEQ ID NO: 409280 - DNA, 140 bp, Artificial Sequence
  Synthetic
atggccgactcccaagtacgattttgtccaactaacattacaatgtgcctttcttatgtctcctattacttctcctgttgtatagaatgcttgtcctggtccaattgctacacttcttctggagacccagcatggcgtat

SEQ ID NO: 409281 - DNA, 140 bp, Artificial Sequence
  Synthetic
aggccctggctgctgatatggcgacaaagaactcctcaaagcagtcaaaagcatcaaaattctctatcaaagcagtaagtagttcatgtaatgcaatctttagaaatattaacaatagtagaccttttgggacagcggtg

SEQ ID NO: 409282 - DNA, 140 bp, Artificial Sequence
  Synthetic
caccgctgtcccaaaaggtctactattgttaatatttctaaagattgcattacatgaactacttactgctttgatagagaattttgatgcttttgactgctttgaggagttctttgtcgccatatcagcagccagggcct

SEQ ID NO: 409283 - DNA, 140 bp, Artificial Sequence
  Synthetic
  misc_feature (56)..(56): n is a, c, g, or t
  misc_feature (64)..(64): n is a, c, g, or t
  misc_feature (77)..(77): n is a, c, g, or t
  misc_feature (80)..(80): n is a, c, g, or t
  misc_feature (90)..(90): n is a, c, g, or t
atacgccatgctgggtctcccatagaatataagaaaataaaaagacaaaaaaaaanaaataggntaataaaaaaaanaanaaaaaaagcngaaaacagtggcaatgagagtgcagaggaacgtacttgggagtcggccat

SEQ ID NO: 409284 - DNA, 140 bp, Artificial Sequence
  Synthetic
  misc_feature (51)..(51): n is a, c, g, or t
  misc_feature (61)..(61): n is a, c, g, or t
  misc_feature (64)..(64): n is a, c, g, or t
  misc_feature (77)..(77): n is a, c, g, or t
  misc_feature (85)..(85): n is a, c, g, or t
atggccgactcccaagtacgttcctctgcactctcattgccactgttttcngctttttttnttnttttttttattancctatttntttttttttgtctttttattttcttatattctatgggagacccagcatggcgtat

SEQ ID NO: 409285 - DNA, 140 bp, Artificial Sequence
  Synthetic
  misc_feature (70)..(70): n is a, c, g, or t
atacgccatgctgggtctccttcagaacagaccagaaccatcagccccaccagcgccatcagccccaccngcagagagcttcaggtttggggaggagacagcagctccctctcagaagcacgtacttgggagtcggccat

SEQ ID NO: 409286 - DNA, 140 bp, Artificial Sequence
  Synthetic
  misc_feature (71)..(71): n is a, c, g, or t
atggccgactcccaagtacgtgcttctgagagggagctgctgtctcctccccaaacctgaagctctctgcnggtggggctgatggcgctggtggggctgatggttctggtctgttctgaaggagacccagcatggcgtat

SEQ ID NO: 409287 - DNA, 140 bp, Artificial Sequence
  Synthetic
  misc_feature (119)..(119): n is a, c, g, or t
atacgccatgctgggtctccagcactcaaaacagcaccctggaaggagggacaatgcaaaactgttctttcagtatgaccacagtattaagagataaacagaagaaagtatatgcgctntcgtacttgggagtcggccat

SEQ ID NO: 409288 - DNA, 140 bp, Artificial Sequence
  Synthetic
  misc_feature (22)..(22): n is a, c, g, or t
atggccgactcccaagtacganagcgcatatactttcttctgtttatctcttaatactgtggtcatactgaaagaacagttttgcattgtccctccttccagggtgctgttttgagtgctggagacccagcatggcgtat

SEQ ID NO: 409289 - DNA, 140 bp, Artificial Sequence
  Synthetic
atacgccatgctgggtctcccaatggtataataaattaaaccaggtaagggcaaagttaaaaactcttttccctaatgcaacaataaaatttaactcatcctcaggaggggacctaaaaacgtacttgggagtcggccat

SEQ ID NO: 409290 - DNA, 140 bp, Artificial Sequence
  Synthetic
atggccgactcccaagtacgtttttaggtcccctcctgaggatgagttaaattttattgttgcattagggaaaagagtttttaactttgcccttacctggtttaatttattataccattgggagacccagcatggcgtat

SEQ ID NO: 409291 - DNA, 140 bp, Artificial Sequence
  Synthetic
aggccctggctgctgatatgccctaatgcaacaataaaatttaactcatcctcaggaggggacctaaaaattacaacgcatagttttaattgtaaaaaaaaatttttctactgcaatacagaccttttgggacagcggtg

SEQ ID NO: 409292 - DNA, 140 bp, Artificial Sequence
  Synthetic
caccgctgtcccaaaaggtctgtattgcagtagaaaaatttttttttacaattaaaactatgcgttgtaatttttaggtcccctcctgaggatgagttaaattttattgttgcattagggcatatcagcagccagggcct

SEQ ID NO: 409293 - DNA, 140 bp, Artificial Sequence
  Synthetic
aggccctggctgctgatatggagatggggcaccatgctccttgggatgttgatgatctgtagtgctgcagaacaattgtgggtcacagtctattatggggtacctgtgtggaaagaagcagaccttttgggacagcggtg

SEQ ID NO: 409294 - DNA, 140 bp, Artificial Sequence
  Synthetic
caccgctgtcccaaaaggtctgcttctttccacacaggtaccccataatagactgtgacccacaattgttctgcagcactacagatcatcaacatcccaaggagcatggtgccccatctccatatcagcagccagggcct

SEQ ID NO: 409295 - DNA, 140 bp, Artificial Sequence
  Synthetic
  misc_feature (54)..(54): n is a, c, g, or t
  misc_feature (94)..(94): n is a, c, g, or t
  misc_feature (99)..(99): n is a, c, g, or t
  misc_feature (101)..(101): n is a, c, g, or t
  misc_feature (107)..(107): n is a, c, g, or t
  misc_feature (110)..(110): n is a, c, g, or t
atacgccatgctgggtctcctaaggcaagcaatgtataccgctcccgttgcagnaataattgcctgtagctcaaatattacaggtctactattnacaananatggtngtnagaataatggcgtacttgggagtcggccat

SEQ ID NO: 409296 - DNA, 140 bp, Artificial Sequence
  Synthetic
  misc_feature (31)..(31): n is a, c, g, or t
  misc_feature (34)..(34): n is a, c, g, or t
  misc_feature (40)..(40): n is a, c, g, or t
  misc_feature (42)..(42): n is a, c, g, or t
  misc_feature (47)..(47): n is a, c, g, or t
  misc_feature (87)..(87): n is a, c, g, or t
atggccgactcccaagtacgccattattctnacnaccatntnttgtnaatagtagacctgtaatatttgagctacaggcaattattnctgcaacgggagcggtatacattgcttgccttaggagacccagcatggcgtat

SEQ ID NO: 409297 - DNA, 140 bp, Artificial Sequence
  Synthetic
  misc_feature (79)..(79): n is a, c, g, or t
aggccctggctgctgatatggaactctagttggagtaataagtctctggaagacatttgggacaacatgacctggatgnaatgggaaaaggaaattggcaattactcaaatgaaatatacgaccttttgggacagcggtg

SEQ ID NO: 409298 - DNA, 140 bp, Artificial Sequence
  Synthetic
  misc_feature (62)..(62): n is a, c, g, or t
caccgctgtcccaaaaggtcgtatatttcatttgagtaattgccaatttccttttcccattncatccaggtcatgttgtcccaaatgtcttccagagacttattactccaactagagttccatatcagcagccagggcct

SEQ ID NO: 409299 - DNA, 140 bp, Artificial Sequence
  Synthetic
aggccctggctgctgatatgccccctctgtgtcactttaagatgtacaaagccaaatgttacgagtactaatgtgactgaaggcatgaaaaattgctctttcaatacaaccacagaaatagaccttttgggacagcggtg

SEQ ID NO: 409300 - DNA, 140 bp, Artificial Sequence
  Synthetic
caccgctgtcccaaaaggtctatttctgtggttgtattgaaagagcaatttttcatgccttcagtcacattagtactcgtaacatttggctttgtacatcttaaagtgacacagagggggcatatcagcagccagggcct

SEQ ID NO: 409301 - DNA, 140 bp, Artificial Sequence
  Synthetic
atacgccatgctgggtctccaaaaattaaaagaacacttcaataaaacaataataacatttagaccaccctcaggaggggacttagaaattataacacatagttttaattgtagaggagacgtacttgggagtcggccat

SEQ ID NO: 409302 - DNA, 140 bp, Artificial Sequence
  Synthetic
atggccgactcccaagtacgtctcctctacaattaaaactatgtgttataatttctaagtcccctcctgagggtggtctaaatgttattattgttttattgaagtgttcttttaatttttggagacccagcatggcgtat

SEQ ID NO: 409303 - DNA, 140 bp, Artificial Sequence
  Synthetic
aggccctggctgctgatatgggaagacagaaagttgtccctttaactgacacaacaaatcagaagactgagttacaagcagttaatctagctttgcaggattcgggattagaagtaaacagaccttttgggacagcggtg

SEQ ID NO: 409304 - DNA, 140 bp, Artificial Sequence
  Synthetic
caccgctgtcccaaaaggtctgtttacttctaatcccgaatcctgcaaagctagattaactgcttgtaactcagtcttctgatttgttgtgtcagttaaagggacaactttctgtcttcccatatcagcagccagggcct

SEQ ID NO: 409305 - DNA, 140 bp, Artificial Sequence
  Synthetic
  misc_feature (21)..(21): n is a, c, g, or t
  misc_feature (32)..(32): n is a, c, g, or t
  misc_feature (46)..(46): n is a, c, g, or t
  misc_feature (65)..(65): n is a, c, g, or t
atacgccatgctgggtctccnaatctatacanattaattgtacaanacccaacaacaatacaagnaaaagtattatctatagaggaccagagagagcattttatgcaaaaggaataatagcgtacttgggagtcggccat

SEQ ID NO: 409306 - DNA, 140 bp, Artificial Sequence
  Synthetic
  misc_feature (76)..(76): n is a, c, g, or t
  misc_feature (95)..(95): n is a, c, g, or t
  misc_feature (109)..(109): n is a, c, g, or t
  misc_feature (120)..(120): n is a, c, g, or t
atggccgactcccaagtacgctattattccttttgcataaaatgctctctctggtcctctatagataatacttttncttgtattgttgttgggtnttgtacaattaatntgtatagattnggagacccagcatggcgtat

SEQ ID NO: 409307 - DNA, 140 bp, Artificial Sequence
  Synthetic
  misc_feature (38)..(38): n is a, c, g, or t
  misc_feature (43)..(43): n is a, c, g, or t
  misc_feature (45)..(45): n is a, c, g, or t
  misc_feature (51)..(51): n is a, c, g, or t
  misc_feature (54)..(54): n is a, c, g, or t
  misc_feature (69)..(69): n is a, c, g, or t
  misc_feature (81)..(81): n is a, c, g, or t
  misc_feature (83)..(83): n is a, c, g, or t
  misc_feature (110)..(110): n is a, c, g, or t
  misc_feature (114)..(114): n is a, c, g, or t
aggccctggctgctgatatgattacaggtctactattnacaananatggtngtnagaataatggtactnctaatcagactnanatcttcagacctgggggaggaaatatnaaanacaattgaccttttgggacagcggtg

SEQ ID NO: 409308 - DNA, 140 bp, Artificial Sequence
  Synthetic
  misc_feature (27)..(27): n is a, c, g, or t
  misc_feature (31)..(31): n is a, c, g, or t
  misc_feature (58)..(58): n is a, c, g, or t
  misc_feature (60)..(60): n is a, c, g, or t
  misc_feature (72)..(72): n is a, c, g, or t
  misc_feature (87)..(87): n is a, c, g, or t
  misc_feature (90)..(90): n is a, c, g, or t
  misc_feature (96)..(96): n is a, c, g, or t
  misc_feature (98)..(98): n is a, c, g, or t
  misc_feature (103)..(103): n is a, c, g, or t
caccgctgtcccaaaaggtcaattgtntttnatatttcctcccccaggtctgaagatntnagtctgattagnagtaccattattctnacnaccatntnttgtnaatagtagacctgtaatcatatcagcagccagggcct

SEQ ID NO: 409309 - DNA, 140 bp, Artificial Sequence
  Synthetic
aggccctggctgctgatatggttacggccaggaggaaagaaaaaatatagactaaaacatatagtatgggcaagcagggagctagaacgcttcgcaattaatcctggccttttagagacagaccttttgggacagcggtg

SEQ ID NO: 409310 - DNA, 140 bp, Artificial Sequence
  Synthetic
caccgctgtcccaaaaggtctgtctctaaaaggccaggattaattgcgaagcgttctagctccctgcttgcccatactatatgttttagtctatattttttctttcctcctggccgtaaccatatcagcagccagggcct

SEQ ID NO: 409311 - DNA, 140 bp, Artificial Sequence
  Synthetic
aggccctggctgctgatatgaatgtgacagaagactttaacatgtggaaaaacaacatggtagagcagatgcatacagatataatcagtctatgggaccaaagcctaaagccatgtgtaagaccttttgggacagcggtg

SEQ ID NO: 409312 - DNA, 140 bp, Artificial Sequence
  Synthetic
caccgctgtcccaaaaggtcttacacatggctttaggctttggtcccatagactgattatatctgtatgcatctgctctaccatgttgtttttccacatgttaaagtcttctgtcacattcatatcagcagccagggcct

SEQ ID NO: 409313 - DNA, 140 bp, Artificial Sequence
  Synthetic
atacgccatgctgggtctccagcaatgtcactagcagcaatgccactaccgaaggaaatggggaagaaatgaaaaactgctctttcaatgtgaccacagaactaagggataagagacagacgtacttgggagtcggccat

SEQ ID NO: 409314 - DNA, 140 bp, Artificial Sequence
  Synthetic
atggccgactcccaagtacgtctgtctcttatcccttagttctgtggtcacattgaaagagcagtttttcatttcttccccatttccttcggtagtggcattgctgctagtgacattgctggagacccagcatggcgtat

SEQ ID NO: 409315 - DNA, 140 bp, Artificial Sequence
  Synthetic
aggccctggctgctgatatgattaaataaaatagtaagaatgtatagccctgtcagcattttggacataagacagggaccaaaggaaccttttagagactatgtagaccggttctataaagaccttttgggacagcggtg

SEQ ID NO: 409316 - DNA, 140 bp, Artificial Sequence
  Synthetic
caccgctgtcccaaaaggtctttatagaaccggtctacatagtctctaaaaggttcctttggtccctgtcttatgtccaaaatgctgacagggctatacattcttactattttatttaatcatatcagcagccagggcct

SEQ ID NO: 409317 - DNA, 140 bp, Artificial Sequence
  Synthetic
aggccctggctgctgatatgagtgttaggaagctatcagaagatagatggaacaagccccagaagaccaagggccacagagggagccatacaacgaatggacattagaacttttggaggagaccttttgggacagcggtg

SEQ ID NO: 409318 - DNA, 140 bp, Artificial Sequence
  Synthetic
caccgctgtcccaaaaggtctcctccaaaagttctaatgtccattcgttgtatggctccctctgtggcccttggtcttctggggcttgttccatctatcttctgatagcttcctaacactcatatcagcagccagggcct

SEQ ID NO: 409319 - DNA, 140 bp, Artificial Sequence
  Synthetic
  misc_feature (28)..(28): n is a, c, g, or t
  misc_feature (42)..(42): n is a, c, g, or t
  misc_feature (95)..(95): n is a, c, g, or t
atacgccatgctgggtctcctggagggnaaatgatgaagganggagaaatgaaaaactgctctttcaatatcaccacaagcacaagagataggangaagaaagaatatgcgcttttttatcgtacttgggagtcggccat

SEQ ID NO: 409320 - DNA, 140 bp, Artificial Sequence
  Synthetic
  misc_feature (46)..(46): n is a, c, g, or t
  misc_feature (99)..(99): n is a, c, g, or t
  misc_feature (113)..(113): n is a, c, g, or t
atggccgactcccaagtacgataaaaaagcgcatattctttcttcntcctatctcttgtgcttgtggtgatattgaaagagcagtttttcatttctccntccttcatcatttnccctccaggagacccagcatggcgtat

SEQ ID NO: 409321 - DNA, 140 bp, Artificial Sequence
  Synthetic
aggccctggctgctgatatgctttgaagcagctttgcaataaaatggggggcaagtggtcaaaaagcagtatagttggatggcctgctgtaagagaaagaatgagaagaactgagccagcgaccttttgggacagcggtg

SEQ ID NO: 409322 - DNA, 140 bp, Artificial Sequence
  Synthetic
caccgctgtcccaaaaggtcgctggctcagttcttctcattctttctcttacagcaggccatccaactatactgctttttgaccacttgccccccattttattgcaaagctgcttcaaagcatatcagcagccagggcct

SEQ ID NO: 409323 - DNA, 140 bp, Artificial Sequence
  Synthetic
aggccctggctgctgatatggatgaaagcctaaggccatgtgtagaattaaccccactttgtgttactttaaattgtactaatatagctaataatatgactagttctaatatagctagtagaccttttgggacagcggtg

SEQ ID NO: 409324 - DNA, 140 bp, Artificial Sequence
  Synthetic
caccgctgtcccaaaaggtctactagctatattagaactagtcatattattagctatattagtacaatttaaagtaacacaaagtggggttaattctacacatggccttaggctttcatccatatcagcagccagggcct

SEQ ID NO: 409325 - DNA, 140 bp, Artificial Sequence
  Synthetic
atacgccatgctgggtctcctcagaactggaggtaaaaaactgctctttcaatataactacagtagtaagagataagagaatgcaagtacgtgcgcttttttatagacctgatatagtatcgtacttgggagtcggccat

SEQ ID NO: 409326 - DNA, 140 bp, Artificial Sequence
  Synthetic
atggccgactcccaagtacgatactatatcaggtctataaaaaagcgcacgtacttgcattctcttatctcttactactgtagttatattgaaagagcagttttttacctccagttctgaggagacccagcatggcgtat

SEQ ID NO: 409327 - DNA, 140 bp, Artificial Sequence
  Synthetic
aggccctggctgctgatatgagaagaagagatcataattagatctgaaaatctcacaaacaatgctaaaaacataatagtacagtttaatgcatctgtagaaattaattgtacaaggcccgaccttttgggacagcggtg

SEQ ID NO: 409328 - DNA, 140 bp, Artificial Sequence
  Synthetic
caccgctgtcccaaaaggtcgggccttgtacaattaatttctacagatgcattaaactgtactattatgtttttagcattgtttgtgagattttcagatctaattatgatctcttcttctcatatcagcagccagggcct

SEQ ID NO: 409329 - DNA, 140 bp, Artificial Sequence
  Synthetic
aggccctggctgctgatatgtgggtgcgagagcgtcagtattaagcgggggaaaattagatgcatgggagaaaattcggttaaggccagggggaaagaaaaaatatagactaaaacatatgaccttttgggacagcggtg

SEQ ID NO: 409330 - DNA, 140 bp, Artificial Sequence
  Synthetic
caccgctgtcccaaaaggtcatatgttttagtctatattttttctttccccctggccttaaccgaattttctcccatgcatctaattttcccccgcttaatactgacgctctcgcacccacatatcagcagccagggcct

SEQ ID NO: 409331 - DNA, 140 bp, Artificial Sequence
  Synthetic
atacgccatgctgggtctccgaccttcttaacaaaacaacaataacttttcgaccaccctcaggaggggacccagaaattacaacacacagttttaattgtggaggggaatttttctactcgtacttgggagtcggccat

SEQ ID NO: 409332 - DNA, 140 bp, Artificial Sequence
  Synthetic
atggccgactcccaagtacgagtagaaaaattcccctccacaattaaaactgtgtgttgtaatttctgggtcccctcctgagggtggtcgaaaagttattgttgttttgttaagaaggtcggagacccagcatggcgtat

SEQ ID NO: 409333 - DNA, 140 bp, Artificial Sequence
  Synthetic
aggccctggctgctgatatgagtatgggcaagcagggagctggaaagattcgcacttaaccctagccttttagaaacaacagaaggatgtcagcaaataatggaacagttacaaccagctgaccttttgggacagcggtg

SEQ ID NO: 409334 - DNA, 140 bp, Artificial Sequence
  Synthetic
caccgctgtcccaaaaggtcagctggttgtaactgttccattatttgctgacatccttctgttgtttctaaaaggctagggttaagtgcgaatctttccagctccctgcttgcccatactcatatcagcagccagggcct

SEQ ID NO: 409335 - DNA, 140 bp, Artificial Sequence
  Synthetic
aggccctggctgctgatatgtgaaaaatcgcagaaccagcaagaaaagaatgaacaagaattattggaattggataaatgggcaagtttgtggaattggtttgacataacaaattggctggaccttttgggacagcggtg

SEQ ID NO: 409336 - DNA, 140 bp, Artificial Sequence
  Synthetic
caccgctgtcccaaaaggtccagccaatttgttatgtcaaaccaattccacaaacttgcccatttatccaattccaataattcttgttcattcttttcttgctggttctgcgatttttcacatatcagcagccagggcct

SEQ ID NO: 409337 - DNA, 140 bp, Artificial Sequence
  Synthetic
aggccctggctgctgatatgtatttagctttacaggattcaggatcagaggtgaacatagtaacagactcacagtatgcattaggaatcattcaagcacaaccagataagagtgaatcaggaccttttgggacagcggtg

SEQ ID NO: 409338 - DNA, 140 bp, Artificial Sequence
  Synthetic
caccgctgtcccaaaaggtcctgattcactcttatctggttgtgcttgaatgattcctaatgcatactgtgagtctgttactatgttcacctctgatcctgaatcctgtaaagctaaatacatatcagcagccagggcct

SEQ ID NO: 409339 - DNA, 140 bp, Artificial Sequence
  Synthetic
aggccctggctgctgatatgcctggctgtggaaagataccttaaggatcaacggctcctgggactttggggttgctctggaaaacacatttgcaccactactgtgccctggaactctagtgaccttttgggacagcggtg

SEQ ID NO: 409340 - DNA, 140 bp, Artificial Sequence
  Synthetic
caccgctgtcccaaaaggtcactagagttccagggcacagtagtggtgcaaatgtgttttccagagcaaccccaaagtcccaggagccgttgatccttaaggtatctttccacagccaggcatatcagcagccagggcct

SEQ ID NO: 409341 - DNA, 140 bp, Artificial Sequence
  Synthetic
aggccctggctgctgatatggttgctctggaaaacacatttgcaccactactgtgccctggaactctagttggagtaatagaactcaagatgagatttggcataacatgtcctggatgcagaccttttgggacagcggtg

SEQ ID NO: 409342 - DNA, 140 bp, Artificial Sequence
  Synthetic
caccgctgtcccaaaaggtctgcatccaggacatgttatgccaaatctcatcttgagttctattactccaactagagttccagggcacagtagtggtgcaaatgtgttttccagagcaaccatatcagcagccagggcct

SEQ ID NO: 409343 - DNA, 140 bp, Artificial Sequence
  Synthetic
  misc_feature (34)..(34): n is a, c, g, or t
  misc_feature (92)..(92): n is a, c, g, or t
aggccctggctgctgatatgtcaaaacataaggngggtggatgggctactataagggaaagaatgagacgagctgagccacgagcagcaganggggtgggagcagcatctcgagacctgggaccttttgggacagcggtg

SEQ ID NO: 409344 - DNA, 140 bp, Artificial Sequence
  Synthetic
  misc_feature (49)..(49): n is a, c, g, or t
  misc_feature (107)..(107): n is a, c, g, or t
caccgctgtcccaaaaggtcccaggtctcgagatgctgctcccaccccntctgctgctcgtggctcagctcgtctcattctttcccttatagtagcccatccacccnccttatgttttgacatatcagcagccagggcct

SEQ ID NO: 409345 - DNA, 140 bp, Artificial Sequence
  Synthetic
atacgccatgctgggtctcccaaaatcctgtatcaaagcagtaagtatatgtaatgattaactttgcagcaagagtagattatagagtaggagtagcagcatttacaatagcactaatcacgtacttgggagtcggccat

SEQ ID NO: 409346 - DNA, 140 bp, Artificial Sequence
  Synthetic
atggccgactcccaagtacgtgattagtgctattgtaaatgctgctactcctactctataatctactcttgctgcaaagttaatcattacatatacttactgctttgatacaggattttgggagacccagcatggcgtat

SEQ ID NO: 409347 - DNA, 140 bp, Artificial Sequence
  Synthetic
aggccctggctgctgatatgggacaccaaatgaaagactgcactgaaagacaggctaattttttagggaaaatttggccttccagcaaggggaggccaggaaattttccacagagcagacgaccttttgggacagcggtg

SEQ ID NO: 409348 - DNA, 140 bp, Artificial Sequence
  Synthetic
caccgctgtcccaaaaggtcgtctgctctgtggaaaatttcctggcctccccttgctggaaggccaaattttccctaaaaaattagcctgtctttcagtgcagtctttcatttggtgtcccatatcagcagccagggcct

SEQ ID NO: 409349 - DNA, 140 bp, Artificial Sequence
  Synthetic
aggccctggctgctgatatgagtttccctcaaatcactctttggcaacgaccccttgtcacagtaaaaatagggggacagctaaaagaagctctattagatacaggagcagatgatacaggaccttttgggacagcggtg

SEQ ID NO: 409350 - DNA, 140 bp, Artificial Sequence
  Synthetic
caccgctgtcccaaaaggtcctgtatcatctgctcctgtatctaatagagcttcttttagctgtccccctatttttactgtgacaaggggtcgttgccaaagagtgatttgagggaaactcatatcagcagccagggcct

SEQ ID NO: 409351 - DNA, 140 bp, Artificial Sequence
  Synthetic
aggccctggctgctgatatgaaaaagtagtatagttggatggtctgctataagggaaagaataagaagaactgatccagcagcagatggggtgggagcagtatctcgagacctggaaaaagaccttttgggacagcggtg

SEQ ID NO: 409352 - DNA, 140 bp, Artificial Sequence
  Synthetic
caccgctgtcccaaaaggtctttttccaggtctcgagatactgctcccaccccatctgctgctggatcagttcttcttattctttcccttatagcagaccatccaactatactactttttcatatcagcagccagggcct

SEQ ID NO: 409353 - DNA, 140 bp, Artificial Sequence
  Synthetic
atacgccatgctgggtctccaataatatgtacacttgtcataatgatacttacaagaatgaactaatgacaaattgcgctttcaatgtaactgaagacttacaagataagaaaaagttagcgtacttgggagtcggccat

SEQ ID NO: 409354 - DNA, 140 bp, Artificial Sequence
  Synthetic
atggccgactcccaagtacgctaactttttcttatcttgtaagtcttcagttacattgaaagcgcaatttgtcattagttcattcttgtaagtatcattatgacaagtgtacatattattggagacccagcatggcgtat

SEQ ID NO: 409355 - DNA, 140 bp, Artificial Sequence
  Synthetic
aggccctggctgctgatatgactttaaatgcatgggtaaaagtaatagaagagaaggctttcagcccagaagtaatacccatgtttacagcattatcagaaggagccaccccacaagattgaccttttgggacagcggtg

SEQ ID NO: 409356 - DNA, 140 bp, Artificial Sequence
  Synthetic
caccgctgtcccaaaaggtcaatcttgtggggtggctccttctgataatgctgtaaacatgggtattacttctgggctgaaagccttctcttctattacttttacccatgcatttaaagtcatatcagcagccagggcct

SEQ ID NO: 409357 - DNA, 140 bp, Artificial Sequence
  Synthetic
atacgccatgctgggtctccggaacgagttaagtgaggagtctctcgcgcaggactcggcttgctgaagcgcgcgcggcaagaggcgaggggcagcgactggtgagtacgctaaaataatcgtacttgggagtcggccat

SEQ ID NO: 409358 - DNA, 140 bp, Artificial Sequence
  Synthetic
atggccgactcccaagtacgattattttagcgtactcaccagtcgctgcccctcgcctcttgccgcgcgcgcttcagcaagccgagtcctgcgcgagagactcctcacttaactcgttccggagacccagcatggcgtat

SEQ ID NO: 409359 - DNA, 140 bp, Artificial Sequence
  Synthetic
aggccctggctgctgatatgattgggcctgaaaatccatacaatactccaatatttgctataaagaaaaaagacagcactaaatggagaaaattagtagatttcagagagctcaataaaagaccttttgggacagcggtg

SEQ ID NO: 409360 - DNA, 140 bp, Artificial Sequence
  Synthetic
caccgctgtcccaaaaggtcttttattgagctctctgaaatctactaattttctccatttagtgctgtcttttttctttatagcaaatattggagtattgtatggattttcaggcccaatcatatcagcagccagggcct

SEQ ID NO: 409361 - DNA, 140 bp, Artificial Sequence
  Synthetic
aggccctggctgctgatatgtaaaattaaccccactctgtgttactttaaattgcactgacgtaaggaatgttactaataccactagtaacagtggggaaacaatagggagagaagaaatgaccttttgggacagcggtg

SEQ ID NO: 409362 - DNA, 140 bp, Artificial Sequence
  Synthetic
caccgctgtcccaaaaggtcatttcttctctccctattgtttccccactgttactagtggtattagtaacattccttacgtcagtgcaatttaaagtaacacagagtggggttaattttacatatcagcagccagggcct

SEQ ID NO: 409363 - DNA, 140 bp, Artificial Sequence
  Synthetic
atacgccatgctgggtctccaacaacaaacagtagtgcagtaattacactcccatgtagaataaaacaaattataaacatgtggcagggagtaggaaaagcaatatatgcccctcccgttcgtacttgggagtcggccat

SEQ ID NO: 409364 - DNA, 140 bp, Artificial Sequence
  Synthetic
atggccgactcccaagtacgaacgggaggggcatatattgcttttcctactccctgccacatgtttataatttgttttattctacatgggagtgtaattactgcactactgtttgttgttggagacccagcatggcgtat

SEQ ID NO: 409365 - DNA, 140 bp, Artificial Sequence
  Synthetic
aggccctggctgctgatatgtagtatacttagaatataggaaattggtaaggcaaagaaaaataaataggttatataaaagaataagagaaagagcagaagacagtggcaatgagagtgagaccttttgggacagcggtg

SEQ ID NO: 409366 - DNA, 140 bp, Artificial Sequence
  Synthetic
caccgctgtcccaaaaggtctcactctcattgccactgtcttctgctctttctcttattcttttatataacctatttatttttctttgccttaccaatttcctatattctaagtatactacatatcagcagccagggcct

SEQ ID NO: 409367 - DNA, 140 bp, Artificial Sequence
  Synthetic
aggccctggctgctgatatggggggatgcagaggaattggcagcacttggggaaatggggccttttattcctgggaatattaataatctgtagtgctgcagacaacttgtgggtcacagtgaccttttgggacagcggtg

SEQ ID NO: 409368 - DNA, 140 bp, Artificial Sequence
  Synthetic
caccgctgtcccaaaaggtcactgtgacccacaagttgtctgcagcactacagattattaatattcccaggaataaaaggccccatttccccaagtgctgccaattcctctgcatccccccatatcagcagccagggcct

SEQ ID NO: 409369 - DNA, 140 bp, Artificial Sequence
  Synthetic
  misc_feature (21)..(21): n is a, c, g, or t
  misc_feature (63)..(63): n is a, c, g, or t
  misc_feature (65)..(65): n is a, c, g, or t
  misc_feature (117)..(117): n is a, c, g, or t
atacgccatgctgggtctccnacaacaactccctctcagaagcaggagacggtggacaagganangtatcctttagcttccctcagatcactctttggcagcgacccatcgtcacantaacgtacttgggagtcggccat

SEQ ID NO: 409370 - DNA, 140 bp, Artificial Sequence
  Synthetic
  misc_feature (24)..(24): n is a, c, g, or t
  misc_feature (76)..(76): n is a, c, g, or t
  misc_feature (78)..(78): n is a, c, g, or t
  misc_feature (120)..(120): n is a, c, g, or t
atggccgactcccaagtacgttantgtgacgatgggtcgctgccaaagagtgatctgagggaagctaaaggatacntntccttgtccaccgtctcctgcttctgagagggagttgttgtnggagacccagcatggcgtat

SEQ ID NO: 409371 - DNA, 140 bp, Artificial Sequence
  Synthetic
atacgccatgctgggtctccccctgaaggaagagcaaggggcaatacaaaactgtactttcaatataaccacagaagtaaaagataagaataagagagtacatgcactcttttatagactcgtacttgggagtcggccat

SEQ ID NO: 409372 - DNA, 140 bp, Artificial Sequence
  Synthetic
atggccgactcccaagtacgagtctataaaagagtgcatgtactctcttattcttatcttttacttctgtggttatattgaaagtacagttttgtattgccccttgctcttccttcagggggagacccagcatggcgtat

SEQ ID NO: 409373 - DNA, 140 bp, Artificial Sequence
  Synthetic
aggccctggctgctgatatgttaagtgtttcaactgtggcaaagaagggcacatagcaaaaaattgcagggcccctaggaaaaagggctgttggaaatgtggaagggaaggacaccaaatgaccttttgggacagcggtg

SEQ ID NO: 409374 - DNA, 140 bp, Artificial Sequence
  Synthetic
caccgctgtcccaaaaggtcatttggtgtccttcccttccacatttccaacagccctttttcctaggggccctgcaattttttgctatgtgcccttctttgccacagttgaaacacttaacatatcagcagccagggcct

SEQ ID NO: 409375 - DNA, 140 bp, Artificial Sequence
  Synthetic
aggccctggctgctgatatggcccctaggaaaaagggctgttggaaatgtggaagggaaggacaccaaatgaaagactgcactgaaagacaggctaattttttagggaaaatttggccttgaccttttgggacagcggtg

SEQ ID NO: 409376 - DNA, 140 bp, Artificial Sequence
  Synthetic
caccgctgtcccaaaaggtcaaggccaaattttccctaaaaaattagcctgtctttcagtgcagtctttcatttggtgtccttcccttccacatttccaacagccctttttcctaggggccatatcagcagccagggcct

SEQ ID NO: 409377 - DNA, 140 bp, Artificial Sequence
  Synthetic
aggccctggctgctgatatggaaaagtttagtaaaataccatatgcatgtttcaaagaaagccaaaagatggttttatagacatcactttgaaagcagacatccaaaaataagttcagaagaccttttgggacagcggtg

SEQ ID NO: 409378 - DNA, 140 bp, Artificial Sequence
  Synthetic
caccgctgtcccaaaaggtcttctgaacttatttttggatgtctgctttcaaagtgatgtctataaaaccatcttttggctttctttgaaacatgcatatggtattttactaaacttttccatatcagcagccagggcct

SEQ ID NO: 409379 - DNA, 140 bp, Artificial Sequence
  Synthetic
atacgccatgctgggtctccaagagctaagggctcatataaaggacataggcaataaaacaatagtatttaactcatccgcaggaggggacctagaaattacaagccatatttttaattgcgtacttgggagtcggccat

SEQ ID NO: 409380 - DNA, 140 bp, Artificial Sequence
  Synthetic
atggccgactcccaagtacgcaattaaaaatatggcttgtaatttctaggtcccctcctgcggatgagttaaatactattgttttattgcctatgtcctttatatgagcccttagctcttggagacccagcatggcgtat

SEQ ID NO: 409381 - DNA, 140 bp, Artificial Sequence
  Synthetic
atacgccatgctgggtctccagcagtaaagctgaatggtctagggtgagagaaaaaataagacaaactgagccagcagcagaaggagtaggggcagtatctcaagacttagctaaacatgcgtacttgggagtcggccat

SEQ ID NO: 409382 - DNA, 140 bp, Artificial Sequence
  Synthetic
atggccgactcccaagtacgcatgtttagctaagtcttgagatactgcccctactccttctgctgctggctcagtttgtcttattttttctctcaccctagaccattcagctttactgctggagacccagcatggcgtat

SEQ ID NO: 409383 - DNA, 140 bp, Artificial Sequence
  Synthetic
aggccctggctgctgatatgttcctgagtgggagtttgttaatacccctcccctagtaaaattatggtaccagctagagaaagaacccatagcaggagcagaaactttctatgtagatgggaccttttgggacagcggtg

SEQ ID NO: 409384 - DNA, 140 bp, Artificial Sequence
  Synthetic
caccgctgtcccaaaaggtcccatctacatagaaagtttctgctcctgctatgggttctttctctagctggtaccataattttactaggggaggggtattaacaaactcccactcaggaacatatcagcagccagggcct

SEQ ID NO: 409385 - DNA, 140 bp, Artificial Sequence
  Synthetic
aggccctggctgctgatatgtgtgccactttagattgtaatgatgttaataataccaccagagttgataataataccattggagaaataaaaaactgctctttcaatataaccacagaaagaccttttgggacagcggtg

SEQ ID NO: 409386 - DNA, 140 bp, Artificial Sequence
  Synthetic
caccgctgtcccaaaaggtctttctgtggttatattgaaagagcagttttttatttctccaatggtattattatcaactctggtggtattattaacatcattacaatctaaagtggcacacatatcagcagccagggcct

SEQ ID NO: 409387 - DNA, 140 bp, Artificial Sequence
  Synthetic
aggccctggctgctgatatgattaagagaacatctattgaggtggggatttactacaccagataaaaaacatcagaaagaacctccatttctttggatgggttatgaactccatcctgatgaccttttgggacagcggtg

SEQ ID NO: 409388 - DNA, 140 bp, Artificial Sequence
  Synthetic
caccgctgtcccaaaaggtcatcaggatggagttcataacccatccaaagaaatggaggttctttctgatgttttttatctggtgtagtaaatccccacctcaatagatgttctcttaatcatatcagcagccagggcct

SEQ ID NO: 409389 - DNA, 140 bp, Artificial Sequence
  Synthetic
aggccctggctgctgatatgcacaatatacaggttaattgaacaatcgcagaaccagcaggaaaagaatgaaaaagacttattggcattggacaagtgggcaagtctgtggaattggtttgaccttttgggacagcggtg

SEQ ID NO: 409390 - DNA, 140 bp, Artificial Sequence
  Synthetic
caccgctgtcccaaaaggtcaaaccaattccacagacttgcccacttgtccaatgccaataagtctttttcattcttttcctgctggttctgcgattgttcaattaacctgtatattgtgcatatcagcagccagggcct

SEQ ID NO: 409391 - DNA, 140 bp, Artificial Sequence
  Synthetic
aggccctggctgctgatatgaaaaagacttattggcattggacaagtgggcaagtctgtggaattggtttagcatatcaaattggctgtggtatataagaatattcataatgatagtagggaccttttgggacagcggtg

SEQ ID NO: 409392 - DNA, 140 bp, Artificial Sequence
  Synthetic
caccgctgtcccaaaaggtccctactatcattatgaatattcttatataccacagccaatttgatatgctaaaccaattccacagacttgcccacttgtccaatgccaataagtctttttcatatcagcagccagggcct

SEQ ID NO: 409393 - DNA, 140 bp, Artificial Sequence
  Synthetic
atacgccatgctgggtctccgtgtacaaggcccaacaataatacaaggaagagtgtgagaataggaccgggacaaacattctatgcaacaggaagtataataggagatataagacaagcacgtacttgggagtcggccat

SEQ ID NO: 409394 - DNA, 140 bp, Artificial Sequence
  Synthetic
atggccgactcccaagtacgtgcttgtcttatatctcctattatacttcctgttgcatagaatgtttgtcccggtcctattctcacactcttccttgtattattgttgggccttgtacacggagacccagcatggcgtat

SEQ ID NO: 409395 - DNA, 140 bp, Artificial Sequence
  Synthetic
atacgccatgctgggtctccaggcagagacagatccgttcgattgctgaccggattgtcgacacttatctgggacgacctgaggaacctgtgcctcttcagctaccaccgcttgagagaccgtacttgggagtcggccat

SEQ ID NO: 409396 - DNA, 140 bp, Artificial Sequence
  Synthetic
atggccgactcccaagtacggtctctcaagcggtggtagctgaagaggcacaggttcctcaggtcgtcccagataagtgtcgacaatccggtcagcaatcgaacggatctgtctctgcctggagacccagcatggcgtat

SEQ ID NO: 409397 - DNA, 140 bp, Artificial Sequence
  Synthetic
atacgccatgctgggtctccacaagtgttactgtaaagtatgttgctatcactgccaagcttgctttttacacaaaggcttaggcatctcctatggcaggaagaagcggaaacagcgccacgtacttgggagtcggccat

SEQ ID NO: 409398 - DNA, 140 bp, Artificial Sequence
  Synthetic
atggccgactcccaagtacgtggcgctgtttccgcttcttcctgccataggagatgcctaagcctttgtgtaaaaagcaagcttggcagtgatagcaacatactttacagtaacacttgtggagacccagcatggcgtat

SEQ ID NO: 409399 - DNA, 140 bp, Artificial Sequence
  Synthetic
atacgccatgctgggtctccgcgacgaggaactcctcaaagcaataaggatcatcaaaatcctctacaaaagcagtaagtattagtaactagtagaggtaatgctttctttggaaatctgcgtacttgggagtcggccat

SEQ ID NO: 409400 - DNA, 140 bp, Artificial Sequence
  Synthetic
atggccgactcccaagtacgcagatttccaaagaaagcattacctctactagttactaatacttactgcttttgtagaggattttgatgatccttattgctttgaggagttcctcgtcgcggagacccagcatggcgtat

SEQ ID NO: 409401 - DNA, 140 bp, Artificial Sequence
  Synthetic
atacgccatgctgggtctcctgccaccgcccccaatgtcaccaatgacatggaaggagaaatgaaaaactgctcttacaatataaccacagaattaaaggataagaaacagcaagtgtatcgtacttgggagtcggccat

SEQ ID NO: 409402 - DNA, 140 bp, Artificial Sequence
  Synthetic
atggccgactcccaagtacgatacacttgctgtttcttatcctttaattctgtggttatattgtaagagcagtttttcatttctccttccatgtcattggtgacattgggggcggtggcaggagacccagcatggcgtat

SEQ ID NO: 409403 - DNA, 140 bp, Artificial Sequence
  Synthetic
aggccctggctgctgatatgggaggaagaacaaaacaaaagtaaaagtaaaaaggcacagcaagcagaagctggcgcaaggaacagcagtcaggtcagtcaaaattatcctatagtgcaggaccttttgggacagcggtg

SEQ ID NO: 409404 - DNA, 140 bp, Artificial Sequence
  Synthetic
caccgctgtcccaaaaggtcctgcactataggataattttgactgacctgactgctgttccttgcgccagcttctgcttgctgtgcctttttacttttacttttgttttgttcttcctcccatatcagcagccagggcct

SEQ ID NO: 409405 - DNA, 140 bp, Artificial Sequence
  Synthetic
aggccctggctgctgatatgtattggcattggacaagtgggcaagtctgtggaattggtttgacatatcaaactggctgtggtatataaaaatatttataatgatagtaggaggcttaatgaccttttgggacagcggtg

SEQ ID NO: 409406 - DNA, 140 bp, Artificial Sequence
  Synthetic
caccgctgtcccaaaaggtcattaagcctcctactatcattataaatatttttatataccacagccagtttgatatgtcaaaccaattccacagacttgcccacttgtccaatgccaatacatatcagcagccagggcct

SEQ ID NO: 409407 - DNA, 140 bp, Artificial Sequence
  Synthetic
atacgccatgctgggtctccttgtagagctatccgcaacctacctagaagaggaagacagggctttgaaacagctttgctataaaatggggagtaactggtcaaaaagaagcctagggggcgtacttgggagtcggccat

SEQ ID NO: 409408 - DNA, 140 bp, Artificial Sequence
  Synthetic
atggccgactcccaagtacgccccctaggcttctttttgaccagttactccccattttatagcaaagctgtttcaaagccctgtcttcctcttctaggtaggttgcggatagctctacaaggagacccagcatggcgtat

SEQ ID NO: 409409 - DNA, 140 bp, Artificial Sequence
  Synthetic
aggccctggctgctgatatgtgtacaaattgctattgtaaacgatgttgctttcattgccaagtttgcttcacacgaaaaggcttaggcatctcctatggcaggaagaagcggagacagcgaccttttgggacagcggtg

SEQ ID NO: 409410 - DNA, 140 bp, Artificial Sequence
  Synthetic
caccgctgtcccaaaaggtcgctgtctccgcttcttcctgccataggagatgcctaagccttttcgtgtgaagcaaacttggcaatgaaagcaacatcgtttacaatagcaatttgtacacatatcagcagccagggcct

SEQ ID NO: 409411 - DNA, 140 bp, Artificial Sequence
  Synthetic
aggccctggctgctgatatgcacacgaaaaggcttaggcatctcctatggcaggaagaagcggagacagcgacgacgagctcctgaggaccgtcagaatcatcaagtttctctatcaaaggaccttttgggacagcggtg

SEQ ID NO: 409412 - DNA, 140 bp, Artificial Sequence
  Synthetic
caccgctgtcccaaaaggtcctttgatagagaaacttgatgattctgacggtcctcaggagctcgtcgtcgctgtctccgcttcttcctgccataggagatgcctaagccttttcgtgtgcatatcagcagccagggcct

SEQ ID NO: 409413 - DNA, 140 bp, Artificial Sequence
  Synthetic
aggccctggctgctgatatgtagaatataggaaaatattaagacaaaggaaaatagataggttacttgacaggatagcagaaagagcagaagacagtggcaatgaaagtgaaggagaccagaccttttgggacagcggtg

SEQ ID NO: 409414 - DNA, 140 bp, Artificial Sequence
  Synthetic
caccgctgtcccaaaaggtctggtctccttcactttcattgccactgtcttctgctctttctgctatcctgtcaagtaacctatctattttcctttgtcttaatattttcctatattctacatatcagcagccagggcct

SEQ ID NO: 409415 - DNA, 140 bp, Artificial Sequence
  Synthetic
atacgccatgctgggtctcctgccactagtactaatgccactagtagcgagggaggagaaatgaaaaactgctctttcaatgtcaccacaaacatgagagataagaagcaaaaagaatatcgtacttgggagtcggccat

SEQ ID NO: 409416 - DNA, 140 bp, Artificial Sequence
  Synthetic
atggccgactcccaagtacgatattctttttgcttcttatctctcatgtttgtggtgacattgaaagagcagtttttcatttctcctccctcgctactagtggcattagtactagtggcaggagacccagcatggcgtat

SEQ ID NO: 409417 - DNA, 140 bp, Artificial Sequence
  Synthetic
aggccctggctgctgatatgtggcagaaagtaggacaagcaatgtatgcccctcccattcaaggagtaataaggtgtgaatcaaacattacaggactactattaacaagagatggagggagaccttttgggacagcggtg

SEQ ID NO: 409418 - DNA, 140 bp, Artificial Sequence
  Synthetic
caccgctgtcccaaaaggtctccctccatctcttgttaatagtagtcctgtaatgtttgattcacaccttattactccttgaatgggaggggcatacattgcttgtcctactttctgccacatatcagcagccagggcct

SEQ ID NO: 409419 - DNA, 140 bp, Artificial Sequence
  Synthetic
aggccctggctgctgatatgtggggatacctgggcaggagttgaagctataataagaattctgcaacaactactgtttattcatttcagaattgggtgtcaacatagcagaataggtattgaccttttgggacagcggtg

SEQ ID NO: 409420 - DNA, 140 bp, Artificial Sequence
  Synthetic
caccgctgtcccaaaaggtcaatacctattctgctatgttgacacccaattctgaaatgaataaacagtagttgttgcagaattcttattatagcttcaactcctgcccaggtatccccacatatcagcagccagggcct

SEQ ID NO: 409421 - DNA, 140 bp, Artificial Sequence
  Synthetic
aggccctggctgctgatatgaaattttaacatgtggaaaaataacatggtagaacagatgcatgaagatataatcagtttatgggatcaaagcctgaagccatgtgtaaaattaaccccagaccttttgggacagcggtg

SEQ ID NO: 409422 - DNA, 140 bp, Artificial Sequence
  Synthetic
caccgctgtcccaaaaggtctggggttaattttacacatggcttcaggctttgatcccataaactgattatatcttcatgcatctgttctaccatgttatttttccacatgttaaaatttcatatcagcagccagggcct

SEQ ID NO: 409423 - DNA, 140 bp, Artificial Sequence
  Synthetic
  misc_feature (45)..(45): n is a, c, g, or t
atacgccatgctgggtctccttatagcactaatgatagtgtgaangagatgaagaaagaaatgaggaactgctctttcaatatcaccacaaacataagagataagatgcagagagtatatcgtacttgggagtcggccat

SEQ ID NO: 409424 - DNA, 140 bp, Artificial Sequence
  Synthetic
  misc_feature (96)..(96): n is a, c, g, or t
atggccgactcccaagtacgatatactctctgcatcttatctcttatgtttgtggtgatattgaaagagcagttcctcatttctttcttcatctcnttcacactatcattagtgctataaggagacccagcatggcgtat

SEQ ID NO: 409425 - DNA, 140 bp, Artificial Sequence
  Synthetic
aggccctggctgctgatatggcagcgaggactgtggaacttctgggacacagcagtctcaagggactgagactggggtgggaaggcctcaagtatctgtggaatcttctgttatattggggaccttttgggacagcggtg

SEQ ID NO: 409426 - DNA, 140 bp, Artificial Sequence
  Synthetic
caccgctgtcccaaaaggtccccaatataacagaagattccacagatacttgaggccttcccaccccagtctcagtcccttgagactgctgtgtcccagaagttccacagtcctcgctgccatatcagcagccagggcct

SEQ ID NO: 409427 - DNA, 140 bp, Artificial Sequence
  Synthetic
atacgccatgctgggtctcccaccaccactgagaagccaacactagaggtgcaaaactgctctttcaatgtagctacagtagtaagagataagagaaaggaagcatctgcgcttttttatcgtacttgggagtcggccat

SEQ ID NO: 409428 - DNA, 140 bp, Artificial Sequence
  Synthetic
atggccgactcccaagtacgataaaaaagcgcagatgcttcctttctcttatctcttactactgtagctacattgaaagagcagttttgcacctctagtgttggcttctcagtggtggtgggagacccagcatggcgtat

SEQ ID NO: 409429 - DNA, 140 bp, Artificial Sequence
  Synthetic
aggccctggctgctgatatgggaaatatgaaggacaattggagaagtgaattatataaatataaagtagtacaaattgaaccagtaggagtagcacccaccaaggcaaagagaagagtgggaccttttgggacagcggtg

SEQ ID NO: 409430 - DNA, 140 bp, Artificial Sequence
  Synthetic
caccgctgtcccaaaaggtcccactcttctctttgccttggtgggtgctactcctactggttcaatttgtactactttatatttatataattcacttctccaattgtccttcatatttcccatatcagcagccagggcct

SEQ ID NO: 409431 - DNA, 140 bp, Artificial Sequence
  Synthetic
atacgccatgctgggtctccatacacaaataggaccagggcaaacattctatgcaagcaggatgataataggagacataagacaagcacattgtaacattagtgaagaaaaatggaagagcgtacttgggagtcggccat

SEQ ID NO: 409432 - DNA, 140 bp, Artificial Sequence
  Synthetic
atggccgactcccaagtacgctcttccatttttcttcactaatgttacaatgtgcttgtcttatgtctcctattatcatcctgcttgcatagaatgtttgccctggtcctatttgtgtatggagacccagcatggcgtat

SEQ ID NO: 409433 - DNA, 140 bp, Artificial Sequence
  Synthetic
  misc_feature (47)..(47): n is a, c, g, or t
  misc_feature (96)..(96): n is a, c, g, or t
atacgccatgctgggtctccgcagtagctgagggaacagatagggtnatagaagtagtacaaagattttgtagggctatcctccacatacctacangaataagacagggcttggaaagggcgtacttgggagtcggccat

SEQ ID NO: 409434 - DNA, 140 bp, Artificial Sequence
  Synthetic
  misc_feature (45)..(45): n is a, c, g, or t
  misc_feature (94)..(94): n is a, c, g, or t
atggccgactcccaagtacgccctttccaagccctgtcttattcntgtaggtatgtggaggatagccctacaaaatctttgtactacttctatnaccctatctgttccctcagctactgcggagacccagcatggcgtat

SEQ ID NO: 409435 - DNA, 140 bp, Artificial Sequence
  Synthetic
atacgccatgctgggtctccaggaatttggggttgctctggaaaacacatttgcaccactactgtgccctgggaccctgaatggagtaataaaacttacgatgagatttgggggaacatgcgtacttgggagtcggccat

SEQ ID NO: 409436 - DNA, 140 bp, Artificial Sequence
  Synthetic
atggccgactcccaagtacgcatgttcccccaaatctcatcgtaagttttattactccattcagggtcccagggcacagtagtggtgcaaatgtgttttccagagcaaccccaaattcctggagacccagcatggcgtat

SEQ ID NO: 409437 - DNA, 140 bp, Artificial Sequence
  Synthetic
atacgccatgctgggtctccggctaatgtaagggaaagaatggtacaagctgagccagcagcagaaggggtgggaccagtatctcgagacctggaaaaacatggagcaatcacaagcaaccgtacttgggagtcggccat

SEQ ID NO: 409438 - DNA, 140 bp, Artificial Sequence
  Synthetic
atggccgactcccaagtacggttgcttgtgattgctccatgtttttccaggtctcgagatactggtcccaccccttctgctgctggctcagcttgtaccattctttcccttacattagccggagacccagcatggcgtat

SEQ ID NO: 409439 - DNA, 140 bp, Artificial Sequence
  Synthetic
aggccctggctgctgatatgtgttggaattggacaagtgggcaagtctgtggaattggtttaacataacaaactggctatggtatataaaaatattcataatgatagtaggaggcttgatgaccttttgggacagcggtg

SEQ ID NO: 409440 - DNA, 140 bp, Artificial Sequence
  Synthetic
caccgctgtcccaaaaggtcatcaagcctcctactatcattatgaatatttttatataccatagccagtttgttatgttaaaccaattccacagacttgcccacttgtccaattccaacacatatcagcagccagggcct

SEQ ID NO: 409441 - DNA, 140 bp, Artificial Sequence
  Synthetic
aggccctggctgctgatatgattgcagcgaggattgtggaacttctgggacgcagggggtgggaagccctcaaatatctgtggaatctcctgcagtattggagtcaggaactaaagaatagaccttttgggacagcggtg

SEQ ID NO: 409442 - DNA, 140 bp, Artificial Sequence
  Synthetic
caccgctgtcccaaaaggtctattctttagttcctgactccaatactgcaggagattccacagatatttgagggcttcccaccccctgcgtcccagaagttccacaatcctcgctgcaatcatatcagcagccagggcct

SEQ ID NO: 409443 - DNA, 140 bp, Artificial Sequence
  Synthetic
atacgccatgctgggtctccgaagggggaaataaaaaattgctctttcaatacaaccacagaattaagagataagaatcagaaggtgtatgcatttttttatagacctgatctagtgccacgtacttgggagtcggccat

SEQ ID NO: 409444 - DNA, 140 bp, Artificial Sequence
  Synthetic
atggccgactcccaagtacgtggcactagatcaggtctataaaaaaatgcatacaccttctgattcttatctcttaattctgtggttgtattgaaagagcaattttttatttcccccttcggagacccagcatggcgtat

SEQ ID NO: 409445 - DNA, 140 bp, Artificial Sequence
  Synthetic
aggccctggctgctgatatggaaattaattgtacaagacccaacaacaatacaagaaaaagtatacctataggaccagggagagcattttatacaacaggagaaataataggagatataagaccttttgggacagcggtg

SEQ ID NO: 409446 - DNA, 140 bp, Artificial Sequence
  Synthetic
caccgctgtcccaaaaggtcttatatctcctattatttctcctgttgtataaaatgctctccctggtcctataggtatactttttcttgtattgttgttgggtcttgtacaattaatttccatatcagcagccagggcct

SEQ ID NO: 409447 - DNA, 140 bp, Artificial Sequence
  Synthetic
atacgccatgctgggtctcctaagctttgaaccatcatccccaggaggggacctagaagttacaacacatagttttaattgtagaggagaatttttctattgcgatacaacaagactgttcgtacttgggagtcggccat

SEQ ID NO: 409448 - DNA, 140 bp, Artificial Sequence
  Synthetic
atggccgactcccaagtacgaacagtcttgttgtatcgcaatagaaaaattctcctctacaattaaaactatgtgttgtaacttctaggtcccctcctggggatgatggttcaaagcttaggagacccagcatggcgtat

SEQ ID NO: 409449 - DNA, 140 bp, Artificial Sequence
  Synthetic
aggccctggctgctgatatgggggtacctgtgtggaaagaagcaaacaccactctattttgtgcatcagatgcaaaggcatatgacaaagaggcacataatgtctgggccacacatgcctgaccttttgggacagcggtg

SEQ ID NO: 409450 - DNA, 140 bp, Artificial Sequence
  Synthetic
caccgctgtcccaaaaggtcaggcatgtgtggcccagacattatgtgcctctttgtcatatgcctttgcatctgatgcacaaaatagagtggtgtttgcttctttccacacaggtacccccatatcagcagccagggcct

SEQ ID NO: 409451 - DNA, 140 bp, Artificial Sequence
  Synthetic
atacgccatgctgggtctccactaaagccactagcaaccccctgaggaagatcaaggagcaacaaaactgttccttcaatatgaccacagtagtaaatgacaagaggcgggaagtacatgcgtacttgggagtcggccat

SEQ ID NO: 409452 - DNA, 140 bp, Artificial Sequence
  Synthetic
atggccgactcccaagtacgcatgtacttcccgcctcttgtcatttactactgtggtcatattgaaggaacagttttgttgctccttgatcttcctcagggggttgctagtggctttagtggagacccagcatggcgtat

SEQ ID NO: 409453 - DNA, 140 bp, Artificial Sequence
  Synthetic
aggccctggctgctgatatgcaagcagtgaggaccatcaaaatcctatatcaaagcagtaagtatatgtaatggttgatttactagcaaaagtagattatagattaggagtaggggcactgaccttttgggacagcggtg

SEQ ID NO: 409454 - DNA, 140 bp, Artificial Sequence
  Synthetic
caccgctgtcccaaaaggtcagtgcccctactcctaatctataatctacttttgctagtaaatcaaccattacatatacttactgctttgatataggattttgatggtcctcactgcttgcatatcagcagccagggcct

SEQ ID NO: 409455 - DNA, 140 bp, Artificial Sequence
  Synthetic
atacgccatgctgggtctccaactcaattgctattaaatggcagcctagcagaagataggatagtaataagatctcaaaatatctcatctaatacaaaaaatataatagtacatcttaatcgtacttgggagtcggccat

SEQ ID NO: 409456 - DNA, 140 bp, Artificial Sequence
  Synthetic
atggccgactcccaagtacgattaagatgtactattatattttttgtattagatgagatattttgagatcttattactatcctatcttctgctaggctgccatttaatagcaattgagttggagacccagcatggcgtat

SEQ ID NO: 409457 - DNA, 140 bp, Artificial Sequence
  Synthetic
atacgccatgctgggtctccactttagaacaggtaaggacagagttaacaaagcttatcaataaaacagtaatatttgagtcacccataggaggggacctagaagttacaagccatagttcgtacttgggagtcggccat

SEQ ID NO: 409458 - DNA, 140 bp, Artificial Sequence
  Synthetic
atggccgactcccaagtacgaactatggcttgtaacttctaggtcccctcctatgggtgactcaaatattactgttttattgataagctttgttaactctgtccttacctgttctaaagtggagacccagcatggcgtat

SEQ ID NO: 409459 - DNA, 140 bp, Artificial Sequence
  Synthetic
aggccctggctgctgatatgactttaagatgtacaaatgctacctacaataatgataataacatggatggaaaaaattgctctttcaatgtaaccacagaattaagagataagacaaagcgaccttttgggacagcggtg

SEQ ID NO: 409460 - DNA, 140 bp, Artificial Sequence
  Synthetic
caccgctgtcccaaaaggtcgctttgtcttatctcttaattctgtggttacattgaaagagcaattttttccatccatgttattatcattattgtaggtagcatttgtacatcttaaagtcatatcagcagccagggcct

SEQ ID NO: 409461 - DNA, 140 bp, Artificial Sequence
  Synthetic
aggccctggctgctgatatgatggttatctatcaatacatggatgatttgtatgtaggatctgacttagaaatagggcagcatagaataaaaatagaggaattaaggggacacctattgagaccttttgggacagcggtg

SEQ ID NO: 409462 - DNA, 140 bp, Artificial Sequence
  Synthetic
caccgctgtcccaaaaggtctcaataggtgtccccttaattcctctatttttattctatgctgccctatttctaagtcagatcctacatacaaatcatccatgtattgatagataaccatcatatcagcagccagggcct

SEQ ID NO: 409463 - DNA, 140 bp, Artificial Sequence
  Synthetic
aggccctggctgctgatatgcagctgctgcaagctatccagataataaagatcctgtaccagagcagtaagtaacgctaatgcatcaaagggacttgctaatcttaatagctgttagtatgaccttttgggacagcggtg

SEQ ID NO: 409464 - DNA, 140 bp, Artificial Sequence
  Synthetic
caccgctgtcccaaaaggtcatactaacagctattaagattagcaagtccctttgatgcattagcgttacttactgctctggtacaggatctttattatctggatagcttgcagcagctgcatatcagcagccagggcct

SEQ ID NO: 409465 - DNA, 140 bp, Artificial Sequence
  Synthetic
atacgccatgctgggtctccatactataataataagacaataaaatttgatcaaccctcaggaggggatctagaaattacatcacatagctttaattgtagaggagaatttttctattgccgtacttgggagtcggccat

SEQ ID NO: 409466 - DNA, 140 bp, Artificial Sequence
  Synthetic
atggccgactcccaagtacggcaatagaaaaattctcctctacaattaaagctatgtgatgtaatttctagatcccctcctgagggttgatcaaattttattgtcttattattatagtatggagacccagcatggcgtat

SEQ ID NO: 409467 - DNA, 140 bp, Artificial Sequence
  Synthetic
aggccctggctgctgatatgtggagtcaggaactaaagaatagtgctattagcttgcttaacaccacagcaatagtagtagctgaggggacagacagagttctagaagctttgcaaagaggaccttttgggacagcggtg

SEQ ID NO: 409468 - DNA, 140 bp, Artificial Sequence
  Synthetic
caccgctgtcccaaaaggtcctctttgcaaagcttctagaactctgtctgtcccctcagctactactattgctgtggtgttaagcaagctaatagcactattctttagttcctgactccacatatcagcagccagggcct

SEQ ID NO: 409469 - DNA, 140 bp, Artificial Sequence
  Synthetic
atacgccatgctgggtctccggggtgggatcagtatctcaagatttagaaagacggggggcaattacaagcaacaatacagcagccactaatcctgacgtggcctgggtagaagcacaagcgtacttgggagtcggccat

SEQ ID NO: 409470 - DNA, 140 bp, Artificial Sequence
  Synthetic
atggccgactcccaagtacgcttgtgcttctacccaggccacgtcaggattagtggctgctgtattgttgcttgtaattgccccccgtctttctaaatcttgagatactgatcccaccccggagacccagcatggcgtat

SEQ ID NO: 409471 - DNA, 140 bp, Artificial Sequence
  Synthetic
atacgccatgctgggtctcccatccctcccgacaggatcggaggagattagatcattatataatacagtagcagtcctctattatgtacatcaaaggatacctgtaaaagataccaaagacgtacttgggagtcggccat

SEQ ID NO: 409472 - DNA, 140 bp, Artificial Sequence
  Synthetic
atggccgactcccaagtacgtctttggtatcttttacaggtatcctttgatgtacataatagaggactgctactgtattatataatgatctaatctcctccgatcctgtcgggagggatgggagacccagcatggcgtat

SEQ ID NO: 409473 - DNA, 140 bp, Artificial Sequence
  Synthetic
aggccctggctgctgatatggcagtcctctattatgtacatcaaaggatacctgtaaaagataccaaagaagctttagagaagttagaggaagagcaaaacaaaagtcagcgaaagccacgaccttttgggacagcggtg

SEQ ID NO: 409474 - DNA, 140 bp, Artificial Sequence
  Synthetic
caccgctgtcccaaaaggtcgtggctttcgctgacttttgttttgctcttcctctaacttctctaaagcttctttggtatcttttacaggtatcctttgatgtacataatagaggactgccatatcagcagccagggcct

SEQ ID NO: 409475 - DNA, 140 bp, Artificial Sequence
  Synthetic
aggccctggctgctgatatggacagatccattcgattagtgaacggattattagcacttgtctgggacgacatacggagcctgtgccttttcagctaccaccgattgagagacttcatatgaccttttgggacagcggtg

SEQ ID NO: 409476 - DNA, 140 bp, Artificial Sequence
  Synthetic
caccgctgtcccaaaaggtcatatgaagtctctcaatcggtggtagctgaaaaggcacaggctccgtatgtcgtcccagacaagtgctaataatccgttcactaatcgaatggatctgtccatatcagcagccagggcct

SEQ ID NO: 409477 - DNA, 140 bp, Artificial Sequence
  Synthetic
aggccctggctgctgatatggttttgcagaatctgctataaggaaagccatattaggacatatagttactcctaggtgtaattatcaagcaggacataacaaggtaggatctttacaatagaccttttgggacagcggtg

SEQ ID NO: 409478 - DNA, 140 bp, Artificial Sequence
  Synthetic
caccgctgtcccaaaaggtctattgtaaagatcctaccttgttatgtcctgcttgataattacacctaggagtaactatatgtcctaatatggctttccttatagcagattctgcaaaaccatatcagcagccagggcct

SEQ ID NO: 409479 - DNA, 140 bp, Artificial Sequence
  Synthetic
  misc_feature (77)..(77): n is a, c, g, or t
atacgccatgctgggtctccaattttttagggagaatttggccttccagcaaagggaggccagggaattttcctcanagcagactagagccatcagccccgccggcggagagcttcgggtcgtacttgggagtcggccat

SEQ ID NO: 409480 - DNA, 140 bp, Artificial Sequence
  Synthetic
  misc_feature (64)..(64): n is a, c, g, or t
atggccgactcccaagtacgacccgaagctctccgccggcggggctgatggctctagtctgctntgaggaaaattccctggcctccctttgctggaaggccaaattctccctaaaaaattggagacccagcatggcgtat

SEQ ID NO: 409481 - DNA, 140 bp, Artificial Sequence
  Synthetic
atacgccatgctgggtctccagcaatagtagcattagtagtagcgctaataatagccatagttgtgtggactatagtattcatagagtgcataagattaaaaaggcaaagaaaaatagaccgtacttgggagtcggccat

SEQ ID NO: 409482 - DNA, 140 bp, Artificial Sequence
  Synthetic
atggccgactcccaagtacggtctatttttctttgcctttttaatcttatgcactctatgaatactatagtccacacaactatggctattattagcgctactactaatgctactattgctggagacccagcatggcgtat

SEQ ID NO: 409483 - DNA, 140 bp, Artificial Sequence
  Synthetic
aggccctggctgctgatatgcgacaggcccgaaggaatcgaagaagaaggtggagagcaaggcagagacagatccatacgcttagtggatggattcttagctcttttctgggacgacctggaccttttgggacagcggtg

SEQ ID NO: 409484 - DNA, 140 bp, Artificial Sequence
  Synthetic
caccgctgtcccaaaaggtccaggtcgtcccagaaaagagctaagaatccatccactaagcgtatggatctgtctctgccttgctctccaccttcttcttcgattccttcgggcctgtcgcatatcagcagccagggcct

SEQ ID NO: 409485 - DNA, 140 bp, Artificial Sequence
  Synthetic
atacgccatgctgggtctcctggttaattgatagaataagagaaagagcagaagatagtggcaatgagagtgagggagataaagaggaattatcagcacttgtggagatggggcaccatgcgtacttgggagtcggccat

SEQ ID NO: 409486 - DNA, 140 bp, Artificial Sequence
  Synthetic
atggccgactcccaagtacgcatggtgccccatctccacaagtgctgataattcctctttatctccctcactctcattgccactatcttctgctctttctcttattctatcaattaaccaggagacccagcatggcgtat

SEQ ID NO: 409487 - DNA, 140 bp, Artificial Sequence
  Synthetic
atacgccatgctgggtctcctaccagtaatggtactgaggaaataggaatgaaaaactgctctttcaatgtaaccacagaagtaagagataagaagaagcaagtacatgcacttttttatcgtacttgggagtcggccat

SEQ ID NO: 409488 - DNA, 140 bp, Artificial Sequence
  Synthetic
atggccgactcccaagtacgataaaaaagtgcatgtacttgcttcttcttatctcttacttctgtggttacattgaaagagcagtttttcattcctatttcctcagtaccattactggtaggagacccagcatggcgtat

SEQ ID NO: 409489 - DNA, 140 bp, Artificial Sequence
  Synthetic
aggccctggctgctgatatgttcagacaggatcagaagaacttaaatcattatataatacagtagcagtcctctattgtgtgcatcaagggatagatgtaaaagacaccaaggaagctctgaccttttgggacagcggtg

SEQ ID NO: 409490 - DNA, 140 bp, Artificial Sequence
  Synthetic
caccgctgtcccaaaaggtcagagcttccttggtgtcttttacatctatcccttgatgcacacaatagaggactgctactgtattatataatgatttaagttcttctgatcctgtctgaacatatcagcagccagggcct

SEQ ID NO: 409491 - DNA, 140 bp, Artificial Sequence
  Synthetic
aggccctggctgctgatatgaagaaaaaggacagtactaaatggagaaaattagtagatttcagagaacttaataaaagaactcaagatttctgggaagttcaattaggaataccacatcgaccttttgggacagcggtg

SEQ ID NO: 409492 - DNA, 140 bp, Artificial Sequence
  Synthetic
caccgctgtcccaaaaggtcgatgtggtattcctaattgaacttcccagaaatcttgagttcttttattaagttctctgaaatctactaattttctccatttagtactgtcctttttcttcatatcagcagccagggcct

SEQ ID NO: 409493 - DNA, 140 bp, Artificial Sequence
  Synthetic
atacgccatgctgggtctccacatgggaccagggcgagcactctttacaacaaaaataataggaaagataagacaagcacattgtaatattagtggaacaggatggaataaaacgttacacgtacttgggagtcggccat

SEQ ID NO: 409494 - DNA, 140 bp, Artificial Sequence
  Synthetic
atggccgactcccaagtacgtgtaacgttttattccatcctgttccactaatattacaatgtgcttgtcttatctttcctattatttttgttgtaaagagtgctcgccctggtcccatgtggagacccagcatggcgtat

SEQ ID NO: 409495 - DNA, 140 bp, Artificial Sequence
  Synthetic
aggccctggctgctgatatgggcagaccaactaattcatatgcattattttgattgttttgcagactctgccataagaaaagccatattaggacaaatagttagccctaggtgtgaatatgaccttttgggacagcggtg

SEQ ID NO: 409496 - DNA, 140 bp, Artificial Sequence
  Synthetic
caccgctgtcccaaaaggtcatattcacacctagggctaactatttgtcctaatatggcttttcttatggcagagtctgcaaaacaatcaaaataatgcatatgaattagttggtctgcccatatcagcagccagggcct

SEQ ID NO: 409497 - DNA, 140 bp, Artificial Sequence
  Synthetic
aggccctggctgctgatatgttaaaccatcctcgggaggggacccagaaattacaacacacagctttaattgtggaggggaatttttctactgcaatacatcaggactgtttaatagcaggaccttttgggacagcggtg

SEQ ID NO: 409498 - DNA, 140 bp, Artificial Sequence
  Synthetic
caccgctgtcccaaaaggtcctgctattaaacagtcctgatgtattgcagtagaaaaattcccctccacaattaaagctgtgtgttgtaatttctgggtcccctcccgaggatggtttaacatatcagcagccagggcct

SEQ ID NO: 409499 - DNA, 140 bp, Artificial Sequence
  Synthetic
atacgccatgctgggtctcctttcaatgtgaccacagaactaagggacaagagaagaaaagaatattcacttttttataaaattgatatagtaccacttgataaagaaaataataatagtcgtacttgggagtcggccat

SEQ ID NO: 409500 - DNA, 140 bp, Artificial Sequence
  Synthetic
atggccgactcccaagtacgactattattattttctttatcaagtggtactatatcaattttataaaaaagtgaatattcttttcttctcttgtcccttagttctgtggtcacattgaaaggagacccagcatggcgtat

SEQ ID NO: 409501 - DNA, 140 bp, Artificial Sequence
  Synthetic
atacgccatgctgggtctccagaatgagaccttcagacctggaggaggagatatgagagacaattggagaagtgaattatacaaatataaagtagtaagaattgaaccactaggtctagccgtacttgggagtcggccat

SEQ ID NO: 409502 - DNA, 140 bp, Artificial Sequence
  Synthetic
atggccgactcccaagtacggctagacctagtggttcaattcttactactttatatttgtataattcacttctccaattgtctctcatatctcctcctccaggtctgaaggtctcattctggagacccagcatggcgtat

SEQ ID NO: 409503 - DNA, 140 bp, Artificial Sequence
  Synthetic
aggccctggctgctgatatgtaccacaccagacaagaaacatcagaaagaacccccatttctttggatggggtatgaactccatcctgacaaatggacagtacagcctatacagctgccagaccttttgggacagcggtg

SEQ ID NO: 409504 - DNA, 140 bp, Artificial Sequence
  Synthetic
caccgctgtcccaaaaggtctggcagctgtataggctgtactgtccatttgtcaggatggagttcataccccatccaaagaaatgggggttctttctgatgtttcttgtctggtgtggtacatatcagcagccagggcct

SEQ ID NO: 409505 - DNA, 140 bp, Artificial Sequence
  Synthetic
atacgccatgctgggtctcctaccagacctaacaacaatacaagaaaaggtatacatctaggaccaggacaagcattctttggaacagaaaaaataacaggggatataagaaaagcacatcgtacttgggagtcggccat

SEQ ID NO: 409506 - DNA, 140 bp, Artificial Sequence
  Synthetic
atggccgactcccaagtacgatgtgcttttcttatatcccctgttattttttctgttccaaagaatgcttgtcctggtcctagatgtataccttttcttgtattgttgttaggtctggtaggagacccagcatggcgtat

SEQ ID NO: 409507 - DNA, 140 bp, Artificial Sequence
  Synthetic
aggccctggctgctgatatgctggctgtggaaagatacctaaaggatcaacagctcctaggaatttggggttgctctggaaaacacatttgcaccactaatgtgccctggaactctagctgaccttttgggacagcggtg

SEQ ID NO: 409508 - DNA, 140 bp, Artificial Sequence
  Synthetic
caccgctgtcccaaaaggtcagctagagttccagggcacattagtggtgcaaatgtgttttccagagcaaccccaaattcctaggagctgttgatcctttaggtatctttccacagccagcatatcagcagccagggcct

SEQ ID NO: 409509 - DNA, 140 bp, Artificial Sequence
  Synthetic
aggccctggctgctgatatggcagaataaagcaaattataaatatgtggcagagagtagggcaagcaatgtatgcccctcccatcccaggaataataaggtgtgaatcaaacattacagggaccttttgggacagcggtg

SEQ ID NO: 409510 - DNA, 140 bp, Artificial Sequence
  Synthetic
caccgctgtcccaaaaggtccctgtaatgtttgattcacaccttattattcctgggatgggaggggcatacattgcttgccctactctctgccacatatttataatttgctttattctgccatatcagcagccagggcct

SEQ ID NO: 409511 - DNA, 140 bp, Artificial Sequence
  Synthetic
atacgccatgctgggtctccaattgctctttcagtgtatcaacagaattaaaagataagaaacagaaacaaaatgcacttttttatacacttgatatagtaccacttaatgagaataacgcgtacttgggagtcggccat

SEQ ID NO: 409512 - DNA, 140 bp, Artificial Sequence
  Synthetic
atggccgactcccaagtacgcgttattctcattaagtggtactatatcaagtgtataaaaaagtgcattttgtttctgtttcttatcttttaattctgttgatacactgaaagagcaattggagacccagcatggcgtat

SEQ ID NO: 409513 - DNA, 140 bp, Artificial Sequence
  Synthetic
atacgccatgctgggtctcctatcagagccaagaactaaagaatagtgctactagcttgtttaataccatagccatagcagtagctaagaggacagatagaatcatagacatattacaaacgtacttgggagtcggccat

SEQ ID NO: 409514 - DNA, 140 bp, Artificial Sequence
  Synthetic
atggccgactcccaagtacgtttgtaatatgtctatgattctatctgtcctcttagctactgctatggctatggtattaaacaagctagtagcactattctttagttcttggctctgataggagacccagcatggcgtat

SEQ ID NO: 409515 - DNA, 140 bp, Artificial Sequence
  Synthetic
aggccctggctgctgatatgaagacagggcttggaaagggctttactataaaatgggtggcaaatggtcaaaaaatagtatagttggatggcctgctataagggaaagaataagaagaacgaccttttgggacagcggtg

SEQ ID NO: 409516 - DNA, 140 bp, Artificial Sequence
  Synthetic
caccgctgtcccaaaaggtcgttcttcttattctttcccttatagcaggccatccaactatactattttttgaccatttgccacccattttatagtaaagccctttccaagccctgtcttcatatcagcagccagggcct

SEQ ID NO: 409517 - DNA, 140 bp, Artificial Sequence
  Synthetic
aggccctggctgctgatatgaaaaatagtatagttggatggcctgctataagggaaagaataagaagaactgatccagtagcagaaggggtgggagcagcatctcgggacctaggaaagcgaccttttgggacagcggtg

SEQ ID NO: 409518 - DNA, 140 bp, Artificial Sequence
  Synthetic
caccgctgtcccaaaaggtcgctttcctaggtcccgagatgctgctcccaccccttctgctactggatcagttcttcttattctttcccttatagcaggccatccaactatactatttttcatatcagcagccagggcct

SEQ ID NO: 409519 - DNA, 140 bp, Artificial Sequence
  Synthetic
aggccctggctgctgatatgagccatagcagtagctaagaggacagatagaatcatagacatattacaaaaattttttagagctatcatccatatacctacaagaataagacaaagcttagaccttttgggacagcggtg

SEQ ID NO: 409520 - DNA, 140 bp, Artificial Sequence
  Synthetic
caccgctgtcccaaaaggtctaagctttgtcttattcttgtaggtatatggatgatagctctaaaaaatttttgtaatatgtctatgattctatctgtcctcttagctactgctatggctcatatcagcagccagggcct

SEQ ID NO: 409521 - DNA, 140 bp, Artificial Sequence
  Synthetic
aggccctggctgctgatatgtaggtgtaactatcaagcaggacataacaaggtaggatccctacaatatttggcactaacagcattagtagctccaaagaagacaaagccacctttgcctgaccttttgggacagcggtg

SEQ ID NO: 409522 - DNA, 140 bp, Artificial Sequence
  Synthetic
caccgctgtcccaaaaggtcaggcaaaggtggctttgtcttctttggagctactaatgctgttagtgccaaatattgtagggatcctaccttgttatgtcctgcttgatagttacacctacatatcagcagccagggcct

SEQ ID NO: 409523 - DNA, 140 bp, Artificial Sequence
  Synthetic
atacgccatgctgggtctccagagttatagaagtaggacaagaaattggtagagctcttcttcacatacctagaagaatcagacaggggttagaaagggctttgctataacaataacatgcgtacttgggagtcggccat

SEQ ID NO: 409524 - DNA, 140 bp, Artificial Sequence
  Synthetic
atggccgactcccaagtacgcatgttattgttatagcaaagccctttctaacccctgtctgattcttctaggtatgtgaagaagagctctaccaatttcttgtcctacttctataactctggagacccagcatggcgtat

SEQ ID NO: 409525 - DNA, 140 bp, Artificial Sequence
  Synthetic
atacgccatgctgggtctcctatggggctgctctggaaaactcatctgcaccacttctgtgccttggaatgaaagttggagtaatatatcttatgacacaatttggggtaacatgacttgcgtacttgggagtcggccat

SEQ ID NO: 409526 - DNA, 140 bp, Artificial Sequence
  Synthetic
atggccgactcccaagtacgcaagtcatgttaccccaaattgtgtcataagatatattactccaactttcattccaaggcacagaagtggtgcagatgagttttccagagcagccccataggagacccagcatggcgtat

SEQ ID NO: 409527 - DNA, 140 bp, Artificial Sequence
  Synthetic
aggccctggctgctgatatgtgggtcacagtctattatggggtacctgtgtggagagaagcaacaactactctattttgtgcatcagatgctaaggcatatgatgaagaggcacacaatggaccttttgggacagcggtg

SEQ ID NO: 409528 - DNA, 140 bp, Artificial Sequence
  Synthetic
caccgctgtcccaaaaggtccattgtgtgcctcttcatcatatgccttagcatctgatgcacaaaatagagtagttgttgcttctctccacacaggtaccccataatagactgtgacccacatatcagcagccagggcct

SEQ ID NO: 409529 - DNA, 140 bp, Artificial Sequence
  Synthetic
aggccctggctgctgatatgggatggcctactgtaagggaaagaatgagacgagctgagccagcagcagatggggtgggagcagtatctcgagacctggaaaaacatggagcaatcacaagaccttttgggacagcggtg

SEQ ID NO: 409530 - DNA, 140 bp, Artificial Sequence
  Synthetic
caccgctgtcccaaaaggtcttgtgattgctccatgtttttccaggtctcgagatactgctcccaccccatctgctgctggctcagctcgtctcattctttcccttacagtaggccatcccatatcagcagccagggcct

SEQ ID NO: 409531 - DNA, 140 bp, Artificial Sequence
  Synthetic
atacgccatgctgggtctccgcaattttaaaggtccaaagaaaagcattaagtgtctcaactgtggcaaagaagggcacacagcaaaaaattgcagagctcctaagaagagaggatgctgcgtacttgggagtcggccat

SEQ ID NO: 409532 - DNA, 140 bp, Artificial Sequence
  Synthetic
atggccgactcccaagtacgcagcatcctctcttcttaggagctctgcaattttttgctgtgtgcccttctttgccacagttgagacacttaatgcttttctttggacctttaaaattgcggagacccagcatggcgtat

SEQ ID NO: 409533 - DNA, 140 bp, Artificial Sequence
  Synthetic
  misc_feature (92)..(92): n is a, c, g, or t
  misc_feature (105)..(105): n is a, c, g, or t
atacgccatgctgggtctccaagataagacaaagcaaatgcgtacacttttttatagccttgatatagaactaatcaacaaacaaagtaaanacaatagaactantaaagagtatatattcgtacttgggagtcggccat

SEQ ID NO: 409534 - DNA, 140 bp, Artificial Sequence
  Synthetic
  misc_feature (36)..(36): n is a, c, g, or t
  misc_feature (49)..(49): n is a, c, g, or t
atggccgactcccaagtacgaatatatactctttantagttctattgtntttactttgtttgttgattagttctatatcaaggctataaaaaagtgtacgcatttgctttgtcttatcttggagacccagcatggcgtat

SEQ ID NO: 409535 - DNA, 140 bp, Artificial Sequence
  Synthetic
  misc_feature (42)..(42): n is a, c, g, or t
  misc_feature (55)..(55): n is a, c, g, or t
aggccctggctgctgatatgctaatcaacaaacaaagtaaanacaatagaactantaaagagtatatattaagaagttgtaatacctcaaccatgacacaggcttgtccaaagatatcttgaccttttgggacagcggtg

SEQ ID NO: 409536 - DNA, 140 bp, Artificial Sequence
  Synthetic
  misc_feature (86)..(86): n is a, c, g, or t
  misc_feature (99)..(99): n is a, c, g, or t
caccgctgtcccaaaaggtcaagatatctttggacaagcctgtgtcatggttgaggtattacaacttcttaatatatactctttantagttctattgtntttactttgtttgttgattagcatatcagcagccagggcct

SEQ ID NO: 409537 - DNA, 140 bp, Artificial Sequence
  Synthetic
  misc_feature (24)..(24): n is a, c, g, or t
  misc_feature (60)..(60): n is a, c, g, or t
  misc_feature (84)..(84): n is a, c, g, or t
  misc_feature (103)..(103): n is a, c, g, or t
  misc_feature (116)..(116): n is a, c, g, or t
atacgccatgctgggtctccaagngtaataataaaactttcaatgggaaagggccatgcnacaatgtcagcacaggacaatgtncacatgggattaagccagnggtatcaactcanctgccgtacttgggagtcggccat

SEQ ID NO: 409538 - DNA, 140 bp, Artificial Sequence
  Synthetic
  misc_feature (25)..(25): n is a, c, g, or t
  misc_feature (38)..(38): n is a, c, g, or t
  misc_feature (57)..(57): n is a, c, g, or t
  misc_feature (81)..(81): n is a, c, g, or t
  misc_feature (117)..(117): n is a, c, g, or t
atggccgactcccaagtacggcagntgagttgataccnctggcttaatcccatgtgnacattgtcctgtgctgacattgtngcatggccctttcccattgaaagttttattattacncttggagacccagcatggcgtat

SEQ ID NO: 409539 - DNA, 140 bp, Artificial Sequence
  Synthetic
atacgccatgctgggtctccctgaagtaagagaaagaataaggagaactagtccaggagcagcagagggagtaggaacagcatctcaagacttacagaaacatggggcacttacaactagcgtacttgggagtcggccat

SEQ ID NO: 409540 - DNA, 140 bp, Artificial Sequence
  Synthetic
atggccgactcccaagtacgctagttgtaagtgccccatgtttctgtaagtcttgagatgctgttcctactccctctgctgctcctggactagttctccttattctttctcttacttcagggagacccagcatggcgtat

SEQ ID NO: 409541 - DNA, 140 bp, Artificial Sequence
  Synthetic
atacgccatgctgggtctccgtcaccacaaacataagagataaggtacagaaagaatctgcacttttttataaaactgatgtagtaccaatagataataataagactagtaatagggatacgtacttgggagtcggccat

SEQ ID NO: 409542 - DNA, 140 bp, Artificial Sequence
  Synthetic
atggccgactcccaagtacgtatccctattactagtcttattattatctattggtactacatcagttttataaaaaagtgcagattctttctgtaccttatctcttatgtttgtggtgacggagacccagcatggcgtat

SEQ ID NO: 409543 - DNA, 140 bp, Artificial Sequence
  Synthetic
atacgccatgctgggtctccaattaattgtacaagacccaataacaatacaagaaagggtgtacagcttgcaccaggggcagcattatatgcaacaggtgcgataataggagacataagacgtacttgggagtcggccat

SEQ ID NO: 409544 - DNA, 140 bp, Artificial Sequence
  Synthetic
atggccgactcccaagtacgtcttatgtctcctattatcgcacctgttgcatataatgctgcccctggtgcaagctgtacaccctttcttgtattgttattgggtcttgtacaattaattggagacccagcatggcgtat

SEQ ID NO: 409545 - DNA, 140 bp, Artificial Sequence
  Synthetic
aggccctggctgctgatatgcaccaggggcagcattatatgcaacaggtgcgataataggagacataagaaaagcacattgtaatattagtggatcaaaatgggaagaaactttaaaaaagaccttttgggacagcggtg

SEQ ID NO: 409546 - DNA, 140 bp, Artificial Sequence
  Synthetic
caccgctgtcccaaaaggtcttttttaaagtttcttcccattttgatccactaatattacaatgtgcttttcttatgtctcctattatcgcacctgttgcatataatgctgcccctggtgcatatcagcagccagggcct

SEQ ID NO: 409547 - DNA, 140 bp, Artificial Sequence
  Synthetic
atacgccatgctgggtctccttgcctcaccacccccaggaggggacatagaaattacaacacatatgtttaattgtggaggagaatttttctactgcaatacatcaaaattgtttaatcacgtacttgggagtcggccat

SEQ ID NO: 409548 - DNA, 140 bp, Artificial Sequence
  Synthetic
atggccgactcccaagtacgtgattaaacaattttgatgtattgcagtagaaaaattctcctccacaattaaacatatgtgttgtaatttctatgtcccctcctgggggtggtgaggcaaggagacccagcatggcgtat

SEQ ID NO: 409549 - DNA, 140 bp, Artificial Sequence
  Synthetic
atacgccatgctgggtctccataataatgccacttgtgttaataacatgaaggaagaaataaaaaattgctctttcagtataaccacagtgataagagataagcaaaagcaagtgtatgccgtacttgggagtcggccat

SEQ ID NO: 409550 - DNA, 140 bp, Artificial Sequence
  Synthetic
atggccgactcccaagtacggcatacacttgcttttgcttatctcttatcactgtggttatactgaaagagcaattttttatttcttccttcatgttattaacacaagtggcattattatggagacccagcatggcgtat

SEQ ID NO: 409551 - DNA, 140 bp, Artificial Sequence
  Synthetic
aggccctggctgctgatatgcatgtggcaggaagtaggaaaagcaatgtatgcccctcccattggaggactaattagatgttcatcaaatattacagggctgatattaacaagagatggtgaccttttgggacagcggtg

SEQ ID NO: 409552 - DNA, 140 bp, Artificial Sequence
  Synthetic
caccgctgtcccaaaaggtcaccatctcttgttaatatcagccctgtaatatttgatgaacatctaattagtcctccaatgggaggggcatacattgcttttcctacttcctgccacatgcatatcagcagccagggcct

SEQ ID NO: 409553 - DNA, 140 bp, Artificial Sequence
  Synthetic
aggccctggctgctgatatgacatagcagaataggcattactcgacagaggagaacaagaaatggagccagtagatcctagactagagccctggaagcatccaggaagtcagcctaagacgaccttttgggacagcggtg

SEQ ID NO: 409554 - DNA, 140 bp, Artificial Sequence
  Synthetic
caccgctgtcccaaaaggtcgtcttaggctgacttcctggatgcttccagggctctagtctaggatctactggctccatttcttgttctcctctgtcgagtaatgcctattctgctatgtcatatcagcagccagggcct

SEQ ID NO: 409555 - DNA, 140 bp, Artificial Sequence
  Synthetic
aggccctggctgctgatatgacatttaattcatcctcaggaggggacctagaaattacaagtcatacctttaattgtagaggagaatttttctattgtaatacatcacaactgtttaatagaccttttgggacagcggtg

SEQ ID NO: 409556 - DNA, 140 bp, Artificial Sequence
  Synthetic
caccgctgtcccaaaaggtctattaaacagttgtgatgtattacaatagaaaaattctcctctacaattaaaggtatgacttgtaatttctaggtcccctcctgaggatgaattaaatgtcatatcagcagccagggcct

SEQ ID NO: 409557 - DNA, 140 bp, Artificial Sequence
  Synthetic
aggccctggctgctgatatgtgatagaataagagaaagagcagaagatagtgaaaatgaaagtgaaggggatcaggaagacttgtcagcgcttttgggaatggggcaccttgctcattgggaccttttgggacagcggtg

SEQ ID NO: 409558 - DNA, 140 bp, Artificial Sequence
  Synthetic
caccgctgtcccaaaaggtcccaatgagcaaggtgccccattcccaaaagcgctgacaagtcttcctgatccccttcactttcattttcactatcttctgctctttctcttattctatcacatatcagcagccagggcct

SEQ ID NO: 409559 - DNA, 140 bp, Artificial Sequence
  Synthetic
atacgccatgctgggtctccccaatagcactattcataacaattatagtgctggggaggaagtagcaatgaaaaactgctctttcaatgtcaccacgagcataagagagaaggtgaagaacgtacttgggagtcggccat

SEQ ID NO: 409560 - DNA, 140 bp, Artificial Sequence
  Synthetic
atggccgactcccaagtacgttcttcaccttctctcttatgctcgtggtgacattgaaagagcagtttttcattgctacttcctccccagcactataattgttatgaatagtgctattggggagacccagcatggcgtat

SEQ ID NO: 409561 - DNA, 140 bp, Artificial Sequence
  Synthetic
  misc_feature (116)..(116): n is a, c, g, or t
atacgccatgctgggtctccgtgccaagtggtcaaaaagtagtatagtgggatggcctgctataagggatagaatgagacgagcccctccagcagcccctccagcagcagaagggngagccgtacttgggagtcggccat

SEQ ID NO: 409562 - DNA, 140 bp, Artificial Sequence
  Synthetic
  misc_feature (25)..(25): n is a, c, g, or t
atggccgactcccaagtacggctcncccttctgctgctggaggggctgctggaggggctcgtctcattctatcccttatagcaggccatcccactatactactttttgaccacttggcacggagacccagcatggcgtat

SEQ ID NO: 409563 - DNA, 140 bp, Artificial Sequence
  Synthetic
atacgccatgctgggtctcctgaacaagtagataaactagtcagtaatagaattagaaaaatactattcttagatagaataaataaggctcaagaagaacataagaaataccacaacaatcgtacttgggagtcggccat

SEQ ID NO: 409564 - DNA, 140 bp, Artificial Sequence
  Synthetic
atggccgactcccaagtacgattgttgtggtatttcttatgttcttcttgagccttatttattctatctaagaatagtatttttctaattctattactgactagtttatctacttgttcaggagacccagcatggcgtat

SEQ ID NO: 409565 - DNA, 140 bp, Artificial Sequence
  Synthetic
atacgccatgctgggtctccaacacgtcgaccaatggcagcatcacaatcaactctacagatgaaatgaaaagctgttcttttaatatgaccacagaagtaggagataggaagcagaatgcgtacttgggagtcggccat

SEQ ID NO: 409566 - DNA, 140 bp, Artificial Sequence
  Synthetic
atggccgactcccaagtacgcattctgcttcctatctcctacttctgtggtcatattaaaagaacagcttttcatttcatctgtagagttgattgtgatgctgccattggtcgacgtgttggagacccagcatggcgtat

SEQ ID NO: 409567 - DNA, 140 bp, Artificial Sequence
  Synthetic
atacgccatgctgggtctccacttgaccctggccttctagaaacaccagaaggctgtagaaaaataataagacaactacaaccatcccttcagacaggatcagaaggacttagatcactacgtacttgggagtcggccat

SEQ ID NO: 409568 - DNA, 140 bp, Artificial Sequence
  Synthetic
atggccgactcccaagtacgtagtgatctaagtccttctgatcctgtctgaagggatggttgtagttgtcttattatttttctacagccttctggtgtttctagaaggccagggtcaagtggagacccagcatggcgtat

SEQ ID NO: 409569 - DNA, 140 bp, Artificial Sequence
  Synthetic
aggccctggctgctgatatgcagttttaattgtagaggggaatttttctactgtaatacatcaaaactgtttaataatagttatattttgaatggtactagctggagtaacaatactaatgaccttttgggacagcggtg

SEQ ID NO: 409570 - DNA, 140 bp, Artificial Sequence
  Synthetic
caccgctgtcccaaaaggtcattagtattgttactccagctagtaccattcaaaatataactattattaaacagttttgatgtattacagtagaaaaattcccctctacaattaaaactgcatatcagcagccagggcct

SEQ ID NO: 409571 - DNA, 140 bp, Artificial Sequence
  Synthetic
atacgccatgctgggtctcctccaaaaataagttcagaagtacacatcccactaggagaagctagactggtagtaaaaacatattggggtctgcatacaggagaaagagaatggcatctacgtacttgggagtcggccat

SEQ ID NO: 409572 - DNA, 140 bp, Artificial Sequence
  Synthetic
atggccgactcccaagtacgtagatgccattctctttctcctgtatgcagaccccaatatgtttttactaccagtctagcttctcctagtgggatgtgtacttctgaacttatttttggaggagacccagcatggcgtat

SEQ ID NO: 409573 - DNA, 140 bp, Artificial Sequence
  Synthetic
atacgccatgctgggtctcccaggcctaatatacactttacttgaaaaatcgcaaaaccaacaagaaaaaaatgaacaagacttattggcattggataaatgggacagtttatggaattgcgtacttgggagtcggccat

SEQ ID NO: 409574 - DNA, 140 bp, Artificial Sequence
  Synthetic
atggccgactcccaagtacgcaattccataaactgtcccatttatccaatgccaataagtcttgttcatttttttcttgttggttttgcgatttttcaagtaaagtgtatattaggcctgggagacccagcatggcgtat

SEQ ID NO: 409575 - DNA, 140 bp, Artificial Sequence
  Synthetic
aggccctggctgctgatatgaaaaattggatgacagaaaccttgttggtccaaaatgcgaacccagattgtaagactattttaaaagcattaggaccaggagctacattagaagaaatgagaccttttgggacagcggtg

SEQ ID NO: 409576 - DNA, 140 bp, Artificial Sequence
  Synthetic
caccgctgtcccaaaaggtctcatttcttctaatgtagctcctggtcctaatgcttttaaaatagtcttacaatctgggttcgcattttggaccaacaaggtttctgtcatccaatttttcatatcagcagccagggcct

SEQ ID NO: 409577 - DNA, 140 bp, Artificial Sequence
  Synthetic
aggccctggctgctgatatgtgtcaacatagcagaataggcattactcgacagagaagaataagaaatggagccagtagatcctaacctagagccctggaaccatccaggaagtcagcctgaccttttgggacagcggtg

SEQ ID NO: 409578 - DNA, 140 bp, Artificial Sequence
  Synthetic
caccgctgtcccaaaaggtcaggctgacttcctggatggttccagggctctaggttaggatctactggctccatttcttattcttctctgtcgagtaatgcctattctgctatgttgacacatatcagcagccagggcct

SEQ ID NO: 409579 - DNA, 140 bp, Artificial Sequence
  Synthetic
aggccctggctgctgatatgaataatacgagaaaaagtgtaaggataggaccaggacaaacattctatgcaacagggagaataataggagatataagagaagcacattgtaacattagtagaccttttgggacagcggtg

SEQ ID NO: 409580 - DNA, 140 bp, Artificial Sequence
  Synthetic
caccgctgtcccaaaaggtctactaatgttacaatgtgcttctcttatatctcctattattctccctgttgcatagaatgtttgtcctggtcctatccttacactttttctcgtattattcatatcagcagccagggcct

SEQ ID NO: 409581 - DNA, 140 bp, Artificial Sequence
  Synthetic
aggccctggctgctgatatggactatagtaggtatagaatataagagattgctaaaacaaaggaaaatagacaggttaattaaaagaataagagaaagagcagaagacagtggcaatgaggaccttttgggacagcggtg

SEQ ID NO: 409582 - DNA, 140 bp, Artificial Sequence
  Synthetic
caccgctgtcccaaaaggtcctcattgccactgtcttctgctctttctcttattcttttaattaacctgtctattttcctttgttttagcaatctcttatattctatacctactatagtccatatcagcagccagggcct

SEQ ID NO: 409583 - DNA, 140 bp, Artificial Sequence
  Synthetic
aggccctggctgctgatatgaatagtagcattagtagtagcgctagtattagcaatagttgtgtggactatagtattcatagagtgtagaagattaagaagacaaaagaaaatagactgggaccttttgggacagcggtg

SEQ ID NO: 409584 - DNA, 140 bp, Artificial Sequence
  Synthetic
caccgctgtcccaaaaggtcccagtctattttcttttgtcttcttaatcttctacactctatgaatactatagtccacacaactattgctaatactagcgctactactaatgctactattcatatcagcagccagggcct

SEQ ID NO: 409585 - DNA, 140 bp, Artificial Sequence
  Synthetic
atacgccatgctgggtctccaggagataaagaggaattatcagcatttgtggggatggggtactgtgctccttaggatattgatgatatatagtagtgcagaaaatttgtaggtcacagtcgtacttgggagtcggccat

SEQ ID NO: 409586 - DNA, 140 bp, Artificial Sequence
  Synthetic
atggccgactcccaagtacgactgtgacctacaaattttctgcactactatatatcatcaatatcctaaggagcacagtaccccatccccacaaatgctgataattcctctttatctcctggagacccagcatggcgtat

SEQ ID NO: 409587 - DNA, 140 bp, Artificial Sequence
  Synthetic
aggccctggctgctgatatgctttaaattttccaattagccctattgagactgtaccagtaaaattgaagccaggaatggatggcccaaaggttaaacaatggccattgacagaagaaaagaccttttgggacagcggtg

SEQ ID NO: 409588 - DNA, 140 bp, Artificial Sequence
  Synthetic
caccgctgtcccaaaaggtcttttcttctgtcaatggccattgtttaacctttgggccatccattcctggcttcaattttactggtacagtctcaatagggctaattggaaaatttaaagcatatcagcagccagggcct

SEQ ID NO: 409589 - DNA, 140 bp, Artificial Sequence
  Synthetic
atacgccatgctgggtctccctccactaatagcactaatactgccaataatgtcactagtgaggacataggaatgaaaaactgttctttcaatataaccacagtattaagagataagaagcgtacttgggagtcggccat

SEQ ID NO: 409590 - DNA, 140 bp, Artificial Sequence
  Synthetic
atggccgactcccaagtacgcttcttatctcttaatactgtggttatattgaaagaacagtttttcattcctatgtcctcactagtgacattattggcagtattagtgctattagtggagggagacccagcatggcgtat

SEQ ID NO: 409591 - DNA, 140 bp, Artificial Sequence
  Synthetic
aggccctggctgctgatatgttacacaggcatgtccaaagataacctttgagccaattcccatacattattgtgccccagctggatttgcaattctaaaatgtaatgataagaagttcaagaccttttgggacagcggtg

SEQ ID NO: 409592 - DNA, 140 bp, Artificial Sequence
  Synthetic
caccgctgtcccaaaaggtcttgaacttcttatcattacattttagaattgcaaatccagctggggcacaataatgtatgggaattggctcaaaggttatctttggacatgcctgtgtaacatatcagcagccagggcct

SEQ ID NO: 409593 - DNA, 140 bp, Artificial Sequence
  Synthetic
aggccctggctgctgatatggaagaaataataattagatctgaaaatctcacaaataatgctaaaaacataatagtacaatttaccgagcctgtaaagattaattgtaccagacctaacagaccttttgggacagcggtg

SEQ ID NO: 409594 - DNA, 140 bp, Artificial Sequence
  Synthetic
caccgctgtcccaaaaggtctgttaggtctggtacaattaatctttacaggctcggtaaattgtactattatgtttttagcattatttgtgagattttcagatctaattattatttcttccatatcagcagccagggcct

SEQ ID NO: 409595 - DNA, 140 bp, Artificial Sequence
  Synthetic
atacgccatgctgggtctccacaggtgacataataagagacataagacaagcacattgtaacattagtggaataagttagaataaaactttacaacaggtagctgaaaaattaaaaggcccgtacttgggagtcggccat

SEQ ID NO: 409596 - DNA, 140 bp, Artificial Sequence
  Synthetic
atggccgactcccaagtacgggccttttaatttttcagctacctgttgtaaagttttattctaacttattccactaatgttacaatgtgcttgtcttatgtctcttattatgtcacctgtggagacccagcatggcgtat

SEQ ID NO: 409597 - DNA, 140 bp, Artificial Sequence
  Synthetic
atacgccatgctgggtctcctttttgacaacaaaacaataatctttgctccatcctcaggaggagacccagaaattacaacacacagctttaattgtggaaaagaatttttctactgtaacgtacttgggagtcggccat

SEQ ID NO: 409598 - DNA, 140 bp, Artificial Sequence
  Synthetic
atggccgactcccaagtacgttacagtagaaaaattcttttccacaattaaagctgtgtgttgtaatttctgggtctcctcctgaggatggagcaaagattattgttttgttgtcaaaaaggagacccagcatggcgtat

SEQ ID NO: 409599 - DNA, 140 bp, Artificial Sequence
  Synthetic
aggccctggctgctgatatgacccaacaacaatacaagaaaaggtatacatatgggaccagggcacgcatggcatacaacaagacaaataataggagatataagaagagcacattgtaccgaccttttgggacagcggtg

SEQ ID NO: 409600 - DNA, 140 bp, Artificial Sequence
  Synthetic
caccgctgtcccaaaaggtcggtacaatgtgctcttcttatatctcctattatttgtcttgttgtatgccatgcgtgccctggtcccatatgtataccttttcttgtattgttgttgggtcatatcagcagccagggcct

SEQ ID NO: 409601 - DNA, 140 bp, Artificial Sequence
  Synthetic
aggccctggctgctgatatgagaaaccttgttggttcaaaatgcgaacccagattgtaaaactattttaaaagcattgggaccagcagctacactagaagaaatgatgacagcatgtcaggaccttttgggacagcggtg

SEQ ID NO: 409602 - DNA, 140 bp, Artificial Sequence
  Synthetic
caccgctgtcccaaaaggtcctgacatgctgtcatcatttcttctagtgtagctgctggtcccaatgcttttaaaatagttttacaatctgggttcgcattttgaaccaacaaggtttctcatatcagcagccagggcct

SEQ ID NO: 409603 - DNA, 140 bp, Artificial Sequence
  Synthetic
aggccctggctgctgatatggaggataggaccaggacaaacattctatgcaacaggagacataataggaaatataagacaggcatattgtaacatcagtgaaagtaaatggaataaaactgaccttttgggacagcggtg

SEQ ID NO: 409604 - DNA, 140 bp, Artificial Sequence
  Synthetic
caccgctgtcccaaaaggtcagttttattccatttactttcactgatgttacaatatgcctgtcttatatttcctattatgtctcctgttgcatagaatgtttgtcctggtcctatcctccatatcagcagccagggcct

SEQ ID NO: 409605 - DNA, 140 bp, Artificial Sequence
  Synthetic
aggccctggctgctgatatgaacagctcctaggaatttggggctgctctggaaaactcatctgcaccactaatgtgccctggaactctagttggagtaataaatctcagagtgagatatggaccttttgggacagcggtg

SEQ ID NO: 409606 - DNA, 140 bp, Artificial Sequence
  Synthetic
caccgctgtcccaaaaggtccatatctcactctgagatttattactccaactagagttccagggcacattagtggtgcagatgagttttccagagcagccccaaattcctaggagctgttcatatcagcagccagggcct

SEQ ID NO: 409607 - DNA, 140 bp, Artificial Sequence
  Synthetic
atacgccatgctgggtctccctaatgtgccctagaactctagctggagtaatagatctttagaggaaatttagaacaacatgacctagatggagtaagaaagagaaattgacaattacaccgtacttgggagtcggccat

SEQ ID NO: 409608 - DNA, 140 bp, Artificial Sequence
  Synthetic
atggccgactcccaagtacggtgtaattgtcaatttctctttcttactccatctaggtcatgttgttctaaatttcctctaaagatctattactccagctagagttctagggcacattagggagacccagcatggcgtat

SEQ ID NO: 409609 - DNA, 140 bp, Artificial Sequence
  Synthetic
aggccctggctgctgatatgatttagaaggaaaagttatcctagtagcagttcatgtagccagtggatatatagaagcagaagttattccagcagaaacagggcaggaaacagcatacttgaccttttgggacagcggtg

SEQ ID NO: 409610 - DNA, 140 bp, Artificial Sequence
  Synthetic
caccgctgtcccaaaaggtcaagtatgctgtttcctgccctgtttctgctggaataacttctgcttctatatatccactggctacatgaactgctactaggataacttttccttctaaatcatatcagcagccagggcct

SEQ ID NO: 409611 - DNA, 140 bp, Artificial Sequence
  Synthetic
aggccctggctgctgatatgatgaataaggagctaaaaaagatcataagacaggtaagagatcaagctgaacatcttaagacagcagtacaaatggcagtattcattcacaattttaaaagaccttttgggacagcggtg

SEQ ID NO: 409612 - DNA, 140 bp, Artificial Sequence
  Synthetic
caccgctgtcccaaaaggtcttttaaaattgtgaatgaatactgccatttgtactgctgtcttaagatgttcagcttgatctcttacctgtcttatgatcttttttagctccttattcatcatatcagcagccagggcct

SEQ ID NO: 409613 - DNA, 140 bp, Artificial Sequence
  Synthetic
atacgccatgctgggtctccatggcctgaggttagggacagaatgagacgtgctcctgctcctgcagcagcaacaggagtaggagcagtatctcgagatttagataaacatggagcaatccgtacttgggagtcggccat

SEQ ID NO: 409614 - DNA, 140 bp, Artificial Sequence
  Synthetic
atggccgactcccaagtacggattgctccatgtttatctaaatctcgagatactgctcctactcctgttgctgctgcaggagcaggagcacgtctcattctgtccctaacctcaggccatggagacccagcatggcgtat

SEQ ID NO: 409615 - DNA, 140 bp, Artificial Sequence
  Synthetic
aggccctggctgctgatatgcaacaggagtaggagcagtatctcgagatttagataaacatggagcaatcacaagtagtaatgcaaatcaccctagttgcgtctggctggaagcacaagagaccttttgggacagcggtg

SEQ ID NO: 409616 - DNA, 140 bp, Artificial Sequence
  Synthetic
caccgctgtcccaaaaggtctcttgtgcttccagccagacgcaactagggtgatttgcattactacttgtgattgctccatgtttatctaaatctcgagatactgctcctactcctgttgcatatcagcagccagggcct

SEQ ID NO: 409617 - DNA, 140 bp, Artificial Sequence
  Synthetic
aggccctggctgctgatatggcacagactaatcctgactgtgcctggctagaagcacaagaagaggatggggacgtaggttttccagtcagacctcaggtaccattaagaccaatgacttgaccttttgggacagcggtg

SEQ ID NO: 409618 - DNA, 140 bp, Artificial Sequence
  Synthetic
caccgctgtcccaaaaggtcaagtcattggtcttaatggtacctgaggtctgactggaaaacctacgtccccatcctcttcttgtgcttctagccaggcacagtcaggattagtctgtgccatatcagcagccagggcct

SEQ ID NO: 409619 - DNA, 140 bp, Artificial Sequence
  Synthetic
aggccctggctgctgatatgctctcgacgcaggactcggcttgctgaagcgcgcacggcaagaggcgaggggcagcgaacggcgagtacgctaaaaatttttgactagcggaggctagaagaccttttgggacagcggtg

SEQ ID NO: 409620 - DNA, 140 bp, Artificial Sequence
  Synthetic
caccgctgtcccaaaaggtcttctagcctccgctagtcaaaaatttttagcgtactcgccgttcgctgcccctcgcctcttgccgtgcgcgcttcagcaagccgagtcctgcgtcgagagcatatcagcagccagggcct

SEQ ID NO: 409621 - DNA, 140 bp, Artificial Sequence
  Synthetic
aggccctggctgctgatatgaggaagctttagacaagatagaggaagaacaaaccaaaagtaagaaaaaagcacagcaagcaacagctgacacaaaaaacagcagccaggtcagccaaaagaccttttgggacagcggtg

SEQ ID NO: 409622 - DNA, 140 bp, Artificial Sequence
  Synthetic
caccgctgtcccaaaaggtcttttggctgacctggctgctgttttttgtgtcagctgttgcttgctgtgcttttttcttacttttggtttgttcttcctctatcttgtctaaagcttcctcatatcagcagccagggcct

SEQ ID NO: 409623 - DNA, 140 bp, Artificial Sequence
  Synthetic
aggccctggctgctgatatgttatcctatagtgcaaaacctacaggggcaaatggtacaccaggccatatcacctagaactttgaacgcatgggtaaaagtaatagaggagaaggctttcgaccttttgggacagcggtg

SEQ ID NO: 409624 - DNA, 140 bp, Artificial Sequence
  Synthetic
caccgctgtcccaaaaggtcgaaagccttctcctctattacttttacccatgcgttcaaagttctaggtgatatggcctggtgtaccatttgcccctgtaggttttgcactataggataacatatcagcagccagggcct

SEQ ID NO: 409625 - DNA, 140 bp, Artificial Sequence
  Synthetic
atacgccatgctgggtctccgctttgtaacaaagggcttaggcatctcctatggcaggaagaagcggagaccgcgacgcagatctcctcaaggccatcagagccatcaaaattctgtatccgtacttgggagtcggccat

SEQ ID NO: 409626 - DNA, 140 bp, Artificial Sequence
  Synthetic
atggccgactcccaagtacggatacagaattttgatggctctgatggccttgaggagatctgcgtcgcggtctccgcttcttcctgccataggagatgcctaagccctttgttacaaagcggagacccagcatggcgtat

SEQ ID NO: 409627 - DNA, 140 bp, Artificial Sequence
  Synthetic
atacgccatgctgggtctccgcaatcacaagcagtaatacagcagctactaatgctgcttgtgcctggctggaagcacaagaggaagaggaggtaggctttccagtcaggccgcaggtaccgtacttgggagtcggccat

SEQ ID NO: 409628 - DNA, 140 bp, Artificial Sequence
  Synthetic
atggccgactcccaagtacggtacctgcggcctgactggaaagcctacctcctcttcctcttgtgcttccagccaggcacaagcagcattagtagctgctgtattactgcttgtgattgcggagacccagcatggcgtat

SEQ ID NO: 409629 - DNA, 140 bp, Artificial Sequence
  Synthetic
atacgccatgctgggtctccgaggcaatgagccaagcaaccaacaacataaatgctgctataatgatgcagagaggcaattttaagggccaaaggaaaataattaagtgtttcaactgtgcgtacttgggagtcggccat

SEQ ID NO: 409630 - DNA, 140 bp, Artificial Sequence
  Synthetic
atggccgactcccaagtacgcacagttgaaacacttaattattttcctttggcccttaaaattgcctctctgcatcattatagcagcatttatgttgttggttgcttggctcattgcctcggagacccagcatggcgtat

SEQ ID NO: 409631 - DNA, 140 bp, Artificial Sequence
  Synthetic
atacgccatgctgggtctccccgctctcgaaaacagcaccctgcaggaagagtcaggggcaatacaaaactgttctttcaatatgaccacagaagtaagagataagaggatgagagtacacgtacttgggagtcggccat

SEQ ID NO: 409632 - DNA, 140 bp, Artificial Sequence
  Synthetic
atggccgactcccaagtacgtgtactctcatcctcttatctcttacttctgtggtcatattgaaagaacagttttgtattgcccctgactcttcctgcagggtgctgttttcgagagcggggagacccagcatggcgtat

SEQ ID NO: 409633 - DNA, 140 bp, Artificial Sequence
  Synthetic
aggccctggctgctgatatgaatataggctaataaattgtaatacctcaaccattacacaggcttgtccaaaggtatcttgggatccaattcccatacattattgtgctccagctggttagaccttttgggacagcggtg

SEQ ID NO: 409634 - DNA, 140 bp, Artificial Sequence
  Synthetic
caccgctgtcccaaaaggtctaaccagctggagcacaataatgtatgggaattggatcccaagatacctttggacaagcctgtgtaatggttgaggtattacaatttattagcctatattcatatcagcagccagggcct

SEQ ID NO: 409635 - DNA, 140 bp, Artificial Sequence
  Synthetic
atacgccatgctgggtctccgatatggaagatcatttgttacagtaagaaaattgggagataggaaacaagcacattgtaccatgaatagaacgaaatgggacaacgctttaaaacagatcgtacttgggagtcggccat

SEQ ID NO: 409636 - DNA, 140 bp, Artificial Sequence
  Synthetic
atggccgactcccaagtacgatctgttttaaagcgttgtcccatttcgttctattcatggtacaatgtgcttgtttcctatctcccaattttcttactgtaacaaatgatcttccatatcggagacccagcatggcgtat

SEQ ID NO: 409637 - DNA, 140 bp, Artificial Sequence
  Synthetic
atacgccatgctgggtctccgaataagacaatttgtaaacatgtggcagaaagtaggaaaagcaatgtatgcccctcccagcgatggacaaattaggtgtacatcaaatattactgggctcgtacttgggagtcggccat

SEQ ID NO: 409638 - DNA, 140 bp, Artificial Sequence
  Synthetic
atggccgactcccaagtacgagcccagtaatatttgatgtacacctaatttgtccatcgctgggaggggcatacattgcttttcctactttctgccacatgtttacaaattgtcttattcggagacccagcatggcgtat

SEQ ID NO: 409639 - DNA, 140 bp, Artificial Sequence
  Synthetic
atacgccatgctgggtctccgtgatggtactgtcacccacattaatagcataaaggaagaaataaaaaattgctctttcaatacaaccacagaaataagggataggaaacaaaatgtgcacgtacttgggagtcggccat

SEQ ID NO: 409640 - DNA, 140 bp, Artificial Sequence
  Synthetic
atggccgactcccaagtacgtgcacattttgtttcctatcccttatttctgtggttgtattgaaagagcaattttttatttcttcctttatgctattaatgtgggtgacagtaccatcacggagacccagcatggcgtat

SEQ ID NO: 409641 - DNA, 140 bp, Artificial Sequence
  Synthetic
aggccctggctgctgatatgacagctcctagggctttggggttgctctggaaaactcatctgtaccactgatgtgctctggaactccagttggagcaataaaacttttgagaaaatttgggaccttttgggacagcggtg

SEQ ID NO: 409642 - DNA, 140 bp, Artificial Sequence
  Synthetic
caccgctgtcccaaaaggtcccaaattttctcaaaagttttattgctccaactggagttccagagcacatcagtggtacagatgagttttccagagcaaccccaaagccctaggagctgtcatatcagcagccagggcct

SEQ ID NO: 409643 - DNA, 140 bp, Artificial Sequence
  Synthetic
aggccctggctgctgatatgaataaaacaataatatttgggccaccttcaggaggggacctagagattacaacacacagctttaattgtagaggagaatttttctattgtaatacatcaagaccttttgggacagcggtg

SEQ ID NO: 409644 - DNA, 140 bp, Artificial Sequence
  Synthetic
caccgctgtcccaaaaggtcttgatgtattacaatagaaaaattctcctctacaattaaagctgtgtgttgtaatctctaggtcccctcctgaaggtggcccaaatattattgttttattcatatcagcagccagggcct

SEQ ID NO: 409645 - DNA, 140 bp, Artificial Sequence
  Synthetic
aggccctggctgctgatatgagaataaaacagattataaacatgtggcagaaggtaggacgagcaatgtatgcccctcccattgaaggaaacataacatgtaggtcaaatatcacaggacgaccttttgggacagcggtg

SEQ ID NO: 409646 - DNA, 140 bp, Artificial Sequence
  Synthetic
caccgctgtcccaaaaggtcgtcctgtgatatttgacctacatgttatgtttccttcaatgggaggggcatacattgctcgtcctaccttctgccacatgtttataatctgttttattctcatatcagcagccagggcct

SEQ ID NO: 409647 - DNA, 140 bp, Artificial Sequence
  Synthetic
aggccctggctgctgatatgttcatattaattgcagcgaggattgtggacaggggactgaagggggggtgggaagccctcaaatatctgtggaatctcacgcagtattggggccaggaatgaccttttgggacagcggtg

SEQ ID NO: 409648 - DNA, 140 bp, Artificial Sequence
  Synthetic
caccgctgtcccaaaaggtcattcctggccccaatactgcgtgagattccacagatatttgagggcttcccacccccccttcagtcccctgtccacaatcctcgctgcaattaatatgaacatatcagcagccagggcct

SEQ ID NO: 409649 - DNA, 140 bp, Artificial Sequence
  Synthetic
aggccctggctgctgatatgcctaaaggatcaacagctcctaggactttggggctgctctggaaaactcatctgcaccactgctgtgccttggaactccagttggagtaataaatctcaagaccttttgggacagcggtg

SEQ ID NO: 409650 - DNA, 140 bp, Artificial Sequence
  Synthetic
caccgctgtcccaaaaggtcttgagatttattactccaactggagttccaaggcacagcagtggtgcagatgagttttccagagcagccccaaagtcctaggagctgttgatcctttaggcatatcagcagccagggcct

SEQ ID NO: 409651 - DNA, 140 bp, Artificial Sequence
  Synthetic
atacgccatgctgggtctccaggaagtaggaatgaaaaactgctctttcaatgtcaccacaagcataagagataaggtaaaaaaagaacatgcacttttctataaccttgatatagtacacgtacttgggagtcggccat

SEQ ID NO: 409652 - DNA, 140 bp, Artificial Sequence
  Synthetic
atggccgactcccaagtacgtgtactatatcaaggttatagaaaagtgcatgttctttttttaccttatctcttatgcttgtggtgacattgaaagagcagtttttcattcctacttcctggagacccagcatggcgtat

SEQ ID NO: 409653 - DNA, 140 bp, Artificial Sequence
  Synthetic
aggccctggctgctgatatggcatggacaagtagactgtagtccaggaatatggcaattagattgtacacatttagaaggaaaagttatcctggtagcagtccatgtagccagtggctatgaccttttgggacagcggtg

SEQ ID NO: 409654 - DNA, 140 bp, Artificial Sequence
  Synthetic
caccgctgtcccaaaaggtcatagccactggctacatggactgctaccaggataacttttccttctaaatgtgtacaatctaattgccatattcctggactacagtctacttgtccatgccatatcagcagccagggcct

SEQ ID NO: 409655 - DNA, 140 bp, Artificial Sequence
  Synthetic
atacgccatgctgggtctccacaggaagtaaaaaactgcactttcaatatgaccacagagctaagggataagagacagaaggtatcttcattgttttataaacttgatatagtaccaattcgtacttgggagtcggccat

SEQ ID NO: 409656 - DNA, 140 bp, Artificial Sequence
  Synthetic
atggccgactcccaagtacgaattggtactatatcaagtttataaaacaatgaagataccttctgtctcttatcccttagctctgtggtcatattgaaagtgcagttttttacttcctgtggagacccagcatggcgtat

SEQ ID NO: 409657 - DNA, 140 bp, Artificial Sequence
  Synthetic
aggccctggctgctgatatggggaccagcggctacactagaagaaatgatgacagcatgtcagggagtgggaggacctagccataaggcaagagttttggctgaggcaatgagcaaagcagaccttttgggacagcggtg

SEQ ID NO: 409658 - DNA, 140 bp, Artificial Sequence
  Synthetic
caccgctgtcccaaaaggtctgctttgctcattgcctcagccaaaactcttgccttatggctaggtcctcccactccctgacatgctgtcatcatttcttctagtgtagccgctggtccccatatcagcagccagggcct

SEQ ID NO: 409659 - DNA, 140 bp, Artificial Sequence
  Synthetic
aggccctggctgctgatatggccttcccacaaggggaggcccggaaattttcttcagagcagacctcagccatcagctccgccagcggagagcttcgggttcggagaggagatagcccccgaccttttgggacagcggtg

SEQ ID NO: 409660 - DNA, 140 bp, Artificial Sequence
  Synthetic
caccgctgtcccaaaaggtcgggggctatctcctctccgaacccgaagctctccgctggcggagctgatggctgaggtctgctctgaagaaaatttccgggcctccccttgtgggaaggccatatcagcagccagggcct

SEQ ID NO: 409661 - DNA, 140 bp, Artificial Sequence
  Synthetic
atacgccatgctgggtctccaccctataccaaagcagtaagtatatatgtaatgcaatctttagtgatattatcaatagtagcattagtagtagcgctagtaatagcaatagttgtgtggcgtacttgggagtcggccat

SEQ ID NO: 409662 - DNA, 140 bp, Artificial Sequence
  Synthetic
atggccgactcccaagtacgccacacaactattgctattactagcgctactactaatgctactattgataatatcactaaagattgcattacatatatacttactgctttggtatagggtggagacccagcatggcgtat

SEQ ID NO: 409663 - DNA, 140 bp, Artificial Sequence
  Synthetic
  misc_feature (100)..(100): n is a, c, g, or t
atacgccatgctgggtctccgcagaaatgaaaaactgctctttcaatatgaccacagagctaagggataagaaacagagggtatattcacttttttatanacttgatatagtacaaattacgtacttgggagtcggccat

SEQ ID NO: 409664 - DNA, 140 bp, Artificial Sequence
  Synthetic
  misc_feature (41)..(41): n is a, c, g, or t
atggccgactcccaagtacgtaatttgtactatatcaagtntataaaaaagtgaatataccctctgtttcttatcccttagctctgtggtcatattgaaagagcagtttttcatttctgcggagacccagcatggcgtat

SEQ ID NO: 409665 - DNA, 140 bp, Artificial Sequence
  Synthetic
atacgccatgctgggtctcctataaaatgggtggcaagtggtcaaaacgtggtagggatggatgggatgctattagggaaagaataagacgagctgagccacgagctgagccagcagcagcgtacttgggagtcggccat

SEQ ID NO: 409666 - DNA, 140 bp, Artificial Sequence
  Synthetic
atggccgactcccaagtacgctgctgctggctcagctcgtggctcagctcgtcttattctttccctaatagcatcccatccatccctaccacgttttgaccacttgccacccattttataggagacccagcatggcgtat

SEQ ID NO: 409667 - DNA, 140 bp, Artificial Sequence
  Synthetic
aggccctggctgctgatatgaatgtcagctcagtacaatgcacacatggaattaagccagtagtatcaactcaactgctgttaaatggcagtctagcagaaggaaaggtaatgatcagatgaccttttgggacagcggtg

SEQ ID NO: 409668 - DNA, 140 bp, Artificial Sequence
  Synthetic
caccgctgtcccaaaaggtcatctgatcattacctttccttctgctagactgccatttaacagcagttgagttgatactactggcttaattccatgtgtgcattgtactgagctgacattcatatcagcagccagggcct

SEQ ID NO: 409669 - DNA, 140 bp, Artificial Sequence
  Synthetic
atacgccatgctgggtctccagatcaacgagacaagcatgaacggagaaataaaaaactgctctttcaatatgaccacagaattaagggataaggaacagcaagtacattcactgttttacgtacttgggagtcggccat

SEQ ID NO: 409670 - DNA, 140 bp, Artificial Sequence
  Synthetic
atggccgactcccaagtacgtaaaacagtgaatgtacttgctgttccttatcccttaattctgtggtcatattgaaagagcagttttttatttctccgttcatgcttgtctcgttgatctggagacccagcatggcgtat

SEQ ID NO: 409671 - DNA, 140 bp, Artificial Sequence
  Synthetic
aggccctggctgctgatatgtaataaattgtaatacctcagccattaaacaagcttgtccaaaggtaacttttgagccaattcccatacattattgtgccccagctggttttgcgattctgaccttttgggacagcggtg

SEQ ID NO: 409672 - DNA, 140 bp, Artificial Sequence
  Synthetic
caccgctgtcccaaaaggtcagaatcgcaaaaccagctggggcacaataatgtatgggaattggctcaaaagttacctttggacaagcttgtttaatggctgaggtattacaatttattacatatcagcagccagggcct

SEQ ID NO: 409673 - DNA, 140 bp, Artificial Sequence
  Synthetic
aggccctggctgctgatatgtttgagccaattcccatacattattgtgccccagctggttttgcgattctaaagtgtaaggatacggagttcaatggaacagggccatgcaagaatgtcagaccttttgggacagcggtg

SEQ ID NO: 409674 - DNA, 140 bp, Artificial Sequence
  Synthetic
caccgctgtcccaaaaggtctgacattcttgcatggccctgttccattgaactccgtatccttacactttagaatcgcaaaaccagctggggcacaataatgtatgggaattggctcaaacatatcagcagccagggcct

SEQ ID NO: 409675 - DNA, 140 bp, Artificial Sequence
  Synthetic
aggccctggctgctgatatgggaccaggacaagcattatatgtaacaggtggcataataggggatataagacaagcattttgtgaggtcaatagaacaaaatgggataaaactttgcgaggaccttttgggacagcggtg

SEQ ID NO: 409676 - DNA, 140 bp, Artificial Sequence
  Synthetic
caccgctgtcccaaaaggtcctcgcaaagttttatcccattttgttctattgacctcacaaaatgcttgtcttatatcccctattatgccacctgttacatataatgcttgtcctggtcccatatcagcagccagggcct

SEQ ID NO: 409677 - DNA, 140 bp, Artificial Sequence
  Synthetic
aggccctggctgctgatatggactaatattaacaagagatggtggggttaataatacaaatgaaaccttcagacctggagggggagatatgagggacaattggagaagtgaattatataagaccttttgggacagcggtg

SEQ ID NO: 409678 - DNA, 140 bp, Artificial Sequence
  Synthetic
caccgctgtcccaaaaggtcttatataattcacttctccaattgtccctcatatctccccctccaggtctgaaggtttcatttgtattattaaccccaccatctcttgttaatattagtccatatcagcagccagggcct

SEQ ID NO: 409679 - DNA, 140 bp, Artificial Sequence
  Synthetic
aggccctggctgctgatatgaacttctgggacacagcagtctcaaggggttgagactggggtgggaaggcctcaagtatctgtggaatctcctggtatattggggtcgggaactaaaaatgaccttttgggacagcggtg

SEQ ID NO: 409680 - DNA, 140 bp, Artificial Sequence
  Synthetic
caccgctgtcccaaaaggtcatttttagttcccgaccccaatataccaggagattccacagatacttgaggccttcccaccccagtctcaaccccttgagactgctgtgtcccagaagttcatatcagcagccagggcct

SEQ ID NO: 409681 - DNA, 140 bp, Artificial Sequence
  Synthetic
aggccctggctgctgatatgccaaaaataagttcagaaatacacatcccactaggggatgctagattggtagtaacaacatattggggtctgcatacaggagaaagagaatggcatttgggaccttttgggacagcggtg

SEQ ID NO: 409682 - DNA, 140 bp, Artificial Sequence
  Synthetic
caccgctgtcccaaaaggtcccaaatgccattctctttctcctgtatgcagaccccaatatgttgttactaccaatctagcatcccctagtgggatgtgtatttctgaacttatttttggcatatcagcagccagggcct

SEQ ID NO: 409683 - DNA, 140 bp, Artificial Sequence
  Synthetic
atacgccatgctgggtctccctctcaggacagggacagaagaacttaaatcattatttaatacagtagcaaccctttattgcgtccataaaaaaatagatgtaaaagacaccaaagaagccgtacttgggagtcggccat

SEQ ID NO: 409684 - DNA, 140 bp, Artificial Sequence
  Synthetic
atggccgactcccaagtacggcttctttggtgtcttttacatctatttttttatggacgcaataaagggttgctactgtattaaataatgatttaagttcttctgtccctgtcctgagagggagacccagcatggcgtat

SEQ ID NO: 409685 - DNA, 140 bp, Artificial Sequence
  Synthetic
aggccctggctgctgatatgaatggaggcagggaaggtatgtgacacaaatagaccctgacctggcagatcaactgatccatttatattattttgattgttttgcagagtctgctataaggaccttttgggacagcggtg

SEQ ID NO: 409686 - DNA, 140 bp, Artificial Sequence
  Synthetic
caccgctgtcccaaaaggtccttatagcagactctgcaaaacaatcaaaataatataaatggatcagttgatctgccaggtcagggtctatttgtgtcacataccttccctgcctccattcatatcagcagccagggcct

SEQ ID NO: 409687 - DNA, 140 bp, Artificial Sequence
  Synthetic
atacgccatgctgggtctcctagtcctaaagacactgaaggaatgagaaattgctctttcaatataaccacagaactaaaagatgagacacagcgagcgtatgcgcttttttatagacctcgtacttgggagtcggccat

SEQ ID NO: 409688 - DNA, 140 bp, Artificial Sequence
  Synthetic
atggccgactcccaagtacgaggtctataaaaaagcgcatacgctcgctgtgtctcatcttttagttctgtggttatattgaaagagcaatttctcattccttcagtgtctttaggactaggagacccagcatggcgtat

SEQ ID NO: 409689 - DNA, 140 bp, Artificial Sequence
  Synthetic
aggccctggctgctgatatggcattctccgacaggcaagagtaagaaatggagccagtagatcctagattagatccctggaaccatccaggaagccagcctgcaactccttgtactaaatgaccttttgggacagcggtg

SEQ ID NO: 409690 - DNA, 140 bp, Artificial Sequence
  Synthetic
caccgctgtcccaaaaggtcatttagtacaaggagttgcaggctggcttcctggatggttccagggatctaatctaggatctactggctccatttcttactcttgcctgtcggagaatgccatatcagcagccagggcct

SEQ ID NO: 409691 - DNA, 140 bp, Artificial Sequence
  Synthetic
atacgccatgctgggtctccacaaacaatgtcaaaacaataatagtgcagcttaatgaatcaataccaattgtgtgtaaaagacctggcaataacacaaggaaaagcatagggctaggaccgtacttgggagtcggccat

SEQ ID NO: 409692 - DNA, 140 bp, Artificial Sequence
  Synthetic
atggccgactcccaagtacggtcctagccctatgcttttccttgtgttattgccaggtcttttacacacaattggtattgattcattaagctgcactattattgttttgacattgtttgtggagacccagcatggcgtat

SEQ ID NO: 409693 - DNA, 140 bp, Artificial Sequence
  Synthetic
aggccctggctgctgatatgtgaaagactgcactgaaagacaggctaattttttagggaaaatttggccttccagcaaggggaggccagggaattttcctcagagcagactggagccaacgaccttttgggacagcggtg

SEQ ID NO: 409694 - DNA, 140 bp, Artificial Sequence
  Synthetic
caccgctgtcccaaaaggtcgttggctccagtctgctctgaggaaaattccctggcctccccttgctggaaggccaaattttccctaaaaaattagcctgtctttcagtgcagtctttcacatatcagcagccagggcct

SEQ ID NO: 409695 - DNA, 140 bp, Artificial Sequence
  Synthetic
atacgccatgctgggtctccgcacattgtatcattagtgaagaaaagtggaatgacactttacaaagggtaggcaaaaaactaggagaacatttcaatagcacaataaactttacagcagcgtacttgggagtcggccat

SEQ ID NO: 409696 - DNA, 140 bp, Artificial Sequence
  Synthetic
atggccgactcccaagtacgctgctgtaaagtttattgtgctattgaaatgttctcctagttttttgcctaccctttgtaaagtgtcattccacttttcttcactaatgatacaatgtgcggagacccagcatggcgtat

SEQ ID NO: 409697 - DNA, 140 bp, Artificial Sequence
  Synthetic
atacgccatgctgggtctcccctcaggaggagacttagaaattacaacacatagttttaattgtggaggagaatttttctattgcaatacatcaggcctatttaatggtacatacaatcccgtacttgggagtcggccat

SEQ ID NO: 409698 - DNA, 140 bp, Artificial Sequence
  Synthetic
atggccgactcccaagtacgggattgtatgtaccattaaataggcctgatgtattgcaatagaaaaattctcctccacaattaaaactatgtgttgtaatttctaagtctcctcctgaggggagacccagcatggcgtat

SEQ ID NO: 409699 - DNA, 140 bp, Artificial Sequence
  Synthetic
atacgccatgctgggtctccctctaacagcaccacccccaacaccctggtagaagagaaaggggaaataaaaaactgttcttttaatatgaccacagaaataagagacaagaggcagcaacgtacttgggagtcggccat

SEQ ID NO: 409700 - DNA, 140 bp, Artificial Sequence
  Synthetic
atggccgactcccaagtacgttgctgcctcttgtctcttatttctgtggtcatattaaaagaacagttttttatttcccctttctcttctaccagggtgttgggggtggtgctgttagagggagacccagcatggcgtat

SEQ ID NO: 409701 - DNA, 140 bp, Artificial Sequence
  Synthetic
atacgccatgctgggtctccatacaagaagtatacctataggaccaggacaagcattctatgcaacaggtgacataataggagacataagaaaggcacattgtaacattagtggattacacgtacttgggagtcggccat

SEQ ID NO: 409702 - DNA, 140 bp, Artificial Sequence
  Synthetic
atggccgactcccaagtacgtgtaatccactaatgttacaatgtgcctttcttatgtctcctattatgtcacctgttgcatagaatgcttgtcctggtcctataggtatacttcttgtatggagacccagcatggcgtat

SEQ ID NO: 409703 - DNA, 140 bp, Artificial Sequence
  Synthetic
atacgccatgctgggtctcctaacactgttaccaacaatagtagtactagtagccccaataataatgaaatgacaaattgctcttttaatacaaccacagaaataagggataagaaacagcgtacttgggagtcggccat

SEQ ID NO: 409704 - DNA, 140 bp, Artificial Sequence
  Synthetic
atggccgactcccaagtacgctgtttcttatcccttatttctgtggttgtattaaaagagcaatttgtcatttcattattattggggctactagtactactattgttggtaacagtgttaggagacccagcatggcgtat

SEQ ID NO: 409705 - DNA, 140 bp, Artificial Sequence
  Synthetic
aggccctggctgctgatatgtcactatcccatgtagaataaaacaaattgtaaacatgtggcagggagtaggacaagcaatgtatgccgctcccattgcaggacaaattacctgtaactcgaccttttgggacagcggtg

SEQ ID NO: 409706 - DNA, 140 bp, Artificial Sequence
  Synthetic
caccgctgtcccaaaaggtcgagttacaggtaatttgtcctgcaatgggagcggcatacattgcttgtcctactccctgccacatgtttacaatttgttttattctacatgggatagtgacatatcagcagccagggcct

SEQ ID NO: 409707 - DNA, 140 bp, Artificial Sequence
  Synthetic
atacgccatgctgggtctccacaagcagcaacactccctctactaatcctgactgtgcctggctggaagcacaagaagaagaggaagtagggtttccagtcaaaccccaagtacctttaacgtacttgggagtcggccat

SEQ ID NO: 409708 - DNA, 140 bp, Artificial Sequence
  Synthetic
atggccgactcccaagtacgttaaaggtacttggggtttgactggaaaccctacttcctcttcttcttgtgcttccagccaggcacagtcaggattagtagagggagtgttgctgcttgtggagacccagcatggcgtat

SEQ ID NO: 409709 - DNA, 140 bp, Artificial Sequence
  Synthetic
aggccctggctgctgatatgggatttaccacaccagacaaaaagcatcagaaagaacctccatttctttggatgggttatgaactccatcctgataaatggacagtacagcctatacagcgaccttttgggacagcggtg

SEQ ID NO: 409710 - DNA, 140 bp, Artificial Sequence
  Synthetic
caccgctgtcccaaaaggtcgctgtataggctgtactgtccatttatcaggatggagttcataacccatccaaagaaatggaggttctttctgatgctttttgtctggtgtggtaaatcccatatcagcagccagggcct

SEQ ID NO: 409711 - DNA, 140 bp, Artificial Sequence
  Synthetic
atacgccatgctgggtctcctcagccagcagcagaaagaatgaggcgagctcagccagcagcagagggagtaggaacagcatctcaagacttagatagacatggagcacttacaaccagccgtacttgggagtcggccat

SEQ ID NO: 409712 - DNA, 140 bp, Artificial Sequence
  Synthetic
atggccgactcccaagtacggctggttgtaagtgctccatgtctatctaagtcttgagatgctgttcctactccctctgctgctggctgagctcgcctcattctttctgctgctggctgaggagacccagcatggcgtat

SEQ ID NO: 409713 - DNA, 140 bp, Artificial Sequence
  Synthetic
atacgccatgctgggtctcctgccagaaaaagaaagctggactgtcaatgatatacagaagttagtgggaaaattaaattgggcaagccagatctatccaggaattaaagtaagacaattcgtacttgggagtcggccat

SEQ ID NO: 409714 - DNA, 140 bp, Artificial Sequence
  Synthetic
atggccgactcccaagtacgaattgtcttactttaattcctggatagatctggcttgcccaatttaattttcccactaacttctgtatatcattgacagtccagctttctttttctggcaggagacccagcatggcgtat

SEQ ID NO: 409715 - DNA, 140 bp, Artificial Sequence
  Synthetic
aggccctggctgctgatatgagatatcaatataatgtgcttccacaaggatggaaaggatcaccagcaatattccagagtagcatgacaaaaatcttagagccctttagagcacaaaatcgaccttttgggacagcggtg

SEQ ID NO: 409716 - DNA, 140 bp, Artificial Sequence
  Synthetic
caccgctgtcccaaaaggtcgattttgtgctctaaagggctctaagatttttgtcatgctactctggaatattgctggtgatcctttccatccttgtggaagcacattatattgatatctcatatcagcagccagggcct

SEQ ID NO: 409717 - DNA, 140 bp, Artificial Sequence
  Synthetic
aggccctggctgctgatatgtagcaataattgtgtggtccatagtattcatagaatataggagaataagaagacagagaaaaatagacagattaattgatagaataagagaaagagcagagaccttttgggacagcggtg

SEQ ID NO: 409718 - DNA, 140 bp, Artificial Sequence
  Synthetic
caccgctgtcccaaaaggtctctgctctttctcttattctatcaattaatctgtctatttttctctgtcttcttattctcctatattctatgaatactatggaccacacaattattgctacatatcagcagccagggcct

SEQ ID NO: 409719 - DNA, 140 bp, Artificial Sequence
  Synthetic
aggccctggctgctgatatgcatacctagaagaataagacagggcttagaaagggctttgctataaaatgggtggcaagtggtcaaaatgtagtatagttggatggcctgctgtaagggagaccttttgggacagcggtg

SEQ ID NO: 409720 - DNA, 140 bp, Artificial Sequence
  Synthetic
caccgctgtcccaaaaggtctcccttacagcaggccatccaactatactacattttgaccacttgccacccattttatagcaaagccctttctaagccctgtcttattcttctaggtatgcatatcagcagccagggcct

SEQ ID NO: 409721 - DNA, 140 bp, Artificial Sequence
  Synthetic
aggccctggctgctgatatgaggggcaaatggtacatcaggccatatcacctagaactttaaatgcatgggtaaaagtagtagaagagaaggccttcagcccagaagtaatacccatgttgaccttttgggacagcggtg

SEQ ID NO: 409722 - DNA, 140 bp, Artificial Sequence
  Synthetic
caccgctgtcccaaaaggtcaacatgggtattacttctgggctgaaggccttctcttctactacttttacccatgcatttaaagttctaggtgatatggcctgatgtaccatttgcccctcatatcagcagccagggcct

SEQ ID NO: 409723 - DNA, 140 bp, Artificial Sequence
  Synthetic
aggccctggctgctgatatggaaagcgaaagtagaaccagagaagatctctcgacgcaggactcggcttgctgaagcgcgcacagcaagaggcgagagcggcgactggtgagtacgccaagaccttttgggacagcggtg

SEQ ID NO: 409724 - DNA, 140 bp, Artificial Sequence
  Synthetic
caccgctgtcccaaaaggtcttggcgtactcaccagtcgccgctctcgcctcttgctgtgcgcgcttcagcaagccgagtcctgcgtcgagagatcttctctggttctactttcgctttccatatcagcagccagggcct

SEQ ID NO: 409725 - DNA, 140 bp, Artificial Sequence
  Synthetic
aggccctggctgctgatatgccacctttgcctagtgttaagaaactgacagaggatagatggaacaagccccagaagaccaagggccacagagggagccatacaatgaatggacactagagaccttttgggacagcggtg

SEQ ID NO: 409726 - DNA, 140 bp, Artificial Sequence
  Synthetic
caccgctgtcccaaaaggtctctagtgtccattcattgtatggctccctctgtggcccttggtcttctggggcttgttccatctatcctctgtcagtttcttaacactaggcaaaggtggcatatcagcagccagggcct

SEQ ID NO: 409727 - DNA, 140 bp, Artificial Sequence
  Synthetic
aggccctggctgctgatatgcgtcagtattaagcgggggaaaactagatgcatgggaaaaaattcggctaagaccagggggaaagaaaaaatatagactgaagcatctagtatgggcaaggaccttttgggacagcggtg

SEQ ID NO: 409728 - DNA, 140 bp, Artificial Sequence
  Synthetic
caccgctgtcccaaaaggtccttgcccatactagatgcttcagtctatattttttctttccccctggtcttagccgaattttttcccatgcatctagttttcccccgcttaatactgacgcatatcagcagccagggcct

SEQ ID NO: 409729 - DNA, 140 bp, Artificial Sequence
  Synthetic
aggccctggctgctgatatgagaccagggggaaagaaaaaatatagactgaagcatctagtatgggcaagcagggagttagaacgatttgcagttgatcctggccttctagaaacaccaggaccttttgggacagcggtg

SEQ ID NO: 409730 - DNA, 140 bp, Artificial Sequence
  Synthetic
caccgctgtcccaaaaggtcctggtgtttctagaaggccaggatcaactgcaaatcgttctaactccctgcttgcccatactagatgcttcagtctatattttttctttccccctggtctcatatcagcagccagggcct

SEQ ID NO: 409731 - DNA, 140 bp, Artificial Sequence
  Synthetic
atacgccatgctgggtctcccaaaggaaccctttagagactatgtagaccggttctataaaactctaagagccgagcaagcttcacaggaagtaaaaaattggatgacagaaaccttgttcgtacttgggagtcggccat

SEQ ID NO: 409732 - DNA, 140 bp, Artificial Sequence
  Synthetic
atggccgactcccaagtacgaacaaggtttctgtcatccaattttttacttcctgtgaagcttgctcggctcttagagttttatagaaccggtctacatagtctctaaagggttcctttgggagacccagcatggcgtat

SEQ ID NO: 409733 - DNA, 140 bp, Artificial Sequence
  Synthetic
aggccctggctgctgatatgggtacatcaggctctatcacctagaactttaaatgcatgggtaaaggtggtagaagagaaggcttttagcccagaagtaatacccatgttttcagcattagaccttttgggacagcggtg

SEQ ID NO: 409734 - DNA, 140 bp, Artificial Sequence
  Synthetic
caccgctgtcccaaaaggtctaatgctgaaaacatgggtattacttctgggctaaaagccttctcttctaccacctttacccatgcatttaaagttctaggtgatagagcctgatgtacccatatcagcagccagggcct

SEQ ID NO: 409735 - DNA, 140 bp, Artificial Sequence
  Synthetic
aggccctggctgctgatatgcctatggcaggaagaagcggaaacagcgacgaggaactcctcaccgcagtaaggatcatcaaaatcctgtaccaaagcagtaagtattagtaattagtatgaccttttgggacagcggtg

SEQ ID NO: 409736 - DNA, 140 bp, Artificial Sequence
  Synthetic
caccgctgtcccaaaaggtcatactaattactaatacttactgctttggtacaggattttgatgatccttactgcggtgaggagttcctcgtcgctgtttccgcttcttcctgccataggcatatcagcagccagggcct

SEQ ID NO: 409737 - DNA, 140 bp, Artificial Sequence
  Synthetic
aggccctggctgctgatatgaaattaccctatagtgcaaaatgcacaagggcaaatgatacatcagaacttgtcacctaggactttgaatgcatgggtaaaagtaatagaagaaaaggctgaccttttgggacagcggtg

SEQ ID NO: 409738 - DNA, 140 bp, Artificial Sequence
  Synthetic
caccgctgtcccaaaaggtcagccttttcttctattacttttacccatgcattcaaagtcctaggtgacaagttctgatgtatcatttgcccttgtgcattttgcactatagggtaatttcatatcagcagccagggcct

SEQ ID NO: 409739 - DNA, 140 bp, Artificial Sequence
  Synthetic
atacgccatgctgggtctccggcgagggactgtatcctcccttagcctccctcaaatcactctttggcaacgacccttagtcacaataaaagtagggggacagctaagggaagctctattcgtacttgggagtcggccat

SEQ ID NO: 409740 - DNA, 140 bp, Artificial Sequence
  Synthetic
atggccgactcccaagtacgaatagagcttcccttagctgtccccctacttttattgtgactaagggtcgttgccaaagagtgatttgagggaggctaagggaggatacagtccctcgccggagacccagcatggcgtat

SEQ ID NO: 409741 - DNA, 140 bp, Artificial Sequence
  Synthetic
atacgccatgctgggtctccctttacattgtggaactgtcaccaacgacacggagggagaaagaaaaaactgctctttcaatatgaccacagagctaagggataaaaaacagaaggtatacgtacttgggagtcggccat

SEQ ID NO: 409742 - DNA, 140 bp, Artificial Sequence
  Synthetic
atggccgactcccaagtacgtataccttctgttttttatcccttagctctgtggtcatattgaaagagcagttttttctttctccctccgtgtcgttggtgacagttccacaatgtaaagggagacccagcatggcgtat

SEQ ID NO: 409743 - DNA, 140 bp, Artificial Sequence
  Synthetic
aggccctggctgctgatatgggggacacagatgaattggcaaaacttgtggagatggggaactatgatcctggggatgataataatttgtagtgctgcagaaaacttgtgggttactgtcgaccttttgggacagcggtg

SEQ ID NO: 409744 - DNA, 140 bp, Artificial Sequence
  Synthetic
caccgctgtcccaaaaggtcgacagtaacccacaagttttctgcagcactacaaattattatcatccccaggatcatagttccccatctccacaagttttgccaattcatctgtgtcccccatatcagcagccagggcct

SEQ ID NO: 409745 - DNA, 140 bp, Artificial Sequence
  Synthetic
aggccctggctgctgatatggagccagcagcggctggggtgggagcagtatctcgagacctggcacaacgtggagcaatcacaagtagcaaccaaaataatgctgattgtgtctggctgggaccttttgggacagcggtg

SEQ ID NO: 409746 - DNA, 140 bp, Artificial Sequence
  Synthetic
caccgctgtcccaaaaggtcccagccagacacaatcagcattattttggttgctacttgtgattgctccacgttgtgccaggtctcgagatactgctcccaccccagccgctgctggctccatatcagcagccagggcct

SEQ ID NO: 409747 - DNA, 140 bp, Artificial Sequence
  Synthetic
atacgccatgctgggtctccaacttattgagcctgtgacaattaattgtaccagacttgccaataatacaagaaaaagtatacgtataggaccaggacaatcattctatgcaatgggtgacgtacttgggagtcggccat

SEQ ID NO: 409748 - DNA, 140 bp, Artificial Sequence
  Synthetic
atggccgactcccaagtacgtcacccattgcatagaatgattgtcctggtcctatacgtatactttttcttgtattattggcaagtctggtacaattaattgtcacaggctcaataagttggagacccagcatggcgtat

SEQ ID NO: 409749 - DNA, 140 bp, Artificial Sequence
  Synthetic
aggccctggctgctgatatgagaaaaagtatacgtataggaccaggacaatcattctatgcaatgggtgacataataggggagataagaaacgcacaatgtgaggtcagtaaatcacagtgaccttttgggacagcggtg

SEQ ID NO: 409750 - DNA, 140 bp, Artificial Sequence
  Synthetic
caccgctgtcccaaaaggtcactgtgatttactgacctcacattgtgcgtttcttatctcccctattatgtcacccattgcatagaatgattgtcctggtcctatacgtatactttttctcatatcagcagccagggcct

SEQ ID NO: 409751 - DNA, 140 bp, Artificial Sequence
  Synthetic
atacgccatgctgggtctccgaagaccagctgttctactgatgccgccacagaagggaataagagggagccaggagttgcacctctttctgatcttgttgcggcgccactggttaatggtcgtacttgggagtcggccat

SEQ ID NO: 409752 - DNA, 140 bp, Artificial Sequence
  Synthetic
atggccgactcccaagtacgaccattaaccagtggcgccgcaacaagatcagaaagaggtgcaactcctggctccctcttattcccttctgtggcggcatcagtagaacagctggtcttcggagacccagcatggcgtat

SEQ ID NO: 409753 - DNA, 140 bp, Artificial Sequence
  Synthetic
atacgccatgctgggtctccaacaaaacaataatatttgataaaccctcaggaggggatctagaaatcacaacacatagttttaattgtggaggagaatttttctattgtaatacatcagcgtacttgggagtcggccat

SEQ ID NO: 409754 - DNA, 140 bp, Artificial Sequence
  Synthetic
atggccgactcccaagtacgctgatgtattacaatagaaaaattctcctccacaattaaaactatgtgttgtgatttctagatcccctcctgagggtttatcaaatattattgttttgttggagacccagcatggcgtat

SEQ ID NO: 409755 - DNA, 140 bp, Artificial Sequence
  Synthetic
atacgccatgctgggtctcctacacaagattgtccaaaggggacaattgagccaattcctatacattattgtgccccagctggattggcaattctaaaatgtaacgacaagaattttagtcgtacttgggagtcggccat

SEQ ID NO: 409756 - DNA, 140 bp, Artificial Sequence
  Synthetic
atggccgactcccaagtacgactaaaattcttgtcgttacattttagaattgccaatccagctggggcacaataatgtataggaattggctcaattgtcccctttggacaatcttgtgtaggagacccagcatggcgtat

SEQ ID NO: 409757 - DNA, 140 bp, Artificial Sequence
  Synthetic
aggccctggctgctgatatgccccattcctttggatggggtatgaactccatcctgataaatggacagtgcagcctatacaattgccagacaaggacagctggactgtcaatgacatacagaccttttgggacagcggtg

SEQ ID NO: 409758 - DNA, 140 bp, Artificial Sequence
  Synthetic
caccgctgtcccaaaaggtctgtatgtcattgacagtccagctgtccttgtctggcaattgtataggctgcactgtccatttatcaggatggagttcataccccatccaaaggaatggggcatatcagcagccagggcct

SEQ ID NO: 409759 - DNA, 140 bp, Artificial Sequence
  Synthetic
atacgccatgctgggtctcccaatacaagaaaaagtgtacatataggaccaggacgagcactctatacaatagaattagtaggagatataagacaagcacattgtgccatcaatggaacacgtacttgggagtcggccat

SEQ ID NO: 409760 - DNA, 140 bp, Artificial Sequence
  Synthetic
atggccgactcccaagtacgtgttccattgatggcacaatgtgcttgtcttatatctcctactaattctattgtatagagtgctcgtcctggtcctatatgtacactttttcttgtattgggagacccagcatggcgtat

SEQ ID NO: 409761 - DNA, 140 bp, Artificial Sequence
  Synthetic
aggccctggctgctgatatgtaaagcaaattataaacatgtggcagggagtaggaatagcaatgtatgcccctcccattgcaggaataatcaaatgttcatcaaatattacaggactattgaccttttgggacagcggtg

SEQ ID NO: 409762 - DNA, 140 bp, Artificial Sequence
  Synthetic
caccgctgtcccaaaaggtcaatagtcctgtaatatttgatgaacatttgattattcctgcaatgggaggggcatacattgctattcctactccctgccacatgtttataatttgctttacatatcagcagccagggcct

SEQ ID NO: 409763 - DNA, 140 bp, Artificial Sequence
  Synthetic
aggccctggctgctgatatgaagtctgtggaattggtttagcatatcaaaatggctgtggtatataaaaatatttataatgatagtaggaggcttaataggattaagaatagtttttgctgaccttttgggacagcggtg

SEQ ID NO: 409764 - DNA, 140 bp, Artificial Sequence
  Synthetic
caccgctgtcccaaaaggtcagcaaaaactattcttaatcctattaagcctcctactatcattataaatatttttatataccacagccattttgatatgctaaaccaattccacagacttcatatcagcagccagggcct

SEQ ID NO: 409765 - DNA, 140 bp, Artificial Sequence
  Synthetic
aggccctggctgctgatatgagacatcattatgaaagcagacatccaaaagtaagttcagaagtacatatcccattaggggatgctagattagtaataaaaacatattgggggttgcagagaccttttgggacagcggtg

SEQ ID NO: 409766 - DNA, 140 bp, Artificial Sequence
  Synthetic
caccgctgtcccaaaaggtctctgcaacccccaatatgtttttattactaatctagcatcccctaatgggatatgtacttctgaacttacttttggatgtctgctttcataatgatgtctcatatcagcagccagggcct

SEQ ID NO: 409767 - DNA, 140 bp, Artificial Sequence
  Synthetic
aggccctggctgctgatatgcaggagaaagagagtggcatttgggtcatggagtctccatagaatggagacttagaagatatagcacacaagtagaccctggcctggcagaccaactaatgaccttttgggacagcggtg

SEQ ID NO: 409768 - DNA, 140 bp, Artificial Sequence
  Synthetic
caccgctgtcccaaaaggtcattagttggtctgccaggccagggtctacttgtgtgctatatcttctaagtctccattctatggagactccatgacccaaatgccactctctttctcctgcatatcagcagccagggcct

SEQ ID NO: 409769 - DNA, 140 bp, Artificial Sequence
  Synthetic
aggccctggctgctgatatgaccaaaaaagaaaaagccacctttgcctagtgttacaaaattgacagaggatagatggaacaagccccagaagaccaagggccacagagggaaccatacagaccttttgggacagcggtg

SEQ ID NO: 409770 - DNA, 140 bp, Artificial Sequence
  Synthetic
caccgctgtcccaaaaggtctgtatggttccctctgtggcccttggtcttctggggcttgttccatctatcctctgtcaattttgtaacactaggcaaaggtggctttttcttttttggtcatatcagcagccagggcct

SEQ ID NO: 409771 - DNA, 140 bp, Artificial Sequence
  Synthetic
atacgccatgctgggtctccaatgataccaactacaagaatatcacagatggggaagtaatgaattgctctttcaatataaccacagaaataagagataagagaagaaaagaatctgcaccgtacttgggagtcggccat

SEQ ID NO: 409772 - DNA, 140 bp, Artificial Sequence
  Synthetic
atggccgactcccaagtacggtgcagattcttttcttctcttatctcttatttctgtggttatattgaaagagcaattcattacttccccatctgtgatattcttgtagttggtatcattggagacccagcatggcgtat

SEQ ID NO: 409773 - DNA, 140 bp, Artificial Sequence
  Synthetic
aggccctggctgctgatatgttaaattgcactgacttcagtaggaatgatactaataccaataatagtagtggggaaaagatggagaaaggagaaataaaaaattgctctttcaatatcagaccttttgggacagcggtg

SEQ ID NO: 409774 - DNA, 140 bp, Artificial Sequence
  Synthetic
caccgctgtcccaaaaggtctgatattgaaagagcaattttttatttctcctttctccatcttttccccactactattattggtattagtatcattcctactgaagtcagtgcaatttaacatatcagcagccagggcct

SEQ ID NO: 409775 - DNA, 140 bp, Artificial Sequence
  Synthetic
atacgccatgctgggtctcctaagtacagaaagcataataatacaaggaaagattcctaagtttaaactaccaatactaaaagaaacacaggatacacagtggacagagtattggcaagccgtacttgggagtcggccat

SEQ ID NO: 409776 - DNA, 140 bp, Artificial Sequence
  Synthetic
atggccgactcccaagtacggcttgccaatactctgtccactgtgtatcctgtgtttcttttagtattggtagtttaaacttaggaatctttccttgtattattatgctttctgtacttaggagacccagcatggcgtat

SEQ ID NO: 409777 - DNA, 140 bp, Artificial Sequence
  Synthetic
aggccctggctgctgatatgcaattttaggggccagaaaaggattaagtgtttcaactgtggcaaagaaggacacctagccagaaattgcagggcccctaggaaaaagggctgttggaaagaccttttgggacagcggtg

SEQ ID NO: 409778 - DNA, 140 bp, Artificial Sequence
  Synthetic
caccgctgtcccaaaaggtctttccaacagccctttttcctaggggccctgcaatttctggctaggtgtccttctttgccacagttgaaacacttaatccttttctggcccctaaaattgcatatcagcagccagggcct

SEQ ID NO: 409779 - DNA, 140 bp, Artificial Sequence
  Synthetic
aggccctggctgctgatatgggaaaataacatggtagaacaaatgcatgaagatataatcagtctatgggatcaaagcctaaagccatgtgtaaagttaaccccactctgtgttactctagaccttttgggacagcggtg

SEQ ID NO: 409780 - DNA, 140 bp, Artificial Sequence
  Synthetic
caccgctgtcccaaaaggtctagagtaacacagagtggggttaactttacacatggctttaggctttgatcccatagactgattatatcttcatgcatttgttctaccatgttattttcccatatcagcagccagggcct

SEQ ID NO: 409781 - DNA, 140 bp, Artificial Sequence
  Synthetic
atacgccatgctgggtctccatagtactgataatggcactatcacactcccatgtaagataaaacaaattgtgagaatgtggcagagagtggggcaagcaatgtatgcccctcccattgccgtacttgggagtcggccat

SEQ ID NO: 409782 - DNA, 140 bp, Artificial Sequence
  Synthetic
atggccgactcccaagtacggcaatgggaggggcatacattgcttgccccactctctgccacattctcacaatttgttttatcttacatgggagtgtgatagtgccattatcagtactatggagacccagcatggcgtat

SEQ ID NO: 409783 - DNA, 140 bp, Artificial Sequence
  Synthetic
atacgccatgctgggtctccatatgaccacagtagtaaatgacaagaagttaaaagtacagtcacttttttatagacttgatatcgtaccactcaacaataataataagaatattagcaacgtacttgggagtcggccat

SEQ ID NO: 409784 - DNA, 140 bp, Artificial Sequence
  Synthetic
atggccgactcccaagtacgttgctaatattcttattattattgttgagtggtacgatatcaagtctataaaaaagtgactgtacttttaacttcttgtcatttactactgtggtcatatggagacccagcatggcgtat

SEQ ID NO: 409785 - DNA, 140 bp, Artificial Sequence
  Synthetic
aggccctggctgctgatatgtcccatgcagaataaaacaaattataaacatgtggcaggaagtaggaaaagcaatgtatgcccctcccatcgcaggacaaattagatgttcatcaaatatgaccttttgggacagcggtg

SEQ ID NO: 409786 - DNA, 140 bp, Artificial Sequence
  Synthetic
caccgctgtcccaaaaggtcatatttgatgaacatctaatttgtcctgcgatgggaggggcatacattgcttttcctacttcctgccacatgtttataatttgttttattctgcatgggacatatcagcagccagggcct

SEQ ID NO: 409787 - DNA, 140 bp, Artificial Sequence
  Synthetic
aggccctggctgctgatatgtcacaataaagatagggggacagataaaggaagctctattagatacaggagcagatgatacagtattagaagaaataaatttgccaggaaaatggaaaccgaccttttgggacagcggtg

SEQ ID NO: 409788 - DNA, 140 bp, Artificial Sequence
  Synthetic
caccgctgtcccaaaaggtcggtttccattttcctggcaaatttatttcttctaatactgtatcatctgctcctgtatctaatagagcttcctttatctgtccccctatctttattgtgacatatcagcagccagggcct

SEQ ID NO: 409789 - DNA, 140 bp, Artificial Sequence
  Synthetic
aggccctggctgctgatatggcagatgatacagtattagaagaaataaatttgccaggaaaatggaaaccaaaaatgatagggggaattggaggttttatcaaagtaagacagtatgatcgaccttttgggacagcggtg

SEQ ID NO: 409790 - DNA, 140 bp, Artificial Sequence
  Synthetic
caccgctgtcccaaaaggtcgatcatactgtcttactttgataaaacctccaattccccctatcatttttggtttccattttcctggcaaatttatttcttctaatactgtatcatctgccatatcagcagccagggcct

SEQ ID NO: 409791 - DNA, 140 bp, Artificial Sequence
  Synthetic
aggccctggctgctgatatgttaattgtacaagacccaacaacaatacaaggaaaagtatacgcatagggccaggacaagcattctatgcaacaggtgatataataggagatataagaaagaccttttgggacagcggtg

SEQ ID NO: 409792 - DNA, 140 bp, Artificial Sequence
  Synthetic
caccgctgtcccaaaaggtctttcttatatctcctattatatcacctgttgcatagaatgcttgtcctggccctatgcgtatacttttccttgtattgttgttgggtcttgtacaattaacatatcagcagccagggcct

SEQ ID NO: 409793 - DNA, 140 bp, Artificial Sequence
  Synthetic
atacgccatgctgggtctcctactgctcccactactattagtagcatgacagaaatacaaaactgctctttcaatacaaccacagaaataagaggtaagaaacagcaagcgtatgcacttcgtacttgggagtcggccat

SEQ ID NO: 409794 - DNA, 140 bp, Artificial Sequence
  Synthetic
atggccgactcccaagtacgaagtgcatacgcttgctgtttcttacctcttatttctgtggttgtattgaaagagcagttttgtatttctgtcatgctactaatagtagtgggagcagtaggagacccagcatggcgtat

SEQ ID NO: 409795 - DNA, 140 bp, Artificial Sequence
  Synthetic
atacgccatgctgggtctccgctccaatgggactatcactctcccatgtagaataaaacagattataaacatgtggcagggagtaggacaagcaatgtataccgcccccattgcaggaaacgtacttgggagtcggccat

SEQ ID NO: 409796 - DNA, 140 bp, Artificial Sequence
  Synthetic
atggccgactcccaagtacgtttcctgcaatgggggcggtatacattgcttgtcctactccctgccacatgtttataatctgttttattctacatgggagagtgatagtcccattggagcggagacccagcatggcgtat

SEQ ID NO: 409797 - DNA, 140 bp, Artificial Sequence
  Synthetic
atacgccatgctgggtctccctgggtgaaggagaaattaaagaaacacttctctaatgcaacaacaatacaatttgcaccacactcaggaggggacctagaagttacagcacatagctttcgtacttgggagtcggccat

SEQ ID NO: 409798 - DNA, 140 bp, Artificial Sequence
  Synthetic
atggccgactcccaagtacgaaagctatgtgctgtaacttctaggtcccctcctgagtgtggtgcaaattgtattgttgttgcattagagaagtgtttctttaatttctccttcacccagggagacccagcatggcgtat

SEQ ID NO: 409799 - DNA, 140 bp, Artificial Sequence
  Synthetic
atacgccatgctgggtctccgaagtattacaaagaatttatagagctttttgcaacatacctagaagaataagacagggcttggaaaggcttttgctataagatgggtggcaagtggtcacgtacttgggagtcggccat

SEQ ID NO: 409800 - DNA, 140 bp, Artificial Sequence
  Synthetic
atggccgactcccaagtacgtgaccacttgccacccatcttatagcaaaagcctttccaagccctgtcttattcttctaggtatgttgcaaaaagctctataaattctttgtaatacttcggagacccagcatggcgtat

SEQ ID NO: 409801 - DNA, 140 bp, Artificial Sequence
  Synthetic
atacgccatgctgggtctccgacaacatgacctggatggaatgggaaaaagagattggtaattactcaaacacaatctaccggttacttgaacaatcgcaaaaccagcaggaaataaatgcgtacttgggagtcggccat

SEQ ID NO: 409802 - DNA, 140 bp, Artificial Sequence
  Synthetic
atggccgactcccaagtacgcatttatttcctgctggttttgcgattgttcaagtaaccggtagattgtgtttgagtaattaccaatctctttttcccattccatccaggtcatgttgtcggagacccagcatggcgtat

SEQ ID NO: 409803 - DNA, 140 bp, Artificial Sequence
  Synthetic
atacgccatgctgggtctccagtttttatagaatataggaaaataagaagagaaaagaaaatagaaagattaattgataggataagagaaagagcagaagacagtggcaatgagagtgatcgtacttgggagtcggccat

SEQ ID NO: 409804 - DNA, 140 bp, Artificial Sequence
  Synthetic
atggccgactcccaagtacgatcactctcattgccactgtcttctgctctttctcttatcctatcaattaatctttctattttcttttctcttcttattttcctatattctataaaaactggagacccagcatggcgtat

SEQ ID NO: 409805 - DNA, 140 bp, Artificial Sequence
  Synthetic
aggccctggctgctgatatgctaatgatgtaaaacaattaacagcggcagtgcaaaaaatagcccaagaatgtatagtgatatggggaaaaactcctaaatttagactacccatacaaaagaccttttgggacagcggtg

SEQ ID NO: 409806 - DNA, 140 bp, Artificial Sequence
  Synthetic
caccgctgtcccaaaaggtcttttgtatgggtagtctaaatttaggagtttttccccatatcactatacattcttgggctattttttgcactgccgctgttaattgttttacatcattagcatatcagcagccagggcct

SEQ ID NO: 409807 - DNA, 140 bp, Artificial Sequence
  Synthetic
aggccctggctgctgatatggtaacagaaaattttaatatgtggaaaaataacatggtagaacagatgcatgaagatataatcagtttatgggatcaaagcctaaagccatgtgtaaaatgaccttttgggacagcggtg

SEQ ID NO: 409808 - DNA, 140 bp, Artificial Sequence
  Synthetic
caccgctgtcccaaaaggtcattttacacatggctttaggctttgatcccataaactgattatatcttcatgcatctgttctaccatgttatttttccacatattaaaattttctgttaccatatcagcagccagggcct

SEQ ID NO: 409809 - DNA, 140 bp, Artificial Sequence
  Synthetic
atacgccatgctgggtctccgaggggacagacagagttatagaagttttgcaaagaattggtagggctattatcaacgtacctagaagaatcagacagggctttgaaagatctttgctatcgtacttgggagtcggccat

SEQ ID NO: 409810 - DNA, 140 bp, Artificial Sequence
  Synthetic
atggccgactcccaagtacgatagcaaagatctttcaaagccctgtctgattcttctaggtacgttgataatagccctaccaattctttgcaaaacttctataactctgtctgtcccctcggagacccagcatggcgtat

SEQ ID NO: 409811 - DNA, 140 bp, Artificial Sequence
  Synthetic
atacgccatgctgggtctccaataaaaaaatgctatttcaatactaccacaggcatgatagataagatgaaggaagaatatgcattattttataaccttgatatagtaccactagataatcgtacttgggagtcggccat

SEQ ID NO: 409812 - DNA, 140 bp, Artificial Sequence
  Synthetic
atggccgactcccaagtacgattatctagtggtactatatcaaggttataaaataatgcatattcttccttcatcttatctatcatgcctgtggtagtattgaaatagcatttttttattggagacccagcatggcgtat

SEQ ID NO: 409813 - DNA, 140 bp, Artificial Sequence
  Synthetic
atacgccatgctgggtctccggaaagaataagacggacccctccaacagcagaaagggtggagagaagacagaaccctccagcagcagaaggggtgggagcagcatctcgagacttagctcgtacttgggagtcggccat

SEQ ID NO: 409814 - DNA, 140 bp, Artificial Sequence
  Synthetic
atggccgactcccaagtacgagctaagtctcgagatgctgctcccaccccttctgctgctggagggttctgtcttctctccaccctttctgctgttggaggggtccgtcttattctttccggagacccagcatggcgtat

SEQ ID NO: 409815 - DNA, 140 bp, Artificial Sequence
  Synthetic
aggccctggctgctgatatggaggaggtaggctttccggtcaggccacaagtacctctaagaccaatgacttacaaggcagctgtggatctcagccactttttaaaagaaaaggggggacgaccttttgggacagcggtg

SEQ ID NO: 409816 - DNA, 140 bp, Artificial Sequence
  Synthetic
caccgctgtcccaaaaggtcgtccccccttttcttttaaaaagtggctgagatccacagctgccttgtaagtcattggtcttagaggtacttgtggcctgaccggaaagcctacctcctccatatcagcagccagggcct

SEQ ID NO: 409817 - DNA, 140 bp, Artificial Sequence
  Synthetic
aggccctggctgctgatatgatggatccggtagatcctaacctagagccctggaaccatccgggaagccagcctacaactgcttgtaacaagtgttactgtaaaaagtgttgctatcattgaccttttgggacagcggtg

SEQ ID NO: 409818 - DNA, 140 bp, Artificial Sequence
  Synthetic
caccgctgtcccaaaaggtcaatgatagcaacactttttacagtaacacttgttacaagcagttgtaggctggcttcccggatggttccagggctctaggttaggatctaccggatccatcatatcagcagccagggcct

SEQ ID NO: 409819 - DNA, 140 bp, Artificial Sequence
  Synthetic
aggccctggctgctgatatgtataggaccagggagagcattttatacaacaggagaaataataggagatataagaaaagcacattgtaaccttagtgaagcagattgggataacactttagaccttttgggacagcggtg

SEQ ID NO: 409820 - DNA, 140 bp, Artificial Sequence
  Synthetic
caccgctgtcccaaaaggtctaaagtgttatcccaatctgcttcactaaggttacaatgtgcttttcttatatctcctattatttctcctgttgtataaaatgctctccctggtcctatacatatcagcagccagggcct

SEQ ID NO: 409821 - DNA, 140 bp, Artificial Sequence
  Synthetic
atacgccatgctgggtctccgttaataagagtgtcaacatcacggggagtggggaagaaataaaaaactgctctttcaatatgaccacagaactaaaggataagagacagcaagtatattcgtacttgggagtcggccat

SEQ ID NO: 409822 - DNA, 140 bp, Artificial Sequence
  Synthetic
atggccgactcccaagtacgaatatacttgctgtctcttatcctttagttctgtggtcatattgaaagagcagttttttatttcttccccactccccgtgatgttgacactcttattaacggagacccagcatggcgtat

SEQ ID NO: 409823 - DNA, 140 bp, Artificial Sequence
  Synthetic
aggccctggctgctgatatgcaatagtagcattagtagtagtgtcaataatagcaatagttgtgtggactatagtattcatagagtggataagattaaaaaggcaaaggaaaatagacaggaccttttgggacagcggtg

SEQ ID NO: 409824 - DNA, 140 bp, Artificial Sequence
  Synthetic
caccgctgtcccaaaaggtcctgtctattttcctttgcctttttaatcttatccactctatgaatactatagtccacacaactattgctattattgacactactactaatgctactattgcatatcagcagccagggcct

SEQ ID NO: 409825 - DNA, 140 bp, Artificial Sequence
  Synthetic
aggccctggctgctgatatgatagtattcatagagtggataagattaaaaaggcaaaggaaaatagacaggttaattgatagaataagagaaagagcagaagatagtggcaatgagagtggaccttttgggacagcggtg

SEQ ID NO: 409826 - DNA, 140 bp, Artificial Sequence
  Synthetic
caccgctgtcccaaaaggtccactctcattgccactatcttctgctctttctcttattctatcaattaacctgtctattttcctttgcctttttaatcttatccactctatgaatactatcatatcagcagccagggcct

SEQ ID NO: 409827 - DNA, 140 bp, Artificial Sequence
  Synthetic
atacgccatgctgggtctccattaaccccactctgtgtcactttacactgcactaatgtgacgattaacaatgctacaaatgccacagatgccaccgctgaccctactgatggcggaggacgtacttgggagtcggccat

SEQ ID NO: 409828 - DNA, 140 bp, Artificial Sequence
  Synthetic
atggccgactcccaagtacgtcctccgccatcagtagggtcagcggtggcatctgtggcatttgtagcattgttaatcgtcacattagtgcagtgtaaagtgacacagagtggggttaatggagacccagcatggcgtat

SEQ ID NO: 409829 - DNA, 140 bp, Artificial Sequence
  Synthetic
atacgccatgctgggtctccgaaaaatgtacatgcgcttgttcatagacttgtggtggtagcagatgatgttgataatactattggtattactacttctaatacaactactggtagtactcgtacttgggagtcggccat

SEQ ID NO: 409830 - DNA, 140 bp, Artificial Sequence
  Synthetic
atggccgactcccaagtacgagtactaccagtagttgtattagaagtagtaataccaatagtattatcaacatcatctgctaccaccacaagtctatgaacaagcgcatgtacatttttcggagacccagcatggcgtat

SEQ ID NO: 409831 - DNA, 140 bp, Artificial Sequence
  Synthetic
aggccctggctgctgatatggaggagatatgagggacaattggagaagtgaattatataaatataaagtagtaaaaattgaaccactaggagtagcacccaccagggcaaagagaagagtgaccttttgggacagcggtg

SEQ ID NO: 409832 - DNA, 140 bp, Artificial Sequence
  Synthetic
caccgctgtcccaaaaggtcactcttctctttgccctggtgggtgctactcctagtggttcaatttttactactttatatttatataattcacttctccaattgtccctcatatctcctccatatcagcagccagggcct

SEQ ID NO: 409833 - DNA, 140 bp, Artificial Sequence
  Synthetic
atacgccatgctgggtctccaaaccataatagtacagcttaatgagactgtaacaattaattgcacaaggcccaacaacaatacaagacaaagtgtacatataggaccagggcaagcactcgtacttgggagtcggccat

SEQ ID NO: 409834 - DNA, 140 bp, Artificial Sequence
  Synthetic
atggccgactcccaagtacgagtgcttgccctggtcctatatgtacactttgtcttgtattgttgttgggccttgtgcaattaattgttacagtctcattaagctgtactattatggtttggagacccagcatggcgtat

SEQ ID NO: 409835 - DNA, 140 bp, Artificial Sequence
  Synthetic
aggccctggctgctgatatgcccaacaacaatacaagacaaagtgtacatataggaccagggcaagcactctatacaacagaaataataggggatataagaaaagcacattgtaatattagaccttttgggacagcggtg

SEQ ID NO: 409836 - DNA, 140 bp, Artificial Sequence
  Synthetic
caccgctgtcccaaaaggtctaatattacaatgtgcttttcttatatcccctattatttctgttgtatagagtgcttgccctggtcctatatgtacactttgtcttgtattgttgttgggcatatcagcagccagggcct

SEQ ID NO: 409837 - DNA, 140 bp, Artificial Sequence
  Synthetic
aggccctggctgctgatatgcactaatgtgccctggaaccagagttggagtaataaatctctagatgagatatggaataacatgacctggctgcagtgggatagagaaattaacaattacgaccttttgggacagcggtg

SEQ ID NO: 409838 - DNA, 140 bp, Artificial Sequence
  Synthetic
caccgctgtcccaaaaggtcgtaattgttaatttctctatcccactgcagccaggtcatgttattccatatctcatctagagatttattactccaactctggttccagggcacattagtgcatatcagcagccagggcct

SEQ ID NO: 409839 - DNA, 140 bp, Artificial Sequence
  Synthetic
atacgccatgctgggtctccggcctttttaataatacgacaatattttttccaccccactcggggggggacctagaaactacaccccactgctatagtggtggaggggaatttttctgctcgtacttgggagtcggccat

SEQ ID NO: 409840 - DNA, 140 bp, Artificial Sequence
  Synthetic
atggccgactcccaagtacgagcagaaaaattcccctccaccactatagcagtggggtgtagtttctaggtccccccccgagtggggtggaaaaaatattgtcgtattattaaaaaggccggagacccagcatggcgtat

SEQ ID NO: 409841 - DNA, 140 bp, Artificial Sequence
  Synthetic
aggccctggctgctgatatgcaccactaatgtgccctggaacactagctggagtaataaatcttataatgaaatttggaacaacatgacctggatggaatgggatagggaaattaacaatgaccttttgggacagcggtg

SEQ ID NO: 409842 - DNA, 140 bp, Artificial Sequence
  Synthetic
caccgctgtcccaaaaggtcattgttaatttccctatcccattccatccaggtcatgttgttccaaatttcattataagatttattactccagctagtgttccagggcacattagtggtgcatatcagcagccagggcct

SEQ ID NO: 409843 - DNA, 140 bp, Artificial Sequence
  Synthetic
atacgccatgctgggtctccggatgcaccaccaacgtacaacagaaaacaatgcttcccatcagactacaactcataataagtaatgtatgcccttgtccatggcaaggagtgtcagcagcgtacttgggagtcggccat

SEQ ID NO: 409844 - DNA, 140 bp, Artificial Sequence
  Synthetic
atggccgactcccaagtacgctgctgacactccttgccatggacaagggcatacattacttattatgagttgtagtctgatgggaagcattgttttctgttgtacgttggtggtgcatccggagacccagcatggcgtat

SEQ ID NO: 409845 - DNA, 140 bp, Artificial Sequence
  Synthetic
aggccctggctgctgatatgactcataataagtaatgtatgcccttgtccatggcaaggagtgtcagcagcaacatctgctgctaccatcctattatcaacaataacaggaggatcattggaccttttgggacagcggtg

SEQ ID NO: 409846 - DNA, 140 bp, Artificial Sequence
  Synthetic
caccgctgtcccaaaaggtccaatgatcctcctgttattgttgataataggatggtagcagcagatgttgctgctgacactccttgccatggacaagggcatacattacttattatgagtcatatcagcagccagggcct

SEQ ID NO: 409847 - DNA, 140 bp, Artificial Sequence
  Synthetic
aggccctggctgctgatatggggcagactattggcaagccacctggattcctgaatgggaatttgtcagcacgcccccattaatcaaattatggtaccaattggaaagtgaacctattgtgaccttttgggacagcggtg

SEQ ID NO: 409848 - DNA, 140 bp, Artificial Sequence
  Synthetic
caccgctgtcccaaaaggtcacaataggttcactttccaattggtaccataatttgattaatgggggcgtgctgacaaattcccattcaggaatccaggtggcttgccaatagtctgccccatatcagcagccagggcct

SEQ ID NO: 409849 - DNA, 140 bp, Artificial Sequence
  Synthetic
aggccctggctgctgatatgatatagcacacaagtagaccctaacctagcagaccaactaattcatctgcattactttgattgtttttcagaatctgccataagaaatgccatattaggagaccttttgggacagcggtg

SEQ ID NO: 409850 - DNA, 140 bp, Artificial Sequence
  Synthetic
caccgctgtcccaaaaggtctcctaatatggcatttcttatggcagattctgaaaaacaatcaaagtaatgcagatgaattagttggtctgctaggttagggtctacttgtgtgctatatcatatcagcagccagggcct

SEQ ID NO: 409851 - DNA, 140 bp, Artificial Sequence
  Synthetic
atacgccatgctgggtctccattgccaagtttgcttcatgtcaaaagcattaggcatctcccatggcaggaagaagcggggacagcgacgaagacctcctaaggacggtcagactcatcacgtacttgggagtcggccat

SEQ ID NO: 409852 - DNA, 140 bp, Artificial Sequence
  Synthetic
atggccgactcccaagtacgtgatgagtctgaccgtccttaggaggtcttcgtcgctgtccccgcttcttcctgccatgggagatgcctaatgcttttgacatgaagcaaacttggcaatggagacccagcatggcgtat

SEQ ID NO: 409853 - DNA, 140 bp, Artificial Sequence
  Synthetic
aggccctggctgctgatatgagatcattatataatacagtagcaaccctctattgcgtacatcaacggatagaggtaaaagacaccaaggaagctctagataaaatagaggagatacaaagaccttttgggacagcggtg

SEQ ID NO: 409854 - DNA, 140 bp, Artificial Sequence
  Synthetic
caccgctgtcccaaaaggtctttgtatctcctctattttatctagagcttccttggtgtcttttacctctatccgttgatgtacgcaatagagggttgctactgtattatataatgatctcatatcagcagccagggcct

SEQ ID NO: 409855 - DNA, 140 bp, Artificial Sequence
  Synthetic
atacgccatgctgggtctcctatagcacaaaacaatcctgacagtgcctggcttgaagcacaagaagaggaagaggaggttggcttttcagtcagacctcaggttcctccaagaccaatgcgtacttgggagtcggccat

SEQ ID NO: 409856 - DNA, 140 bp, Artificial Sequence
  Synthetic
atggccgactcccaagtacgcattggtcttggaggaacctgaggtctgactgaaaagccaacctcctcttcctcttcttgtgcttcaagccaggcactgtcaggattgttttgtgctataggagacccagcatggcgtat

SEQ ID NO: 409857 - DNA, 140 bp, Artificial Sequence
  Synthetic
aggccctggctgctgatatgaagaggaggttggcttttcagtcagacctcaggttcctccaagaccaatgacttataatgcagcatcggttctcatcttctttttaaaaaaaaagggggggaccttttgggacagcggtg

SEQ ID NO: 409858 - DNA, 140 bp, Artificial Sequence
  Synthetic
caccgctgtcccaaaaggtccccccctttttttttaaaaagaagatgagaaccgatgctgcattataagtcattggtcttggaggaacctgaggtctgactgaaaagccaacctcctcttcatatcagcagccagggcct

SEQ ID NO: 409859 - DNA, 140 bp, Artificial Sequence
  Synthetic
aggccctggctgctgatatgacaagcctgtccaaaggtcacttttgacccaattcctatacattattgtgctccagctggttatgcgattctaaagtgtaataataagacattcaatggggaccttttgggacagcggtg

SEQ ID NO: 409860 - DNA, 140 bp, Artificial Sequence
  Synthetic
caccgctgtcccaaaaggtccccattgaatgtcttattattacactttagaatcgcataaccagctggagcacaataatgtataggaattgggtcaaaagtgacctttggacaggcttgtcatatcagcagccagggcct

SEQ ID NO: 409861 - DNA, 140 bp, Artificial Sequence
  Synthetic
aggccctggctgctgatatgttagcaatagcaacagctaactggacagatagggttatagaaataggacaaagagcttgtagggcttttctcaacgtacctagaagaataagacaaggatgaccttttgggacagcggtg

SEQ ID NO: 409862 - DNA, 140 bp, Artificial Sequence
  Synthetic
caccgctgtcccaaaaggtcatccttgtcttattcttctaggtacgttgagaaaagccctacaagctctttgtcctatttctataaccctatctgtccagttagctgttgctattgctaacatatcagcagccagggcct

SEQ ID NO: 409863 - DNA, 140 bp, Artificial Sequence
  Synthetic
aggccctggctgctgatatgtgtggaaaaataacatggtagaacagatgcatgaggatataatcagtttatgggatcaaagcttaaagccatgtgtaaaattaaccccactctgtgttacgaccttttgggacagcggtg

SEQ ID NO: 409864 - DNA, 140 bp, Artificial Sequence
  Synthetic
caccgctgtcccaaaaggtcgtaacacagagtggggttaattttacacatggctttaagctttgatcccataaactgattatatcctcatgcatctgttctaccatgttatttttccacacatatcagcagccagggcct

SEQ ID NO: 409865 - DNA, 140 bp, Artificial Sequence
  Synthetic
atacgccatgctgggtctccctagcaccactactagtagcggggaaaagatggagccaggagagatacaaaattgctctttccatgtcacctcaggcataagagacaagtggcagaaagacgtacttgggagtcggccat

SEQ ID NO: 409866 - DNA, 140 bp, Artificial Sequence
  Synthetic
atggccgactcccaagtacgtctttctgccacttgtctcttatgcctgaggtgacatggaaagagcaattttgtatctctcctggctccatcttttccccgctactagtagtggtgctagggagacccagcatggcgtat

SEQ ID NO: 409867 - DNA, 140 bp, Artificial Sequence
  Synthetic
aggccctggctgctgatatggtacctgtgtggaaggaagcgaccactactctattttgtgcctcagatgctaaaggatatgaaaaagaggtacataatgtctgggctacacatgcctgtggaccttttgggacagcggtg

SEQ ID NO: 409868 - DNA, 140 bp, Artificial Sequence
  Synthetic
caccgctgtcccaaaaggtccacaggcatgtgtagcccagacattatgtacctctttttcatatcctttagcatctgaggcacaaaatagagtagtggtcgcttccttccacacaggtaccatatcagcagccagggcct

SEQ ID NO: 409869 - DNA, 140 bp, Artificial Sequence
  Synthetic
atacgccatgctgggtctccatattttacaacagaaataacaggagatataagaaacgcacattgtacccttaatggaacacaatggaatgacaccttaaaacagatagttacaaaattacgtacttgggagtcggccat

SEQ ID NO: 409870 - DNA, 140 bp, Artificial Sequence
  Synthetic
atggccgactcccaagtacgtaattttgtaactatctgttttaaggtgtcattccattgtgttccattaagggtacaatgtgcgtttcttatatctcctgttatttctgttgtaaaatatggagacccagcatggcgtat

SEQ ID NO: 409871 - DNA, 140 bp, Artificial Sequence
  Synthetic
atacgccatgctgggtctccagacacaggggcaatacaaaactgctctttcaatataaccacagaagtaggagacaagaagctaagagcacaggcacttttttataaacttgatatagtacgtacttgggagtcggccat

SEQ ID NO: 409872 - DNA, 140 bp, Artificial Sequence
  Synthetic
atggccgactcccaagtacgtactatatcaagtttataaaaaagtgcctgtgctcttagcttcttgtctcctacttctgtggttatattgaaagagcagttttgtattgcccctgtgtctggagacccagcatggcgtat

SEQ ID NO: 409873 - DNA, 140 bp, Artificial Sequence
  Synthetic
aggccctggctgctgatatgacacaatatacaggttgcttgaagaatcgcaaatccagcaggaacaaaatgaaaaagatttattagcattggacaagtggcaaaatctgtggagttggttgaccttttgggacagcggtg

SEQ ID NO: 409874 - DNA, 140 bp, Artificial Sequence
  Synthetic
caccgctgtcccaaaaggtcaaccaactccacagattttgccacttgtccaatgctaataaatctttttcattttgttcctgctggatttgcgattcttcaagcaacctgtatattgtgtcatatcagcagccagggcct

SEQ ID NO: 409875 - DNA, 140 bp, Artificial Sequence
  Synthetic
atacgccatgctgggtctccacatggtggatcagatgcatgaggatataatcagtatatgggatcaaagtctaaaaccatgtgtaaagttgaccccactctgtgtcactttaaattgtaccgtacttgggagtcggccat

SEQ ID NO: 409876 - DNA, 140 bp, Artificial Sequence
  Synthetic
atggccgactcccaagtacggtacaatttaaagtgacacagagtggggtcaactttacacatggttttagactttgatcccatatactgattatatcctcatgcatctgatccaccatgtggagacccagcatggcgtat

SEQ ID NO: 409877 - DNA, 140 bp, Artificial Sequence
  Synthetic
atacgccatgctgggtctccaaatgcaaatgttactgtcaataatagcacgtctggagaagtaaaaaactgctctttcaatacaaccacagaaataagagataagaaacagaaagcgtatcgtacttgggagtcggccat

SEQ ID NO: 409878 - DNA, 140 bp, Artificial Sequence
  Synthetic
atggccgactcccaagtacgatacgctttctgtttcttatctcttatttctgtggttgtattgaaagagcagttttttacttctccagacgtgctattattgacagtaacatttgcatttggagacccagcatggcgtat

SEQ ID NO: 409879 - DNA, 140 bp, Artificial Sequence
  Synthetic
aggccctggctgctgatatgagagttaggcagggatactcacctttgtcatttcagacccttaccccaaacccgaggggactcgacaggctcggaagaatcgaagaagaaggtggagagcgaccttttgggacagcggtg

SEQ ID NO: 409880 - DNA, 140 bp, Artificial Sequence
  Synthetic
caccgctgtcccaaaaggtcgctctccaccttcttcttcgattcttccgagcctgtcgagtcccctcgggtttggggtaagggtctgaaatgacaaaggtgagtatccctgcctaactctcatatcagcagccagggcct

SEQ ID NO: 409881 - DNA, 140 bp, Artificial Sequence
  Synthetic
aggccctggctgctgatatgacagattaactgtacaagacccaacaacaatacaaggagaagtatatatttaggaccaggacacgcattccatacaacagacaggataataggagatatagaccttttgggacagcggtg

SEQ ID NO: 409882 - DNA, 140 bp, Artificial Sequence
  Synthetic
caccgctgtcccaaaaggtctatatctcctattatcctgtctgttgtatggaatgcgtgtcctggtcctaaatatatacttctccttgtattgttgttgggtcttgtacagttaatctgtcatatcagcagccagggcct

SEQ ID NO: 409883 - DNA, 140 bp, Artificial Sequence
  Synthetic
aggccctggctgctgatatggaaagatacctaaaggatcaacagctcctagggatttggggctgctctggaaaactcatctgcaccactaatgtgccctggaactctagttggagtaatagaccttttgggacagcggtg

SEQ ID NO: 409884 - DNA, 140 bp, Artificial Sequence
  Synthetic
caccgctgtcccaaaaggtctattactccaactagagttccagggcacattagtggtgcagatgagttttccagagcagccccaaatccctaggagctgttgatcctttaggtatctttccatatcagcagccagggcct

SEQ ID NO: 409885 - DNA, 140 bp, Artificial Sequence
  Synthetic
aggccctggctgctgatatgcggattcttagctcttgtctgggacgacctgcggaacctgtgcctcttcagctaccgccacttgagagacttcatattaattgcagcgaggactgtgaacgaccttttgggacagcggtg

SEQ ID NO: 409886 - DNA, 140 bp, Artificial Sequence
  Synthetic
caccgctgtcccaaaaggtcgttcacagtcctcgctgcaattaatatgaagtctctcaagtggcggtagctgaagaggcacaggttccgcaggtcgtcccagacaagagctaagaatccgcatatcagcagccagggcct

SEQ ID NO: 409887 - DNA, 140 bp, Artificial Sequence
  Synthetic
atacgccatgctgggtctccaaaatggagacaggagaaatgaaaaactgctctttcaatatcaccacagacctaagagataagaggaaggaagtatatgcaactttttataaactggatgcgtacttgggagtcggccat

SEQ ID NO: 409888 - DNA, 140 bp, Artificial Sequence
  Synthetic
atggccgactcccaagtacgcatccagtttataaaaagttgcatatacttccttcctcttatctcttaggtctgtggtgatattgaaagagcagtttttcatttctcctgtctccattttggagacccagcatggcgtat

SEQ ID NO: 409889 - DNA, 140 bp, Artificial Sequence
  Synthetic
aggccctggctgctgatatgttggcctgggtggaagcacaagaggaggatggggaagtaggctttccagtcagacctcaggtaccgccgagaccaatgacttataagggagctctagatcgaccttttgggacagcggtg

SEQ ID NO: 409890 - DNA, 140 bp, Artificial Sequence
  Synthetic
caccgctgtcccaaaaggtcgatctagagctcccttataagtcattggtctcggcggtacctgaggtctgactggaaagcctacttccccatcctcctcttgtgcttccacccaggccaacatatcagcagccagggcct

SEQ ID NO: 409891 - DNA, 140 bp, Artificial Sequence
  Synthetic
atacgccatgctgggtctccgtggcgcccgaacagggacgcgaaagcgaaagtagaaccagagaagatctctcgacgcaggactcggcttgctgaagtgcgcacggcaagaggcgaggggcgtacttgggagtcggccat

SEQ ID NO: 409892 - DNA, 140 bp, Artificial Sequence
  Synthetic
atggccgactcccaagtacgcccctcgcctcttgccgtgcgcacttcagcaagccgagtcctgcgtcgagagatcttctctggttctactttcgctttcgcgtccctgttcgggcgccacggagacccagcatggcgtat

SEQ ID NO: 409893 - DNA, 140 bp, Artificial Sequence
  Synthetic
aggccctggctgctgatatggcatctagtatgggcaagcagggaactagaacgatttgcacttgatcctggccttttagaaacaccagaaggctgtaagaaaataataggacagctacaagaccttttgggacagcggtg

SEQ ID NO: 409894 - DNA, 140 bp, Artificial Sequence
  Synthetic
caccgctgtcccaaaaggtcttgtagctgtcctattattttcttacagccttctggtgtttctaaaaggccaggatcaagtgcaaatcgttctagttccctgcttgcccatactagatgccatatcagcagccagggcct

SEQ ID NO: 409895 - DNA, 140 bp, Artificial Sequence
  Synthetic
  misc_feature (66)..(66): n is a, c, g, or t
  misc_feature (69)..(69): n is a, c, g, or t
  misc_feature (74)..(74): n is a, c, g, or t
atacgccatgctgggtctccccatcccttcagacaggatcagaagagcttaaatcattgttcaatncantagcngtcctctattatgtacataaaagggaaaagataaaagacaccaaggcgtacttgggagtcggccat

SEQ ID NO: 409896 - DNA, 140 bp, Artificial Sequence
  Synthetic
  misc_feature (67)..(67): n is a, c, g, or t
  misc_feature (72)..(72): n is a, c, g, or t
  misc_feature (75)..(75): n is a, c, g, or t
atggccgactcccaagtacgccttggtgtcttttatcttttcccttttatgtacataatagaggacngctantgnattgaacaatgatttaagctcttctgatcctgtctgaagggatggggagacccagcatggcgtat

SEQ ID NO: 409897 - DNA, 140 bp, Artificial Sequence
  Synthetic
aggccctggctgctgatatgaagccacctttgcctagtgttaagaaattagcagaggatagatggaacaagccccagaagaccaggggccacagagagagccatacaatgaatggatgttgaccttttgggacagcggtg

SEQ ID NO: 409898 - DNA, 140 bp, Artificial Sequence
  Synthetic
caccgctgtcccaaaaggtcaacatccattcattgtatggctctctctgtggcccctggtcttctggggcttgttccatctatcctctgctaatttcttaacactaggcaaaggtggcttcatatcagcagccagggcct

SEQ ID NO: 409899 - DNA, 140 bp, Artificial Sequence
  Synthetic
aggccctggctgctgatatgttcaggaagtatactgcatttaccatacctagtataaacaatgagacaccagggattagatatcagtacaatgtgcttccacagggatggaaaggatcacgaccttttgggacagcggtg

SEQ ID NO: 409900 - DNA, 140 bp, Artificial Sequence
  Synthetic
caccgctgtcccaaaaggtcgtgatcctttccatccctgtggaagcacattgtactgatatctaatccctggtgtctcattgtttatactaggtatggtaaatgcagtatacttcctgaacatatcagcagccagggcct

SEQ ID NO: 409901 - DNA, 140 bp, Artificial Sequence
  Synthetic
atacgccatgctgggtctccaatactgcagaaaacttgtgggttactgtctactatggggtacctatatggaaggatgcaaataccaccttattttgtgcatcagatgcgaaagcatatgcgtacttgggagtcggccat

SEQ ID NO: 409902 - DNA, 140 bp, Artificial Sequence
  Synthetic
atggccgactcccaagtacgcatatgctttcgcatctgatgcacaaaataaggtggtatttgcatccttccatataggtaccccatagtagacagtaacccacaagttttctgcagtattggagacccagcatggcgtat

SEQ ID NO: 409903 - DNA, 140 bp, Artificial Sequence
  Synthetic
aggccctggctgctgatatgtagaagtattacaaagagcttatagagctattctccacatacctacaagaataagacagggcttggaaagggctttgctataaaatgggtggcaagtggtgaccttttgggacagcggtg

SEQ ID NO: 409904 - DNA, 140 bp, Artificial Sequence
  Synthetic
caccgctgtcccaaaaggtcaccacttgccacccattttatagcaaagccctttccaagccctgtcttattcttgtaggtatgtggagaatagctctataagctctttgtaatacttctacatatcagcagccagggcct

SEQ ID NO: 409905 - DNA, 140 bp, Artificial Sequence
  Synthetic
atacgccatgctgggtctccctaaaatgtaatgataaggagttcaatggaacagggctatgcaagaatgtcagcacagtacaatgcacacatggaatcaggccagtagtatcaactcaaccgtacttgggagtcggccat

SEQ ID NO: 409906 - DNA, 140 bp, Artificial Sequence
  Synthetic
atggccgactcccaagtacggttgagttgatactactggcctgattccatgtgtgcattgtactgtgctgacattcttgcatagccctgttccattgaactccttatcattacattttagggagacccagcatggcgtat

SEQ ID NO: 409907 - DNA, 140 bp, Artificial Sequence
  Synthetic
aggccctggctgctgatatgagaaatgcaaaattgctctttcaatgtaaccacagaagtaagagataaagagaagaaagtacatgcgcttttttatagacttgatgtggtaccaatagatgaccttttgggacagcggtg

SEQ ID NO: 409908 - DNA, 140 bp, Artificial Sequence
  Synthetic
caccgctgtcccaaaaggtcatctattggtaccacatcaagtctataaaaaagcgcatgtactttcttctctttatctcttacttctgtggttacattgaaagagcaattttgcatttctcatatcagcagccagggcct

SEQ ID NO: 409909 - DNA, 140 bp, Artificial Sequence
  Synthetic
aggccctggctgctgatatgttaatagctcctcaggaggggatttagaaattacaacacatagttttaattgtggaggagaatttttctattgtaatacatcaggcctgtttaatagtacgaccttttgggacagcggtg

SEQ ID NO: 409910 - DNA, 140 bp, Artificial Sequence
  Synthetic
caccgctgtcccaaaaggtcgtactattaaacaggcctgatgtattacaatagaaaaattctcctccacaattaaaactatgtgttgtaatttctaaatcccctcctgaggagctattaacatatcagcagccagggcct

SEQ ID NO: 409911 - DNA, 140 bp, Artificial Sequence
  Synthetic
aggccctggctgctgatatggcagaataaagcaaattataaatatgtggcagagagtaggacaagcaatatatgcccctcccatccaaggagtaataaggtgtgtatcaaacattacagggaccttttgggacagcggtg

SEQ ID NO: 409912 - DNA, 140 bp, Artificial Sequence
  Synthetic
caccgctgtcccaaaaggtccctgtaatgtttgatacacaccttattactccttggatgggaggggcatatattgcttgtcctactctctgccacatatttataatttgctttattctgccatatcagcagccagggcct

SEQ ID NO: 409913 - DNA, 140 bp, Artificial Sequence
  Synthetic
aggccctggctgctgatatgtcactgtctggggcattaaacagctccaggcaagagtcctggctgtggaaagatacctaagggatcaacagctcctaggaatttggggctgctctggaaagaccttttgggacagcggtg

SEQ ID NO: 409914 - DNA, 140 bp, Artificial Sequence
  Synthetic
caccgctgtcccaaaaggtctttccagagcagccccaaattcctaggagctgttgatcccttaggtatctttccacagccaggactcttgcctggagctgtttaatgccccagacagtgacatatcagcagccagggcct

SEQ ID NO: 409915 - DNA, 140 bp, Artificial Sequence
  Synthetic
atacgccatgctgggtctcctgaagatcagaacatggaatagtttggtaaagcatcatatgtatgtctcaaagagggctagtagatggttctatagacatcattttgaaagcaggaatcccgtacttgggagtcggccat

SEQ ID NO: 409916 - DNA, 140 bp, Artificial Sequence
  Synthetic
atggccgactcccaagtacgggattcctgctttcaaaatgatgtctatagaaccatctactagccctctttgagacatacatatgatgctttaccaaactattccatgttctgatcttcaggagacccagcatggcgtat

SEQ ID NO: 409917 - DNA, 140 bp, Artificial Sequence
  Synthetic
atacgccatgctgggtctccgaagaaataaaaaactgctctttcaatatcaccacaggcataaaagataaggtgaaaaaagaacatgcactttttaatagacttgatgtagtaccaatagcgtacttgggagtcggccat

SEQ ID NO: 409918 - DNA, 140 bp, Artificial Sequence
  Synthetic
atggccgactcccaagtacgctattggtactacatcaagtctattaaaaagtgcatgttcttttttcaccttatcttttatgcctgtggtgatattgaaagagcagttttttatttcttcggagacccagcatggcgtat

SEQ ID NO: 409919 - DNA, 140 bp, Artificial Sequence
  Synthetic
aggccctggctgctgatatgccagcaagaaaagaatgaacaagaactattgcaattggacaaatgggcaagtttgtggaattggtttagcataacaaaatggctgtggtatataaaaatagaccttttgggacagcggtg

SEQ ID NO: 409920 - DNA, 140 bp, Artificial Sequence
  Synthetic
caccgctgtcccaaaaggtctatttttatataccacagccattttgttatgctaaaccaattccacaaacttgcccatttgtccaattgcaatagttcttgttcattcttttcttgctggcatatcagcagccagggcct

SEQ ID NO: 409921 - DNA, 140 bp, Artificial Sequence
  Synthetic
aggccctggctgctgatatgattcttagcacttttctgggacgatctgaggaacctgtgcctcttcagctaccaccgcttgagagacttaatcttaattgcaacgaggattgtggaacttgaccttttgggacagcggtg

SEQ ID NO: 409922 - DNA, 140 bp, Artificial Sequence
  Synthetic
caccgctgtcccaaaaggtcaagttccacaatcctcgttgcaattaagattaagtctctcaagcggtggtagctgaagaggcacaggttcctcagatcgtcccagaaaagtgctaagaatcatatcagcagccagggcct

SEQ ID NO: 409923 - DNA, 140 bp, Artificial Sequence
  Synthetic
atacgccatgctgggtctccaatagggactcgaaaacgaaagttccagagaagaagctctcttgacgcaggactcggcttgctgaggtgcacacagcaagaggcgagagcggcgactggtcgtacttgggagtcggccat

SEQ ID NO: 409924 - DNA, 140 bp, Artificial Sequence
  Synthetic
atggccgactcccaagtacgaccagtcgccgctctcgcctcttgctgtgtgcacctcagcaagccgagtcctgcgtcaagagagcttcttctctggaactttcgttttcgagtccctattggagacccagcatggcgtat

SEQ ID NO: 409925 - DNA, 140 bp, Artificial Sequence
  Synthetic
aggccctggctgctgatatgcagaataaaacaaattataaacatgtggcaggaagtaggaaaagcaatgtatgcccctcccatcagaggaaacattacctgttcatcaaatattacaggggaccttttgggacagcggtg

SEQ ID NO: 409926 - DNA, 140 bp, Artificial Sequence
  Synthetic
caccgctgtcccaaaaggtcccctgtaatatttgatgaacaggtaatgtttcctctgatgggaggggcatacattgcttttcctacttcctgccacatgtttataatttgttttattctgcatatcagcagccagggcct

SEQ ID NO: 409927 - DNA, 140 bp, Artificial Sequence
  Synthetic
aggccctggctgctgatatggtacaaatgttaccagaaatagtaatgttaccgtcaataataccatgaaggaagaaataagaaattgctctttcaatacaaccacagaactaagagataagaccttttgggacagcggtg

SEQ ID NO: 409928 - DNA, 140 bp, Artificial Sequence
  Synthetic
caccgctgtcccaaaaggtcttatctcttagttctgtggttgtattgaaagagcaatttcttatttcttccttcatggtattattgacggtaacattactatttctggtaacatttgtaccatatcagcagccagggcct

SEQ ID NO: 409929 - DNA, 140 bp, Artificial Sequence
  Synthetic
aggccctggctgctgatatggcagggagctagaacgattcgcacttaatcctggccttttagaaacatcagaaggctgtagacaaataataagacagctacaaccatctattcagacagggaccttttgggacagcggtg

SEQ ID NO: 409930 - DNA, 140 bp, Artificial Sequence
  Synthetic
caccgctgtcccaaaaggtccctgtctgaatagatggttgtagctgtcttattatttgtctacagccttctgatgtttctaaaaggccaggattaagtgcgaatcgttctagctccctgccatatcagcagccagggcct

SEQ ID NO: 409931 - DNA, 140 bp, Artificial Sequence
  Synthetic
aggccctggctgctgatatgcaactccttgtaccaattgttattgtaaaaagtgttgctttcattgctactactgctttgcaacgaagggcttaggcatctcctatggcaggaagaagcggaccttttgggacagcggtg

SEQ ID NO: 409932 - DNA, 140 bp, Artificial Sequence
  Synthetic
caccgctgtcccaaaaggtccgcttcttcctgccataggagatgcctaagcccttcgttgcaaagcagtagtagcaatgaaagcaacactttttacaataacaattggtacaaggagttgcatatcagcagccagggcct

SEQ ID NO: 409933 - DNA, 140 bp, Artificial Sequence
  Synthetic
atacgccatgctgggtctccggaaaatacttccctaataaaacaataacttttgcaccatctgtaggtggggacctagaaattacaacacatagctttaattgtagaggagagtttttctcgtacttgggagtcggccat

SEQ ID NO: 409934 - DNA, 140 bp, Artificial Sequence
  Synthetic
atggccgactcccaagtacgagaaaaactctcctctacaattaaagctatgtgttgtaatttctaggtccccacctacagatggtgcaaaagttattgttttattagggaagtattttccggagacccagcatggcgtat

SEQ ID NO: 409935 - DNA, 140 bp, Artificial Sequence
  Synthetic
atacgccatgctgggtctcctaccagagcagtaagtattgattaagtagtgtatgtaatgtttgatttattagcaatagcaatagtagcattagtgatagcaggaatactagcaatagttcgtacttgggagtcggccat

SEQ ID NO: 409936 - DNA, 140 bp, Artificial Sequence
  Synthetic
atggccgactcccaagtacgaactattgctagtattcctgctatcactaatgctactattgctattgctaataaatcaaacattacatacactacttaatcaatacttactgctctggtaggagacccagcatggcgtat

SEQ ID NO: 409937 - DNA, 140 bp, Artificial Sequence
  Synthetic
atacgccatgctgggtctccattccaatagctccactaacagcaccctgagggaagagccaggagcaataaaaaactgttctttcaatatgaccacagaagtaagagacaagcagcggaacgtacttgggagtcggccat

SEQ ID NO: 409938 - DNA, 140 bp, Artificial Sequence
  Synthetic
atggccgactcccaagtacgttccgctgcttgtctcttacttctgtggtcatattgaaagaacagttttttattgctcctggctcttccctcagggtgctgttagtggagctattggaatggagacccagcatggcgtat

SEQ ID NO: 409939 - DNA, 140 bp, Artificial Sequence
  Synthetic
aggccctggctgctgatatgagcactaaatggagaaaattagtagattttagagagctcaataaaagaactcaagacttttgggaagttcaattaggaataccgcatccagcgggcttaagaccttttgggacagcggtg

SEQ ID NO: 409940 - DNA, 140 bp, Artificial Sequence
  Synthetic
caccgctgtcccaaaaggtcttaagcccgctggatgcggtattcctaattgaacttcccaaaagtcttgagttcttttattgagctctctaaaatctactaattttctccatttagtgctcatatcagcagccagggcct

SEQ ID NO: 409941 - DNA, 140 bp, Artificial Sequence
  Synthetic
aggccctggctgctgatatgtagggggacagctaaaggaagctctattagatacaggagcagatgatacagtattagaagaaataaatttgccaggaaaatggaaaccaaaaatgatagggaccttttgggacagcggtg

SEQ ID NO: 409942 - DNA, 140 bp, Artificial Sequence
  Synthetic
caccgctgtcccaaaaggtccctatcatttttggtttccattttcctggcaaatttatttcttctaatactgtatcatctgctcctgtatctaatagagcttcctttagctgtccccctacatatcagcagccagggcct

SEQ ID NO: 409943 - DNA, 140 bp, Artificial Sequence
  Synthetic
atacgccatgctgggtctccaacaatacaagaaaaagtatacatttaggaccaggacaagcattctatgcaacaggtgacataataggagatataagaaaggcacattgtaacattagtacgtacttgggagtcggccat

SEQ ID NO: 409944 - DNA, 140 bp, Artificial Sequence
  Synthetic
atggccgactcccaagtacgtactaatgttacaatgtgcctttcttatatctcctattatgtcacctgttgcatagaatgcttgtcctggtcctaaatgtatactttttcttgtattgttggagacccagcatggcgtat

SEQ ID NO: 409945 - DNA, 140 bp, Artificial Sequence
  Synthetic
atacgccatgctgggtctcctatttccctaataaaacaatagcatttaaccaatcctcaggaggggacctagaaattacaatgcatagttttaattgtagaggagaatttttctactgcacgtacttgggagtcggccat

SEQ ID NO: 409946 - DNA, 140 bp, Artificial Sequence
  Synthetic
atggccgactcccaagtacgtgcagtagaaaaattctcctctacaattaaaactatgcattgtaatttctaggtcccctcctgaggattggttaaatgctattgttttattagggaaataggagacccagcatggcgtat

SEQ ID NO: 409947 - DNA, 140 bp, Artificial Sequence
  Synthetic
aggccctggctgctgatatgaaggacaccaaatgaaagattgtactgagaggcaggctaattttttagggaaaatttggccttcccacaaggggaggccagggaatttccttcagagcaggaccttttgggacagcggtg

SEQ ID NO: 409948 - DNA, 140 bp, Artificial Sequence
  Synthetic
caccgctgtcccaaaaggtcctgctctgaaggaaattccctggcctccccttgtgggaaggccaaattttccctaaaaaattagcctgcctctcagtacaatctttcatttggtgtccttcatatcagcagccagggcct

SEQ ID NO: 409949 - DNA, 140 bp, Artificial Sequence
  Synthetic
atacgccatgctgggtctccgacactattactctcccatgtaaaataaaacaaattgtaagaatgtggcagggagtaggacaagcaatgtatgctgctcctattgcaggaaacattacctcgtacttgggagtcggccat

SEQ ID NO: 409950 - DNA, 140 bp, Artificial Sequence
  Synthetic
atggccgactcccaagtacgaggtaatgtttcctgcaataggagcagcatacattgcttgtcctactccctgccacattcttacaatttgttttattttacatgggagagtaatagtgtcggagacccagcatggcgtat

SEQ ID NO: 409951 - DNA, 140 bp, Artificial Sequence
  Synthetic
aggccctggctgctgatatgaacaaattataaacatgtggcagggggtaggacgagcaatgtatgcccctcccattgcaggaaacataacatgtaactcaagtatcacaggactactattgaccttttgggacagcggtg

SEQ ID NO: 409952 - DNA, 140 bp, Artificial Sequence
  Synthetic
caccgctgtcccaaaaggtcaatagtagtcctgtgatacttgagttacatgttatgtttcctgcaatgggaggggcatacattgctcgtcctaccccctgccacatgtttataatttgttcatatcagcagccagggcct

SEQ ID NO: 409953 - DNA, 140 bp, Artificial Sequence
  Synthetic
aggccctggctgctgatatgtgcaacgccttgcactaaatgtttttgtaaacggtgttgctttcattgttaccactgctttgcaacgaagggcttaggaatctcctatggcaggaagaaggaccttttgggacagcggtg

SEQ ID NO: 409954 - DNA, 140 bp, Artificial Sequence
  Synthetic
caccgctgtcccaaaaggtccttcttcctgccataggagattcctaagcccttcgttgcaaagcagtggtaacaatgaaagcaacaccgtttacaaaaacatttagtgcaaggcgttgcacatatcagcagccagggcct

SEQ ID NO: 409955 - DNA, 140 bp, Artificial Sequence
  Synthetic
aggccctggctgctgatatgggtggatggactattggcaggctacctgaattcctgaatgggagtttgtcaatacccctcctctagtaaaattatggtaccagttagagaaagaccccatgaccttttgggacagcggtg

SEQ ID NO: 409956 - DNA, 140 bp, Artificial Sequence
  Synthetic
caccgctgtcccaaaaggtcatggggtctttctctaactggtaccataattttactagaggaggggtattgacaaactcccattcaggaattcaggtagcctgccaatagtccatccacccatatcagcagccagggcct

SEQ ID NO: 409957 - DNA, 140 bp, Artificial Sequence
  Synthetic
atacgccatgctgggtctcctagggatttggggctgctctggaaaactcatctgcaccactaatgtgccttggaactctagttggagtaatagatctcaggaggagatttggggaaacatcgtacttgggagtcggccat

SEQ ID NO: 409958 - DNA, 140 bp, Artificial Sequence
  Synthetic
atggccgactcccaagtacgatgtttccccaaatctcctcctgagatctattactccaactagagttccaaggcacattagtggtgcagatgagttttccagagcagccccaaatccctaggagacccagcatggcgtat

SEQ ID NO: 409959 - DNA, 140 bp, Artificial Sequence
  Synthetic
atacgccatgctgggtctccgtcaatcaaataatagagaagctaatagaaaaggacaaagtctacctgtcatgggtaccagcacacaaaggaattggaggaaatgaacaagtagataaatcgtacttgggagtcggccat

SEQ ID NO: 409960 - DNA, 140 bp, Artificial Sequence
  Synthetic
atggccgactcccaagtacgatttatctacttgttcatttcctccaattcctttgtgtgctggtacccatgacaggtagactttgtccttttctattagcttctctattatttgattgacggagacccagcatggcgtat

SEQ ID NO: 409961 - DNA, 140 bp, Artificial Sequence
  Synthetic
atacgccatgctgggtctccaataacagtacagagaataataacagtactatagacttggaagaggtaagaaactgctctttcaatataacaagaggcatgggaggaaaggtgcggaaggcgtacttgggagtcggccat

SEQ ID NO: 409962 - DNA, 140 bp, Artificial Sequence
  Synthetic
atggccgactcccaagtacgccttccgcacctttcctcccatgcctcttgttatattgaaagagcagtttcttacctcttccaagtctatagtactgttattattctctgtactgttattggagacccagcatggcgtat

SEQ ID NO: 409963 - DNA, 140 bp, Artificial Sequence
  Synthetic
atacgccatgctgggtctccgaatgagacggaccccttcagcggcagcaggggtgggagcagcgtctcaagacttagataaacggggggcaattacaaccagcaatactaaagatactaacgtacttgggagtcggccat

SEQ ID NO: 409964 - DNA, 140 bp, Artificial Sequence
  Synthetic
atggccgactcccaagtacgttagtatctttagtattgctggttgtaattgccccccgtttatctaagtcttgagacgctgctcccacccctgctgccgctgaaggggtccgtctcattcggagacccagcatggcgtat

SEQ ID NO: 409965 - DNA, 140 bp, Artificial Sequence
  Synthetic
atacgccatgctgggtctcctaataggagatataagacaagcacattgtaacattagttttacaaaatggaataacactttaaaacagatagttagaaaattaagggaacaatttaataacgtacttgggagtcggccat

SEQ ID NO: 409966 - DNA, 140 bp, Artificial Sequence
  Synthetic
atggccgactcccaagtacgttattaaattgttcccttaattttctaactatctgttttaaagtgttattccattttgtaaaactaatgttacaatgtgcttgtcttatatctcctattaggagacccagcatggcgtat

SEQ ID NO: 409967 - DNA, 140 bp, Artificial Sequence
  Synthetic
atacgccatgctgggtctccgtggcgcccgaacagggacgcgaaaagcgaaaataaaaccagagaagatctctcgacgcaggactcggcttgctgaagtgcacacggcaagaggcgagggcgtacttgggagtcggccat

SEQ ID NO: 409968 - DNA, 140 bp, Artificial Sequence
  Synthetic
atggccgactcccaagtacgccctcgcctcttgccgtgtgcacttcagcaagccgagtcctgcgtcgagagatcttctctggttttattttcgcttttcgcgtccctgttcgggcgccacggagacccagcatggcgtat

SEQ ID NO: 409969 - DNA, 140 bp, Artificial Sequence
  Synthetic
atacgccatgctgggtctccaacaataatctttaattcatcctcaggaggagacctagaaattgtaatgcacacttttaattgcggaggggaatttttctactgtaacacaacaaagctgcgtacttgggagtcggccat

SEQ ID NO: 409970 - DNA, 140 bp, Artificial Sequence
  Synthetic
atggccgactcccaagtacgcagctttgttgtgttacagtagaaaaattcccctccgcaattaaaagtgtgcattacaatttctaggtctcctcctgaggatgaattaaagattattgttggagacccagcatggcgtat

SEQ ID NO: 409971 - DNA, 140 bp, Artificial Sequence
  Synthetic
atacgccatgctgggtctccgtgctttgcttcttataaatatagtgatatggacatttattcttaagaaatatttagagcaaaagaaacaagatagaagggaaagagaactacttaacagcgtacttgggagtcggccat

SEQ ID NO: 409972 - DNA, 140 bp, Artificial Sequence
  Synthetic
atggccgactcccaagtacgctgttaagtagttctctttcccttctatcttgtttcttttgctctaaatatttcttaagaataaatgtccatatcactatatttataagaagcaaagcacggagacccagcatggcgtat

SEQ ID NO: 409973 - DNA, 140 bp, Artificial Sequence
  Synthetic
aggccctggctgctgatatgaaaaaggctataggtacagtattagtaggacctacacctgtcaacataattggaagaaatatgttgactcagcttggatgcacactaaattttccaattagaccttttgggacagcggtg

SEQ ID NO: 409974 - DNA, 140 bp, Artificial Sequence
  Synthetic
caccgctgtcccaaaaggtctaattggaaaatttagtgtgcatccaagctgagtcaacatatttcttccaattatgttgacaggtgtaggtcctactaatactgtacctatagcctttttcatatcagcagccagggcct

SEQ ID NO: 409975 - DNA, 140 bp, Artificial Sequence
  Synthetic
aggccctggctgctgatatgaaacagatggcaggtgatgattgtgtggcaagtagacaggatgaggattagaacatggaaaagtttagtaaaacaccatatgtatatttcaaagaaagctgaccttttgggacagcggtg

SEQ ID NO: 409976 - DNA, 140 bp, Artificial Sequence
  Synthetic
caccgctgtcccaaaaggtcagctttctttgaaatatacatatggtgttttactaaacttttccatgttctaatcctcatcctgtctacttgccacacaatcatcacctgccatctgtttcatatcagcagccagggcct

SEQ ID NO: 409977 - DNA, 140 bp, Artificial Sequence
  Synthetic
aggccctggctgctgatatgtgaatgcatgggtaaaagtaatagaggaaaaagctttcagcccagaggtaatacccatgtttacagcattatcagaaggagccaccccacaagatttaaagaccttttgggacagcggtg

SEQ ID NO: 409978 - DNA, 140 bp, Artificial Sequence
  Synthetic
caccgctgtcccaaaaggtctttaaatcttgtggggtggctccttctgataatgctgtaaacatgggtattacctctgggctgaaagctttttcctctattacttttacccatgcattcacatatcagcagccagggcct

SEQ ID NO: 409979 - DNA, 140 bp, Artificial Sequence
  Synthetic
aggccctggctgctgatatggacaatggcagcaatttcaccagtactacagttaaggccgcctgttggtgggcaggaatcaagcaggaatttggcattccctacaatccccaaagtcaaggaccttttgggacagcggtg

SEQ ID NO: 409980 - DNA, 140 bp, Artificial Sequence
  Synthetic
caccgctgtcccaaaaggtccttgactttggggattgtagggaatgccaaattcctgcttgattcctgcccaccaacaggcggccttaactgtagtactggtgaaattgctgccattgtccatatcagcagccagggcct

SEQ ID NO: 409981 - DNA, 140 bp, Artificial Sequence
  Synthetic
aggccctggctgctgatatggattcaggaactaaagaatagtgctgttagtttgcttaatgccacagctatagcagtagctgaggggacagatagggtgatagaagtattacaaagaattgaccttttgggacagcggtg

SEQ ID NO: 409982 - DNA, 140 bp, Artificial Sequence
  Synthetic
caccgctgtcccaaaaggtcaattctttgtaatacttctatcaccctatctgtcccctcagctactgctatagctgtggcattaagcaaactaacagcactattctttagttcctgaatccatatcagcagccagggcct

SEQ ID NO: 409983 - DNA, 140 bp, Artificial Sequence
  Synthetic
atacgccatgctgggtctccaacaaatgctattgtaaaaggtgttgctatcattgttacgtgtgcttcgtaacgaaaggcttaggcatctcctatggcaggaagaagcggagaccgcgaccgtacttgggagtcggccat

SEQ ID NO: 409984 - DNA, 140 bp, Artificial Sequence
  Synthetic
atggccgactcccaagtacggtcgcggtctccgcttcttcctgccataggagatgcctaagcctttcgttacgaagcacacgtaacaatgatagcaacaccttttacaatagcatttgttggagacccagcatggcgtat

SEQ ID NO: 409985 - DNA, 140 bp, Artificial Sequence
  Synthetic
atacgccatgctgggtctccagctttacaataagatgggtaacaagtggtcaaaaagtattgaaaatggatgggctactgtaagggaaagaatgaggcgaactgagccagcagcagatggcgtacttgggagtcggccat

SEQ ID NO: 409986 - DNA, 140 bp, Artificial Sequence
  Synthetic
atggccgactcccaagtacgccatctgctgctggctcagttcgcctcattctttcccttacagtagcccatccattttcaatactttttgaccacttgttacccatcttattgtaaagctggagacccagcatggcgtat

SEQ ID NO: 409987 - DNA, 140 bp, Artificial Sequence
  Synthetic
aggccctggctgctgatatgtgggctactgtaagggaaagaatgaggcgaactgagccagcagcagatggggtgggagcagtatctcgagacttggaacaaaggggagcaatcacaagtagaccttttgggacagcggtg

SEQ ID NO: 409988 - DNA, 140 bp, Artificial Sequence
  Synthetic
caccgctgtcccaaaaggtctacttgtgattgctcccctttgttccaagtctcgagatactgctcccaccccatctgctgctggctcagttcgcctcattctttcccttacagtagcccacatatcagcagccagggcct

SEQ ID NO: 409989 - DNA, 140 bp, Artificial Sequence
  Synthetic
aggccctggctgctgatatgtaagtagtacatgtaatgcaacctttagagatattagcaatagtagcattagtagtagcactaatactagcaatagttgtgtggactatagtattcataggaccttttgggacagcggtg

SEQ ID NO: 409990 - DNA, 140 bp, Artificial Sequence
  Synthetic
caccgctgtcccaaaaggtcctatgaatactatagtccacacaactattgctagtattagtgctactactaatgctactattgctaatatctctaaaggttgcattacatgtactacttacatatcagcagccagggcct

SEQ ID NO: 409991 - DNA, 140 bp, Artificial Sequence
  Synthetic
atacgccatgctgggtctcctgtgtcactttaaactgcactaactgggtcactgataccaccaataccacaggaatggcaaactgctctttcaatataaccacagaaataagagataagacgtacttgggagtcggccat

SEQ ID NO: 409992 - DNA, 140 bp, Artificial Sequence
  Synthetic
atggccgactcccaagtacgtcttatctcttatttctgtggttatattgaaagagcagtttgccattcctgtggtattggtggtatcagtgacccagttagtgcagtttaaagtgacacaggagacccagcatggcgtat

SEQ ID NO: 409993 - DNA, 140 bp, Artificial Sequence
  Synthetic
atacgccatgctgggtctccttcaatggaacaggtccatgcaaaaatgtcagcacagtacagtgtacacatgggattaagccagtagtgtcaactcaactgttgttgaatggcagtctagcgtacttgggagtcggccat

SEQ ID NO: 409994 - DNA, 140 bp, Artificial Sequence
  Synthetic
atggccgactcccaagtacgctagactgccattcaacaacagttgagttgacactactggcttaatcccatgtgtacactgtactgtgctgacatttttgcatggacctgttccattgaaggagacccagcatggcgtat

SEQ ID NO: 409995 - DNA, 140 bp, Artificial Sequence
  Synthetic
atacgccatgctgggtctccctataacaatacaagacaaagtacacgtataggaccagggcaagcactctttacaacaaaagtaataggagatataagacaagcacattgtaacattagtcgtacttgggagtcggccat

SEQ ID NO: 409996 - DNA, 140 bp, Artificial Sequence
  Synthetic
atggccgactcccaagtacgactaatgttacaatgtgcttgtcttatatctcctattacttttgttgtaaagagtgcttgccctggtcctatacgtgtactttgtcttgtattgttatagggagacccagcatggcgtat

SEQ ID NO: 409997 - DNA, 140 bp, Artificial Sequence
  Synthetic
aggccctggctgctgatatgaaactccttaggggagccaaggcactaacagacatagtgccactgactgcagaagcagagttagaattggcagagaatagggaaattctaaaagaaccaggaccttttgggacagcggtg

SEQ ID NO: 409998 - DNA, 140 bp, Artificial Sequence
  Synthetic
caccgctgtcccaaaaggtcctggttcttttagaatttccctattctctgccaattctaactctgcttctgcagtcagtggcactatgtctgttagtgccttggctcccctaaggagtttcatatcagcagccagggcct

SEQ ID NO: 409999 - DNA, 140 bp, Artificial Sequence
  Synthetic
  misc_feature (64)..(64): n is a, c, g, or t
atacgccatgctgggtctccggagaggagaaataaaaaattgctctttcaatatcaccacaagnataagagataaagtgaagaaagaatatgcacttttttatagtcttgatgtaatacccgtacttgggagtcggccat

SEQ ID NO: 410000 - DNA, 140 bp, Artificial Sequence
  Synthetic
  misc_feature (77)..(77): n is a, c, g, or t
atggccgactcccaagtacgggtattacatcaagactataaaaaagtgcatattctttcttcactttatctcttatncttgtggtgatattgaaagagcaattttttatttctcctctccggagacccagcatggcgtat

SEQ ID NO: 410001 - DNA, 140 bp, Artificial Sequence
  Synthetic
aggccctggctgctgatatgctaaaggatcaacagctcctaggaatttggggttgctctggaaaacacatttgcaccactaatgtgccctggaactctagctggagtaatagatctgtaggaccttttgggacagcggtg

SEQ ID NO: 410002 - DNA, 140 bp, Artificial Sequence
  Synthetic
caccgctgtcccaaaaggtcctacagatctattactccagctagagttccagggcacattagtggtgcaaatgtgttttccagagcaaccccaaattcctaggagctgttgatcctttagcatatcagcagccagggcct

SEQ ID NO: 410003 - DNA, 140 bp, Artificial Sequence
  Synthetic
atacgccatgctgggtctcctggcctgctgtaagagaaagaatgagaagaactgagccagcagcagaaggggtgggagcagcatcccgggacctggaaaaacatggggcaatcacaagcacgtacttgggagtcggccat

SEQ ID NO: 410004 - DNA, 140 bp, Artificial Sequence
  Synthetic
atggccgactcccaagtacgtgcttgtgattgccccatgtttttccaggtcccgggatgctgctcccaccccttctgctgctggctcagttcttctcattctttctcttacagcaggccaggagacccagcatggcgtat

SEQ ID NO: 410005 - DNA, 140 bp, Artificial Sequence
  Synthetic
atacgccatgctgggtctccccagtaccagtaatattagcatgaatgtagacatgaaaaattgctctttcaatgtaaccacagaattaagagataaggagagacaagaacgtgcatttttcgtacttgggagtcggccat

SEQ ID NO: 410006 - DNA, 140 bp, Artificial Sequence
  Synthetic
atggccgactcccaagtacgaaaaatgcacgttcttgtctctccttatctcttaattctgtggttacattgaaagagcaatttttcatgtctacattcatgctaatattactggtactggggagacccagcatggcgtat

SEQ ID NO: 410007 - DNA, 140 bp, Artificial Sequence
  Synthetic
aggccctggctgctgatatgggaaactagtagaagatagatggaacaagccccaggagaccaggggccacagagagagccatacaatgaatggacactagagcttttagaggagcttaaggaccttttgggacagcggtg

SEQ ID NO: 410008 - DNA, 140 bp, Artificial Sequence
  Synthetic
caccgctgtcccaaaaggtccttaagctcctctaaaagctctagtgtccattcattgtatggctctctctgtggcccctggtctcctggggcttgttccatctatcttctactagtttcccatatcagcagccagggcct

SEQ ID NO: 410009 - DNA, 140 bp, Artificial Sequence
  Synthetic
aggccctggctgctgatatgcatagcagaataggcattactcgacagagaagagtgagaaatggaagtagtagatcctaacttagatccctggaaccatccaggaagccagcctacaactgaccttttgggacagcggtg

SEQ ID NO: 410010 - DNA, 140 bp, Artificial Sequence
  Synthetic
caccgctgtcccaaaaggtcagttgtaggctggcttcctggatggttccagggatctaagttaggatctactacttccatttctcactcttctctgtcgagtaatgcctattctgctatgcatatcagcagccagggcct

SEQ ID NO: 410011 - DNA, 140 bp, Artificial Sequence
  Synthetic
aggccctggctgctgatatgtagatcctaacttagatccctggaaccatccaggaagccagcctacaactccttgtaccacatgctattgtaaagtgtgttgctttcattgctaccgctggaccttttgggacagcggtg

SEQ ID NO: 410012 - DNA, 140 bp, Artificial Sequence
  Synthetic
caccgctgtcccaaaaggtccagcggtagcaatgaaagcaacacactttacaatagcatgtggtacaaggagttgtaggctggcttcctggatggttccagggatctaagttaggatctacatatcagcagccagggcct

SEQ ID NO: 410013 - DNA, 140 bp, Artificial Sequence
  Synthetic
atacgccatgctgggtctccagcgacgaagacctcctcagagcaataagaaccatcaaaatcctgtaccagagcagtaagtattggttaaaagtatatgtaatgtctaatttgttagcaacgtacttgggagtcggccat

SEQ ID NO: 410014 - DNA, 140 bp, Artificial Sequence
  Synthetic
atggccgactcccaagtacgttgctaacaaattagacattacatatacttttaaccaatacttactgctctggtacaggattttgatggttcttattgctctgaggaggtcttcgtcgctggagacccagcatggcgtat

SEQ ID NO: 410015 - DNA, 140 bp, Artificial Sequence
  Synthetic
atacgccatgctgggtctcctcacccatcacactcccatgcagaataaaacaaattataaacatgtggcagggggtaggaagagcagtgtatgccaaccccattgcaggaaacataacatcgtacttgggagtcggccat

SEQ ID NO: 410016 - DNA, 140 bp, Artificial Sequence
  Synthetic
atggccgactcccaagtacgatgttatgtttcctgcaatggggttggcatacactgctcttcctaccccctgccacatgtttataatttgttttattctgcatgggagtgtgatgggtgaggagacccagcatggcgtat

SEQ ID NO: 410017 - DNA, 140 bp, Artificial Sequence
  Synthetic
atacgccatgctgggtctccgactactattaacaagagatggagggagtaataatagtacaaatgagactttcaggcctggaggaggagatatgagggacaattggagaagtgaattatacgtacttgggagtcggccat

SEQ ID NO: 410018 - DNA, 140 bp, Artificial Sequence
  Synthetic
atggccgactcccaagtacgtataattcacttctccaattgtccctcatatctcctcctccaggcctgaaagtctcatttgtactattattactccctccatctcttgttaatagtagtcggagacccagcatggcgtat

SEQ ID NO: 410019 - DNA, 140 bp, Artificial Sequence
  Synthetic
aggccctggctgctgatatgtccttcagagcagaccagagccaacagccccaccagcagagagcttcgggtttggggaggagataacaccctctcagaaacaggagcagaaagacaaggagaccttttgggacagcggtg

SEQ ID NO: 410020 - DNA, 140 bp, Artificial Sequence
  Synthetic
caccgctgtcccaaaaggtctccttgtctttctgctcctgtttctgagagggtgttatctcctccccaaacccgaagctctctgctggtggggctgttggctctggtctgctctgaaggacatatcagcagccagggcct

SEQ ID NO: 410021 - DNA, 140 bp, Artificial Sequence
  Synthetic
atacgccatgctgggtctccgatataaaaaacaatagtaccagggggaataatggtagtgatagcatcaaggaaagcatgacaaattgctctttcaatacaaccacagaattaagagatacgtacttgggagtcggccat

SEQ ID NO: 410022 - DNA, 140 bp, Artificial Sequence
  Synthetic
atggccgactcccaagtacgtatctcttaattctgtggttgtattgaaagagcaatttgtcatgctttccttgatgctatcactaccattattccccctggtactattgttttttatatcggagacccagcatggcgtat

SEQ ID NO: 410023 - DNA, 140 bp, Artificial Sequence
  Synthetic
aggccctggctgctgatatgtcaactcaactgctgttaaatggcagcctagcagaagaagagatagtaatcagaactcaaaatatctcagataacacaaaaaccataatagtacaccttagaccttttgggacagcggtg

SEQ ID NO: 410024 - DNA, 140 bp, Artificial Sequence
  Synthetic
caccgctgtcccaaaaggtctaaggtgtactattatggtttttgtgttatctgagatattttgagttctgattactatctcttcttctgctaggctgccatttaacagcagttgagttgacatatcagcagccagggcct

SEQ ID NO: 410025 - DNA, 140 bp, Artificial Sequence
  Synthetic
aggccctggctgctgatatgcatgcagaataaagcaaattataaatatgtggcagagagtaggacaagcaatgtatgcccctcccatccaaggagtaataaagtgtgaatcaaacattacgaccttttgggacagcggtg

SEQ ID NO: 410026 - DNA, 140 bp, Artificial Sequence
  Synthetic
caccgctgtcccaaaaggtcgtaatgtttgattcacactttattactccttggatgggaggggcatacattgcttgtcctactctctgccacatatttataatttgctttattctgcatgcatatcagcagccagggcct

SEQ ID NO: 410027 - DNA, 140 bp, Artificial Sequence
  Synthetic
atacgccatgctgggtctccacaatatcatttaaccaacccgcaggaggggacctggaaattacaatgcatagctttaattgtagaggagaatttttctactgtaatacatcaagattgtcgtacttgggagtcggccat

SEQ ID NO: 410028 - DNA, 140 bp, Artificial Sequence
  Synthetic
atggccgactcccaagtacgacaatcttgatgtattacagtagaaaaattctcctctacaattaaagctatgcattgtaatttccaggtcccctcctgcgggttggttaaatgatattgtggagacccagcatggcgtat

SEQ ID NO: 410029 - DNA, 140 bp, Artificial Sequence
  Synthetic
aggccctggctgctgatatgccttcagacctggaggaggagatatgagggataattggagaagtgaattatataagtataaggtagtaaaaattgaaccactaggagtagcacccaccaagaccttttgggacagcggtg

SEQ ID NO: 410030 - DNA, 140 bp, Artificial Sequence
  Synthetic
caccgctgtcccaaaaggtcttggtgggtgctactcctagtggttcaatttttactaccttatacttatataattcacttctccaattatccctcatatctcctcctccaggtctgaaggcatatcagcagccagggcct

SEQ ID NO: 410031 - DNA, 140 bp, Artificial Sequence
  Synthetic
atacgccatgctgggtctccaaaagaacacttccataataaaaccatatcctttaaaccaccctcaggaggggacttagaaattacaacacatagttttaattgtggaggagaatttttccgtacttgggagtcggccat

SEQ ID NO: 410032 - DNA, 140 bp, Artificial Sequence
  Synthetic
atggccgactcccaagtacggaaaaattctcctccacaattaaaactatgtgttgtaatttctaagtcccctcctgagggtggtttaaaggatatggttttattatggaagtgttcttttggagacccagcatggcgtat

SEQ ID NO: 410033 - DNA, 140 bp, Artificial Sequence
  Synthetic
atacgccatgctgggtctccagtagtgatagcaatactactaattgggaaaaagtaaaggaagaaatgacaatctgctctttcaatgtcaccacaggaataggaaataaagtgaagaaagcgtacttgggagtcggccat

SEQ ID NO: 410034 - DNA, 140 bp, Artificial Sequence
  Synthetic
atggccgactcccaagtacgctttcttcactttatttcctattcctgtggtgacattgaaagagcagattgtcatttcttcctttactttttcccaattagtagtattgctatcactactggagacccagcatggcgtat

SEQ ID NO: 410035 - DNA, 140 bp, Artificial Sequence
  Synthetic
aggccctggctgctgatatgcagcagcaaaaggagtaggagcagtatctcaagatttagataaacatggagcagtcacaagcagcaatgtaaatcaccctagttgcgtctggctggaagcgaccttttgggacagcggtg

SEQ ID NO: 410036 - DNA, 140 bp, Artificial Sequence
  Synthetic
caccgctgtcccaaaaggtcgcttccagccagacgcaactagggtgatttacattgctgcttgtgactgctccatgtttatctaaatcttgagatactgctcctactccttttgctgctgcatatcagcagccagggcct

SEQ ID NO: 410037 - DNA, 140 bp, Artificial Sequence
  Synthetic
aggccctggctgctgatatgtgtgccttttcagctaccaccaattgagagacttcatattgattgtagcgagagcagtggaacttctgggacgcagcagtctcaggggactacagagggggaccttttgggacagcggtg

SEQ ID NO: 410038 - DNA, 140 bp, Artificial Sequence
  Synthetic
caccgctgtcccaaaaggtccccctctgtagtcccctgagactgctgcgtcccagaagttccactgctctcgctacaatcaatatgaagtctctcaattggtggtagctgaaaaggcacacatatcagcagccagggcct

SEQ ID NO: 410039 - DNA, 140 bp, Artificial Sequence
  Synthetic
atacgccatgctgggtctccagtaaattttactcaatcctcggggggggacccagaaattataatgcacacttttaattgtggaggggaatttttctactgtaatacatcacagctatttcgtacttgggagtcggccat

SEQ ID NO: 410040 - DNA, 140 bp, Artificial Sequence
  Synthetic
atggccgactcccaagtacgaaatagctgtgatgtattacagtagaaaaattcccctccacaattaaaagtgtgcattataatttctgggtccccccccgaggattgagtaaaatttactggagacccagcatggcgtat

SEQ ID NO: 410041 - DNA, 140 bp, Artificial Sequence
  Synthetic
atacgccatgctgggtctccgctgaggggacagataggattatagaattaataagaataagataaggctttgaaacagctttgctataaaatggggggcaagttgtcaaaacgcagcatacgtacttgggagtcggccat

SEQ ID NO: 410042 - DNA, 140 bp, Artificial Sequence
  Synthetic
atggccgactcccaagtacgtatgctgcgttttgacaacttgccccccattttatagcaaagctgtttcaaagccttatcttattcttattaattctataatcctatctgtcccctcagcggagacccagcatggcgtat

SEQ ID NO: 410043 - DNA, 140 bp, Artificial Sequence
  Synthetic
atacgccatgctgggtctccggaagtgacacaatcaccctcccatgcagaattaaacaaattatcacatgtgttgagaagtaggcaaaagcaatgtatgcccctcccatcagcggacaaacgtacttgggagtcggccat

SEQ ID NO: 410044 - DNA, 140 bp, Artificial Sequence
  Synthetic
atggccgactcccaagtacgtttgtccgctgatgggaggggcatacattgcttttgcctacttctcaacacatgtgataatttgtttaattctgcatgggagggtgattgtgtcacttccggagacccagcatggcgtat

SEQ ID NO: 410045 - DNA, 140 bp, Artificial Sequence
  Synthetic
aggccctggctgctgatatgtgttgagaagtaggcaaaagcaatgtatgcccctcccatcagcggacaaattagctgttcatcaaatattacagggctgttatcaacaagagatggtggtgaccttttgggacagcggtg

SEQ ID NO: 410046 - DNA, 140 bp, Artificial Sequence
  Synthetic
caccgctgtcccaaaaggtcaccaccatctcttgttgataacagccctgtaatatttgatgaacagctaatttgtccgctgatgggaggggcatacattgcttttgcctacttctcaacacatatcagcagccagggcct

SEQ ID NO: 410047 - DNA, 140 bp, Artificial Sequence
  Synthetic
  misc_feature (30)..(30): n is a, c, g, or t
  misc_feature (68)..(68): n is a, c, g, or t
  misc_feature (71)..(71): n is a, c, g, or t
  misc_feature (97)..(97): n is a, c, g, or t
atacgccatgctgggtctccttagcttgtncaacgccatagctatagcagtagctgaggggacagatnggnttatagaagcagtacaaagagctttnagaagaataagacagggcttggacgtacttgggagtcggccat

SEQ ID NO: 410048 - DNA, 140 bp, Artificial Sequence
  Synthetic
  misc_feature (44)..(44): n is a, c, g, or t
  misc_feature (70)..(70): n is a, c, g, or t
  misc_feature (73)..(73): n is a, c, g, or t
  misc_feature (111)..(111): n is a, c, g, or t
atggccgactcccaagtacgtccaagccctgtcttattcttctnaaagctctttgtactgcttctataanccnatctgtcccctcagctactgctatagctatggcgttgnacaagctaaggagacccagcatggcgtat

SEQ ID NO: 410049 - DNA, 140 bp, Artificial Sequence
  Synthetic
aggccctggctgctgatatgctgattgtgcctggctagaagcacatgaagatgaggaagtaggttttccagtcaggcctcaggtgcctttaaggccaatgacctacaaggcagcgtttgagaccttttgggacagcggtg

SEQ ID NO: 410050 - DNA, 140 bp, Artificial Sequence
  Synthetic
caccgctgtcccaaaaggtctcaaacgctgccttgtaggtcattggccttaaaggcacctgaggcctgactggaaaacctacttcctcatcttcatgtgcttctagccaggcacaatcagcatatcagcagccagggcct

SEQ ID NO: 410051 - DNA, 140 bp, Artificial Sequence
  Synthetic
aggccctggctgctgatatgaccttaattgaagaatcgcagaaccaacaggaaaagaatgaacaagagttattggaattggatcagtgggcaagtttgtggaattggtttagcataacaagaccttttgggacagcggtg

SEQ ID NO: 410052 - DNA, 140 bp, Artificial Sequence
  Synthetic
caccgctgtcccaaaaggtcttgttatgctaaaccaattccacaaacttgcccactgatccaattccaataactcttgttcattcttttcctgttggttctgcgattcttcaattaaggtcatatcagcagccagggcct

SEQ ID NO: 410053 - DNA, 140 bp, Artificial Sequence
  Synthetic
aggccctggctgctgatatgcctacaagaataagacagggcttagaaagggctttactataagatgggtggcaagtggtcaaaacgtagtgggggaggatgggctgctgtaagggaaagagaccttttgggacagcggtg

SEQ ID NO: 410054 - DNA, 140 bp, Artificial Sequence
  Synthetic
caccgctgtcccaaaaggtctctttcccttacagcagcccatcctcccccactacgttttgaccacttgccacccatcttatagtaaagccctttctaagccctgtcttattcttgtaggcatatcagcagccagggcct

SEQ ID NO: 410055 - DNA, 140 bp, Artificial Sequence
  Synthetic
aggccctggctgctgatatggcaagaaatggagccagtagatcctagactagagccctggaagcatccaggaagtcagcctaagactgcttgtaccaattgctattgtaaaaagtgttgcgaccttttgggacagcggtg

SEQ ID NO: 410056 - DNA, 140 bp, Artificial Sequence
  Synthetic
caccgctgtcccaaaaggtcgcaacactttttacaatagcaattggtacaagcagtcttaggctgacttcctggatgcttccagggctctagtctaggatctactggctccatttcttgccatatcagcagccagggcct

SEQ ID NO: 410057 - DNA, 140 bp, Artificial Sequence
  Synthetic
atacgccatgctgggtctccaggaatgaaaaactgctctttcaatataaccacagaattaagagataggaaaaagcaagtacatgcacttttttacaaacttgatgtagtacaaatagatcgtacttgggagtcggccat

SEQ ID NO: 410058 - DNA, 140 bp, Artificial Sequence
  Synthetic
atggccgactcccaagtacgatctatttgtactacatcaagtttgtaaaaaagtgcatgtacttgctttttcctatctcttaattctgtggttatattgaaagagcagtttttcattcctggagacccagcatggcgtat

SEQ ID NO: 410059 - DNA, 140 bp, Artificial Sequence
  Synthetic
aggccctggctgctgatatgacagtgtacacatgggatcaggccagtagtgtcaactcaactgttgttgaatggcagtttagcagaagaagagataataattagatctgaaaatctcacagaccttttgggacagcggtg

SEQ ID NO: 410060 - DNA, 140 bp, Artificial Sequence
  Synthetic
caccgctgtcccaaaaggtctgtgagattttcagatctaattattatctcttcttctgctaaactgccattcaacaacagttgagttgacactactggcctgatcccatgtgtacactgtcatatcagcagccagggcct

SEQ ID NO: 410061 - DNA, 140 bp, Artificial Sequence
  Synthetic
aggccctggctgctgatatgatggcagtttagcagaagaagagataataattagatctgaaaatctcacaaataatgctaaaatcataatagtacagcttaatgagtctgtaacaattaagaccttttgggacagcggtg

SEQ ID NO: 410062 - DNA, 140 bp, Artificial Sequence
  Synthetic
caccgctgtcccaaaaggtcttaattgttacagactcattaagctgtactattatgattttagcattatttgtgagattttcagatctaattattatctcttcttctgctaaactgccatcatatcagcagccagggcct

SEQ ID NO: 410063 - DNA, 140 bp, Artificial Sequence
  Synthetic
atacgccatgctgggtctccgacgagcatggtatacaacaaaaataatagggataaatggagatataaaacgagcatattgtaatgttactagagctggatggaataaaactttacaacacgtacttgggagtcggccat

SEQ ID NO: 410064 - DNA, 140 bp, Artificial Sequence
  Synthetic
atggccgactcccaagtacgtgttgtaaagttttattccatccagctctagtaacattacaatatgctcgttttatatctccatttatccctattatttttgttgtataccatgctcgtcggagacccagcatggcgtat

SEQ ID NO: 410065 - DNA, 140 bp, Artificial Sequence
  Synthetic
atacgccatgctgggtctcccaggggtaaatgaaatcaaactcccatgcagaataaaacagcttataaacatgtggcagagagtaggaaaagcaatgtatgcccctcccattgaagcactcgtacttgggagtcggccat

SEQ ID NO: 410066 - DNA, 140 bp, Artificial Sequence
  Synthetic
atggccgactcccaagtacgagtgcttcaatgggaggggcatacattgcttttcctactctctgccacatgtttataagctgttttattctgcatgggagtttgatttcatttacccctgggagacccagcatggcgtat

SEQ ID NO: 410067 - DNA, 140 bp, Artificial Sequence
  Synthetic
atacgccatgctgggtctccatactaatggtaccagtaatagtagtgtttccatgacagaggaaatggaaaattgctctttcaatgtaaccacagagctaagagataaaaacaagcaagacgtacttgggagtcggccat

SEQ ID NO: 410068 - DNA, 140 bp, Artificial Sequence
  Synthetic
atggccgactcccaagtacgtcttgcttgtttttatctcttagctctgtggttacattgaaagagcaattttccatttcctctgtcatggaaacactactattactggtaccattagtatggagacccagcatggcgtat

SEQ ID NO: 410069 - DNA, 140 bp, Artificial Sequence
  Synthetic
aggccctggctgctgatatgcaatcacactcccatgcagaataaaacaaattataaacatgtggcaggaagtaggaaaagcaatgtatgcccctcccatcaaaggacaaattagatgttcgaccttttgggacagcggtg

SEQ ID NO: 410070 - DNA, 140 bp, Artificial Sequence
  Synthetic
caccgctgtcccaaaaggtcgaacatctaatttgtcctttgatgggaggggcatacattgcttttcctacttcctgccacatgtttataatttgttttattctgcatgggagtgtgattgcatatcagcagccagggcct

SEQ ID NO: 410071 - DNA, 140 bp, Artificial Sequence
  Synthetic
atacgccatgctgggtctccgggtgggagcagtatctcgggacctggaaaaacatggggcaatcacaagtagcaatacagcccatactaatcctgactgtgcctggctggaagcacaagacgtacttgggagtcggccat

SEQ ID NO: 410072 - DNA, 140 bp, Artificial Sequence
  Synthetic
atggccgactcccaagtacgtcttgtgcttccagccaggcacagtcaggattagtatgggctgtattgctacttgtgattgccccatgtttttccaggtcccgagatactgctcccacccggagacccagcatggcgtat

SEQ ID NO: 410073 - DNA, 140 bp, Artificial Sequence
  Synthetic
atacgccatgctgggtctcctacctccaggaatatcaatggaaatgctaccttcaattatagcatggaggaagaaatgagaaattgctcttttaatatgaccacagaagtaagagataagcgtacttgggagtcggccat

SEQ ID NO: 410074 - DNA, 140 bp, Artificial Sequence
  Synthetic
atggccgactcccaagtacgcttatctcttacttctgtggtcatattaaaagagcaatttctcatttcttcctccatgctataattgaaggtagcatttccattgatattcctggaggtaggagacccagcatggcgtat

SEQ ID NO: 410075 - DNA, 140 bp, Artificial Sequence
  Synthetic
atacgccatgctgggtctcccccgaaaacgaaagtgagaccagagcagctctcttgacgcaggactcggcttgctgaagtgcacacagcaagaggcgaggcggcggcgactggtgagtaccgtacttgggagtcggccat

SEQ ID NO: 410076 - DNA, 140 bp, Artificial Sequence
  Synthetic
atggccgactcccaagtacggtactcaccagtcgccgccgcctcgcctcttgctgtgtgcacttcagcaagccgagtcctgcgtcaagagagctgctctggtctcactttcgttttcgggggagacccagcatggcgtat

SEQ ID NO: 410077 - DNA, 140 bp, Artificial Sequence
  Synthetic
atacgccatgctgggtctccaacactttaataaaacaatacaatttgaaccacactcaggaggggacctagaagttgtgacacatagctttaattgtagaggagagtttttctattgcaacgtacttgggagtcggccat

SEQ ID NO: 410078 - DNA, 140 bp, Artificial Sequence
  Synthetic
atggccgactcccaagtacgttgcaatagaaaaactctcctctacaattaaagctatgtgtcacaacttctaggtcccctcctgagtgtggttcaaattgtattgttttattaaagtgttggagacccagcatggcgtat

SEQ ID NO: 410079 - DNA, 140 bp, Artificial Sequence
  Synthetic
aggccctggctgctgatatggtgcttcacaacaaagggcttaggcatctcctatggcaggaagaagcggagtcagcgacgaagacctcctcaaaacagtgagaaccatcaaaatcttgtagaccttttgggacagcggtg

SEQ ID NO: 410080 - DNA, 140 bp, Artificial Sequence
  Synthetic
caccgctgtcccaaaaggtctacaagattttgatggttctcactgttttgaggaggtcttcgtcgctgactccgcttcttcctgccataggagatgcctaagccctttgttgtgaagcaccatatcagcagccagggcct

SEQ ID NO: 410081 - DNA, 140 bp, Artificial Sequence
  Synthetic
atacgccatgctgggtctcccagaagagcttaggtcactatttaatacagtagtaaccctctattgggtacatcaaaggatagaggtaaaggacaccaaggaagccttagacaaactagacgtacttgggagtcggccat

SEQ ID NO: 410082 - DNA, 140 bp, Artificial Sequence
  Synthetic
atggccgactcccaagtacgtctagtttgtctaaggcttccttggtgtcctttacctctatcctttgatgtacccaatagagggttactactgtattaaatagtgacctaagctcttctgggagacccagcatggcgtat

SEQ ID NO: 410083 - DNA, 140 bp, Artificial Sequence
  Synthetic
atacgccatgctgggtctcctataacggcaccaacagtacggttgacatgcgagaagaaataaaaaactgctctttcaatataaccacagaattaagggataagaaaaagaaagagcattcgtacttgggagtcggccat

SEQ ID NO: 410084 - DNA, 140 bp, Artificial Sequence
  Synthetic
atggccgactcccaagtacgaatgctctttctttttcttatcccttaattctgtggttatattgaaagagcagttttttatttcttctcgcatgtcaaccgtactgttggtgccgttataggagacccagcatggcgtat

SEQ ID NO: 410085 - DNA, 140 bp, Artificial Sequence
  Synthetic
aggccctggctgctgatatgtgtggaaaggagggacaccaaatgaaagattgtactgagagacaggctaattttttagggaaaatctggccttcccacaggggaaggccagggaattttcgaccttttgggacagcggtg

SEQ ID NO: 410086 - DNA, 140 bp, Artificial Sequence
  Synthetic
caccgctgtcccaaaaggtcgaaaattccctggccttcccctgtgggaaggccagattttccctaaaaaattagcctgtctctcagtacaatctttcatttggtgtccctcctttccacacatatcagcagccagggcct

SEQ ID NO: 410087 - DNA, 140 bp, Artificial Sequence
  Synthetic
atacgccatgctgggtctccgtgtcactttaaattgcaatactactagccacaataatagcagccccagccccatgacaaattgctctttcaatgcaaccacagaattaagagataagaccgtacttgggagtcggccat

SEQ ID NO: 410088 - DNA, 140 bp, Artificial Sequence
  Synthetic
atggccgactcccaagtacggtcttatctcttaattctgtggttgcattgaaagagcaatttgtcatggggctggggctgctattattgtggctagtagtattgcaatttaaagtgacacggagacccagcatggcgtat

SEQ ID NO: 410089 - DNA, 140 bp, Artificial Sequence
  Synthetic
atacgccatgctgggtctccaaggaggagccagaggcaatacaaaactgctctttcgatatgaccacagaagtaacagataaaaagcagaaagtacatgcacttttttatagacttgatacgtacttgggagtcggccat

SEQ ID NO: 410090 - DNA, 140 bp, Artificial Sequence
  Synthetic
atggccgactcccaagtacgtatcaagtctataaaaaagtgcatgtactttctgctttttatctgttacttctgtggtcatatcgaaagagcagttttgtattgcctctggctcctccttggagacccagcatggcgtat

SEQ ID NO: 410091 - DNA, 140 bp, Artificial Sequence
  Synthetic
aggccctggctgctgatatgccagtggtatcaactcaactactgttaaatggtagcctagcagaaggggagataataattagatctgaaaatctgacagacaatgccaaaacaataataggaccttttgggacagcggtg

SEQ ID NO: 410092 - DNA, 140 bp, Artificial Sequence
  Synthetic
caccgctgtcccaaaaggtcctattattgttttggcattgtctgtcagattttcagatctaattattatctccccttctgctaggctaccatttaacagtagttgagttgataccactggcatatcagcagccagggcct

SEQ ID NO: 410093 - DNA, 140 bp, Artificial Sequence
  Synthetic
aggccctggctgctgatatggataataattagatctgaaaatctgacagacaatgccaaaacaataatagtacatcttaataaatctgtagcaattgtgtgtacaagacccaacaataatgaccttttgggacagcggtg

SEQ ID NO: 410094 - DNA, 140 bp, Artificial Sequence
  Synthetic
caccgctgtcccaaaaggtcattattgttgggtcttgtacacacaattgctacagatttattaagatgtactattattgttttggcattgtctgtcagattttcagatctaattattatccatatcagcagccagggcct

SEQ ID NO: 410095 - DNA, 140 bp, Artificial Sequence
  Synthetic
atacgccatgctgggtctccacaaggaaaagtataaggataggaccaggacaagtattctatacaaatgaaataataggaaacataagacaagcacattgtaacattagtagagagctatcgtacttgggagtcggccat

SEQ ID NO: 410096 - DNA, 140 bp, Artificial Sequence
  Synthetic
atggccgactcccaagtacgatagctctctactaatgttacaatgtgcttgtcttatgtttcctattatttcatttgtatagaatacttgtcctggtcctatccttatacttttccttgtggagacccagcatggcgtat

SEQ ID NO: 410097 - DNA, 140 bp, Artificial Sequence
  Synthetic
aggccctggctgctgatatgaataaaacaatagaatttcaaccacccgcaggaggggatctagaagttacaacacatagttttaattgtagaggagaatttttctattgcaatacatcaagaccttttgggacagcggtg

SEQ ID NO: 410098 - DNA, 140 bp, Artificial Sequence
  Synthetic
caccgctgtcccaaaaggtcttgatgtattgcaatagaaaaattctcctctacaattaaaactatgtgttgtaacttctagatcccctcctgcgggtggttgaaattctattgttttattcatatcagcagccagggcct

SEQ ID NO: 410099 - DNA, 140 bp, Artificial Sequence
  Synthetic
aggccctggctgctgatatggcaatagtagcattagtagtagcagcaatactagcaatagttgtgtggaccatagtattcatagaatataggaaaatattaagacaaagaaaaatagacagaccttttgggacagcggtg

SEQ ID NO: 410100 - DNA, 140 bp, Artificial Sequence
  Synthetic
caccgctgtcccaaaaggtctgtctatttttctttgtcttaatattttcctatattctatgaatactatggtccacacaactattgctagtattgctgctactactaatgctactattgccatatcagcagccagggcct

SEQ ID NO: 410101 - DNA, 140 bp, Artificial Sequence
  Synthetic
aggccctggctgctgatatgatcacactcccatgcaaaataaaacaaattataaacatgtggcaggaggtaggacgagcaatgtatgcccctcccattgcaggaaacataacatgtaactgaccttttgggacagcggtg

SEQ ID NO: 410102 - DNA, 140 bp, Artificial Sequence
  Synthetic
caccgctgtcccaaaaggtcagttacatgttatgtttcctgcaatgggaggggcatacattgctcgtcctacctcctgccacatgtttataatttgttttattttgcatgggagtgtgatcatatcagcagccagggcct

SEQ ID NO: 410103 - DNA, 140 bp, Artificial Sequence
  Synthetic
atacgccatgctgggtctccaactaaccccactctgtgttactttaaattgcactgatgagttgattgtcactaatagtactaatggcaataatactaatagccatagtactaggggcaacgtacttgggagtcggccat

SEQ ID NO: 410104 - DNA, 140 bp, Artificial Sequence
  Synthetic
atggccgactcccaagtacgttgcccctagtactatggctattagtattattgccattagtactattagtgacaatcaactcatcagtgcaatttaaagtaacacagagtggggttagttggagacccagcatggcgtat

SEQ ID NO: 410105 - DNA, 140 bp, Artificial Sequence
  Synthetic
atacgccatgctgggtctccaaaactgctctttcaatatccccacaagtgtaaaagataagatgcagaaacaatatgctctcttctataaacttgatgtagtagcaataaatgatgataacgtacttgggagtcggccat

SEQ ID NO: 410106 - DNA, 140 bp, Artificial Sequence
  Synthetic
atggccgactcccaagtacgttatcatcatttattgctactacatcaagtttatagaagagagcatattgtttctgcatcttatcttttacacttgtggggatattgaaagagcagttttggagacccagcatggcgtat

SEQ ID NO: 410107 - DNA, 140 bp, Artificial Sequence
  Synthetic
atacgccatgctgggtctccggaaaactcatctgcaccactaatgtgccctggaactctagttgttggagtaatagaacttatgaagatatttgggaaaacaaaaacatgacctggatgacgtacttgggagtcggccat

SEQ ID NO: 410108 - DNA, 140 bp, Artificial Sequence
  Synthetic
atggccgactcccaagtacgtcatccaggtcatgtttttgttttcccaaatatcttcataagttctattactccaacaactagagttccagggcacattagtggtgcagatgagttttccggagacccagcatggcgtat

SEQ ID NO: 410109 - DNA, 140 bp, Artificial Sequence
  Synthetic
atacgccatgctgggtctcctaataagaacagtagtaattataatagtagtaagcttagtagtagcaatagtaattgtggtaaaagtgataataatagcagttgtaattgtagtagtagtcgtacttgggagtcggccat

SEQ ID NO: 410110 - DNA, 140 bp, Artificial Sequence
  Synthetic
atggccgactcccaagtacgactactactacaattacaactgctattattatcacttttaccacaattactattgctactactaagcttactactattataattactactgttcttattaggagacccagcatggcgtat

SEQ ID NO: 410111 - DNA, 140 bp, Artificial Sequence
  Synthetic
aggccctggctgctgatatgagcaattaattgtacaagacccaacaacaatacaagaaaaggcatacgtataggaccagggagaacattttatgcggcggaaaaaataataggagatatagaccttttgggacagcggtg

SEQ ID NO: 410112 - DNA, 140 bp, Artificial Sequence
  Synthetic
caccgctgtcccaaaaggtctatatctcctattattttttccgccgcataaaatgttctccctggtcctatacgtatgccttttcttgtattgttgttgggtcttgtacaattaattgctcatatcagcagccagggcct

SEQ ID NO: 410113 - DNA, 140 bp, Artificial Sequence
  Synthetic
aggccctggctgctgatatggaggaggtaggctttccagtcaggccacaagtacctctaagaccaatgacttacaagggagctctggatctcagccactttttaaaagaaaaggggggacgaccttttgggacagcggtg

SEQ ID NO: 410114 - DNA, 140 bp, Artificial Sequence
  Synthetic
caccgctgtcccaaaaggtcgtccccccttttcttttaaaaagtggctgagatccagagctcccttgtaagtcattggtcttagaggtacttgtggcctgactggaaagcctacctcctccatatcagcagccagggcct

SEQ ID NO: 410115 - DNA, 140 bp, Artificial Sequence
  Synthetic
atacgccatgctgggtctccactgatagttgcaaaattaagagaacaagaacaaattggggagaatacaacaataatctttaaaccatcctcaggaggggacccagaaattgaaaatcaccgtacttgggagtcggccat

SEQ ID NO: 410116 - DNA, 140 bp, Artificial Sequence
  Synthetic
atggccgactcccaagtacggtgattttcaatttctgggtcccctcctgaggatggtttaaagattattgttgtattctccccaatttgttcttgttctcttaattttgcaactatcagtggagacccagcatggcgtat

SEQ ID NO: 410117 - DNA, 140 bp, Artificial Sequence
  Synthetic
aggccctggctgctgatatgcaataatctttaaaccatcctcaggaggggacccagaaattgaaaatcacatttttaattgtagaggggaatttttctactgtaatacaacacaactgttgaccttttgggacagcggtg

SEQ ID NO: 410118 - DNA, 140 bp, Artificial Sequence
  Synthetic
caccgctgtcccaaaaggtcaacagttgtgttgtattacagtagaaaaattcccctctacaattaaaaatgtgattttcaatttctgggtcccctcctgaggatggtttaaagattattgcatatcagcagccagggcct

SEQ ID NO: 410119 - DNA, 140 bp, Artificial Sequence
  Synthetic
aggccctggctgctgatatgtagcaactctctattgtgtacatgcagagatagaggtacgagacaccaaggaagccttagacaagatagaggaagaacaaaacaaaagtcagcaaaaaacgaccttttgggacagcggtg

SEQ ID NO: 410120 - DNA, 140 bp, Artificial Sequence
  Synthetic
caccgctgtcccaaaaggtcgttttttgctgacttttgttttgttcttcctctatcttgtctaaggcttccttggtgtctcgtacctctatctctgcatgtacacaatagagagttgctacatatcagcagccagggcct

SEQ ID NO: 410121 - DNA, 140 bp, Artificial Sequence
  Synthetic
atacgccatgctgggtctccataatcctgatgtagcctgggtggaagcacaagaggaggaagaggaagtaggctttcctgtcaagcctcaggtacctttaagaccaatgacctataaggccgtacttgggagtcggccat

SEQ ID NO: 410122 - DNA, 140 bp, Artificial Sequence
  Synthetic
atggccgactcccaagtacggccttataggtcattggtcttaaaggtacctgaggcttgacaggaaagcctacttcctcttcctcctcttgtgcttccacccaggctacatcaggattatggagacccagcatggcgtat

SEQ ID NO: 410123 - DNA, 140 bp, Artificial Sequence
  Synthetic
aggccctggctgctgatatgaaaggcttaggcatctcctatggcaggaagaagcggagacagcgacgaggcactcctcaaggcagtaaggatcatcaaaatcctgtaccaaagcagtaaggaccttttgggacagcggtg

SEQ ID NO: 410124 - DNA, 140 bp, Artificial Sequence
  Synthetic
caccgctgtcccaaaaggtccttactgctttggtacaggattttgatgatccttactgccttgaggagtgcctcgtcgctgtctccgcttcttcctgccataggagatgcctaagcctttcatatcagcagccagggcct

SEQ ID NO: 410125 - DNA, 140 bp, Artificial Sequence
  Synthetic
atacgccatgctgggtctccatttggaataacatgacctggatggagtgggaaagagaaattgaaaattacacaggcttaatatacaacttacttgaaaaatcgcaaaaccagcaagaaacgtacttgggagtcggccat

SEQ ID NO: 410126 - DNA, 140 bp, Artificial Sequence
  Synthetic
atggccgactcccaagtacgtttcttgctggttttgcgatttttcaagtaagttgtatattaagcctgtgtaattttcaatttctctttcccactccatccaggtcatgttattccaaatggagacccagcatggcgtat

SEQ ID NO: 410127 - DNA, 140 bp, Artificial Sequence
  Synthetic
atacgccatgctgggtctcctaggactggtagtggcgctaatcctagcaatagttgtgtggactatagtattcatagagtgtagaagagtgcaaaagcaaagaaaaatagataggttaatcgtacttgggagtcggccat

SEQ ID NO: 410128 - DNA, 140 bp, Artificial Sequence
  Synthetic
atggccgactcccaagtacgattaacctatctatttttctttgcttttgcactcttctacactctatgaatactatagtccacacaactattgctaggattagcgccactaccagtcctaggagacccagcatggcgtat

SEQ ID NO: 410129 - DNA, 140 bp, Artificial Sequence
  Synthetic
atacgccatgctgggtctccgtagctgaaggaacagataggattatagaaatagcaagaacaatttttagagctttttaccatatacctagaagaataagacagggctttgagagggcttcgtacttgggagtcggccat

SEQ ID NO: 410130 - DNA, 140 bp, Artificial Sequence
  Synthetic
atggccgactcccaagtacgaagccctctcaaagccctgtcttattcttctaggtatatggtaaaaagctctaaaaattgttcttgctatttctataatcctatctgttccttcagctacggagacccagcatggcgtat

SEQ ID NO: 410131 - DNA, 140 bp, Artificial Sequence
  Synthetic
aggccctggctgctgatatggtggggatttaccacaccagacaagaaacatcagaaagaacctccatttctttggatggggtatgaactccatcctgacaaatggacagtacagcctatagaccttttgggacagcggtg

SEQ ID NO: 410132 - DNA, 140 bp, Artificial Sequence
  Synthetic
caccgctgtcccaaaaggtctataggctgtactgtccatttgtcaggatggagttcataccccatccaaagaaatggaggttctttctgatgtttcttgtctggtgtggtaaatccccaccatatcagcagccagggcct

SEQ ID NO: 410133 - DNA, 140 bp, Artificial Sequence
  Synthetic
atacgccatgctgggtctcccttggagaggagttgaagctataataaggattctgcaacaactactatttacccatttcagaattggatgccaacaagcagaataggcattaatcgacagcgtacttgggagtcggccat

SEQ ID NO: 410134 - DNA, 140 bp, Artificial Sequence
  Synthetic
atggccgactcccaagtacgctgtcgattaatgcctattctgcttgttggcatccaattctgaaatgggtaaatagtagttgttgcagaatccttattatagcttcaactcctctccaagggagacccagcatggcgtat

SEQ ID NO: 410135 - DNA, 140 bp, Artificial Sequence
  Synthetic
aggccctggctgctgatatgaaggctttcagcccagaagtaatacccatgttttcagcattatcagaaggagccaccccacaagatttaaacaccatgctaaatacagtggggggacatcgaccttttgggacagcggtg

SEQ ID NO: 410136 - DNA, 140 bp, Artificial Sequence
  Synthetic
caccgctgtcccaaaaggtcgatgtccccccactgtatttagcatggtgtttaaatcttgtggggtggctccttctgataatgctgaaaacatgggtattacttctgggctgaaagccttcatatcagcagccagggcct

SEQ ID NO: 410137 - DNA, 140 bp, Artificial Sequence
  Synthetic
atacgccatgctgggtctccagttgtgtggaccatagcatatctagaatataggaaagtgttaaagcaagaaagaataaaccagttatataatagactaatagaaagagcagaagacagtcgtacttgggagtcggccat

SEQ ID NO: 410138 - DNA, 140 bp, Artificial Sequence
  Synthetic
atggccgactcccaagtacgactgtcttctgctctttctattagtctattatataactggtttattctttcttgctttaacactttcctatattctagatatgctatggtccacacaactggagacccagcatggcgtat

SEQ ID NO: 410139 - DNA, 140 bp, Artificial Sequence
  Synthetic
aggccctggctgctgatatgattagaattggcagagaacagggaaattttaaaagaaccagtacatggggtatattatgacccatcaaaagacttaatagctgaaatacagaaacagggggaccttttgggacagcggtg

SEQ ID NO: 410140 - DNA, 140 bp, Artificial Sequence
  Synthetic
caccgctgtcccaaaaggtccccctgtttctgtatttcagctattaagtcttttgatgggtcataatataccccatgtactggttcttttaaaatttccctgttctctgccaattctaatcatatcagcagccagggcct

SEQ ID NO: 410141 - DNA, 140 bp, Artificial Sequence
  Synthetic
aggccctggctgctgatatgggactgtcaatgatatacagaagttagtaggaaaactaaattgggcaagtcagatttatccagggattaaagtaaagcaattatgtaaactccttagggggaccttttgggacagcggtg

SEQ ID NO: 410142 - DNA, 140 bp, Artificial Sequence
  Synthetic
caccgctgtcccaaaaggtccccctaaggagtttacataattgctttactttaatccctggataaatctgacttgcccaatttagttttcctactaacttctgtatatcattgacagtcccatatcagcagccagggcct

SEQ ID NO: 410143 - DNA, 140 bp, Artificial Sequence
  Synthetic
aggccctggctgctgatatgattgctctttcaatataaccacaatgctaaaagataagaaaaagaaacagtatgcacttttctatagagaagatatagtgccaattaacattaagaagaagaccttttgggacagcggtg

SEQ ID NO: 410144 - DNA, 140 bp, Artificial Sequence
  Synthetic
caccgctgtcccaaaaggtcttcttcttaatgttaattggcactatatcttctctatagaaaagtgcatactgtttctttttcttatcttttagcattgtggttatattgaaagagcaatcatatcagcagccagggcct

SEQ ID NO: 410145 - DNA, 140 bp, Artificial Sequence
  Synthetic
atacgccatgctgggtctcctgccccagctggttttgcgattctaaaatgtaatgaaaaagagttcaatggaacagggccatgcaaaaatgtcagcacagtacaatgtacacatggaattcgtacttgggagtcggccat

SEQ ID NO: 410146 - DNA, 140 bp, Artificial Sequence
  Synthetic
atggccgactcccaagtacgaattccatgtgtacattgtactgtgctgacatttttgcatggccctgttccattgaactctttttcattacattttagaatcgcaaaaccagctggggcaggagacccagcatggcgtat

SEQ ID NO: 410147 - DNA, 140 bp, Artificial Sequence
  Synthetic
atacgccatgctgggtctccgaacagggccatgcaaaaatgtcagcacagtacaatgtacacatggaattagaccagtaatatcaacccaactattgctaaatggcagcctagcagaaaacgtacttgggagtcggccat

SEQ ID NO: 410148 - DNA, 140 bp, Artificial Sequence
  Synthetic
atggccgactcccaagtacgttttctgctaggctgccatttagcaatagttgggttgatattactggtctaattccatgtgtacattgtactgtgctgacatttttgcatggccctgttcggagacccagcatggcgtat

SEQ ID NO: 410149 - DNA, 140 bp, Artificial Sequence
  Synthetic
atacgccatgctgggtctcctagtacagcttaatgaaactgtagaaattgtgtgtataagaccaggcaacaacacaagaaaaagtattcgtataggaccaggacagacattttatgcaaccgtacttgggagtcggccat

SEQ ID NO: 410150 - DNA, 140 bp, Artificial Sequence
  Synthetic
atggccgactcccaagtacggttgcataaaatgtctgtcctggtcctatacgaatactttttcttgtgttgttgcctggtcttatacacacaatttctacagtttcattaagctgtactaggagacccagcatggcgtat

SEQ ID NO: 410151 - DNA, 140 bp, Artificial Sequence
  Synthetic
aggccctggctgctgatatgaacacaagaaaaagtattcgtataggaccaggacagacattttatgcaacaggtgatataataggagatataagacaggcgcattgtaatattactggaggaccttttgggacagcggtg

SEQ ID NO: 410152 - DNA, 140 bp, Artificial Sequence
  Synthetic
caccgctgtcccaaaaggtcctccagtaatattacaatgcgcctgtcttatatctcctattatatcacctgttgcataaaatgtctgtcctggtcctatacgaatactttttcttgtgttcatatcagcagccagggcct

SEQ ID NO: 410153 - DNA, 140 bp, Artificial Sequence
  Synthetic
atacgccatgctgggtctcctttactaataaaacaataatatttaaaccacactcaggaggggacccagaagttgtaatgcatacctttaattgtggaggagaatttttctactgcaatacgtacttgggagtcggccat

SEQ ID NO: 410154 - DNA, 140 bp, Artificial Sequence
  Synthetic
atggccgactcccaagtacgtattgcagtagaaaaattctcctccacaattaaaggtatgcattacaacttctgggtcccctcctgagtgtggtttaaatattattgttttattagtaaaggagacccagcatggcgtat

SEQ ID NO: 410155 - DNA, 140 bp, Artificial Sequence
  Synthetic
atacgccatgctgggtctccacactcccatgtaaaataaaacagattataaacaggtggcagggagtgggccaagcaatgtatgcccctcccatcgcaggaaatattacctgtagatcaacgtacttgggagtcggccat

SEQ ID NO: 410156 - DNA, 140 bp, Artificial Sequence
  Synthetic
atggccgactcccaagtacgttgatctacaggtaatatttcctgcgatgggaggggcatacattgcttggcccactccctgccacctgtttataatctgttttattttacatgggagtgtggagacccagcatggcgtat

SEQ ID NO: 410157 - DNA, 140 bp, Artificial Sequence
  Synthetic
atacgccatgctgggtctcccagccaaaattaccctatagtgcaaaatgcacaagggcaaatgatactccagaccttatcacctaggactttgaatgcatgggtaaaagtaatagaagaacgtacttgggagtcggccat

SEQ ID NO: 410158 - DNA, 140 bp, Artificial Sequence
  Synthetic
atggccgactcccaagtacgttcttctattacttttacccatgcattcaaagtcctaggtgataaggtctggagtatcatttgcccttgtgcattttgcactatagggtaattttggctgggagacccagcatggcgtat

SEQ ID NO: 410159 - DNA, 140 bp, Artificial Sequence
  Synthetic
aggccctggctgctgatatgagctggagtaatagatctcaggatgagatttggaacaacatgacctggatggagtgggagaatgagattaacaattacacaggaataatatatcaattgagaccttttgggacagcggtg

SEQ ID NO: 410160 - DNA, 140 bp, Artificial Sequence
  Synthetic
caccgctgtcccaaaaggtctcaattgatatattattcctgtgtaattgttaatctcattctcccactccatccaggtcatgttgttccaaatctcatcctgagatctattactccagctcatatcagcagccagggcct

SEQ ID NO: 410161 - DNA, 140 bp, Artificial Sequence
  Synthetic
aggccctggctgctgatatgtgccaagtttgtttcatgaaaaaaggcttaggcatcttctatggcaggaagaagcgaagacaccgacgaaaagctcctccagacagtcaagctaatcaaggaccttttgggacagcggtg

SEQ ID NO: 410162 - DNA, 140 bp, Artificial Sequence
  Synthetic
caccgctgtcccaaaaggtccttgattagcttgactgtctggaggagcttttcgtcggtgtcttcgcttcttcctgccatagaagatgcctaagccttttttcatgaaacaaacttggcacatatcagcagccagggcct

SEQ ID NO: 410163 - DNA, 140 bp, Artificial Sequence
  Synthetic
aggccctggctgctgatatgggctaattttttagggaaaatttggccttccagcaaggggaggccaggaaattttcctcagagcagaccggagccaacagccccaccagcagagatctttgaccttttgggacagcggtg

SEQ ID NO: 410164 - DNA, 140 bp, Artificial Sequence
  Synthetic
caccgctgtcccaaaaggtcaaagatctctgctggtggggctgttggctccggtctgctctgaggaaaatttcctggcctccccttgctggaaggccaaattttccctaaaaaattagcccatatcagcagccagggcct

SEQ ID NO: 410165 - DNA, 140 bp, Artificial Sequence
  Synthetic
atacgccatgctgggtctccgtcaaaaggttggcctagtgtaagagaaagaataaggcgaacccctccagcagctccagcagcagatggggtgggagcagtgtctcaagacctagctaaacgtacttgggagtcggccat

SEQ ID NO: 410166 - DNA, 140 bp, Artificial Sequence
  Synthetic
atggccgactcccaagtacgtttagctaggtcttgagacactgctcccaccccatctgctgctggagctgctggaggggttcgccttattctttctcttacactaggccaaccttttgacggagacccagcatggcgtat

SEQ ID NO: 410167 - DNA, 140 bp, Artificial Sequence
  Synthetic
atacgccatgctgggtctccggtacctacaagggggccgaccaggaaataaaaaattgctctttcaatgccaccacagaattaaaagataaggagaaaaaagtgtatgcacttttttatacgtacttgggagtcggccat

SEQ ID NO: 410168 - DNA, 140 bp, Artificial Sequence
  Synthetic
atggccgactcccaagtacgtataaaaaagtgcatacacttttttctccttatcttttaattctgtggtggcattgaaagagcaattttttatttcctggtcggcccccttgtaggtaccggagacccagcatggcgtat

SEQ ID NO: 410169 - DNA, 140 bp, Artificial Sequence
  Synthetic
aggccctggctgctgatatgctcgacgcaggactcggcttgctgaagtgcactcggcaagaggcgagagcggcgactggtgagtacgccgaaaaatttttgactagcggaggctagaagggaccttttgggacagcggtg

SEQ ID NO: 410170 - DNA, 140 bp, Artificial Sequence
  Synthetic
caccgctgtcccaaaaggtcccttctagcctccgctagtcaaaaatttttcggcgtactcaccagtcgccgctctcgcctcttgccgagtgcacttcagcaagccgagtcctgcgtcgagcatatcagcagccagggcct

SEQ ID NO: 410171 - DNA, 140 bp, Artificial Sequence
  Synthetic
aggccctggctgctgatatgctattgtaaaaagtgttgctttcattgttactggtgctttacaacaaagggcttaggcatctcctatggcaggaagaagcggggacagcgacgaagaactgaccttttgggacagcggtg

SEQ ID NO: 410172 - DNA, 140 bp, Artificial Sequence
  Synthetic
caccgctgtcccaaaaggtcagttcttcgtcgctgtccccgcttcttcctgccataggagatgcctaagccctttgttgtaaagcaccagtaacaatgaaagcaacactttttacaatagcatatcagcagccagggcct

SEQ ID NO: 410173 - DNA, 140 bp, Artificial Sequence
  Synthetic
aggccctggctgctgatatggcttaggcatctcctatggcaggaagaagcggggacagcgacgaagaactcctcagagcagtaagatacatcaagattttgtacagcagcagtaagtattgaccttttgggacagcggtg

SEQ ID NO: 410174 - DNA, 140 bp, Artificial Sequence
  Synthetic
caccgctgtcccaaaaggtcaatacttactgctgctgtacaaaatcttgatgtatcttactgctctgaggagttcttcgtcgctgtccccgcttcttcctgccataggagatgcctaagccatatcagcagccagggcct

SEQ ID NO: 410175 - DNA, 140 bp, Artificial Sequence
  Synthetic
aggccctggctgctgatatgttagtagtagcactaatattagcaatagttgtgtggactatagtatatatagaatataagaaaatagtaaggcaaagaagaataaatagcttatatgaaagaccttttgggacagcggtg

SEQ ID NO: 410176 - DNA, 140 bp, Artificial Sequence
  Synthetic
caccgctgtcccaaaaggtctttcatataagctatttattcttctttgccttactattttcttatattctatatatactatagtccacacaactattgctaatattagtgctactactaacatatcagcagccagggcct

SEQ ID NO: 410177 - DNA, 140 bp, Artificial Sequence
  Synthetic
atacgccatgctgggtctccttgcaaccctctattgtgtacattgtaagatagaagtaaaagacaccaaggaagctctagacaagatagaggagattcaaaacaaaagcaagaaaaaggccgtacttgggagtcggccat

SEQ ID NO: 410178 - DNA, 140 bp, Artificial Sequence
  Synthetic
atggccgactcccaagtacggcctttttcttgcttttgttttgaatctcctctatcttgtctagagcttccttggtgtcttttacttctatcttacaatgtacacaatagagggttgcaaggagacccagcatggcgtat

SEQ ID NO: 410179 - DNA, 140 bp, Artificial Sequence
  Synthetic
atacgccatgctgggtctccggtggagagagagacagagacagatcaactcgattagtggatggattcttagcaatcatctgggacgatctgcggagcctgtgcctcttcagctaccacccgtacttgggagtcggccat

SEQ ID NO: 410180 - DNA, 140 bp, Artificial Sequence
  Synthetic
atggccgactcccaagtacgggtggtagctgaagaggcacaggctccgcagatcgtcccagatgattgctaagaatccatccactaatcgagttgatctgtctctgtctctctctccaccggagacccagcatggcgtat

SEQ ID NO: 410181 - DNA, 140 bp, Artificial Sequence
  Synthetic
atacgccatgctgggtctccggcaggggcaatacaaaactgttctttcaatgtgaccacagagttaagagataagaagaagaaagaatatgcaattttttataaacttgatatagtaccacgtacttgggagtcggccat

SEQ ID NO: 410182 - DNA, 140 bp, Artificial Sequence
  Synthetic
atggccgactcccaagtacgtggtactatatcaagtttataaaaaattgcatattctttcttcttcttatctcttaactctgtggtcacattgaaagaacagttttgtattgcccctgccggagacccagcatggcgtat

SEQ ID NO: 410183 - DNA, 140 bp, Artificial Sequence
  Synthetic
aggccctggctgctgatatgaccttaatgaatctgtagaaattgtgtgtacaagacccaacaataatacaagaacaagtataaggataggaccaggacaaacattctatgcaacaaatgagaccttttgggacagcggtg

SEQ ID NO: 410184 - DNA, 140 bp, Artificial Sequence
  Synthetic
caccgctgtcccaaaaggtctcatttgttgcatagaatgtttgtcctggtcctatccttatacttgttcttgtattattgttgggtcttgtacacacaatttctacagattcattaaggtcatatcagcagccagggcct

SEQ ID NO: 410185 - DNA, 140 bp, Artificial Sequence
  Synthetic
atacgccatgctgggtctccgagagaaacataagctttcaaccatcctcaggaggggatctagaaattacaacacatagttttaactgtagaggagaatttttctattgcgatacaacaacgtacttgggagtcggccat

SEQ ID NO: 410186 - DNA, 140 bp, Artificial Sequence
  Synthetic
atggccgactcccaagtacgttgttgtatcgcaatagaaaaattctcctctacagttaaaactatgtgttgtaatttctagatcccctcctgaggatggttgaaagcttatgtttctctcggagacccagcatggcgtat

SEQ ID NO: 410187 - DNA, 140 bp, Artificial Sequence
  Synthetic
aggccctggctgctgatatggggggtaggacaagcaatgtatgcccctcccattgcaggaaacataacatgtagatcaaatatcacaggactactattgacacgtgatggaggaaaaacagaccttttgggacagcggtg

SEQ ID NO: 410188 - DNA, 140 bp, Artificial Sequence
  Synthetic
caccgctgtcccaaaaggtctgtttttcctccatcacgtgtcaatagtagtcctgtgatatttgatctacatgttatgtttcctgcaatgggaggggcatacattgcttgtcctaccccccatatcagcagccagggcct

SEQ ID NO: 410189 - DNA, 140 bp, Artificial Sequence
  Synthetic
aggccctggctgctgatatgtcccatgcagaataaaacaaattataaacatgtggcaggaagtaggaaaagcaatgtatgcccctcccatcagaggacaaattagatgttcatcaaatatgaccttttgggacagcggtg

SEQ ID NO: 410190 - DNA, 140 bp, Artificial Sequence
  Synthetic
caccgctgtcccaaaaggtcatatttgatgaacatctaatttgtcctctgatgggaggggcatacattgcttttcctacttcctgccacatgtttataatttgttttattctgcatgggacatatcagcagccagggcct

SEQ ID NO: 410191 - DNA, 140 bp, Artificial Sequence
  Synthetic
atacgccatgctgggtctccctttaacttccctcaaatcactctttggcagcgacccatggtcacagtaaacataggggggcaagtaaaggaagctctgttagatacaggggcagatgaccgtacttgggagtcggccat

SEQ ID NO: 410192 - DNA, 140 bp, Artificial Sequence
  Synthetic
atggccgactcccaagtacggtcatctgcccctgtatctaacagagcttcctttacttgcccccctatgtttactgtgaccatgggtcgctgccaaagagtgatttgagggaagttaaagggagacccagcatggcgtat

SEQ ID NO: 410193 - DNA, 140 bp, Artificial Sequence
  Synthetic
atacgccatgctgggtctccgagtaggacgagcaatgtatgccaatcccattgcaggaaaaattaactgtaactcaaatattacaggtctattattgacaagagatggtggtaatcaggccgtacttgggagtcggccat

SEQ ID NO: 410194 - DNA, 140 bp, Artificial Sequence
  Synthetic
atggccgactcccaagtacggcctgattaccaccatctcttgtcaataatagacctgtaatatttgagttacagttaatttttcctgcaatgggattggcatacattgctcgtcctactcggagacccagcatggcgtat

SEQ ID NO: 410195 - DNA, 140 bp, Artificial Sequence
  Synthetic
aggccctggctgctgatatgatctgcaacatacctagaagaataagacagggctttgaagcagctttgcaataaaatggggaacaagtggtcaaaaagtagcatagttggatggcctgctgaccttttgggacagcggtg

SEQ ID NO: 410196 - DNA, 140 bp, Artificial Sequence
  Synthetic
caccgctgtcccaaaaggtcagcaggccatccaactatgctactttttgaccacttgttccccattttattgcaaagctgcttcaaagccctgtcttattcttctaggtatgttgcagatcatatcagcagccagggcct

SEQ ID NO: 410197 - DNA, 140 bp, Artificial Sequence
  Synthetic
aggccctggctgctgatatgttgggataacatgacctggatggagtgggatagagaaattgataattacacaaacataatatacatgttgcttgaagactcgcaaatccagcaggagaaagaccttttgggacagcggtg

SEQ ID NO: 410198 - DNA, 140 bp, Artificial Sequence
  Synthetic
caccgctgtcccaaaaggtctttctcctgctggatttgcgagtcttcaagcaacatgtatattatgtttgtgtaattatcaatttctctatcccactccatccaggtcatgttatcccaacatatcagcagccagggcct

SEQ ID NO: 410199 - DNA, 140 bp, Artificial Sequence
  Synthetic
atacgccatgctgggtctccgagtagtagtagtaggaatataatggaaggagaaatggcaaactgctcttttaatatcaccacaaccatgaataaggtgcagaaagaatatgcactctttcgtacttgggagtcggccat

SEQ ID NO: 410200 - DNA, 140 bp, Artificial Sequence
  Synthetic
atggccgactcccaagtacgaaagagtgcatattctttctgcaccttattcatggttgtggtgatattaaaagagcagtttgccatttctccttccattatattcctactactactactcggagacccagcatggcgtat

SEQ ID NO: 410201 - DNA, 140 bp, Artificial Sequence
  Synthetic
aggccctggctgctgatatgattagtggatggattcttagcaattatctgggtcgacctgcggagcctgtgcctcttcagctaccaccgcttgagagacttactcttgattgtaacgagggaccttttgggacagcggtg

SEQ ID NO: 410202 - DNA, 140 bp, Artificial Sequence
  Synthetic
caccgctgtcccaaaaggtccctcgttacaatcaagagtaagtctctcaagcggtggtagctgaagaggcacaggctccgcaggtcgacccagataattgctaagaatccatccactaatcatatcagcagccagggcct

SEQ ID NO: 410203 - DNA, 140 bp, Artificial Sequence
  Synthetic
aggccctggctgctgatatgcactattgtgccccggctggttttgcgattctaaaatgtaacgagaaggagttcagtggaaagggaccatgtaaaaatgtcagcacagtacaatctacacgaccttttgggacagcggtg

SEQ ID NO: 410204 - DNA, 140 bp, Artificial Sequence
  Synthetic
caccgctgtcccaaaaggtcgtgtagattgtactgtgctgacatttttacatggtccctttccactgaactccttctcgttacattttagaatcgcaaaaccagccggggcacaatagtgcatatcagcagccagggcct

SEQ ID NO: 410205 - DNA, 140 bp, Artificial Sequence
  Synthetic
aggccctggctgctgatatgtgatactatagcaatagtagtagctgaaggaacagataggatcatagaagtactacaaagaatttttagagctatctgcaacatacctacaagaataagagaccttttgggacagcggtg

SEQ ID NO: 410206 - DNA, 140 bp, Artificial Sequence
  Synthetic
caccgctgtcccaaaaggtctcttattcttgtaggtatgttgcagatagctctaaaaattctttgtagtacttctatgatcctatctgttccttcagctactactattgctatagtatcacatatcagcagccagggcct

SEQ ID NO: 410207 - DNA, 140 bp, Artificial Sequence
  Synthetic
aggccctggctgctgatatggacccagaaattgtagcacacagttttaattgtggaggggaatttttctactgtgagacaacacaactgtttaatagcacttggattagggataatggtagaccttttgggacagcggtg

SEQ ID NO: 410208 - DNA, 140 bp, Artificial Sequence
  Synthetic
caccgctgtcccaaaaggtctaccattatccctaatccaagtgctattaaacagttgtgttgtctcacagtagaaaaattcccctccacaattaaaactgtgtgctacaatttctgggtccatatcagcagccagggcct

SEQ ID NO: 410209 - DNA, 140 bp, Artificial Sequence
  Synthetic
aggccctggctgctgatatgtgcagaataagacaaattgtaaacctgtggcagcaagtaggaaaagcaatgtatgcccctcccatcagtggaccaattaactgtttatcaaatattacaggaccttttgggacagcggtg

SEQ ID NO: 410210 - DNA, 140 bp, Artificial Sequence
  Synthetic
caccgctgtcccaaaaggtcctgtaatatttgataaacagttaattggtccactgatgggaggggcatacattgcttttcctacttgctgccacaggtttacaatttgtcttattctgcacatatcagcagccagggcct

SEQ ID NO: 410211 - DNA, 140 bp, Artificial Sequence
  Synthetic
aggccctggctgctgatatggtttcaactgtggcaaggaagggcacatagccagaaattgcagggcccctaggaaaaagggctgttggaaatgtggaaaggaaggacaccaaatgaaagagaccttttgggacagcggtg

SEQ ID NO: 410212 - DNA, 140 bp, Artificial Sequence
  Synthetic
caccgctgtcccaaaaggtctctttcatttggtgtccttcctttccacatttccaacagccctttttcctaggggccctgcaatttctggctatgtgcccttccttgccacagttgaaaccatatcagcagccagggcct

SEQ ID NO: 410213 - DNA, 140 bp, Artificial Sequence
  Synthetic
aggccctggctgctgatatgtgctgaagcgcgcacggcaggaggcgaggggcggcgactggtgagtacgccaaaaataaaatttggactagcggaggctagaaggagagagatgggtgcggaccttttgggacagcggtg

SEQ ID NO: 410214 - DNA, 140 bp, Artificial Sequence
  Synthetic
caccgctgtcccaaaaggtccgcacccatctctctccttctagcctccgctagtccaaattttatttttggcgtactcaccagtcgccgcccctcgcctcctgccgtgcgcgcttcagcacatatcagcagccagggcct

SEQ ID NO: 410215 - DNA, 140 bp, Artificial Sequence
  Synthetic
aggccctggctgctgatatgaccagtgctgcggttaaggcagcctgttggtgggcaggtatcaagcaggaatttggaattccctacaatccccaaagtcaaggagtagtagaatctatgagaccttttgggacagcggtg

SEQ ID NO: 410216 - DNA, 140 bp, Artificial Sequence
  Synthetic
caccgctgtcccaaaaggtctcatagattctactactccttgactttggggattgtagggaattccaaattcctgcttgatacctgcccaccaacaggctgccttaaccgcagcactggtcatatcagcagccagggcct

SEQ ID NO: 410217 - DNA, 140 bp, Artificial Sequence
  Synthetic
aggccctggctgctgatatgtaaattgtaatacctcagccattacacaagcttgtccaaaggtatcctttgagccaattcccatacattattgtgccccagctggttttgcgatcctaaagaccttttgggacagcggtg

SEQ ID NO: 410218 - DNA, 140 bp, Artificial Sequence
  Synthetic
caccgctgtcccaaaaggtctttaggatcgcaaaaccagctggggcacaataatgtatgggaattggctcaaaggatacctttggacaagcttgtgtaatggctgaggtattacaatttacatatcagcagccagggcct

SEQ ID NO: 410219 - DNA, 140 bp, Artificial Sequence
  Synthetic
aggccctggctgctgatatgtggccttcccacaagggaaggccagggaatttccttcagaacagaccagagccaacagccccaccagagccaacagccccaccagcagagagcttcaggtgaccttttgggacagcggtg

SEQ ID NO: 410220 - DNA, 140 bp, Artificial Sequence
  Synthetic
caccgctgtcccaaaaggtcacctgaagctctctgctggtggggctgttggctctggtggggctgttggctctggtctgttctgaaggaaattccctggccttcccttgtgggaaggccacatatcagcagccagggcct

SEQ ID NO: 410221 - DNA, 140 bp, Artificial Sequence
  Synthetic
aggccctggctgctgatatgctgccataaggaaagccatattaggacatagagttagtcctaggtgtgaatatcaagcaggacataacaaggtaggatccttacaatatctggcactaacgaccttttgggacagcggtg

SEQ ID NO: 410222 - DNA, 140 bp, Artificial Sequence
  Synthetic
caccgctgtcccaaaaggtcgttagtgccagatattgtaaggatcctaccttgttatgtcctgcttgatattcacacctaggactaactctatgtcctaatatggctttccttatggcagcatatcagcagccagggcct

SEQ ID NO: 410223 - DNA, 140 bp, Artificial Sequence
  Synthetic
aggccctggctgctgatatgggatgaaagcctaaagccatgtgtaaagctaacccctctctgtgttactttaaactgtactgatgcaaatgtaaccacagtagccaacgaaagcgtgagtgaccttttgggacagcggtg

SEQ ID NO: 410224 - DNA, 140 bp, Artificial Sequence
  Synthetic
caccgctgtcccaaaaggtcactcacgctttcgttggctactgtggttacatttgcatcagtacagtttaaagtaacacagagaggggttagctttacacatggctttaggctttcatcccatatcagcagccagggcct

SEQ ID NO: 410225 - DNA, 140 bp, Artificial Sequence
  Synthetic
aggccctggctgctgatatgaccttcagacctggaggaggagatatgagagacaattggagaagtgaattatataagtataaagtagtaaaaattgaaccactaggagtagcacccaccagaccttttgggacagcggtg

SEQ ID NO: 410226 - DNA, 140 bp, Artificial Sequence
  Synthetic
caccgctgtcccaaaaggtctggtgggtgctactcctagtggttcaatttttactactttatacttatataattcacttctccaattgtctctcatatctcctcctccaggtctgaaggtcatatcagcagccagggcct

SEQ ID NO: 410227 - DNA, 140 bp, Artificial Sequence
  Synthetic
aggccctggctgctgatatggaatactgcaacaactgctgtttactcatttcagaattgggtgccaacatagcagaataggcattttgcaacagagaagagggaggaatggagccaataggaccttttgggacagcggtg

SEQ ID NO: 410228 - DNA, 140 bp, Artificial Sequence
  Synthetic
caccgctgtcccaaaaggtcctattggctccattcctccctcttctctgttgcaaaatgcctattctgctatgttggcacccaattctgaaatgagtaaacagcagttgttgcagtattccatatcagcagccagggcct

SEQ ID NO: 410229 - DNA, 140 bp, Artificial Sequence
  Synthetic
atacgccatgctgggtctcctgcaaccagtgctattgtaaaaagtgttgctatcattgccaactatgctttttaaagaagggcttaggcatttccaatggcaggaagaagaggagaccaacgtacttgggagtcggccat

SEQ ID NO: 410230 - DNA, 140 bp, Artificial Sequence
  Synthetic
atggccgactcccaagtacgttggtctcctcttcttcctgccattggaaatgcctaagcccttctttaaaaagcatagttggcaatgatagcaacactttttacaatagcactggttgcaggagacccagcatggcgtat

SEQ ID NO: 410231 - DNA, 140 bp, Artificial Sequence
  Synthetic
atacgccatgctgggtctccgacgcacaactccttacggcagtaagaatcatcaagatcctataccagagcagtaagtattgttaaatagtatatgtaatgagatgaatattttagcagtcgtacttgggagtcggccat

SEQ ID NO: 410232 - DNA, 140 bp, Artificial Sequence
  Synthetic
atggccgactcccaagtacgactgctaaaatattcatctcattacatatactatttaacaatacttactgctctggtataggatcttgatgattcttactgccgtaaggagttgtgcgtcggagacccagcatggcgtat

SEQ ID NO: 410233 - DNA, 140 bp, Artificial Sequence
  Synthetic
aggccctggctgctgatatgtgaactccatcctgacaaatggacagtacagcctatacagctgccagaaaaagatagctggactgtcaatgatatacagaagttagtgggaaaattaaacgaccttttgggacagcggtg

SEQ ID NO: 410234 - DNA, 140 bp, Artificial Sequence
  Synthetic
caccgctgtcccaaaaggtcgtttaattttcccactaacttctgtatatcattgacagtccagctatctttttctggcagctgtataggctgtactgtccatttgtcaggatggagttcacatatcagcagccagggcct

SEQ ID NO: 410235 - DNA, 140 bp, Artificial Sequence
  Synthetic
aggccctggctgctgatatgtacctagaagaatcagacagggcttcgaaagggctttgctataacatggggggcaagtggtcaaaaagtagcatagtgggatggcctgagattagagaaagaccttttgggacagcggtg

SEQ ID NO: 410236 - DNA, 140 bp, Artificial Sequence
  Synthetic
caccgctgtcccaaaaggtctttctctaatctcaggccatcccactatgctactttttgaccacttgccccccatgttatagcaaagccctttcgaagccctgtctgattcttctaggtacatatcagcagccagggcct

SEQ ID NO: 410237 - DNA, 140 bp, Artificial Sequence
  Synthetic
  misc_feature (75)..(75): n is a, c, g, or t
  misc_feature (92)..(92): n is a, c, g, or t
aggccctggctgctgatatggggcaagtggtcaaaaagtagcatagtgggatggcctgagattagagaaagaatnagacgtactcctccacntactcctccagcagcagcaggagtaggagaccttttgggacagcggtg

SEQ ID NO: 410238 - DNA, 140 bp, Artificial Sequence
  Synthetic
  misc_feature (49)..(49): n is a, c, g, or t
  misc_feature (66)..(66): n is a, c, g, or t
caccgctgtcccaaaaggtctcctactcctgctgctgctggaggagtangtggaggagtacgtctnattctttctctaatctcaggccatcccactatgctactttttgaccacttgccccatatcagcagccagggcct

SEQ ID NO: 410239 - DNA, 140 bp, Artificial Sequence
  Synthetic
atacgccatgctgggtctcccacatggaattaagccagtggtgtcaacccagttactgctaaatggcagtctagcagaagaagacataatgattagaactgaaaacatcatagacaataccgtacttgggagtcggccat

SEQ ID NO: 410240 - DNA, 140 bp, Artificial Sequence
  Synthetic
atggccgactcccaagtacggtattgtctatgatgttttcagttctaatcattatgtcttcttctgctagactgccatttagcagtaactgggttgacaccactggcttaattccatgtgggagacccagcatggcgtat

SEQ ID NO: 410241 - DNA, 140 bp, Artificial Sequence
  Synthetic
atacgccatgctgggtctccgacccaacaacaatacaagaaaaagtatacccatgggaccaggacgagcgttctatgcaacaggtgacataataggaaatataagaaaagcatattgtgacgtacttgggagtcggccat

SEQ ID NO: 410242 - DNA, 140 bp, Artificial Sequence
  Synthetic
atggccgactcccaagtacgtcacaatatgcttttcttatatttcctattatgtcacctgttgcatagaacgctcgtcctggtcccatgggtatactttttcttgtattgttgttgggtcggagacccagcatggcgtat

SEQ ID NO: 410243 - DNA, 140 bp, Artificial Sequence
  Synthetic
atacgccatgctgggtctccccatgtcacataaaacaaattgtgagaatgtggcaaagagtagaataagcaatgtatgccccccccatcgcaggaaaaattcaatgtatatcaaatattacgtacttgggagtcggccat

SEQ ID NO: 410244 - DNA, 140 bp, Artificial Sequence
  Synthetic
atggccgactcccaagtacgtaatatttgatatacattgaatttttcctgcgatggggggggcatacattgcttattctactctttgccacattctcacaatttgttttatgtgacatggggagacccagcatggcgtat

SEQ ID NO: 410245 - DNA, 140 bp, Artificial Sequence
  Synthetic
aggccctggctgctgatatgttatcacctaggactttgaatgcatgggtaaaagtaatagaagaaaagggtttcagcccagaagtaatacccatgttctcagcattatcagaaggagccagaccttttgggacagcggtg

SEQ ID NO: 410246 - DNA, 140 bp, Artificial Sequence
  Synthetic
caccgctgtcccaaaaggtctggctccttctgataatgctgagaacatgggtattacttctgggctgaaacccttttcttctattacttttacccatgcattcaaagtcctaggtgataacatatcagcagccagggcct

SEQ ID NO: 410247 - DNA, 140 bp, Artificial Sequence
  Synthetic
aggccctggctgctgatatgccccacaagatttaaatatgatgctgaacatagtggggggacaccaggcagctatgcaaatgttaaaagataccatcaatgaggaagctgcagaatgggagaccttttgggacagcggtg

SEQ ID NO: 410248 - DNA, 140 bp, Artificial Sequence
  Synthetic
caccgctgtcccaaaaggtctcccattctgcagcttcctcattgatggtatcttttaacatttgcatagctgcctggtgtccccccactatgttcagcatcatatttaaatcttgtggggcatatcagcagccagggcct

SEQ ID NO: 410249 - DNA, 140 bp, Artificial Sequence
  Synthetic
aggccctggctgctgatatggagaaagaacccatagtaggagcagaaactttctatgtagatggggcagctaatagggaaactaaattaggaaaagcaggatatgttactgacagaggaagaccttttgggacagcggtg

SEQ ID NO: 410250 - DNA, 140 bp, Artificial Sequence
  Synthetic
caccgctgtcccaaaaggtcttcctctgtcagtaacatatcctgcttttcctaatttagtttccctattagctgccccatctacatagaaagtttctgctcctactatgggttctttctccatatcagcagccagggcct

SEQ ID NO: 410251 - DNA, 140 bp, Artificial Sequence
  Synthetic
atacgccatgctgggtctccttgtacaagaccctacaacaaaataaaaaaaagaatcatgcatataggaccagggagagcattttatacaacaggaggcgtaggaaatataaaaaaagcacgtacttgggagtcggccat

SEQ ID NO: 410252 - DNA, 140 bp, Artificial Sequence
  Synthetic
atggccgactcccaagtacgtgctttttttatatttcctacgcctcctgttgtataaaatgctctccctggtcctatatgcatgattcttttttttattttgttgtagggtcttgtacaaggagacccagcatggcgtat

SEQ ID NO: 410253 - DNA, 140 bp, Artificial Sequence
  Synthetic
aggccctggctgctgatatgtaataagtgctattgtaaatactgtagctaccattgtctagtttgctttcagacaaaaggcttaggcatttcctatggcaggaagaagcggagacagcgagaccttttgggacagcggtg

SEQ ID NO: 410254 - DNA, 140 bp, Artificial Sequence
  Synthetic
caccgctgtcccaaaaggtctcgctgtctccgcttcttcctgccataggaaatgcctaagccttttgtctgaaagcaaactagacaatggtagctacagtatttacaatagcacttattacatatcagcagccagggcct

SEQ ID NO: 410255 - DNA, 140 bp, Artificial Sequence
  Synthetic
atacgccatgctgggtctcccagcattaatagcagcactaataatagcaatagttgtgtggactatagcatatatagaatatagggaactagtaaggcaaagaaaaataaataggttatacgtacttgggagtcggccat

SEQ ID NO: 410256 - DNA, 140 bp, Artificial Sequence
  Synthetic
atggccgactcccaagtacgtataacctatttatttttctttgccttactagttccctatattctatatatgctatagtccacacaactattgctattattagtgctgctattaatgctgggagacccagcatggcgtat

SEQ ID NO: 410257 - DNA, 140 bp, Artificial Sequence
  Synthetic
aggccctggctgctgatatgtatatagaatatagggaactagtaaggcaaagaaaaataaataggttatataaaagaataagagaaagagcagaagacagtggcaatgagagtgaggggggaccttttgggacagcggtg

SEQ ID NO: 410258 - DNA, 140 bp, Artificial Sequence
  Synthetic
caccgctgtcccaaaaggtcccccctcactctcattgccactgtcttctgctctttctcttattcttttatataacctatttatttttctttgccttactagttccctatattctatatacatatcagcagccagggcct

SEQ ID NO: 410259 - DNA, 140 bp, Artificial Sequence
  Synthetic
atacgccatgctgggtctcctaacaaaaactacaaatggaaaaaatgccagtactgatatgatgaaatgctctttcaatacaaccacagaattaagagataaggaacagaaagcatctgccgtacttgggagtcggccat

SEQ ID NO: 410260 - DNA, 140 bp, Artificial Sequence
  Synthetic
atggccgactcccaagtacggcagatgctttctgttccttatctcttaattctgtggttgtattgaaagagcatttcatcatatcagtactggcattttttccatttgtagtttttgttaggagacccagcatggcgtat

SEQ ID NO: 410261 - DNA, 140 bp, Artificial Sequence
  Synthetic
aggccctggctgctgatatggactgaggaagcagaattagaattggcagagaacagggagattctaaaaaaccctgtgcatggagtatattatgacccatcaaaagacttaatagcagaagaccttttgggacagcggtg

SEQ ID NO: 410262 - DNA, 140 bp, Artificial Sequence
  Synthetic
caccgctgtcccaaaaggtcttctgctattaagtcttttgatgggtcataatatactccatgcacagggttttttagaatctccctgttctctgccaattctaattctgcttcctcagtccatatcagcagccagggcct

SEQ ID NO: 410263 - DNA, 140 bp, Artificial Sequence
  Synthetic
aggccctggctgctgatatgatacctagaagaataagacagggctttgaagcagctttgcaataaaatggggaacaagtggtcaaaaagttggcctgctataagagaaagaatgaggcgagaccttttgggacagcggtg

SEQ ID NO: 410264 - DNA, 140 bp, Artificial Sequence
  Synthetic
caccgctgtcccaaaaggtctcgcctcattctttctcttatagcaggccaactttttgaccacttgttccccattttattgcaaagctgcttcaaagccctgtcttattcttctaggtatcatatcagcagccagggcct

SEQ ID NO: 410265 - DNA, 140 bp, Artificial Sequence
  Synthetic
aggccctggctgctgatatgcagatgctaaagcatatgacacagaggcacataatgtttgggcaacacatgcctgtgtacccacagaccctaaccagcaggaagtagaattggaagatgtgaccttttgggacagcggtg

SEQ ID NO: 410266 - DNA, 140 bp, Artificial Sequence
  Synthetic
caccgctgtcccaaaaggtcacatcttccaattctacttcctgctggttagggtctgtgggtacacaggcatgtgttgcccaaacattatgtgcctctgtgtcatatgctttagcatctgcatatcagcagccagggcct

SEQ ID NO: 410267 - DNA, 140 bp, Artificial Sequence
  Synthetic
atacgccatgctgggtctccaagagatagtcagtgtatgggatcaaagcgtaaagccatgtgtaaaattagccccactctgtgttactctaaattgcactaatttgaataatagtgttgacgtacttgggagtcggccat

SEQ ID NO: 410268 - DNA, 140 bp, Artificial Sequence
  Synthetic
atggccgactcccaagtacgtcaacactattattcaaattagtgcaatttagagtaacacagagtggggctaattttacacatggctttacgctttgatcccatacactgactatctcttggagacccagcatggcgtat

SEQ ID NO: 410269 - DNA, 140 bp, Artificial Sequence
  Synthetic
aggccctggctgctgatatgtaaaagaaccagtacatggggtgtattatgacccatcaaaagacttaatagcagaaatacagaagcaggggcaaggccaatggacatatcaaatttatcagaccttttgggacagcggtg

SEQ ID NO: 410270 - DNA, 140 bp, Artificial Sequence
  Synthetic
caccgctgtcccaaaaggtctgataaatttgatatgtccattggccttgcccctgcttctgtatttctgctattaagtcttttgatgggtcataatacaccccatgtactggttcttttacatatcagcagccagggcct

SEQ ID NO: 410271 - DNA, 140 bp, Artificial Sequence
  Synthetic
aggccctggctgctgatatgtgggacgacctgcggagcctgtgccttttcagctaccaccaattgagagacttcatattgattgtagcgagagcagtggaacttctgggacgcagcagtcgaccttttgggacagcggtg

SEQ ID NO: 410272 - DNA, 140 bp, Artificial Sequence
  Synthetic
caccgctgtcccaaaaggtcgactgctgcgtcccagaagttccactgctctcgctacaatcaatatgaagtctctcaattggtggtagctgaaaaggcacaggctccgcaggtcgtcccacatatcagcagccagggcct

SEQ ID NO: 410273 - DNA, 140 bp, Artificial Sequence
  Synthetic
aggccctggctgctgatatgtaccatagcaatagcagtagctgaaggaacagataggattatagaattagtacaaagaatttgtagagctatccgcaacatacctagaagaataagacaggaccttttgggacagcggtg

SEQ ID NO: 410274 - DNA, 140 bp, Artificial Sequence
  Synthetic
caccgctgtcccaaaaggtcctgtcttattcttctaggtatgttgcggatagctctacaaattctttgtactaattctataatcctatctgttccttcagctactgctattgctatggtacatatcagcagccagggcct

SEQ ID NO: 410275 - DNA, 140 bp, Artificial Sequence
  Synthetic
aggccctggctgctgatatgattgtacaagacccaacaacaatacaagaaaaagtatacatatgggaccagggagagcatggttcacaacaggagaaataataggaaatataagagaagcgaccttttgggacagcggtg

SEQ ID NO: 410276 - DNA, 140 bp, Artificial Sequence
  Synthetic
caccgctgtcccaaaaggtcgcttctcttatatttcctattatttctcctgttgtgaaccatgctctccctggtcccatatgtatactttttcttgtattgttgttgggtcttgtacaatcatatcagcagccagggcct

SEQ ID NO: 410277 - DNA, 140 bp, Artificial Sequence
  Synthetic
atacgccatgctgggtctccgcatgtcaggatggcctgcagtaagacaaagaatagaaagaactccgccaacagcagagagaaccccacctgcaacagagggagtaggagcagcagctggcgtacttgggagtcggccat

SEQ ID NO: 410278 - DNA, 140 bp, Artificial Sequence
  Synthetic
atggccgactcccaagtacgccagctgctgctcctactccctctgttgcaggtggggttctctctgctgttggcggagttctttctattctttgtcttactgcaggccatcctgacatgcggagacccagcatggcgtat

SEQ ID NO: 410279 - DNA, 140 bp, Artificial Sequence
  Synthetic
atacgccatgctgggtctccctataaaattaggaaactactttgacaacaaaacaataatctttactaactcctcaggaggggaccctgaaattgtaactcacagttttatttgtggaggcgtacttgggagtcggccat

SEQ ID NO: 410280 - DNA, 140 bp, Artificial Sequence
  Synthetic
atggccgactcccaagtacgcctccacaaataaaactgtgagttacaatttcagggtcccctcctgaggagttagtaaagattattgttttgttgtcaaagtagtttcctaattttatagggagacccagcatggcgtat

SEQ ID NO: 410281 - DNA, 140 bp, Artificial Sequence
  Synthetic
atacgccatgctgggtctccgaagagggggtgggaagccctcaaacttctggggaatctcgcgctgtattggagtcaggaactaaagaatagtgctattagcttgcttaataccacagcacgtacttgggagtcggccat

SEQ ID NO: 410282 - DNA, 140 bp, Artificial Sequence
  Synthetic
atggccgactcccaagtacgtgctgtggtattaagcaagctaatagcactattctttagttcctgactccaatacagcgcgagattccccagaagtttgagggcttcccaccccctcttcggagacccagcatggcgtat

SEQ ID NO: 410283 - DNA, 140 bp, Artificial Sequence
  Synthetic
aggccctggctgctgatatggggctttgctataaaatgggtagcaagtggtcaaaaagtagtatagttgggtggcctgctataagggaaagattaagacaaacccctccagcagcagaaggaccttttgggacagcggtg

SEQ ID NO: 410284 - DNA, 140 bp, Artificial Sequence
  Synthetic
caccgctgtcccaaaaggtccttctgctgctggaggggtttgtcttaatctttcccttatagcaggccacccaactatactactttttgaccacttgctacccattttatagcaaagccccatatcagcagccagggcct

SEQ ID NO: 410285 - DNA, 140 bp, Artificial Sequence
  Synthetic
aggccctggctgctgatatgggaagaggaagtaggctttccagtcagacctcaggtacctttaagaccaatgacttataagggagctcttgatctcagtcactttttaaaagaaaagggggaccttttgggacagcggtg

SEQ ID NO: 410286 - DNA, 140 bp, Artificial Sequence
  Synthetic
caccgctgtcccaaaaggtcccccttttcttttaaaaagtgactgagatcaagagctcccttataagtcattggtcttaaaggtacctgaggtctgactggaaagcctacttcctcttcccatatcagcagccagggcct

SEQ ID NO: 410287 - DNA, 140 bp, Artificial Sequence
  Synthetic
aggccctggctgctgatatgtcctagggatttggggttgctctggaaaactcatctgcaccactactgtgccttggaataatagttggagtaataaatctctagattatatttggaataagaccttttgggacagcggtg

SEQ ID NO: 410288 - DNA, 140 bp, Artificial Sequence
  Synthetic
caccgctgtcccaaaaggtcttattccaaatataatctagagatttattactccaactattattccaaggcacagtagtggtgcagatgagttttccagagcaaccccaaatccctaggacatatcagcagccagggcct

SEQ ID NO: 410289 - DNA, 140 bp, Artificial Sequence
  Synthetic
atacgccatgctgggtctccgacatgggaggagaaataaaaaactgctctttcaatatgaccacagaattaagggataagaaaaagaaagtatattcacttttttatagacttgatatagcgtacttgggagtcggccat

SEQ ID NO: 410290 - DNA, 140 bp, Artificial Sequence
  Synthetic
atggccgactcccaagtacgctatatcaagtctataaaaaagtgaatatactttctttttcttatcccttaattctgtggtcatattgaaagagcagttttttatttctcctcccatgtcggagacccagcatggcgtat

SEQ ID NO: 410291 - DNA, 140 bp, Artificial Sequence
  Synthetic
aggccctggctgctgatatgagaaccaaggggaagtgacatagcaggaactactagtacccttcaggaacaaataggatggatgacaagtaatccacctatcccagtaggagaaatctatgaccttttgggacagcggtg

SEQ ID NO: 410292 - DNA, 140 bp, Artificial Sequence
  Synthetic
caccgctgtcccaaaaggtcatagatttctcctactgggataggtggattacttgtcatccatcctatttgttcctgaagggtactagtagttcctgctatgtcacttccccttggttctcatatcagcagccagggcct

SEQ ID NO: 410293 - DNA, 140 bp, Artificial Sequence
  Synthetic
aggccctggctgctgatatgccatagcatatcttgaatataggaagctgaaaaagcaagaaagaatagataagataattaaaagaataagagaaagagcagaagacagtggcaatgagaggaccttttgggacagcggtg

SEQ ID NO: 410294 - DNA, 140 bp, Artificial Sequence
  Synthetic
caccgctgtcccaaaaggtcctctcattgccactgtcttctgctctttctcttattcttttaattatcttatctattctttcttgctttttcagcttcctatattcaagatatgctatggcatatcagcagccagggcct

SEQ ID NO: 410295 - DNA, 140 bp, Artificial Sequence
  Synthetic
  misc_feature (81)..(81): n is a, c, g, or t
aggccctggctgctgatatgggctaattttttagggaaaatttggccttccccccaggggaggcccggcaatttccttcanagcaggccagagccaacagccccgccagcagaaagcttcgaccttttgggacagcggtg

SEQ ID NO: 410296 - DNA, 140 bp, Artificial Sequence
  Synthetic
  misc_feature (60)..(60): n is a, c, g, or t
caccgctgtcccaaaaggtcgaagctttctgctggcggggctgttggctctggcctgctntgaaggaaattgccgggcctcccctggggggaaggccaaattttccctaaaaaattagcccatatcagcagccagggcct

SEQ ID NO: 410297 - DNA, 140 bp, Artificial Sequence
  Synthetic
atacgccatgctgggtctccaactaacaatgccactgttgaagaaaatggagaactaaaaaactgctctttcaatgtaaccacagtactacaagataagaagacaaaagaatatgcgcttcgtacttgggagtcggccat

SEQ ID NO: 410298 - DNA, 140 bp, Artificial Sequence
  Synthetic
atggccgactcccaagtacgaagcgcatattcttttgtcttcttatcttgtagtactgtggttacattgaaagagcagttttttagttctccattttcttcaacagtggcattgttagttggagacccagcatggcgtat

SEQ ID NO: 410299 - DNA, 140 bp, Artificial Sequence
  Synthetic
aggccctggctgctgatatgtacacatggaattaggccagtagtatcaactcaactgctgttaaatggcagtctagcagaagaagaggtagtaattagatcagacaatttctcggacaatgaccttttgggacagcggtg

SEQ ID NO: 410300 - DNA, 140 bp, Artificial Sequence
  Synthetic
caccgctgtcccaaaaggtcattgtccgagaaattgtctgatctaattactacctcttcttctgctagactgccatttaacagcagttgagttgatactactggcctaattccatgtgtacatatcagcagccagggcct

SEQ ID NO: 410301 - DNA, 140 bp, Artificial Sequence
  Synthetic
aggccctggctgctgatatgtaccagtacaatgtgcttccacaaggatggaaaggatcaccagcaatattccaaagtagcatgacaaaaatcttagagccttttagaaaacaaaatccaggaccttttgggacagcggtg

SEQ ID NO: 410302 - DNA, 140 bp, Artificial Sequence
  Synthetic
caccgctgtcccaaaaggtcctggattttgttttctaaaaggctctaagatttttgtcatgctactttggaatattgctggtgatcctttccatccttgtggaagcacattgtactggtacatatcagcagccagggcct

SEQ ID NO: 410303 - DNA, 140 bp, Artificial Sequence
  Synthetic
atacgccatgctgggtctccacaaaacaataatctttaattcatctgcaggaggggacctagaaatcacaacacatagttttaattgtatgggagaatttttctattgtaatacaacacacgtacttgggagtcggccat

SEQ ID NO: 410304 - DNA, 140 bp, Artificial Sequence
  Synthetic
atggccgactcccaagtacgtgtgttgtattacaatagaaaaattctcccatacaattaaaactatgtgttgtgatttctaggtcccctcctgcagatgaattaaagattattgttttgtggagacccagcatggcgtat

SEQ ID NO: 410305 - DNA, 140 bp, Artificial Sequence
  Synthetic
aggccctggctgctgatatgcctcaggaggggacccagaaattgtaatgcacagttttaattgtggaggggaatttttctactgtaattcaacacaactgtttaatagtacttggaatgagaccttttgggacagcggtg

SEQ ID NO: 410306 - DNA, 140 bp, Artificial Sequence
  Synthetic
caccgctgtcccaaaaggtctcattccaagtactattaaacagttgtgttgaattacagtagaaaaattcccctccacaattaaaactgtgcattacaatttctgggtcccctcctgaggcatatcagcagccagggcct

SEQ ID NO: 410307 - DNA, 140 bp, Artificial Sequence
  Synthetic
aggccctggctgctgatatgaattagatgcatgggagaaaattcggttaaggccagggggaaagaaaaaatatagaatgaaacatttagtatgggcaagcagggagctggaaagatttgcgaccttttgggacagcggtg

SEQ ID NO: 410308 - DNA, 140 bp, Artificial Sequence
  Synthetic
caccgctgtcccaaaaggtcgcaaatctttccagctccctgcttgcccatactaaatgtttcattctatattttttctttccccctggccttaaccgaattttctcccatgcatctaattcatatcagcagccagggcct

SEQ ID NO: 410309 - DNA, 140 bp, Artificial Sequence
  Synthetic
aggccctggctgctgatatggtacaatgtgcttccacagggatggaaaggatcaccagcaatattccaaagtagcatgacaaaaatcttagagccttttagaaagcaaaatccagacatagaccttttgggacagcggtg

SEQ ID NO: 410310 - DNA, 140 bp, Artificial Sequence
  Synthetic
caccgctgtcccaaaaggtctatgtctggattttgctttctaaaaggctctaagatttttgtcatgctactttggaatattgctggtgatcctttccatccctgtggaagcacattgtaccatatcagcagccagggcct

SEQ ID NO: 410311 - DNA, 140 bp, Artificial Sequence
  Synthetic
atacgccatgctgggtctcccagcagcagatggagtaggggcagtgtctcgagacctggataggcatggggcaatcacaagcagcaatacagcagcaacgaatgcagactgtgcctggctcgtacttgggagtcggccat

SEQ ID NO: 410312 - DNA, 140 bp, Artificial Sequence
  Synthetic
atggccgactcccaagtacgagccaggcacagtctgcattcgttgctgctgtattgctgcttgtgattgccccatgcctatccaggtctcgagacactgcccctactccatctgctgctgggagacccagcatggcgtat

SEQ ID NO: 410313 - DNA, 140 bp, Artificial Sequence
  Synthetic
atacgccatgctgggtctccgctaattttttagggaaactttggccttccagcaaagggaggccaggaaattttcctcagaacaagatagaaccaacagctccaccagcagagctcttggcgtacttgggagtcggccat

SEQ ID NO: 410314 - DNA, 140 bp, Artificial Sequence
  Synthetic
atggccgactcccaagtacgccaagagctctgctggtggagctgttggttctatcttgttctgaggaaaatttcctggcctccctttgctggaaggccaaagtttccctaaaaaattagcggagacccagcatggcgtat

SEQ ID NO: 410315 - DNA, 140 bp, Artificial Sequence
  Synthetic
atacgccatgctgggtctccgtaaccacagaagtgagagataagaaaaagcaagtgtatgcacttttctatagacttgatgtggtaccacttaatgggaaggaaaatagtagcagctatacgtacttgggagtcggccat

SEQ ID NO: 410316 - DNA, 140 bp, Artificial Sequence
  Synthetic
atggccgactcccaagtacgtatagctgctactattttccttcccattaagtggtaccacatcaagtctatagaaaagtgcatacacttgctttttcttatctctcacttctgtggttacggagacccagcatggcgtat

SEQ ID NO: 410317 - DNA, 140 bp, Artificial Sequence
  Synthetic
atacgccatgctgggtctccactcatccaagaataagttcagaagtacacatcccattaggggaaaatagattagtagtaacaacatattggggtctgcatacaggagaaagagactggccgtacttgggagtcggccat

SEQ ID NO: 410318 - DNA, 140 bp, Artificial Sequence
  Synthetic
atggccgactcccaagtacggccagtctctttctcctgtatgcagaccccaatatgttgttactactaatctattttcccctaatgggatgtgtacttctgaacttattcttggatgagtggagacccagcatggcgtat

SEQ ID NO: 410319 - DNA, 140 bp, Artificial Sequence
  Synthetic
aggccctggctgctgatatgggagacagcgacgaagagctcctccaagtagcgaggatcatcaaaatcctataccaaagcagtaagtatatgtaatgttagcaatagattatagcttagggaccttttgggacagcggtg

SEQ ID NO: 410320 - DNA, 140 bp, Artificial Sequence
  Synthetic
caccgctgtcccaaaaggtccctaagctataatctattgctaacattacatatacttactgctttggtataggattttgatgatcctcgctacttggaggagctcttcgtcgctgtctcccatatcagcagccagggcct

SEQ ID NO: 410321 - DNA, 140 bp, Artificial Sequence
  Synthetic
aggccctggctgctgatatgcaagtagaccctgacctagcagaccaactaattcatctgtattattttgattgtttttcagaatctgctataagacatgccatattaggacgcatagttagaccttttgggacagcggtg

SEQ ID NO: 410322 - DNA, 140 bp, Artificial Sequence
  Synthetic
caccgctgtcccaaaaggtctaactatgcgtcctaatatggcatgtcttatagcagattctgaaaaacaatcaaaataatacagatgaattagttggtctgctaggtcagggtctacttgcatatcagcagccagggcct

SEQ ID NO: 410323 - DNA, 140 bp, Artificial Sequence
  Synthetic
aggccctggctgctgatatgataggaccaggacaagcattttatacaaatgacataataggagacataagactagcacattgtaacattagtaaaaaggcatggaacaaaactttacaacgaccttttgggacagcggtg

SEQ ID NO: 410324 - DNA, 140 bp, Artificial Sequence
  Synthetic
caccgctgtcccaaaaggtcgttgtaaagttttgttccatgcctttttactaatgttacaatgtgctagtcttatgtctcctattatgtcatttgtataaaatgcttgtcctggtcctatcatatcagcagccagggcct

SEQ ID NO: 410325 - DNA, 140 bp, Artificial Sequence
  Synthetic
atacgccatgctgggtctcctaatagtagcatgacagaagaaataagaaattgttctttcaacacaactacagaaataagagataagcaaaagaaaatgtatgcacttttttatagatctcgtacttgggagtcggccat

SEQ ID NO: 410326 - DNA, 140 bp, Artificial Sequence
  Synthetic
atggccgactcccaagtacgagatctataaaaaagtgcatacattttcttttgcttatctcttatttctgtagttgtgttgaaagaacaatttcttatttcttctgtcatgctactattaggagacccagcatggcgtat

SEQ ID NO: 410327 - DNA, 140 bp, Artificial Sequence
  Synthetic
aggccctggctgctgatatgatcacacttccatgtaaaataaaacaaattataaacatgtggcaggaggtaggacgggcaatatatgcccctcccattgcaggaaacataacatgcacatgaccttttgggacagcggtg

SEQ ID NO: 410328 - DNA, 140 bp, Artificial Sequence
  Synthetic
caccgctgtcccaaaaggtcatgtgcatgttatgtttcctgcaatgggaggggcatatattgcccgtcctacctcctgccacatgtttataatttgttttattttacatggaagtgtgatcatatcagcagccagggcct

SEQ ID NO: 410329 - DNA, 140 bp, Artificial Sequence
  Synthetic
atacgccatgctgggtctccacagagacattcagacctggaggaggagatatgagagacaattggagaagtgaattatataaatataaagtggtagaagttaaaccattgggaatagcaccgtacttgggagtcggccat

SEQ ID NO: 410330 - DNA, 140 bp, Artificial Sequence
  Synthetic
atggccgactcccaagtacggtgctattcccaatggtttaacttctaccactttatatttatataattcacttctccaattgtctctcatatctcctcctccaggtctgaatgtctctgtggagacccagcatggcgtat

SEQ ID NO: 410331 - DNA, 140 bp, Artificial Sequence
  Synthetic
aggccctggctgctgatatgagaaattgcagggcccctaggaaaaagggctgttggaaatgtggaagggaaggacaccaaatgaaagactgcactgagagacaggctaattttttagggagaccttttgggacagcggtg

SEQ ID NO: 410332 - DNA, 140 bp, Artificial Sequence
  Synthetic
caccgctgtcccaaaaggtctccctaaaaaattagcctgtctctcagtgcagtctttcatttggtgtccttcccttccacatttccaacagccctttttcctaggggccctgcaatttctcatatcagcagccagggcct

SEQ ID NO: 410333 - DNA, 140 bp, Artificial Sequence
  Synthetic
atacgccatgctgggtctccataatacaagaaaaagtatgaggataggaccaggacaagcatggttctatacaaatgacataataggagacataagacaagcacattgtaacatcagtaacgtacttgggagtcggccat

SEQ ID NO: 410334 - DNA, 140 bp, Artificial Sequence
  Synthetic
atggccgactcccaagtacgttactgatgttacaatgtgcttgtcttatgtctcctattatgtcatttgtatagaaccatgcttgtcctggtcctatcctcatactttttcttgtattatggagacccagcatggcgtat

SEQ ID NO: 410335 - DNA, 140 bp, Artificial Sequence
  Synthetic
aggccctggctgctgatatgacaaatgacataataggagacataagacaagcacattgtaacatcagtaaaacaaattggaacacaacttagggaagggtagcggaaaaattaaaagagcgaccttttgggacagcggtg

SEQ ID NO: 410336 - DNA, 140 bp, Artificial Sequence
  Synthetic
caccgctgtcccaaaaggtcgctcttttaatttttccgctacccttccctaagttgtgttccaatttgttttactgatgttacaatgtgcttgtcttatgtctcctattatgtcatttgtcatatcagcagccagggcct

SEQ ID NO: 410337 - DNA, 140 bp, Artificial Sequence
  Synthetic
atacgccatgctgggtctccgaaattacaacacatagttttaattgtagaggaggatttttctattgtaatacaacaaacctgtttaacataaacctgactaactggaggtctgatagtacgtacttgggagtcggccat

SEQ ID NO: 410338 - DNA, 140 bp, Artificial Sequence
  Synthetic
atggccgactcccaagtacgtactatcagacctccagttagtcaggtttatgttaaacaggtttgttgtattacaatagaaaaatcctcctctacaattaaaactatgtgttgtaatttcggagacccagcatggcgtat

SEQ ID NO: 410339 - DNA, 140 bp, Artificial Sequence
  Synthetic
atacgccatgctgggtctccagggaaattccacaattatcacactcccatgtagaataagacaatttgtaaacctgtggcagggggtaggaagggcaatgtatgcccctcccattgaaggcgtacttgggagtcggccat

SEQ ID NO: 410340 - DNA, 140 bp, Artificial Sequence
  Synthetic
atggccgactcccaagtacgccttcaatgggaggggcatacattgcccttcctaccccctgccacaggtttacaaattgtcttattctacatgggagtgtgataattgtggaatttccctggagacccagcatggcgtat

SEQ ID NO: 410341 - DNA, 140 bp, Artificial Sequence
  Synthetic
aggccctggctgctgatatggatatgagggacaattggagaagtgaattatataaatataaagtggtagaaattaagccattgggagtagcacccacagaggcaaaaaggagagtggtgggaccttttgggacagcggtg

SEQ ID NO: 410342 - DNA, 140 bp, Artificial Sequence
  Synthetic
caccgctgtcccaaaaggtcccaccactctcctttttgcctctgtgggtgctactcccaatggcttaatttctaccactttatatttatataattcacttctccaattgtccctcatatccatatcagcagccagggcct

SEQ ID NO: 410343 - DNA, 140 bp, Artificial Sequence
  Synthetic
aggccctggctgctgatatgtttttagatgggatagataaagctcaagaagagcatgaaagatatcacagcaattggagagcaatggctagtgattttaatctgccacctatagtagcaagaccttttgggacagcggtg

SEQ ID NO: 410344 - DNA, 140 bp, Artificial Sequence
  Synthetic
caccgctgtcccaaaaggtcttgctactataggtggcagattaaaatcactagccattgctctccaattgctgtgatatctttcatgctcttcttgagctttatctatcccatctaaaaacatatcagcagccagggcct

SEQ ID NO: 410345 - DNA, 140 bp, Artificial Sequence
  Synthetic
aggccctggctgctgatatggagaaagaatgagacgagcgaggcctgctgtaagagaaagaaggagacaaactgaaccagcagcagagggagtagcagcagagggagtaggaacagcatcgaccttttgggacagcggtg

SEQ ID NO: 410346 - DNA, 140 bp, Artificial Sequence
  Synthetic
caccgctgtcccaaaaggtcgatgctgttcctactccctctgctgctactccctctgctgctggttcagtttgtctccttctttctcttacagcaggcctcgctcgtctcattctttctccatatcagcagccagggcct

SEQ ID NO: 410347 - DNA, 140 bp, Artificial Sequence
  Synthetic
atacgccatgctgggtctcctgctaacagtactgctagtaatagcagtactaattggaaaaacataaatgaagtaatgacaaactgctctttcaatgtcaccacaggtataggaaataggcgtacttgggagtcggccat

SEQ ID NO: 410348 - DNA, 140 bp, Artificial Sequence
  Synthetic
atggccgactcccaagtacgcctatttcctatacctgtggtgacattgaaagagcagtttgtcattacttcatttatgtttttccaattagtactgctattactagcagtactgttagcaggagacccagcatggcgtat

SEQ ID NO: 410349 - DNA, 140 bp, Artificial Sequence
  Synthetic
atacgccatgctgggtctccagacaagcacattgtaacattagtagagcaaaatggaataacactttaaaacagatagttacaaaattaagagaacaatttgggaataaaacaatagtctcgtacttgggagtcggccat

SEQ ID NO: 410350 - DNA, 140 bp, Artificial Sequence
  Synthetic
atggccgactcccaagtacgagactattgttttattcccaaattgttctcttaattttgtaactatctgttttaaagtgttattccattttgctctactaatgttacaatgtgcttgtctggagacccagcatggcgtat

SEQ ID NO: 410351 - DNA, 140 bp, Artificial Sequence
  Synthetic
aggccctggctgctgatatgacagatagttacaaaattaagagaacaatttgggaataaaacaatagtctttaatcaatcctcaggaggggacccagaaattgtaatgcacagttttaatgaccttttgggacagcggtg

SEQ ID NO: 410352 - DNA, 140 bp, Artificial Sequence
  Synthetic
caccgctgtcccaaaaggtcattaaaactgtgcattacaatttctgggtcccctcctgaggattgattaaagactattgttttattcccaaattgttctcttaattttgtaactatctgtcatatcagcagccagggcct

SEQ ID NO: 410353 - DNA, 140 bp, Artificial Sequence
  Synthetic
aggccctggctgctgatatgttaatcaatcctcaggaggggacccagaaattgtaatgcacagttttaattgtggaggggaatttttctactgtaattcaacacaactgtttaatagtacgaccttttgggacagcggtg

SEQ ID NO: 410354 - DNA, 140 bp, Artificial Sequence
  Synthetic
caccgctgtcccaaaaggtcgtactattaaacagttgtgttgaattacagtagaaaaattcccctccacaattaaaactgtgcattacaatttctgggtcccctcctgaggattgattaacatatcagcagccagggcct

SEQ ID NO: 410355 - DNA, 140 bp, Artificial Sequence
  Synthetic
atacgccatgctgggtctccttaatctaacaacaattgtctttacaacaccctcaggaggggacccagaaattacaatgcacagttttacttgtggaggagaatttttctactgtaataccgtacttgggagtcggccat

SEQ ID NO: 410356 - DNA, 140 bp, Artificial Sequence
  Synthetic
atggccgactcccaagtacggtattacagtagaaaaattctcctccacaagtaaaactgtgcattgtaatttctgggtcccctcctgagggtgttgtaaagacaattgttgttagattaaggagacccagcatggcgtat

SEQ ID NO: 410357 - DNA, 140 bp, Artificial Sequence
  Synthetic
aggccctggctgctgatatgagaataaaacaaattataaacaggtggcaggaagtaggaaaagcaatgtatgcccctcccatccaaggacaaattaactgttcatcaaatattacaggacgaccttttgggacagcggtg

SEQ ID NO: 410358 - DNA, 140 bp, Artificial Sequence
  Synthetic
caccgctgtcccaaaaggtcgtcctgtaatatttgatgaacagttaatttgtccttggatgggaggggcatacattgcttttcctacttcctgccacctgtttataatttgttttattctcatatcagcagccagggcct

SEQ ID NO: 410359 - DNA, 140 bp, Artificial Sequence
  Synthetic
aggccctggctgctgatatgtggtcaaaaagtagtatagttggatggcctgccataagggacagaatgagacgaacccctccagcagcagaaggggtgggagcagtgtctcaagacttaggaccttttgggacagcggtg

SEQ ID NO: 410360 - DNA, 140 bp, Artificial Sequence
  Synthetic
caccgctgtcccaaaaggtcctaagtcttgagacactgctcccaccccttctgctgctggaggggttcgtctcattctgtcccttatggcaggccatccaactatactactttttgaccacatatcagcagccagggcct

SEQ ID NO: 410361 - DNA, 140 bp, Artificial Sequence
  Synthetic
atacgccatgctgggtctccaatagttgcatggactatagtaggtatagaaattaagaaattgctaaaacaaagaaaaatagacaggctaattaagagaatacaagaaagagcagaagaccgtacttgggagtcggccat

SEQ ID NO: 410362 - DNA, 140 bp, Artificial Sequence
  Synthetic
atggccgactcccaagtacggtcttctgctctttcttgtattctcttaattagcctgtctatttttctttgttttagcaatttcttaatttctatacctactatagtccatgcaactattggagacccagcatggcgtat

SEQ ID NO: 410363 - DNA, 140 bp, Artificial Sequence
  Synthetic
aggccctggctgctgatatgttcagaagtacacatcccactagaggatgctaaattagtaataacaacatattggggtctgcatacaggagaaagagactggcatttgggtcagggagtcgaccttttgggacagcggtg

SEQ ID NO: 410364 - DNA, 140 bp, Artificial Sequence
  Synthetic
caccgctgtcccaaaaggtcgactccctgacccaaatgccagtctctttctcctgtatgcagaccccaatatgttgttattactaatttagcatcctctagtgggatgtgtacttctgaacatatcagcagccagggcct

SEQ ID NO: 410365 - DNA, 140 bp, Artificial Sequence
  Synthetic
atacgccatgctgggtctccacaaagcattgggagaggcattctccacatacctacaaggataagacagggcctcgaaagagctttgctataagatgggtggcaagtggtcaaagtttagcgtacttgggagtcggccat

SEQ ID NO: 410366 - DNA, 140 bp, Artificial Sequence
  Synthetic
atggccgactcccaagtacgctaaactttgaccacttgccacccatcttatagcaaagctctttcgaggccctgtcttatccttgtaggtatgtggagaatgcctctcccaatgctttgtggagacccagcatggcgtat

SEQ ID NO: 410367 - DNA, 140 bp, Artificial Sequence
  Synthetic
atacgccatgctgggtctcctagccttaatagtggcatttatcttagtagtaattgtgtggaccatagtatattttgaatataagaagctgaaaaggcaagaaagaatagataagataatcgtacttgggagtcggccat

SEQ ID NO: 410368 - DNA, 140 bp, Artificial Sequence
  Synthetic
atggccgactcccaagtacgattatcttatctattctttcttgccttttcagcttcttatattcaaaatatactatggtccacacaattactactaagataaatgccactattaaggctaggagacccagcatggcgtat

SEQ ID NO: 410369 - DNA, 140 bp, Artificial Sequence
  Synthetic
aggccctggctgctgatatgcacagggatggaaaggatcaccagcaatattccaaagtagcatgacaaaaatcttagagccctttagagcaaaaaatccagaaatggtcatctatcaatagaccttttgggacagcggtg

SEQ ID NO: 410370 - DNA, 140 bp, Artificial Sequence
  Synthetic
caccgctgtcccaaaaggtctattgatagatgaccatttctggattttttgctctaaagggctctaagatttttgtcatgctactttggaatattgctggtgatcctttccatccctgtgcatatcagcagccagggcct

SEQ ID NO: 410371 - DNA, 140 bp, Artificial Sequence
  Synthetic
atacgccatgctgggtctccgtgagaacaataccactgttgaagaaaaaggagaactaaaaaactgctctttcaatataaccacagtattacaagataagaagacaaaagaatatgcgctcgtacttgggagtcggccat

SEQ ID NO: 410372 - DNA, 140 bp, Artificial Sequence
  Synthetic
atggccgactcccaagtacgagcgcatattcttttgtcttcttatcttgtaatactgtggttatattgaaagagcagttttttagttctcctttttcttcaacagtggtattgttctcacggagacccagcatggcgtat

SEQ ID NO: 410373 - DNA, 140 bp, Artificial Sequence
  Synthetic
aggccctggctgctgatatgaacacatagttttaattgtatgggagaatttttctattgtaatacaacacgcctgtttaatacaacacacctgtataatagtactgggaatgacacacaagaccttttgggacagcggtg

SEQ ID NO: 410374 - DNA, 140 bp, Artificial Sequence
  Synthetic
caccgctgtcccaaaaggtcttgtgtgtcattcccagtactattatacaggtgtgttgtattaaacaggcgtgttgtattacaatagaaaaattctcccatacaattaaaactatgtgttcatatcagcagccagggcct

SEQ ID NO: 410375 - DNA, 140 bp, Artificial Sequence
  Synthetic
atacgccatgctgggtctccacatggaatagtttagtaaagcaccatatgtatgtttcaaggagagctaatggatggttttacagacatcattatgaaagcagacatccaaaagtaagttcgtacttgggagtcggccat

SEQ ID NO: 410376 - DNA, 140 bp, Artificial Sequence
  Synthetic
atggccgactcccaagtacgaacttacttttggatgtctgctttcataatgatgtctgtaaaaccatccattagctctccttgaaacatacatatggtgctttactaaactattccatgtggagacccagcatggcgtat

SEQ ID NO: 410377 - DNA, 140 bp, Artificial Sequence
  Synthetic
atacgccatgctgggtctccgggaagccctcaaatacctgtggagccttgtgcagtattggagtcaggaactaaagaatagtgctattaacttgcttaataccacagcaatagcagtagccgtacttgggagtcggccat

SEQ ID NO: 410378 - DNA, 140 bp, Artificial Sequence
  Synthetic
atggccgactcccaagtacggctactgctattgctgtggtattaagcaagttaatagcactattctttagttcctgactccaatactgcacaaggctccacaggtatttgagggcttcccggagacccagcatggcgtat

SEQ ID NO: 410379 - DNA, 140 bp, Artificial Sequence
  Synthetic
atacgccatgctgggtctccagcaatgtcaatggcaacagcacggggtggggcaaggaagaaataaaaaactgctctttcaatataaccacagaactaagggataagagacagaaggtatcgtacttgggagtcggccat

SEQ ID NO: 410380 - DNA, 140 bp, Artificial Sequence
  Synthetic
atggccgactcccaagtacgataccttctgtctcttatcccttagttctgtggttatattgaaagagcagttttttatttcttccttgccccaccccgtgctgttgccattgacattgctggagacccagcatggcgtat

SEQ ID NO: 410381 - DNA, 140 bp, Artificial Sequence
  Synthetic
aggccctggctgctgatatgacatggaatcaagccagtagtatcaactcaactgctgttaaatggcagtctagcagaaaaagaagtaataattagatctgaaaatatcacaaacaatgtcgaccttttgggacagcggtg

SEQ ID NO: 410382 - DNA, 140 bp, Artificial Sequence
  Synthetic
caccgctgtcccaaaaggtcgacattgtttgtgatattttcagatctaattattacttctttttctgctagactgccatttaacagcagttgagttgatactactggcttgattccatgtcatatcagcagccagggcct

SEQ ID NO: 410383 - DNA, 140 bp, Artificial Sequence
  Synthetic
aggccctggctgctgatatgactaatgatgtaaaacaattaacagaggcagtgcaaaaaatagccacagaaagcatagtaatatggggaaagactcctaaatttagactacccatacaaagaccttttgggacagcggtg

SEQ ID NO: 410384 - DNA, 140 bp, Artificial Sequence
  Synthetic
caccgctgtcccaaaaggtctttgtatgggtagtctaaatttaggagtctttccccatattactatgctttctgtggctattttttgcactgcctctgttaattgttttacatcattagtcatatcagcagccagggcct

SEQ ID NO: 410385 - DNA, 140 bp, Artificial Sequence
  Synthetic
aggccctggctgctgatatgggtgtaattatcaagcaggacataacaaggtaggatctctacagtacttggcactaacagcattaataacaccaaaaaagataaagccacctttgcctaggaccttttgggacagcggtg

SEQ ID NO: 410386 - DNA, 140 bp, Artificial Sequence
  Synthetic
caccgctgtcccaaaaggtcctaggcaaaggtggctttatcttttttggtgttattaatgctgttagtgccaagtactgtagagatcctaccttgttatgtcctgcttgataattacacccatatcagcagccagggcct

SEQ ID NO: 410387 - DNA, 140 bp, Artificial Sequence
  Synthetic
atacgccatgctgggtctcccccactctgtgtcactttaaattgtactaccagaaggaccaaccatactacccaagaaatgaaaaattgcacttttaatgcaaccacagaaataaaggatcgtacttgggagtcggccat

SEQ ID NO: 410388 - DNA, 140 bp, Artificial Sequence
  Synthetic
atggccgactcccaagtacgatcctttatttctgtggttgcattaaaagtgcaatttttcatttcttgggtagtatggttggtccttctggtagtacaatttaaagtgacacagagtgggggagacccagcatggcgtat

SEQ ID NO: 410389 - DNA, 140 bp, Artificial Sequence
  Synthetic
aggccctggctgctgatatggtcaacatagcagaataggcattactcgacagaggagagcaaggaatggagccagtagatcctagcctagagccctggaagcatccaggaagtcagcctagaccttttgggacagcggtg

SEQ ID NO: 410390 - DNA, 140 bp, Artificial Sequence
  Synthetic
caccgctgtcccaaaaggtctaggctgacttcctggatgcttccagggctctaggctaggatctactggctccattccttgctctcctctgtcgagtaatgcctattctgctatgttgaccatatcagcagccagggcct

SEQ ID NO: 410391 - DNA, 140 bp, Artificial Sequence
  Synthetic
atacgccatgctgggtctccgtttgtttcataacaaaaggcttaggcatctcctatggcaggaggaagcggagacagcgacagagaacttctccaagcaatcagaaccatcaaaatcttgcgtacttgggagtcggccat

SEQ ID NO: 410392 - DNA, 140 bp, Artificial Sequence
  Synthetic
atggccgactcccaagtacgcaagattttgatggttctgattgcttggagaagttctctgtcgctgtctccgcttcctcctgccataggagatgcctaagccttttgttatgaaacaaacggagacccagcatggcgtat

SEQ ID NO: 410393 - DNA, 140 bp, Artificial Sequence
  Synthetic
aggccctggctgctgatatgggacaaacattctatgcaagaggtgacataataggagacataagacaagcacattgtaacattactagaagtaactggaccaacactttaaaaaaggtacgaccttttgggacagcggtg

SEQ ID NO: 410394 - DNA, 140 bp, Artificial Sequence
  Synthetic
caccgctgtcccaaaaggtcgtaccttttttaaagtgttggtccagttacttctagtaatgttacaatgtgcttgtcttatgtctcctattatgtcacctcttgcatagaatgtttgtcccatatcagcagccagggcct

SEQ ID NO: 410395 - DNA, 140 bp, Artificial Sequence
  Synthetic
atacgccatgctgggtctcccactcaggaggggatctagaagttacaacacatatttttaattgtagaggagaatttttctattgtgatacaacagaactgtttaattcaacagaacagtcgtacttgggagtcggccat

SEQ ID NO: 410396 - DNA, 140 bp, Artificial Sequence
  Synthetic
atggccgactcccaagtacgactgttctgttgaattaaacagttctgttgtatcacaatagaaaaattctcctctacaattaaaaatatgtgttgtaacttctagatcccctcctgagtgggagacccagcatggcgtat

SEQ ID NO: 410397 - DNA, 140 bp, Artificial Sequence
  Synthetic
atacgccatgctgggtctcctggttgataccatagcaatagtagtagctggctggacagataggattatagaaataggacaaggaattggtagagctattctccacatacctagaagaatcgtacttgggagtcggccat

SEQ ID NO: 410398 - DNA, 140 bp, Artificial Sequence
  Synthetic
atggccgactcccaagtacgattcttctaggtatgtggagaatagctctaccaattccttgtcctatttctataatcctatctgtccagccagctactactattgctatggtatcaaccaggagacccagcatggcgtat

SEQ ID NO: 410399 - DNA, 140 bp, Artificial Sequence
  Synthetic
aggccctggctgctgatatggtaacagaaaattttaatatgtggaaaaatgacatggtagagcaaatgcatacagatataatcagtttatgggatcaaagcctaaaaccatgtgtaaagtgaccttttgggacagcggtg

SEQ ID NO: 410400 - DNA, 140 bp, Artificial Sequence
  Synthetic
caccgctgtcccaaaaggtcactttacacatggttttaggctttgatcccataaactgattatatctgtatgcatttgctctaccatgtcatttttccacatattaaaattttctgttaccatatcagcagccagggcct

SEQ ID NO: 410401 - DNA, 140 bp, Artificial Sequence
  Synthetic
aggccctggctgctgatatgaaaagtagcgtagtgggatggcctgaggttagggaaagaataagacgtactcctgcagcagcaccaggagtaggagcagtatctcaagatttagataaacgaccttttgggacagcggtg

SEQ ID NO: 410402 - DNA, 140 bp, Artificial Sequence
  Synthetic
caccgctgtcccaaaaggtcgtttatctaaatcttgagatactgctcctactcctggtgctgctgcaggagtacgtcttattctttccctaacctcaggccatcccactacgctacttttcatatcagcagccagggcct

SEQ ID NO: 410403 - DNA, 140 bp, Artificial Sequence
  Synthetic
aggccctggctgctgatatgtcctgcagcagcaccaggagtaggagcagtatctcaagatttagataaacatggagcagttacaagtagtaatgtaaaccaccctagttgcgtctggctggaccttttgggacagcggtg

SEQ ID NO: 410404 - DNA, 140 bp, Artificial Sequence
  Synthetic
caccgctgtcccaaaaggtccagccagacgcaactagggtggtttacattactacttgtaactgctccatgtttatctaaatcttgagatactgctcctactcctggtgctgctgcaggacatatcagcagccagggcct

SEQ ID NO: 410405 - DNA, 140 bp, Artificial Sequence
  Synthetic
atacgccatgctgggtctccgccatcaatggcactaacaccaccaatggcactcaaaacagcgccctaagagaagatccaggggcagtacaaaactgttctttcaatatgaccacagaaacgtacttgggagtcggccat

SEQ ID NO: 410406 - DNA, 140 bp, Artificial Sequence
  Synthetic
atggccgactcccaagtacgtttctgtggtcatattgaaagaacagttttgtactgcccctggatcttctcttagggcgctgttttgagtgccattggtggtgttagtgccattgatggcggagacccagcatggcgtat

SEQ ID NO: 410407 - DNA, 140 bp, Artificial Sequence
  Synthetic
atacgccatgctgggtctccaatgtaactgtcactaatgataaaacggtaaagaaccagcaagaattaaaaaactgttctttcaatgtaactacagaattaagggataagaaaaagaaagcgtacttgggagtcggccat

SEQ ID NO: 410408 - DNA, 140 bp, Artificial Sequence
  Synthetic
atggccgactcccaagtacgctttctttttcttatcccttaattctgtagttacattgaaagaacagttttttaattcttgctggttctttaccgttttatcattagtgacagttacattggagacccagcatggcgtat

SEQ ID NO: 410409 - DNA, 140 bp, Artificial Sequence
  Synthetic
atacgccatgctgggtctccttaattgtacaagactcaacaacaatacaaggagaagtatacatgtaggacatgtaggaccaggcagagcaatttatacaacaggaataataggaaagatcgtacttgggagtcggccat

SEQ ID NO: 410410 - DNA, 140 bp, Artificial Sequence
  Synthetic
atggccgactcccaagtacgatctttcctattattcctgttgtataaattgctctgcctggtcctacatgtcctacatgtatacttctccttgtattgttgttgagtcttgtacaattaaggagacccagcatggcgtat

SEQ ID NO: 410411 - DNA, 140 bp, Artificial Sequence
  Synthetic
aggccctggctgctgatatgagttgcttgaagactcgcaaatccagcaggagaaaaatgaaaaagatttattagcattggacagttggaacaatctatggaattggtttgacataacaaagaccttttgggacagcggtg

SEQ ID NO: 410412 - DNA, 140 bp, Artificial Sequence
  Synthetic
caccgctgtcccaaaaggtctttgttatgtcaaaccaattccatagattgttccaactgtccaatgctaataaatctttttcatttttctcctgctggatttgcgagtcttcaagcaactcatatcagcagccagggcct

SEQ ID NO: 410413 - DNA, 140 bp, Artificial Sequence
  Synthetic
atacgccatgctgggtctcccaggccagtagtatcaactcaattgctgttaaatggtagtctagcaaatgaaaagataataattagatctaaaaatatcacagacaatggtaaaaatatacgtacttgggagtcggccat

SEQ ID NO: 410414 - DNA, 140 bp, Artificial Sequence
  Synthetic
atggccgactcccaagtacgtatatttttaccattgtctgtgatatttttagatctaattattatcttttcatttgctagactaccatttaacagcaattgagttgatactactggcctgggagacccagcatggcgtat

SEQ ID NO: 410415 - DNA, 140 bp, Artificial Sequence
  Synthetic
aggccctggctgctgatatgcaatacaagaaaaagtgtgcatatagggccaggacaggcattctatgcaacaggtgccataataggggatataagacaagcacattgtaatatcagtagagaccttttgggacagcggtg

SEQ ID NO: 410416 - DNA, 140 bp, Artificial Sequence
  Synthetic
caccgctgtcccaaaaggtctctactgatattacaatgtgcttgtcttatatcccctattatggcacctgttgcatagaatgcctgtcctggccctatatgcacactttttcttgtattgcatatcagcagccagggcct

SEQ ID NO: 410417 - DNA, 140 bp, Artificial Sequence
  Synthetic
atacgccatgctgggtctccctttgagaataaaacaataaagtttgaaaaatcctcaggaggggatccagaagtcacaacacatagttttaattgtggaggagaatttttctattgtgatcgtacttgggagtcggccat

SEQ ID NO: 410418 - DNA, 140 bp, Artificial Sequence
  Synthetic
atggccgactcccaagtacgatcacaatagaaaaattctcctccacaattaaaactatgtgttgtgacttctggatcccctcctgaggatttttcaaactttattgttttattctcaaagggagacccagcatggcgtat

SEQ ID NO: 410419 - DNA, 140 bp, Artificial Sequence
  Synthetic
aggccctggctgctgatatgaagtcacaacacatagttttaattgtggaggagaatttttctattgtgatacatcagctctgttcaatagcacttggaatgccactgagtcaaatgacacgaccttttgggacagcggtg

SEQ ID NO: 410420 - DNA, 140 bp, Artificial Sequence
  Synthetic
caccgctgtcccaaaaggtcgtgtcatttgactcagtggcattccaagtgctattgaacagagctgatgtatcacaatagaaaaattctcctccacaattaaaactatgtgttgtgacttcatatcagcagccagggcct

SEQ ID NO: 410421 - DNA, 140 bp, Artificial Sequence
  Synthetic
aggccctggctgctgatatgttgttagagctatctgcaacatacctacaagaataagacagggcttggaaacagctttgctataaaatggggggcaagtgttcaaaaagcagcagagctggaccttttgggacagcggtg

SEQ ID NO: 410422 - DNA, 140 bp, Artificial Sequence
  Synthetic
caccgctgtcccaaaaggtccagctctgctgctttttgaacacttgccccccattttatagcaaagctgtttccaagccctgtcttattcttgtaggtatgttgcagatagctctaacaacatatcagcagccagggcct

SEQ ID NO: 410423 - DNA, 140 bp, Artificial Sequence
  Synthetic
aggccctggctgctgatatgagcacttacaagtagcaacacagcccacaataatgctgattgtgcctggctgcaagcacaggaggaggaagaagaagtaggctttccagtcagacctcaggaccttttgggacagcggtg

SEQ ID NO: 410424 - DNA, 140 bp, Artificial Sequence
  Synthetic
caccgctgtcccaaaaggtcctgaggtctgactggaaagcctacttcttcttcctcctcctgtgcttgcagccaggcacaatcagcattattgtgggctgtgttgctacttgtaagtgctcatatcagcagccagggcct

SEQ ID NO: 410425 - DNA, 140 bp, Artificial Sequence
  Synthetic
atacgccatgctgggtctcctaataaatctgaacaggagatctggggaaacatgacatggatggagtgggaaaaagagattagcaattacacacaaggaatatacagattgcttgaggcacgtacttgggagtcggccat

SEQ ID NO: 410426 - DNA, 140 bp, Artificial Sequence
  Synthetic
atggccgactcccaagtacgtgcctcaagcaatctgtatattccttgtgtgtaattgctaatctctttttcccactccatccatgtcatgtttccccagatctcctgttcagatttattaggagacccagcatggcgtat

SEQ ID NO: 410427 - DNA, 140 bp, Artificial Sequence
  Synthetic
atacgccatgctgggtctccctaataccaatagtagtacggagaaagtaatggaggaaggagaaatgaaaaactgctctttcaatgttaccacaaacataggaaataaggtgaagaaagacgtacttgggagtcggccat

SEQ ID NO: 410428 - DNA, 140 bp, Artificial Sequence
  Synthetic
atggccgactcccaagtacgtctttcttcaccttatttcctatgtttgtggtaacattgaaagagcagtttttcatttctccttcctccattactttctccgtactactattggtattagggagacccagcatggcgtat

SEQ ID NO: 410429 - DNA, 140 bp, Artificial Sequence
  Synthetic
atacgccatgctgggtctccaatacaacaacaataatctttaatagttcctcaggaggggacccagagattacagcgcacagctttaactgtggaggggaatttttctactgtgatacaacgtacttgggagtcggccat

SEQ ID NO: 410430 - DNA, 140 bp, Artificial Sequence
  Synthetic
atggccgactcccaagtacgttgtatcacagtagaaaaattcccctccacagttaaagctgtgcgctgtaatctctgggtcccctcctgaggaactattaaagattattgttgttgtattggagacccagcatggcgtat

SEQ ID NO: 410431 - DNA, 140 bp, Artificial Sequence
  Synthetic
aggccctggctgctgatatggagctgagccagcagcagatggggtgggagcagtatctcgagacctggaaaaacatggagcaatcacaagtagcaatacagcagctaacaatgctgattggaccttttgggacagcggtg

SEQ ID NO: 410432 - DNA, 140 bp, Artificial Sequence
  Synthetic
caccgctgtcccaaaaggtccaatcagcattgttagctgctgtattgctacttgtgattgctccatgtttttccaggtctcgagatactgctcccaccccatctgctgctggctcagctccatatcagcagccagggcct

SEQ ID NO: 410433 - DNA, 140 bp, Artificial Sequence
  Synthetic
aggccctggctgctgatatgtataaacaggtggcaggaagtaggaaaagcaatgtatgcccctcccatcagcggactaattagatgttcatcaaatattacagggctgctattaacaagagaccttttgggacagcggtg

SEQ ID NO: 410434 - DNA, 140 bp, Artificial Sequence
  Synthetic
caccgctgtcccaaaaggtctcttgttaatagcagccctgtaatatttgatgaacatctaattagtccgctgatgggaggggcatacattgcttttcctacttcctgccacctgtttatacatatcagcagccagggcct

SEQ ID NO: 410435 - DNA, 140 bp, Artificial Sequence
  Synthetic
atacgccatgctgggtctccgtggcgcccgaacagggacctgaaagcgaaagtagaaccagaggagatctctcgacgcaggactcggcttgctgaagcgcgcacggcaagaggcgaggggcgtacttgggagtcggccat

SEQ ID NO: 410436 - DNA, 140 bp, Artificial Sequence
  Synthetic
atggccgactcccaagtacgcccctcgcctcttgccgtgcgcgcttcagcaagccgagtcctgcgtcgagagatctcctctggttctactttcgctttcaggtccctgttcgggcgccacggagacccagcatggcgtat

SEQ ID NO: 410437 - DNA, 140 bp, Artificial Sequence
  Synthetic
atacgccatgctgggtctccccaatgacaccctgaaagaagagccagagacaatacaaaactgtactttcaaggtgaccacagaagtaaaagataagcagctgaaagtaaatgcacttttcgtacttgggagtcggccat

SEQ ID NO: 410438 - DNA, 140 bp, Artificial Sequence
  Synthetic
atggccgactcccaagtacgaaaagtgcatttactttcagctgcttatcttttacttctgtggtcaccttgaaagtacagttttgtattgtctctggctcttctttcagggtgtcattggggagacccagcatggcgtat

SEQ ID NO: 410439 - DNA, 140 bp, Artificial Sequence
  Synthetic
aggccctggctgctgatatgaggatcaacggctcctggggatttggggatgctctggaaagctcatctgcaccactaatgtgccttggaatactagttggagtaataaatctcaggatgagaccttttgggacagcggtg

SEQ ID NO: 410440 - DNA, 140 bp, Artificial Sequence
  Synthetic
caccgctgtcccaaaaggtctcatcctgagatttattactccaactagtattccaaggcacattagtggtgcagatgagctttccagagcatccccaaatccccaggagccgttgatcctcatatcagcagccagggcct

SEQ ID NO: 410441 - DNA, 140 bp, Artificial Sequence
  Synthetic
aggccctggctgctgatatgctctagataaaatagaggaaatacaaaataagagcaagcaaaagacacaacaggcagcagctgccacaggaaacagcagcaatgtcagccaaaattacccgaccttttgggacagcggtg

SEQ ID NO: 410442 - DNA, 140 bp, Artificial Sequence
  Synthetic
caccgctgtcccaaaaggtcgggtaattttggctgacattgctgctgtttcctgtggcagctgctgcctgttgtgtcttttgcttgctcttattttgtatttcctctattttatctagagcatatcagcagccagggcct

SEQ ID NO: 410443 - DNA, 140 bp, Artificial Sequence
  Synthetic
aggccctggctgctgatatgttaatagaataagagaaagagcagaagacagtggcaatgagagtgagggggatgcagaggaattggcggcacttggggagatggggtatcttgttcttaggaccttttgggacagcggtg

SEQ ID NO: 410444 - DNA, 140 bp, Artificial Sequence
  Synthetic
caccgctgtcccaaaaggtcctaagaacaagataccccatctccccaagtgccgccaattcctctgcatccccctcactctcattgccactgtcttctgctctttctcttattctattaacatatcagcagccagggcct

SEQ ID NO: 410445 - DNA, 140 bp, Artificial Sequence
  Synthetic
atacgccatgctgggtctccgtggcgcccgaacagggacttgaaagcgaaagtagaaccagaggagctctctcgacgcaggactcggcttgctgagcgcgcacggcaagaggcgaggggccgtacttgggagtcggccat

SEQ ID NO: 410446 - DNA, 140 bp, Artificial Sequence
  Synthetic
atggccgactcccaagtacggcccctcgcctcttgccgtgcgcgctcagcaagccgagtcctgcgtcgagagagctcctctggttctactttcgctttcaagtccctgttcgggcgccacggagacccagcatggcgtat

SEQ ID NO: 410447 - DNA, 140 bp, Artificial Sequence
  Synthetic
atacgccatgctgggtctccaattatagtgaatataggttaataaattgtaatatctcaaccattaaacaggcttgtccaaaggtggattttgaaccaattcccatacattattgtgccccgtacttgggagtcggccat

SEQ ID NO: 410448 - DNA, 140 bp, Artificial Sequence
  Synthetic
atggccgactcccaagtacggggcacaataatgtatgggaattggttcaaaatccacctttggacaagcctgtttaatggttgagatattacaatttattaacctatattcactataattggagacccagcatggcgtat

SEQ ID NO: 410449 - DNA, 140 bp, Artificial Sequence
  Synthetic
aggccctggctgctgatatgacataaaacaaattgtgagaatgtggcaaagagtagaacaagcaatgtatgcccctcccatcgcaggaagaattcaatgtatatcaaatattacaggattgaccttttgggacagcggtg

SEQ ID NO: 410450 - DNA, 140 bp, Artificial Sequence
  Synthetic
caccgctgtcccaaaaggtcaatcctgtaatatttgatatacattgaattcttcctgcgatgggaggggcatacattgcttgttctactctttgccacattctcacaatttgttttatgtcatatcagcagccagggcct

SEQ ID NO: 410451 - DNA, 140 bp, Artificial Sequence
  Synthetic
aggccctggctgctgatatgacagatagggttatagaaacaatacaaagaatttttagagccattctccacatacctagaagaataagacagggcttagaaaggcttttactataagatggaccttttgggacagcggtg

SEQ ID NO: 410452 - DNA, 140 bp, Artificial Sequence
  Synthetic
caccgctgtcccaaaaggtccatcttatagtaaaagcctttctaagccctgtcttattcttctaggtatgtggagaatggctctaaaaattctttgtattgtttctataaccctatctgtcatatcagcagccagggcct

SEQ ID NO: 410453 - DNA, 140 bp, Artificial Sequence
  Synthetic
aggccctggctgctgatatgataggcattttgcgacaaagaagagcaagaaatggatccagtagatcctaacctagagccctggaaccatccaggaagtcagcctaaaactgcttgtaatgaccttttgggacagcggtg

SEQ ID NO: 410454 - DNA, 140 bp, Artificial Sequence
  Synthetic
caccgctgtcccaaaaggtcattacaagcagttttaggctgacttcctggatggttccagggctctaggttaggatctactggatccatttcttgctcttctttgtcgcaaaatgcctatcatatcagcagccagggcct

SEQ ID NO: 410455 - DNA, 140 bp, Artificial Sequence
  Synthetic
aggccctggctgctgatatgagttgtgtggatcatagtatatatagaatataggaaattgttaagacagagaaaaatagacaggttaattaaaagaattagggaaagagcagaagacagtgaccttttgggacagcggtg

SEQ ID NO: 410456 - DNA, 140 bp, Artificial Sequence
  Synthetic
caccgctgtcccaaaaggtcactgtcttctgctctttccctaattcttttaattaacctgtctatttttctctgtcttaacaatttcctatattctatatatactatgatccacacaactcatatcagcagccagggcct

SEQ ID NO: 410457 - DNA, 140 bp, Artificial Sequence
  Synthetic
atacgccatgctgggtctcctagtagtgtaaataataaccatactagtgttaatgcctccagtgacatgaaaaattgctcttttaatgcaaccacagaaataaaaaataagaaaaagaatcgtacttgggagtcggccat

SEQ ID NO: 410458 - DNA, 140 bp, Artificial Sequence
  Synthetic
atggccgactcccaagtacgattctttttcttattttttatttctgtggttgcattaaaagagcaatttttcatgtcactggaggcattaacactagtatggttattatttacactactaggagacccagcatggcgtat

SEQ ID NO: 410459 - DNA, 140 bp, Artificial Sequence
  Synthetic
aggccctggctgctgatatgtgattgtttttcagaatctgctataagaaatgccatattaggacatatagttagtcctaggtgtgaatatcaagcaggacataacaaggtaggatctctagaccttttgggacagcggtg

SEQ ID NO: 410460 - DNA, 140 bp, Artificial Sequence
  Synthetic
caccgctgtcccaaaaggtctagagatcctaccttgttatgtcctgcttgatattcacacctaggactaactatatgtcctaatatggcatttcttatagcagattctgaaaaacaatcacatatcagcagccagggcct

SEQ ID NO: 410461 - DNA, 140 bp, Artificial Sequence
  Synthetic
aggccctggctgctgatatgcaagaagaagtataaggataggaccaggacaagcattctatgcaacaaatgtaataggagacataaggcaggcatattgcagcattgaagaagacttatggaccttttgggacagcggtg

SEQ ID NO: 410462 - DNA, 140 bp, Artificial Sequence
  Synthetic
caccgctgtcccaaaaggtccataagtcttcttcaatgctgcaatatgcctgccttatgtctcctattacatttgttgcatagaatgcttgtcctggtcctatccttatacttcttcttgcatatcagcagccagggcct

SEQ ID NO: 410463 - DNA, 140 bp, Artificial Sequence
  Synthetic
atacgccatgctgggtctccattagaagaaaactacgttaataaaacaatagtctttgaacaacacgcaggaggggatctagaagttacaacacatagctttaattgcaaaggagaatttcgtacttgggagtcggccat

SEQ ID NO: 410464 - DNA, 140 bp, Artificial Sequence
  Synthetic
atggccgactcccaagtacgaaattctcctttgcaattaaagctatgtgttgtaacttctagatcccctcctgcgtgttgttcaaagactattgttttattaacgtagttttcttctaatggagacccagcatggcgtat

SEQ ID NO: 410465 - DNA, 140 bp, Artificial Sequence
  Synthetic
aggccctggctgctgatatggatagaggtaaaagacaccaaggaagctttagatagaatagaggaagaacaaaataaatgcaagcaggcaacaggtgccacaggaaatggccgcgaggtcgaccttttgggacagcggtg

SEQ ID NO: 410466 - DNA, 140 bp, Artificial Sequence
  Synthetic
caccgctgtcccaaaaggtcgacctcgcggccatttcctgtggcacctgttgcctgcttgcatttattttgttcttcctctattctatctaaagcttccttggtgtcttttacctctatccatatcagcagccagggcct

SEQ ID NO: 410467 - DNA, 140 bp, Artificial Sequence
  Synthetic
aggccctggctgctgatatgaagagaacaatttaagaataaaacaatagtctttaatcaatcctcaggaggggacccagaaattgtaatgcacagttttaattgtggaggggaatttttcgaccttttgggacagcggtg

SEQ ID NO: 410468 - DNA, 140 bp, Artificial Sequence
  Synthetic
caccgctgtcccaaaaggtcgaaaaattcccctccacaattaaaactgtgcattacaatttctgggtcccctcctgaggattgattaaagactattgttttattcttaaattgttctcttcatatcagcagccagggcct

SEQ ID NO: 410469 - DNA, 140 bp, Artificial Sequence
  Synthetic
aggccctggctgctgatatgagaagaataagacagggcttagaaagggctttgttataagatgggtggcaagtggtcaaaaagtagtatagttggatggcctgctataagggaaagaatggaccttttgggacagcggtg

SEQ ID NO: 410470 - DNA, 140 bp, Artificial Sequence
  Synthetic
caccgctgtcccaaaaggtccattctttcccttatagcaggccatccaactatactactttttgaccacttgccacccatcttataacaaagccctttctaagccctgtcttattcttctcatatcagcagccagggcct

SEQ ID NO: 410471 - DNA, 140 bp, Artificial Sequence
  Synthetic
atacgccatgctgggtctccctttcctcagagcagaccagcgccaacagccccaccagcagagagccttcagagcagaccagagccaacagccccaccagcagagaacctttggaaggggcgtacttgggagtcggccat

SEQ ID NO: 410472 - DNA, 140 bp, Artificial Sequence
  Synthetic
atggccgactcccaagtacgccccttccaaaggttctctgctggtggggctgttggctctggtctgctctgaaggctctctgctggtggggctgttggcgctggtctgctctgaggaaagggagacccagcatggcgtat

SEQ ID NO: 410473 - DNA, 140 bp, Artificial Sequence
  Synthetic
atacgccatgctgggtctccgagacttagagagacatggagcacttacaaccagtaacacagctagcaataatgctgcttgtgcatggctggaagctcaagaagagggagaagaagtaggcgtacttgggagtcggccat

SEQ ID NO: 410474 - DNA, 140 bp, Artificial Sequence
  Synthetic
atggccgactcccaagtacgcctacttcttctccctcttcttgagcttccagccatgcacaagcagcattattgctagctgtgttactggttgtaagtgctccatgtctctctaagtctcggagacccagcatggcgtat

SEQ ID NO: 410475 - DNA, 140 bp, Artificial Sequence
  Synthetic
aggccctggctgctgatatgaatgctgcttgtgcatggctggaagctcaagaagagggagaagaagtaggctttccagtcagacctcaggtgcctctaagaccaatgacttataaaagcggaccttttgggacagcggtg

SEQ ID NO: 410476 - DNA, 140 bp, Artificial Sequence
  Synthetic
caccgctgtcccaaaaggtccgcttttataagtcattggtcttagaggcacctgaggtctgactggaaagcctacttcttctccctcttcttgagcttccagccatgcacaagcagcattcatatcagcagccagggcct

SEQ ID NO: 410477 - DNA, 140 bp, Artificial Sequence
  Synthetic
atacgccatgctgggtctccgagagccactaatggcactcataacagcaccttgaaggaagatccaggagcaatacaaaactgttctttctttatgaccacagaagtaagagataagaagcgtacttgggagtcggccat

SEQ ID NO: 410478 - DNA, 140 bp, Artificial Sequence
  Synthetic
atggccgactcccaagtacgcttcttatctcttacttctgtggtcataaagaaagaacagttttgtattgctcctggatcttccttcaaggtgctgttatgagtgccattagtggctctcggagacccagcatggcgtat

SEQ ID NO: 410479 - DNA, 140 bp, Artificial Sequence
  Synthetic
atacgccatgctgggtctccgtggcgcccgaacagggacttgaaagcgaaagttccagagaagttctctcgacgcaggactcggcttgctgaggtgcacacagcaagaggcgagagcggtcgtacttgggagtcggccat

SEQ ID NO: 410480 - DNA, 140 bp, Artificial Sequence
  Synthetic
atggccgactcccaagtacgaccgctctcgcctcttgctgtgtgcacctcagcaagccgagtcctgcgtcgagagaacttctctggaactttcgctttcaagtccctgttcgggcgccacggagacccagcatggcgtat

SEQ ID NO: 410481 - DNA, 140 bp, Artificial Sequence
  Synthetic
atacgccatgctgggtctccccaccaacatcactgaggacatgagaggagaaataaaaaactgctcgtacaatatgaccacagtattaagggataagagaaggaaagtgtattcacttttcgtacttgggagtcggccat

SEQ ID NO: 410482 - DNA, 140 bp, Artificial Sequence
  Synthetic
atggccgactcccaagtacgaaaagtgaatacactttccttctcttatcccttaatactgtggtcatattgtacgagcagttttttatttctcctctcatgtcctcagtgatgttggtggggagacccagcatggcgtat

SEQ ID NO: 410483 - DNA, 140 bp, Artificial Sequence
  Synthetic
atacgccatgctgggtctcctatcaagccaacagtaagtactcaactaatactaaatggaacaatctctgaaggaaaaataagaatgctgggaaaaaatctttcaaatactgataatatccgtacttgggagtcggccat

SEQ ID NO: 410484 - DNA, 140 bp, Artificial Sequence
  Synthetic
atggccgactcccaagtacggatattatcagtatttgaaagattttttcccagcattcttatttttccttcagagattgttccatttagtattagttgagtacttactgttggcttgataggagacccagcatggcgtat

SEQ ID NO: 410485 - DNA, 140 bp, Artificial Sequence
  Synthetic
aggccctggctgctgatatgggccatgcaagaatgtcagcacagtacaatgcacacatggaatcaagccagtagtatcaactcaactgctgttaaatggcagtctagcagaaggaaaggtgaccttttgggacagcggtg

SEQ ID NO: 410486 - DNA, 140 bp, Artificial Sequence
  Synthetic
caccgctgtcccaaaaggtcacctttccttctgctagactgccatttaacagcagttgagttgatactactggcttgattccatgtgtgcattgtactgtgctgacattcttgcatggcccatatcagcagccagggcct

SEQ ID NO: 410487 - DNA, 140 bp, Artificial Sequence
  Synthetic
aggccctggctgctgatatggtagtatcaactcaactgctgttaaatggcagtctagcagaaggaaaggtaagaattagatctgaaaatattacaaacaatgccaaaaacataatagtacgaccttttgggacagcggtg

SEQ ID NO: 410488 - DNA, 140 bp, Artificial Sequence
  Synthetic
caccgctgtcccaaaaggtcgtactattatgtttttggcattgtttgtaatattttcagatctaattcttacctttccttctgctagactgccatttaacagcagttgagttgatactaccatatcagcagccagggcct

SEQ ID NO: 410489 - DNA, 140 bp, Artificial Sequence
  Synthetic
aggccctggctgctgatatgtggggtgggagcagtatctcgagacctggaaaaacatggagcaatcacaagtagcaatacagcagctaacaatgctgattgtgcctggctagaagcacaagaccttttgggacagcggtg

SEQ ID NO: 410490 - DNA, 140 bp, Artificial Sequence
  Synthetic
caccgctgtcccaaaaggtcttgtgcttctagccaggcacaatcagcattgttagctgctgtattgctacttgtgattgctccatgtttttccaggtctcgagatactgctcccaccccacatatcagcagccagggcct

SEQ ID NO: 410491 - DNA, 140 bp, Artificial Sequence
  Synthetic
atacgccatgctgggtctcctagtggaacacaatggaataaaacattaagacaggtaaaggaagaattgaagtctcacttccctaatggaacaataagctttaaaccagcctcaggagggcgtacttgggagtcggccat

SEQ ID NO: 410492 - DNA, 140 bp, Artificial Sequence
  Synthetic
atggccgactcccaagtacgccctcctgaggctggtttaaagcttattgttccattagggaagtgagacttcaattcttcctttacctgtcttaatgttttattccattgtgttccactaggagacccagcatggcgtat

SEQ ID NO: 410493 - DNA, 140 bp, Artificial Sequence
  Synthetic
aggccctggctgctgatatgagtctcacttccctaatggaacaataagctttaaaccagcctcaggaggggacctagaagtcacaatgcatagttttaattgtagaggagaatttttctagaccttttgggacagcggtg

SEQ ID NO: 410494 - DNA, 140 bp, Artificial Sequence
  Synthetic
caccgctgtcccaaaaggtctagaaaaattctcctctacaattaaaactatgcattgtgacttctaggtcccctcctgaggctggtttaaagcttattgttccattagggaagtgagactcatatcagcagccagggcct

SEQ ID NO: 410495 - DNA, 140 bp, Artificial Sequence
  Synthetic
aggccctggctgctgatatggtaacagactcacaatatgcattaggaatcattcaagcacaaccagataagagtgaatcagagttagtcagtcaaataatagaacagttaataaaaaagggaccttttgggacagcggtg

SEQ ID NO: 410496 - DNA, 140 bp, Artificial Sequence
  Synthetic
caccgctgtcccaaaaggtcccttttttattaactgttctattatttgactgactaactctgattcactcttatctggttgtgcttgaatgattcctaatgcatattgtgagtctgttaccatatcagcagccagggcct

SEQ ID NO: 410497 - DNA, 140 bp, Artificial Sequence
  Synthetic
aggccctggctgctgatatgtgtggggatgcgaattttactaataccaatagtagtaggactaccaatgatagtagaaatgagacagtgatggcgatcggagaaataaaaaactgctcttgaccttttgggacagcggtg

SEQ ID NO: 410498 - DNA, 140 bp, Artificial Sequence
  Synthetic
caccgctgtcccaaaaggtcaagagcagttttttatttctccgatcgccatcactgtctcatttctactatcattggtagtcctactactattggtattagtaaaattcgcatccccacacatatcagcagccagggcct

SEQ ID NO: 410499 - DNA, 140 bp, Artificial Sequence
  Synthetic
aggccctggctgctgatatgagtacaatgtacacatggaattaggccagtagtatcaactcaactactgttaaatggcagtctagcagaagaagagatagtaattagatctgagaatttcgaccttttgggacagcggtg

SEQ ID NO: 410500 - DNA, 140 bp, Artificial Sequence
  Synthetic
caccgctgtcccaaaaggtcgaaattctcagatctaattactatctcttcttctgctagactgccatttaacagtagttgagttgatactactggcctaattccatgtgtacattgtactcatatcagcagccagggcct

SEQ ID NO: 410501 - DNA, 140 bp, Artificial Sequence
  Synthetic
aggccctggctgctgatatgggggaatctcttgctgtattggagtcaggaactaaagaatagtgctattagcttgcttaataccacagcaatagtagtagctgaggggacagatagaattgaccttttgggacagcggtg

SEQ ID NO: 410502 - DNA, 140 bp, Artificial Sequence
  Synthetic
caccgctgtcccaaaaggtcaattctatctgtcccctcagctactactattgctgtggtattaagcaagctaatagcactattctttagttcctgactccaatacagcaagagattcccccatatcagcagccagggcct

SEQ ID NO: 410503 - DNA, 140 bp, Artificial Sequence
  Synthetic
aggccctggctgctgatatgtaattgtacaagaccctacaacaatacaagaaaaagtataagaataggaccagggagcgcattttatgcaacaggagatgtaataggagatataagaaaagaccttttgggacagcggtg

SEQ ID NO: 410504 - DNA, 140 bp, Artificial Sequence
  Synthetic
caccgctgtcccaaaaggtcttttcttatatctcctattacatctcctgttgcataaaatgcgctccctggtcctattcttatactttttcttgtattgttgtagggtcttgtacaattacatatcagcagccagggcct

SEQ ID NO: 410505 - DNA, 140 bp, Artificial Sequence
  Synthetic
aggccctggctgctgatatgtcaaggggttgagactggggtgggaaagcctcaagtatctggggaatcttctgctatattggagtcaggaactaaaaattagtgctgttaatttagttgagaccttttgggacagcggtg

SEQ ID NO: 410506 - DNA, 140 bp, Artificial Sequence
  Synthetic
caccgctgtcccaaaaggtctcaactaaattaacagcactaatttttagttcctgactccaatatagcagaagattccccagatacttgaggctttcccaccccagtctcaaccccttgacatatcagcagccagggcct

SEQ ID NO: 410507 - DNA, 140 bp, Artificial Sequence
  Synthetic
aggccctggctgctgatatggaggaagtaggctttccagtcagacctcaggtacctttaagaccaatgacttataaagcagctttagatctcagccactttttaaaagaaaaggggggacgaccttttgggacagcggtg

SEQ ID NO: 410508 - DNA, 140 bp, Artificial Sequence
  Synthetic
caccgctgtcccaaaaggtcgtccccccttttcttttaaaaagtggctgagatctaaagctgctttataagtcattggtcttaaaggtacctgaggtctgactggaaagcctacttcctccatatcagcagccagggcct

SEQ ID NO: 410509 - DNA, 140 bp, Artificial Sequence
  Synthetic
aggccctggctgctgatatgtggaactctagttggagtaataagtctcaggaggagatttggaataacatgacctggatacagtgggaaaaagagattagcaattactcagaagaaatatgaccttttgggacagcggtg

SEQ ID NO: 410510 - DNA, 140 bp, Artificial Sequence
  Synthetic
caccgctgtcccaaaaggtcatatttcttctgagtaattgctaatctctttttcccactgtatccaggtcatgttattccaaatctcctcctgagacttattactccaactagagttccacatatcagcagccagggcct

SEQ ID NO: 410511 - DNA, 140 bp, Artificial Sequence
  Synthetic
aggccctggctgctgatatgaacaagggcaagaccaatggacatatcaaatttatcaagagccatttaaaaatctaaaaacaggaaaatatgcaagaaaaaggtctgctcacactaatgagaccttttgggacagcggtg

SEQ ID NO: 410512 - DNA, 140 bp, Artificial Sequence
  Synthetic
caccgctgtcccaaaaggtctcattagtgtgagcagacctttttcttgcatattttcctgtttttagatttttaaatggctcttgataaatttgatatgtccattggtcttgcccttgttcatatcagcagccagggcct

SEQ ID NO: 410513 - DNA, 140 bp, Artificial Sequence
  Synthetic
aggccctggctgctgatatggttgctttcattgccaagtgtgctttttaaagaaaggcttaggcatttcctatggcaggaagaagcggagaccgcgacgagcagctcctcttagcagtaagaccttttgggacagcggtg

SEQ ID NO: 410514 - DNA, 140 bp, Artificial Sequence
  Synthetic
caccgctgtcccaaaaggtcttactgctaagaggagctgctcgtcgcggtctccgcttcttcctgccataggaaatgcctaagcctttctttaaaaagcacacttggcaatgaaagcaaccatatcagcagccagggcct

SEQ ID NO: 410515 - DNA, 140 bp, Artificial Sequence
  Synthetic
aggccctggctgctgatatgtatggcaggaagaagcggagaccgcgacgagcagctcctcttagcagtaaggaccatcaaaatcctgtaccaaagcagtaagtaaatttgtatagtattggaccttttgggacagcggtg

SEQ ID NO: 410516 - DNA, 140 bp, Artificial Sequence
  Synthetic
caccgctgtcccaaaaggtccaatactatacaaatttacttactgctttggtacaggattttgatggtccttactgctaagaggagctgctcgtcgcggtctccgcttcttcctgccatacatatcagcagccagggcct

SEQ ID NO: 410517 - DNA, 140 bp, Artificial Sequence
  Synthetic
atacgccatgctgggtctcccttatagccatctgtgtatggaccatagtctatgtagaatatagaagactgttaaggcaaaagaaaatagataagttaattgatagaataagagaaagagcgtacttgggagtcggccat

SEQ ID NO: 410518 - DNA, 140 bp, Artificial Sequence
  Synthetic
atggccgactcccaagtacgctctttctcttattctatcaattaacttatctattttcttttgccttaacagtcttctatattctacatagactatggtccatacacagatggctataagggagacccagcatggcgtat

SEQ ID NO: 410519 - DNA, 140 bp, Artificial Sequence
  Synthetic
aggccctggctgctgatatggttaaggcaaaagaaaatagataagttaattgatagaataagagaaagagcagaagatagtggcaatgagagtgatggagacgaagaggaattatcagcggaccttttgggacagcggtg

SEQ ID NO: 410520 - DNA, 140 bp, Artificial Sequence
  Synthetic
caccgctgtcccaaaaggtccgctgataattcctcttcgtctccatcactctcattgccactatcttctgctctttctcttattctatcaattaacttatctattttcttttgccttaaccatatcagcagccagggcct

SEQ ID NO: 410521 - DNA, 140 bp, Artificial Sequence
  Synthetic
atacgccatgctgggtctccaagaatgagaagaactgagccagcagcagaaggggtgggagcagtatctcgagacctggaacaacgtggagcaattacaattagtaatacagcaagtaaccgtacttgggagtcggccat

SEQ ID NO: 410522 - DNA, 140 bp, Artificial Sequence
  Synthetic
atggccgactcccaagtacggttacttgctgtattactaattgtaattgctccacgttgttccaggtctcgagatactgctcccaccccttctgctgctggctcagttcttctcattcttggagacccagcatggcgtat

SEQ ID NO: 410523 - DNA, 140 bp, Artificial Sequence
  Synthetic
aggccctggctgctgatatgtggaaagaggcaaagaccactctattttgtgcatctgacgctcaatcatatagtactgaaaaacataatgtctgggccacacatgcttgtgtacccacaggaccttttgggacagcggtg

SEQ ID NO: 410524 - DNA, 140 bp, Artificial Sequence
  Synthetic
caccgctgtcccaaaaggtcctgtgggtacacaagcatgtgtggcccagacattatgtttttcagtactatatgattgagcgtcagatgcacaaaatagagtggtctttgcctctttccacatatcagcagccagggcct

SEQ ID NO: 410525 - DNA, 140 bp, Artificial Sequence
  Synthetic
aggccctggctgctgatatgtagtactgaaaaacataatgtctgggccacacatgcttgtgtacccacagaccccgacccacaggagatagacctaaaaaatgtaacagaaaattttaatgaccttttgggacagcggtg

SEQ ID NO: 410526 - DNA, 140 bp, Artificial Sequence
  Synthetic
caccgctgtcccaaaaggtcattaaaattttctgttacattttttaggtctatctcctgtgggtcggggtctgtgggtacacaagcatgtgtggcccagacattatgtttttcagtactacatatcagcagccagggcct

SEQ ID NO: 410527 - DNA, 140 bp, Artificial Sequence
  Synthetic
aggccctggctgctgatatgactttaaaacagatagttacaaaattaagagaacaatttaagaataaaacaatagtctttaatcaatcctcaggaggggacccagaaattgtaatgcacagaccttttgggacagcggtg

SEQ ID NO: 410528 - DNA, 140 bp, Artificial Sequence
  Synthetic
caccgctgtcccaaaaggtctgtgcattacaatttctgggtcccctcctgaggattgattaaagactattgttttattcttaaattgttctcttaattttgtaactatctgttttaaagtcatatcagcagccagggcct

SEQ ID NO: 410529 - DNA, 140 bp, Artificial Sequence
  Synthetic
  misc_feature (41)..(41): n is a, c, g, or t
atacgccatgctgggtctccatgggatgaaagtctaaaacnttgtgtaaaattaacccctctctgtgttactttaacctgtaccagtgtagctaataatattactacaactaatgtaactcgtacttgggagtcggccat

SEQ ID NO: 410530 - DNA, 140 bp, Artificial Sequence
  Synthetic
  misc_feature (100)..(100): n is a, c, g, or t
atggccgactcccaagtacgagttacattagttgtagtaatattattagctacactggtacaggttaaagtaacacagagaggggttaattttacacaangttttagactttcatcccatggagacccagcatggcgtat

SEQ ID NO: 410531 - DNA, 140 bp, Artificial Sequence
  Synthetic
atacgccatgctgggtctccagaaatgaaaaactgttcttttaatataaccacagaaataagagataagaagaaacaagaatatgcgcttttttataaagctgatctagtaccactagatcgtacttgggagtcggccat

SEQ ID NO: 410532 - DNA, 140 bp, Artificial Sequence
  Synthetic
atggccgactcccaagtacgatctagtggtactagatcagctttataaaaaagcgcatattcttgtttcttcttatctcttatttctgtggttatattaaaagaacagtttttcatttctggagacccagcatggcgtat

SEQ ID NO: 410533 - DNA, 140 bp, Artificial Sequence
  Synthetic
aggccctggctgctgatatgccatcccttcagacaggatcagaagaacttaaatcattatataatacagtagcagtcctctattgtgtacatcaaaggatagaggtaaaagacaccaagggaccttttgggacagcggtg

SEQ ID NO: 410534 - DNA, 140 bp, Artificial Sequence
  Synthetic
caccgctgtcccaaaaggtcccttggtgtcttttacctctatcctttgatgtacacaatagaggactgctactgtattatataatgatttaagttcttctgatcctgtctgaagggatggcatatcagcagccagggcct

SEQ ID NO: 410535 - DNA, 140 bp, Artificial Sequence
  Synthetic
aggccctggctgctgatatgagcagtcctctattgtgtacatcaaaggatagaggtaaaagacaccaaggaagctttagataagatagaggaagagcaaaacaaaagtaagaaaaaggcagaccttttgggacagcggtg

SEQ ID NO: 410536 - DNA, 140 bp, Artificial Sequence
  Synthetic
caccgctgtcccaaaaggtctgcctttttcttacttttgttttgctcttcctctatcttatctaaagcttccttggtgtcttttacctctatcctttgatgtacacaatagaggactgctcatatcagcagccagggcct

SEQ ID NO: 410537 - DNA, 140 bp, Artificial Sequence
  Synthetic
aggccctggctgctgatatgcagctggttttgcgattctaaagtgtaaagataagaatttcaatggaacaggaccatgcagcaatgtcagtacagtacaatgtacacatggaattaagccgaccttttgggacagcggtg

SEQ ID NO: 410538 - DNA, 140 bp, Artificial Sequence
  Synthetic
caccgctgtcccaaaaggtcggcttaattccatgtgtacattgtactgtactgacattgctgcatggtcctgttccattgaaattcttatctttacactttagaatcgcaaaaccagctgcatatcagcagccagggcct

SEQ ID NO: 410539 - DNA, 140 bp, Artificial Sequence
  Synthetic
aggccctggctgctgatatgggaccatgcagcaatgtcagtacagtacaatgtacacatggaattaagccagtgatatcaactcaattactgctaaatggcagtctagcagaaaaagagagaccttttgggacagcggtg

SEQ ID NO: 410540 - DNA, 140 bp, Artificial Sequence
  Synthetic
caccgctgtcccaaaaggtctctctttttctgctagactgccatttagcagtaattgagttgatatcactggcttaattccatgtgtacattgtactgtactgacattgctgcatggtcccatatcagcagccagggcct

SEQ ID NO: 410541 - DNA, 140 bp, Artificial Sequence
  Synthetic
atacgccatgctgggtctcccagcttaataaacctgtagaaattatatgtaccagacctagcaacaatacaagaaaaagtataagaatagggccaggacaaacattctatacaacaggcgcgtacttgggagtcggccat

SEQ ID NO: 410542 - DNA, 140 bp, Artificial Sequence
  Synthetic
atggccgactcccaagtacgcgcctgttgtatagaatgtttgtcctggccctattcttatactttttcttgtattgttgctaggtctggtacatataatttctacaggtttattaagctgggagacccagcatggcgtat

SEQ ID NO: 410543 - DNA, 140 bp, Artificial Sequence
  Synthetic
aggccctggctgctgatatgaagaaaaagtataagaatagggccaggacaaacattctatacaacaggcgaagtaataggaaatataagacaagcacattgtaatattagtaagagcaatgaccttttgggacagcggtg

SEQ ID NO: 410544 - DNA, 140 bp, Artificial Sequence
  Synthetic
caccgctgtcccaaaaggtcattgctcttactaatattacaatgtgcttgtcttatatttcctattacttcgcctgttgtatagaatgtttgtcctggccctattcttatactttttcttcatatcagcagccagggcct

SEQ ID NO: 410545 - DNA, 140 bp, Artificial Sequence
  Synthetic
atacgccatgctgggtctcctgtaactaagatattctttaatgaatcctcaggaggggacctagaaattgtaacacatagttttaattgtggaggagaatttttctattgtaatacatcacgtacttgggagtcggccat

SEQ ID NO: 410546 - DNA, 140 bp, Artificial Sequence
  Synthetic
atggccgactcccaagtacgtgatgtattacaatagaaaaattctcctccacaattaaaactatgtgttacaatttctaggtcccctcctgaggattcattaaagaatatcttagttacaggagacccagcatggcgtat

SEQ ID NO: 410547 - DNA, 140 bp, Artificial Sequence
  Synthetic
aggccctggctgctgatatgggaaaactaaattgggcaagtcagatttatccaggaattaaagtaaagcaattatgtaaactccttaggggagccaaagcactaacagacatagtgccacgaccttttgggacagcggtg

SEQ ID NO: 410548 - DNA, 140 bp, Artificial Sequence
  Synthetic
caccgctgtcccaaaaggtcgtggcactatgtctgttagtgctttggctcccctaaggagtttacataattgctttactttaattcctggataaatctgacttgcccaatttagttttcccatatcagcagccagggcct

SEQ ID NO: 410549 - DNA, 140 bp, Artificial Sequence
  Synthetic
atacgccatgctgggtctcccaggaggagatatgagggacatttggagaagtgaattatataattataagatagtggagattgaaccactaggagtagcacccaccaaggcaaggagaagcgtacttgggagtcggccat

SEQ ID NO: 410550 - DNA, 140 bp, Artificial Sequence
  Synthetic
atggccgactcccaagtacgcttctccttgccttggtgggtgctactcctagtggttcaatctccactatcttataattatataattcacttctccaaatgtccctcatatctcctcctgggagacccagcatggcgtat

SEQ ID NO: 410551 - DNA, 140 bp, Artificial Sequence
  Synthetic
aggccctggctgctgatatgaagagacatgggacacatggtggacagagtattggcaagccacctggattcctgaatgggagtttgtcaacaccccccctctagtaaaactatggtatcagaccttttgggacagcggtg

SEQ ID NO: 410552 - DNA, 140 bp, Artificial Sequence
  Synthetic
caccgctgtcccaaaaggtctgataccatagttttactagagggggggtgttgacaaactcccattcaggaatccaggtggcttgccaatactctgtccaccatgtgtcccatgtctcttcatatcagcagccagggcct

SEQ ID NO: 410553 - DNA, 140 bp, Artificial Sequence
  Synthetic
atacgccatgctgggtctcccctctatgaaaatgataccatgtatggagaagtaaaaaattgctctttcaatatgaccacagaaataagagataagaaaaagggagtgtatgcactttttcgtacttgggagtcggccat

SEQ ID NO: 410554 - DNA, 140 bp, Artificial Sequence
  Synthetic
atggccgactcccaagtacgaaaaagtgcatacactccctttttcttatctcttatttctgtggtcatattgaaagagcaattttttacttctccatacatggtatcattttcatagaggggagacccagcatggcgtat

SEQ ID NO: 410555 - DNA, 140 bp, Artificial Sequence
  Synthetic
atacgccatgctgggtctccgttagaaacagagcccatagcaggagcagaaaccttctatgtagatggggcatctaatagagagaccaaaaaaggaaaagcaggatatgttactgacagacgtacttgggagtcggccat

SEQ ID NO: 410556 - DNA, 140 bp, Artificial Sequence
  Synthetic
atggccgactcccaagtacgtctgtcagtaacatatcctgcttttccttttttggtctctctattagatgccccatctacatagaaggtttctgctcctgctatgggctctgtttctaacggagacccagcatggcgtat

SEQ ID NO: 410557 - DNA, 140 bp, Artificial Sequence
  Synthetic
  misc_feature (45)..(45): n is a, c, g, or t
aggccctggctgctgatatgctgattgtgcctggctagaagcacnagaggaggaggaggtgggttttccagtcagacctcaggtacctcttcagcgttcgatcttagccactttttaaaagaccttttgggacagcggtg

SEQ ID NO: 410558 - DNA, 140 bp, Artificial Sequence
  Synthetic
  misc_feature (96)..(96): n is a, c, g, or t
caccgctgtcccaaaaggtcttttaaaaagtggctaagatcgaacgctgaagaggtacctgaggtctgactggaaaacccacctcctcctcctctngtgcttctagccaggcacaatcagcatatcagcagccagggcct

SEQ ID NO: 410559 - DNA, 140 bp, Artificial Sequence
  Synthetic
atacgccatgctgggtctccaataaatagagttaggcagggatactcacctctgtcgtttcagatccataccccaagcccagagggactcgacaggctcgaaagaatcgcaggagaaggtcgtacttgggagtcggccat

SEQ ID NO: 410560 - DNA, 140 bp, Artificial Sequence
  Synthetic
atggccgactcccaagtacgaccttctcctgcgattctttcgagcctgtcgagtccctctgggcttggggtatggatctgaaacgacagaggtgagtatccctgcctaactctatttattggagacccagcatggcgtat

SEQ ID NO: 410561 - DNA, 140 bp, Artificial Sequence
  Synthetic
aggccctggctgctgatatggaacacttccctaataaaacaataaactttaactcatcctcaggaggggacctagaaattacaacacatagttttaattgtagaggagaatttttttattgaccttttgggacagcggtg

SEQ ID NO: 410562 - DNA, 140 bp, Artificial Sequence
  Synthetic
caccgctgtcccaaaaggtcaataaaaaaattctcctctacaattaaaactatgtgttgtaatttctaggtcccctcctgaggatgagttaaagtttattgttttattagggaagtgttccatatcagcagccagggcct

SEQ ID NO: 410563 - DNA, 140 bp, Artificial Sequence
  Synthetic
atacgccatgctgggtctcctacctccattaataccacgaatggaggcattaacatgaaggaagaaataaaaaattgctctttcaatacaaccacagaaataagaaatagggaaaagaaacgtacttgggagtcggccat

SEQ ID NO: 410564 - DNA, 140 bp, Artificial Sequence
  Synthetic
atggccgactcccaagtacgtttcttttccctatttcttatttctgtggttgtattgaaagagcaattttttatttcttccttcatgttaatgcctccattcgtggtattaatggaggtaggagacccagcatggcgtat

SEQ ID NO: 410565 - DNA, 140 bp, Artificial Sequence
  Synthetic
atacgccatgctgggtctccagcagcctcaagggactgaggctagggtgggaaggcctcaaatatctgtggaatcttctggcatattggggtcaggaactgaagactagtgctattaattcgtacttgggagtcggccat

SEQ ID NO: 410566 - DNA, 140 bp, Artificial Sequence
  Synthetic
atggccgactcccaagtacgaattaatagcactagtcttcagttcctgaccccaatatgccagaagattccacagatatttgaggccttcccaccctagcctcagtcccttgaggctgctggagacccagcatggcgtat

SEQ ID NO: 410567 - DNA, 140 bp, Artificial Sequence
  Synthetic
atacgccatgctgggtctccgggaaaattagaagaacactttaagaataaaagtatagtttttaatcaatcctcaggaggggacctagaaatcacaacacatagctttaattgtgggggacgtacttgggagtcggccat

SEQ ID NO: 410568 - DNA, 140 bp, Artificial Sequence
  Synthetic
atggccgactcccaagtacgtcccccacaattaaagctatgtgttgtgatttctaggtcccctcctgaggattgattaaaaactatacttttattcttaaagtgttcttctaattttcccggagacccagcatggcgtat

SEQ ID NO: 410569 - DNA, 140 bp, Artificial Sequence
  Synthetic
aggccctggctgctgatatgaagggatggcctgctatcagggaaagaatgagaaggactcctccaactccaactccagcagcagaaggagtgggagcagtgtctaaaagtttacagaagcgaccttttgggacagcggtg

SEQ ID NO: 410570 - DNA, 140 bp, Artificial Sequence
  Synthetic
caccgctgtcccaaaaggtcgcttctgtaaacttttagacactgctcccactccttctgctgctggagttggagttggaggagtccttctcattctttccctgatagcaggccatcccttcatatcagcagccagggcct

SEQ ID NO: 410571 - DNA, 140 bp, Artificial Sequence
  Synthetic
atacgccatgctgggtctccctggtaaaaatataacgtttggcaatcactcaggaggggatctagaaattacaacacatagttttaattgtagaggagagtttttctattgcaatacaaccgtacttgggagtcggccat

SEQ ID NO: 410572 - DNA, 140 bp, Artificial Sequence
  Synthetic
atggccgactcccaagtacggttgtattgcaatagaaaaactctcctctacaattaaaactatgtgttgtaatttctagatcccctcctgagtgattgccaaacgttatatttttaccagggagacccagcatggcgtat

SEQ ID NO: 410573 - DNA, 140 bp, Artificial Sequence
  Synthetic
atacgccatgctgggtctccaaaactcatctgcaccactgctgtgccttggaacaatagttggagtaataaaactcaagagcagatttgggaaaacatgacttggatgcagtgggaaaaacgtacttgggagtcggccat

SEQ ID NO: 410574 - DNA, 140 bp, Artificial Sequence
  Synthetic
atggccgactcccaagtacgtttttcccactgcatccaagtcatgttttcccaaatctgctcttgagttttattactccaactattgttccaaggcacagcagtggtgcagatgagttttggagacccagcatggcgtat

SEQ ID NO: 410575 - DNA, 140 bp, Artificial Sequence
  Synthetic
aggccctggctgctgatatggctataataagaatattgcaacaactactgtttatccatttcagaattgggtgtcagcatagcagaataggcattatacgacagagaagagcaagaaatggaccttttgggacagcggtg

SEQ ID NO: 410576 - DNA, 140 bp, Artificial Sequence
  Synthetic
caccgctgtcccaaaaggtccatttcttgctcttctctgtcgtataatgcctattctgctatgctgacacccaattctgaaatggataaacagtagttgttgcaatattcttattatagccatatcagcagccagggcct

SEQ ID NO: 410577 - DNA, 140 bp, Artificial Sequence
  Synthetic
aggccctggctgctgatatggataggattatagaagtagtacaaagaatttgtagagctatctgcaacatacctagaagaataagacagggctttgaagcagctttgcaataaaatgggggaccttttgggacagcggtg

SEQ ID NO: 410578 - DNA, 140 bp, Artificial Sequence
  Synthetic
caccgctgtcccaaaaggtcccccattttattgcaaagctgcttcaaagccctgtcttattcttctaggtatgttgcagatagctctacaaattctttgtactacttctataatcctatccatatcagcagccagggcct

SEQ ID NO: 410579 - DNA, 140 bp, Artificial Sequence
  Synthetic
aggccctggctgctgatatgacctagaagaataagacagggctttgaagcagctttgcaataaaatggggggcaagtggtcaaaaagcagcatagttggatggcctgctgtaagagaaaggaccttttgggacagcggtg

SEQ ID NO: 410580 - DNA, 140 bp, Artificial Sequence
  Synthetic
caccgctgtcccaaaaggtcctttctcttacagcaggccatccaactatgctgctttttgaccacttgccccccattttattgcaaagctgcttcaaagccctgtcttattcttctaggtcatatcagcagccagggcct

SEQ ID NO: 410581 - DNA, 140 bp, Artificial Sequence
  Synthetic
atacgccatgctgggtctcctgtaccagagcagtaagtattgttaagtagtatatgtaatgtctgatttgttagcattaggcatagcagcattaatagtagcattaataatagcaatagtcgtacttgggagtcggccat

SEQ ID NO: 410582 - DNA, 140 bp, Artificial Sequence
  Synthetic
atggccgactcccaagtacgactattgctattattaatgctactattaatgctgctatgcctaatgctaacaaatcagacattacatatactacttaacaatacttactgctctggtacaggagacccagcatggcgtat

SEQ ID NO: 410583 - DNA, 140 bp, Artificial Sequence
  Synthetic
aggccctggctgctgatatgtcccacagagcagaccagagccaacagccccaccattccctcagagcagcctagagccaacagccccaccagcagagagcctggggaaggcggaagggatgaccttttgggacagcggtg

SEQ ID NO: 410584 - DNA, 140 bp, Artificial Sequence
  Synthetic
caccgctgtcccaaaaggtcatcccttccgccttccccaggctctctgctggtggggctgttggctctaggctgctctgagggaatggtggggctgttggctctggtctgctctgtgggacatatcagcagccagggcct

SEQ ID NO: 410585 - DNA, 140 bp, Artificial Sequence
  Synthetic
aggccctggctgctgatatgacgaggaactcctcaaagcagtaaggatcatcaaaattctgtacaacagcagtaagtattagtaattaatgtatgtaatgttgtctcctttgcaaatctggaccttttgggacagcggtg

SEQ ID NO: 410586 - DNA, 140 bp, Artificial Sequence
  Synthetic
caccgctgtcccaaaaggtccagatttgcaaaggagacaacattacatacattaattactaatacttactgctgttgtacagaattttgatgatccttactgctttgaggagttcctcgtcatatcagcagccagggcct

SEQ ID NO: 410587 - DNA, 140 bp, Artificial Sequence
  Synthetic
aggccctggctgctgatatgcctcaggaggggacccagaaattgtaatgcacagttttaattgtggaggggaatttttctactgtaattcaacacaactgtttaatagtacttggaatgggaccttttgggacagcggtg

SEQ ID NO: 410588 - DNA, 140 bp, Artificial Sequence
  Synthetic
caccgctgtcccaaaaggtcccattccaagtactattaaacagttgtgttgaattacagtagaaaaattcccctccacaattaaaactgtgcattacaatttctgggtcccctcctgaggcatatcagcagccagggcct

SEQ ID NO: 410589 - DNA, 140 bp, Artificial Sequence
  Synthetic
aggccctggctgctgatatgctatagtattcatagagtgtataaaattaagaagacaaagaaaaatagactggttaattaatagaataagtgaaagagcagaagacagtggcaatgacaggaccttttgggacagcggtg

SEQ ID NO: 410590 - DNA, 140 bp, Artificial Sequence
  Synthetic
caccgctgtcccaaaaggtcctgtcattgccactgtcttctgctctttcacttattctattaattaaccagtctatttttctttgtcttcttaattttatacactctatgaatactatagcatatcagcagccagggcct

SEQ ID NO: 410591 - DNA, 140 bp, Artificial Sequence
  Synthetic
aggccctggctgctgatatgtttatgcaacaggagacataataggagacatcagaaaggcacattgtaatgttagtggagaacaatggaataaaacattagaacgggtaaaggcagagttgaccttttgggacagcggtg

SEQ ID NO: 410592 - DNA, 140 bp, Artificial Sequence
  Synthetic
caccgctgtcccaaaaggtcaactctgcctttacccgttctaatgttttattccattgttctccactaacattacaatgtgcctttctgatgtctcctattatgtctcctgttgcataaacatatcagcagccagggcct

SEQ ID NO: 410593 - DNA, 140 bp, Artificial Sequence
  Synthetic
aggccctggctgctgatatggcattagtagtagcaggaataatagcaatagttgtgtggtctatagtactcatagaatataggaaaatactaaaacaaagaaaaatagacaggttaattggaccttttgggacagcggtg

SEQ ID NO: 410594 - DNA, 140 bp, Artificial Sequence
  Synthetic
caccgctgtcccaaaaggtccaattaacctgtctatttttctttgttttagtattttcctatattctatgagtactatagaccacacaactattgctattattcctgctactactaatgccatatcagcagccagggcct

SEQ ID NO: 410595 - DNA, 140 bp, Artificial Sequence
  Synthetic
aggccctggctgctgatatgggccctaaaagaattgttaaatgtttcaactgtggcaaggaagggcacatagccagaaattgcagggcccctaggaaaaaaggctgttggaaatgtggaagaccttttgggacagcggtg

SEQ ID NO: 410596 - DNA, 140 bp, Artificial Sequence
  Synthetic
caccgctgtcccaaaaggtcttccacatttccaacagccttttttcctaggggccctgcaatttctggctatgtgcccttccttgccacagttgaaacatttaacaattcttttagggcccatatcagcagccagggcct

SEQ ID NO: 410597 - DNA, 140 bp, Artificial Sequence
  Synthetic
atacgccatgctgggtctcccaacgtcacggagtgggaagaaataaaaaactgctctttcaatataaccacagagataagggataagaaacagaaggtgtattcacttttttataaacttcgtacttgggagtcggccat

SEQ ID NO: 410598 - DNA, 140 bp, Artificial Sequence
  Synthetic
atggccgactcccaagtacgaagtttataaaaaagtgaatacaccttctgtttcttatcccttatctctgtggttatattgaaagagcagttttttatttcttcccactccgtgacgttgggagacccagcatggcgtat

SEQ ID NO: 410599 - DNA, 140 bp, Artificial Sequence
  Synthetic
aggccctggctgctgatatgtagattaataaattgtaatacctcagccattacacaagcttgcccaaaggtaacctttgagccaattcccatacattattgtgccccagctggttttgcggaccttttgggacagcggtg

SEQ ID NO: 410600 - DNA, 140 bp, Artificial Sequence
  Synthetic
caccgctgtcccaaaaggtccgcaaaaccagctggggcacaataatgtatgggaattggctcaaaggttacctttgggcaagcttgtgtaatggctgaggtattacaatttattaatctacatatcagcagccagggcct

SEQ ID NO: 410601 - DNA, 140 bp, Artificial Sequence
  Synthetic
aggccctggctgctgatatgtagatcctaacctagagccctggaaccatccaggaagtcagcctaaaactccttgtactaattgctattgtaaacactgtagctaccattgtctagtttggaccttttgggacagcggtg

SEQ ID NO: 410602 - DNA, 140 bp, Artificial Sequence
  Synthetic
caccgctgtcccaaaaggtccaaactagacaatggtagctacagtgtttacaatagcaattagtacaaggagttttaggctgacttcctggatggttccagggctctaggttaggatctacatatcagcagccagggcct

SEQ ID NO: 410603 - DNA, 140 bp, Artificial Sequence
  Synthetic
aggccctggctgctgatatgctccactctgtgtcactttaaattgtaatattaatagtagtagtggtggtagtaatactactagtactaatactactactactagtagtagtaaaggagtgaccttttgggacagcggtg

SEQ ID NO: 410604 - DNA, 140 bp, Artificial Sequence
  Synthetic
caccgctgtcccaaaaggtcactcctttactactactagtagtagtagtattagtactagtagtattactaccaccactactactattaatattacaatttaaagtgacacagagtggagcatatcagcagccagggcct

SEQ ID NO: 410605 - DNA, 140 bp, Artificial Sequence
  Synthetic
atacgccatgctgggtctccgcagaagtgataaggtgaaaaaagaatatgctcttttttataaacttgatgtagtgaaaacagataatactagcaattcaagctatacgctgatgagttgcgtacttgggagtcggccat

SEQ ID NO: 410606 - DNA, 140 bp, Artificial Sequence
  Synthetic
atggccgactcccaagtacgcaactcatcagcgtatagcttgaattgctagtattatctgttttcactacatcaagtttataaaaaagagcatattcttttttcaccttatcacttctgcggagacccagcatggcgtat

SEQ ID NO: 410607 - DNA, 140 bp, Artificial Sequence
  Synthetic
aggccctggctgctgatatggaacttctgggacgcagggggtgggaagccctcaaatattggtggaatctcctacaatattggattcaggaactaaagaatagtgctgttagcttgctcagaccttttgggacagcggtg

SEQ ID NO: 410608 - DNA, 140 bp, Artificial Sequence
  Synthetic
caccgctgtcccaaaaggtctgagcaagctaacagcactattctttagttcctgaatccaatattgtaggagattccaccaatatttgagggcttcccaccccctgcgtcccagaagttccatatcagcagccagggcct

SEQ ID NO: 410609 - DNA, 140 bp, Artificial Sequence
  Synthetic
atacgccatgctgggtctccgcactatttatgcaacaggaggtataataggagatataagacaagcacattgtaacgttagtaaaaatgaatggaatgacactttaaaggaaatagttatcgtacttgggagtcggccat

SEQ ID NO: 410610 - DNA, 140 bp, Artificial Sequence
  Synthetic
atggccgactcccaagtacgataactatttcctttaaagtgtcattccattcatttttactaacgttacaatgtgcttgtcttatatctcctattatacctcctgttgcataaatagtgcggagacccagcatggcgtat

SEQ ID NO: 410611 - DNA, 140 bp, Artificial Sequence
  Synthetic
atacgccatgctgggtctcctagtgccattagcttacttgatagcacagcaataggagtagctgagtggacagatagagttatagaaaccttgcaaagagctggtagagctgtgcgcaaccgtacttgggagtcggccat

SEQ ID NO: 410612 - DNA, 140 bp, Artificial Sequence
  Synthetic
atggccgactcccaagtacggttgcgcacagctctaccagctctttgcaaggtttctataactctatctgtccactcagctactcctattgctgtgctatcaagtaagctaatggcactaggagacccagcatggcgtat

SEQ ID NO: 410613 - DNA, 140 bp, Artificial Sequence
  Synthetic
  misc_feature (89)..(89): n is a, c, g, or t
aggccctggctgctgatatggcagttggcaattggactgatagcatcatcttaggaatacaaagaataggaaggggaattcttaatatnccacgaagaattagacagggcttcgaacgctgaccttttgggacagcggtg

SEQ ID NO: 410614 - DNA, 140 bp, Artificial Sequence
  Synthetic
  misc_feature (52)..(52): n is a, c, g, or t
caccgctgtcccaaaaggtcagcgttcgaagccctgtctaattcttcgtggnatattaagaattccccttcctattctttgtattcctaagatgatgctatcagtccaattgccaactgccatatcagcagccagggcct

SEQ ID NO: 410615 - DNA, 140 bp, Artificial Sequence
  Synthetic
  misc_feature (80)..(80): n is a, c, g, or t
  misc_feature (118)..(118): n is a, c, g, or t
aggccctggctgctgatatgagcatctaatatgggcaagcagggagctagaacgatttgcaattgatcctggccttctanaaacagcagaaggctgtcgaaaaataatagaacaactncagaccttttgggacagcggtg

SEQ ID NO: 410616 - DNA, 140 bp, Artificial Sequence
  Synthetic
  misc_feature (23)..(23): n is a, c, g, or t
  misc_feature (61)..(61): n is a, c, g, or t
caccgctgtcccaaaaggtctgnagttgttctattatttttcgacagccttctgctgtttntagaaggccaggatcaattgcaaatcgttctagctccctgcttgcccatattagatgctcatatcagcagccagggcct

SEQ ID NO: 410617 - DNA, 140 bp, Artificial Sequence
  Synthetic
aggccctggctgctgatatggcctcttcagctaccaccgcttgagagacttcatcttgattgccgcgaggactgtggaacttctgggacacagcagtctcaaggggttgagactggggtggaccttttgggacagcggtg

SEQ ID NO: 410618 - DNA, 140 bp, Artificial Sequence
  Synthetic
caccgctgtcccaaaaggtccaccccagtctcaaccccttgagactgctgtgtcccagaagttccacagtcctcgcggcaatcaagatgaagtctctcaagcggtggtagctgaagaggccatatcagcagccagggcct

SEQ ID NO: 410619 - DNA, 140 bp, Artificial Sequence
  Synthetic
aggccctggctgctgatatggcggaggctagaaggagagagatgggtgcgagagcgtcagtattaagcgggggaaaattagatgcatgggagaaaattcggttaaggccagggggaaagagaccttttgggacagcggtg

SEQ ID NO: 410620 - DNA, 140 bp, Artificial Sequence
  Synthetic
caccgctgtcccaaaaggtctctttccccctggccttaaccgaattttctcccatgcatctaattttcccccgcttaatactgacgctctcgcacccatctctctccttctagcctccgccatatcagcagccagggcct

SEQ ID NO: 410621 - DNA, 140 bp, Artificial Sequence
  Synthetic
atacgccatgctgggtctccttaagggccaaagaagaattgttaaatgtttcaattgtggcaaagaaggacacatagccaaaaattgcagggcccctaggaaaaagggctgttggaaatgcgtacttgggagtcggccat

SEQ ID NO: 410622 - DNA, 140 bp, Artificial Sequence
  Synthetic
atggccgactcccaagtacgcatttccaacagccctttttcctaggggccctgcaatttttggctatgtgtccttctttgccacaattgaaacatttaacaattcttctttggcccttaaggagacccagcatggcgtat

SEQ ID NO: 410623 - DNA, 140 bp, Artificial Sequence
  Synthetic
atacgccatgctgggtctccccatggcaggaagaagcggagacaacgacgagcggctcctctcagcagtaaggatcatcaaaatcctgtaccaaagcagtaagtacatttgtagagtattcgtacttgggagtcggccat

SEQ ID NO: 410624 - DNA, 140 bp, Artificial Sequence
  Synthetic
atggccgactcccaagtacgaatactctacaaatgtacttactgctttggtacaggattttgatgatccttactgctgagaggagccgctcgtcgttgtctccgcttcttcctgccatggggagacccagcatggcgtat

SEQ ID NO: 410625 - DNA, 140 bp, Artificial Sequence
  Synthetic
aggccctggctgctgatatggcatgaggatataatcagtctatgggatcaaagcctaaagccatgtgttaagttaacccctctttgcgttactttaaattgtaataactataatggcaccgaccttttgggacagcggtg

SEQ ID NO: 410626 - DNA, 140 bp, Artificial Sequence
  Synthetic
caccgctgtcccaaaaggtcggtgccattatagttattacaatttaaagtaacgcaaagaggggttaacttaacacatggctttaggctttgatcccatagactgattatatcctcatgccatatcagcagccagggcct

SEQ ID NO: 410627 - DNA, 140 bp, Artificial Sequence
  Synthetic
aggccctggctgctgatatgtgttaaggcaaaagaaaatagataggttaattgatagaataacagaaagagcagaagatagtggcaatgagagtgatggggacacagaggaattatcaaagaccttttgggacagcggtg

SEQ ID NO: 410628 - DNA, 140 bp, Artificial Sequence
  Synthetic
caccgctgtcccaaaaggtctttgataattcctctgtgtccccatcactctcattgccactatcttctgctctttctgttattctatcaattaacctatctattttcttttgccttaacacatatcagcagccagggcct

SEQ ID NO: 410629 - DNA, 140 bp, Artificial Sequence
  Synthetic
atacgccatgctgggtctccactaaaggggagaacttgtgggccacagtttattatggggtacctgtgtggagagaggcaaaggccactttattttgcgcatctgatgctcaatcatatacgtacttgggagtcggccat

SEQ ID NO: 410630 - DNA, 140 bp, Artificial Sequence
  Synthetic
atggccgactcccaagtacgtatatgattgagcatcagatgcgcaaaataaagtggcctttgcctctctccacacaggtaccccataataaactgtggcccacaagttctcccctttagtggagacccagcatggcgtat

SEQ ID NO: 410631 - DNA, 140 bp, Artificial Sequence
  Synthetic
atacgccatgctgggtctccaactctcaacgccaccactggggaaataaaaaactgcacttttaatatgactacagaaataagaaataagaataaacaagaatatgcgcttttttataaacgtacttgggagtcggccat

SEQ ID NO: 410632 - DNA, 140 bp, Artificial Sequence
  Synthetic
atggccgactcccaagtacgtttataaaaaagcgcatattcttgtttattcttatttcttatttctgtagtcatattaaaagtgcagttttttatttccccagtggtggcgttgagagttggagacccagcatggcgtat

SEQ ID NO: 410633 - DNA, 140 bp, Artificial Sequence
  Synthetic
atacgccatgctgggtctccgtgtaccagacctaacaacaatacaagaaaaagtataagaatagggccaggacaaacattctttgcaacagacataataggagatataagacaagcatatcgtacttgggagtcggccat

SEQ ID NO: 410634 - DNA, 140 bp, Artificial Sequence
  Synthetic
atggccgactcccaagtacgatatgcttgtcttatatctcctattatgtctgttgcaaagaatgtttgtcctggccctattcttatactttttcttgtattgttgttaggtctggtacacggagacccagcatggcgtat

SEQ ID NO: 410635 - DNA, 140 bp, Artificial Sequence
  Synthetic
aggccctggctgctgatatggacaaacattctttgcaacagacataataggagatataagacaagcatattgtaatattagtagtaaaaactggacagacactttacaaaaggtagctgagaccttttgggacagcggtg

SEQ ID NO: 410636 - DNA, 140 bp, Artificial Sequence
  Synthetic
caccgctgtcccaaaaggtctcagctaccttttgtaaagtgtctgtccagtttttactactaatattacaatatgcttgtcttatatctcctattatgtctgttgcaaagaatgtttgtccatatcagcagccagggcct

SEQ ID NO: 410637 - DNA, 140 bp, Artificial Sequence
  Synthetic
atacgccatgctgggtctcccctttgatgaggcctccgggggggatccagaaattgtaacacatagttttaattgtggaggagaatttttttattgtaatacatcaaaactatttaatagcgtacttgggagtcggccat

SEQ ID NO: 410638 - DNA, 140 bp, Artificial Sequence
  Synthetic
atggccgactcccaagtacgctattaaatagttttgatgtattacaataaaaaaattctcctccacaattaaaactatgtgttacaatttctggatcccccccggaggcctcatcaaaggggagacccagcatggcgtat

SEQ ID NO: 410639 - DNA, 140 bp, Artificial Sequence
  Synthetic
aggccctggctgctgatatgagaatgtggcagagagtaggacaagcaatgtatgcccctcccattgcaggaaatattacatgtgtatcaaacattacaggcttattactgacacgtgatggaccttttgggacagcggtg

SEQ ID NO: 410640 - DNA, 140 bp, Artificial Sequence
  Synthetic
caccgctgtcccaaaaggtccatcacgtgtcagtaataagcctgtaatgtttgatacacatgtaatatttcctgcaatgggaggggcatacattgcttgtcctactctctgccacattctcatatcagcagccagggcct

SEQ ID NO: 410641 - DNA, 140 bp, Artificial Sequence
  Synthetic
atacgccatgctgggtctcccaaaggttaataatactgaaagtgcaaacgttactgccagtgatgctagggccagggaagaaatgaaaaattgctctttcaatgcaaccacagaagtacacgtacttgggagtcggccat

SEQ ID NO: 410642 - DNA, 140 bp, Artificial Sequence
  Synthetic
atggccgactcccaagtacgtgtacttctgtggttgcattgaaagagcaatttttcatttcttccctggccctagcatcactggcagtaacgtttgcactttcagtattattaacctttgggagacccagcatggcgtat

SEQ ID NO: 410643 - DNA, 140 bp, Artificial Sequence
  Synthetic
aggccctggctgctgatatgtgtcactttaacctgtataaatgcaaatgtaactgtaaataatagcgtgaaagaagaaataaaaaactgctctttcaatgtaaccacagaaataagagatgaccttttgggacagcggtg

SEQ ID NO: 410644 - DNA, 140 bp, Artificial Sequence
  Synthetic
caccgctgtcccaaaaggtcatctcttatttctgtggttacattgaaagagcagttttttatttcttctttcacgctattatttacagttacatttgcatttatacaggttaaagtgacacatatcagcagccagggcct

SEQ ID NO: 410645 - DNA, 140 bp, Artificial Sequence
  Synthetic
aggccctggctgctgatatgctgaatgggagtttgtcaatacccctcctctagtaaaattatggtaccaattagagaaagaccccatagtaggagcagagactttctatgtagatggggcgaccttttgggacagcggtg

SEQ ID NO: 410646 - DNA, 140 bp, Artificial Sequence
  Synthetic
caccgctgtcccaaaaggtcgccccatctacatagaaagtctctgctcctactatggggtctttctctaattggtaccataattttactagaggaggggtattgacaaactcccattcagcatatcagcagccagggcct

SEQ ID NO: 410647 - DNA, 140 bp, Artificial Sequence
  Synthetic
aggccctggctgctgatatggtggcaaaaggtaggacgagcaatgtatgcccctcccattgcaggaaacataacatgtagatcaaatatcacaggactactattgacacgtgatggaggagaccttttgggacagcggtg

SEQ ID NO: 410648 - DNA, 140 bp, Artificial Sequence
  Synthetic
caccgctgtcccaaaaggtctcctccatcacgtgtcaatagtagtcctgtgatatttgatctacatgttatgtttcctgcaatgggaggggcatacattgctcgtcctaccttttgccaccatatcagcagccagggcct

SEQ ID NO: 410649 - DNA, 140 bp, Artificial Sequence
  Synthetic
atacgccatgctgggtctccacaaagaatttgtagagctattcgcaatatccctagaagaataagacagggcttcgaaagggctttgctataaaatgggtggcaagtggtcaaaaagaagcgtacttgggagtcggccat

SEQ ID NO: 410650 - DNA, 140 bp, Artificial Sequence
  Synthetic
atggccgactcccaagtacgcttctttttgaccacttgccacccattttatagcaaagccctttcgaagccctgtcttattcttctagggatattgcgaatagctctacaaattctttgtggagacccagcatggcgtat

SEQ ID NO: 410651 - DNA, 140 bp, Artificial Sequence
  Synthetic
  misc_feature (40)..(40): n is a, c, g, or t
  misc_feature (45)..(45): n is a, c, g, or t
  misc_feature (64)..(64): n is a, c, g, or t
  misc_feature (70)..(70): n is a, c, g, or t
  misc_feature (86)..(86): n is a, c, g, or t
atacgccatgctgggtctcccatagtgggatggcctgctntcagngaaagaatgagaagggctnctccanctccagcagcagcagnaggagtgggagcagtgtctaaagatttagagaagcgtacttgggagtcggccat

SEQ ID NO: 410652 - DNA, 140 bp, Artificial Sequence
  Synthetic
  misc_feature (55)..(55): n is a, c, g, or t
  misc_feature (71)..(71): n is a, c, g, or t
  misc_feature (77)..(77): n is a, c, g, or t
  misc_feature (96)..(96): n is a, c, g, or t
  misc_feature (101)..(101): n is a, c, g, or t
atggccgactcccaagtacgcttctctaaatctttagacactgctcccactcctnctgctgctgctggagntggagnagcccttctcattctttcnctganagcaggccatcccactatgggagacccagcatggcgtat

SEQ ID NO: 410653 - DNA, 140 bp, Artificial Sequence
  Synthetic
aggccctggctgctgatatgtggagaagtgaattatataaatataaagtggtagaaattaaaccattgggaatagcacccactgaggcaaaaaggagagtggtggagagagaaaaaagaggaccttttgggacagcggtg

SEQ ID NO: 410654 - DNA, 140 bp, Artificial Sequence
  Synthetic
caccgctgtcccaaaaggtcctcttttttctctctccaccactctcctttttgcctcagtgggtgctattcccaatggtttaatttctaccactttatatttatataattcacttctccacatatcagcagccagggcct

SEQ ID NO: 410655 - DNA, 140 bp, Artificial Sequence
  Synthetic
aggccctggctgctgatatgaatgtgccttggaacaacagttggagtaataaatctctagacaagatttggaataacatgacctggatgcagtgggagagagaaattgataattacacaggaccttttgggacagcggtg

SEQ ID NO: 410656 - DNA, 140 bp, Artificial Sequence
  Synthetic
caccgctgtcccaaaaggtcctgtgtaattatcaatttctctctcccactgcatccaggtcatgttattccaaatcttgtctagagatttattactccaactgttgttccaaggcacattcatatcagcagccagggcct

SEQ ID NO: 410657 - DNA, 140 bp, Artificial Sequence
  Synthetic
aggccctggctgctgatatgcatcatagcagaataggcattattcgacagagaagagtaagaaatggagccagtagatcctaacttagatccctggaaccatccaggaagccagcctacagaccttttgggacagcggtg

SEQ ID NO: 410658 - DNA, 140 bp, Artificial Sequence
  Synthetic
caccgctgtcccaaaaggtctgtaggctggcttcctggatggttccagggatctaagttaggatctactggctccatttcttactcttctctgtcgaataatgcctattctgctatgatgcatatcagcagccagggcct

SEQ ID NO: 410659 - DNA, 140 bp, Artificial Sequence
  Synthetic
aggccctggctgctgatatggtttctctatcaaagcagtaagtagtacatgtaatgcaagctttacaaatatcagcaatagtaggattagtagtagcagcaataatagcaatagttgtgtgaccttttgggacagcggtg

SEQ ID NO: 410660 - DNA, 140 bp, Artificial Sequence
  Synthetic
caccgctgtcccaaaaggtcacacaactattgctattattgctgctactactaatcctactattgctgatatttgtaaagcttgcattacatgtactacttactgctttgatagagaaaccatatcagcagccagggcct

SEQ ID NO: 410661 - DNA, 140 bp, Artificial Sequence
  Synthetic
aggccctggctgctgatatgaattaatacaaagagtttgtagagctatctgcaacatacctacaagaattagacagggctttgaaacagctttgctataaaatggggggcacgtggtcaagaccttttgggacagcggtg

SEQ ID NO: 410662 - DNA, 140 bp, Artificial Sequence
  Synthetic
caccgctgtcccaaaaggtcttgaccacgtgccccccattttatagcaaagctgtttcaaagccctgtctaattcttgtaggtatgttgcagatagctctacaaactctttgtattaattcatatcagcagccagggcct

SEQ ID NO: 410663 - DNA, 140 bp, Artificial Sequence
  Synthetic
aggccctggctgctgatatggtaaaattaactccactctgtgttactttaaattgcactgtaagcgggggaatgatggggggaggagaaatgaaaaattgctctttcaatatcaccacaagaccttttgggacagcggtg

SEQ ID NO: 410664 - DNA, 140 bp, Artificial Sequence
  Synthetic
caccgctgtcccaaaaggtcttgtggtgatattgaaagagcaatttttcatttctcctccccccatcattcccccgcttacagtgcaatttaaagtaacacagagtggagttaattttaccatatcagcagccagggcct

SEQ ID NO: 410665 - DNA, 140 bp, Artificial Sequence
  Synthetic
aggccctggctgctgatatgatagtaccaatagataataaaaatgatagctataggttgataagttgtaacacctcagtcattacacaggcctgtccaaaggtatcctttgagccaattcgaccttttgggacagcggtg

SEQ ID NO: 410666 - DNA, 140 bp, Artificial Sequence
  Synthetic
caccgctgtcccaaaaggtcgaattggctcaaaggatacctttggacaggcctgtgtaatgactgaggtgttacaacttatcaacctatagctatcatttttattatctattggtactatcatatcagcagccagggcct

SEQ ID NO: 410667 - DNA, 140 bp, Artificial Sequence
  Synthetic
aggccctggctgctgatatgaagacccaacaacaatacaagaaaaagtataaatataggaccaggcagagcattttatacaacaggagaaataataggagatataagacaagcacattgtgaccttttgggacagcggtg

SEQ ID NO: 410668 - DNA, 140 bp, Artificial Sequence
  Synthetic
caccgctgtcccaaaaggtcacaatgtgcttgtcttatatctcctattatttctcctgttgtataaaatgctctgcctggtcctatatttatactttttcttgtattgttgttgggtcttcatatcagcagccagggcct

SEQ ID NO: 410669 - DNA, 140 bp, Artificial Sequence
  Synthetic
atacgccatgctgggtctccctcccatgtcgaataaaacaaattgtaaacatgtggcagcaagtgggaagagcaatgtatgccgctcccattgcaggaaaaatatcctgtagatcaaatacgtacttgggagtcggccat

SEQ ID NO: 410670 - DNA, 140 bp, Artificial Sequence
  Synthetic
atggccgactcccaagtacgtatttgatctacaggatatttttcctgcaatgggagcggcatacattgctcttcccacttgctgccacatgtttacaatttgttttattcgacatgggagggagacccagcatggcgtat

SEQ ID NO: 410671 - DNA, 140 bp, Artificial Sequence
  Synthetic
aggccctggctgctgatatggggttactgtctactatggggtacctgtgtggaaagatgcagagaccaccctattttgtgcatcagatgctaaagcatatgagacagaaaagcataatgtgaccttttgggacagcggtg

SEQ ID NO: 410672 - DNA, 140 bp, Artificial Sequence
  Synthetic
caccgctgtcccaaaaggtcacattatgcttttctgtctcatatgctttagcatctgatgcacaaaatagggtggtctctgcatctttccacacaggtaccccatagtagacagtaaccccatatcagcagccagggcct

SEQ ID NO: 410673 - DNA, 140 bp, Artificial Sequence
  Synthetic
atacgccatgctgggtctccaaaggagatataaaacaagcatattgtaacattagtaaaacagactggaacaacactttaatactgatagttaaaaaattaagagaacaatatgagaatacgtacttgggagtcggccat

SEQ ID NO: 410674 - DNA, 140 bp, Artificial Sequence
  Synthetic
atggccgactcccaagtacgtattctcatattgttctcttaattttttaactatcagtattaaagtgttgttccagtctgttttactaatgttacaatatgcttgttttatatctcctttggagacccagcatggcgtat

SEQ ID NO: 410675 - DNA, 140 bp, Artificial Sequence
  Synthetic
atacgccatgctgggtctccctttaaaaacgcatcaggaggggatctagaaattacaacacatagttttaattgtggaggagaatttttctattgtaatacatcagacctgtttaatggccgtacttgggagtcggccat

SEQ ID NO: 410676 - DNA, 140 bp, Artificial Sequence
  Synthetic
atggccgactcccaagtacggccattaaacaggtctgatgtattacaatagaaaaattctcctccacaattaaaactatgtgttgtaatttctagatcccctcctgatgcgtttttaaagggagacccagcatggcgtat

SEQ ID NO: 410677 - DNA, 140 bp, Artificial Sequence
  Synthetic
atacgccatgctgggtctccaacagcacggaggacatgagaaactgctctttcaatatgaccacagaactaagagataagcaacagaaagtatattcacttttttatagacttgatctagcgtacttgggagtcggccat

SEQ ID NO: 410678 - DNA, 140 bp, Artificial Sequence
  Synthetic
atggccgactcccaagtacgctagatcaagtctataaaaaagtgaatatactttctgttgcttatctcttagttctgtggtcatattgaaagagcagtttctcatgtcctccgtgctgttggagacccagcatggcgtat

SEQ ID NO: 410679 - DNA, 140 bp, Artificial Sequence
  Synthetic
aggccctggctgctgatatgaggcaggctaattttttagggagaatttggccttcccagaaaggggggaggccagggaatttcctccagagcagaccagagccaacagccccaccagcaggaccttttgggacagcggtg

SEQ ID NO: 410680 - DNA, 140 bp, Artificial Sequence
  Synthetic
caccgctgtcccaaaaggtcctgctggtggggctgttggctctggtctgctctggaggaaattccctggcctcccccctttctgggaaggccaaattctccctaaaaaattagcctgcctcatatcagcagccagggcct

SEQ ID NO: 410681 - DNA, 140 bp, Artificial Sequence
  Synthetic
atacgccatgctgggtctcctactagcaccaatagtactaataccactagtagtattgggggagggatggagggaggagaaatgaaaaactgctctttcaatgttaccacaagcataagacgtacttgggagtcggccat

SEQ ID NO: 410682 - DNA, 140 bp, Artificial Sequence
  Synthetic
atggccgactcccaagtacgtcttatgcttgtggtaacattgaaagagcagtttttcatttctcctccctccatccctcccccaatactactagtggtattagtactattggtgctagtaggagacccagcatggcgtat

SEQ ID NO: 410683 - DNA, 140 bp, Artificial Sequence
  Synthetic
aggccctggctgctgatatggttagagctattctccacatacctagaagaataagacagggcttggaaagggctttgctataagatgggtggcaagtggtcaaaaagtagtatagttggagaccttttgggacagcggtg

SEQ ID NO: 410684 - DNA, 140 bp, Artificial Sequence
  Synthetic
caccgctgtcccaaaaggtctccaactatactactttttgaccacttgccacccatcttatagcaaagccctttccaagccctgtcttattcttctaggtatgtggagaatagctctaaccatatcagcagccagggcct

SEQ ID NO: 410685 - DNA, 140 bp, Artificial Sequence
  Synthetic
atacgccatgctgggtctccaagaacaatatggtaataataaaacaatagtctttgctcaaccccccccaggaggggacccagagattgtaatgcacagttttaattgtggaggggaattcgtacttgggagtcggccat

SEQ ID NO: 410686 - DNA, 140 bp, Artificial Sequence
  Synthetic
atggccgactcccaagtacgaattcccctccacaattaaaactgtgcattacaatctctgggtcccctcctggggggggttgagcaaagactattgttttattattaccatattgttcttggagacccagcatggcgtat

SEQ ID NO: 410687 - DNA, 140 bp, Artificial Sequence
  Synthetic
aggccctggctgctgatatgggaggggacccagagattgtaatgcacagttttaattgtggaggggaatttttttactgtaatacaacacaactgtttaatagtacttggagggtgaatggaccttttgggacagcggtg

SEQ ID NO: 410688 - DNA, 140 bp, Artificial Sequence
  Synthetic
caccgctgtcccaaaaggtccattcaccctccaagtactattaaacagttgtgttgtattacagtaaaaaaattcccctccacaattaaaactgtgcattacaatctctgggtcccctcccatatcagcagccagggcct

SEQ ID NO: 410689 - DNA, 140 bp, Artificial Sequence
  Synthetic
  misc_feature (46)..(46): n is a, c, g, or t
  misc_feature (53)..(53): n is a, c, g, or t
atacgccatgctgggtctccggcttgctgaagtgcacaaggcaagnggcgagnggagcggcgactggtgagtactgccaaattttgactagcagaggctagaaggagagagatgggtgcgcgtacttgggagtcggccat

SEQ ID NO: 410690 - DNA, 140 bp, Artificial Sequence
  Synthetic
  misc_feature (88)..(88): n is a, c, g, or t
  misc_feature (95)..(95): n is a, c, g, or t
atggccgactcccaagtacgcgcacccatctctctccttctagcctctgctagtcaaaatttggcagtactcaccagtcgccgctccnctcgccncttgccttgtgcacttcagcaagccggagacccagcatggcgtat

SEQ ID NO: 410691 - DNA, 140 bp, Artificial Sequence
  Synthetic
aggccctggctgctgatatgatagaggagttaagagaacatctattaaagtggggatttaccacaccagacaaaaaacatcagaaagaacccccatttctttggatggggtatgaactccgaccttttgggacagcggtg

SEQ ID NO: 410692 - DNA, 140 bp, Artificial Sequence
  Synthetic
caccgctgtcccaaaaggtcggagttcataccccatccaaagaaatgggggttctttctgatgttttttgtctggtgtggtaaatccccactttaatagatgttctcttaactcctctatcatatcagcagccagggcct

SEQ ID NO: 410693 - DNA, 140 bp, Artificial Sequence
  Synthetic
aggccctggctgctgatatgcgaggactgtggaacttctgggacacagcagtctcaagggattgagactggggtgggaaggcctcaagtatctgtggaatctcctgttatattggggtcggaccttttgggacagcggtg

SEQ ID NO: 410694 - DNA, 140 bp, Artificial Sequence
  Synthetic
caccgctgtcccaaaaggtccgaccccaatataacaggagattccacagatacttgaggccttcccaccccagtctcaatcccttgagactgctgtgtcccagaagttccacagtcctcgcatatcagcagccagggcct

SEQ ID NO: 410695 - DNA, 140 bp, Artificial Sequence
  Synthetic
aggccctggctgctgatatggggtgggaaggcctcaagtatctgtggaatctcctgttatattggggtcgggaactaaagagtagtgctattaatttggttgataccatagcaatagcaggaccttttgggacagcggtg

SEQ ID NO: 410696 - DNA, 140 bp, Artificial Sequence
  Synthetic
caccgctgtcccaaaaggtcctgctattgctatggtatcaaccaaattaatagcactactctttagttcccgaccccaatataacaggagattccacagatacttgaggccttcccaccccatatcagcagccagggcct

SEQ ID NO: 410697 - DNA, 140 bp, Artificial Sequence
  Synthetic
atacgccatgctgggtctcctgaaagtagaaacccaagagcaagttcagaagtacacatcccattaggggaggctaaattagtagtaagaacatactggggtctgcagccaggaaaaaagcgtacttgggagtcggccat

SEQ ID NO: 410698 - DNA, 140 bp, Artificial Sequence
  Synthetic
atggccgactcccaagtacgcttttttcctggctgcagaccccagtatgttcttactactaatttagcctcccctaatgggatgtgtacttctgaacttgctcttgggtttctactttcaggagacccagcatggcgtat

SEQ ID NO: 410699 - DNA, 140 bp, Artificial Sequence
  Synthetic
atacgccatgctgggtctcccacccttgcccagtgttaagaaattagtagaagatagatggaacaagtcccagaagaccaagggccgcagagagagccacataatgaatggacactaacacgtacttgggagtcggccat

SEQ ID NO: 410700 - DNA, 140 bp, Artificial Sequence
  Synthetic
atggccgactcccaagtacgtgttagtgtccattcattatgtggctctctctgcggcccttggtcttctgggacttgttccatctatcttctactaatttcttaacactgggcaagggtgggagacccagcatggcgtat

SEQ ID NO: 410701 - DNA, 140 bp, Artificial Sequence
  Synthetic
aggccctggctgctgatatgattggtggaatctcctgcagtactggagtcaggaactaaagaaaagtgctgttagtttgcttaatgccacagctgtagcagtagctgaggggacagataggaccttttgggacagcggtg

SEQ ID NO: 410702 - DNA, 140 bp, Artificial Sequence
  Synthetic
caccgctgtcccaaaaggtcctatctgtcccctcagctactgctacagctgtggcattaagcaaactaacagcacttttctttagttcctgactccagtactgcaggagattccaccaatcatatcagcagccagggcct

SEQ ID NO: 410703 - DNA, 140 bp, Artificial Sequence
  Synthetic
atacgccatgctgggtctcccaagaataagacagggttttgaaagggctttgctataagatgggtggcaagtggtcaaaacgcggtgtgcctgggtggaatcttataagggagagaatgacgtacttgggagtcggccat

SEQ ID NO: 410704 - DNA, 140 bp, Artificial Sequence
  Synthetic
atggccgactcccaagtacgtcattctctcccttataagattccacccaggcacaccgcgttttgaccacttgccacccatcttatagcaaagccctttcaaaaccctgtcttattcttgggagacccagcatggcgtat

SEQ ID NO: 410705 - DNA, 140 bp, Artificial Sequence
  Synthetic
atacgccatgctgggtctccaagaggcagaggcaggggatggagccagtagatcctaacctagagccctggaatcatccaggaagtcagcctacaactgcttgtaccaagtgtttctgtacgtacttgggagtcggccat

SEQ ID NO: 410706 - DNA, 140 bp, Artificial Sequence
  Synthetic
atggccgactcccaagtacgtacagaaacacttggtacaagcagttgtaggctgacttcctggatgattccagggctctaggttaggatctactggctccatcccctgcctctgcctcttggagacccagcatggcgtat

SEQ ID NO: 410707 - DNA, 140 bp, Artificial Sequence
  Synthetic
aggccctggctgctgatatgcagtagggatcgtcaaaatcctataccaaagcagtaagtaataagcatatgtaatgtcatccatgtcttccttgcaagtctgggcaataacagcattgatgaccttttgggacagcggtg

SEQ ID NO: 410708 - DNA, 140 bp, Artificial Sequence
  Synthetic
caccgctgtcccaaaaggtcatcaatgctgttattgcccagacttgcaaggaagacatggatgacattacatatgcttattacttactgctttggtataggattttgacgatccctactgcatatcagcagccagggcct

SEQ ID NO: 410709 - DNA, 140 bp, Artificial Sequence
  Synthetic
atacgccatgctgggtctccataggaaattgctaaggcaaagaaaaatagacagattgtgcaagagaataatagaaagagcagaagacagtggcaatgacagtgatggggacacagaggacgtacttgggagtcggccat

SEQ ID NO: 410710 - DNA, 140 bp, Artificial Sequence
  Synthetic
atggccgactcccaagtacgtcctctgtgtccccatcactgtcattgccactgtcttctgctctttctattattctcttgcacaatctgtctatttttctttgccttagcaatttcctatggagacccagcatggcgtat

SEQ ID NO: 410711 - DNA, 140 bp, Artificial Sequence
  Synthetic
atacgccatgctgggtctccgtttatgggaggaaggcctaaaaccatgtgtaaagctaacccctctctgtgttgctttaaactgtggtgatgcaaccattaaaagtactaatagtacccccgtacttgggagtcggccat

SEQ ID NO: 410712 - DNA, 140 bp, Artificial Sequence
  Synthetic
atggccgactcccaagtacgggggtactattagtacttttaatggttgcatcaccacagtttaaagcaacacagagaggggttagctttacacatggttttaggccttcctcccataaacggagacccagcatggcgtat

SEQ ID NO: 410713 - DNA, 140 bp, Artificial Sequence
  Synthetic
atacgccatgctgggtctcccagaaataagagataagaagaagaaagcttatgcgcttttctatagacttgatatagtgccaattaatgataataatagtactaatagtaggagaagtagcgtacttgggagtcggccat

SEQ ID NO: 410714 - DNA, 140 bp, Artificial Sequence
  Synthetic
atggccgactcccaagtacgctacttctcctactattagtactattattatcattaattggcactatatcaagtctatagaaaagcgcataagctttcttcttcttatctcttatttctgggagacccagcatggcgtat

SEQ ID NO: 410715 - DNA, 140 bp, Artificial Sequence
  Synthetic
atacgccatgctgggtctccaagcttgcccaaagataaagtttgaaccaattcccatacattattgtgctccagctggttttgcgattctacagtgtaatgaaaagagattcaatggatccgtacttgggagtcggccat

SEQ ID NO: 410716 - DNA, 140 bp, Artificial Sequence
  Synthetic
atggccgactcccaagtacggatccattgaatctcttttcattacactgtagaatcgcaaaaccagctggagcacaataatgtatgggaattggttcaaactttatctttgggcaagcttggagacccagcatggcgtat

SEQ ID NO: 410717 - DNA, 140 bp, Artificial Sequence
  Synthetic
aggccctggctgctgatatgaagacaggctaattttttagggaaaatttggccttccagcaaggggaggccaggaaattttcctcagagcagaccggagccatcagccccaccagcagaggaccttttgggacagcggtg

SEQ ID NO: 410718 - DNA, 140 bp, Artificial Sequence
  Synthetic
caccgctgtcccaaaaggtcctctgctggtggggctgatggctccggtctgctctgaggaaaatttcctggcctccccttgctggaaggccaaattttccctaaaaaattagcctgtcttcatatcagcagccagggcct

SEQ ID NO: 410719 - DNA, 140 bp, Artificial Sequence
  Synthetic
aggccctggctgctgatatgcagtagtatcaactcaattgctgttaaatggaagcttatcaacagaaggggtagtacttagatctaaaaacttcacagacaataccaaaaatataatagtgaccttttgggacagcggtg

SEQ ID NO: 410720 - DNA, 140 bp, Artificial Sequence
  Synthetic
caccgctgtcccaaaaggtcactattatatttttggtattgtctgtgaagtttttagatctaagtactaccccttctgttgataagcttccatttaacagcaattgagttgatactactgcatatcagcagccagggcct

SEQ ID NO: 410721 - DNA, 140 bp, Artificial Sequence
  Synthetic
aggccctggctgctgatatggtagtacttagatctaaaaacttcacagacaataccaaaaatataatagtacagcttgcagaggctgtaaaaattaattgtaccagacctaacaacaatagaccttttgggacagcggtg

SEQ ID NO: 410722 - DNA, 140 bp, Artificial Sequence
  Synthetic
caccgctgtcccaaaaggtctattgttgttaggtctggtacaattaatttttacagcctctgcaagctgtactattatatttttggtattgtctgtgaagtttttagatctaagtactaccatatcagcagccagggcct

SEQ ID NO: 410723 - DNA, 140 bp, Artificial Sequence
  Synthetic
aggccctggctgctgatatgcctatggggatacttgggcaggagttgaagctataataagaatactgcaacaactactgtttattcatttcagaattgggtgccagcatagcagaatagggaccttttgggacagcggtg

SEQ ID NO: 410724 - DNA, 140 bp, Artificial Sequence
  Synthetic
caccgctgtcccaaaaggtccctattctgctatgctggcacccaattctgaaatgaataaacagtagttgttgcagtattcttattatagcttcaactcctgcccaagtatccccataggcatatcagcagccagggcct

SEQ ID NO: 410725 - DNA, 140 bp, Artificial Sequence
  Synthetic
atacgccatgctgggtctccgaagtaataggagacataagaaaagcacattgtaacattagtgaaaaagattggaatacaactttacaaaagatagttgatgaattaagaaaacacttcccgtacttgggagtcggccat

SEQ ID NO: 410726 - DNA, 140 bp, Artificial Sequence
  Synthetic
atggccgactcccaagtacgggaagtgttttcttaattcatcaactatcttttgtaaagttgtattccaatctttttcactaatgttacaatgtgcttttcttatgtctcctattacttcggagacccagcatggcgtat

SEQ ID NO: 410727 - DNA, 140 bp, Artificial Sequence
  Synthetic
atacgccatgctgggtctccgatggaatagataaggcccaagaagaacatgaaaaatatcacagtaattggagagcaatggctagtgattttaacctgccacctgtggtagcaaaagaaacgtacttgggagtcggccat

SEQ ID NO: 410728 - DNA, 140 bp, Artificial Sequence
  Synthetic
atggccgactcccaagtacgtttcttttgctaccacaggtggcaggttaaaatcactagccattgctctccaattactgtgatatttttcatgttcttcttgggccttatctattccatcggagacccagcatggcgtat

SEQ ID NO: 410729 - DNA, 140 bp, Artificial Sequence
  Synthetic
atacgccatgctgggtctccagacctgtttaataggacatacatggttaataaaaacgaaacaaatagtacaaacacgacagatgaaaaaattatcaggcttccatgcagaataaaacaacgtacttgggagtcggccat

SEQ ID NO: 410730 - DNA, 140 bp, Artificial Sequence
  Synthetic
atggccgactcccaagtacgttgttttattctgcatggaagcctgataattttttcatctgtcgtgtttgtactatttgtttcgtttttattaaccatgtatgtcctattaaacaggtctggagacccagcatggcgtat

SEQ ID NO: 410731 - DNA, 140 bp, Artificial Sequence
  Synthetic
aggccctggctgctgatatgcaaacacgacagatgaaaaaattatcaggcttccatgcagaataaaacaaattgtaaacaggtggcaggaagtgggacaagcaatatacgcccccccattgaccttttgggacagcggtg

SEQ ID NO: 410732 - DNA, 140 bp, Artificial Sequence
  Synthetic
caccgctgtcccaaaaggtcaatgggggggcgtatattgcttgtcccacttcctgccacctgtttacaatttgttttattctgcatggaagcctgataattttttcatctgtcgtgtttgcatatcagcagccagggcct

SEQ ID NO: 410733 - DNA, 140 bp, Artificial Sequence
  Synthetic
aggccctggctgctgatatggaactgtatcctttagcttccctcaaatcactctttggcaacgacccctcgtcacaataaaggtaggggggcaactaaaggaagctctattagatacagggaccttttgggacagcggtg

SEQ ID NO: 410734 - DNA, 140 bp, Artificial Sequence
  Synthetic
caccgctgtcccaaaaggtccctgtatctaatagagcttcctttagttgcccccctacctttattgtgacgaggggtcgttgccaaagagtgatttgagggaagctaaaggatacagttccatatcagcagccagggcct

SEQ ID NO: 410735 - DNA, 140 bp, Artificial Sequence
  Synthetic
atacgccatgctgggtctcctgatatccacaataataccatgaaaggagaagtaaaaaattgctctttcatggcaaccacagaaataaaagataagaaaaaacaagtgtatgcactttttcgtacttgggagtcggccat

SEQ ID NO: 410736 - DNA, 140 bp, Artificial Sequence
  Synthetic
atggccgactcccaagtacgaaaaagtgcatacacttgttttttcttatcttttatttctgtggttgccatgaaagagcaattttttacttctcctttcatggtattattgtggatatcaggagacccagcatggcgtat

SEQ ID NO: 410737 - DNA, 140 bp, Artificial Sequence
  Synthetic
aggccctggctgctgatatgactctgtgtcactttaaactgtacaaatgctaacagcagtgctgataatgacataatgaaagaaataaaaaattgctctttcaatacaaccacagaaatagaccttttgggacagcggtg

SEQ ID NO: 410738 - DNA, 140 bp, Artificial Sequence
  Synthetic
caccgctgtcccaaaaggtctatttctgtggttgtattgaaagagcaattttttatttctttcattatgtcattatcagcactgctgttagcatttgtacagtttaaagtgacacagagtcatatcagcagccagggcct

SEQ ID NO: 410739 - DNA, 140 bp, Artificial Sequence
  Synthetic
atacgccatgctgggtctccgcaccactaacgtgccttggaactctagttggagtaataaatcttatgaaaaaatatgggacaatatgacctggctgcaatgggataaagaaattaacaacgtacttgggagtcggccat

SEQ ID NO: 410740 - DNA, 140 bp, Artificial Sequence
  Synthetic
atggccgactcccaagtacgttgttaatttctttatcccattgcagccaggtcatattgtcccatattttttcataagatttattactccaactagagttccaaggcacgttagtggtgcggagacccagcatggcgtat

SEQ ID NO: 410741 - DNA, 140 bp, Artificial Sequence
  Synthetic
atacgccatgctgggtctccctgaagtaagagaaagactaagaagaactgagccagcagcagagggagtaggagcagcatcccgagacttagctaaacatggagcacttacaagcagcaacgtacttgggagtcggccat

SEQ ID NO: 410742 - DNA, 140 bp, Artificial Sequence
  Synthetic
atggccgactcccaagtacgttgctgcttgtaagtgctccatgtttagctaagtctcgggatgctgctcctactccctctgctgctggctcagttcttcttagtctttctcttacttcagggagacccagcatggcgtat

SEQ ID NO: 410743 - DNA, 140 bp, Artificial Sequence
  Synthetic
atacgccatgctgggtctcctgaatctgtagaaattgtgtgtataaggcccggcaataatacaaggaagagtataagaataggaccaggacaaacatacttttcaacaggagaaataatacgtacttgggagtcggccat

SEQ ID NO: 410744 - DNA, 140 bp, Artificial Sequence
  Synthetic
atggccgactcccaagtacgtattatttctcctgttgaaaagtatgtttgtcctggtcctattcttatactcttccttgtattattgccgggccttatacacacaatttctacagattcaggagacccagcatggcgtat

SEQ ID NO: 410745 - DNA, 140 bp, Artificial Sequence
  Synthetic
aggccctggctgctgatatgtagtaaagagagttaggcagggatactcacctttgtcttcgcagacccttatcccaacaacacagcggggacccgacaggcccgaaggaacagaaggagggaccttttgggacagcggtg

SEQ ID NO: 410746 - DNA, 140 bp, Artificial Sequence
  Synthetic
caccgctgtcccaaaaggtccctccttctgttccttcgggcctgtcgggtccccgctgtgttgttgggataagggtctgcgaagacaaaggtgagtatccctgcctaactctctttactacatatcagcagccagggcct

SEQ ID NO: 410747 - DNA, 140 bp, Artificial Sequence
  Synthetic
atacgccatgctgggtctcctgccaaaacaataatagtgcaccttaataggtctgtagaaattgtgtgtacaagaccccacaataatacaagggaaggtataggaataggaccaggacaacgtacttgggagtcggccat

SEQ ID NO: 410748 - DNA, 140 bp, Artificial Sequence
  Synthetic
atggccgactcccaagtacgttgtcctggtcctattcctataccttcccttgtattattgtggggtcttgtacacacaatttctacagacctattaaggtgcactattattgttttggcaggagacccagcatggcgtat

SEQ ID NO: 410749 - DNA, 140 bp, Artificial Sequence
  Synthetic
atacgccatgctgggtctcctaacattagtggaggaaattggagcactactatagatgaggtaaaaaggaaattaggagaacacttccctaatacatcaatacaattcgaaccatcctcacgtacttgggagtcggccat

SEQ ID NO: 410750 - DNA, 140 bp, Artificial Sequence
  Synthetic
atggccgactcccaagtacgtgaggatggttcgaattgtattgatgtattagggaagtgttctcctaatttcctttttacctcatctatagtagtgctccaatttcctccactaatgttaggagacccagcatggcgtat

SEQ ID NO: 410751 - DNA, 140 bp, Artificial Sequence
  Synthetic
aggccctggctgctgatatgaattaggagaacacttccctaatacatcaatacaattcgaaccatcctcaggaggagacctagaaattacaacacatagttttaattgtagaggagaattgaccttttgggacagcggtg

SEQ ID NO: 410752 - DNA, 140 bp, Artificial Sequence
  Synthetic
caccgctgtcccaaaaggtcaattctcctctacaattaaaactatgtgttgtaatttctaggtctcctcctgaggatggttcgaattgtattgatgtattagggaagtgttctcctaattcatatcagcagccagggcct

SEQ ID NO: 410753 - DNA, 140 bp, Artificial Sequence
  Synthetic
atacgccatgctgggtctccgtagcagtagctgagggaacagataggattatagaagcagtgcagagaatttgtagagctattctcaatatacctagaagaataagacagggccttgaaacgtacttgggagtcggccat

SEQ ID NO: 410754 - DNA, 140 bp, Artificial Sequence
  Synthetic
atggccgactcccaagtacgtttcaaggccctgtcttattcttctaggtatattgagaatagctctacaaattctctgcactgcttctataatcctatctgttccctcagctactgctacggagacccagcatggcgtat

SEQ ID NO: 410755 - DNA, 140 bp, Artificial Sequence
  Synthetic
aggccctggctgctgatatgttgtagagctattctcaatatacctagaagaataagacagggccttgaaagagctttgctttaaaaatgggaaataaatggtcaaaaagttggccagcgggaccttttgggacagcggtg

SEQ ID NO: 410756 - DNA, 140 bp, Artificial Sequence
  Synthetic
caccgctgtcccaaaaggtcccgctggccaactttttgaccatttatttcccatttttaaagcaaagctctttcaaggccctgtcttattcttctaggtatattgagaatagctctacaacatatcagcagccagggcct

SEQ ID NO: 410757 - DNA, 140 bp, Artificial Sequence
  Synthetic
aggccctggctgctgatatgccatcacactcccatgcagaataaaacaaattgtaaacatgtggcagggggtaggacgagcaatgtatgcccctcccattgaaggaaacataacatgtaagaccttttgggacagcggtg

SEQ ID NO: 410758 - DNA, 140 bp, Artificial Sequence
  Synthetic
caccgctgtcccaaaaggtcttacatgttatgtttccttcaatgggaggggcatacattgctcgtcctaccccctgccacatgtttacaatttgttttattctgcatgggagtgtgatggcatatcagcagccagggcct

SEQ ID NO: 410759 - DNA, 140 bp, Artificial Sequence
  Synthetic
aggccctggctgctgatatgtgggatattaatgatctgtaatgctaaagaaaaattgtgggtcacagtctattatggggtacctgtgtggaaagaagcaaccaccactctattttgtgcagaccttttgggacagcggtg

SEQ ID NO: 410760 - DNA, 140 bp, Artificial Sequence
  Synthetic
caccgctgtcccaaaaggtctgcacaaaatagagtggtggttgcttctttccacacaggtaccccataatagactgtgacccacaatttttctttagcattacagatcattaatatcccacatatcagcagccagggcct

SEQ ID NO: 410761 - DNA, 140 bp, Artificial Sequence
  Synthetic
aggccctggctgctgatatggcttgaagaatcacaaaaccagcaggaagaaaatgaaaaagatttactagcattggacagttggaacaatctgtggaattggtttagcataacaaaatgggaccttttgggacagcggtg

SEQ ID NO: 410762 - DNA, 140 bp, Artificial Sequence
  Synthetic
caccgctgtcccaaaaggtcccattttgttatgctaaaccaattccacagattgttccaactgtccaatgctagtaaatctttttcattttcttcctgctggttttgtgattcttcaagccatatcagcagccagggcct

SEQ ID NO: 410763 - DNA, 140 bp, Artificial Sequence
  Synthetic
atacgccatgctgggtctccgaaaagatggataaaggagagataaaaaattgctctttcaatatcaccacaaacataagagataagatgcagaaagaatatgcgcttttttataaacttgcgtacttgggagtcggccat

SEQ ID NO: 410764 - DNA, 140 bp, Artificial Sequence
  Synthetic
atggccgactcccaagtacgcaagtttataaaaaagcgcatattctttctgcatcttatctcttatgtttgtggtgatattgaaagagcaattttttatctctcctttatccatcttttcggagacccagcatggcgtat

SEQ ID NO: 410765 - DNA, 140 bp, Artificial Sequence
  Synthetic
aggccctggctgctgatatgggtgcgtacatcaaagaatagatgtacaagacaccaaggaagctttagataaaatagaggaaatacaaagtaagagcaagcaaaagacacagcaggcagcgaccttttgggacagcggtg

SEQ ID NO: 410766 - DNA, 140 bp, Artificial Sequence
  Synthetic
caccgctgtcccaaaaggtcgctgcctgctgtgtcttttgcttgctcttactttgtatttcctctattttatctaaagcttccttggtgtcttgtacatctattctttgatgtacgcacccatatcagcagccagggcct

SEQ ID NO: 410767 - DNA, 140 bp, Artificial Sequence
  Synthetic
aggccctggctgctgatatgattcacaattttaaaagaaaaggggggattggggggtacactgcaggggaaagaataatagacataatagcaacagacatacaaactagagaattacaaagaccttttgggacagcggtg

SEQ ID NO: 410768 - DNA, 140 bp, Artificial Sequence
  Synthetic
caccgctgtcccaaaaggtctttgtaattctctagtttgtatgtctgttgctattatgtctattattctttcccctgcagtgtaccccccaatccccccttttcttttaaaattgtgaatcatatcagcagccagggcct

SEQ ID NO: 410769 - DNA, 140 bp, Artificial Sequence
  Synthetic
aggccctggctgctgatatgacttctgggacgcagggggtgggaagcaaccaaatatctgtggaatctcctgaaatattggattcaggaactaaagaatagtgctattagcttgcttaatgaccttttgggacagcggtg

SEQ ID NO: 410770 - DNA, 140 bp, Artificial Sequence
  Synthetic
caccgctgtcccaaaaggtcattaagcaagctaatagcactattctttagttcctgaatccaatatttcaggagattccacagatatttggttgcttcccaccccctgcgtcccagaagtcatatcagcagccagggcct

SEQ ID NO: 410771 - DNA, 140 bp, Artificial Sequence
  Synthetic
aggccctggctgctgatatgctataataaggatattgcaacaactactgtttatccatttcagaattgggtgccatcatagcagaataggcattattcgacagagaagagtaagaaatgggaccttttgggacagcggtg

SEQ ID NO: 410772 - DNA, 140 bp, Artificial Sequence
  Synthetic
caccgctgtcccaaaaggtcccatttcttactcttctctgtcgaataatgcctattctgctatgatggcacccaattctgaaatggataaacagtagttgttgcaatatccttattatagcatatcagcagccagggcct

SEQ ID NO: 410773 - DNA, 140 bp, Artificial Sequence
  Synthetic
  misc_feature (49)..(49): n is a, c, g, or t
aggccctggctgctgatatgatacaaaaaccataatagtacagttgaangaatctgtagtaattgattgtgcaagacccaacaacaatacaaggaaaggtatacctataggaccaggcaggaccttttgggacagcggtg

SEQ ID NO: 410774 - DNA, 140 bp, Artificial Sequence
  Synthetic
  misc_feature (92)..(92): n is a, c, g, or t
caccgctgtcccaaaaggtcctgcctggtcctataggtatacctttccttgtattgttgttgggtcttgcacaatcaattactacagattcnttcaactgtactattatggtttttgtatcatatcagcagccagggcct

SEQ ID NO: 410775 - DNA, 140 bp, Artificial Sequence
  Synthetic
aggccctggctgctgatatgctggtgctttgtgacgaagggcttaggcatctcctatggcaggaagaagcggagacagcgacgtagacctcctcaaagtgatcagatacatcaagatcctgaccttttgggacagcggtg

SEQ ID NO: 410776 - DNA, 140 bp, Artificial Sequence
  Synthetic
caccgctgtcccaaaaggtcaggatcttgatgtatctgatcactttgaggaggtctacgtcgctgtctccgcttcttcctgccataggagatgcctaagcccttcgtcacaaagcaccagcatatcagcagccagggcct

SEQ ID NO: 410777 - DNA, 140 bp, Artificial Sequence
  Synthetic
aggccctggctgctgatatgaataaataggttatatgaaagaataagagaaagagcagaagacagtggcaatgagagtgagggggatgcagaggaattggcagcacttggggaagtgggggaccttttgggacagcggtg

SEQ ID NO: 410778 - DNA, 140 bp, Artificial Sequence
  Synthetic
caccgctgtcccaaaaggtcccccacttccccaagtgctgccaattcctctgcatccccctcactctcattgccactgtcttctgctctttctcttattctttcatataacctatttattcatatcagcagccagggcct

SEQ ID NO: 410779 - DNA, 140 bp, Artificial Sequence
  Synthetic
aggccctggctgctgatatggggtcacagtctattatggggtacctgtgtggaaagaagcaaccaccactctattttgtgcatcagatgctaaagcatatgatacagaggtacataatgtgaccttttgggacagcggtg

SEQ ID NO: 410780 - DNA, 140 bp, Artificial Sequence
  Synthetic
caccgctgtcccaaaaggtcacattatgtacctctgtatcatatgctttagcatctgatgcacaaaatagagtggtggttgcttctttccacacaggtaccccataatagactgtgaccccatatcagcagccagggcct

SEQ ID NO: 410781 - DNA, 140 bp, Artificial Sequence
  Synthetic
aggccctggctgctgatatgcagaattgggtgccaacatagcagaataggcattgttcgagggagaagagtcagggatggatccggtagatcctaacctagagccctggaatcatccggggaccttttgggacagcggtg

SEQ ID NO: 410782 - DNA, 140 bp, Artificial Sequence
  Synthetic
caccgctgtcccaaaaggtccccggatgattccagggctctaggttaggatctaccggatccatccctgactcttctccctcgaacaatgcctattctgctatgttggcacccaattctgcatatcagcagccagggcct

SEQ ID NO: 410783 - DNA, 140 bp, Artificial Sequence
  Synthetic
aggccctggctgctgatatgaggaagaagcggagacagcgacgaggacctcctcagagcaataagaatcatcaaaatcctataccaaagcagtaagtataagtaattagtatatgtaatggaccttttgggacagcggtg

SEQ ID NO: 410784 - DNA, 140 bp, Artificial Sequence
  Synthetic
caccgctgtcccaaaaggtccattacatatactaattacttatacttactgctttggtataggattttgatgattcttattgctctgaggaggtcctcgtcgctgtctccgcttcttcctcatatcagcagccagggcct

SEQ ID NO: 410785 - DNA, 140 bp, Artificial Sequence
  Synthetic
atacgccatgctgggtctcctcaaaatcctataccaaagcagtaagtataagtaattagtatatgtaatgcttcctttgcaaatctgggcaatagtaggactgatagtagcgctaatcctcgtacttgggagtcggccat

SEQ ID NO: 410786 - DNA, 140 bp, Artificial Sequence
  Synthetic
atggccgactcccaagtacgaggattagcgctactatcagtcctactattgcccagatttgcaaaggaagcattacatatactaattacttatacttactgctttggtataggattttgaggagacccagcatggcgtat

SEQ ID NO: 410787 - DNA, 140 bp, Artificial Sequence
  Synthetic
aggccctggctgctgatatgccataatagtacaccttaatgaatctgtacagattaattgtacaagacccaacaataatacaagaaaaagtatacatataggaccaggacaagcattttagaccttttgggacagcggtg

SEQ ID NO: 410788 - DNA, 140 bp, Artificial Sequence
  Synthetic
caccgctgtcccaaaaggtctaaaatgcttgtcctggtcctatatgtatactttttcttgtattattgttgggtcttgtacaattaatctgtacagattcattaaggtgtactattatggcatatcagcagccagggcct

SEQ ID NO: 410789 - DNA, 140 bp, Artificial Sequence
  Synthetic
atacgccatgctgggtctccaacaataatacaagaaaaagtatacatataggaccaggacaagcattttatgcaacaggagacataataggagacatcagaaaggcacactgtaatgttacgtacttgggagtcggccat

SEQ ID NO: 410790 - DNA, 140 bp, Artificial Sequence
  Synthetic
atggccgactcccaagtacgtaacattacagtgtgcctttctgatgtctcctattatgtctcctgttgcataaaatgcttgtcctggtcctatatgtatactttttcttgtattattgttggagacccagcatggcgtat

SEQ ID NO: 410791 - DNA, 140 bp, Artificial Sequence
  Synthetic
atacgccatgctgggtctccagcaatgttgccaacagcactggcacgggtggggaagaaataaaaaactgctcttacaatattaccacagaactaagggataaaagaaagaaagtatattcgtacttgggagtcggccat

SEQ ID NO: 410792 - DNA, 140 bp, Artificial Sequence
  Synthetic
atggccgactcccaagtacgaatatactttctttcttttatcccttagttctgtggtaatattgtaagagcagttttttatttcttccccacccgtgccagtgctgttggcaacattgctggagacccagcatggcgtat

SEQ ID NO: 410793 - DNA, 140 bp, Artificial Sequence
  Synthetic
aggccctggctgctgatatgattaactccactctgtgttactttgcattgtagtaattggacggttaatttcaccaagaatagtaatactacttttaacagtagtagtagtgatgaaatggaccttttgggacagcggtg

SEQ ID NO: 410794 - DNA, 140 bp, Artificial Sequence
  Synthetic
caccgctgtcccaaaaggtccatttcatcactactactactgttaaaagtagtattactattcttggtgaaattaaccgtccaattactacaatgcaaagtaacacagagtggagttaatcatatcagcagccagggcct

SEQ ID NO: 410795 - DNA, 140 bp, Artificial Sequence
  Synthetic
aggccctggctgctgatatgttggaatacaactttacaaaagatagttgatgaattaagaaaacacttccctaataaaaacataacatttgctccatcagcaggaggggacgtagaaattgaccttttgggacagcggtg

SEQ ID NO: 410796 - DNA, 140 bp, Artificial Sequence
  Synthetic
caccgctgtcccaaaaggtcaatttctacgtcccctcctgctgatggagcaaatgttatgtttttattagggaagtgttttcttaattcatcaactatcttttgtaaagttgtattccaacatatcagcagccagggcct

SEQ ID NO: 410797 - DNA, 140 bp, Artificial Sequence
  Synthetic
aggccctggctgctgatatgaacaagtatacgtataggaccaggacaatcattccatgcaacaggtgacataataggggatatcagacaagcacattgcaatgtcagtagatcagaatgggaccttttgggacagcggtg

SEQ ID NO: 410798 - DNA, 140 bp, Artificial Sequence
  Synthetic
caccgctgtcccaaaaggtcccattctgatctactgacattgcaatgtgcttgtctgatatcccctattatgtcacctgttgcatggaatgattgtcctggtcctatacgtatacttgttcatatcagcagccagggcct

SEQ ID NO: 410799 - DNA, 140 bp, Artificial Sequence
  Synthetic
aggccctggctgctgatatgtgcttgaagactcgcaaatccagcaggaacagaatgaacaagatttattagcattggacaagtggcaaaatctgtggaattggtttagcataacaaagtggaccttttgggacagcggtg

SEQ ID NO: 410800 - DNA, 140 bp, Artificial Sequence
  Synthetic
caccgctgtcccaaaaggtccactttgttatgctaaaccaattccacagattttgccacttgtccaatgctaataaatcttgttcattctgttcctgctggatttgcgagtcttcaagcacatatcagcagccagggcct

SEQ ID NO: 410801 - DNA, 140 bp, Artificial Sequence
  Synthetic
aggccctggctgctgatatgttgaagaatcgcagaaccagcaggaaaagaatgaacaagacttattggcattggacaaatgggcaagtctgtggaattggtttagcataacaaactggctgaccttttgggacagcggtg

SEQ ID NO: 410802 - DNA, 140 bp, Artificial Sequence
  Synthetic
caccgctgtcccaaaaggtcagccagtttgttatgctaaaccaattccacagacttgcccatttgtccaatgccaataagtcttgttcattcttttcctgctggttctgcgattcttcaacatatcagcagccagggcct

SEQ ID NO: 410803 - DNA, 140 bp, Artificial Sequence
  Synthetic
atacgccatgctgggtctccttgtctccctatctgaaacaacaaatcagaagactgaattacaagcaatttacttagctttgcaggattcaggatcagaagtaaacatagtaacagactccgtacttgggagtcggccat

SEQ ID NO: 410804 - DNA, 140 bp, Artificial Sequence
  Synthetic
atggccgactcccaagtacggagtctgttactatgtttacttctgatcctgaatcctgcaaagctaagtaaattgcttgtaattcagtcttctgatttgttgtttcagatagggagacaaggagacccagcatggcgtat

SEQ ID NO: 410805 - DNA, 140 bp, Artificial Sequence
  Synthetic
aggccctggctgctgatatgtatagaagttttgcaaagagctggtagagctgttctccacatacctagaagaataagacagggctttgaaagggctttactataaaatgggtggcaagtggaccttttgggacagcggtg

SEQ ID NO: 410806 - DNA, 140 bp, Artificial Sequence
  Synthetic
caccgctgtcccaaaaggtccacttgccacccattttatagtaaagccctttcaaagccctgtcttattcttctaggtatgtggagaacagctctaccagctctttgcaaaacttctatacatatcagcagccagggcct

SEQ ID NO: 410807 - DNA, 140 bp, Artificial Sequence
  Synthetic
aggccctggctgctgatatgtctggaaagctcatctgcaccactaatgtgccttggaatactagttggagtaataaatctctgaatgatatctgggataacatgacctggatgcagtggggaccttttgggacagcggtg

SEQ ID NO: 410808 - DNA, 140 bp, Artificial Sequence
  Synthetic
caccgctgtcccaaaaggtccccactgcatccaggtcatgttatcccagatatcattcagagatttattactccaactagtattccaaggcacattagtggtgcagatgagctttccagacatatcagcagccagggcct

SEQ ID NO: 410809 - DNA, 140 bp, Artificial Sequence
  Synthetic
aggccctggctgctgatatgtaatgccacagctatagcagtagctgaggggacagataggattatagaaatattacaaagagcttatagagctattctccacatacctagaagaataagagaccttttgggacagcggtg

SEQ ID NO: 410810 - DNA, 140 bp, Artificial Sequence
  Synthetic
caccgctgtcccaaaaggtctcttattcttctaggtatgtggagaatagctctataagctctttgtaatatttctataatcctatctgtcccctcagctactgctatagctgtggcattacatatcagcagccagggcct

SEQ ID NO: 410811 - DNA, 140 bp, Artificial Sequence
  Synthetic
aggccctggctgctgatatgggcagaccaactaattcatatgcattactttgattgtttttcagaatctgccataaggaaagccatattaggacatagagttagtcctaggtgtgaatatgaccttttgggacagcggtg

SEQ ID NO: 410812 - DNA, 140 bp, Artificial Sequence
  Synthetic
caccgctgtcccaaaaggtcatattcacacctaggactaactctatgtcctaatatggctttccttatggcagattctgaaaaacaatcaaagtaatgcatatgaattagttggtctgcccatatcagcagccagggcct

SEQ ID NO: 410813 - DNA, 140 bp, Artificial Sequence
  Synthetic
atacgccatgctgggtctccgtggcgcccgaacagggaccgagaaagcgaaagtagaaccagaggagctctctcgacgcacgactcggcttgctgagcgcgcacggcaagaggcgaggggcgtacttgggagtcggccat

SEQ ID NO: 410814 - DNA, 140 bp, Artificial Sequence
  Synthetic
atggccgactcccaagtacgcccctcgcctcttgccgtgcgcgctcagcaagccgagtcgtgcgtcgagagagctcctctggttctactttcgctttctcggtccctgttcgggcgccacggagacccagcatggcgtat

SEQ ID NO: 410815 - DNA, 140 bp, Artificial Sequence
  Synthetic
atacgccatgctgggtctcccgacgaggatctcttcaaggcagcaagggccatcaaaatcttataccaaagcagtaagtattaagtatatgtaatgttattctgggaaatctgggcaatacgtacttgggagtcggccat

SEQ ID NO: 410816 - DNA, 140 bp, Artificial Sequence
  Synthetic
atggccgactcccaagtacgtattgcccagatttcccagaataacattacatatacttaatacttactgctttggtataagattttgatggcccttgctgccttgaagagatcctcgtcgggagacccagcatggcgtat

SEQ ID NO: 410817 - DNA, 140 bp, Artificial Sequence
  Synthetic
atacgccatgctgggtctccatttatagaatataagaaattgagaaggcaaaggagaatagacagcttgtacaatagaataagagaaagagcagaagacagtggcaatgagagtgatgggcgtacttgggagtcggccat

SEQ ID NO: 410818 - DNA, 140 bp, Artificial Sequence
  Synthetic
atggccgactcccaagtacgcccatcactctcattgccactgtcttctgctctttctcttattctattgtacaagctgtctattctcctttgccttctcaatttcttatattctataaatggagacccagcatggcgtat

SEQ ID NO: 410819 - DNA, 140 bp, Artificial Sequence
  Synthetic
atacgccatgctgggtctccaaacaaagaaaaatagacaggctgattgaaagaataagagagagagcagaagacagtggcaatgagagtgaaggggatacagaggaattgtcaatgcttacgtacttgggagtcggccat

SEQ ID NO: 410820 - DNA, 140 bp, Artificial Sequence
  Synthetic
atggccgactcccaagtacgtaagcattgacaattcctctgtatccccttcactctcattgccactgtcttctgctctctctcttattctttcaatcagcctgtctatttttctttgtttggagacccagcatggcgtat

SEQ ID NO: 410821 - DNA, 140 bp, Artificial Sequence
  Synthetic
atacgccatgctgggtctccaaccacagaaataagggataagaagaagaaagaatatgcgcttttctatagaattgatatagtgccaattaatgctagagtgccaattaatggtagtaatcgtacttgggagtcggccat

SEQ ID NO: 410822 - DNA, 140 bp, Artificial Sequence
  Synthetic
atggccgactcccaagtacgattactaccattaattggcactctagcattaattggcactatatcaattctatagaaaagcgcatattctttcttcttcttatcccttatttctgtggttggagacccagcatggcgtat

SEQ ID NO: 410823 - DNA, 140 bp, Artificial Sequence
  Synthetic
atacgccatgctgggtctccaggaataatagtacagaagagtatatgttaataaattgtaacgcctcaaccattaaacaggcttgcccaaaggtgtcttttgagccaattcccatacattcgtacttgggagtcggccat

SEQ ID NO: 410824 - DNA, 140 bp, Artificial Sequence
  Synthetic
atggccgactcccaagtacgaatgtatgggaattggctcaaaagacacctttgggcaagcctgtttaatggttgaggcgttacaatttattaacatatactcttctgtactattattcctggagacccagcatggcgtat

SEQ ID NO: 410825 - DNA, 140 bp, Artificial Sequence
  Synthetic
atacgccatgctgggtctccactggattagggccatgcacaaatgtcagctcggtacgatgcactcatggaattaagccagtggtatcaactcaattgctgttaaatggaagcttagcaacgtacttgggagtcggccat

SEQ ID NO: 410826 - DNA, 140 bp, Artificial Sequence
  Synthetic
atggccgactcccaagtacgttgctaagcttccatttaacagcaattgagttgataccactggcttaattccatgagtgcatcgtaccgagctgacatttgtgcatggccctaatccagtggagacccagcatggcgtat

SEQ ID NO: 410827 - DNA, 140 bp, Artificial Sequence
  Synthetic
aggccctggctgctgatatgcaacaatacaagaaaaagtgtacatatagggccaggactaacatggtatgcaacaggtgaaataataggagatataagacaagcacattgtaacattagtgaccttttgggacagcggtg

SEQ ID NO: 410828 - DNA, 140 bp, Artificial Sequence
  Synthetic
caccgctgtcccaaaaggtcactaatgttacaatgtgcttgtcttatatctcctattatttcacctgttgcataccatgttagtcctggccctatatgtacactttttcttgtattgttgcatatcagcagccagggcct

SEQ ID NO: 410829 - DNA, 140 bp, Artificial Sequence
  Synthetic
aggccctggctgctgatatgactcctccaagcagtgaggatcatcaaaatcttatatcaaagcagtaagtatatgtaatgtttagtttaacagaaagagtagattatagattaggagtaggaccttttgggacagcggtg

SEQ ID NO: 410830 - DNA, 140 bp, Artificial Sequence
  Synthetic
caccgctgtcccaaaaggtcctactcctaatctataatctactctttctgttaaactaaacattacatatacttactgctttgatataagattttgatgatcctcactgcttggaggagtcatatcagcagccagggcct

SEQ ID NO: 410831 - DNA, 140 bp, Artificial Sequence
  Synthetic
aggccctggctgctgatatgtagaaattacaacacatagctttaattgtaaaggagaatttttctattgcaatacaacaccactgtttaatagtacacacatgcaaaatggtacaaacatgaccttttgggacagcggtg

SEQ ID NO: 410832 - DNA, 140 bp, Artificial Sequence
  Synthetic
caccgctgtcccaaaaggtcatgtttgtaccattttgcatgtgtgtactattaaacagtggtgttgtattgcaatagaaaaattctcctttacaattaaagctatgtgttgtaatttctacatatcagcagccagggcct

SEQ ID NO: 410833 - DNA, 140 bp, Artificial Sequence
  Synthetic
aggccctggctgctgatatggtacatggagtgtattatgacccatcaaaagacttaatagcagaaatacagaaacaagggcaaggccaatggacatatcaaatttatcaagagccatttagaccttttgggacagcggtg

SEQ ID NO: 410834 - DNA, 140 bp, Artificial Sequence
  Synthetic
caccgctgtcccaaaaggtctaaatggctcttgataaatttgatatgtccattggccttgcccttgtttctgtatttctgctattaagtcttttgatgggtcataatacactccatgtaccatatcagcagccagggcct

SEQ ID NO: 410835 - DNA, 140 bp, Artificial Sequence
  Synthetic
aggccctggctgctgatatgactctgtgtcactctaaattgtgcaaattttaatgctagtagtaccagtactggtactgctacctacaataatagcatgaatggacaaataaaaaattgcgaccttttgggacagcggtg

SEQ ID NO: 410836 - DNA, 140 bp, Artificial Sequence
  Synthetic
caccgctgtcccaaaaggtcgcaattttttatttgtccattcatgctattattgtaggtagcagtaccagtactggtactactagcattaaaatttgcacaatttagagtgacacagagtcatatcagcagccagggcct

SEQ ID NO: 410837 - DNA, 140 bp, Artificial Sequence
  Synthetic
atacgccatgctgggtctccacttttttatagacttgatatagtaccacttaaggagaatagtagtgagtatagactaataaattgtaatacctcagccataacacaagcctgtccaaagcgtacttgggagtcggccat

SEQ ID NO: 410838 - DNA, 140 bp, Artificial Sequence
  Synthetic
atggccgactcccaagtacgctttggacaggcttgtgttatggctgaggtattacaatttattagtctatactcactactattctccttaagtggtactatatcaagtctataaaaaagtggagacccagcatggcgtat

SEQ ID NO: 410839 - DNA, 140 bp, Artificial Sequence
  Synthetic
atacgccatgctgggtctccataaggataggaccaggacaaacattctttgcaacaggtgacataacaggagacataagacaagcatattgtaacattaataacacaaagtggaaccaaacgtacttgggagtcggccat

SEQ ID NO: 410840 - DNA, 140 bp, Artificial Sequence
  Synthetic
atggccgactcccaagtacgtttggttccactttgtgttattaatgttacaatatgcttgtcttatgtctcctgttatgtcacctgttgcaaagaatgtttgtcctggtcctatccttatggagacccagcatggcgtat

SEQ ID NO: 410841 - DNA, 140 bp, Artificial Sequence
  Synthetic
aggccctggctgctgatatgtatctgggacgacctgcggaacctgtgcctcttcagctaccgccacttgagaaacttactcttaattgtagcgaggactgtggaacttctggggataagggaccttttgggacagcggtg

SEQ ID NO: 410842 - DNA, 140 bp, Artificial Sequence
  Synthetic
caccgctgtcccaaaaggtcccttatccccagaagttccacagtcctcgctacaattaagagtaagtttctcaagtggcggtagctgaagaggcacaggttccgcaggtcgtcccagatacatatcagcagccagggcct

SEQ ID NO: 410843 - DNA, 140 bp, Artificial Sequence
  Synthetic
aggccctggctgctgatatggaaacttactcttaattgtagcgaggactgtggaacttctggggataagggggtgggaagccctcaagtatctgtggaacttcctgctgtattggggacagaccttttgggacagcggtg

SEQ ID NO: 410844 - DNA, 140 bp, Artificial Sequence
  Synthetic
caccgctgtcccaaaaggtctgtccccaatacagcaggaagttccacagatacttgagggcttcccacccccttatccccagaagttccacagtcctcgctacaattaagagtaagtttccatatcagcagccagggcct

SEQ ID NO: 410845 - DNA, 140 bp, Artificial Sequence
  Synthetic
atacgccatgctgggtctcctagctgagggaacagataggattatagaagcagtacagagagcttgtagagctatttgcaacatacctagaagaatcagacagggccttgaaagagctttcgtacttgggagtcggccat

SEQ ID NO: 410846 - DNA, 140 bp, Artificial Sequence
  Synthetic
atggccgactcccaagtacgaaagctctttcaaggccctgtctgattcttctaggtatgttgcaaatagctctacaagctctctgtactgcttctataatcctatctgttccctcagctaggagacccagcatggcgtat

SEQ ID NO: 410847 - DNA, 140 bp, Artificial Sequence
  Synthetic
aggccctggctgctgatatggctatttgcaacatacctagaagaatcagacagggccttgaaagagctttgctttaaaatgggaggcaaatggtcaaaaagtagcatagttggatggcctgaccttttgggacagcggtg

SEQ ID NO: 410848 - DNA, 140 bp, Artificial Sequence
  Synthetic
caccgctgtcccaaaaggtcaggccatccaactatgctactttttgaccatttgcctcccattttaaagcaaagctctttcaaggccctgtctgattcttctaggtatgttgcaaatagccatatcagcagccagggcct

SEQ ID NO: 410849 - DNA, 140 bp, Artificial Sequence
  Synthetic
aggccctggctgctgatatgcctgacaaaacctggctggaagcacaagaagaggaagaagaggtaggttttccagtcaggccacaggtacctttaaggccaatgacctttaaaggagcttgaccttttgggacagcggtg

SEQ ID NO: 410850 - DNA, 140 bp, Artificial Sequence
  Synthetic
caccgctgtcccaaaaggtcaagctcctttaaaggtcattggccttaaaggtacctgtggcctgactggaaaacctacctcttcttcctcttcttgtgcttccagccaggttttgtcaggcatatcagcagccagggcct

SEQ ID NO: 410851 - DNA, 140 bp, Artificial Sequence
  Synthetic
aggccctggctgctgatatgctatggaaaacagatggcaggtgatgattgtgtggcaggtagacaggatgaggattagaacatggaaaagtttagtaaagtaccatatgcatgtttcaaagaccttttgggacagcggtg

SEQ ID NO: 410852 - DNA, 140 bp, Artificial Sequence
  Synthetic
caccgctgtcccaaaaggtctttgaaacatgcatatggtactttactaaacttttccatgttctaatcctcatcctgtctacctgccacacaatcatcacctgccatctgttttccatagcatatcagcagccagggcct

SEQ ID NO: 410853 - DNA, 140 bp, Artificial Sequence
  Synthetic
aggccctggctgctgatatgctgcggagcctgtgcctcttcagctaccaccgattgagagacttcatattgattgcagcgagagcggtggaacttctgggacgcagcagtctcaggggacgaccttttgggacagcggtg

SEQ ID NO: 410854 - DNA, 140 bp, Artificial Sequence
  Synthetic
caccgctgtcccaaaaggtcgtcccctgagactgctgcgtcccagaagttccaccgctctcgctgcaatcaatatgaagtctctcaatcggtggtagctgaagaggcacaggctccgcagcatatcagcagccagggcct

SEQ ID NO: 410855 - DNA, 140 bp, Artificial Sequence
  Synthetic
aggccctggctgctgatatgagaagagcaagcaaaagacacagcaggcagcagctgacacaggaggtagcagcaaggtcagccaaaattaccctatagtgcaaaatgcacaagggcaaatgaccttttgggacagcggtg

SEQ ID NO: 410856 - DNA, 140 bp, Artificial Sequence
  Synthetic
caccgctgtcccaaaaggtcatttgcccttgtgcattttgcactatagggtaattttggctgaccttgctgctacctcctgtgtcagctgctgcctgctgtgtcttttgcttgctcttctcatatcagcagccagggcct

SEQ ID NO: 410857 - DNA, 140 bp, Artificial Sequence
  Synthetic
atacgccatgctgggtctcctaatagaataagagaaagagcagaagacagtggcaatgagagtgagggggatgcagaggaattggcagcacttggggacatggggcctcttattcttgggcgtacttgggagtcggccat

SEQ ID NO: 410858 - DNA, 140 bp, Artificial Sequence
  Synthetic
atggccgactcccaagtacgcccaagaataagaggccccatgtccccaagtgctgccaattcctctgcatccccctcactctcattgccactgtcttctgctctttctcttattctattaggagacccagcatggcgtat

SEQ ID NO: 410859 - DNA, 140 bp, Artificial Sequence
  Synthetic
  misc_feature (21)..(21): n is a, c, g, or t
  misc_feature (99)..(99): n is a, c, g, or t
atacgccatgctgggtctccncagcaccctgaaggaagatccaggggaaatacaaaactgtactttcaatatgaccacagaaagaacagataagcagcngaaagtacactcacttttttacgtacttgggagtcggccat

SEQ ID NO: 410860 - DNA, 140 bp, Artificial Sequence
  Synthetic
  misc_feature (42)..(42): n is a, c, g, or t
  misc_feature (120)..(120): n is a, c, g, or t
atggccgactcccaagtacgtaaaaaagtgagtgtactttcngctgcttatctgttctttctgtggtcatattgaaagtacagttttgtatttcccctggatcttccttcagggtgctgnggagacccagcatggcgtat

SEQ ID NO: 410861 - DNA, 140 bp, Artificial Sequence
  Synthetic
atacgccatgctgggtctcccacccgcagagagcttagagatgaaagaggagacaacctcctctccgaagcaggaaccgagggacaaggaactatatcctttaacttccctcaaatcactcgtacttgggagtcggccat

SEQ ID NO: 410862 - DNA, 140 bp, Artificial Sequence
  Synthetic
atggccgactcccaagtacgagtgatttgagggaagttaaaggatatagttccttgtccctcggttcctgcttcggagaggaggttgtctcctctttcatctctaagctctctgcgggtgggagacccagcatggcgtat

SEQ ID NO: 410863 - DNA, 140 bp, Artificial Sequence
  Synthetic
aggccctggctgctgatatgatacccatgtttacagcattatcagaaggagccaccccacaagatttaaacaccatgttaaatacagtggggggacatcaagcagccatgcaaatgttaagaccttttgggacagcggtg

SEQ ID NO: 410864 - DNA, 140 bp, Artificial Sequence
  Synthetic
caccgctgtcccaaaaggtcttaacatttgcatggctgcttgatgtccccccactgtatttaacatggtgtttaaatcttgtggggtggctccttctgataatgctgtaaacatgggtatcatatcagcagccagggcct

SEQ ID NO: 410865 - DNA, 140 bp, Artificial Sequence
  Synthetic
  misc_feature (59)..(59): n is a, c, g, or t
aggccctggctgctgatatgagacagcgacgaagagctcctcaggacaataagcatcancatgctcctctatcaaatcagtaagtaatacatgtgatgcctcctttaacaatattagcaagaccttttgggacagcggtg

SEQ ID NO: 410866 - DNA, 140 bp, Artificial Sequence
  Synthetic
  misc_feature (82)..(82): n is a, c, g, or t
caccgctgtcccaaaaggtcttgctaatattgttaaaggaggcatcacatgtattacttactgatttgatagaggagcatgntgatgcttattgtcctgaggagctcttcgtcgctgtctcatatcagcagccagggcct

SEQ ID NO: 410867 - DNA, 140 bp, Artificial Sequence
  Synthetic
  misc_feature (46)..(46): n is a, c, g, or t
atacgccatgctgggtctccgtattcatagaatataggaaaataanaagacaacgactaatagactggttagttgatagaataagagaaagagaagacaacagtggcaatgagagtgaagcgtacttgggagtcggccat

SEQ ID NO: 410868 - DNA, 140 bp, Artificial Sequence
  Synthetic
  misc_feature (95)..(95): n is a, c, g, or t
atggccgactcccaagtacgcttcactctcattgccactgttgtcttctctttctcttattctatcaactaaccagtctattagtcgttgtcttnttattttcctatattctatgaatacggagacccagcatggcgtat

SEQ ID NO: 410869 - DNA, 140 bp, Artificial Sequence
  Synthetic
aggccctggctgctgatatgggccttcccacaaggggaggccagggaatttcctccagaacaggccagagccatcagccccaccagcagagagcctcaggccagagccatcagccccaccgaccttttgggacagcggtg

SEQ ID NO: 410870 - DNA, 140 bp, Artificial Sequence
  Synthetic
caccgctgtcccaaaaggtcggtggggctgatggctctggcctgaggctctctgctggtggggctgatggctctggcctgttctggaggaaattccctggcctccccttgtgggaaggcccatatcagcagccagggcct

SEQ ID NO: 410871 - DNA, 140 bp, Artificial Sequence
  Synthetic
atacgccatgctgggtctccccaatagtaattgtaggtatttgaatgagactaataacaatggtagtagtgggggagtgatggagaaagaagaaatgaaaaactgctctttcaatgttaccgtacttgggagtcggccat

SEQ ID NO: 410872 - DNA, 140 bp, Artificial Sequence
  Synthetic
atggccgactcccaagtacggtaacattgaaagagcagtttttcatttcttctttctccatcactcccccactactaccattgttattagtctcattcaaatacctacaattactattggggagacccagcatggcgtat

SEQ ID NO: 410873 - DNA, 140 bp, Artificial Sequence
  Synthetic
aggccctggctgctgatatgagtcgcagatccagcaggaaaagaatgaacaagaattattggcattggacaaatgggcaagtctgtggagttggtttgacataacaagatggctgtggtagaccttttgggacagcggtg

SEQ ID NO: 410874 - DNA, 140 bp, Artificial Sequence
  Synthetic
caccgctgtcccaaaaggtctaccacagccatcttgttatgtcaaaccaactccacagacttgcccatttgtccaatgccaataattcttgttcattcttttcctgctggatctgcgactcatatcagcagccagggcct

SEQ ID NO: 410875 - DNA, 140 bp, Artificial Sequence
  Synthetic
aggccctggctgctgatatgagaattagaattggcagagaacagggagattctaaaagaacctgtacatggggtatattatgacccatcaaaagacttaatagcagaaatacagaaacaagaccttttgggacagcggtg

SEQ ID NO: 410876 - DNA, 140 bp, Artificial Sequence
  Synthetic
caccgctgtcccaaaaggtcttgtttctgtatttctgctattaagtcttttgatgggtcataatataccccatgtacaggttcttttagaatctccctgttctctgccaattctaattctcatatcagcagccagggcct

SEQ ID NO: 410877 - DNA, 140 bp, Artificial Sequence
  Synthetic
aggccctggctgctgatatgttaagagaacaatttgggaataaaacaatagcctttaataaatcctcaggaggggacccagagattgtaatgcacagttttaattgtggaggggaattttgaccttttgggacagcggtg

SEQ ID NO: 410878 - DNA, 140 bp, Artificial Sequence
  Synthetic
caccgctgtcccaaaaggtcaaaattcccctccacaattaaaactgtgcattacaatctctgggtcccctcctgaggatttattaaaggctattgttttattcccaaattgttctcttaacatatcagcagccagggcct

SEQ ID NO: 410879 - DNA, 140 bp, Artificial Sequence
  Synthetic
aggccctggctgctgatatggaaacagcctacttcatactaaaattagcaggaagatggccagtaaaaataatacatacagacaatggccccaatttcaccagtgctgcggttaaggcaggaccttttgggacagcggtg

SEQ ID NO: 410880 - DNA, 140 bp, Artificial Sequence
  Synthetic
caccgctgtcccaaaaggtcctgccttaaccgcagcactggtgaaattggggccattgtctgtatgtattatttttactggccatcttcctgctaattttagtatgaagtaggctgtttccatatcagcagccagggcct

SEQ ID NO: 410881 - DNA, 140 bp, Artificial Sequence
  Synthetic
aggccctggctgctgatatggagaaggtggagaaggagacagagatggatccggtcgcttagtggatggattcttaacactcatctgggtcgacctgcggagcctgtgcctcttcagctagaccttttgggacagcggtg

SEQ ID NO: 410882 - DNA, 140 bp, Artificial Sequence
  Synthetic
caccgctgtcccaaaaggtctagctgaagaggcacaggctccgcaggtcgacccagatgagtgttaagaatccatccactaagcgaccggatccatctctgtctccttctccaccttctccatatcagcagccagggcct

SEQ ID NO: 410883 - DNA, 140 bp, Artificial Sequence
  Synthetic
aggccctggctgctgatatgcttgacgcaggactcggcttgctgaagcgcgcacggcaagaggcgaggggcggcgaacggtgagtacgccaaaattttgactagcggaggctagaaggaggaccttttgggacagcggtg

SEQ ID NO: 410884 - DNA, 140 bp, Artificial Sequence
  Synthetic
caccgctgtcccaaaaggtcctccttctagcctccgctagtcaaaattttggcgtactcaccgttcgccgcccctcgcctcttgccgtgcgcgcttcagcaagccgagtcctgcgtcaagcatatcagcagccagggcct

SEQ ID NO: 410885 - DNA, 140 bp, Artificial Sequence
  Synthetic
atacgccatgctgggtctcctcctcggcttcagtagggatcgtcaaaatcctataccaaagcagtaagtattaagtatatgtaatgtcatccttgtcatccttggaaatctggacaatagcgtacttgggagtcggccat

SEQ ID NO: 410886 - DNA, 140 bp, Artificial Sequence
  Synthetic
atggccgactcccaagtacgctattgtccagatttccaaggatgacaaggatgacattacatatacttaatacttactgctttggtataggattttgacgatccctactgaagccgaggaggagacccagcatggcgtat

SEQ ID NO: 410887 - DNA, 140 bp, Artificial Sequence
  Synthetic
atacgccatgctgggtctcctaagtattagtaataagtatatgtaatgtctcctttggaaatcagtgcaatagtagggctgatagtagcgctaatcctagcaatagctgtgtggactatacgtacttgggagtcggccat

SEQ ID NO: 410888 - DNA, 140 bp, Artificial Sequence
  Synthetic
atggccgactcccaagtacgtatagtccacacagctattgctaggattagcgctactatcagccctactattgcactgatttccaaaggagacattacatatacttattactaatacttaggagacccagcatggcgtat

SEQ ID NO: 410889 - DNA, 140 bp, Artificial Sequence
  Synthetic
atacgccatgctgggtctccttcgggttcggggaggagataaccccctctccgaagcaggagcagaaaaacgagggactgtaccctcccttagcttccctcaaatcactctttggcaacgcgtacttgggagtcggccat

SEQ ID NO: 410890 - DNA, 140 bp, Artificial Sequence
  Synthetic
atggccgactcccaagtacgcgttgccaaagagtgatttgagggaagctaagggagggtacagtccctcgtttttctgctcctgcttcggagagggggttatctcctccccgaacccgaaggagacccagcatggcgtat

SEQ ID NO: 410891 - DNA, 140 bp, Artificial Sequence
  Synthetic
atacgccatgctgggtctccatacagaggaattatccacacttgtgggaatgggggactttgatccttgggttggtaataatgtgtagtgcctcaaaagacatgtgggtcacagtttattcgtacttgggagtcggccat

SEQ ID NO: 410892 - DNA, 140 bp, Artificial Sequence
  Synthetic
atggccgactcccaagtacgaataaactgtgacccacatgtcttttgaggcactacacattattaccaacccaaggatcaaagtcccccattcccacaagtgtggataattcctctgtatggagacccagcatggcgtat

SEQ ID NO: 410893 - DNA, 140 bp, Artificial Sequence
  Synthetic
aggccctggctgctgatatggaaaggagaattaaaaaactgctctttcaataccaccacaagcataagagataagatgcaggaacaatatgcacttttttataaacttgatgtattaccagaccttttgggacagcggtg

SEQ ID NO: 410894 - DNA, 140 bp, Artificial Sequence
  Synthetic
caccgctgtcccaaaaggtctggtaatacatcaagtttataaaaaagtgcatattgttcctgcatcttatctcttatgcttgtggtggtattgaaagagcagttttttaattctcctttccatatcagcagccagggcct

SEQ ID NO: 410895 - DNA, 140 bp, Artificial Sequence
  Synthetic
atacgccatgctgggtctccaacccctctctgcgttactttacattgtacaaatgtcacaagtgtcaacaccactggagacagggaaggcttaaaaaactgctctttcaatatgaccacacgtacttgggagtcggccat

SEQ ID NO: 410896 - DNA, 140 bp, Artificial Sequence
  Synthetic
atggccgactcccaagtacgtgtggtcatattgaaagagcagttttttaagccttccctgtctccagtggtgttgacacttgtgacatttgtacaatgtaaagtaacgcagagaggggttggagacccagcatggcgtat

SEQ ID NO: 410897 - DNA, 140 bp, Artificial Sequence
  Synthetic
atacgccatgctgggtctcctaagcagaagaaagaacatgcacttttctatagacttgatgtagtgccaattaataataatgtgccaattaataatactagtaatacaagtgagtataggcgtacttgggagtcggccat

SEQ ID NO: 410898 - DNA, 140 bp, Artificial Sequence
  Synthetic
atggccgactcccaagtacgcctatactcacttgtattactagtattattaattggcacattattattaattggcactacatcaagtctatagaaaagtgcatgttctttcttctgcttaggagacccagcatggcgtat

SEQ ID NO: 410899 - DNA, 140 bp, Artificial Sequence
  Synthetic
atacgccatgctgggtctccgagtataggttaatgagttgtaatacctccaaccataaacaggcttgcccaaaggtgactttggagcccaattcccatacattattgtgccccggctggtcgtacttgggagtcggccat

SEQ ID NO: 410900 - DNA, 140 bp, Artificial Sequence
  Synthetic
atggccgactcccaagtacgaccagccggggcacaataatgtatgggaattgggctccaaagtcacctttgggcaagcctgtttatggttggaggtattacaactcattaacctatactcggagacccagcatggcgtat

SEQ ID NO: 410901 - DNA, 140 bp, Artificial Sequence
  Synthetic
aggccctggctgctgatatgcaacaatacaagaaacaggatatcaataggaccagggagagcatttcatacaacaaaacaaataataggagatataagacaagcacattgtaaccttagtgaccttttgggacagcggtg

SEQ ID NO: 410902 - DNA, 140 bp, Artificial Sequence
  Synthetic
caccgctgtcccaaaaggtcactaaggttacaatgtgcttgtcttatatctcctattatttgttttgttgtatgaaatgctctccctggtcctattgatatcctgtttcttgtattgttgcatatcagcagccagggcct

SEQ ID NO: 410903 - DNA, 140 bp, Artificial Sequence
  Synthetic
aggccctggctgctgatatggtatcagacctaacaacaatacaagaaaaagtatacgtataggaccaggacaagcattctatgcaacaggtgacataataggggatataagacaagcacagaccttttgggacagcggtg

SEQ ID NO: 410904 - DNA, 140 bp, Artificial Sequence
  Synthetic
caccgctgtcccaaaaggtctgtgcttgtcttatatcccctattatgtcacctgttgcatagaatgcttgtcctggtcctatacgtatactttttcttgtattgttgttaggtctgataccatatcagcagccagggcct

SEQ ID NO: 410905 - DNA, 140 bp, Artificial Sequence
  Synthetic
atacgccatgctgggtctcctgaacgtatcggtatagggccaggacacacatggtatgcaacaggtaacatagtaggagatataagacaagcacactgtaacattagtggaagtgattggcgtacttgggagtcggccat

SEQ ID NO: 410906 - DNA, 140 bp, Artificial Sequence
  Synthetic
atggccgactcccaagtacgccaatcacttccactaatgttacagtgtgcttgtcttatatctcctactatgttacctgttgcataccatgtgtgtcctggccctataccgatacgttcaggagacccagcatggcgtat

SEQ ID NO: 410907 - DNA, 140 bp, Artificial Sequence
  Synthetic
aggccctggctgctgatatgtaacatgtggaaaaatgacatggtagatcagatgcatgaggatataatcagtttatgggatcaaagcctaaagccatgtgtaaagttgaccccactctgtgaccttttgggacagcggtg

SEQ ID NO: 410908 - DNA, 140 bp, Artificial Sequence
  Synthetic
caccgctgtcccaaaaggtcacagagtggggtcaactttacacatggctttaggctttgatcccataaactgattatatcctcatgcatctgatctaccatgtcatttttccacatgttacatatcagcagccagggcct

SEQ ID NO: 410909 - DNA, 140 bp, Artificial Sequence
  Synthetic
atacgccatgctgggtctcctaagaatgtggcagggagtaggacaagcaatgtacgcccctcccattgcagggagcattaactgcagctcagatattacaggaataatattgacaagagacgtacttgggagtcggccat

SEQ ID NO: 410910 - DNA, 140 bp, Artificial Sequence
  Synthetic
atggccgactcccaagtacgtctcttgtcaatattattcctgtaatatctgagctgcagttaatgctccctgcaatgggaggggcgtacattgcttgtcctactccctgccacattcttaggagacccagcatggcgtat

SEQ ID NO: 410911 - DNA, 140 bp, Artificial Sequence
  Synthetic
atacgccatgctgggtctccaatgaaaccttcagacctggaggaggagatatgagggacaattggagaagtgaattatataagtataaagtagtagaaattgaaccactaggagtagcaccgtacttgggagtcggccat

SEQ ID NO: 410912 - DNA, 140 bp, Artificial Sequence
  Synthetic
atggccgactcccaagtacggtgctactcctagtggttcaatttctactactttatacttatataattcacttctccaattgtccctcatatctcctcctccaggtctgaaggtttcattggagacccagcatggcgtat

SEQ ID NO: 410913 - DNA, 140 bp, Artificial Sequence
  Synthetic
atacgccatgctgggtctcctggtggtataagtaataataatgagactaatgataatgagaccctcagacctggaggaggagacatgagggacaattggagaagtgtactatataaatatcgtacttgggagtcggccat

SEQ ID NO: 410914 - DNA, 140 bp, Artificial Sequence
  Synthetic
atggccgactcccaagtacgatatttatatagtacacttctccaattgtccctcatgtctcctcctccaggtctgagggtctcattatcattagtctcattattattacttataccaccaggagacccagcatggcgtat

SEQ ID NO: 410915 - DNA, 140 bp, Artificial Sequence
  Synthetic
aggccctggctgctgatatgtactgtgccttggaatgctagttggagtaataaatctctgaatgagatttgggataacatgacctggatgcagtgggaaagagaaattgacaattacacagaccttttgggacagcggtg

SEQ ID NO: 410916 - DNA, 140 bp, Artificial Sequence
  Synthetic
caccgctgtcccaaaaggtctgtgtaattgtcaatttctctttcccactgcatccaggtcatgttatcccaaatctcattcagagatttattactccaactagcattccaaggcacagtacatatcagcagccagggcct

SEQ ID NO: 410917 - DNA, 140 bp, Artificial Sequence
  Synthetic
atacgccatgctgggtctccatgaatctataaacattgtatgtacaagacctggcaataatacaaggaaaaatgtaaggattataagaataggaccaggacgagcattccatgcaaataacgtacttgggagtcggccat

SEQ ID NO: 410918 - DNA, 140 bp, Artificial Sequence
  Synthetic
atggccgactcccaagtacgttatttgcatggaatgctcgtcctggtcctattcttataatccttacatttttccttgtattattgccaggtcttgtacatacaatgtttatagattcatggagacccagcatggcgtat

SEQ ID NO: 410919 - DNA, 140 bp, Artificial Sequence
  Synthetic
atacgccatgctgggtctccatgatatatggggcaatatgacctggctgcaatgggataaagaaattaacaattacacacaaattatatatgagttacttgaagaatcgcaaatccagcacgtacttgggagtcggccat

SEQ ID NO: 410920 - DNA, 140 bp, Artificial Sequence
  Synthetic
atggccgactcccaagtacgtgctggatttgcgattcttcaagtaactcatatataatttgtgtgtaattgttaatttctttatcccattgcagccaggtcatattgccccatatatcatggagacccagcatggcgtat

SEQ ID NO: 410921 - DNA, 140 bp, Artificial Sequence
  Synthetic
aggccctggctgctgatatgtataaaaatatttataataatagtaggaggcttaataggattaagaatagtttttgctgtgctttctgtaataaatagagttaggcagggatactcacctgaccttttgggacagcggtg

SEQ ID NO: 410922 - DNA, 140 bp, Artificial Sequence
  Synthetic
caccgctgtcccaaaaggtcaggtgagtatccctgcctaactctatttattacagaaagcacagcaaaaactattcttaatcctattaagcctcctactattattataaatatttttatacatatcagcagccagggcct

SEQ ID NO: 410923 - DNA, 140 bp, Artificial Sequence
  Synthetic
atacgccatgctgggtctccccatgcagaattaaacaaatcataaacatgtggcagacggtaggacgagcaatgtatgctcctcccattgaaggatacataaattgtacatcaaatatcacgtacttgggagtcggccat

SEQ ID NO: 410924 - DNA, 140 bp, Artificial Sequence
  Synthetic
atggccgactcccaagtacgtgatatttgatgtacaatttatgtatccttcaatgggaggagcatacattgctcgtcctaccgtctgccacatgtttatgatttgtttaattctgcatggggagacccagcatggcgtat

SEQ ID NO: 410925 - DNA, 140 bp, Artificial Sequence
  Synthetic
aggccctggctgctgatatgtgtagagctattcgcaacatacctaggagaataagacagggctttgaaaaagctttgctttaaaatgggaggtaaatggtcaaaaagtagcttagtgggagaccttttgggacagcggtg

SEQ ID NO: 410926 - DNA, 140 bp, Artificial Sequence
  Synthetic
caccgctgtcccaaaaggtctcccactaagctactttttgaccatttacctcccattttaaagcaaagctttttcaaagccctgtcttattctcctaggtatgttgcgaatagctctacacatatcagcagccagggcct

SEQ ID NO: 410927 - DNA, 140 bp, Artificial Sequence
  Synthetic
atacgccatgctgggtctcctcaagctgagccagcagcagcaggagtaggagcagtgtctcgagacttggacaaacatggggcaatcacaagcagcaatacagcagctactaatcctgaccgtacttgggagtcggccat

SEQ ID NO: 410928 - DNA, 140 bp, Artificial Sequence
  Synthetic
atggccgactcccaagtacggtcaggattagtagctgctgtattgctgcttgtgattgccccatgtttgtccaagtctcgagacactgctcctactcctgctgctgctggctcagcttgaggagacccagcatggcgtat

SEQ ID NO: 410929 - DNA, 140 bp, Artificial Sequence
  Synthetic
aggccctggctgctgatatgtgggtgcgagagcgtcagtattaagtgggggaaaattagatgcatgggagaaaattcggttaaggccagggggaaagaaaaaatatagaatgaaacatttgaccttttgggacagcggtg

SEQ ID NO: 410930 - DNA, 140 bp, Artificial Sequence
  Synthetic
caccgctgtcccaaaaggtcaaatgtttcattctatattttttctttccccctggccttaaccgaattttctcccatgcatctaattttcccccacttaatactgacgctctcgcacccacatatcagcagccagggcct

SEQ ID NO: 410931 - DNA, 140 bp, Artificial Sequence
  Synthetic
aggccctggctgctgatatgaaaattcggttaaggccagggggaaagaaaaaatatagaatgaaacatttagtatgggcaagcagggagctggaaagattcgcacttaaccctggcctttgaccttttgggacagcggtg

SEQ ID NO: 410932 - DNA, 140 bp, Artificial Sequence
  Synthetic
caccgctgtcccaaaaggtcaaaggccagggttaagtgcgaatctttccagctccctgcttgcccatactaaatgtttcattctatattttttctttccccctggccttaaccgaattttcatatcagcagccagggcct

SEQ ID NO: 410933 - DNA, 140 bp, Artificial Sequence
  Synthetic
aggccctggctgctgatatgactacagagggggtgggaaatccttaagtatctgggaagtcttgtgcaatattggggtctagagctaaaaaagagtgctattagtctgcttgataccatagaccttttgggacagcggtg

SEQ ID NO: 410934 - DNA, 140 bp, Artificial Sequence
  Synthetic
caccgctgtcccaaaaggtctatggtatcaagcagactaatagcactcttttttagctctagaccccaatattgcacaagacttcccagatacttaaggatttcccaccccctctgtagtcatatcagcagccagggcct

SEQ ID NO: 410935 - DNA, 140 bp, Artificial Sequence
  Synthetic
aggccctggctgctgatatgtgtacatcaaaagatagatgtaaaagacaccaaggaagctttagataaaatagaggaaatacaaaataagagcaagcaaaaaacacagcaggcagcagctgaccttttgggacagcggtg

SEQ ID NO: 410936 - DNA, 140 bp, Artificial Sequence
  Synthetic
caccgctgtcccaaaaggtcagctgctgcctgctgtgttttttgcttgctcttattttgtatttcctctattttatctaaagcttccttggtgtcttttacatctatcttttgatgtacacatatcagcagccagggcct

SEQ ID NO: 410937 - DNA, 140 bp, Artificial Sequence
  Synthetic
aggccctggctgctgatatgtatagtgcaaaatgcacaagggcaaatgacacatcagaacttgtcacctaggactttaaatgcatgggtgaaagtaatagaagaaaaggctttcagcccagaccttttgggacagcggtg

SEQ ID NO: 410938 - DNA, 140 bp, Artificial Sequence
  Synthetic
caccgctgtcccaaaaggtctgggctgaaagccttttcttctattactttcacccatgcatttaaagtcctaggtgacaagttctgatgtgtcatttgcccttgtgcattttgcactatacatatcagcagccagggcct

SEQ ID NO: 410939 - DNA, 140 bp, Artificial Sequence
  Synthetic
aggccctggctgctgatatgcacctatcccagtgggagaaatctataaaagatggataatcctgggattaaataaaatagtaagaatgtatagccctgtcagcattttggacataagacagaccttttgggacagcggtg

SEQ ID NO: 410940 - DNA, 140 bp, Artificial Sequence
  Synthetic
caccgctgtcccaaaaggtctgtcttatgtccaaaatgctgacagggctatacattcttactattttatttaatcccaggattatccatcttttatagatttctcccactgggataggtgcatatcagcagccagggcct

SEQ ID NO: 410941 - DNA, 140 bp, Artificial Sequence
  Synthetic
aggccctggctgctgatatgggaattttcctcagagcagaacagagccaacagccccaccagaagagagcttcaggtttggggaagagacaacaactccctatcagaagcaggagaagaagaccttttgggacagcggtg

SEQ ID NO: 410942 - DNA, 140 bp, Artificial Sequence
  Synthetic
caccgctgtcccaaaaggtcttcttctcctgcttctgatagggagttgttgtctcttccccaaacctgaagctctcttctggtggggctgttggctctgttctgctctgaggaaaattcccatatcagcagccagggcct

SEQ ID NO: 410943 - DNA, 140 bp, Artificial Sequence
  Synthetic
  misc_feature (29)..(29): n is a, c, g, or t
atacgccatgctgggtctccggaagatanaggggcaatacaaaactgtactttcaatatgaccacagaaataagagataaagagcggagagtatactcacttttttataaacttgatatacgtacttgggagtcggccat

SEQ ID NO: 410944 - DNA, 140 bp, Artificial Sequence
  Synthetic
  misc_feature (112)..(112): n is a, c, g, or t
atggccgactcccaagtacgtatatcaagtttataaaaaagtgagtatactctccgctctttatctcttatttctgtggtcatattgaaagtacagttttgtattgcccctntatcttccggagacccagcatggcgtat

SEQ ID NO: 410945 - DNA, 140 bp, Artificial Sequence
  Synthetic
atacgccatgctgggtctccctaataccactaatagtaataataatgataccactaagggagtgagggaggaaggagaactgaaaaactgctctttcaatgttaccacaagcataagaaacgtacttgggagtcggccat

SEQ ID NO: 410946 - DNA, 140 bp, Artificial Sequence
  Synthetic
atggccgactcccaagtacgtttcttatgcttgtggtaacattgaaagagcagtttttcagttctccttcctccctcactcccttagtggtatcattattattactattagtggtattagggagacccagcatggcgtat

SEQ ID NO: 410947 - DNA, 140 bp, Artificial Sequence
  Synthetic
aggccctggctgctgatatgtgcaaaaaatagccacagaaagcatagtaatatggggaaagactcctaaatttagactacccatacaaaaagaaacatgggaaacatggtggacagagtagaccttttgggacagcggtg

SEQ ID NO: 410948 - DNA, 140 bp, Artificial Sequence
  Synthetic
caccgctgtcccaaaaggtctactctgtccaccatgtttcccatgtttctttttgtatgggtagtctaaatttaggagtctttccccatattactatgctttctgtggctattttttgcacatatcagcagccagggcct

SEQ ID NO: 410949 - DNA, 140 bp, Artificial Sequence
  Synthetic
aggccctggctgctgatatgcattaggaacaggggctacattagaagaaatgatgacagcatgtcagggagtgggaggacccagccataaagcaagagttttagctgaggcaatgagccagaccttttgggacagcggtg

SEQ ID NO: 410950 - DNA, 140 bp, Artificial Sequence
  Synthetic
caccgctgtcccaaaaggtctggctcattgcctcagctaaaactcttgctttatggctgggtcctcccactccctgacatgctgtcatcatttcttctaatgtagcccctgttcctaatgcatatcagcagccagggcct

SEQ ID NO: 410951 - DNA, 140 bp, Artificial Sequence
  Synthetic
aggccctggctgctgatatgtaaaacaccatatgtatatttcaaagaaagctaaaggatggttttatagacatcactatgaaagcactcatccaagaataagttcagaagtacacatcccgaccttttgggacagcggtg

SEQ ID NO: 410952 - DNA, 140 bp, Artificial Sequence
  Synthetic
caccgctgtcccaaaaggtcgggatgtgtacttctgaacttattcttggatgagtgctttcatagtgatgtctataaaaccatcctttagctttctttgaaatatacatatggtgttttacatatcagcagccagggcct

SEQ ID NO: 410953 - DNA, 140 bp, Artificial Sequence
  Synthetic
aggccctggctgctgatatgagttcagaagtacacatcccactaggggatgctagattagtagtaagaacatattggggtctgcatacaggagaaaaagattggcatttgggtcatgggggaccttttgggacagcggtg

SEQ ID NO: 410954 - DNA, 140 bp, Artificial Sequence
  Synthetic
caccgctgtcccaaaaggtcccccatgacccaaatgccaatctttttctcctgtatgcagaccccaatatgttcttactactaatctagcatcccctagtgggatgtgtacttctgaactcatatcagcagccagggcct

SEQ ID NO: 410955 - DNA, 140 bp, Artificial Sequence
  Synthetic
aggccctggctgctgatatgaacaggaatttggaattccctacaatccccaaagtcagggagtagtagaatccatgaataaagaattaaagaaaatcataggacaggtaagagatcaagcgaccttttgggacagcggtg

SEQ ID NO: 410956 - DNA, 140 bp, Artificial Sequence
  Synthetic
caccgctgtcccaaaaggtcgcttgatctcttacctgtcctatgattttctttaattctttattcatggattctactactccctgactttggggattgtagggaattccaaattcctgttcatatcagcagccagggcct

SEQ ID NO: 410957 - DNA, 140 bp, Artificial Sequence
  Synthetic
aggccctggctgctgatatgactgtttattcatttcagaattgggtgccaacatagcagaataggtattgtgcgacagagaagagggagaaatggatccagtagatcctaacatagagccgaccttttgggacagcggtg

SEQ ID NO: 410958 - DNA, 140 bp, Artificial Sequence
  Synthetic
caccgctgtcccaaaaggtcggctctatgttaggatctactggatccatttctccctcttctctgtcgcacaatacctattctgctatgttggcacccaattctgaaatgaataaacagtcatatcagcagccagggcct

SEQ ID NO: 410959 - DNA, 140 bp, Artificial Sequence
  Synthetic
aggccctggctgctgatatgtgcgacagagaagagggagaaatggatccagtagatcctaacatagagccctggaaccagccaggaagtcagcctaaaactgcttgtaaccagtgttattgaccttttgggacagcggtg

SEQ ID NO: 410960 - DNA, 140 bp, Artificial Sequence
  Synthetic
caccgctgtcccaaaaggtcaataacactggttacaagcagttttaggctgacttcctggctggttccagggctctatgttaggatctactggatccatttctccctcttctctgtcgcacatatcagcagccagggcct

SEQ ID NO: 410961 - DNA, 140 bp, Artificial Sequence
  Synthetic
aggccctggctgctgatatgatgaaagactgcactgaaagacaggctaattttttagggaaaatttggccttccaacaaggggaggccagggaatttccttcagaacaggccagagccaagaccttttgggacagcggtg

SEQ ID NO: 410962 - DNA, 140 bp, Artificial Sequence
  Synthetic
caccgctgtcccaaaaggtcttggctctggcctgttctgaaggaaattccctggcctccccttgttggaaggccaaattttccctaaaaaattagcctgtctttcagtgcagtctttcatcatatcagcagccagggcct

SEQ ID NO: 410963 - DNA, 140 bp, Artificial Sequence
  Synthetic
atacgccatgctgggtctccacataatgtttgggccacacatgcctgtgtacccacagaccccaacccacaagaagtagaattggtaaatgtgacagaaaattttaacatgtggaaaaatcgtacttgggagtcggccat

SEQ ID NO: 410964 - DNA, 140 bp, Artificial Sequence
  Synthetic
atggccgactcccaagtacgatttttccacatgttaaaattttctgtcacatttaccaattctacttcttgtgggttggggtctgtgggtacacaggcatgtgtggcccaaacattatgtggagacccagcatggcgtat

SEQ ID NO: 410965 - DNA, 140 bp, Artificial Sequence
  Synthetic
aggccctggctgctgatatgcaaagaaaaatagactggttaattagaagaataagtgaaagagcagaagacagtggcaatgagagtgatggagacacagaggaattatccacgcttgtgggaccttttgggacagcggtg

SEQ ID NO: 410966 - DNA, 140 bp, Artificial Sequence
  Synthetic
caccgctgtcccaaaaggtcccacaagcgtggataattcctctgtgtctccatcactctcattgccactgtcttctgctctttcacttattcttctaattaaccagtctatttttctttgcatatcagcagccagggcct

SEQ ID NO: 410967 - DNA, 140 bp, Artificial Sequence
  Synthetic
atacgccatgctgggtctccttaacccctctctgcgttactttagattgtagctataatgtcactaccaatgtctccaatgacatgcaaggagaaataaaaaactgctctttcaatgtgacgtacttgggagtcggccat

SEQ ID NO: 410968 - DNA, 140 bp, Artificial Sequence
  Synthetic
atggccgactcccaagtacgtcacattgaaagagcagttttttatttctccttgcatgtcattggagacattggtagtgacattatagctacaatctaaagtaacgcagagaggggttaaggagacccagcatggcgtat

SEQ ID NO: 410969 - DNA, 140 bp, Artificial Sequence
  Synthetic
aggccctggctgctgatatgacttctgggaagttcaattaggaataccacatcccgcagggttaaaaaagaaaaaatcagtaacagtactggatgtgggggatgcatatttttcagttccgaccttttgggacagcggtg

SEQ ID NO: 410970 - DNA, 140 bp, Artificial Sequence
  Synthetic
caccgctgtcccaaaaggtcggaactgaaaaatatgcatcccccacatccagtactgttactgattttttcttttttaaccctgcgggatgtggtattcctaattgaacttcccagaagtcatatcagcagccagggcct

SEQ ID NO: 410971 - DNA, 140 bp, Artificial Sequence
  Synthetic
atacgccatgctgggtctcccaaattaattgtacaagacccaactacattaaaagaaaaaggatacatataggaccagggagagcattttatacaacaaaaaatataaaaggaactataacgtacttgggagtcggccat

SEQ ID NO: 410972 - DNA, 140 bp, Artificial Sequence
  Synthetic
atggccgactcccaagtacgttatagttccttttatattttttgttgtataaaatgctctccctggtcctatatgtatcctttttcttttaatgtagttgggtcttgtacaattaatttgggagacccagcatggcgtat

SEQ ID NO: 410973 - DNA, 140 bp, Artificial Sequence
  Synthetic
aggccctggctgctgatatgatgcacacatggaatcaagccagtagtatcaactcaactgctgttaaatggcagtctagcagaaggaaatataacaattagatctgaaaatatcacagacgaccttttgggacagcggtg

SEQ ID NO: 410974 - DNA, 140 bp, Artificial Sequence
  Synthetic
caccgctgtcccaaaaggtcgtctgtgatattttcagatctaattgttatatttccttctgctagactgccatttaacagcagttgagttgatactactggcttgattccatgtgtgcatcatatcagcagccagggcct

SEQ ID NO: 410975 - DNA, 140 bp, Artificial Sequence
  Synthetic
aggccctggctgctgatatgagaatcacaaagccagcaggaaaagaatgaacaagatttattggcatttgacaaatgggcaagcctgtggaattggtttgacatatcaaactggctgtgggaccttttgggacagcggtg

SEQ ID NO: 410976 - DNA, 140 bp, Artificial Sequence
  Synthetic
caccgctgtcccaaaaggtcccacagccagtttgatatgtcaaaccaattccacaggcttgcccatttgtcaaatgccaataaatcttgttcattcttttcctgctggctttgtgattctcatatcagcagccagggcct

SEQ ID NO: 410977 - DNA, 140 bp, Artificial Sequence
  Synthetic
atacgccatgctgggtctccgaggaactgagacaacatctgttgaggtggggatttaccacaccagacaaaaaacatcagaaagaacctccattcctttggatgggttatgaactccatccgtacttgggagtcggccat

SEQ ID NO: 410978 - DNA, 140 bp, Artificial Sequence
  Synthetic
atggccgactcccaagtacggatggagttcataacccatccaaaggaatggaggttctttctgatgttttttgtctggtgtggtaaatccccacctcaacagatgttgtctcagttcctcggagacccagcatggcgtat

SEQ ID NO: 410979 - DNA, 140 bp, Artificial Sequence
  Synthetic
atacgccatgctgggtctcccataatagtacagcttaatgaaactgtagaaattaattgtacaaggccaaacaacaatacaaggaaaggtatacgtataggaccaggaagagtgatttatcgtacttgggagtcggccat

SEQ ID NO: 410980 - DNA, 140 bp, Artificial Sequence
  Synthetic
atggccgactcccaagtacgataaatcactcttcctggtcctatacgtatacctttccttgtattgttgtttggccttgtacaattaatttctacagtttcattaagctgtactattatgggagacccagcatggcgtat

SEQ ID NO: 410981 - DNA, 140 bp, Artificial Sequence
  Synthetic
atacgccatgctgggtctccacaattagcaacatactttgagaacaaaacaataatctttactaactcctcaggaggggatctagaagttacaactcatagttttaattgtggaggagaacgtacttgggagtcggccat

SEQ ID NO: 410982 - DNA, 140 bp, Artificial Sequence
  Synthetic
atggccgactcccaagtacgttctcctccacaattaaaactatgagttgtaacttctagatcccctcctgaggagttagtaaagattattgttttgttctcaaagtatgttgctaattgtggagacccagcatggcgtat

SEQ ID NO: 410983 - DNA, 140 bp, Artificial Sequence
  Synthetic
atacgccatgctgggtctccgacactttaagaataaaacaataacatttaaaccagcctcaggaggggacccagaagttacaatgcatatttttaattgtagaggagaatttttctactgcgtacttgggagtcggccat

SEQ ID NO: 410984 - DNA, 140 bp, Artificial Sequence
  Synthetic
atggccgactcccaagtacgcagtagaaaaattctcctctacaattaaaaatatgcattgtaacttctgggtcccctcctgaggctggtttaaatgttattgttttattcttaaagtgtcggagacccagcatggcgtat

SEQ ID NO: 410985 - DNA, 140 bp, Artificial Sequence
  Synthetic
atacgccatgctgggtctccaaaacaagactatcacactcccatgtagaataagacagattgtaaacatgtggcagagagtgggacgagcaatgtatgcccctcccattgcaggaaacatcgtacttgggagtcggccat

SEQ ID NO: 410986 - DNA, 140 bp, Artificial Sequence
  Synthetic
atggccgactcccaagtacgatgtttcctgcaatgggaggggcatacattgctcgtcccactctctgccacatgtttacaatctgtcttattctacatgggagtgtgatagtcttgttttggagacccagcatggcgtat

SEQ ID NO: 410987 - DNA, 140 bp, Artificial Sequence
  Synthetic
aggccctggctgctgatatgacacatggaattaagccactggtatcaactcagctactgttaaatgggagcttagcacaacaacagataatgattacatctgaaaatctaaccaacaatggaccttttgggacagcggtg

SEQ ID NO: 410988 - DNA, 140 bp, Artificial Sequence
  Synthetic
caccgctgtcccaaaaggtccattgttggttagattttcagatgtaatcattatctgttgttgtgctaagctcccatttaacagtagctgagttgataccagtggcttaattccatgtgtcatatcagcagccagggcct

SEQ ID NO: 410989 - DNA, 140 bp, Artificial Sequence
  Synthetic
aggccctggctgctgatatgcaccactaatgtcccttggaactctagttggagtaataaatccctgactgagatatgggacaatatgacctggctacaatgggataaagaaattagcaatgaccttttgggacagcggtg

SEQ ID NO: 410990 - DNA, 140 bp, Artificial Sequence
  Synthetic
caccgctgtcccaaaaggtcattgctaatttctttatcccattgtagccaggtcatattgtcccatatctcagtcagggatttattactccaactagagttccaagggacattagtggtgcatatcagcagccagggcct

SEQ ID NO: 410991 - DNA, 140 bp, Artificial Sequence
  Synthetic
aggccctggctgctgatatgagacccaacaataatacaagaacaagtataaggataggaccaggacatagcttctttgcaacaaatggcataataggagacataagacaagcacattgtagaccttttgggacagcggtg

SEQ ID NO: 410992 - DNA, 140 bp, Artificial Sequence
  Synthetic
caccgctgtcccaaaaggtctacaatgtgcttgtcttatgtctcctattatgccatttgttgcaaagaagctatgtcctggtcctatccttatacttgttcttgtattattgttgggtctcatatcagcagccagggcct

SEQ ID NO: 410993 - DNA, 140 bp, Artificial Sequence
  Synthetic
atacgccatgctgggtctccgcatattgtaacattaatggaagtaaatggaatgaaactttagaaggggtaaagaagaaattagaagatctctaccctaataaaactataatatttaaaccgtacttgggagtcggccat

SEQ ID NO: 410994 - DNA, 140 bp, Artificial Sequence
  Synthetic
atggccgactcccaagtacggtttaaatattatagttttattagggtagagatcttctaatttcttctttaccccttctaaagtttcattccatttacttccattaatgttacaatatgcggagacccagcatggcgtat

SEQ ID NO: 410995 - DNA, 140 bp, Artificial Sequence
  Synthetic
aggccctggctgctgatatgaaagaagaaattagaagatctctaccctaataaaactataatatttaaaccacactcaggaggggatctagaagttacaacacatagttttaattgtagagaccttttgggacagcggtg

SEQ ID NO: 410996 - DNA, 140 bp, Artificial Sequence
  Synthetic
caccgctgtcccaaaaggtctctacaattaaaactatgtgttgtaacttctagatcccctcctgagtgtggtttaaatattatagttttattagggtagagatcttctaatttcttctttcatatcagcagccagggcct

SEQ ID NO: 410997 - DNA, 140 bp, Artificial Sequence
  Synthetic
atacgccatgctgggtctccttagaagaatatttccctaataaaacaataaaatttgccaattcctcaggaggggatctagaaattacaacacatagcttcaattgtggaggagaattttcgtacttgggagtcggccat

SEQ ID NO: 410998 - DNA, 140 bp, Artificial Sequence
  Synthetic
atggccgactcccaagtacgaaaattctcctccacaattgaagctatgtgttgtaatttctagatcccctcctgaggaattggcaaattttattgttttattagggaaatattcttctaaggagacccagcatggcgtat

SEQ ID NO: 410999 - DNA, 140 bp, Artificial Sequence
  Synthetic
aggccctggctgctgatatgaaactgctctttcaatatcaccacaagcataagaaataaggtacagaaagaatatgcacttttttataaacttgatgtagtaccaatagataatgataatgaccttttgggacagcggtg

SEQ ID NO: 411000 - DNA, 140 bp, Artificial Sequence
  Synthetic
caccgctgtcccaaaaggtcattatcattatctattggtactacatcaagtttataaaaaagtgcatattctttctgtaccttatttcttatgcttgtggtgatattgaaagagcagtttcatatcagcagccagggcct

SEQ ID NO: 411001 - DNA, 140 bp, Artificial Sequence
  Synthetic
atacgccatgctgggtctcctagaagtactgcaaagagctggtagagctattctccacatacctacaagaataagacagggcttggaaagggctttgctcagctttagatcttagccactcgtacttgggagtcggccat

SEQ ID NO: 411002 - DNA, 140 bp, Artificial Sequence
  Synthetic
atggccgactcccaagtacgagtggctaagatctaaagctgagcaaagccctttccaagccctgtcttattcttgtaggtatgtggagaatagctctaccagctctttgcagtacttctaggagacccagcatggcgtat

SEQ ID NO: 411003 - DNA, 140 bp, Artificial Sequence
  Synthetic
atacgccatgctgggtctccgtggcgcccgaacagggacttgaaagcgaaagaaaaaccagagctctctcgacgcaggactcggcttgctgaagcgcgcacggcaagaggcgaggggcggcgtacttgggagtcggccat

SEQ ID NO: 411004 - DNA, 140 bp, Artificial Sequence
  Synthetic
atggccgactcccaagtacgccgcccctcgcctcttgccgtgcgcgcttcagcaagccgagtcctgcgtcgagagagctctggtttttctttcgctttcaagtccctgttcgggcgccacggagacccagcatggcgtat

SEQ ID NO: 411005 - DNA, 140 bp, Artificial Sequence
  Synthetic
atacgccatgctgggtctcccagaagcagatccattcgattggtgaacgggttcttgccacttatctgggaagacctgcggaacctgtgcctcttcagctaccgccacttgagagacttacgtacttgggagtcggccat

SEQ ID NO: 411006 - DNA, 140 bp, Artificial Sequence
  Synthetic
atggccgactcccaagtacgtaagtctctcaagtggcggtagctgaagaggcacaggttccgcaggtcttcccagataagtggcaagaacccgttcaccaatcgaatggatctgcttctgggagacccagcatggcgtat

SEQ ID NO: 411007 - DNA, 140 bp, Artificial Sequence
  Synthetic
aggccctggctgctgatatgaagacctgcggaacctgtgcctcttcagctaccgccacttgagagacttactcttgattgtagcgaggactgtggaacttctggggaaaagggggtgggggaccttttgggacagcggtg

SEQ ID NO: 411008 - DNA, 140 bp, Artificial Sequence
  Synthetic
caccgctgtcccaaaaggtcccccacccccttttccccagaagttccacagtcctcgctacaatcaagagtaagtctctcaagtggcggtagctgaagaggcacaggttccgcaggtcttcatatcagcagccagggcct

SEQ ID NO: 411009 - DNA, 140 bp, Artificial Sequence
  Synthetic
aggccctggctgctgatatgctgttagaaacatcagaaggctgtagacaaatactgggacagctacaaccatcccttcagacaggatcagaagaacttaaatcattatataatacagtaggaccttttgggacagcggtg

SEQ ID NO: 411010 - DNA, 140 bp, Artificial Sequence
  Synthetic
caccgctgtcccaaaaggtcctactgtattatataatgatttaagttcttctgatcctgtctgaagggatggttgtagctgtcccagtatttgtctacagccttctgatgtttctaacagcatatcagcagccagggcct

SEQ ID NO: 411011 - DNA, 140 bp, Artificial Sequence
  Synthetic
aggccctggctgctgatatgtgtgccttggaattctagttggagtaataaatctcaagcagatatttggggaaacatgacctggatgcagtgggatagagaaattagtaattacacaggcgaccttttgggacagcggtg

SEQ ID NO: 411012 - DNA, 140 bp, Artificial Sequence
  Synthetic
caccgctgtcccaaaaggtcgcctgtgtaattactaatttctctatcccactgcatccaggtcatgtttccccaaatatctgcttgagatttattactccaactagaattccaaggcacacatatcagcagccagggcct

SEQ ID NO: 411013 - DNA, 140 bp, Artificial Sequence
  Synthetic
atacgccatgctgggtctccggaaagaatgaggcgagctgagccagcagcagcaggggtaggagcagtgtctcaagatttggataaacgcggtgccatcacaacaaataatactgtaaaacgtacttgggagtcggccat

SEQ ID NO: 411014 - DNA, 140 bp, Artificial Sequence
  Synthetic
atggccgactcccaagtacgttttacagtattatttgttgtgatggcaccgcgtttatccaaatcttgagacactgctcctacccctgctgctgctggctcagctcgcctcattctttccggagacccagcatggcgtat

SEQ ID NO: 411015 - DNA, 140 bp, Artificial Sequence
  Synthetic
aggccctggctgctgatatgtccggagaggttctctcgacgcaggactcggcttgctgaggtgcacacagcaagaggcgagagcggcgactggtgagtacgccatttttgactagcggaggaccttttgggacagcggtg

SEQ ID NO: 411016 - DNA, 140 bp, Artificial Sequence
  Synthetic
caccgctgtcccaaaaggtcctccgctagtcaaaaatggcgtactcaccagtcgccgctctcgcctcttgctgtgtgcacctcagcaagccgagtcctgcgtcgagagaacctctccggacatatcagcagccagggcct

SEQ ID NO: 411017 - DNA, 140 bp, Artificial Sequence
  Synthetic
aggccctggctgctgatatggcatacaggagaaagagattggcatctgggtcagggagtctccatagaatggaggcaggggaggtataggacacaaatagaccctggcctggcagaccaagaccttttgggacagcggtg

SEQ ID NO: 411018 - DNA, 140 bp, Artificial Sequence
  Synthetic
caccgctgtcccaaaaggtcttggtctgccaggccagggtctatttgtgtcctatacctcccctgcctccattctatggagactccctgacccagatgccaatctctttctcctgtatgccatatcagcagccagggcct

SEQ ID NO: 411019 - DNA, 140 bp, Artificial Sequence
  Synthetic
aggccctggctgctgatatggagggagtaggagcagcatctcaagacttagataaacatggggcacttacaagcagcaacacagccaccaataatgctgattgtgcctggctgcaagcgcgaccttttgggacagcggtg

SEQ ID NO: 411020 - DNA, 140 bp, Artificial Sequence
  Synthetic
caccgctgtcccaaaaggtcgcgcttgcagccaggcacaatcagcattattggtggctgtgttgctgcttgtaagtgccccatgtttatctaagtcttgagatgctgctcctactccctccatatcagcagccagggcct

SEQ ID NO: 411021 - DNA, 140 bp, Artificial Sequence
  Synthetic
aggccctggctgctgatatgaatattaagacaaagaaaaatagacaggttaattgatagaataagagaaagagcagaagacagtggcaatgagagtgagggggaggcagaggaattggcagaccttttgggacagcggtg

SEQ ID NO: 411022 - DNA, 140 bp, Artificial Sequence
  Synthetic
caccgctgtcccaaaaggtctgccaattcctctgcctccccctcactctcattgccactgtcttctgctctttctcttattctatcaattaacctgtctatttttctttgtcttaatattcatatcagcagccagggcct

SEQ ID NO: 411023 - DNA, 140 bp, Artificial Sequence
  Synthetic
aggccctggctgctgatatggagcttttagagacagcagatggctgtaaacagataataaaacagttacaaccagcttttcagacagggacagaggaaattagatcattatacaactcaagaccttttgggacagcggtg

SEQ ID NO: 411024 - DNA, 140 bp, Artificial Sequence
  Synthetic
caccgctgtcccaaaaggtcttgagttgtataatgatctaatttcctctgtccctgtctgaaaagctggttgtaactgttttattatctgtttacagccatctgctgtctctaaaagctccatatcagcagccagggcct

SEQ ID NO: 411025 - DNA, 140 bp, Artificial Sequence
  Synthetic
aggccctggctgctgatatgaggaataacatggtagaacaaatgcatacagatataatcagtctatgggatcaaagcctaaagccatgtgggaagttaaccccactctgtgttactttaagaccttttgggacagcggtg

SEQ ID NO: 411026 - DNA, 140 bp, Artificial Sequence
  Synthetic
caccgctgtcccaaaaggtcttaaagtaacacagagtggggttaacttcccacatggctttaggctttgatcccatagactgattatatctgtatgcatttgttctaccatgttattcctcatatcagcagccagggcct

SEQ ID NO: 411027 - DNA, 140 bp, Artificial Sequence
  Synthetic
  misc_feature (95)..(95): n is a, c, g, or t
atacgccatgctgggtctccgatttcggggcgatacaaaactgttctttcaatatgaccacagaagtaacagataagcagaggaaagtacaggcncttttttataaacttgatatagtaccgtacttgggagtcggccat

SEQ ID NO: 411028 - DNA, 140 bp, Artificial Sequence
  Synthetic
  misc_feature (46)..(46): n is a, c, g, or t
atggccgactcccaagtacggtactatatcaagtttataaaaaagngcctgtactttcctctgcttatctgttacttctgtggtcatattgaaagaacagttttgtatcgccccgaaatcggagacccagcatggcgtat

SEQ ID NO: 411029 - DNA, 140 bp, Artificial Sequence
  Synthetic
atacgccatgctgggtctccgtaatttgagtaatactaataccagtactttgaattgtagtaatttgaataatactaataccaataatagtagtgggggagtgatggaggaaggagaaatcgtacttgggagtcggccat

SEQ ID NO: 411030 - DNA, 140 bp, Artificial Sequence
  Synthetic
atggccgactcccaagtacgatttctccttcctccatcactcccccactactattattggtattagtattattcaaattactacaattcaaagtactggtattagtattactcaaattacggagacccagcatggcgtat

SEQ ID NO: 411031 - DNA, 140 bp, Artificial Sequence
  Synthetic
aggccctggctgctgatatggggacaacgtgacagtaggacaggtgggcccaggtccaatggctgtgatcagcatgaacctggcagcagagggcagaggaaacaactcaaggagagcttagaccttttgggacagcggtg

SEQ ID NO: 411032 - DNA, 140 bp, Artificial Sequence
  Synthetic
caccgctgtcccaaaaggtctaagctctccttgagttgtttcctctgccctctgctgccaggttcatgctgatcacagccattggacctgggcccacctgtcctactgtcacgttgtccccatatcagcagccagggcct

SEQ ID NO: 411033 - DNA, 140 bp, Artificial Sequence
  Synthetic
aggccctggctgctgatatgagagtagcatgacaaaaatcttagagccctttagatcaaaaaatccagaaataattatctatcaatacatggatgacttgtatgtaggatctgatttagagaccttttgggacagcggtg

SEQ ID NO: 411034 - DNA, 140 bp, Artificial Sequence
  Synthetic
caccgctgtcccaaaaggtctctaaatcagatcctacatacaagtcatccatgtattgatagataattatttctggattttttgatctaaagggctctaagatttttgtcatgctactctcatatcagcagccagggcct

SEQ ID NO: 411035 - DNA, 140 bp, Artificial Sequence
  Synthetic
atacgccatgctgggtctcccaagtggtcaaaaatgggtgggtggcctactgtaagggaaagaatgaggcgaactgacccagcagcagaaggggtaggaccagcatctcgagacctggaacgtacttgggagtcggccat

SEQ ID NO: 411036 - DNA, 140 bp, Artificial Sequence
  Synthetic
atggccgactcccaagtacgttccaggtctcgagatgctggtcctaccccttctgctgctgggtcagttcgcctcattctttcccttacagtaggccacccacccatttttgaccacttgggagacccagcatggcgtat

SEQ ID NO: 411037 - DNA, 140 bp, Artificial Sequence
  Synthetic
atacgccatgctgggtctccaaaaagtataaggataggaccagggagtacattttatgcaacaggagacataataggagatataagacaaacacattgtaacattagtgaagcaaactggcgtacttgggagtcggccat

SEQ ID NO: 411038 - DNA, 140 bp, Artificial Sequence
  Synthetic
atggccgactcccaagtacgccagtttgcttcactaatgttacaatgtgtttgtcttatatctcctattatgtctcctgttgcataaaatgtactccctggtcctatccttatactttttggagacccagcatggcgtat

SEQ ID NO: 411039 - DNA, 140 bp, Artificial Sequence
  Synthetic
aggccctggctgctgatatgcgattagtgaacggattcttaccacttatctgggacgacctgaggaacctgtgcctcttcagctaccaccgcttgagagacttactcttgattgtagcgagaccttttgggacagcggtg

SEQ ID NO: 411040 - DNA, 140 bp, Artificial Sequence
  Synthetic
caccgctgtcccaaaaggtctcgctacaatcaagagtaagtctctcaagcggtggtagctgaagaggcacaggttcctcaggtcgtcccagataagtggtaagaatccgttcactaatcgcatatcagcagccagggcct

SEQ ID NO: 411041 - DNA, 140 bp, Artificial Sequence
  Synthetic
aggccctggctgctgatatgtagaagctttgcaaagagctggtagagctgttctcaacatacctagaagaataagacagggcttagaaagggctttgcaataaaatggggggcaagtggtgaccttttgggacagcggtg

SEQ ID NO: 411042 - DNA, 140 bp, Artificial Sequence
  Synthetic
caccgctgtcccaaaaggtcaccacttgccccccattttattgcaaagccctttctaagccctgtcttattcttctaggtatgttgagaacagctctaccagctctttgcaaagcttctacatatcagcagccagggcct

SEQ ID NO: 411043 - DNA, 140 bp, Artificial Sequence
  Synthetic
aggccctggctgctgatatgtgtcatgggtaccagcacacaaagggattggaggaaatgaacaagtagataaattagtcagcagtggaatcaggaaggtgctatttttagatggaatagagaccttttgggacagcggtg

SEQ ID NO: 411044 - DNA, 140 bp, Artificial Sequence
  Synthetic
caccgctgtcccaaaaggtctctattccatctaaaaatagcaccttcctgattccactgctgactaatttatctacttgttcatttcctccaatccctttgtgtgctggtacccatgacacatatcagcagccagggcct

SEQ ID NO: 411045 - DNA, 140 bp, Artificial Sequence
  Synthetic
aggccctggctgctgatatgcatttcagaattgggtgtcgacatagcagaataggcattattcgacagaggagagcaagaaatggagccagtagatcctagactagagccctggaagcatgaccttttgggacagcggtg

SEQ ID NO: 411046 - DNA, 140 bp, Artificial Sequence
  Synthetic
caccgctgtcccaaaaggtcatgcttccagggctctagtctaggatctactggctccatttcttgctctcctctgtcgaataatgcctattctgctatgtcgacacccaattctgaaatgcatatcagcagccagggcct

SEQ ID NO: 411047 - DNA, 140 bp, Artificial Sequence
  Synthetic
aggccctggctgctgatatggtttttcagactctgccataaggaaagccatattaggacaagtagttagccctagttgtgaatatcaagcaggacataacaaggtaggatctctacaatagaccttttgggacagcggtg

SEQ ID NO: 411048 - DNA, 140 bp, Artificial Sequence
  Synthetic
caccgctgtcccaaaaggtctattgtagagatcctaccttgttatgtcctgcttgatattcacaactagggctaactacttgtcctaatatggctttccttatggcagagtctgaaaaaccatatcagcagccagggcct

SEQ ID NO: 411049 - DNA, 140 bp, Artificial Sequence
  Synthetic
aggccctggctgctgatatgattgtgggtcacagtctattatggggtacctgtgtggaaagaagcaaccaccactctattttgtgcatcagatgctaaagcatatgatacagaggtacatgaccttttgggacagcggtg

SEQ ID NO: 411050 - DNA, 140 bp, Artificial Sequence
  Synthetic
caccgctgtcccaaaaggtcatgtacctctgtatcatatgctttagcatctgatgcacaaaatagagtggtggttgcttctttccacacaggtaccccataatagactgtgacccacaatcatatcagcagccagggcct

SEQ ID NO: 411051 - DNA, 140 bp, Artificial Sequence
  Synthetic
aggccctggctgctgatatggggcgactggtgagtacgccaaaaaattttttgactagcggaggctagaaggagagagatgggtgcgagagcgtcagtattaagcgggggacaattagatgaccttttgggacagcggtg

SEQ ID NO: 411052 - DNA, 140 bp, Artificial Sequence
  Synthetic
caccgctgtcccaaaaggtcatctaattgtcccccgcttaatactgacgctctcgcacccatctctctccttctagcctccgctagtcaaaaaattttttggcgtactcaccagtcgccccatatcagcagccagggcct

SEQ ID NO: 411053 - DNA, 140 bp, Artificial Sequence
  Synthetic
aggccctggctgctgatatgtggtagaacagatgcatgaggatataatcagtttatgggatcaaagcctaaagccatgtgtaaaattaaccccactctgtgttactttaaattgcactgagaccttttgggacagcggtg

SEQ ID NO: 411054 - DNA, 140 bp, Artificial Sequence
  Synthetic
caccgctgtcccaaaaggtctcagtgcaatttaaagtaacacagagtggggttaattttacacatggctttaggctttgatcccataaactgattatatcctcatgcatctgttctaccacatatcagcagccagggcct

SEQ ID NO: 411055 - DNA, 140 bp, Artificial Sequence
  Synthetic
aggccctggctgctgatatggttgtgtggactatagtaggtatagaatataagaaagtgctaaagcaaagaaaaatagacaggttaattgagagaataagagaaagagcagaagacagtggaccttttgggacagcggtg

SEQ ID NO: 411056 - DNA, 140 bp, Artificial Sequence
  Synthetic
caccgctgtcccaaaaggtccactgtcttctgctctttctcttattctctcaattaacctgtctatttttctttgctttagcactttcttatattctatacctactatagtccacacaaccatatcagcagccagggcct

SEQ ID NO: 411057 - DNA, 140 bp, Artificial Sequence
  Synthetic
atacgccatgctgggtctcccattaatagtagcatttattatagcagtagttgtgtggaccatagtatatatagaatatagaaagatattaaaacaaaagaaaatagataggttaattgacgtacttgggagtcggccat

SEQ ID NO: 411058 - DNA, 140 bp, Artificial Sequence
  Synthetic
atggccgactcccaagtacgtcaattaacctatctattttcttttgttttaatatctttctatattctatatatactatggtccacacaactactgctataataaatgctactattaatgggagacccagcatggcgtat

SEQ ID NO: 411059 - DNA, 140 bp, Artificial Sequence
  Synthetic
aggccctggctgctgatatgatagaatatagaaagatattaaaacaaaagaaaatagataggttaattgagagaataagagacagagcagaagacagtggcaatgagagtggtggggacagaccttttgggacagcggtg

SEQ ID NO: 411060 - DNA, 140 bp, Artificial Sequence
  Synthetic
caccgctgtcccaaaaggtctgtccccaccactctcattgccactgtcttctgctctgtctcttattctctcaattaacctatctattttcttttgttttaatatctttctatattctatcatatcagcagccagggcct

SEQ ID NO: 411061 - DNA, 140 bp, Artificial Sequence
  Synthetic
atacgccatgctgggtctccgagaataagagacagagcagaagacagtggcaatgagagtggtggggacacagaggaattatccacacttgtggaaatggggaaccataatcttgggtttcgtacttgggagtcggccat

SEQ ID NO: 411062 - DNA, 140 bp, Artificial Sequence
  Synthetic
atggccgactcccaagtacgaaacccaagattatggttccccatttccacaagtgtggataattcctctgtgtccccaccactctcattgccactgtcttctgctctgtctcttattctcggagacccagcatggcgtat

SEQ ID NO: 411063 - DNA, 140 bp, Artificial Sequence
  Synthetic
aggccctggctgctgatatgtagatcctaacctagagccctggaaccatccaggaagtcagcctcaaactccttgtaataattgctattgtaaatgctgtagctatcattgtctagtttggaccttttgggacagcggtg

SEQ ID NO: 411064 - DNA, 140 bp, Artificial Sequence
  Synthetic
caccgctgtcccaaaaggtccaaactagacaatgatagctacagcatttacaatagcaattattacaaggagtttgaggctgacttcctggatggttccagggctctaggttaggatctacatatcagcagccagggcct

SEQ ID NO: 411065 - DNA, 140 bp, Artificial Sequence
  Synthetic
aggccctggctgctgatatgcaatcctcaggaggggacccagaaattgtaatgcacagttttaattgtggaggggaatttttctactgtaatacatcaccactgtttaatagtacttggagaccttttgggacagcggtg

SEQ ID NO: 411066 - DNA, 140 bp, Artificial Sequence
  Synthetic
caccgctgtcccaaaaggtctccaagtactattaaacagtggtgatgtattacagtagaaaaattcccctccacaattaaaactgtgcattacaatttctgggtcccctcctgaggattgcatatcagcagccagggcct

SEQ ID NO: 411067 - DNA, 140 bp, Artificial Sequence
  Synthetic
atacgccatgctgggtctccctacttgcgatagcaatagcactaaatgggctaatgaggctatgaagaactgctctttcaatgtaaccacagaattaagagataagaagaaacaagaatacgtacttgggagtcggccat

SEQ ID NO: 411068 - DNA, 140 bp, Artificial Sequence
  Synthetic
atggccgactcccaagtacgtattcttgtttcttcttatctcttaattctgtggttacattgaaagagcagttcttcatagcctcattagcccatttagtgctattgctatcgcaagtagggagacccagcatggcgtat

SEQ ID NO: 411069 - DNA, 140 bp, Artificial Sequence
  Synthetic
atacgccatgctgggtctccgaacagggccatgcacaaatgttagcacagtacaatgtacacatggaattaagccagtggtatcaactcaactgctgctaaatggaagtctagcagcagacgtacttgggagtcggccat

SEQ ID NO: 411070 - DNA, 140 bp, Artificial Sequence
  Synthetic
atggccgactcccaagtacgtctgctgctagacttccatttagcagcagttgagttgataccactggcttaattccatgtgtacattgtactgtgctaacatttgtgcatggccctgttcggagacccagcatggcgtat

SEQ ID NO: 411071 - DNA, 140 bp, Artificial Sequence
  Synthetic
aggccctggctgctgatatgaagccagtggtatcaactcaactgctgctaaatggaagtctagcagcagaaaaggtaatgatcagatctgaaaatatcacagacaataccaaaaacatcagaccttttgggacagcggtg

SEQ ID NO: 411072 - DNA, 140 bp, Artificial Sequence
  Synthetic
caccgctgtcccaaaaggtctgatgtttttggtattgtctgtgatattttcagatctgatcattaccttttctgctgctagacttccatttagcagcagttgagttgataccactggcttcatatcagcagccagggcct

SEQ ID NO: 411073 - DNA, 140 bp, Artificial Sequence
  Synthetic
aggccctggctgctgatatgaacacgagaaaaagtatacatataggaccaggacaagcattctatgcaacaggtgagataataggagatataagacaagcacattgtaatatcagtggaagaccttttgggacagcggtg

SEQ ID NO: 411074 - DNA, 140 bp, Artificial Sequence
  Synthetic
caccgctgtcccaaaaggtcttccactgatattacaatgtgcttgtcttatatctcctattatctcacctgttgcatagaatgcttgtcctggtcctatatgtatactttttctcgtgttcatatcagcagccagggcct

SEQ ID NO: 411075 - DNA, 140 bp, Artificial Sequence
  Synthetic
aggccctggctgctgatatgaggtgagataataggagatataagacaagcacattgtaatatcagtggaacagagtggaatgacactttacacaaggtagttacacaattaggagaacacgaccttttgggacagcggtg

SEQ ID NO: 411076 - DNA, 140 bp, Artificial Sequence
  Synthetic
caccgctgtcccaaaaggtcgtgttctcctaattgtgtaactaccttgtgtaaagtgtcattccactctgttccactgatattacaatgtgcttgtcttatatctcctattatctcacctcatatcagcagccagggcct

SEQ ID NO: 411077 - DNA, 140 bp, Artificial Sequence
  Synthetic
atacgccatgctgggtctcccaaaaatggtaatatcacctataataataccatgaagggagaaataaaaaattgctctttcaatgcaaccacagaaataaaacataagaaaaaggaaatgcgtacttgggagtcggccat

SEQ ID NO: 411078 - DNA, 140 bp, Artificial Sequence
  Synthetic
atggccgactcccaagtacgcatttcctttttcttatgttttatttctgtggttgcattgaaagagcaattttttatttctcccttcatggtattattataggtgatattaccatttttgggagacccagcatggcgtat

SEQ ID NO: 411079 - DNA, 140 bp, Artificial Sequence
  Synthetic
  misc_feature (98)..(98): n is a, c, g, or t
  misc_feature (111)..(111): n is a, c, g, or t
  misc_feature (117)..(117): n is a, c, g, or t
atacgccatgctgggtctccaattacaacacctacttttaattgtgcaggagaatttttctattgttatacaacaaacctgtttaatagtacctggtncaagaataatgancaaatnatacgtacttgggagtcggccat

SEQ ID NO: 411080 - DNA, 140 bp, Artificial Sequence
  Synthetic
  misc_feature (24)..(24): n is a, c, g, or t
  misc_feature (30)..(30): n is a, c, g, or t
  misc_feature (43)..(43): n is a, c, g, or t
atggccgactcccaagtacgtatnatttgntcattattcttgnaccaggtactattaaacaggtttgttgtataacaatagaaaaattctcctgcacaattaaaagtaggtgttgtaattggagacccagcatggcgtat

SEQ ID NO: 411081 - DNA, 140 bp, Artificial Sequence
  Synthetic
aggccctggctgctgatatgcaaaagaattaatagcagaagtacagaaacaagggctagaccaatggacatatcaaatttatcaagagccatacaaaaatctgaaaacaggaaaatatgcgaccttttgggacagcggtg

SEQ ID NO: 411082 - DNA, 140 bp, Artificial Sequence
  Synthetic
caccgctgtcccaaaaggtcgcatattttcctgttttcagatttttgtatggctcttgataaatttgatatgtccattggtctagcccttgtttctgtacttctgctattaattcttttgcatatcagcagccagggcct

SEQ ID NO: 411083 - DNA, 140 bp, Artificial Sequence
  Synthetic
atacgccatgctgggtctccctattacactcccatgcagaaaatacaaattataataatgtggcagcggacaggacaagcaatgtatgcccctcccagcagcagaaatattacatgttgacgtacttgggagtcggccat

SEQ ID NO: 411084 - DNA, 140 bp, Artificial Sequence
  Synthetic
atggccgactcccaagtacgtcaacatgtaatatttctgctgctgggaggggcatacattgcttgtcctgtccgctgccacattattataatttgtattttctgcatgggagtgtaatagggagacccagcatggcgtat

SEQ ID NO: 411085 - DNA, 140 bp, Artificial Sequence
  Synthetic
atacgccatgctgggtctccaccagtacatggagtatattatgacccatcaaaagacttaatagcagaaatacagaagcaggggcaaggccaatggacatatcaaatttatcaagagccacgtacttgggagtcggccat

SEQ ID NO: 411086 - DNA, 140 bp, Artificial Sequence
  Synthetic
atggccgactcccaagtacgtggctcttgataaatttgatatgtccattggccttgcccctgcttctgtatttctgctattaagtcttttgatgggtcataatatactccatgtactggtggagacccagcatggcgtat

SEQ ID NO: 411087 - DNA, 140 bp, Artificial Sequence
  Synthetic
aggccctggctgctgatatgtcctacagtattggagtcaggaactaaagagtagtgctgttagcttgcttaatgccacagctatagcagtagctgaggggacagatagggttatagaagtgaccttttgggacagcggtg

SEQ ID NO: 411088 - DNA, 140 bp, Artificial Sequence
  Synthetic
caccgctgtcccaaaaggtcacttctataaccctatctgtcccctcagctactgctatagctgtggcattaagcaagctaacagcactactctttagttcctgactccaatactgtaggacatatcagcagccagggcct

SEQ ID NO: 411089 - DNA, 140 bp, Artificial Sequence
  Synthetic
aggccctggctgctgatatgtcgacaggcccggaagaatcgaagaagaaggtggagagcaagacagaaccagatcgattcgattagtgagcggattcttagcacttgcctgggacgatctgaccttttgggacagcggtg

SEQ ID NO: 411090 - DNA, 140 bp, Artificial Sequence
  Synthetic
caccgctgtcccaaaaggtcagatcgtcccaggcaagtgctaagaatccgctcactaatcgaatcgatctggttctgtcttgctctccaccttcttcttcgattcttccgggcctgtcgacatatcagcagccagggcct

SEQ ID NO: 411091 - DNA, 140 bp, Artificial Sequence
  Synthetic
aggccctggctgctgatatggggctgctctggaaaactcatctgcaccactgctgtgccttggaactccagttggagtaataaatctcaagaagagatttggaataacatgacctggatggaccttttgggacagcggtg

SEQ ID NO: 411092 - DNA, 140 bp, Artificial Sequence
  Synthetic
caccgctgtcccaaaaggtccatccaggtcatgttattccaaatctcttcttgagatttattactccaactggagttccaaggcacagcagtggtgcagatgagttttccagagcagccccatatcagcagccagggcct

SEQ ID NO: 411093 - DNA, 140 bp, Artificial Sequence
  Synthetic
aggccctggctgctgatatgttcttaacatacctagaagaatcagacagggcaccgaaagggctttgctataacatggggggcaagtggtcaaaaagtagcatagtaggatggcctgagagaccttttgggacagcggtg

SEQ ID NO: 411094 - DNA, 140 bp, Artificial Sequence
  Synthetic
caccgctgtcccaaaaggtctctcaggccatcctactatgctactttttgaccacttgccccccatgttatagcaaagccctttcggtgccctgtctgattcttctaggtatgttaagaacatatcagcagccagggcct

SEQ ID NO: 411095 - DNA, 140 bp, Artificial Sequence
  Synthetic
atacgccatgctgggtctccttagggaaagaataagaagaactcctccagcagcaggagcagaagcagcgtccccagaggagaacaaacatgcaacagtaacaaacagcaatccagcagccgtacttgggagtcggccat

SEQ ID NO: 411096 - DNA, 140 bp, Artificial Sequence
  Synthetic
atggccgactcccaagtacggctgctggattgctgtttgttactgttgcatgtttgttctcctctggggacgctgcttctgctcctgctgctggaggagttcttcttattctttccctaaggagacccagcatggcgtat

SEQ ID NO: 411097 - DNA, 140 bp, Artificial Sequence
  Synthetic
aggccctggctgctgatatggaggaggtaggctttccagtcaggccacaggtacctctaaggccaatgacctacaagggagctttcgatctcagccactttttaaaagaaaaggggggacgaccttttgggacagcggtg

SEQ ID NO: 411098 - DNA, 140 bp, Artificial Sequence
  Synthetic
caccgctgtcccaaaaggtcgtccccccttttcttttaaaaagtggctgagatcgaaagctcccttgtaggtcattggccttagaggtacctgtggcctgactggaaagcctacctcctccatatcagcagccagggcct

SEQ ID NO: 411099 - DNA, 140 bp, Artificial Sequence
  Synthetic
aggccctggctgctgatatggaagaagtaggctttccagtcagacctcaggtgcctttaagaccaatgacttataagggagcattcgatctcagcttctttttaaaagaaaaggggggacgaccttttgggacagcggtg

SEQ ID NO: 411100 - DNA, 140 bp, Artificial Sequence
  Synthetic
caccgctgtcccaaaaggtcgtccccccttttcttttaaaaagaagctgagatcgaatgctcccttataagtcattggtcttaaaggcacctgaggtctgactggaaagcctacttcttccatatcagcagccagggcct

SEQ ID NO: 411101 - DNA, 140 bp, Artificial Sequence
  Synthetic
atacgccatgctgggtctccctccttgtaccaaatgttattgtaaaaagtgttgctttcattgttaccggtgcttcataacaaaaggcttaggcatctcctatggcaggaagaagcggagcgtacttgggagtcggccat

SEQ ID NO: 411102 - DNA, 140 bp, Artificial Sequence
  Synthetic
atggccgactcccaagtacgctccgcttcttcctgccataggagatgcctaagccttttgttatgaagcaccggtaacaatgaaagcaacactttttacaataacatttggtacaaggagggagacccagcatggcgtat

SEQ ID NO: 411103 - DNA, 140 bp, Artificial Sequence
  Synthetic
atacgccatgctgggtctccgaagccttagacaggatagaggaagaacaaaacaaatgtcagcaaaaagcacagcagcaggaagaggctgccgcaaaggtcagtcagaattaccctatagcgtacttgggagtcggccat

SEQ ID NO: 411104 - DNA, 140 bp, Artificial Sequence
  Synthetic
atggccgactcccaagtacgctatagggtaattctgactgacctttgcggcagcctcttcctgctgctgtgctttttgctgacatttgttttgttcttcctctatcctgtctaaggcttcggagacccagcatggcgtat

SEQ ID NO: 411105 - DNA, 140 bp, Artificial Sequence
  Synthetic
aggccctggctgctgatatgtgcactgagagacaggctaattttttagggaaaatttggccttccagcaaggggaggccaggaaattttcctcagagcagaccggagccaacagccccgcgaccttttgggacagcggtg

SEQ ID NO: 411106 - DNA, 140 bp, Artificial Sequence
  Synthetic
caccgctgtcccaaaaggtcgcggggctgttggctccggtctgctctgaggaaaatttcctggcctccccttgctggaaggccaaattttccctaaaaaattagcctgtctctcagtgcacatatcagcagccagggcct

SEQ ID NO: 411107 - DNA, 140 bp, Artificial Sequence
  Synthetic
  misc_feature (39)..(39): n is a, c, g, or t
atacgccatgctgggtctccaacaccaataacactgggngtagcaccctgaaggaagagccagaggcaatacaaaactgctctttcaatgcaaccacagaaataagagataaggagcggacgtacttgggagtcggccat

SEQ ID NO: 411108 - DNA, 140 bp, Artificial Sequence
  Synthetic
  misc_feature (102)..(102): n is a, c, g, or t
atggccgactcccaagtacgtccgctccttatctcttatttctgtggttgcattgaaagagcagttttgtattgcctctggctcttccttcagggtgctacncccagtgttattggtgttggagacccagcatggcgtat

SEQ ID NO: 411109 - DNA, 140 bp, Artificial Sequence
  Synthetic
atacgccatgctgggtctcccagtaatagtaccagtaatagtagtggggaagtgatggaggaagtagacatgaaaaactgctctttcaccgttaccaccgaattaaaaaatacggtgagccgtacttgggagtcggccat

SEQ ID NO: 411110 - DNA, 140 bp, Artificial Sequence
  Synthetic
atggccgactcccaagtacggctcaccgtattttttaattcggtggtaacggtgaaagagcagtttttcatgtctacttcctccatcacttccccactactattactggtactattactgggagacccagcatggcgtat

SEQ ID NO: 411111 - DNA, 140 bp, Artificial Sequence
  Synthetic
aggccctggctgctgatatgaaaaggtctacctggcatgggtaccagcacacaaaggaattggaggaaatgaacaagtagataaattagtcagtgctggaatcaggaaagtactatttttgaccttttgggacagcggtg

SEQ ID NO: 411112 - DNA, 140 bp, Artificial Sequence
  Synthetic
caccgctgtcccaaaaggtcaaaaatagtactttcctgattccagcactgactaatttatctacttgttcatttcctccaattcctttgtgtgctggtacccatgccaggtagaccttttcatatcagcagccagggcct

SEQ ID NO: 411113 - DNA, 140 bp, Artificial Sequence
  Synthetic
atacgccatgctgggtctcccaataaaaaatataagaataggaccagggataggactagggagtacattacatgcaacaaaaagcataacaggaagaataagaccacattgcaacattagcgtacttgggagtcggccat

SEQ ID NO: 411114 - DNA, 140 bp, Artificial Sequence
  Synthetic
atggccgactcccaagtacgctaatgttgcaatgtggtcttattcttcctgttatgctttttgttgcatgtaatgtactccctagtcctatccctggtcctattcttatattttttattgggagacccagcatggcgtat

SEQ ID NO: 411115 - DNA, 140 bp, Artificial Sequence
  Synthetic
atacgccatgctgggtctcctgcaacaacaataaaatttacctcatcctcaggaggggacctagaaattacaacgcatagttttaattgtagaggagaatttttctactgcaatacatcacgtacttgggagtcggccat

SEQ ID NO: 411116 - DNA, 140 bp, Artificial Sequence
  Synthetic
atggccgactcccaagtacgtgatgtattgcagtagaaaaattctcctctacaattaaaactatgcgttgtaatttctaggtcccctcctgaggatgaggtaaattttattgttgttgcaggagacccagcatggcgtat

SEQ ID NO: 411117 - DNA, 140 bp, Artificial Sequence
  Synthetic
atacgccatgctgggtctccgaagagtggtgcagagagaaaaaagagcagtgggaatattaggagctatgttccttgggttcttgggagcagcaggaagcactatgggcgcagcgtcaatcgtacttgggagtcggccat

SEQ ID NO: 411118 - DNA, 140 bp, Artificial Sequence
  Synthetic
atggccgactcccaagtacgattgacgctgcgcccatagtgcttcctgctgctcccaagaacccaaggaacatagctcctaatattcccactgctcttttttctctctgcaccactcttcggagacccagcatggcgtat

SEQ ID NO: 411119 - DNA, 140 bp, Artificial Sequence
  Synthetic
aggccctggctgctgatatgaaaagacttaatagcagaaatacagaaacaagggcaagaccaatggacatatcaaatttatcaagagccatttaaaaatttaaaaacagggaaatatgcagaccttttgggacagcggtg

SEQ ID NO: 411120 - DNA, 140 bp, Artificial Sequence
  Synthetic
caccgctgtcccaaaaggtctgcatatttccctgtttttaaatttttaaatggctcttgataaatttgatatgtccattggtcttgcccttgtttctgtatttctgctattaagtcttttcatatcagcagccagggcct

SEQ ID NO: 411121 - DNA, 140 bp, Artificial Sequence
  Synthetic
aggccctggctgctgatatgcgatcagccatctgagacttggactgtggatcctaggagagaagataattagtgcttgcagaatttgtacagctgtagtacaatactggttacaagaattgaccttttgggacagcggtg

SEQ ID NO: 411122 - DNA, 140 bp, Artificial Sequence
  Synthetic
caccgctgtcccaaaaggtcaattcttgtaaccagtattgtactacagctgtacaaattctgcaagcactaattatcttctctcctaggatccacagtccaagtctcagatggctgatcgcatatcagcagccagggcct

SEQ ID NO: 411123 - DNA, 140 bp, Artificial Sequence
  Synthetic
atacgccatgctgggtctcctgtggaccatagcatatataaaatataggaaattggtaaagacaaagaaaaatagactagttaatcaaaagaattaaggaaagagcagaagacagtggcacgtacttgggagtcggccat

SEQ ID NO: 411124 - DNA, 140 bp, Artificial Sequence
  Synthetic
atggccgactcccaagtacgtgccactgtcttctgctctttccttaattcttttgattaactagtctatttttctttgtctttaccaatttcctatattttatatatgctatggtccacaggagacccagcatggcgtat

SEQ ID NO: 411125 - DNA, 140 bp, Artificial Sequence
  Synthetic
aggccctggctgctgatatgaacaaatcaaaagactgaactacatgcaatctatctagccttgcaggattcaggatcagaagtaaatatagtaacagactcacagtatgcattaggaatcgaccttttgggacagcggtg

SEQ ID NO: 411126 - DNA, 140 bp, Artificial Sequence
  Synthetic
caccgctgtcccaaaaggtcgattcctaatgcatactgtgagtctgttactatatttacttctgatcctgaatcctgcaaggctagatagattgcatgtagttcagtcttttgatttgttcatatcagcagccagggcct

SEQ ID NO: 411127 - DNA, 140 bp, Artificial Sequence
  Synthetic
aggccctggctgctgatatgaactaaaatagggaaagcagggtatgtcactgacaaaggaagacaaaaggttatctccataactgaaacaacaaatcagaaaactgaattagaagcaattgaccttttgggacagcggtg

SEQ ID NO: 411128 - DNA, 140 bp, Artificial Sequence
  Synthetic
caccgctgtcccaaaaggtcaattgcttctaattcagttttctgatttgttgtttcagttatggagataaccttttgtcttcctttgtcagtgacataccctgctttccctattttagttcatatcagcagccagggcct

SEQ ID NO: 411129 - DNA, 140 bp, Artificial Sequence
  Synthetic
aggccctggctgctgatatgggattcttgccactcatctgggacgacctaaggagcctgtgcctcttcagctaccaccgcttgagagacttactcttgattgtaacgaggattgtggaacgaccttttgggacagcggtg

SEQ ID NO: 411130 - DNA, 140 bp, Artificial Sequence
  Synthetic
caccgctgtcccaaaaggtcgttccacaatcctcgttacaatcaagagtaagtctctcaagcggtggtagctgaagaggcacaggctccttaggtcgtcccagatgagtggcaagaatcccatatcagcagccagggcct

SEQ ID NO: 411131 - DNA, 140 bp, Artificial Sequence
  Synthetic
aggccctggctgctgatatgcacagcaatagtagtagctgaggggacagatagagttatagaagctttgcaaagagctggtagagctgttctccacatacctagaagaataagacagggcgaccttttgggacagcggtg

SEQ ID NO: 411132 - DNA, 140 bp, Artificial Sequence
  Synthetic
caccgctgtcccaaaaggtcgccctgtcttattcttctaggtatgtggagaacagctctaccagctctttgcaaagcttctataactctatctgtcccctcagctactactattgctgtgcatatcagcagccagggcct

SEQ ID NO: 411133 - DNA, 140 bp, Artificial Sequence
  Synthetic
aggccctggctgctgatatggcagaaggggtgggagcagtgtctcaagacttagaaagacggggggcaattacaagcagcaatactagagccaataatcctgacttggcctggctggaaggaccttttgggacagcggtg

SEQ ID NO: 411134 - DNA, 140 bp, Artificial Sequence
  Synthetic
caccgctgtcccaaaaggtccttccagccaggccaagtcaggattattggctctagtattgctgcttgtaattgccccccgtctttctaagtcttgagacactgctcccaccccttctgccatatcagcagccagggcct

SEQ ID NO: 411135 - DNA, 140 bp, Artificial Sequence
  Synthetic
aggccctggctgctgatatgctcgacgcaggactcggcttgctgaagcgcgcacggcaagaggcgaggggcggcgaacggtgagtacgccaaaatttttgactagcggaggctagaaggagaccttttgggacagcggtg

SEQ ID NO: 411136 - DNA, 140 bp, Artificial Sequence
  Synthetic
caccgctgtcccaaaaggtctccttctagcctccgctagtcaaaaattttggcgtactcaccgttcgccgcccctcgcctcttgccgtgcgcgcttcagcaagccgagtcctgcgtcgagcatatcagcagccagggcct

SEQ ID NO: 411137 - DNA, 140 bp, Artificial Sequence
  Synthetic
aggccctggctgctgatatggtggcgcccgaacagggacccgaaagcgaaagtagaaccagagaagatctctcgacgcaggactcggcttgctgagtgcacgcagcaagaggcgaggggcgaccttttgggacagcggtg

SEQ ID NO: 411138 - DNA, 140 bp, Artificial Sequence
  Synthetic
caccgctgtcccaaaaggtcgcccctcgcctcttgctgcgtgcactcagcaagccgagtcctgcgtcgagagatcttctctggttctactttcgctttcgggtccctgttcgggcgccaccatatcagcagccagggcct

SEQ ID NO: 411139 - DNA, 140 bp, Artificial Sequence
  Synthetic
aggccctggctgctgatatgttgtaagactattttaaaagcattgggaccagcagctacactagaagaaatgatgacagcatgtcagggagtgggaggacccggccataaagcaagagttgaccttttgggacagcggtg

SEQ ID NO: 411140 - DNA, 140 bp, Artificial Sequence
  Synthetic
caccgctgtcccaaaaggtcaactcttgctttatggccgggtcctcccactccctgacatgctgtcatcatttcttctagtgtagctgctggtcccaatgcttttaaaatagtcttacaacatatcagcagccagggcct

SEQ ID NO: 411141 - DNA, 140 bp, Artificial Sequence
  Synthetic
aggccctggctgctgatatggcattgggaccaggggctacactagaagagatgatgacagcatgtcagggagtgggaggacctggccataaggcaagagttttggctgaggcaatgagccgaccttttgggacagcggtg

SEQ ID NO: 411142 - DNA, 140 bp, Artificial Sequence
  Synthetic
caccgctgtcccaaaaggtcggctcattgcctcagccaaaactcttgccttatggccaggtcctcccactccctgacatgctgtcatcatctcttctagtgtagcccctggtcccaatgccatatcagcagccagggcct

SEQ ID NO: 411143 - DNA, 140 bp, Artificial Sequence
  Synthetic
aggccctggctgctgatatgtctacaatacttggcactgacagcattgataaaaccaaaaaagagaaagccacctctgcctagtgtcaggaaattagtagaggatagatggaacaaatccgaccttttgggacagcggtg

SEQ ID NO: 411144 - DNA, 140 bp, Artificial Sequence
  Synthetic
caccgctgtcccaaaaggtcggatttgttccatctatcctctactaatttcctgacactaggcagaggtggctttctcttttttggttttatcaatgctgtcagtgccaagtattgtagacatatcagcagccagggcct

SEQ ID NO: 411145 - DNA, 140 bp, Artificial Sequence
  Synthetic
aggccctggctgctgatatgaaggatcaacagctcctagggatttggggttgctctggaaaactcatctgcaccactgctgtgccttggaatgctagttggagtaataaatctctggatagaccttttgggacagcggtg

SEQ ID NO: 411146 - DNA, 140 bp, Artificial Sequence
  Synthetic
caccgctgtcccaaaaggtctatccagagatttattactccaactagcattccaaggcacagcagtggtgcagatgagttttccagagcaaccccaaatccctaggagctgttgatccttcatatcagcagccagggcct

SEQ ID NO: 411147 - DNA, 140 bp, Artificial Sequence
  Synthetic
aggccctggctgctgatatgataagtgaaagagcagaagacagtggcaatgagagcgatggggacacagatgaattgtcaaaactggtggagatggggaactataatcttggggatgctagaccttttgggacagcggtg

SEQ ID NO: 411148 - DNA, 140 bp, Artificial Sequence
  Synthetic
caccgctgtcccaaaaggtctagcatccccaagattatagttccccatctccaccagttttgacaattcatctgtgtccccatcgctctcattgccactgtcttctgctctttcacttatcatatcagcagccagggcct

SEQ ID NO: 411149 - DNA, 140 bp, Artificial Sequence
  Synthetic
aggccctggctgctgatatgtatagaaagattttaaaacaaaagaaaatagatgggttatttgagagaataagagacagagcagaagacagtggctatgagagtgagggggacacagagggaccttttgggacagcggtg

SEQ ID NO: 411150 - DNA, 140 bp, Artificial Sequence
  Synthetic
caccgctgtcccaaaaggtccctctgtgtccccctcactctcatagccactgtcttctgctctgtctcttattctctcaaataacccatctattttcttttgttttaaaatctttctatacatatcagcagccagggcct

SEQ ID NO: 411151 - DNA, 140 bp, Artificial Sequence
  Synthetic
aggccctggctgctgatatgttaatatgtggaaaaataacatggtagaacagatgcatgaagacataatcagtttatgggatgaaagcctaaaaccatgtgtaaagctaacccctctctggaccttttgggacagcggtg

SEQ ID NO: 411152 - DNA, 140 bp, Artificial Sequence
  Synthetic
caccgctgtcccaaaaggtccagagaggggttagctttacacatggttttaggctttcatcccataaactgattatgtcttcatgcatctgttctaccatgttatttttccacatattaacatatcagcagccagggcct

SEQ ID NO: 411153 - DNA, 140 bp, Artificial Sequence
  Synthetic
  misc_feature (92)..(92): n is a, c, g, or t
atacgccatgctgggtctccctagcaatagtagcataagctacagaagaaatgaaaaactgctctttctttataaccacagaagtaagaganaagcagaagcaagaatatgcgcttttctcgtacttgggagtcggccat

SEQ ID NO: 411154 - DNA, 140 bp, Artificial Sequence
  Synthetic
  misc_feature (49)..(49): n is a, c, g, or t
atggccgactcccaagtacgagaaaagcgcatattcttgcttctgcttntctcttacttctgtggttataaagaaagagcagtttttcatttcttctgtagcttatgctactattgctagggagacccagcatggcgtat

SEQ ID NO: 411155 - DNA, 140 bp, Artificial Sequence
  Synthetic
atacgccatgctgggtctccaattaattgtaccagacctaacaacaatacaagaacaagtgtacgtataggaccaggacaagcattctatgcaacaggtgacataataggggatataagacgtacttgggagtcggccat

SEQ ID NO: 411156 - DNA, 140 bp, Artificial Sequence
  Synthetic
atggccgactcccaagtacgtcttatatcccctattatgtcacctgttgcatagaatgcttgtcctggtcctatacgtacacttgttcttgtattgttgttaggtctggtacaattaattggagacccagcatggcgtat

SEQ ID NO: 411157 - DNA, 140 bp, Artificial Sequence
  Synthetic
atacgccatgctgggtctccaccttatgaatgctagcataaagggagaaatgaaaaactgctctttcaatataaccacagaaataagagataagaaacagaaagtgcatgcactcttttacgtacttgggagtcggccat

SEQ ID NO: 411158 - DNA, 140 bp, Artificial Sequence
  Synthetic
atggccgactcccaagtacgtaaaagagtgcatgcactttctgtttcttatctcttatttctgtggttatattgaaagagcagtttttcatttctccctttatgctagcattcataaggtggagacccagcatggcgtat

SEQ ID NO: 411159 - DNA, 140 bp, Artificial Sequence
  Synthetic
atacgccatgctgggtctccaataaaaaattgctctttcaaagtaaacacggaactaaaagataagaaacataaagagtatgcacttttttataaacttgatatagtaccacttgatggccgtacttgggagtcggccat

SEQ ID NO: 411160 - DNA, 140 bp, Artificial Sequence
  Synthetic
atggccgactcccaagtacggccatcaagtggtactatatcaagtttataaaaaagtgcatactctttatgtttcttatcttttagttccgtgtttactttgaaagagcaattttttattggagacccagcatggcgtat

SEQ ID NO: 411161 - DNA, 140 bp, Artificial Sequence
  Synthetic
aggccctggctgctgatatgctaactcctcaggaggggatatagaaataacaacacatagttttaattgtggaggagaatttttctattgtgacacatcaggcctgtttaatagcacttggaccttttgggacagcggtg

SEQ ID NO: 411162 - DNA, 140 bp, Artificial Sequence
  Synthetic
caccgctgtcccaaaaggtccaagtgctattaaacaggcctgatgtgtcacaatagaaaaattctcctccacaattaaaactatgtgttgttatttctatatcccctcctgaggagttagcatatcagcagccagggcct

SEQ ID NO: 411163 - DNA, 140 bp, Artificial Sequence
  Synthetic
atacgccatgctgggtctccatatactttaaaccatcttcaggaggagacatagaaattacaacacatacttttaattgtggaggagaatttttctattgtaatacaacagccttgtttacgtacttgggagtcggccat

SEQ ID NO: 411164 - DNA, 140 bp, Artificial Sequence
  Synthetic
atggccgactcccaagtacgtaaacaaggctgttgtattacaatagaaaaattctcctccacaattaaaagtatgtgttgtaatttctatgtctcctcctgaagatggtttaaagtatatggagacccagcatggcgtat

SEQ ID NO: 411165 - DNA, 140 bp, Artificial Sequence
  Synthetic
  misc_feature (27)..(27): n is a, c, g, or t
atacgccatgctgggtctccacaaatncgcaaaatggtactattacactgcaatgcagaataaaacaaattgtaagaatgtggcagagaacaggacaagcaatgtatgcccctcccagcacgtacttgggagtcggccat

SEQ ID NO: 411166 - DNA, 140 bp, Artificial Sequence
  Synthetic
  misc_feature (114)..(114): n is a, c, g, or t
atggccgactcccaagtacgtgctgggaggggcatacattgcttgtcctgttctctgccacattcttacaatttgttttattctgcattgcagtgtaatagtaccattttgcgnatttgtggagacccagcatggcgtat

SEQ ID NO: 411167 - DNA, 140 bp, Artificial Sequence
  Synthetic
aggccctggctgctgatatgagacaaagtacaaggataggacctgggcaagtattctatacacatagcataataggagacataagacaagcatattgtaacattagtgcagaaaaatggagaccttttgggacagcggtg

SEQ ID NO: 411168 - DNA, 140 bp, Artificial Sequence
  Synthetic
caccgctgtcccaaaaggtctccatttttctgcactaatgttacaatatgcttgtcttatgtctcctattatgctatgtgtatagaatacttgcccaggtcctatccttgtactttgtctcatatcagcagccagggcct

SEQ ID NO: 411169 - DNA, 140 bp, Artificial Sequence
  Synthetic
atacgccatgctgggtctcccaccctcaggaggagatctagagattacaacacatagctttaattgtagaggagaatttttctattgcaatacatcagaactgtttaatggaacatataacgtacttgggagtcggccat

SEQ ID NO: 411170 - DNA, 140 bp, Artificial Sequence
  Synthetic
atggccgactcccaagtacgttatatgttccattaaacagttctgatgtattgcaatagaaaaattctcctctacaattaaagctatgtgttgtaatctctagatctcctcctgagggtgggagacccagcatggcgtat

SEQ ID NO: 411171 - DNA, 140 bp, Artificial Sequence
  Synthetic
atacgccatgctgggtctccaacaaattataaacacatggcaggaggtaggacgggcaatatacgcccctcccattgcaggaaacataatatgtatatcaaacatcacaggactactcttcgtacttgggagtcggccat

SEQ ID NO: 411172 - DNA, 140 bp, Artificial Sequence
  Synthetic
atggccgactcccaagtacgaagagtagtcctgtgatgtttgatatacatattatgtttcctgcaatgggaggggcgtatattgcccgtcctacctcctgccatgtgtttataatttgttggagacccagcatggcgtat

SEQ ID NO: 411173 - DNA, 140 bp, Artificial Sequence
  Synthetic
aggccctggctgctgatatgtcaagggactgagactggggtgggaggctctcaagtacctgtggaatcttctggtgtattggggacaggagataaagagtagtgctattaatttgcttgagaccttttgggacagcggtg

SEQ ID NO: 411174 - DNA, 140 bp, Artificial Sequence
  Synthetic
caccgctgtcccaaaaggtctcaagcaaattaatagcactactctttatctcctgtccccaatacaccagaagattccacaggtacttgagagcctcccaccccagtctcagtcccttgacatatcagcagccagggcct

SEQ ID NO: 411175 - DNA, 140 bp, Artificial Sequence
  Synthetic
atacgccatgctgggtctccccatagcagtagtaacagctgggtggacagatagagttatagaattaggacaaagactttgtagagctattttacacatacctagaagaatcagacaaggcgtacttgggagtcggccat

SEQ ID NO: 411176 - DNA, 140 bp, Artificial Sequence
  Synthetic
atggccgactcccaagtacgccttgtctgattcttctaggtatgtgtaaaatagctctacaaagtctttgtcctaattctataactctatctgtccacccagctgttactactgctatggggagacccagcatggcgtat

SEQ ID NO: 411177 - DNA, 140 bp, Artificial Sequence
  Synthetic
aggccctggctgctgatatggcctagtaggatggcctgagattagggaaagaataagaagaactcaagaactacctagaactcctccagcagagtcccaagaggagcgaaagcatgggtcgaccttttgggacagcggtg

SEQ ID NO: 411178 - DNA, 140 bp, Artificial Sequence
  Synthetic
caccgctgtcccaaaaggtcgacccatgctttcgctcctcttgggactctgctggaggagttctaggtagttcttgagttcttcttattctttccctaatctcaggccatcctactaggccatatcagcagccagggcct

SEQ ID NO: 411179 - DNA, 140 bp, Artificial Sequence
  Synthetic
aggccctggctgctgatatgtgtggaattggtttaacatatcaaattggctgtggtatataaaaatattcataatgatagtaggaggcttgataggattaagaatagtttttgctgtgctgaccttttgggacagcggtg

SEQ ID NO: 411180 - DNA, 140 bp, Artificial Sequence
  Synthetic
caccgctgtcccaaaaggtcagcacagcaaaaactattcttaatcctatcaagcctcctactatcattatgaatatttttatataccacagccaatttgatatgttaaaccaattccacacatatcagcagccagggcct

SEQ ID NO: 411181 - DNA, 140 bp, Artificial Sequence
  Synthetic
atacgccatgctgggtctccgtggcgcccgaacagggactcgaaagcgaaagtaaccagagaagatctctcgacgcaggactcggcttgctgagtgcacacagcaagaggcgaggggcggcgtacttgggagtcggccat

SEQ ID NO: 411182 - DNA, 140 bp, Artificial Sequence
  Synthetic
atggccgactcccaagtacgccgcccctcgcctcttgctgtgtgcactcagcaagccgagtcctgcgtcgagagatcttctctggttactttcgctttcgagtccctgttcgggcgccacggagacccagcatggcgtat

SEQ ID NO: 411183 - DNA, 140 bp, Artificial Sequence
  Synthetic
aggccctggctgctgatatgatcattatttaatacagtagcaaccctctattgtgtacatcaacggatagatgtaaaagacaccaaggaagctctagataaaatagaggaaatacaaaatgaccttttgggacagcggtg

SEQ ID NO: 411184 - DNA, 140 bp, Artificial Sequence
  Synthetic
caccgctgtcccaaaaggtcattttgtatttcctctattttatctagagcttccttggtgtcttttacatctatccgttgatgtacacaatagagggttgctactgtattaaataatgatcatatcagcagccagggcct

SEQ ID NO: 411185 - DNA, 140 bp, Artificial Sequence
  Synthetic
aggccctggctgctgatatggtggtccatagtattcatagaatataggaaaatattaaaacaaagaagaatagacaggttaattgatagaataagagaaagagcagaagacagtggcaatgaccttttgggacagcggtg

SEQ ID NO: 411186 - DNA, 140 bp, Artificial Sequence
  Synthetic
caccgctgtcccaaaaggtcattgccactgtcttctgctctttctcttattctatcaattaacctgtctattcttctttgttttaatattttcctatattctatgaatactatggaccaccatatcagcagccagggcct

SEQ ID NO: 411187 - DNA, 140 bp, Artificial Sequence
  Synthetic
aggccctggctgctgatatgtcagagattatgtagataggttctttaaaactctcagagctgagcaagctacacaggaggtaaaaggttggatgacagaaacattactggtccaaaatgcgaccttttgggacagcggtg

SEQ ID NO: 411188 - DNA, 140 bp, Artificial Sequence
  Synthetic
caccgctgtcccaaaaggtcgcattttggaccagtaatgtttctgtcatccaaccttttacctcctgtgtagcttgctcagctctgagagttttaaagaacctatctacataatctctgacatatcagcagccagggcct

SEQ ID NO: 411189 - DNA, 140 bp, Artificial Sequence
  Synthetic
atacgccatgctgggtctcctgatgctccttgggatgtggacgatctgtagtgctgcaggaggattgtgggtcactgtctattatggtgtacctgcggggagagatgctgacaccaccctcgtacttgggagtcggccat

SEQ ID NO: 411190 - DNA, 140 bp, Artificial Sequence
  Synthetic
atggccgactcccaagtacgagggtggtgtcagcatctctccccgcaggtacaccataatagacagtgacccacaatcctcctgcagcactacagatcgtccacatcccaaggagcatcaggagacccagcatggcgtat

SEQ ID NO: 411191 - DNA, 140 bp, Artificial Sequence
  Synthetic
atacgccatgctgggtctccgatggaggcagacgaagtgaaaaactgttctttcaatgttacaaatacaaacataaaagataaaaggcagagggaatatgcccttttttataaatatgatcgtacttgggagtcggccat

SEQ ID NO: 411192 - DNA, 140 bp, Artificial Sequence
  Synthetic
atggccgactcccaagtacgatcatatttataaaaaagggcatattccctctgccttttatcttttatgtttgtatttgtaacattgaaagaacagtttttcacttcgtctgcctccatcggagacccagcatggcgtat

SEQ ID NO: 411193 - DNA, 140 bp, Artificial Sequence
  Synthetic
atacgccatgctgggtctccggagagcatttcgtgcaataaaagctataacaggagatataagaaaagcacattgtaacattagtgaagaaaattggaatgacactttaaaacagctagccgtacttgggagtcggccat

SEQ ID NO: 411194 - DNA, 140 bp, Artificial Sequence
  Synthetic
atggccgactcccaagtacggctagctgttttaaagtgtcattccaattttcttcactaatgttacaatgtgcttttcttatatctcctgttatagcttttattgcacgaaatgctctccggagacccagcatggcgtat

SEQ ID NO: 411195 - DNA, 140 bp, Artificial Sequence
  Synthetic
aggccctggctgctgatatgcctcaggaggggacccagagattgtaatgcacagttttaattgtggaggagaatttttttactgtaatacaacaaaactgtttaatagtacttggtatgggaccttttgggacagcggtg

SEQ ID NO: 411196 - DNA, 140 bp, Artificial Sequence
  Synthetic
caccgctgtcccaaaaggtcccataccaagtactattaaacagttttgttgtattacagtaaaaaaattctcctccacaattaaaactgtgcattacaatctctgggtcccctcctgaggcatatcagcagccagggcct

SEQ ID NO: 411197 - DNA, 140 bp, Artificial Sequence
  Synthetic
atacgccatgctgggtctccggacgagcattttatgcaacaggggaaataataggagacattagaaaggcacattgtaatattagtggagtacaatggaataaaacaatgcaacaggtaacgtacttgggagtcggccat

SEQ ID NO: 411198 - DNA, 140 bp, Artificial Sequence
  Synthetic
atggccgactcccaagtacgttacctgttgcattgttttattccattgtactccactaatattacaatgtgcctttctaatgtctcctattatttcccctgttgcataaaatgctcgtccggagacccagcatggcgtat

SEQ ID NO: 411199 - DNA, 140 bp, Artificial Sequence
  Synthetic
aggccctggctgctgatatgatagtacaaagagcttttagagctattctccacatacctacaagaataagacagggcttggaaagggctttgctataagatgggtggcaagtggtcaaaagaccttttgggacagcggtg

SEQ ID NO: 411200 - DNA, 140 bp, Artificial Sequence
  Synthetic
caccgctgtcccaaaaggtcttttgaccacttgccacccatcttatagcaaagccctttccaagccctgtcttattcttgtaggtatgtggagaatagctctaaaagctctttgtactatcatatcagcagccagggcct

SEQ ID NO: 411201 - DNA, 140 bp, Artificial Sequence
  Synthetic
aggccctggctgctgatatggaggaagtgggttttccagtcagacctcaggtacccttaagaccaatgacttacaaggcagcttttgatcttagcttctttttaaaagaaaaggggggacgaccttttgggacagcggtg

SEQ ID NO: 411202 - DNA, 140 bp, Artificial Sequence
  Synthetic
caccgctgtcccaaaaggtcgtccccccttttcttttaaaaagaagctaagatcaaaagctgccttgtaagtcattggtcttaagggtacctgaggtctgactggaaaacccacttcctccatatcagcagccagggcct

SEQ ID NO: 411203 - DNA, 140 bp, Artificial Sequence
  Synthetic
atacgccatgctgggtctccggtgtttgctataaaatgggtggcaagtggtcacgaagtagcatagttggatggcctactgtaagggacaggatgagacaaacccctccagcagcagaagcgtacttgggagtcggccat

SEQ ID NO: 411204 - DNA, 140 bp, Artificial Sequence
  Synthetic
atggccgactcccaagtacgcttctgctgctggaggggtttgtctcatcctgtcccttacagtaggccatccaactatgctacttcgtgaccacttgccacccattttatagcaaacaccggagacccagcatggcgtat

SEQ ID NO: 411205 - DNA, 140 bp, Artificial Sequence
  Synthetic
aggccctggctgctgatatgatggcctactgtaagggacaggatgagacaaacccctccagcagcagaaggggtgggagcagtgtctcgagacttagaaaaccggggggcaatcacaagcgaccttttgggacagcggtg

SEQ ID NO: 411206 - DNA, 140 bp, Artificial Sequence
  Synthetic
caccgctgtcccaaaaggtcgcttgtgattgccccccggttttctaagtctcgagacactgctcccaccccttctgctgctggaggggtttgtctcatcctgtcccttacagtaggccatcatatcagcagccagggcct

SEQ ID NO: 411207 - DNA, 140 bp, Artificial Sequence
  Synthetic
aggccctggctgctgatatgcagtatgcattaggaatcattcaagcacaaccagataagagtgaatcagaattagtcaatcaaataatagaacagttaataaaaaaggaaaaggtctaccgaccttttgggacagcggtg

SEQ ID NO: 411208 - DNA, 140 bp, Artificial Sequence
  Synthetic
caccgctgtcccaaaaggtcggtagaccttttccttttttattaactgttctattatttgattgactaattctgattcactcttatctggttgtgcttgaatgattcctaatgcatactgcatatcagcagccagggcct

SEQ ID NO: 411209 - DNA, 140 bp, Artificial Sequence
  Synthetic
aggccctggctgctgatatgatcatatgtatgtctcaaagaaagctaaaggttggttttatagacatcactatgaaagcaggcatccaaaagtaagttcagaagtacacatcccactagggaccttttgggacagcggtg

SEQ ID NO: 411210 - DNA, 140 bp, Artificial Sequence
  Synthetic
caccgctgtcccaaaaggtccctagtgggatgtgtacttctgaacttacttttggatgcctgctttcatagtgatgtctataaaaccaacctttagctttctttgagacatacatatgatcatatcagcagccagggcct

SEQ ID NO: 411211 - DNA, 140 bp, Artificial Sequence
  Synthetic
aggccctggctgctgatatgtatgaaagcaggcatccaaaagtaagttcagaagtacacatcccactaggggatgctagattagtagtaagaacatattggggtctgcatacaggagaaagaccttttgggacagcggtg

SEQ ID NO: 411212 - DNA, 140 bp, Artificial Sequence
  Synthetic
caccgctgtcccaaaaggtctttctcctgtatgcagaccccaatatgttcttactactaatctagcatcccctagtgggatgtgtacttctgaacttacttttggatgcctgctttcatacatatcagcagccagggcct

SEQ ID NO: 411213 - DNA, 140 bp, Artificial Sequence
  Synthetic
aggccctggctgctgatatggccacctttgcctagtgttaggaaattagcagaggacagatggaacaagccccagaagaccaggggccccagagagagccatacaatgaatggatgttaggaccttttgggacagcggtg

SEQ ID NO: 411214 - DNA, 140 bp, Artificial Sequence
  Synthetic
caccgctgtcccaaaaggtcctaacatccattcattgtatggctctctctggggcccctggtcttctggggcttgttccatctgtcctctgctaatttcctaacactaggcaaaggtggccatatcagcagccagggcct

SEQ ID NO: 411215 - DNA, 140 bp, Artificial Sequence
  Synthetic
aggccctggctgctgatatggaacaggccagagccaacagccccgccagcagagagcttcgggttcggagaggagataaccccctctccgaagcaggagcagaaaaccgagggactgtacgaccttttgggacagcggtg

SEQ ID NO: 411216 - DNA, 140 bp, Artificial Sequence
  Synthetic
caccgctgtcccaaaaggtcgtacagtccctcggttttctgctcctgcttcggagagggggttatctcctctccgaacccgaagctctctgctggcggggctgttggctctggcctgttccatatcagcagccagggcct

SEQ ID NO: 411217 - DNA, 140 bp, Artificial Sequence
  Synthetic
aggccctggctgctgatatgggaaggagttgaagctataataagaattctgcaacaattactgtttgttcatttcagaattgggtgccaacatagcagaataggcattattcgagggagagaccttttgggacagcggtg

SEQ ID NO: 411218 - DNA, 140 bp, Artificial Sequence
  Synthetic
caccgctgtcccaaaaggtctctccctcgaataatgcctattctgctatgttggcacccaattctgaaatgaacaaacagtaattgttgcagaattcttattatagcttcaactccttcccatatcagcagccagggcct

SEQ ID NO: 411219 - DNA, 140 bp, Artificial Sequence
  Synthetic
aggccctggctgctgatatgcagagcagaccagagccatcagccccaccagaagagagcttcaggtttggggaagagacaacaactccctctcagaagcaggagccgatagacaaggaacgaccttttgggacagcggtg

SEQ ID NO: 411220 - DNA, 140 bp, Artificial Sequence
  Synthetic
caccgctgtcccaaaaggtcgttccttgtctatcggctcctgcttctgagagggagttgttgtctcttccccaaacctgaagctctcttctggtggggctgatggctctggtctgctctgcatatcagcagccagggcct

SEQ ID NO: 411221 - DNA, 140 bp, Artificial Sequence
  Synthetic
aggccctggctgctgatatgctaaagcaaaggaaaatagacaggttaattgagagaataagagaaagagcagaagacagtggcaatgagagtgatggggacacagaggaattgtcaacacgaccttttgggacagcggtg

SEQ ID NO: 411222 - DNA, 140 bp, Artificial Sequence
  Synthetic
caccgctgtcccaaaaggtcgtgttgacaattcctctgtgtccccatcactctcattgccactgtcttctgctctttctcttattctctcaattaacctgtctattttcctttgctttagcatatcagcagccagggcct

SEQ ID NO: 411223 - DNA, 140 bp, Artificial Sequence
  Synthetic
aggccctggctgctgatatggggacccgacaggcccgaaggaatcgaagaagaaggtggagagagagacagagacagatccggacaattagtgaacggattcttagcacttatctgggtcgaccttttgggacagcggtg

SEQ ID NO: 411224 - DNA, 140 bp, Artificial Sequence
  Synthetic
caccgctgtcccaaaaggtcgacccagataagtgctaagaatccgttcactaattgtccggatctgtctctgtctctctctccaccttcttcttcgattccttcgggcctgtcgggtccccatatcagcagccagggcct

SEQ ID NO: 411225 - DNA, 140 bp, Artificial Sequence
  Synthetic
aggccctggctgctgatatgaatataagaaactaagaaagcaaaggaaaatagactggttacttgaaagaataagtgaaagagcagaagacagtggcaatgagagtgatggagacactgagaccttttgggacagcggtg

SEQ ID NO: 411226 - DNA, 140 bp, Artificial Sequence
  Synthetic
caccgctgtcccaaaaggtctcagtgtctccatcactctcattgccactgtcttctgctctttcacttattctttcaagtaaccagtctattttcctttgctttcttagtttcttatattcatatcagcagccagggcct

SEQ ID NO: 411227 - DNA, 140 bp, Artificial Sequence
  Synthetic
atacgccatgctgggtctccgtaggttccatgagaacatgaaaggagaaatacaaaactgctcttacaatgtgaccacagaattaagggataagagaaagaaagtatattcacttttttacgtacttgggagtcggccat

SEQ ID NO: 411228 - DNA, 140 bp, Artificial Sequence
  Synthetic
atggccgactcccaagtacgtaaaaaagtgaatatactttctttctcttatcccttaattctgtggtcacattgtaagagcagttttgtatttctcctttcatgttctcatggaacctacggagacccagcatggcgtat

SEQ ID NO: 411229 - DNA, 140 bp, Artificial Sequence
  Synthetic
aggccctggctgctgatatggcctgtgtggaaagaagcaaaaaccactttattttgtgcatcagatgctaagggacatacaacagaagtgcataatatatgggctacacatgcctgtgtagaccttttgggacagcggtg

SEQ ID NO: 411230 - DNA, 140 bp, Artificial Sequence
  Synthetic
caccgctgtcccaaaaggtctacacaggcatgtgtagcccatatattatgcacttctgttgtatgtcccttagcatctgatgcacaaaataaagtggtttttgcttctttccacacaggccatatcagcagccagggcct

SEQ ID NO: 411231 - DNA, 140 bp, Artificial Sequence
  Synthetic
aggccctggctgctgatatgttatatattaataaattgcaattcctcaaccataacacaagcctgtccaaaggtctcttttgacccaattcctatacattattgtgctccagctggttatgaccttttgggacagcggtg

SEQ ID NO: 411232 - DNA, 140 bp, Artificial Sequence
  Synthetic
caccgctgtcccaaaaggtcataaccagctggagcacaataatgtataggaattgggtcaaaagagacctttggacaggcttgtgttatggttgaggaattgcaatttattaatatataacatatcagcagccagggcct

SEQ ID NO: 411233 - DNA, 140 bp, Artificial Sequence
  Synthetic
atacgccatgctgggtctccgtggcgcccgaacagggacttgaaagtgaaagttaaccagaggagctctctcgacgcaggactcggcttgctgaaagcgcgcacggcaagaggcgaggggcgtacttgggagtcggccat

SEQ ID NO: 411234 - DNA, 140 bp, Artificial Sequence
  Synthetic
atggccgactcccaagtacgcccctcgcctcttgccgtgcgcgctttcagcaagccgagtcctgcgtcgagagagctcctctggttaactttcactttcaagtccctgttcgggcgccacggagacccagcatggcgtat

SEQ ID NO: 411235 - DNA, 140 bp, Artificial Sequence
  Synthetic
aggccctggctgctgatatgaaaagtgtacatataggaccaggacaagcattctatgcaacaggggacataataggggatataagacgagcacattgtaatgtcagtagagtagactggtgaccttttgggacagcggtg

SEQ ID NO: 411236 - DNA, 140 bp, Artificial Sequence
  Synthetic
caccgctgtcccaaaaggtcaccagtctactctactgacattacaatgtgctcgtcttatatcccctattatgtcccctgttgcatagaatgcttgtcctggtcctatatgtacacttttcatatcagcagccagggcct

SEQ ID NO: 411237 - DNA, 140 bp, Artificial Sequence
  Synthetic
atacgccatgctgggtctcccaatgctacatctacagttaataatagcattagtgaagacatgagaaattgctcttttaatgtaaccacagaactaagagataagaaacagaaagtgtatcgtacttgggagtcggccat

SEQ ID NO: 411238 - DNA, 140 bp, Artificial Sequence
  Synthetic
atggccgactcccaagtacgatacactttctgtttcttatctcttagttctgtggttacattaaaagagcaatttctcatgtcttcactaatgctattattaactgtagatgtagcattgggagacccagcatggcgtat

SEQ ID NO: 411239 - DNA, 140 bp, Artificial Sequence
  Synthetic
aggccctggctgctgatatgaaaacaataacttttactaactcctcaggaggggatctagaaattacaacacatagttttaattgtggaggagaatttttctattgtaatacatcaggccgaccttttgggacagcggtg

SEQ ID NO: 411240 - DNA, 140 bp, Artificial Sequence
  Synthetic
caccgctgtcccaaaaggtcggcctgatgtattacaatagaaaaattctcctccacaattaaaactatgtgttgtaatttctagatcccctcctgaggagttagtaaaagttattgttttcatatcagcagccagggcct

SEQ ID NO: 411241 - DNA, 140 bp, Artificial Sequence
  Synthetic
aggccctggctgctgatatgcccaactactgttaaatggaagtctagcagcagaagaggtaataattagatctaaaaatatcacagacaataccaaaaacataatagtacagtttaaagagaccttttgggacagcggtg

SEQ ID NO: 411242 - DNA, 140 bp, Artificial Sequence
  Synthetic
caccgctgtcccaaaaggtctctttaaactgtactattatgtttttggtattgtctgtgatatttttagatctaattattacctcttctgctgctagacttccatttaacagtagttgggcatatcagcagccagggcct

SEQ ID NO: 411243 - DNA, 140 bp, Artificial Sequence
  Synthetic
aggccctggctgctgatatgtaaactttacttcaccctcaggaggggacctagaaattacaacacatagctttaattgtagaggagaatttttctattgcaatacatcacaactgtttaagaccttttgggacagcggtg

SEQ ID NO: 411244 - DNA, 140 bp, Artificial Sequence
  Synthetic
caccgctgtcccaaaaggtcttaaacagttgtgatgtattgcaatagaaaaattctcctctacaattaaagctatgtgttgtaatttctaggtcccctcctgagggtgaagtaaagtttacatatcagcagccagggcct

SEQ ID NO: 411245 - DNA, 140 bp, Artificial Sequence
  Synthetic
atacgccatgctgggtctcctaactatagggccaggacgagcattctatgcaacaggagagattgtaggaaatataagactagcacattgtaatattagtagaaaagattggaatgacaccgtacttgggagtcggccat

SEQ ID NO: 411246 - DNA, 140 bp, Artificial Sequence
  Synthetic
atggccgactcccaagtacggtgtcattccaatcttttctactaatattacaatgtgctagtcttatatttcctacaatctctcctgttgcatagaatgctcgtcctggccctatagttaggagacccagcatggcgtat

SEQ ID NO: 411247 - DNA, 140 bp, Artificial Sequence
  Synthetic
atacgccatgctgggtctcctaatttttaaaccgcctgcaggaggagacatagaaattacaatgcatacttttaattgtggaggggaatttttctattgcaacacaacagaattgtttgacgtacttgggagtcggccat

SEQ ID NO: 411248 - DNA, 140 bp, Artificial Sequence
  Synthetic
atggccgactcccaagtacgtcaaacaattctgttgtgttgcaatagaaaaattcccctccacaattaaaagtatgcattgtaatttctatgtctcctcctgcaggcggtttaaaaattaggagacccagcatggcgtat

SEQ ID NO: 411249 - DNA, 140 bp, Artificial Sequence
  Synthetic
atacgccatgctgggtctccacctggatggagtgggataggcaaattagtaattacacagaagaaatatacagattgcttgaagactcgcaaaaccagcaggaaaagaatgaacaagattcgtacttgggagtcggccat

SEQ ID NO: 411250 - DNA, 140 bp, Artificial Sequence
  Synthetic
atggccgactcccaagtacgaatcttgttcattcttttcctgctggttttgcgagtcttcaagcaatctgtatatttcttctgtgtaattactaatttgcctatcccactccatccaggtggagacccagcatggcgtat

SEQ ID NO: 411251 - DNA, 140 bp, Artificial Sequence
  Synthetic
aggccctggctgctgatatgctcctggtatattggggtcgggaactaaaaattagtgctattaatttgcttgataccatagcaatagcagtagctggctggacagatagggttatagaaagaccttttgggacagcggtg

SEQ ID NO: 411252 - DNA, 140 bp, Artificial Sequence
  Synthetic
caccgctgtcccaaaaggtctttctataaccctatctgtccagccagctactgctattgctatggtatcaagcaaattaatagcactaatttttagttcccgaccccaatataccaggagcatatcagcagccagggcct

SEQ ID NO: 411253 - DNA, 140 bp, Artificial Sequence
  Synthetic
aggccctggctgctgatatggcagcatagtgggatggcctgaggttagggaaagaatgagacgtgctcctccagcagcaccaggagtaggagcagtatctcaagatttagataaacatgggaccttttgggacagcggtg

SEQ ID NO: 411254 - DNA, 140 bp, Artificial Sequence
  Synthetic
caccgctgtcccaaaaggtcccatgtttatctaaatcttgagatactgctcctactcctggtgctgctggaggagcacgtctcattctttccctaacctcaggccatcccactatgctgccatatcagcagccagggcct

SEQ ID NO: 411255 - DNA, 140 bp, Artificial Sequence
  Synthetic
aggccctggctgctgatatgattgcagcgaggactgtggaaattctgggacacagcagtctcaagggactgagactagtgagggaagccctccaatacctgggagctctggcggtgtactgaccttttgggacagcggtg

SEQ ID NO: 411256 - DNA, 140 bp, Artificial Sequence
  Synthetic
caccgctgtcccaaaaggtcagtacaccgccagagctcccaggtattggagggcttccctcactagtctcagtcccttgagactgctgtgtcccagaatttccacagtcctcgctgcaatcatatcagcagccagggcct

SEQ ID NO: 411257 - DNA, 140 bp, Artificial Sequence
  Synthetic
aggccctggctgctgatatggaagctgttagacattttcctaggccatggcttcatagcttaggacaatatatctataacacctatggggatacttgggagggagttgaagccataataagaccttttgggacagcggtg

SEQ ID NO: 411258 - DNA, 140 bp, Artificial Sequence
  Synthetic
caccgctgtcccaaaaggtcttattatggcttcaactccctcccaagtatccccataggtgttatagatatattgtcctaagctatgaagccatggcctaggaaaatgtctaacagcttccatatcagcagccagggcct

SEQ ID NO: 411259 - DNA, 140 bp, Artificial Sequence
  Synthetic
atacgccatgctgggtctcccatctattatagtagtagttgtgtggaccatagtatatatagaatataagaaactaagaaagcaaaggaaaatagactggttacttgaaagaataagtgacgtacttgggagtcggccat

SEQ ID NO: 411260 - DNA, 140 bp, Artificial Sequence
  Synthetic
atggccgactcccaagtacgtcacttattctttcaagtaaccagtctattttcctttgctttcttagtttcttatattctatatatactatggtccacacaactactactataatagatgggagacccagcatggcgtat

SEQ ID NO: 411261 - DNA, 140 bp, Artificial Sequence
  Synthetic
atacgccatgctgggtctccctaatattgatgacggaaacatgaaaaactgctctttcaatgttaccacaaacataggaaataagttgcagaaagaatatgctcttttttataaacttgacgtacttgggagtcggccat

SEQ ID NO: 411262 - DNA, 140 bp, Artificial Sequence
  Synthetic
atggccgactcccaagtacgtcaagtttataaaaaagagcatattctttctgcaacttatttcctatgtttgtggtaacattgaaagagcagtttttcatgtttccgtcatcaatattagggagacccagcatggcgtat

SEQ ID NO: 411263 - DNA, 140 bp, Artificial Sequence
  Synthetic
aggccctggctgctgatatgtaataaattgtaatacctcagccattacacaggcctgcccaaaggtatcctttgaaccaattcccatacattattgtgctccagctggttttgcgattctgaccttttgggacagcggtg

SEQ ID NO: 411264 - DNA, 140 bp, Artificial Sequence
  Synthetic
caccgctgtcccaaaaggtcagaatcgcaaaaccagctggagcacaataatgtatgggaattggttcaaaggatacctttgggcaggcctgtgtaatggctgaggtattacaatttattacatatcagcagccagggcct

SEQ ID NO: 411265 - DNA, 140 bp, Artificial Sequence
  Synthetic
atacgccatgctgggtctcctaaaccagatagctacaaaattaagagaacaatataataaaacaaaaatattctttgctccatcctcaggaggggacccagaaattacaatgcaccgtttcgtacttgggagtcggccat

SEQ ID NO: 411266 - DNA, 140 bp, Artificial Sequence
  Synthetic
atggccgactcccaagtacgaaacggtgcattgtaatttctgggtcccctcctgaggatggagcaaagaatatttttgttttattatattgttctcttaattttgtagctatctggtttaggagacccagcatggcgtat

SEQ ID NO: 411267 - DNA, 140 bp, Artificial Sequence
  Synthetic
aggccctggctgctgatatgttctttgctccatcctcaggaggggacccagaaattacaatgcaccgttttatttgtggaggggaatttttctactgtaatacaacaaaactgtttagtagaccttttgggacagcggtg

SEQ ID NO: 411268 - DNA, 140 bp, Artificial Sequence
  Synthetic
caccgctgtcccaaaaggtctactaaacagttttgttgtattacagtagaaaaattcccctccacaaataaaacggtgcattgtaatttctgggtcccctcctgaggatggagcaaagaacatatcagcagccagggcct

SEQ ID NO: 411269 - DNA, 140 bp, Artificial Sequence
  Synthetic
atacgccatgctgggtctcccaaggaaaagtatacagctaggaccaggacgagcattttttacaacaggggatataataggggacataaaaaaggcacattgtaacattagtggagcacacgtacttgggagtcggccat

SEQ ID NO: 411270 - DNA, 140 bp, Artificial Sequence
  Synthetic
atggccgactcccaagtacgtgtgctccactaatgttacaatgtgccttttttatgtcccctattatatcccctgttgtaaaaaatgctcgtcctggtcctagctgtatacttttccttgggagacccagcatggcgtat

SEQ ID NO: 411271 - DNA, 140 bp, Artificial Sequence
  Synthetic
atacgccatgctgggtctccccgcaacatacctagcagaataagacagggcttagaaatagctttgcaataaaatggggggcaagcgttcaaaatatagcagatggcctgagataagagacgtacttgggagtcggccat

SEQ ID NO: 411272 - DNA, 140 bp, Artificial Sequence
  Synthetic
atggccgactcccaagtacgtctcttatctcaggccatctgctatattttgaacgcttgccccccattttattgcaaagctatttctaagccctgtcttattctgctaggtatgttgcggggagacccagcatggcgtat

SEQ ID NO: 411273 - DNA, 140 bp, Artificial Sequence
  Synthetic
aggccctggctgctgatatgataagttgtaacacctcagtcattacacaggcctgtccaaaggtatcctttgagccaattcccatacattattgtgccccggctggttttgcgattctaagaccttttgggacagcggtg

SEQ ID NO: 411274 - DNA, 140 bp, Artificial Sequence
  Synthetic
caccgctgtcccaaaaggtcttagaatcgcaaaaccagccggggcacaataatgtatgggaattggctcaaaggatacctttggacaggcctgtgtaatgactgaggtgttacaacttatcatatcagcagccagggcct

SEQ ID NO: 411275 - DNA, 140 bp, Artificial Sequence
  Synthetic
atacgccatgctgggtctccaagaaataaaaaactgctctttcaatatcaccacaggcataagagataaggtacagaaggcatatgcatatttttataaacttgatgtagtaccaatagacgtacttgggagtcggccat

SEQ ID NO: 411276 - DNA, 140 bp, Artificial Sequence
  Synthetic
atggccgactcccaagtacgtctattggtactacatcaagtttataaaaatatgcatatgccttctgtaccttatctcttatgcctgtggtgatattgaaagagcagttttttatttcttggagacccagcatggcgtat

SEQ ID NO: 411277 - DNA, 140 bp, Artificial Sequence
  Synthetic
aggccctggctgctgatatggaaagatacctaagggatcaacagctcctagggatttggggctgctctggaaaactcatctgcaccactaatgtgccctggaatgctagttggagtaatagaccttttgggacagcggtg

SEQ ID NO: 411278 - DNA, 140 bp, Artificial Sequence
  Synthetic
caccgctgtcccaaaaggtctattactccaactagcattccagggcacattagtggtgcagatgagttttccagagcagccccaaatccctaggagctgttgatcccttaggtatctttccatatcagcagccagggcct

SEQ ID NO: 411279 - DNA, 140 bp, Artificial Sequence
  Synthetic
aggccctggctgctgatatgaaagcactaacagacatagtaccactgactgaagaagcagaattagaattggcagagaacagggagattctaaaagaaccagtacatggagtatattatggaccttttgggacagcggtg

SEQ ID NO: 411280 - DNA, 140 bp, Artificial Sequence
  Synthetic
caccgctgtcccaaaaggtccataatatactccatgtactggttcttttagaatctccctgttctctgccaattctaattctgcttcttcagtcagtggtactatgtctgttagtgctttcatatcagcagccagggcct

SEQ ID NO: 411281 - DNA, 140 bp, Artificial Sequence
  Synthetic
atacgccatgctgggtctccaggttgtttccctaactgagacaacaaatcaaaagactgaactacatgcaatctatctagccttgcaggattcaggatcagaagtaaatatagtaacagacgtacttgggagtcggccat

SEQ ID NO: 411282 - DNA, 140 bp, Artificial Sequence
  Synthetic
atggccgactcccaagtacgtctgttactatatttacttctgatcctgaatcctgcaaggctagatagattgcatgtagttcagtcttttgatttgttgtctcagttagggaaacaacctggagacccagcatggcgtat

SEQ ID NO: 411283 - DNA, 140 bp, Artificial Sequence
  Synthetic
atacgccatgctgggtctcccagtaagggaaagaatcagacaaactcctgcaagagcagatgaaagacgcaggcaaaaccctgcagcagcagaaggagtaggaccagtgtctcaagatttcgtacttgggagtcggccat

SEQ ID NO: 411284 - DNA, 140 bp, Artificial Sequence
  Synthetic
atggccgactcccaagtacgaaatcttgagacactggtcctactccttctgctgctgcagggttttgcctgcgtctttcatctgctcttgcaggagtttgtctgattctttcccttactgggagacccagcatggcgtat

SEQ ID NO: 411285 - DNA, 140 bp, Artificial Sequence
  Synthetic
atacgccatgctgggtctccgtggcgcccgaacagggactcgaaagcgaaagttaaccagagaagttctctcgacgcaggactcggcttgctgaagtgcgcacggcaagaggcgaggggccgtacttgggagtcggccat

SEQ ID NO: 411286 - DNA, 140 bp, Artificial Sequence
  Synthetic
atggccgactcccaagtacggcccctcgcctcttgccgtgcgcacttcagcaagccgagtcctgcgtcgagagaacttctctggttaactttcgctttcgagtccctgttcgggcgccacggagacccagcatggcgtat

SEQ ID NO: 411287 - DNA, 140 bp, Artificial Sequence
  Synthetic
aggccctggctgctgatatgcctgacttggcctggctggaagcacaagaggaaggggaagtaggctttccagttagacctcaggtacccttaagaccaatgactcggagtgcagctatacgaccttttgggacagcggtg

SEQ ID NO: 411288 - DNA, 140 bp, Artificial Sequence
  Synthetic
caccgctgtcccaaaaggtcgtatagctgcactccgagtcattggtcttaagggtacctgaggtctaactggaaagcctacttccccttcctcttgtgcttccagccaggccaagtcaggcatatcagcagccagggcct

SEQ ID NO: 411289 - DNA, 140 bp, Artificial Sequence
  Synthetic
aggccctggctgctgatatgtggtttagcataacaaactggctgtggtatataagaatattcataatgatagtaggaggcttgataggtttaagaataatttttgctgtgctttctataggaccttttgggacagcggtg

SEQ ID NO: 411290 - DNA, 140 bp, Artificial Sequence
  Synthetic
caccgctgtcccaaaaggtcctatagaaagcacagcaaaaattattcttaaacctatcaagcctcctactatcattatgaatattcttatataccacagccagtttgttatgctaaaccacatatcagcagccagggcct

SEQ ID NO: 411291 - DNA, 140 bp, Artificial Sequence
  Synthetic
aggccctggctgctgatatgcatattggggtctgcatacaggagaaaaagactggcacttgggtcatggggtctccatagaatggaggctaaaaagatatagcacacaaatagatcctgagaccttttgggacagcggtg

SEQ ID NO: 411292 - DNA, 140 bp, Artificial Sequence
  Synthetic
caccgctgtcccaaaaggtctcaggatctatttgtgtgctatatctttttagcctccattctatggagaccccatgacccaagtgccagtctttttctcctgtatgcagaccccaatatgcatatcagcagccagggcct

SEQ ID NO: 411293 - DNA, 140 bp, Artificial Sequence
  Synthetic
aggccctggctgctgatatgtttaccccagaagtaatacccatgttttcagcattatcagaaggggccactccacaagatttaaacaccatgttaaatacagtggggggacatcaagcaggaccttttgggacagcggtg

SEQ ID NO: 411294 - DNA, 140 bp, Artificial Sequence
  Synthetic
caccgctgtcccaaaaggtcctgcttgatgtccccccactgtatttaacatggtgtttaaatcttgtggagtggccccttctgataatgctgaaaacatgggtattacttctggggtaaacatatcagcagccagggcct

SEQ ID NO: 411295 - DNA, 140 bp, Artificial Sequence
  Synthetic
aggccctggctgctgatatgtaattttttagggaaaatttggccttcccacaaggggaggcccggaaatttccttcagaacaggccagagccaacagccccgccagcagagagcttcggggaccttttgggacagcggtg

SEQ ID NO: 411296 - DNA, 140 bp, Artificial Sequence
  Synthetic
caccgctgtcccaaaaggtccccgaagctctctgctggcggggctgttggctctggcctgttctgaaggaaatttccgggcctccccttgtgggaaggccaaattttccctaaaaaattacatatcagcagccagggcct

SEQ ID NO: 411297 - DNA, 140 bp, Artificial Sequence
  Synthetic
aggccctggctgctgatatgcataatgtctgggctacacatgcctgtgtacccacagaccccaacccacaagaaatagttttggaaaatgtaacagaaaattttaacatgtggaaaaatggaccttttgggacagcggtg

SEQ ID NO: 411298 - DNA, 140 bp, Artificial Sequence
  Synthetic
caccgctgtcccaaaaggtccatttttccacatgttaaaattttctgttacattttccaaaactatttcttgtgggttggggtctgtgggtacacaggcatgtgtagcccagacattatgcatatcagcagccagggcct

SEQ ID NO: 411299 - DNA, 140 bp, Artificial Sequence
  Synthetic
atacgccatgctgggtctccgttaacccctctctgcgttactttaaattgtagccatgaggtcatggttgctgccaatgccgatggcaccactgccggtaccaccactgccattggagagcgtacttgggagtcggccat

SEQ ID NO: 411300 - DNA, 140 bp, Artificial Sequence
  Synthetic
atggccgactcccaagtacgctctccaatggcagtggtggtaccggcagtggtgccatcggcattggcagcaaccatgacctcatggctacaatttaaagtaacgcagagaggggttaacggagacccagcatggcgtat

SEQ ID NO: 411301 - DNA, 140 bp, Artificial Sequence
  Synthetic
atacgccatgctgggtctccgaaggagtatgcactttcagatagacttgttctagttccacttgctgaagagctagagaagagtagtagtgggggggattgtttaataaatagtagtactcgtacttgggagtcggccat

SEQ ID NO: 411302 - DNA, 140 bp, Artificial Sequence
  Synthetic
atggccgactcccaagtacgagtactactatttattaaacaatcccccccactactactcttctctagctcttcagcaagtggaactagaacaagtctatctgaaagtgcatactccttcggagacccagcatggcgtat

SEQ ID NO: 411303 - DNA, 140 bp, Artificial Sequence
  Synthetic
atacgccatgctgggtctccggatccagaaatcacaacacatatgtttaattgtggaggagaatttttctattgtaacacatcaggtctgtttaatatcactgacagaacggggcctgatcgtacttgggagtcggccat

SEQ ID NO: 411304 - DNA, 140 bp, Artificial Sequence
  Synthetic
atggccgactcccaagtacgatcaggccccgttctgtcagtgatattaaacagacctgatgtgttacaatagaaaaattctcctccacaattaaacatatgtgttgtgatttctggatccggagacccagcatggcgtat

SEQ ID NO: 411305 - DNA, 140 bp, Artificial Sequence
  Synthetic
aggccctggctgctgatatgagaaccagtacatggagtgtattatgatccatcaaaagacttaatagcagaaatacagaagcaggggcaaggccaatggacatatcaaatttaccaagaggaccttttgggacagcggtg

SEQ ID NO: 411306 - DNA, 140 bp, Artificial Sequence
  Synthetic
caccgctgtcccaaaaggtcctcttggtaaatttgatatgtccattggccttgcccctgcttctgtatttctgctattaagtcttttgatggatcataatacactccatgtactggttctcatatcagcagccagggcct

SEQ ID NO: 411307 - DNA, 140 bp, Artificial Sequence
  Synthetic
aggccctggctgctgatatgtcctttagtaaaattatggtaccagttagaaacagaccccataccaggagcagagactttctatgtagatggggcagatgatagggacacaaaattaggagaccttttgggacagcggtg

SEQ ID NO: 411308 - DNA, 140 bp, Artificial Sequence
  Synthetic
caccgctgtcccaaaaggtctcctaattttgtgtccctatcatctgccccatctacatagaaagtctctgctcctggtatggggtctgtttctaactggtaccataattttactaaaggacatatcagcagccagggcct

SEQ ID NO: 411309 - DNA, 140 bp, Artificial Sequence
  Synthetic
aggccctggctgctgatatgtgcaacagcaaagcaatttgctgagggctatagaggctcaacagcatctgttgagactcacggtctggggcattaaacagctccaggcaagagtcctggcgaccttttgggacagcggtg

SEQ ID NO: 411310 - DNA, 140 bp, Artificial Sequence
  Synthetic
caccgctgtcccaaaaggtcgccaggactcttgcctggagctgtttaatgccccagaccgtgagtctcaacagatgctgttgagcctctatagccctcagcaaattgctttgctgttgcacatatcagcagccagggcct

SEQ ID NO: 411311 - DNA, 140 bp, Artificial Sequence
  Synthetic
aggccctggctgctgatatggtgatgcatatttttcagttcccttagataaagactttaggaagtatactgcatttaccatacctagtataaacaatgagacaccagggattagatatcagaccttttgggacagcggtg

SEQ ID NO: 411312 - DNA, 140 bp, Artificial Sequence
  Synthetic
caccgctgtcccaaaaggtctgatatctaatccctggtgtctcattgtttatactaggtatggtaaatgcagtatacttcctaaagtctttatctaagggaactgaaaaatatgcatcaccatatcagcagccagggcct

SEQ ID NO: 411313 - DNA, 140 bp, Artificial Sequence
  Synthetic
aggccctggctgctgatatgagttagaaaaagaacccatagtaggagcagaaactttctatgtagatggggcagctaatagggaaactaaaaaaggaaaagcaggatatgttactgacaggaccttttgggacagcggtg

SEQ ID NO: 411314 - DNA, 140 bp, Artificial Sequence
  Synthetic
caccgctgtcccaaaaggtcctgtcagtaacatatcctgcttttccttttttagtttccctattagctgccccatctacatagaaagtttctgctcctactatgggttctttttctaactcatatcagcagccagggcct

SEQ ID NO: 411315 - DNA, 140 bp, Artificial Sequence
  Synthetic
aggccctggctgctgatatgtctcaagacttagataaatatggagcacttacaagtagcaacacagcccaaaataatgctgattgtgcctggctgcaagcacaagaggaggaagaagaaggaccttttgggacagcggtg

SEQ ID NO: 411316 - DNA, 140 bp, Artificial Sequence
  Synthetic
caccgctgtcccaaaaggtccttcttcttcctcctcttgtgcttgcagccaggcacaatcagcattattttgggctgtgttgctacttgtaagtgctccatatttatctaagtcttgagacatatcagcagccagggcct

SEQ ID NO: 411317 - DNA, 140 bp, Artificial Sequence
  Synthetic
atacgccatgctgggtctccaatcactcaggaggggacctagaaattacaacacatagcttcaattgtagaggagaatttttttattgcgatacatcaatcctgtttaatagtacatactcgtacttgggagtcggccat

SEQ ID NO: 411318 - DNA, 140 bp, Artificial Sequence
  Synthetic
atggccgactcccaagtacgagtatgtactattaaacaggattgatgtatcgcaataaaaaaattctcctctacaattgaagctatgtgttgtaatttctaggtcccctcctgagtgattggagacccagcatggcgtat

SEQ ID NO: 411319 - DNA, 140 bp, Artificial Sequence
  Synthetic
atacgccatgctgggtctccagtaataacaacatactgggggctgcatacaggagaaagagattggcatctgggtcagggagtctccatagaatggaggcaggggaagtataggacacaacgtacttgggagtcggccat

SEQ ID NO: 411320 - DNA, 140 bp, Artificial Sequence
  Synthetic
atggccgactcccaagtacgttgtgtcctatacttcccctgcctccattctatggagactccctgacccagatgccaatctctttctcctgtatgcagcccccagtatgttgttattactggagacccagcatggcgtat

SEQ ID NO: 411321 - DNA, 140 bp, Artificial Sequence
  Synthetic
aggccctggctgctgatatgggcatttcctatggaaggaagaagcggagacagcgacgaacaacttcttacaacagtaagaatcatcaggatcttgtaccagagcagtaagtataattaagaccttttgggacagcggtg

SEQ ID NO: 411322 - DNA, 140 bp, Artificial Sequence
  Synthetic
caccgctgtcccaaaaggtcttaattatacttactgctctggtacaagatcctgatgattcttactgttgtaagaagttgttcgtcgctgtctccgcttcttccttccataggaaatgcccatatcagcagccagggcct

SEQ ID NO: 411323 - DNA, 140 bp, Artificial Sequence
  Synthetic
atacgccatgctgggtctcctagtaccgatgatagtagtgggggaggagtgatggagaaaggagaaatgaaaaactgctctttcaatgttaccacacacctatatgataaggtgaaaaaacgtacttgggagtcggccat

SEQ ID NO: 411324 - DNA, 140 bp, Artificial Sequence
  Synthetic
atggccgactcccaagtacgttttttcaccttatcatataggtgtgtggtaacattgaaagagcagtttttcatttctcctttctccatcactcctcccccactactatcatcggtactaggagacccagcatggcgtat

SEQ ID NO: 411325 - DNA, 140 bp, Artificial Sequence
  Synthetic
atacgccatgctgggtctccctctatcaaagcagtaagtagtatatgtaatgcaacctttagtaatatttgcaatagtagcattagtagtagtagcaataatagcaatagttgtgtggtccgtacttgggagtcggccat

SEQ ID NO: 411326 - DNA, 140 bp, Artificial Sequence
  Synthetic
atggccgactcccaagtacggaccacacaactattgctattattgctactactactaatgctactattgcaaatattactaaaggttgcattacatatactacttactgctttgatagagggagacccagcatggcgtat

SEQ ID NO: 411327 - DNA, 140 bp, Artificial Sequence
  Synthetic
aggccctggctgctgatatgcctgtccaaaggtatcctttgaaccaattcccatacattattgtaccccggctggttttgcgattctacagtgtaatgataagaagttcaatggaacagggaccttttgggacagcggtg

SEQ ID NO: 411328 - DNA, 140 bp, Artificial Sequence
  Synthetic
caccgctgtcccaaaaggtccctgttccattgaacttcttatcattacactgtagaatcgcaaaaccagccggggtacaataatgtatgggaattggttcaaaggatacctttggacaggcatatcagcagccagggcct

SEQ ID NO: 411329 - DNA, 140 bp, Artificial Sequence
  Synthetic
aggccctggctgctgatatgtgtgtggaaagaagcaaaaaccactttattttgtgcatcagacgctgaagcctatagcaaagaagtgcataatgtatgggctacacatgcctgtgtacccgaccttttgggacagcggtg

SEQ ID NO: 411330 - DNA, 140 bp, Artificial Sequence
  Synthetic
caccgctgtcccaaaaggtcgggtacacaggcatgtgtagcccatacattatgcacttctttgctataggcttcagcgtctgatgcacaaaataaagtggtttttgcttctttccacacacatatcagcagccagggcct

SEQ ID NO: 411331 - DNA, 140 bp, Artificial Sequence
  Synthetic
atacgccatgctgggtctcctagttgcacctggctagaagcacaaaaggaagagggagaagaagtaggctttccagtcagaccacaagtgcctttaagacccatgacttataaagcagctcgtacttgggagtcggccat

SEQ ID NO: 411332 - DNA, 140 bp, Artificial Sequence
  Synthetic
atggccgactcccaagtacgagctgctttataagtcatgggtcttaaaggcacttgtggtctgactggaaagcctacttcttctccctcttccttttgtgcttctagccaggtgcaactaggagacccagcatggcgtat

SEQ ID NO: 411333 - DNA, 140 bp, Artificial Sequence
  Synthetic
aggccctggctgctgatatgccacccttagtttccctcaaatcactctttggcaacgaccccttgtcacagtaagaataggaggacagctaaaagaagctctattagatacaggagcagagaccttttgggacagcggtg

SEQ ID NO: 411334 - DNA, 140 bp, Artificial Sequence
  Synthetic
caccgctgtcccaaaaggtctctgctcctgtatctaatagagcttcttttagctgtcctcctattcttactgtgacaaggggtcgttgccaaagagtgatttgagggaaactaagggtggcatatcagcagccagggcct

SEQ ID NO: 411335 - DNA, 140 bp, Artificial Sequence
  Synthetic
atacgccatgctgggtctcctaataacacagtgaataggactatcagtgaacaggtagaaatgaaaaactgctctttcaatgtaaccacaaaagtaagagataagcaaaagaaagtaaatcgtacttgggagtcggccat

SEQ ID NO: 411336 - DNA, 140 bp, Artificial Sequence
  Synthetic
atggccgactcccaagtacgatttactttcttttgcttatctcttacttttgtggttacattgaaagagcagtttttcatttctacctgttcactgatagtcctattcactgtgttattaggagacccagcatggcgtat

SEQ ID NO: 411337 - DNA, 140 bp, Artificial Sequence
  Synthetic
atacgccatgctgggtctccatacaaaaatgtcagcacagtacaatgtacacatggaattagaccagtggtgtcaactcaattgctgttgaatggaagtctagcagcagaaaaggtaatacgtacttgggagtcggccat

SEQ ID NO: 411338 - DNA, 140 bp, Artificial Sequence
  Synthetic
atggccgactcccaagtacgtattaccttttctgctgctagacttccattcaacagcaattgagttgacaccactggtctaattccatgtgtacattgtactgtgctgacatttttgtatggagacccagcatggcgtat

SEQ ID NO: 411339 - DNA, 140 bp, Artificial Sequence
  Synthetic
atacgccatgctgggtctcccaaagaggctgtaacaattaactgtaccagacctaacaataacacaagaaaaggcatatatatagggccaggacgaagattcattgcaacaaacagaatccgtacttgggagtcggccat

SEQ ID NO: 411340 - DNA, 140 bp, Artificial Sequence
  Synthetic
atggccgactcccaagtacggattctgtttgttgcaatgaatcttcgtcctggccctatatatatgccttttcttgtgttattgttaggtctggtacagttaattgttacagcctctttgggagacccagcatggcgtat

SEQ ID NO: 411341 - DNA, 140 bp, Artificial Sequence
  Synthetic
aggccctggctgctgatatgaaggcatatatatagggccaggacgaagattcattgcaacaaacagaatcataggagatataagacaagcacattgtaatattagtgaacaggagtggaagaccttttgggacagcggtg

SEQ ID NO: 411342 - DNA, 140 bp, Artificial Sequence
  Synthetic
caccgctgtcccaaaaggtcttccactcctgttcactaatattacaatgtgcttgtcttatatctcctatgattctgtttgttgcaatgaatcttcgtcctggccctatatatatgccttcatatcagcagccagggcct

SEQ ID NO: 411343 - DNA, 140 bp, Artificial Sequence
  Synthetic
atacgccatgctgggtctcccaacaataaaatttgaaccatcctcaggaggggacatagaaattacaacacacacttttaattgtggaggagaatttttctattgtaacacaacacgactcgtacttgggagtcggccat

SEQ ID NO: 411344 - DNA, 140 bp, Artificial Sequence
  Synthetic
atggccgactcccaagtacgagtcgtgttgtgttacaatagaaaaattctcctccacaattaaaagtgtgtgttgtaatttctatgtcccctcctgaggatggttcaaattttattgttgggagacccagcatggcgtat

SEQ ID NO: 411345 - DNA, 140 bp, Artificial Sequence
  Synthetic
aggccctggctgctgatatgctgtgttactttaaattgcactgatctggtgaatgctactaatacggggaatgctactaataccactagtagtagctgggaaaagctagagaaaggagaagaccttttgggacagcggtg

SEQ ID NO: 411346 - DNA, 140 bp, Artificial Sequence
  Synthetic
caccgctgtcccaaaaggtcttctcctttctctagcttttcccagctactactagtggtattagtagcattccccgtattagtagcattcaccagatcagtgcaatttaaagtaacacagcatatcagcagccagggcct

SEQ ID NO: 411347 - DNA, 140 bp, Artificial Sequence
  Synthetic
atacgccatgctgggtctcccagataagaatattacactgccatgtagaataaaacaaattgtacacatgtggcagagagtaggacaagcaatgtatgcccctcccattgaaggaaagatcgtacttgggagtcggccat

SEQ ID NO: 411348 - DNA, 140 bp, Artificial Sequence
  Synthetic
atggccgactcccaagtacgatctttccttcaatgggaggggcatacattgcttgtcctactctctgccacatgtgtacaatttgttttattctacatggcagtgtaatattcttatctgggagacccagcatggcgtat

SEQ ID NO: 411349 - DNA, 140 bp, Artificial Sequence
  Synthetic
  misc_feature (81)..(81): n is a, c, g, or t
aggccctggctgctgatatgttagcaggaagatggccagtaaaaagaatacatacagacaatggcagcaatttcaccagtnctgcggttaaggccgcctgttggtgggcggggatcaagcgaccttttgggacagcggtg

SEQ ID NO: 411350 - DNA, 140 bp, Artificial Sequence
  Synthetic
  misc_feature (60)..(60): n is a, c, g, or t
caccgctgtcccaaaaggtcgcttgatccccgcccaccaacaggcggccttaaccgcagnactggtgaaattgctgccattgtctgtatgtattctttttactggccatcttcctgctaacatatcagcagccagggcct

SEQ ID NO: 411351 - DNA, 140 bp, Artificial Sequence
  Synthetic
aggccctggctgctgatatgtttctatagtgaatagagttaggcagggatactcaccattatcgtttcagaccctcctcccaagccagaggggacccgacaggccagaaggaatcgaagggaccttttgggacagcggtg

SEQ ID NO: 411352 - DNA, 140 bp, Artificial Sequence
  Synthetic
caccgctgtcccaaaaggtcccttcgattccttctggcctgtcgggtcccctctggcttgggaggagggtctgaaacgataatggtgagtatccctgcctaactctattcactatagaaacatatcagcagccagggcct

SEQ ID NO: 411353 - DNA, 140 bp, Artificial Sequence
  Synthetic
atacgccatgctgggtctccaacatgacctggatggagtgggataggcaaattagcaactacacaagtgaaatatacaccttgcttgaagtctcgcaaaaccagcaggaacaaaatgaaacgtacttgggagtcggccat

SEQ ID NO: 411354 - DNA, 140 bp, Artificial Sequence
  Synthetic
atggccgactcccaagtacgtttcattttgttcctgctggttttgcgagacttcaagcaaggtgtatatttcacttgtgtagttgctaatttgcctatcccactccatccaggtcatgttggagacccagcatggcgtat

SEQ ID NO: 411355 - DNA, 140 bp, Artificial Sequence
  Synthetic
atacgccatgctgggtctcctgggtggaatactataagggaaagaatgagacgaactgagccaggacgaactgagccagcagcagaaggggtgggagcagtatctcgagacctggaacaacgtacttgggagtcggccat

SEQ ID NO: 411356 - DNA, 140 bp, Artificial Sequence
  Synthetic
atggccgactcccaagtacgttgttccaggtctcgagatactgctcccaccccttctgctgctggctcagttcgtcctggctcagttcgtctcattctttcccttatagtattccacccaggagacccagcatggcgtat

SEQ ID NO: 411357 - DNA, 140 bp, Artificial Sequence
  Synthetic
aggccctggctgctgatatgaagtctgtggaattggtttgacatatcaaaatggctgtggtatataagaatattcataatgatagtaggaggcttgataggcttaagaatagtttttgctgaccttttgggacagcggtg

SEQ ID NO: 411358 - DNA, 140 bp, Artificial Sequence
  Synthetic
caccgctgtcccaaaaggtcagcaaaaactattcttaagcctatcaagcctcctactatcattatgaatattcttatataccacagccattttgatatgtcaaaccaattccacagacttcatatcagcagccagggcct

SEQ ID NO: 411359 - DNA, 140 bp, Artificial Sequence
  Synthetic
atacgccatgctgggtctccgcattgattgcagcgaggactgtggaacttctgggacacagcagtctcaggggactgagactggggtgggaagcccttaaatacctaaaaggtcttgtggcgtacttgggagtcggccat

SEQ ID NO: 411360 - DNA, 140 bp, Artificial Sequence
  Synthetic
atggccgactcccaagtacgccacaagaccttttaggtatttaagggcttcccaccccagtctcagtcccctgagactgctgtgtcccagaagttccacagtcctcgctgcaatcaatgcggagacccagcatggcgtat

SEQ ID NO: 411361 - DNA, 140 bp, Artificial Sequence
  Synthetic
atacgccatgctgggtctccgtagcaatagtagtagctaacgggacagataggattatagaagtattacaaagagctggtagagctattcttaacatacctagaaggataagacagggcccgtacttgggagtcggccat

SEQ ID NO: 411362 - DNA, 140 bp, Artificial Sequence
  Synthetic
atggccgactcccaagtacgggccctgtcttatccttctaggtatgttaagaatagctctaccagctctttgtaatacttctataatcctatctgtcccgttagctactactattgctacggagacccagcatggcgtat

SEQ ID NO: 411363 - DNA, 140 bp, Artificial Sequence
  Synthetic
atacgccatgctgggtctccgttctttcaatatgaccacagagttaagagataaaaaaaggcaagtgtatgcacttttttataaacttgatatagtgccaattgatggggaaaataatgacgtacttgggagtcggccat

SEQ ID NO: 411364 - DNA, 140 bp, Artificial Sequence
  Synthetic
atggccgactcccaagtacgtcattattttccccatcaattggcactatatcaagtttataaaaaagtgcatacacttgcctttttttatctcttaactctgtggtcatattgaaagaacggagacccagcatggcgtat

SEQ ID NO: 411365 - DNA, 140 bp, Artificial Sequence
  Synthetic
atacgccatgctgggtctccttgaaatagctttgcaataaaatggggggcaagtggtcaaaaagcagcatagttgggtggtctgcagtaagagagagaatcagacgaacccctccaacagcgtacttgggagtcggccat

SEQ ID NO: 411366 - DNA, 140 bp, Artificial Sequence
  Synthetic
atggccgactcccaagtacgctgttggaggggttcgtctgattctctctcttactgcagaccacccaactatgctgctttttgaccacttgccccccattttattgcaaagctatttcaaggagacccagcatggcgtat

SEQ ID NO: 411367 - DNA, 140 bp, Artificial Sequence
  Synthetic
aggccctggctgctgatatgagttgggtggtctgcagtaagagagagaatcagacgaacccctccaacagaagagagagcagaagcagcagcagttggagcaggagcggtatctcaagatgaccttttgggacagcggtg

SEQ ID NO: 411368 - DNA, 140 bp, Artificial Sequence
  Synthetic
caccgctgtcccaaaaggtcatcttgagataccgctcctgctccaactgctgctgcttctgctctctcttctgttggaggggttcgtctgattctctctcttactgcagaccacccaactcatatcagcagccagggcct

SEQ ID NO: 411369 - DNA, 140 bp, Artificial Sequence
  Synthetic
aggccctggctgctgatatgtggcaactctctattgtgtacatcaaaggatagagataaaagacaccaaggaagccttagataagatagaggaactacaaaacaagagcaagcaaaagacgaccttttgggacagcggtg

SEQ ID NO: 411370 - DNA, 140 bp, Artificial Sequence
  Synthetic
caccgctgtcccaaaaggtcgtcttttgcttgctcttgttttgtagttcctctatcttatctaaggcttccttggtgtcttttatctctatcctttgatgtacacaatagagagttgccacatatcagcagccagggcct

SEQ ID NO: 411371 - DNA, 140 bp, Artificial Sequence
  Synthetic
aggccctggctgctgatatgtcagaagagcttaaatctttatttaatacagtagtagtcctctactatgtacatcaaaaggtagatatacaggacaccaaggaagctttagacaagctaggaccttttgggacagcggtg

SEQ ID NO: 411372 - DNA, 140 bp, Artificial Sequence
  Synthetic
caccgctgtcccaaaaggtcctagcttgtctaaagcttccttggtgtcctgtatatctaccttttgatgtacatagtagaggactactactgtattaaataaagatttaagctcttctgacatatcagcagccagggcct

SEQ ID NO: 411373 - DNA, 140 bp, Artificial Sequence
  Synthetic
aggccctggctgctgatatgtggggtctccatagaatggaggctaaaaagatatagcacacaaatagatcctgacctggcagaccaactaattcatctgcattattttaactgtttttcagaccttttgggacagcggtg

SEQ ID NO: 411374 - DNA, 140 bp, Artificial Sequence
  Synthetic
caccgctgtcccaaaaggtctgaaaaacagttaaaataatgcagatgaattagttggtctgccaggtcaggatctatttgtgtgctatatctttttagcctccattctatggagaccccacatatcagcagccagggcct

SEQ ID NO: 411375 - DNA, 140 bp, Artificial Sequence
  Synthetic
aggccctggctgctgatatgtgaatatcaagcaggacataacaaggtaggatctctacaatatttggcactgaaagcattagtaacaccaacaaggacaaagccacctttgcctagtgttgaccttttgggacagcggtg

SEQ ID NO: 411376 - DNA, 140 bp, Artificial Sequence
  Synthetic
caccgctgtcccaaaaggtcaacactaggcaaaggtggctttgtccttgttggtgttactaatgctttcagtgccaaatattgtagagatcctaccttgttatgtcctgcttgatattcacatatcagcagccagggcct

SEQ ID NO: 411377 - DNA, 140 bp, Artificial Sequence
  Synthetic
aggccctggctgctgatatgatagtatatatagaatataggaaattggtaaaacaaagaagaatagactggttagttaaaagaattagggaaagagcagaagacagtggcaatgagagtggaccttttgggacagcggtg

SEQ ID NO: 411378 - DNA, 140 bp, Artificial Sequence
  Synthetic
caccgctgtcccaaaaggtccactctcattgccactgtcttctgctctttccctaattcttttaactaaccagtctattcttctttgttttaccaatttcctatattctatatatactatcatatcagcagccagggcct

SEQ ID NO: 411379 - DNA, 140 bp, Artificial Sequence
  Synthetic
aggccctggctgctgatatgaagaaattagcagaggacagatggaacaagccccagaagaccaggggccacagagggagccatacaatgaatggacattagaactgttagaagagcttaagaccttttgggacagcggtg

SEQ ID NO: 411380 - DNA, 140 bp, Artificial Sequence
  Synthetic
caccgctgtcccaaaaggtcttaagctcttctaacagttctaatgtccattcattgtatggctccctctgtggcccctggtcttctggggcttgttccatctgtcctctgctaatttcttcatatcagcagccagggcct

SEQ ID NO: 411381 - DNA, 140 bp, Artificial Sequence
  Synthetic
atacgccatgctgggtctccgcatgaagctgttagacattttcctaggccatggcttcatggattaggacaacatatttataacacctatggggatacttgggaaggagttgaagctatacgtacttgggagtcggccat

SEQ ID NO: 411382 - DNA, 140 bp, Artificial Sequence
  Synthetic
atggccgactcccaagtacgtatagcttcaactccttcccaagtatccccataggtgttataaatatgttgtcctaatccatgaagccatggcctaggaaaatgtctaacagcttcatgcggagacccagcatggcgtat

SEQ ID NO: 411383 - DNA, 140 bp, Artificial Sequence
  Synthetic
atacgccatgctgggtctcctgatcttggggatgataataatctgtagtgctgcagaaaacttgtgggttactgtctactatggggtacctgtgtggaaagacgcagagaccaccttattcgtacttgggagtcggccat

SEQ ID NO: 411384 - DNA, 140 bp, Artificial Sequence
  Synthetic
atggccgactcccaagtacgaataaggtggtctctgcgtctttccacacaggtaccccatagtagacagtaacccacaagttttctgcagcactacagattattatcatccccaagatcaggagacccagcatggcgtat

SEQ ID NO: 411385 - DNA, 140 bp, Artificial Sequence
  Synthetic
atacgccatgctgggtctccattgccactatcaccaatgatgtgagagaagaaataaaaaactgctctttcaatatgactacagaattaagggataagacacagaaagtatattcactttcgtacttgggagtcggccat

SEQ ID NO: 411386 - DNA, 140 bp, Artificial Sequence
  Synthetic
atggccgactcccaagtacgaaagtgaatatactttctgtgtcttatcccttaattctgtagtcatattgaaagagcagttttttatttcttctctcacatcattggtgatagtggcaatggagacccagcatggcgtat

SEQ ID NO: 411387 - DNA, 140 bp, Artificial Sequence
  Synthetic
aggccctggctgctgatatgctggactgtcaatgacatacagaagttagtgggaaaactaaattgggcaagtcagatttatccagggattaaagtaaagcaattatgtaaactccttagggaccttttgggacagcggtg

SEQ ID NO: 411388 - DNA, 140 bp, Artificial Sequence
  Synthetic
caccgctgtcccaaaaggtccctaaggagtttacataattgctttactttaatccctggataaatctgacttgcccaatttagttttcccactaacttctgtatgtcattgacagtccagcatatcagcagccagggcct

SEQ ID NO: 411389 - DNA, 140 bp, Artificial Sequence
  Synthetic
aggccctggctgctgatatgatgtgggggatgcatatttttcagttcccttagatgagagctttagaaagtatactgcattcactatacctagtataaataatgagacaccaggaattaggaccttttgggacagcggtg

SEQ ID NO: 411390 - DNA, 140 bp, Artificial Sequence
  Synthetic
caccgctgtcccaaaaggtcctaattcctggtgtctcattatttatactaggtatagtgaatgcagtatactttctaaagctctcatctaagggaactgaaaaatatgcatcccccacatcatatcagcagccagggcct

SEQ ID NO: 411391 - DNA, 140 bp, Artificial Sequence
  Synthetic
aggccctggctgctgatatgatcaactcaactgctgttaaatggcagtctagcagaaggaaaggtaatgattagatttgaaaatatcacaaacaatgccaaaaacataatagtacaacttgaccttttgggacagcggtg

SEQ ID NO: 411392 - DNA, 140 bp, Artificial Sequence
  Synthetic
caccgctgtcccaaaaggtcaagttgtactattatgtttttggcattgtttgtgatattttcaaatctaatcattacctttccttctgctagactgccatttaacagcagttgagttgatcatatcagcagccagggcct

SEQ ID NO: 411393 - DNA, 140 bp, Artificial Sequence
  Synthetic
atacgccatgctgggtctccaagtatacgtataggaccaggacaagcattctatgcaacaggaagcataatagggaatataagacaagcacattgtactgtcaatagatcagaatggaatcgtacttgggagtcggccat

SEQ ID NO: 411394 - DNA, 140 bp, Artificial Sequence
  Synthetic
atggccgactcccaagtacgattccattctgatctattgacagtacaatgtgcttgtcttatattccctattatgcttcctgttgcatagaatgcttgtcctggtcctatacgtatacttggagacccagcatggcgtat

SEQ ID NO: 411395 - DNA, 140 bp, Artificial Sequence
  Synthetic
atacgccatgctgggtctccgataatgataataccagctataggttgataagttgtaacacctcagtcattacacaggcctgtccaaaagtatcctttgagccaattcccatacattattcgtacttgggagtcggccat

SEQ ID NO: 411396 - DNA, 140 bp, Artificial Sequence
  Synthetic
atggccgactcccaagtacgaataatgtatgggaattggctcaaaggatacttttggacaggcctgtgtaatgactgaggtgttacaacttatcaacctatagctggtattatcattatcggagacccagcatggcgtat

SEQ ID NO: 411397 - DNA, 140 bp, Artificial Sequence
  Synthetic
aggccctggctgctgatatggatacctaaaggatcaacagctcctaggaatttggggctgctctggaaaactcatctgcaccactaatgtgccctggaactctagttggagtaataaatcgaccttttgggacagcggtg

SEQ ID NO: 411398 - DNA, 140 bp, Artificial Sequence
  Synthetic
caccgctgtcccaaaaggtcgatttattactccaactagagttccagggcacattagtggtgcagatgagttttccagagcagccccaaattcctaggagctgttgatcctttaggtatccatatcagcagccagggcct

SEQ ID NO: 411399 - DNA, 140 bp, Artificial Sequence
  Synthetic
aggccctggctgctgatatgcagcaggaaaagaatgaacaagacttattggcattggacaagtgggcaaatctgtggacttggtttaacatatcaaactggctgtggtatataaaaatatgaccttttgggacagcggtg

SEQ ID NO: 411400 - DNA, 140 bp, Artificial Sequence
  Synthetic
caccgctgtcccaaaaggtcatatttttatataccacagccagtttgatatgttaaaccaagtccacagatttgcccacttgtccaatgccaataagtcttgttcattcttttcctgctgcatatcagcagccagggcct

SEQ ID NO: 411401 - DNA, 140 bp, Artificial Sequence
  Synthetic
aggccctggctgctgatatgcatgggtaccagcacacaaaggaattggaggaaatgaacaagtagataaattagtcagttctggaatcagaaaagtactgtttttagatgggatagataagaccttttgggacagcggtg

SEQ ID NO: 411402 - DNA, 140 bp, Artificial Sequence
  Synthetic
caccgctgtcccaaaaggtcttatctatcccatctaaaaacagtacttttctgattccagaactgactaatttatctacttgttcatttcctccaattcctttgtgtgctggtacccatgcatatcagcagccagggcct

SEQ ID NO: 411403 - DNA, 140 bp, Artificial Sequence
  Synthetic
atacgccatgctgggtctcccctggctggaagcgcaagaggaagaggaggtaggctttccggtcaggccacaagtacctctaagaccaatgacttacaaggcagctcttgatctcagccacgtacttgggagtcggccat

SEQ ID NO: 411404 - DNA, 140 bp, Artificial Sequence
  Synthetic
atggccgactcccaagtacgtggctgagatcaagagctgccttgtaagtcattggtcttagaggtacttgtggcctgaccggaaagcctacctcctcttcctcttgcgcttccagccaggggagacccagcatggcgtat

SEQ ID NO: 411405 - DNA, 140 bp, Artificial Sequence
  Synthetic
atacgccatgctgggtctccaaaggtagatgacaccaaagaagctctggataaagtagaggaaatacaaaacaaaaagacagagcaggcagcagctgacacaggaagcagcaggagtgtccgtacttgggagtcggccat

SEQ ID NO: 411406 - DNA, 140 bp, Artificial Sequence
  Synthetic
atggccgactcccaagtacggacactcctgctgcttcctgtgtcagctgctgcctgctctgtctttttgttttgtatttcctctactttatccagagcttctttggtgtcatctacctttggagacccagcatggcgtat

SEQ ID NO: 411407 - DNA, 140 bp, Artificial Sequence
  Synthetic
aggccctggctgctgatatggttaaggccagggggaaagaaaaaatatagattaaaacatatcgtatgggcaagcagggaactagaacgattcgcagttaatcctggcctgttagaaacagaccttttgggacagcggtg

SEQ ID NO: 411408 - DNA, 140 bp, Artificial Sequence
  Synthetic
caccgctgtcccaaaaggtctgtttctaacaggccaggattaactgcgaatcgttctagttccctgcttgcccatacgatatgttttaatctatattttttctttccccctggccttaaccatatcagcagccagggcct

SEQ ID NO: 411409 - DNA, 140 bp, Artificial Sequence
  Synthetic
aggccctggctgctgatatggggacaggctacatccagtacaggcagggcccattccaccaggccagataagggaaccaaggggaagtgacatagcaggaaccaccagtacccttcaggagaccttttgggacagcggtg

SEQ ID NO: 411410 - DNA, 140 bp, Artificial Sequence
  Synthetic
caccgctgtcccaaaaggtctcctgaagggtactggtggttcctgctatgtcacttccccttggttcccttatctggcctggtggaatgggccctgcctgtactggatgtagcctgtccccatatcagcagccagggcct

SEQ ID NO: 411411 - DNA, 140 bp, Artificial Sequence
  Synthetic
aggccctggctgctgatatgaaatggagccagtagatcctaacatagagccctggaaccagccaggaagtcagcctaaaactgcttgtagccagtgttattgtaaaaaatgttgctatcagaccttttgggacagcggtg

SEQ ID NO: 411412 - DNA, 140 bp, Artificial Sequence
  Synthetic
caccgctgtcccaaaaggtctgatagcaacattttttacaataacactggctacaagcagttttaggctgacttcctggctggttccagggctctatgttaggatctactggctccatttcatatcagcagccagggcct

SEQ ID NO: 411413 - DNA, 140 bp, Artificial Sequence
  Synthetic
aggccctggctgctgatatgtagttgtgtggaccatagtatttatagaatataagaaaatattaaggcaaagaagaatagacaggttaattaaaagaataagtgaaagagcagaagacaggaccttttgggacagcggtg

SEQ ID NO: 411414 - DNA, 140 bp, Artificial Sequence
  Synthetic
caccgctgtcccaaaaggtcctgtcttctgctctttcacttattcttttaattaacctgtctattcttctttgccttaatattttcttatattctataaatactatggtccacacaactacatatcagcagccagggcct

SEQ ID NO: 411415 - DNA, 140 bp, Artificial Sequence
  Synthetic
atacgccatgctgggtctcctgaaaaactgctctttcaatgttaccaccaccataagagataagatgaagaaggaacatgctcttttttatagacttgatgtagcaccactagaaaataacgtacttgggagtcggccat

SEQ ID NO: 411416 - DNA, 140 bp, Artificial Sequence
  Synthetic
atggccgactcccaagtacgttattttctagtggtgctacatcaagtctataaaaaagagcatgttccttcttcatcttatctcttatggtggtggtaacattgaaagagcagtttttcaggagacccagcatggcgtat

SEQ ID NO: 411417 - DNA, 140 bp, Artificial Sequence
  Synthetic
aggccctggctgctgatatgaagatttgcactcaaccctggccttttagagtcagcaggaggttgtcaacaaataatgagccaattgcaaccagctctccaaacaggaacagaggaacttgaccttttgggacagcggtg

SEQ ID NO: 411418 - DNA, 140 bp, Artificial Sequence
  Synthetic
caccgctgtcccaaaaggtcaagttcctctgttcctgtttggagagctggttgcaattggctcattatttgttgacaacctcctgctgactctaaaaggccagggttgagtgcaaatcttcatatcagcagccagggcct

SEQ ID NO: 411419 - DNA, 140 bp, Artificial Sequence
  Synthetic
atacgccatgctgggtctcctaatgatgcagagaggcaattttagaggccagaagaggattaagtgtttcaactgtggcaaagaaggacacctagccagaaattgcagggcccctaggaacgtacttgggagtcggccat

SEQ ID NO: 411420 - DNA, 140 bp, Artificial Sequence
  Synthetic
atggccgactcccaagtacgttcctaggggccctgcaatttctggctaggtgtccttctttgccacagttgaaacacttaatcctcttctggcctctaaaattgcctctctgcatcattaggagacccagcatggcgtat

SEQ ID NO: 411421 - DNA, 140 bp, Artificial Sequence
  Synthetic
aggccctggctgctgatatgaaaccatgtgtaaagctaacccctctctgtgttactttagaatgtactaatgcaaattatactaaggtaaataacaatagcactgtaaattccactgagggaccttttgggacagcggtg

SEQ ID NO: 411422 - DNA, 140 bp, Artificial Sequence
  Synthetic
caccgctgtcccaaaaggtccctcagtggaatttacagtgctattgttatttaccttagtataatttgcattagtacattctaaagtaacacagagaggggttagctttacacatggtttcatatcagcagccagggcct

SEQ ID NO: 411423 - DNA, 140 bp, Artificial Sequence
  Synthetic
aggccctggctgctgatatggaagaagtataagaataggaccagggagcgcattttatacaacaggagaagtaataggaaatataagactagcatattgtaacattagtagagaaaaatggaccttttgggacagcggtg

SEQ ID NO: 411424 - DNA, 140 bp, Artificial Sequence
  Synthetic
caccgctgtcccaaaaggtccatttttctctactaatgttacaatatgctagtcttatatttcctattacttctcctgttgtataaaatgcgctccctggtcctattcttatacttcttccatatcagcagccagggcct

SEQ ID NO: 411425 - DNA, 140 bp, Artificial Sequence
  Synthetic
atacgccatgctgggtctccgaaatgaaaaactgctctttcaatataaccacagaattaagagataaggttaagaaagaatacgcgcttttctataaagttgatatagtatcaattaatgcgtacttgggagtcggccat

SEQ ID NO: 411426 - DNA, 140 bp, Artificial Sequence
  Synthetic
atggccgactcccaagtacgcattaattgatactatatcaactttatagaaaagcgcgtattctttcttaaccttatctcttaattctgtggttatattgaaagagcagtttttcatttcggagacccagcatggcgtat

SEQ ID NO: 411427 - DNA, 140 bp, Artificial Sequence
  Synthetic
atacgccatgctgggtctcctcatactcccatccaggataaaacaaattattatcagctggcaggaagtaggaacagcaacgtatgcccctcccatcagcggaataattagctgttcatccgtacttgggagtcggccat

SEQ ID NO: 411428 - DNA, 140 bp, Artificial Sequence
  Synthetic
atggccgactcccaagtacggatgaacagctaattattccgctgatgggaggggcatacgttgctgttcctacttcctgccagctgataataatttgttttatcctggatgggagtatgaggagacccagcatggcgtat

SEQ ID NO: 411429 - DNA, 140 bp, Artificial Sequence
  Synthetic
aggccctggctgctgatatgagcacagtacagtgtacacatggaattaagccagtggtatcaactcaactgctgttaaatggaagtctagcagcagagaaggtaataattagatctgaaggaccttttgggacagcggtg

SEQ ID NO: 411430 - DNA, 140 bp, Artificial Sequence
  Synthetic
caccgctgtcccaaaaggtccttcagatctaattattaccttctctgctgctagacttccatttaacagcagttgagttgataccactggcttaattccatgtgtacactgtactgtgctcatatcagcagccagggcct

SEQ ID NO: 411431 - DNA, 140 bp, Artificial Sequence
  Synthetic
aggccctggctgctgatatggctgttaaatggaagtctagcagcagagaaggtaataattagatctgaagatatgacagaccattccaaaaacataatagtacagtttacaaagcctgtagaccttttgggacagcggtg

SEQ ID NO: 411432 - DNA, 140 bp, Artificial Sequence
  Synthetic
caccgctgtcccaaaaggtctacaggctttgtaaactgtactattatgtttttggaatggtctgtcatatcttcagatctaattattaccttctctgctgctagacttccatttaacagccatatcagcagccagggcct

SEQ ID NO: 411433 - DNA, 140 bp, Artificial Sequence
  Synthetic
atacgccatgctgggtctccggggccaggacgagcattctatgcaacaggagatgtcataggagacataagacaagcacattgtaatattagtgaaaaagcattatcccaggtagttggacgtacttgggagtcggccat

SEQ ID NO: 411434 - DNA, 140 bp, Artificial Sequence
  Synthetic
atggccgactcccaagtacgtccaactacctgggataatgctttttcactaatattacaatgtgcttgtcttatgtctcctatgacatctcctgttgcatagaatgctcgtcctggccccggagacccagcatggcgtat

SEQ ID NO: 411435 - DNA, 140 bp, Artificial Sequence
  Synthetic
aggccctggctgctgatatggacaagcacattgtaatattagtgaaaaagcattatcccaggtagttggacaattaggagaacacctaaacaagagcatagcaatcatttttgcaccatcgaccttttgggacagcggtg

SEQ ID NO: 411436 - DNA, 140 bp, Artificial Sequence
  Synthetic
caccgctgtcccaaaaggtcgatggtgcaaaaatgattgctatgctcttgtttaggtgttctcctaattgtccaactacctgggataatgctttttcactaatattacaatgtgcttgtccatatcagcagccagggcct

SEQ ID NO: 411437 - DNA, 140 bp, Artificial Sequence
  Synthetic
aggccctggctgctgatatgagaggtaaaagacaccaaagaagctctagatgaagtggaaaaattacaaaagaaaagtcagcaaaaaatgcaacaggcagcaacaggtgaaggaagcagcgaccttttgggacagcggtg

SEQ ID NO: 411438 - DNA, 140 bp, Artificial Sequence
  Synthetic
caccgctgtcccaaaaggtcgctgcttccttcacctgttgctgcctgttgcattttttgctgacttttcttttgtaatttttccacttcatctagagcttctttggtgtcttttacctctcatatcagcagccagggcct

SEQ ID NO: 411439 - DNA, 140 bp, Artificial Sequence
  Synthetic
atacgccatgctgggtctccaatttttctattgcaacacaacaaaactgtttaatagtagctggaaacatgacaataacaccaataacacctggaatagaactaatggtaaaatcgatggcgtacttgggagtcggccat

SEQ ID NO: 411440 - DNA, 140 bp, Artificial Sequence
  Synthetic
atggccgactcccaagtacgccatcgattttaccattagttctattccaggtgttattggtgttattgtcatgtttccagctactattaaacagttttgttgtgttgcaatagaaaaattggagacccagcatggcgtat

SEQ ID NO: 411441 - DNA, 140 bp, Artificial Sequence
  Synthetic
aggccctggctgctgatatgttataaacatgtggcagagagtgggacaagcaatgtatgcccctcccatccaaggaaatattacatgtgtatcaaatattacaggactaatattgacaaggaccttttgggacagcggtg

SEQ ID NO: 411442 - DNA, 140 bp, Artificial Sequence
  Synthetic
caccgctgtcccaaaaggtccttgtcaatattagtcctgtaatatttgatacacatgtaatatttccttggatgggaggggcatacattgcttgtcccactctctgccacatgtttataacatatcagcagccagggcct

SEQ ID NO: 411443 - DNA, 140 bp, Artificial Sequence
  Synthetic
  misc_feature (31)..(31): n is a, c, g, or t
atacgccatgctgggtctcctgtcactttanagtgtaaaaatattacaaatgataatactacagaaatgagaaattgctctttcaatgcaaccacagaagtaagagataagaaacagagacgtacttgggagtcggccat

SEQ ID NO: 411444 - DNA, 140 bp, Artificial Sequence
  Synthetic
  misc_feature (110)..(110): n is a, c, g, or t
atggccgactcccaagtacgtctctgtttcttatctcttacttctgtggttgcattgaaagagcaatttctcatttctgtagtattatcatttgtaatatttttacactntaaagtgacaggagacccagcatggcgtat

SEQ ID NO: 411445 - DNA, 140 bp, Artificial Sequence
  Synthetic
aggccctggctgctgatatgccaacaataatacaaggaaaagtataaggataggaccaggacaagcattctatgcaacaggagacataataggaaatataagagaagcacattgtaacatgaccttttgggacagcggtg

SEQ ID NO: 411446 - DNA, 140 bp, Artificial Sequence
  Synthetic
caccgctgtcccaaaaggtcatgttacaatgtgcttctcttatatttcctattatgtctcctgttgcatagaatgcttgtcctggtcctatccttatacttttccttgtattattgttggcatatcagcagccagggcct

SEQ ID NO: 411447 - DNA, 140 bp, Artificial Sequence
  Synthetic
aggccctggctgctgatatgctcaggaggggatctagaagttacaacacatagttttaattgtggaggagagtttttctattgttacacatcagacctgtttaatagcactttgtatagcgaccttttgggacagcggtg

SEQ ID NO: 411448 - DNA, 140 bp, Artificial Sequence
  Synthetic
caccgctgtcccaaaaggtcgctatacaaagtgctattaaacaggtctgatgtgtaacaatagaaaaactctcctccacaattaaaactatgtgttgtaacttctagatcccctcctgagcatatcagcagccagggcct

SEQ ID NO: 411449 - DNA, 140 bp, Artificial Sequence
  Synthetic
atacgccatgctgggtctccgagctatagaagctttgcaaacagctggtagagctgtgctccacatacctagaagaataagacagggcttggaaaggcttttgctatagaatgggtaatacgtacttgggagtcggccat

SEQ ID NO: 411450 - DNA, 140 bp, Artificial Sequence
  Synthetic
atggccgactcccaagtacgtattacccattctatagcaaaagcctttccaagccctgtcttattcttctaggtatgtggagcacagctctaccagctgtttgcaaagcttctatagctcggagacccagcatggcgtat

SEQ ID NO: 411451 - DNA, 140 bp, Artificial Sequence
  Synthetic
atacgccatgctgggtctccattataaacttgtggcaggaggtaggacgagcgatgtacgctcctcccattgcaggaaacataacatgtaagtcaaccatcacaggattactattggtgccgtacttgggagtcggccat

SEQ ID NO: 411452 - DNA, 140 bp, Artificial Sequence
  Synthetic
atggccgactcccaagtacggcaccaatagtaatcctgtgatggttgacttacatgttatgtttcctgcaatgggaggagcgtacatcgctcgtcctacctcctgccacaagtttataatggagacccagcatggcgtat

SEQ ID NO: 411453 - DNA, 140 bp, Artificial Sequence
  Synthetic
atacgccatgctgggtctccggcatggagcaatcacaagcagcaatattaataatcctgcctgtgaatggctggaagcacagacagatgaggagtgggctttccagtcagaccacaggtacgtacttgggagtcggccat

SEQ ID NO: 411454 - DNA, 140 bp, Artificial Sequence
  Synthetic
atggccgactcccaagtacgtacctgtggtctgactggaaagcccactcctcatctgtctgtgcttccagccattcacaggcaggattattaatattgctgcttgtgattgctccatgccggagacccagcatggcgtat

SEQ ID NO: 411455 - DNA, 140 bp, Artificial Sequence
  Synthetic
aggccctggctgctgatatggaggaagtaggatttccagtcagacctcaagtacctttaagaccaatgacttttaagggagcttttgatctcagcttctttttaaaagaaaaggggggacgaccttttgggacagcggtg

SEQ ID NO: 411456 - DNA, 140 bp, Artificial Sequence
  Synthetic
caccgctgtcccaaaaggtcgtccccccttttcttttaaaaagaagctgagatcaaaagctcccttaaaagtcattggtcttaaaggtacttgaggtctgactggaaatcctacttcctccatatcagcagccagggcct

SEQ ID NO: 411457 - DNA, 140 bp, Artificial Sequence
  Synthetic
atacgccatgctgggtctccaagggcgcccgaacctgggaccccgaagcgaaagtaagaccagagaagttctctcgacgcaggactcggcttgctgaaagtgcacgcagcaagaggcgagcgtacttgggagtcggccat

SEQ ID NO: 411458 - DNA, 140 bp, Artificial Sequence
  Synthetic
atggccgactcccaagtacgctcgcctcttgctgcgtgcactttcagcaagccgagtcctgcgtcgagagaacttctctggtcttactttcgcttcggggtcccaggttcgggcgcccttggagacccagcatggcgtat

SEQ ID NO: 411459 - DNA, 140 bp, Artificial Sequence
  Synthetic
atacgccatgctgggtctccgcaggcatccaaaagtatgttcagaagtacatatcccaatagaggaagctagattagtaattagaacatattggggtttacaaccaggagaaaaagcttgcgtacttgggagtcggccat

SEQ ID NO: 411460 - DNA, 140 bp, Artificial Sequence
  Synthetic
atggccgactcccaagtacgcaagctttttctcctggttgtaaaccccaatatgttctaattactaatctagcttcctctattgggatatgtacttctgaacatacttttggatgcctgcggagacccagcatggcgtat

SEQ ID NO: 411461 - DNA, 140 bp, Artificial Sequence
  Synthetic
atacgccatgctgggtctccaggaggctctagataaagtagaggaaataaaaaataagagcaagcaaaagaaacagcaggcagaagctgacacaggaaacagcaataaggtcagtcaaaacgtacttgggagtcggccat

SEQ ID NO: 411462 - DNA, 140 bp, Artificial Sequence
  Synthetic
atggccgactcccaagtacgttttgactgaccttattgctgtttcctgtgtcagcttctgcctgctgtttcttttgcttgctcttattttttatttcctctactttatctagagcctcctggagacccagcatggcgtat

SEQ ID NO: 411463 - DNA, 140 bp, Artificial Sequence
  Synthetic
atacgccatgctgggtctcctacttatagtaatgctactacttaccctcatagtgtaaataatagtaatgaaataaaaaattgctctttcaatataaccacagaattaagagataagaatcgtacttgggagtcggccat

SEQ ID NO: 411464 - DNA, 140 bp, Artificial Sequence
  Synthetic
atggccgactcccaagtacgattcttatctcttaattctgtggttatattgaaagagcaattttttatttcattactattatttacactatgagggtaagtagtagcattactataagtaggagacccagcatggcgtat

SEQ ID NO: 411465 - DNA, 140 bp, Artificial Sequence
  Synthetic
aggccctggctgctgatatgagtacaaagactttgtagagctatctgcaacatacctacaagaattagacagggtttggaaacagctttgctataaaatggggagcaaatggtcaaaaaggaccttttgggacagcggtg

SEQ ID NO: 411466 - DNA, 140 bp, Artificial Sequence
  Synthetic
caccgctgtcccaaaaggtcctttttgaccatttgctccccattttatagcaaagctgtttccaaaccctgtctaattcttgtaggtatgttgcagatagctctacaaagtctttgtactcatatcagcagccagggcct

SEQ ID NO: 411467 - DNA, 140 bp, Artificial Sequence
  Synthetic
aggccctggctgctgatatgtaagaaatgccatattaggacgtatagttagtcctagttgtgaatatcaagcaggacataacaaggtaggatctctacagtacttggcactagcagcattgaccttttgggacagcggtg

SEQ ID NO: 411468 - DNA, 140 bp, Artificial Sequence
  Synthetic
caccgctgtcccaaaaggtcaatgctgctagtgccaagtactgtagagatcctaccttgttatgtcctgcttgatattcacaactaggactaactatacgtcctaatatggcatttcttacatatcagcagccagggcct

SEQ ID NO: 411469 - DNA, 140 bp, Artificial Sequence
  Synthetic
atacgccatgctgggtctcccaagaagaagtgtaaggataggaccaggacaaacattctatacaacaggtgacataataggagacataaggaaagcacattgtaaacttaataggacagccgtacttgggagtcggccat

SEQ ID NO: 411470 - DNA, 140 bp, Artificial Sequence
  Synthetic
atggccgactcccaagtacggctgtcctattaagtttacaatgtgctttccttatgtctcctattatgtcacctgttgtatagaatgtttgtcctggtcctatccttacacttcttcttgggagacccagcatggcgtat

SEQ ID NO: 411471 - DNA, 140 bp, Artificial Sequence
  Synthetic
atacgccatgctgggtctccgtgtggtttgtagtaataatagattataggataataatacaacgaaggataatcgactggcttcttaaaataataaataatacagcagacagcagcaacacgtacttgggagtcggccat

SEQ ID NO: 411472 - DNA, 140 bp, Artificial Sequence
  Synthetic
atggccgactcccaagtacgtgttgctgctgtctgctgtattatttattattttaagaagccagtcgattatccttcgttgtattattatcctataatctattattactacaaaccacacggagacccagcatggcgtat

SEQ ID NO: 411473 - DNA, 140 bp, Artificial Sequence
  Synthetic
aggccctggctgctgatatgaaggagaggtaggctttccagtcagacctcaggtgcctttaagaccaatgacttataagggagcagtcgatctcggcttctttttaaaagaaaagggggggaccttttgggacagcggtg

SEQ ID NO: 411474 - DNA, 140 bp, Artificial Sequence
  Synthetic
caccgctgtcccaaaaggtcccccccttttcttttaaaaagaagccgagatcgactgctcccttataagtcattggtcttaaaggcacctgaggtctgactggaaagcctacctctccttcatatcagcagccagggcct

SEQ ID NO: 411475 - DNA, 140 bp, Artificial Sequence
  Synthetic
atacgccatgctgggtctccgagaacacaggtccctccccgaaacaggagcagagcttcgggatcggggagaacgtagccccctccccgaaacaggagccgaagaaggaggagctatatccgtacttgggagtcggccat

SEQ ID NO: 411476 - DNA, 140 bp, Artificial Sequence
  Synthetic
atggccgactcccaagtacggatatagctcctccttcttcggctcctgtttcggggagggggctacgttctccccgatcccgaagctctgctcctgtttcggggagggacctgtgttctcggagacccagcatggcgtat

SEQ ID NO: 411477 - DNA, 140 bp, Artificial Sequence
  Synthetic
atacgccatgctgggtctccacaataggggacgcaacacaagacatgaaaaactgctctttcaatatgaccacaattctaacagacaagaaagagaaggtacaggctcttttttataagtcgtacttgggagtcggccat

SEQ ID NO: 411478 - DNA, 140 bp, Artificial Sequence
  Synthetic
atggccgactcccaagtacgacttataaaaaagagcctgtaccttctctttcttgtctgttagaattgtggtcatattgaaagagcagtttttcatgtcttgtgttgcgtcccctattgtggagacccagcatggcgtat

SEQ ID NO: 411479 - DNA, 140 bp, Artificial Sequence
  Synthetic
aggccctggctgctgatatgacgtataggaccaggacaagcattctatgcaacaggtgaagtaacaggagacataaggcaagctcattgcaacatcagtacacaagattggaataacactgaccttttgggacagcggtg

SEQ ID NO: 411480 - DNA, 140 bp, Artificial Sequence
  Synthetic
caccgctgtcccaaaaggtcagtgttattccaatcttgtgtactgatgttgcaatgagcttgccttatgtctcctgttacttcacctgttgcatagaatgcttgtcctggtcctatacgtcatatcagcagccagggcct

SEQ ID NO: 411481 - DNA, 140 bp, Artificial Sequence
  Synthetic
atacgccatgctgggtctccagtctttaagcaaccctcaggaggggacctagaagttacaatgcatagtttcaattgcagaggagaatttttctattgtaatacatcaagcctgtttaatcgtacttgggagtcggccat

SEQ ID NO: 411482 - DNA, 140 bp, Artificial Sequence
  Synthetic
atggccgactcccaagtacgattaaacaggcttgatgtattacaatagaaaaattctcctctgcaattgaaactatgcattgtaacttctaggtcccctcctgagggttgcttaaagactggagacccagcatggcgtat

SEQ ID NO: 411483 - DNA, 140 bp, Artificial Sequence
  Synthetic
atacgccatgctgggtctccgataaaacaaattgtaaacatgtggcagggagtaggacgagcaatatatgcccctcctattgcaggaaagatacagtgtgtatctaatataacaggactacgtacttgggagtcggccat

SEQ ID NO: 411484 - DNA, 140 bp, Artificial Sequence
  Synthetic
atggccgactcccaagtacgtagtcctgttatattagatacacactgtatctttcctgcaataggaggggcatatattgctcgtcctactccctgccacatgtttacaatttgttttatcggagacccagcatggcgtat

SEQ ID NO: 411485 - DNA, 140 bp, Artificial Sequence
  Synthetic
aggccctggctgctgatatgcagcagagggagtaggagcagcgtctcaagacttagataaacatggagcacttacaaccagcaacacagcccacaataatgctgattgtgcctggctgcagaccttttgggacagcggtg

SEQ ID NO: 411486 - DNA, 140 bp, Artificial Sequence
  Synthetic
caccgctgtcccaaaaggtctgcagccaggcacaatcagcattattgtgggctgtgttgctggttgtaagtgctccatgtttatctaagtcttgagacgctgctcctactccctctgctgcatatcagcagccagggcct

SEQ ID NO: 411487 - DNA, 140 bp, Artificial Sequence
  Synthetic
aggccctggctgctgatatgatctgcaccactactgtgccttggaactctagttggagtaataaatcttggaatgagatttgggataacatgacctggttgcaatgggataaagaaattagaccttttgggacagcggtg

SEQ ID NO: 411488 - DNA, 140 bp, Artificial Sequence
  Synthetic
caccgctgtcccaaaaggtctaatttctttatcccattgcaaccaggtcatgttatcccaaatctcattccaagatttattactccaactagagttccaaggcacagtagtggtgcagatcatatcagcagccagggcct

SEQ ID NO: 411489 - DNA, 140 bp, Artificial Sequence
  Synthetic
aggccctggctgctgatatggacacagcagtctcaagggactgagactggggtgggagggcctcaaatacctgtggaatctactggtttattggggacaggaactgaaaaatagtgctatgaccttttgggacagcggtg

SEQ ID NO: 411490 - DNA, 140 bp, Artificial Sequence
  Synthetic
caccgctgtcccaaaaggtcatagcactatttttcagttcctgtccccaataaaccagtagattccacaggtatttgaggccctcccaccccagtctcagtcccttgagactgctgtgtccatatcagcagccagggcct

SEQ ID NO: 411491 - DNA, 140 bp, Artificial Sequence
  Synthetic
aggccctggctgctgatatgagaataagacagggcttagaaagagctttgctataaaatgggtggcaaatggtcaaaaagcagcatagtgggatggcctgatgttagggaaagaatgagagaccttttgggacagcggtg

SEQ ID NO: 411492 - DNA, 140 bp, Artificial Sequence
  Synthetic
caccgctgtcccaaaaggtctctcattctttccctaacatcaggccatcccactatgctgctttttgaccatttgccacccattttatagcaaagctctttctaagccctgtcttattctcatatcagcagccagggcct

SEQ ID NO: 411493 - DNA, 140 bp, Artificial Sequence
  Synthetic
aggccctggctgctgatatgggtcaaaaagcagcatagtgggatggcctgatgttagggaaagaatgagacgggctagtccagcagcagaaggagtgggagcagcgtctaaagatttagagaccttttgggacagcggtg

SEQ ID NO: 411494 - DNA, 140 bp, Artificial Sequence
  Synthetic
caccgctgtcccaaaaggtctctaaatctttagacgctgctcccactccttctgctgctggactagcccgtctcattctttccctaacatcaggccatcccactatgctgctttttgacccatatcagcagccagggcct

SEQ ID NO: 411495 - DNA, 140 bp, Artificial Sequence
  Synthetic
atacgccatgctgggtctccgtggcgcccgaacagggacttgaaaagcgaaagtaaaagggactcgaaagcggaagttccagagaagttctctcgacgcaggactcggcttgctgagtgccgtacttgggagtcggccat

SEQ ID NO: 411496 - DNA, 140 bp, Artificial Sequence
  Synthetic
atggccgactcccaagtacggcactcagcaagccgagtcctgcgtcgagagaacttctctggaacttccgctttcgagtcccttttactttcgcttttcaagtccctgttcgggcgccacggagacccagcatggcgtat

SEQ ID NO: 411497 - DNA, 140 bp, Artificial Sequence
  Synthetic
aggccctggctgctgatatgtagggaaaatttggccttcccacaaggggaggccagggaatttccttcagaacagaccagagccaacagccccaccagagccaacagccccaccagcagagaccttttgggacagcggtg

SEQ ID NO: 411498 - DNA, 140 bp, Artificial Sequence
  Synthetic
caccgctgtcccaaaaggtctctgctggtggggctgttggctctggtggggctgttggctctggtctgttctgaaggaaattccctggcctccccttgtgggaaggccaaattttccctacatatcagcagccagggcct

SEQ ID NO: 411499 - DNA, 140 bp, Artificial Sequence
  Synthetic
atacgccatgctgggtctcccactctgtgttactttaaattgtagtaattacaatgggactagtaccaatgggactaatatcaataatagtagtaggatggaggaaggagaaatgaaaaacgtacttgggagtcggccat

SEQ ID NO: 411500 - DNA, 140 bp, Artificial Sequence
  Synthetic
atggccgactcccaagtacgtttttcatttctccttcctccatcctactactattattgatattagtcccattggtactagtcccattgtaattactacaatttaaagtaacacagagtgggagacccagcatggcgtat

SEQ ID NO: 411501 - DNA, 140 bp, Artificial Sequence
  Synthetic
atacgccatgctgggtctccagtcaaaattaccctatagtgcagaatgcacaagggcagatggtacaccaagccatatcacctaggactttaaatgcatgggtaaaagtgatagaggaaacgtacttgggagtcggccat

SEQ ID NO: 411502 - DNA, 140 bp, Artificial Sequence
  Synthetic
atggccgactcccaagtacgtttcctctatcacttttacccatgcatttaaagtcctaggtgatatggcttggtgtaccatctgcccttgtgcattctgcactatagggtaattttgactggagacccagcatggcgtat

SEQ ID NO: 411503 - DNA, 140 bp, Artificial Sequence
  Synthetic
atacgccatgctgggtctccgtaaccagccccgtaaaaaagtgtgatttcaatgtaaccacaattttcaaagacaaaagggagaaaaaacaggctctattctataaagcagatttgcttgcgtacttgggagtcggccat

SEQ ID NO: 411504 - DNA, 140 bp, Artificial Sequence
  Synthetic
atggccgactcccaagtacgcaagcaaatctgctttatagaatagagcctgttttttctcccttttgtctttgaaaattgtggttacattgaaatcacacttttttacggggctggttacggagacccagcatggcgtat

SEQ ID NO: 411505 - DNA, 140 bp, Artificial Sequence
  Synthetic
atacgccatgctgggtctccgcatctgtacaaattaattgtacaagacccaacaacaatacaagaaaaagtataaggataggaccagggagcacattctatgcaacaggggacataatagcgtacttgggagtcggccat

SEQ ID NO: 411506 - DNA, 140 bp, Artificial Sequence
  Synthetic
atggccgactcccaagtacgctattatgtcccctgttgcatagaatgtgctccctggtcctatccttatactttttcttgtattgttgttgggtcttgtacaattaatttgtacagatgcggagacccagcatggcgtat

SEQ ID NO: 411507 - DNA, 140 bp, Artificial Sequence
  Synthetic
atacgccatgctgggtctccgtataattaataagtttggtaatgataactactttgcaaatagtaggcatagtagcattaatagtagcatttattatagcagtagttgtgtggactatagcgtacttgggagtcggccat

SEQ ID NO: 411508 - DNA, 140 bp, Artificial Sequence
  Synthetic
atggccgactcccaagtacgctatagtccacacaactactgctataataaatgctactattaatgctactatgcctactatttgcaaagtagttatcattaccaaacttattaattatacggagacccagcatggcgtat

SEQ ID NO: 411509 - DNA, 140 bp, Artificial Sequence
  Synthetic
aggccctggctgctgatatgattgatagaataagagacagagcagaagacagtggcaatgagagtgaaggagacacagatgaattggcaaaacttgtggagatggggcctcatgatctttgaccttttgggacagcggtg

SEQ ID NO: 411510 - DNA, 140 bp, Artificial Sequence
  Synthetic
caccgctgtcccaaaaggtcaaagatcatgaggccccatctccacaagttttgccaattcatctgtgtctccttcactctcattgccactgtcttctgctctgtctcttattctatcaatcatatcagcagccagggcct

SEQ ID NO: 411511 - DNA, 140 bp, Artificial Sequence
  Synthetic
atacgccatgctgggtctccagggagagcattttatacaacaggagaaatagtaggaaacataagacaagcacattgtaacattagcaaaacacaatgggagagtactttaagaaggatacgtacttgggagtcggccat

SEQ ID NO: 411512 - DNA, 140 bp, Artificial Sequence
  Synthetic
atggccgactcccaagtacgtatccttcttaaagtactctcccattgtgttttgctaatgttacaatgtgcttgtcttatgtttcctactatttctcctgttgtataaaatgctctccctggagacccagcatggcgtat

SEQ ID NO: 411513 - DNA, 140 bp, Artificial Sequence
  Synthetic
atacgccatgctgggtctccacccctctctgtgttactttaaaatgtgctaatgttacttctaatagtactgcggatacaaccgaagttgataggcaagacgacatgttaaatggcacctcgtacttgggagtcggccat

SEQ ID NO: 411514 - DNA, 140 bp, Artificial Sequence
  Synthetic
atggccgactcccaagtacgaggtgccatttaacatgtcgtcttgcctatcaacttcggttgtatccgcagtactattagaagtaacattagcacattttaaagtaacacagagaggggtggagacccagcatggcgtat

SEQ ID NO: 411515 - DNA, 140 bp, Artificial Sequence
  Synthetic
atacgccatgctgggtctccttcaaagtacttattaaggtaaatattaaggtaaatgattataatataaataaatgtaatatcgtaacaattaataagcagggttctccgaaggtaacctcgtacttgggagtcggccat

SEQ ID NO: 411516 - DNA, 140 bp, Artificial Sequence
  Synthetic
atggccgactcccaagtacgaggttaccttcggagaaccctgcttattaattgttacgatattacatttatttatattataatcatttaccttaatatttaccttaataagtactttgaaggagacccagcatggcgtat

SEQ ID NO: 411517 - DNA, 140 bp, Artificial Sequence
  Synthetic
aggccctggctgctgatatgtaaatgtaatatcgtaacaattaataagcagggttctccgaaggtaacctttgagccaattccaatacattattgtgccccagctggttttgcgattaaagaccttttgggacagcggtg

SEQ ID NO: 411518 - DNA, 140 bp, Artificial Sequence
  Synthetic
caccgctgtcccaaaaggtctttaatcgcaaaaccagctggggcacaataatgtattggaattggctcaaaggttaccttcggagaaccctgcttattaattgttacgatattacatttacatatcagcagccagggcct

SEQ ID NO: 411519 - DNA, 140 bp, Artificial Sequence
  Synthetic
atacgccatgctgggtctccagtacaatgcacacatgggattaaaccagtagtatcaactaaactactgctaaataatggcagtctagcagaaggagaggtaaagattagatctgacaaccgtacttgggagtcggccat

SEQ ID NO: 411520 - DNA, 140 bp, Artificial Sequence
  Synthetic
atggccgactcccaagtacggttgtcagatctaatctttacctctccttctgctagactgccattatttagcagtagtttagttgatactactggtttaatcccatgtgtgcattgtactggagacccagcatggcgtat

SEQ ID NO: 411521 - DNA, 140 bp, Artificial Sequence
  Synthetic
aggccctggctgctgatatgagttaggcagggatactcaccattatcgtttcagacccacttcccaagcccgaggggacccgacaggccaggaggaatcgaaggagaaggtggagaaggagaccttttgggacagcggtg

SEQ ID NO: 411522 - DNA, 140 bp, Artificial Sequence
  Synthetic
caccgctgtcccaaaaggtctccttctccaccttctccttcgattcctcctggcctgtcgggtcccctcgggcttgggaagtgggtctgaaacgataatggtgagtatccctgcctaactcatatcagcagccagggcct

SEQ ID NO: 411523 - DNA, 140 bp, Artificial Sequence
  Synthetic
aggccctggctgctgatatgaaaatttaactcatcctcaggaggggacccagaaattacaatgcatagtttcaattgtagaggagaatttttctactgcaatacatcaggactgtttaatgaccttttgggacagcggtg

SEQ ID NO: 411524 - DNA, 140 bp, Artificial Sequence
  Synthetic
caccgctgtcccaaaaggtcattaaacagtcctgatgtattgcagtagaaaaattctcctctacaattgaaactatgcattgtaatttctgggtcccctcctgaggatgagttaaattttcatatcagcagccagggcct

SEQ ID NO: 411525 - DNA, 140 bp, Artificial Sequence
  Synthetic
atacgccatgctgggtctccaattaattgtaccagacctaacaacaatacaagaaaaggtatacatacaggaccaggacaagctctctatacaacaggtgctataataggagatataagacgtacttgggagtcggccat

SEQ ID NO: 411526 - DNA, 140 bp, Artificial Sequence
  Synthetic
atggccgactcccaagtacgtcttatatctcctattatagcacctgttgtatagagagcttgtcctggtcctgtatgtataccttttcttgtattgttgttaggtctggtacaattaattggagacccagcatggcgtat

SEQ ID NO: 411527 - DNA, 140 bp, Artificial Sequence
  Synthetic
aggccctggctgctgatatgtgtaaacctgtggcaggaagtgggacgagcaatgtatgccgctcccattgaaggaaacattacctgtaactcaaatattacaggtctactattgacaagagaccttttgggacagcggtg

SEQ ID NO: 411528 - DNA, 140 bp, Artificial Sequence
  Synthetic
caccgctgtcccaaaaggtctcttgtcaatagtagacctgtaatatttgagttacaggtaatgtttccttcaatgggagcggcatacattgctcgtcccacttcctgccacaggtttacacatatcagcagccagggcct

SEQ ID NO: 411529 - DNA, 140 bp, Artificial Sequence
  Synthetic
aggccctggctgctgatatgactcctcaggaggggatttagaaattacaacacatagctttaattgtggaggagaatttttctattgcaatacatcaggtctgtttaatagcacttggatgaccttttgggacagcggtg

SEQ ID NO: 411530 - DNA, 140 bp, Artificial Sequence
  Synthetic
caccgctgtcccaaaaggtcatccaagtgctattaaacagacctgatgtattgcaatagaaaaattctcctccacaattaaagctatgtgttgtaatttctaaatcccctcctgaggagtcatatcagcagccagggcct

SEQ ID NO: 411531 - DNA, 140 bp, Artificial Sequence
  Synthetic
atacgccatgctgggtctccagcagaaggggtgggagcagtatctcgagatctggaacaacgtggcgcaatcacaactagtaatacagcaagtaacaatgctgcttgtgcctggctagaacgtacttgggagtcggccat

SEQ ID NO: 411532 - DNA, 140 bp, Artificial Sequence
  Synthetic
atggccgactcccaagtacgttctagccaggcacaagcagcattgttacttgctgtattactagttgtgattgcgccacgttgttccagatctcgagatactgctcccaccccttctgctggagacccagcatggcgtat

SEQ ID NO: 411533 - DNA, 140 bp, Artificial Sequence
  Synthetic
aggccctggctgctgatatgaatgaacaagaattattggcattggacaaatgggcaagtctgtggaattggtttgacatatcaaaatggctgtggtatataagaatattcataatgataggaccttttgggacagcggtg

SEQ ID NO: 411534 - DNA, 140 bp, Artificial Sequence
  Synthetic
caccgctgtcccaaaaggtcctatcattatgaatattcttatataccacagccattttgatatgtcaaaccaattccacagacttgcccatttgtccaatgccaataattcttgttcattcatatcagcagccagggcct

SEQ ID NO: 411535 - DNA, 140 bp, Artificial Sequence
  Synthetic
aggccctggctgctgatatgagcaaggcaaagtcagatccgtgcgattagtgaacggattattgacacttatctgggacgacctgaggagcctgtgccttttcagctaccaccgcttgaggaccttttgggacagcggtg

SEQ ID NO: 411536 - DNA, 140 bp, Artificial Sequence
  Synthetic
caccgctgtcccaaaaggtcctcaagcggtggtagctgaaaaggcacaggctcctcaggtcgtcccagataagtgtcaataatccgttcactaatcgcacggatctgactttgccttgctcatatcagcagccagggcct

SEQ ID NO: 411537 - DNA, 140 bp, Artificial Sequence
  Synthetic
aggccctggctgctgatatgggtgggaagccctcaaatattggtggaatctcctacagtattggagtcgggaactaaagaatagtgctattagcttgcttaataccacagcaatagtagtgaccttttgggacagcggtg

SEQ ID NO: 411538 - DNA, 140 bp, Artificial Sequence
  Synthetic
caccgctgtcccaaaaggtcactactattgctgtggtattaagcaagctaatagcactattctttagttcccgactccaatactgtaggagattccaccaatatttgagggcttcccacccatatcagcagccagggcct

SEQ ID NO: 411539 - DNA, 140 bp, Artificial Sequence
  Synthetic
aggccctggctgctgatatgacctgtgccttttcagctaccaccgattgagagacttcatcttgatagtagcgaggattgtggagactctgggacgcagggggtgggagattctcaaatagaccttttgggacagcggtg

SEQ ID NO: 411540 - DNA, 140 bp, Artificial Sequence
  Synthetic
caccgctgtcccaaaaggtctatttgagaatctcccaccccctgcgtcccagagtctccacaatcctcgctactatcaagatgaagtctctcaatcggtggtagctgaaaaggcacaggtcatatcagcagccagggcct

SEQ ID NO: 411541 - DNA, 140 bp, Artificial Sequence
  Synthetic
atacgccatgctgggtctccttagtttgtttaatgccacagcaatagcagtagctgaaggaacagataggattatagaaatagtacagagagtgttaagagcaattctccatatacctagcgtacttgggagtcggccat

SEQ ID NO: 411542 - DNA, 140 bp, Artificial Sequence
  Synthetic
atggccgactcccaagtacgctaggtatatggagaattgctcttaacactctctgtactatttctataatcctatctgttccttcagctactgctattgctgtggcattaaacaaactaaggagacccagcatggcgtat

SEQ ID NO: 411543 - DNA, 140 bp, Artificial Sequence
  Synthetic
aggccctggctgctgatatgatggtcaaaaagtagcatagtgggatggcctgaaattagggaaagaataagacgcactcgcccaacagcagcagcagaaggagtaggagcagcatctaaagaccttttgggacagcggtg

SEQ ID NO: 411544 - DNA, 140 bp, Artificial Sequence
  Synthetic
caccgctgtcccaaaaggtctttagatgctgctcctactccttctgctgctgctgttgggcgagtgcgtcttattctttccctaatttcaggccatcccactatgctactttttgaccatcatatcagcagccagggcct

SEQ ID NO: 411545 - DNA, 140 bp, Artificial Sequence
  Synthetic
atacgccatgctgggtctccgtggcgcccgaacagggacttgaaagcgaaagtaagaccagagaaagttctctcgacgcaggactcggcttgctgaggtgcacacagcaagaggcgagagcgtacttgggagtcggccat

SEQ ID NO: 411546 - DNA, 140 bp, Artificial Sequence
  Synthetic
atggccgactcccaagtacgctctcgcctcttgctgtgtgcacctcagcaagccgagtcctgcgtcgagagaactttctctggtcttactttcgctttcaagtccctgttcgggcgccacggagacccagcatggcgtat

SEQ ID NO: 411547 - DNA, 140 bp, Artificial Sequence
  Synthetic
atacgccatgctgggtctccagcagtcctctattatgtacatcaaagggtagaggtaaaggacaccaaggaagctttagagaagctagaggaagaacaaaacaaaagtcagcaaaagacacgtacttgggagtcggccat

SEQ ID NO: 411548 - DNA, 140 bp, Artificial Sequence
  Synthetic
atggccgactcccaagtacgtgtcttttgctgacttttgttttgttcttcctctagcttctctaaagcttccttggtgtcctttacctctaccctttgatgtacataatagaggactgctggagacccagcatggcgtat

SEQ ID NO: 411549 - DNA, 140 bp, Artificial Sequence
  Synthetic
atacgccatgctgggtctccgtatatttcaaagaaagccacaggatggtggtataggcatcactatgaaagcagacatccaaaagtatgttcagaagtacacatcccaatagagaatgctcgtacttgggagtcggccat

SEQ ID NO: 411550 - DNA, 140 bp, Artificial Sequence
  Synthetic
atggccgactcccaagtacgagcattctctattgggatgtgtacttctgaacatacttttggatgtctgctttcatagtgatgcctataccaccatcctgtggctttctttgaaatatacggagacccagcatggcgtat

SEQ ID NO: 411551 - DNA, 140 bp, Artificial Sequence
  Synthetic
atacgccatgctgggtctccaaaattgctctttcaatataaccacagaaataagggataagacacagaaagcatatgcacttttttatagagctgatgtaataccacttggggagaataacgtacttgggagtcggccat

SEQ ID NO: 411552 - DNA, 140 bp, Artificial Sequence
  Synthetic
atggccgactcccaagtacgttattctccccaagtggtattacatcagctctataaaaaagtgcatatgctttctgtgtcttatcccttatttctgtggttatattgaaagagcaattttggagacccagcatggcgtat

SEQ ID NO: 411553 - DNA, 140 bp, Artificial Sequence
  Synthetic
atacgccatgctgggtctccgcataagacccggcaataatacaagaggaagtgtaaggataggaccaggacaaacactctttacaaatgacatgataggagacataagacaagcatactgcgtacttgggagtcggccat

SEQ ID NO: 411554 - DNA, 140 bp, Artificial Sequence
  Synthetic
atggccgactcccaagtacgcagtatgcttgtcttatgtctcctatcatgtcatttgtaaagagtgtttgtcctggtcctatccttacacttcctcttgtattattgccgggtcttatgcggagacccagcatggcgtat

SEQ ID NO: 411555 - DNA, 140 bp, Artificial Sequence
  Synthetic
atacgccatgctgggtctccaagaagtggagaccccgacgaggaactcctaagaacagtaaggatcatcaagatcctgtaccaaagcagtaagtaataaatagtatatgtaatgaattatcgtacttgggagtcggccat

SEQ ID NO: 411556 - DNA, 140 bp, Artificial Sequence
  Synthetic
atggccgactcccaagtacgataattcattacatatactatttattacttactgctttggtacaggatcttgatgatccttactgttcttaggagttcctcgtcggggtctccacttcttggagacccagcatggcgtat

SEQ ID NO: 411557 - DNA, 140 bp, Artificial Sequence
  Synthetic
aggccctggctgctgatatgagatcctgtaccaaagcagtaagtaataaatagtatatgtaatgaattatttgataataacaatagtagcatatgtagtagcaataatcatagcaatagtgaccttttgggacagcggtg

SEQ ID NO: 411558 - DNA, 140 bp, Artificial Sequence
  Synthetic
caccgctgtcccaaaaggtcactattgctatgattattgctactacatatgctactattgttattatcaaataattcattacatatactatttattacttactgctttggtacaggatctcatatcagcagccagggcct

SEQ ID NO: 411559 - DNA, 140 bp, Artificial Sequence
  Synthetic
atacgccatgctgggtctccgaatagactgcttagtggatagaataagggaaagagcagaagacagtggcaatgacagtgaaggggatacagaggaattatcaacactggtggaaatgggcgtacttgggagtcggccat

SEQ ID NO: 411560 - DNA, 140 bp, Artificial Sequence
  Synthetic
atggccgactcccaagtacgcccatttccaccagtgttgataattcctctgtatccccttcactgtcattgccactgtcttctgctctttcccttattctatccactaagcagtctattcggagacccagcatggcgtat

SEQ ID NO: 411561 - DNA, 140 bp, Artificial Sequence
  Synthetic
aggccctggctgctgatatgcaccaaatgaaagattgtactgaaagacaggctaattttttagggaaaatctggccttcccacaagggaaggccagggaattttcttcagagcagaccaggaccttttgggacagcggtg

SEQ ID NO: 411562 - DNA, 140 bp, Artificial Sequence
  Synthetic
caccgctgtcccaaaaggtcctggtctgctctgaagaaaattccctggccttcccttgtgggaaggccagattttccctaaaaaattagcctgtctttcagtacaatctttcatttggtgcatatcagcagccagggcct

SEQ ID NO: 411563 - DNA, 140 bp, Artificial Sequence
  Synthetic
atacgccatgctgggtctccagaaatacaaaactgttctttcaatgcaaccacagaaataagggacaaagtaaagaaagtacatgcacttttttatagaattgatatggtgccaattgatcgtacttgggagtcggccat

SEQ ID NO: 411564 - DNA, 140 bp, Artificial Sequence
  Synthetic
atggccgactcccaagtacgatcaattggcaccatatcaattctataaaaaagtgcatgtactttctttactttgtcccttatttctgtggttgcattgaaagaacagttttgtatttctggagacccagcatggcgtat

SEQ ID NO: 411565 - DNA, 140 bp, Artificial Sequence
  Synthetic
atacgccatgctgggtctcctgttaaatggcagcctagcagaaaaagggataataattagatctgagaacctgacagacaatgctaaaacaataatagtacagctcaatgagtctgtaaccgtacttgggagtcggccat

SEQ ID NO: 411566 - DNA, 140 bp, Artificial Sequence
  Synthetic
atggccgactcccaagtacggttacagactcattgagctgtactattattgttttagcattgtctgtcaggttctcagatctaattattatccctttttctgctaggctgccatttaacaggagacccagcatggcgtat

SEQ ID NO: 411567 - DNA, 140 bp, Artificial Sequence
  Synthetic
aggccctggctgctgatatgctgacagacaatgctaaaacaataatagtacagctcaatgagtctgtaacaattgagtgtataagaccaggcaacaatacaagacaaagtatacgtataggaccttttgggacagcggtg

SEQ ID NO: 411568 - DNA, 140 bp, Artificial Sequence
  Synthetic
caccgctgtcccaaaaggtcctatacgtatactttgtcttgtattgttgcctggtcttatacactcaattgttacagactcattgagctgtactattattgttttagcattgtctgtcagcatatcagcagccagggcct

SEQ ID NO: 411569 - DNA, 140 bp, Artificial Sequence
  Synthetic
aggccctggctgctgatatgtggcactaacagcattaataacaccaaaaaagataaagccacctttgcctagtgttaggaagctaacagaggatagatggaacaagccccagaagaccaagaccttttgggacagcggtg

SEQ ID NO: 411570 - DNA, 140 bp, Artificial Sequence
  Synthetic
caccgctgtcccaaaaggtcttggtcttctggggcttgttccatctatcctctgttagcttcctaacactaggcaaaggtggctttatcttttttggtgttattaatgctgttagtgccacatatcagcagccagggcct

SEQ ID NO: 411571 - DNA, 140 bp, Artificial Sequence
  Synthetic
atacgccatgctgggtctccgcacattgcaacatcagtataaaaagctggaatgaaaccatgaacctggtagctaaggaattagagaaacacttccctaataaaacaatagactttcagccgtacttgggagtcggccat

SEQ ID NO: 411572 - DNA, 140 bp, Artificial Sequence
  Synthetic
atggccgactcccaagtacggctgaaagtctattgttttattagggaagtgtttctctaattccttagctaccaggttcatggtttcattccagctttttatactgatgttgcaatgtgcggagacccagcatggcgtat

SEQ ID NO: 411573 - DNA, 140 bp, Artificial Sequence
  Synthetic
aggccctggctgctgatatggacaaaaatcttagaaccatttagaaaacaaaacccagaaatagttatctatcaatacatggatgacttgtatgtgggatctgacttagaaatagggcaagaccttttgggacagcggtg

SEQ ID NO: 411574 - DNA, 140 bp, Artificial Sequence
  Synthetic
caccgctgtcccaaaaggtcttgccctatttctaagtcagatcccacatacaagtcatccatgtattgatagataactatttctgggttttgttttctaaatggttctaagatttttgtccatatcagcagccagggcct

SEQ ID NO: 411575 - DNA, 140 bp, Artificial Sequence
  Synthetic
atacgccatgctgggtctccaatcctcaggaggggacttagaaataacaatgcatagttttaattgtagaggagagtttttctattgtaatacatcaggcctgtttaataacgagtggaacgtacttgggagtcggccat

SEQ ID NO: 411576 - DNA, 140 bp, Artificial Sequence
  Synthetic
atggccgactcccaagtacgttccactcgttattaaacaggcctgatgtattacaatagaaaaactctcctctacaattaaaactatgcattgttatttctaagtcccctcctgaggattggagacccagcatggcgtat

SEQ ID NO: 411577 - DNA, 140 bp, Artificial Sequence
  Synthetic
aggccctggctgctgatatgaacacatagtatgggcaagcagggagctggaaagatttgcacttaaccctggccttttagaaacatcagaaggctgtaaacagatactgacacagctacagaccttttgggacagcggtg

SEQ ID NO: 411578 - DNA, 140 bp, Artificial Sequence
  Synthetic
caccgctgtcccaaaaggtctgtagctgtgtcagtatctgtttacagccttctgatgtttctaaaaggccagggttaagtgcaaatctttccagctccctgcttgcccatactatgtgttcatatcagcagccagggcct

SEQ ID NO: 411579 - DNA, 140 bp, Artificial Sequence
  Synthetic
atacgccatgctgggtctccgtaaagtgaacaatgccactaatagtaatgggacagtggtaggggaaacagaagtaaaaaactgcaccttcaatgttaccacaagcataagagataaggtcgtacttgggagtcggccat

SEQ ID NO: 411580 - DNA, 140 bp, Artificial Sequence
  Synthetic
atggccgactcccaagtacgaccttatctcttatgcttgtggtaacattgaaggtgcagttttttacttctgtttcccctaccactgtcccattactattagtggcattgttcactttacggagacccagcatggcgtat

SEQ ID NO: 411581 - DNA, 140 bp, Artificial Sequence
  Synthetic
atacgccatgctgggtctccagacccctaccccgagcccagagggagtcgccaggcccggaggaatcgaagaagacggtggagagcaaggcagaaccagatcgattcgattagtgaacggcgtacttgggagtcggccat

SEQ ID NO: 411582 - DNA, 140 bp, Artificial Sequence
  Synthetic
atggccgactcccaagtacgccgttcactaatcgaatcgatctggttctgccttgctctccaccgtcttcttcgattcctccgggcctggcgactccctctgggctcggggtaggggtctggagacccagcatggcgtat

SEQ ID NO: 411583 - DNA, 140 bp, Artificial Sequence
  Synthetic
atacgccatgctgggtctccaagacaggtagtaagatcatggataaagggagagtcgggactctatgcacctcccatccctggcaacctaacatgtcaatccaacataactggaatgattcgtacttgggagtcggccat

SEQ ID NO: 411584 - DNA, 140 bp, Artificial Sequence
  Synthetic
atggccgactcccaagtacgaatcattccagttatgttggattgacatgttaggttgccagggatgggaggtgcatagagtcccgactctccctttatccatgatcttactacctgtcttggagacccagcatggcgtat

SEQ ID NO: 411585 - DNA, 140 bp, Artificial Sequence
  Synthetic
atacgccatgctgggtctccgaacaggactcctccagcagcagaaggagtgggagcagtgtctaaagatttagataaacatggagcaatcactagcagtaatacatcacagactaatcctcgtacttgggagtcggccat

SEQ ID NO: 411586 - DNA, 140 bp, Artificial Sequence
  Synthetic
atggccgactcccaagtacgaggattagtctgtgatgtattactgctagtgattgctccatgtttatctaaatctttagacactgctcccactccttctgctgctggaggagtcctgttcggagacccagcatggcgtat

SEQ ID NO: 411587 - DNA, 140 bp, Artificial Sequence
  Synthetic
aggccctggctgctgatatgcaaaatggaatgacactttaaaacaggtagttataaaattaaggaaacaatttgtaaataaaacaatagtctttgatcaaccatccccaggaggggacccgaccttttgggacagcggtg

SEQ ID NO: 411588 - DNA, 140 bp, Artificial Sequence
  Synthetic
caccgctgtcccaaaaggtcgggtcccctcctggggatggttgatcaaagactattgttttatttacaaattgtttccttaattttataactacctgttttaaagtgtcattccattttgcatatcagcagccagggcct

SEQ ID NO: 411589 - DNA, 140 bp, Artificial Sequence
  Synthetic
atacgccatgctgggtctccatacatcaaagctgtttaatagtacttgggctgtgaatatgactaacgggtcaaatataactaaagaaggaaataccacaacaatcccatgcagaataaacgtacttgggagtcggccat

SEQ ID NO: 411590 - DNA, 140 bp, Artificial Sequence
  Synthetic
atggccgactcccaagtacgtttattctgcatgggattgttgtggtatttccttctttagttatatttgacccgttagtcatattcacagcccaagtactattaaacagctttgatgtatggagacccagcatggcgtat

SEQ ID NO: 411591 - DNA, 140 bp, Artificial Sequence
  Synthetic
aggccctggctgctgatatggaagtgaattatataaatataaagtagtaaaaattgagccattaggaatagcacccaccaaggcaaggagaagagtggtgcagagagaaaaaagagcagtgaccttttgggacagcggtg

SEQ ID NO: 411592 - DNA, 140 bp, Artificial Sequence
  Synthetic
caccgctgtcccaaaaggtcactgctcttttttctctctgcaccactcttctccttgccttggtgggtgctattcctaatggctcaatttttactactttatatttatataattcacttccatatcagcagccagggcct

SEQ ID NO: 411593 - DNA, 140 bp, Artificial Sequence
  Synthetic
aggccctggctgctgatatgaacatattggggtctgcatacaggagaaagagattggcatttgggtcagggggtctccatagaatggaggctgaaaaggtacagaacacaagtagaccctgaccttttgggacagcggtg

SEQ ID NO: 411594 - DNA, 140 bp, Artificial Sequence
  Synthetic
caccgctgtcccaaaaggtcagggtctacttgtgttctgtaccttttcagcctccattctatggagaccccctgacccaaatgccaatctctttctcctgtatgcagaccccaatatgttcatatcagcagccagggcct

SEQ ID NO: 411595 - DNA, 140 bp, Artificial Sequence
  Synthetic
aggccctggctgctgatatgaaagcattagtagcaccaacaaggacaaagccacctttgcctagtgttaggaaattagcagaggatagatggaacaagccccagaagaccaggggccacagaccttttgggacagcggtg

SEQ ID NO: 411596 - DNA, 140 bp, Artificial Sequence
  Synthetic
caccgctgtcccaaaaggtctgtggcccctggtcttctggggcttgttccatctatcctctgctaatttcctaacactaggcaaaggtggctttgtccttgttggtgctactaatgctttcatatcagcagccagggcct

SEQ ID NO: 411597 - DNA, 140 bp, Artificial Sequence
  Synthetic
aggccctggctgctgatatgtcttgcctgggacgacctgcggagcctgtgcctcttcagctaccaccgattgagagacttcatattggtgacagtgagagtggtggaacttctgggacgcgaccttttgggacagcggtg

SEQ ID NO: 411598 - DNA, 140 bp, Artificial Sequence
  Synthetic
caccgctgtcccaaaaggtcgcgtcccagaagttccaccactctcactgtcaccaatatgaagtctctcaatcggtggtagctgaagaggcacaggctccgcaggtcgtcccaggcaagacatatcagcagccagggcct

SEQ ID NO: 411599 - DNA, 140 bp, Artificial Sequence
  Synthetic
atacgccatgctgggtctcccttgtaaccagtgcttttgtaaaaggtgttgctaccattgccaaatttgctttctaaagaaaggcttaggcatttcctatggcaggaagaagcggagacacgtacttgggagtcggccat

SEQ ID NO: 411600 - DNA, 140 bp, Artificial Sequence
  Synthetic
atggccgactcccaagtacgtgtctccgcttcttcctgccataggaaatgcctaagcctttctttagaaagcaaatttggcaatggtagcaacaccttttacaaaagcactggttacaagggagacccagcatggcgtat

SEQ ID NO: 411601 - DNA, 140 bp, Artificial Sequence
  Synthetic
atacgccatgctgggtctccagaccattttaaaaggattaggacaaggggcttcattggaagaaatgatgacagcatgtcagggagtgggaggacccggacataaagcaagagttttggccgtacttgggagtcggccat

SEQ ID NO: 411602 - DNA, 140 bp, Artificial Sequence
  Synthetic
atggccgactcccaagtacggccaaaactcttgctttatgtccgggtcctcccactccctgacatgctgtcatcatttcttccaatgaagccccttgtcctaatccttttaaaatggtctggagacccagcatggcgtat

SEQ ID NO: 411603 - DNA, 140 bp, Artificial Sequence
  Synthetic
atacgccatgctgggtctccgggagaagggacaaccccctccccgaagcaggagccaagagagagggaacagaatcctccttcagtttccctcaaatcactctttggcaaagacccatggcgtacttgggagtcggccat

SEQ ID NO: 411604 - DNA, 140 bp, Artificial Sequence
  Synthetic
atggccgactcccaagtacgccatgggtctttgccaaagagtgatttgagggaaactgaaggaggattctgttccctctctcttggctcctgcttcggggagggggttgtcccttctcccggagacccagcatggcgtat

SEQ ID NO: 411605 - DNA, 140 bp, Artificial Sequence
  Synthetic
aggccctggctgctgatatggaatctgtacaaattaattgtacaagacccaacaataatacaagaaaaggtatacagataggaccaggacgagcattttggacaacagaaaaaataataggaccttttgggacagcggtg

SEQ ID NO: 411606 - DNA, 140 bp, Artificial Sequence
  Synthetic
caccgctgtcccaaaaggtcctattattttttctgttgtccaaaatgctcgtcctggtcctatctgtataccttttcttgtattattgttgggtcttgtacaattaatttgtacagattccatatcagcagccagggcct

SEQ ID NO: 411607 - DNA, 140 bp, Artificial Sequence
  Synthetic
atacgccatgctgggtctccagggagaaatagaaaactgctctttcagggtaaccacagaggtaacatataaaaatgaggtagaatacgcgcttttctataaacatgatgtagtaccaatcgtacttgggagtcggccat

SEQ ID NO: 411608 - DNA, 140 bp, Artificial Sequence
  Synthetic
atggccgactcccaagtacgattggtactacatcatgtttatagaaaagcgcgtattctacctcatttttatatgttacctctgtggttaccctgaaagagcagttttctatttctccctggagacccagcatggcgtat

SEQ ID NO: 411609 - DNA, 140 bp, Artificial Sequence
  Synthetic
aggccctggctgctgatatgaacaggcttgtccaaaagtaacctttgagccaattcccatacattattgtgctccagctggttttgcgattctaaagtgtaatgatgaggagttcaatgggaccttttgggacagcggtg

SEQ ID NO: 411610 - DNA, 140 bp, Artificial Sequence
  Synthetic
caccgctgtcccaaaaggtcccattgaactcctcatcattacactttagaatcgcaaaaccagctggagcacaataatgtatgggaattggctcaaaggttacttttggacaagcctgttcatatcagcagccagggcct

SEQ ID NO: 411611 - DNA, 140 bp, Artificial Sequence
  Synthetic
aggccctggctgctgatatgagcccttcagacaggatcagaagaacttaaatcattatttaatacagtagcaaccctctattgtgtacatcaaaggatagagataaaagacaccaaggaagaccttttgggacagcggtg

SEQ ID NO: 411612 - DNA, 140 bp, Artificial Sequence
  Synthetic
caccgctgtcccaaaaggtcttccttggtgtcttttatctctatcctttgatgtacacaatagagggttgctactgtattaaataatgatttaagttcttctgatcctgtctgaagggctcatatcagcagccagggcct

SEQ ID NO: 411613 - DNA, 140 bp, Artificial Sequence
  Synthetic
atacgccatgctgggtctccagccaatagtatcaactcaactactgataaatggcagtctagcaaaaggggaggtaaagattagatctgaaaacttcacagacaatgctaaaaccataatcgtacttgggagtcggccat

SEQ ID NO: 411614 - DNA, 140 bp, Artificial Sequence
  Synthetic
atggccgactcccaagtacgattatggttttagcattgtctgtgaagttttcagatctaatctttacctccccttttgctagactgccatttatcagtagttgagttgatactattggctggagacccagcatggcgtat

SEQ ID NO: 411615 - DNA, 140 bp, Artificial Sequence
  Synthetic
aggccctggctgctgatatgtaggaccagggagagcattttatggaacagaaatcataggagatataagaaaagcacattgtacccttaatagaacacaatggaacaacactttacaacggaccttttgggacagcggtg

SEQ ID NO: 411616 - DNA, 140 bp, Artificial Sequence
  Synthetic
caccgctgtcccaaaaggtccgttgtaaagtgttgttccattgtgttctattaagggtacaatgtgcttttcttatatctcctatgatttctgttccataaaatgctctccctggtcctacatatcagcagccagggcct

SEQ ID NO: 411617 - DNA, 140 bp, Artificial Sequence
  Synthetic
atacgccatgctgggtctccatacaagaaaagggatacagataggaccaggacgaactgtctatgcaacaggggctataataggggacataaggaaagcacattgtaatatcagtggatgcgtacttgggagtcggccat

SEQ ID NO: 411618 - DNA, 140 bp, Artificial Sequence
  Synthetic
atggccgactcccaagtacgcatccactgatattacaatgtgctttccttatgtcccctattatagcccctgttgcatagacagttcgtcctggtcctatctgtatcccttttcttgtatggagacccagcatggcgtat

SEQ ID NO: 411619 - DNA, 140 bp, Artificial Sequence
  Synthetic
aggccctggctgctgatatgaattgtacaagacctaacaactatacaaggaaaagaataactatgggaccagggagagtatattatacaacaggagaaataataggagatataagacgaggaccttttgggacagcggtg

SEQ ID NO: 411620 - DNA, 140 bp, Artificial Sequence
  Synthetic
caccgctgtcccaaaaggtcctcgtcttatatctcctattatttctcctgttgtataatatactctccctggtcccatagttattcttttccttgtatagttgttaggtcttgtacaattcatatcagcagccagggcct

SEQ ID NO: 411621 - DNA, 140 bp, Artificial Sequence
  Synthetic
atacgccatgctgggtctccacacatagctttaattgtggaggagaatttttctattgcgatacatcaggactgtttaatagcagttggagttggaatgagactaacaatacaatgacaccgtacttgggagtcggccat

SEQ ID NO: 411622 - DNA, 140 bp, Artificial Sequence
  Synthetic
atggccgactcccaagtacggtgtcattgtattgttagtctcattccaactccaactgctattaaacagtcctgatgtatcgcaatagaaaaattctcctccacaattaaagctatgtgtggagacccagcatggcgtat

SEQ ID NO: 411623 - DNA, 140 bp, Artificial Sequence
  Synthetic
aggccctggctgctgatatgattgtaagaatgtggcagagagtagggcaagcaatgtatgcccctcccatcccaggaaaaataagttgtaattcaagcattacaggattactattaacaagaccttttgggacagcggtg

SEQ ID NO: 411624 - DNA, 140 bp, Artificial Sequence
  Synthetic
caccgctgtcccaaaaggtcttgttaatagtaatcctgtaatgcttgaattacaacttatttttcctgggatgggaggggcatacattgcttgccctactctctgccacattcttacaatcatatcagcagccagggcct

SEQ ID NO: 411625 - DNA, 140 bp, Artificial Sequence
  Synthetic
atacgccatgctgggtctcccgaattcctcaggaggggacctagaaattacaatgcatagttttaattgtggaggagaatttttcttctgtaatacaacaaaactgtttgggggtacttgcgtacttgggagtcggccat

SEQ ID NO: 411626 - DNA, 140 bp, Artificial Sequence
  Synthetic
atggccgactcccaagtacgcaagtacccccaaacagttttgttgtattacagaagaaaaattctcctccacaattaaaactatgcattgtaatttctaggtcccctcctgaggaattcgggagacccagcatggcgtat

SEQ ID NO: 411627 - DNA, 140 bp, Artificial Sequence
  Synthetic
aggccctggctgctgatatgctgagtgggagtttgtcaatacccctcctttagtaaaactatggtatcagttagaaaaggaacccatagcaggagcagaaacttactatgtagatggagcgaccttttgggacagcggtg

SEQ ID NO: 411628 - DNA, 140 bp, Artificial Sequence
  Synthetic
caccgctgtcccaaaaggtcgctccatctacatagtaagtttctgctcctgctatgggttccttttctaactgataccatagttttactaaaggaggggtattgacaaactcccactcagcatatcagcagccagggcct

SEQ ID NO: 411629 - DNA, 140 bp, Artificial Sequence
  Synthetic
atacgccatgctgggtctcccacttgcctgggacgatctgaggagcctgtgtctttgcctctaccaccgattgagagacttcatcttcattgcagcgaggatagtggagactctgggacacgtacttgggagtcggccat

SEQ ID NO: 411630 - DNA, 140 bp, Artificial Sequence
  Synthetic
atggccgactcccaagtacgtgtcccagagtctccactatcctcgctgcaatgaagatgaagtctctcaatcggtggtagaggcaaagacacaggctcctcagatcgtcccaggcaagtgggagacccagcatggcgtat

SEQ ID NO: 411631 - DNA, 140 bp, Artificial Sequence
  Synthetic
atacgccatgctgggtctccgtcaagaactgaagaatagtgctattagtttgtttaatgccacagcaatagcagtagctgaaggaacagatagaataatagaaatagcacatagagccttcgtacttgggagtcggccat

SEQ ID NO: 411632 - DNA, 140 bp, Artificial Sequence
  Synthetic
atggccgactcccaagtacgaaggctctatgtgctatttctattattctatctgttccttcagctactgctattgctgtggcattaaacaaactaatagcactattcttcagttcttgacggagacccagcatggcgtat

SEQ ID NO: 411633 - DNA, 140 bp, Artificial Sequence
  Synthetic
aggccctggctgctgatatggcagtagctgaaggaacagatagaataatagaaatagcacatagagccttaagagcttttctccacatacctagaagaatcagacagggcctcgaaaggggaccttttgggacagcggtg

SEQ ID NO: 411634 - DNA, 140 bp, Artificial Sequence
  Synthetic
caccgctgtcccaaaaggtcccctttcgaggccctgtctgattcttctaggtatgtggagaaaagctcttaaggctctatgtgctatttctattattctatctgttccttcagctactgccatatcagcagccagggcct

SEQ ID NO: 411635 - DNA, 140 bp, Artificial Sequence
  Synthetic
aggccctggctgctgatatgccatcccttcagacaggatcagaagagcttaaatcattatttaatacagtagcagtcctctattttgtacatcaaaaggtagaggtaaaggacaccaagggaccttttgggacagcggtg

SEQ ID NO: 411636 - DNA, 140 bp, Artificial Sequence
  Synthetic
caccgctgtcccaaaaggtcccttggtgtcctttacctctaccttttgatgtacaaaatagaggactgctactgtattaaataatgatttaagctcttctgatcctgtctgaagggatggcatatcagcagccagggcct

SEQ ID NO: 411637 - DNA, 140 bp, Artificial Sequence
  Synthetic
aggccctggctgctgatatgagagggagccatacaatgaatggatgttagaactgttagaagagcttaagcaggaagctgttagacattttcctaggccttggctccatggattagggcagaccttttgggacagcggtg

SEQ ID NO: 411638 - DNA, 140 bp, Artificial Sequence
  Synthetic
caccgctgtcccaaaaggtctgccctaatccatggagccaaggcctaggaaaatgtctaacagcttcctgcttaagctcttctaacagttctaacatccattcattgtatggctccctctcatatcagcagccagggcct

SEQ ID NO: 411639 - DNA, 140 bp, Artificial Sequence
  Synthetic
aggccctggctgctgatatgtgggtcactgtttactatggggtacctgtgtggaaagacgcagagaccactttattttgtgcatcagatgctaaaggatatagtacagaaaagcataatggaccttttgggacagcggtg

SEQ ID NO: 411640 - DNA, 140 bp, Artificial Sequence
  Synthetic
caccgctgtcccaaaaggtccattatgcttttctgtactatatcctttagcatctgatgcacaaaataaagtggtctctgcgtctttccacacaggtaccccatagtaaacagtgacccacatatcagcagccagggcct

SEQ ID NO: 411641 - DNA, 140 bp, Artificial Sequence
  Synthetic
atacgccatgctgggtctcctccaaaagtaagttcagaagtacatatcccaatacaggatggtagattaatagttagaacatactggggtctacagccaggagaaaaggaatggcagttgcgtacttgggagtcggccat

SEQ ID NO: 411642 - DNA, 140 bp, Artificial Sequence
  Synthetic
atggccgactcccaagtacgcaactgccattccttttctcctggctgtagaccccagtatgttctaactattaatctaccatcctgtattgggatatgtacttctgaacttacttttggaggagacccagcatggcgtat

SEQ ID NO: 411643 - DNA, 140 bp, Artificial Sequence
  Synthetic
atacgccatgctgggtctccagaaatggtaatgatacaaatacaaccaaaactaataatgctacccttaataataccatgtatgaggaaatgagaaattgctctttcaatataaccacagcgtacttgggagtcggccat

SEQ ID NO: 411644 - DNA, 140 bp, Artificial Sequence
  Synthetic
atggccgactcccaagtacgctgtggttatattgaaagagcaatttctcatttcctcatacatggtattattaagggtagcattattagttttggttgtatttgtatcattaccatttctggagacccagcatggcgtat

SEQ ID NO: 411645 - DNA, 140 bp, Artificial Sequence
  Synthetic
aggccctggctgctgatatgcatagtgcaaaatgcacaagggcaaatgatacaccaagccctatcacctagaactttgaatgcatgggtaaaagtaatagaagaaaaggctttcagcccagaccttttgggacagcggtg

SEQ ID NO: 411646 - DNA, 140 bp, Artificial Sequence
  Synthetic
caccgctgtcccaaaaggtctgggctgaaagccttttcttctattacttttacccatgcattcaaagttctaggtgatagggcttggtgtatcatttgcccttgtgcattttgcactatgcatatcagcagccagggcct

SEQ ID NO: 411647 - DNA, 140 bp, Artificial Sequence
  Synthetic
aggccctggctgctgatatgcttaagcatgaagctgtgagacattttcctagactgtggcttcaaggcttaggacaacatatctatggaacctatggggacacttgggtaggagttgaaggaccttttgggacagcggtg

SEQ ID NO: 411648 - DNA, 140 bp, Artificial Sequence
  Synthetic
caccgctgtcccaaaaggtccttcaactcctacccaagtgtccccataggttccatagatatgttgtcctaagccttgaagccacagtctaggaaaatgtctcacagcttcatgcttaagcatatcagcagccagggcct

SEQ ID NO: 411649 - DNA, 140 bp, Artificial Sequence
  Synthetic
aggccctggctgctgatatgagccggtagatcctaaactagagccctggaaccatccgggaagtcagcctaaaactgcttgcaacaagtgccattgtaaagtatgttgctatcattgccagaccttttgggacagcggtg

SEQ ID NO: 411650 - DNA, 140 bp, Artificial Sequence
  Synthetic
caccgctgtcccaaaaggtctggcaatgatagcaacatactttacaatggcacttgttgcaagcagttttaggctgacttcccggatggttccagggctctagtttaggatctaccggctcatatcagcagccagggcct

SEQ ID NO: 411651 - DNA, 140 bp, Artificial Sequence
  Synthetic
atacgccatgctgggtctccggagatcccgacgaggaacttctcagaacaataaggatcatcaaaatcctgtaccagagcagtaagtagctatcatatgtaatgccacctttggacatcgcgtacttgggagtcggccat

SEQ ID NO: 411652 - DNA, 140 bp, Artificial Sequence
  Synthetic
atggccgactcccaagtacgcgatgtccaaaggtggcattacatatgatagctacttactgctctggtacaggattttgatgatccttattgttctgagaagttcctcgtcgggatctccggagacccagcatggcgtat

SEQ ID NO: 411653 - DNA, 140 bp, Artificial Sequence
  Synthetic
atacgccatgctgggtctcccaaccgaaatgaatggagaaataaaaaactgctctttcagtatgaccacagtactaagagataagaaagagaaggtacatgctcttttttataaagtagacgtacttgggagtcggccat

SEQ ID NO: 411654 - DNA, 140 bp, Artificial Sequence
  Synthetic
atggccgactcccaagtacgtctactttataaaaaagagcatgtaccttctctttcttatctcttagtactgtggtcatactgaaagagcagttttttatttctccattcatttcggttgggagacccagcatggcgtat

SEQ ID NO: 411655 - DNA, 140 bp, Artificial Sequence
  Synthetic
aggccctggctgctgatatgagaaaaagtatacatataggaccagggagagcattttatgcaacaggagaaataataggagatataagacaagcacattgtaaccttagtagagcaaaatgaccttttgggacagcggtg

SEQ ID NO: 411656 - DNA, 140 bp, Artificial Sequence
  Synthetic
caccgctgtcccaaaaggtcattttgctctactaaggttacaatgtgcttgtcttatatctcctattatttctcctgttgcataaaatgctctccctggtcctatatgtatactttttctcatatcagcagccagggcct

SEQ ID NO: 411657 - DNA, 140 bp, Artificial Sequence
  Synthetic
aggccctggctgctgatatgctgctgctaaatggcagtctagcagaaaaagaggtaaaggttaggtctgagaatttcacaaacaatgccaaaaacataatagtacagcttgataagcctggaccttttgggacagcggtg

SEQ ID NO: 411658 - DNA, 140 bp, Artificial Sequence
  Synthetic
caccgctgtcccaaaaggtccaggcttatcaagctgtactattatgtttttggcattgtttgtgaaattctcagacctaacctttacctctttttctgctagactgccatttagcagcagcatatcagcagccagggcct

SEQ ID NO: 411659 - DNA, 140 bp, Artificial Sequence
  Synthetic
atacgccatgctgggtctccgaatttcacaaacaatgccaaaaacataatagtacagcttgataagcctgtaaatattacctgtaccagaccaggcaacaatagaaggaagagtatacatcgtacttgggagtcggccat

SEQ ID NO: 411660 - DNA, 140 bp, Artificial Sequence
  Synthetic
atggccgactcccaagtacgatgtatactcttccttctattgttgcctggtctggtacaggtaatatttacaggcttatcaagctgtactattatgtttttggcattgtttgtgaaattcggagacccagcatggcgtat

SEQ ID NO: 411661 - DNA, 140 bp, Artificial Sequence
  Synthetic
atacgccatgctgggtctccaagaagagctcattgtaacatcagtaaaacagattggaacatgactttgcaaaaggtagctacagaattaagaaaacacttccctaataaaacaattacccgtacttgggagtcggccat

SEQ ID NO: 411662 - DNA, 140 bp, Artificial Sequence
  Synthetic
atggccgactcccaagtacgggtaattgttttattagggaagtgttttcttaattctgtagctaccttttgcaaagtcatgttccaatctgttttactgatgttacaatgagctcttcttggagacccagcatggcgtat

SEQ ID NO: 411663 - DNA, 140 bp, Artificial Sequence
  Synthetic
aggccctggctgctgatatgtttactcagtcctcaggaggggacccagaaattacaatgcatagtttcaattgtagaggagagtttttctattgtgatacatcaggactgtttaatagcagaccttttgggacagcggtg

SEQ ID NO: 411664 - DNA, 140 bp, Artificial Sequence
  Synthetic
caccgctgtcccaaaaggtctgctattaaacagtcctgatgtatcacaatagaaaaactctcctctacaattgaaactatgcattgtaatttctgggtcccctcctgaggactgagtaaacatatcagcagccagggcct

SEQ ID NO: 411665 - DNA, 140 bp, Artificial Sequence
  Synthetic
aggccctggctgctgatatggcatagtaatatggggaaagactcctaaatttaaactacccatacaaaaggaaacatgggaagcatggtggatggagtattggcaagccacctggattccgaccttttgggacagcggtg

SEQ ID NO: 411666 - DNA, 140 bp, Artificial Sequence
  Synthetic
caccgctgtcccaaaaggtcggaatccaggtggcttgccaatactccatccaccatgcttcccatgtttccttttgtatgggtagtttaaatttaggagtctttccccatattactatgccatatcagcagccagggcct

SEQ ID NO: 411667 - DNA, 140 bp, Artificial Sequence
  Synthetic
atacgccatgctgggtctccaaaatagcacgaatagcatgaatgatagcatgagtagagaaatgagaaactgctctttcaagacaaccacagaaataagagataagcaacagaacacgtacgtacttgggagtcggccat

SEQ ID NO: 411668 - DNA, 140 bp, Artificial Sequence
  Synthetic
atggccgactcccaagtacgtacgtgttctgttgcttatctcttatttctgtggttgtcttgaaagagcagtttctcatttctctactcatgctatcattcatgctattcgtgctattttggagacccagcatggcgtat

SEQ ID NO: 411669 - DNA, 140 bp, Artificial Sequence
  Synthetic
atacgccatgctgggtctccaacactgaaatcttcagacctggaggaggaaatatgaaggacaattggagaagtgaattatataagtataaggtagttcaaattgaaccgctgggagtagcgtacttgggagtcggccat

SEQ ID NO: 411670 - DNA, 140 bp, Artificial Sequence
  Synthetic
atggccgactcccaagtacgctactcccagcggttcaatttgaactaccttatacttatataattcacttctccaattgtccttcatatttcctcctccaggtctgaagatttcagtgttggagacccagcatggcgtat

SEQ ID NO: 411671 - DNA, 140 bp, Artificial Sequence
  Synthetic
atacgccatgctgggtctcctagtagtaatggtactactcctactactagtactagtagtggtaaagtgaaggaggaaggagaaatgaaaaactgctctttcaatgttaccacaaccatccgtacttgggagtcggccat

SEQ ID NO: 411672 - DNA, 140 bp, Artificial Sequence
  Synthetic
atggccgactcccaagtacggatggttgtggtaacattgaaagagcagtttttcatttctccttcctccttcactttaccactactagtactagtagtaggagtagtaccattactactaggagacccagcatggcgtat

SEQ ID NO: 411673 - DNA, 140 bp, Artificial Sequence
  Synthetic
aggccctggctgctgatatggctgctctggaaaactcatctgcaccactaatgtaccttggaactctagttggagtaacaaatcttttgatgatatttggggaaacatgacctggttgcagaccttttgggacagcggtg

SEQ ID NO: 411674 - DNA, 140 bp, Artificial Sequence
  Synthetic
caccgctgtcccaaaaggtctgcaaccaggtcatgtttccccaaatatcatcaaaagatttgttactccaactagagttccaaggtacattagtggtgcagatgagttttccagagcagccatatcagcagccagggcct

SEQ ID NO: 411675 - DNA, 140 bp, Artificial Sequence
  Synthetic
aggccctggctgctgatatgtaataggagcagaaactttctatgtagatggggcagctaatagggaaactaaagtaggaaaagcagggtatgtcactgacagaggaagacagaaagtggtgaccttttgggacagcggtg

SEQ ID NO: 411676 - DNA, 140 bp, Artificial Sequence
  Synthetic
caccgctgtcccaaaaggtcaccactttctgtcttcctctgtcagtgacataccctgcttttcctactttagtttccctattagctgccccatctacatagaaagtttctgctcctattacatatcagcagccagggcct

SEQ ID NO: 411677 - DNA, 140 bp, Artificial Sequence
  Synthetic
atacgccatgctgggtctcctaccctaactgaaacaacaaatcaaaagactgaactagaagcaattcatctagctttgcaggattcaggactagaagtaaatatagttacagattcacaacgtacttgggagtcggccat

SEQ ID NO: 411678 - DNA, 140 bp, Artificial Sequence
  Synthetic
atggccgactcccaagtacgttgtgaatctgtaactatatttacttctagtcctgaatcctgcaaagctagatgaattgcttctagttcagtcttttgatttgttgtttcagttagggtaggagacccagcatggcgtat

SEQ ID NO: 411679 - DNA, 140 bp, Artificial Sequence
  Synthetic
aggccctggctgctgatatgcaagacccaacaataatacaagaaaaagtatgaggataggaccaggacaaacattctatgcaacaggagacataataggagatataagacaagcacattggaccttttgggacagcggtg

SEQ ID NO: 411680 - DNA, 140 bp, Artificial Sequence
  Synthetic
caccgctgtcccaaaaggtccaatgtgcttgtcttatatctcctattatgtctcctgttgcatagaatgtttgtcctggtcctatcctcatactttttcttgtattattgttgggtcttgcatatcagcagccagggcct

SEQ ID NO: 411681 - DNA, 140 bp, Artificial Sequence
  Synthetic
aggccctggctgctgatatgtcagggaaagaatgagaagagctattccagcaccagcagcagaaggagtgggagcagtgtctagagatttagagaaacatggagcaatcacaagcagtaagaccttttgggacagcggtg

SEQ ID NO: 411682 - DNA, 140 bp, Artificial Sequence
  Synthetic
caccgctgtcccaaaaggtcttactgcttgtgattgctccatgtttctctaaatctctagacactgctcccactccttctgctgctggtgctggaatagctcttctcattctttccctgacatatcagcagccagggcct

SEQ ID NO: 411683 - DNA, 140 bp, Artificial Sequence
  Synthetic
atacgccatgctgggtctccgtggcgcccgaacagggaccttaaagcgaaagtaaaagggactcgaaagcggaagttccagagaagactctcgacgcaggactcggcttgctgagtgcaccgtacttgggagtcggccat

SEQ ID NO: 411684 - DNA, 140 bp, Artificial Sequence
  Synthetic
atggccgactcccaagtacggtgcactcagcaagccgagtcctgcgtcgagagtcttctctggaacttccgctttcgagtcccttttactttcgctttaaggtccctgttcgggcgccacggagacccagcatggcgtat

SEQ ID NO: 411685 - DNA, 140 bp, Artificial Sequence
  Synthetic
aggccctggctgctgatatgggaagttccagagaagactctcgacgcaggactcggcttgctgagtgcacacagcaagaggcgaggagcggcgactggtgagtacgccaaaatattttttgaccttttgggacagcggtg

SEQ ID NO: 411686 - DNA, 140 bp, Artificial Sequence
  Synthetic
caccgctgtcccaaaaggtcaaaaaatattttggcgtactcaccagtcgccgctcctcgcctcttgctgtgtgcactcagcaagccgagtcctgcgtcgagagtcttctctggaacttcccatatcagcagccagggcct

SEQ ID NO: 411687 - DNA, 140 bp, Artificial Sequence
  Synthetic
aggccctggctgctgatatgtaaatgtaaaagacaccaaggaagctttggataaagtagaggaaatgcaaaacaaaaaagcacagcaggcagcagataacacaggaagcagcagtaaggtgaccttttgggacagcggtg

SEQ ID NO: 411688 - DNA, 140 bp, Artificial Sequence
  Synthetic
caccgctgtcccaaaaggtcaccttactgctgcttcctgtgttatctgctgcctgctgtgcttttttgttttgcatttcctctactttatccaaagcttccttggtgtcttttacatttacatatcagcagccagggcct

SEQ ID NO: 411689 - DNA, 140 bp, Artificial Sequence
  Synthetic
atacgccatgctgggtctccaggccctatcacctaggactttgaatgcatgggtaaaggtggtagaggaaaaggcctttagcccagaagtaatacccatgtttgtggcattgtcagaaggcgtacttgggagtcggccat

SEQ ID NO: 411690 - DNA, 140 bp, Artificial Sequence
  Synthetic
atggccgactcccaagtacgccttctgacaatgccacaaacatgggtattacttctgggctaaaggccttttcctctaccacctttacccatgcattcaaagtcctaggtgatagggcctggagacccagcatggcgtat

SEQ ID NO: 411691 - DNA, 140 bp, Artificial Sequence
  Synthetic
aggccctggctgctgatatgtataattaattagttctgtaatgatatctttacaaatagcaagcataatagcattagtagtagcattcattatagtagtagttgtgtggactatagtagggaccttttgggacagcggtg

SEQ ID NO: 411692 - DNA, 140 bp, Artificial Sequence
  Synthetic
caccgctgtcccaaaaggtccctactatagtccacacaactactactataatgaatgctactactaatgctattatgcttgctatttgtaaagatatcattacagaactaattaattatacatatcagcagccagggcct

SEQ ID NO: 411693 - DNA, 140 bp, Artificial Sequence
  Synthetic
atacgccatgctgggtctccgagacaggctaattttttagggagattctggcctcccaacaaggggaggccagggaattttcctcagagcaggttagtgccaacagctccaccagcagagcgtacttgggagtcggccat

SEQ ID NO: 411694 - DNA, 140 bp, Artificial Sequence
  Synthetic
atggccgactcccaagtacgctctgctggtggagctgttggcactaacctgctctgaggaaaattccctggcctccccttgttgggaggccagaatctccctaaaaaattagcctgtctcggagacccagcatggcgtat

SEQ ID NO: 411695 - DNA, 140 bp, Artificial Sequence
  Synthetic
aggccctggctgctgatatgccatcccttcagacaggatcagaagaacttaaatcattatttaatgcagtagcagtcctctattgtgtacatcaaaggatagagataaaagacaccaagggaccttttgggacagcggtg

SEQ ID NO: 411696 - DNA, 140 bp, Artificial Sequence
  Synthetic
caccgctgtcccaaaaggtcccttggtgtcttttatctctatcctttgatgtacacaatagaggactgctactgcattaaataatgatttaagttcttctgatcctgtctgaagggatggcatatcagcagccagggcct

SEQ ID NO: 411697 - DNA, 140 bp, Artificial Sequence
  Synthetic
atacgccatgctgggtctccagctgggaccaggacgagcattttatgcaacaggagacataataggagacatcagacaggcacattgtaacgttgatggaaaacaatggcataaaaagttcgtacttgggagtcggccat

SEQ ID NO: 411698 - DNA, 140 bp, Artificial Sequence
  Synthetic
atggccgactcccaagtacgaactttttatgccattgttttccatcaacgttacaatgtgcctgtctgatgtctcctattatgtctcctgttgcataaaatgctcgtcctggtcccagctggagacccagcatggcgtat

SEQ ID NO: 411699 - DNA, 140 bp, Artificial Sequence
  Synthetic
atacgccatgctgggtctccacagcaggcaaaagcggctgacggaaaggtcagtcaaaattatcctatagtacagaatctccaagggcaaatggtacaccaggccatatcacctagaactcgtacttgggagtcggccat

SEQ ID NO: 411700 - DNA, 140 bp, Artificial Sequence
  Synthetic
atggccgactcccaagtacgagttctaggtgatatggcctggtgtaccatttgcccttggagattctgtactataggataattttgactgacctttccgtcagccgcttttgcctgctgtggagacccagcatggcgtat

SEQ ID NO: 411701 - DNA, 140 bp, Artificial Sequence
  Synthetic
atacgccatgctgggtctcccactgtggagggccaagcagaaatgaaaaattgctctttcaatataaccacagaaataagagataagcagaagcaagaatatgcgcttttctataaacttcgtacttgggagtcggccat

SEQ ID NO: 411702 - DNA, 140 bp, Artificial Sequence
  Synthetic
atggccgactcccaagtacgaagtttatagaaaagcgcatattcttgcttctgcttatctcttatttctgtggttatattgaaagagcaatttttcatttctgcttggccctccacagtgggagacccagcatggcgtat

SEQ ID NO: 411703 - DNA, 140 bp, Artificial Sequence
  Synthetic
aggccctggctgctgatatggacaagctttctatgcaacaggtgctataataggggatataagacaagcacattgtgtaatcaatgcaacaatatggaataacactttaaaaagggtagtgaccttttgggacagcggtg

SEQ ID NO: 411704 - DNA, 140 bp, Artificial Sequence
  Synthetic
caccgctgtcccaaaaggtcactaccctttttaaagtgttattccatattgttgcattgattacacaatgtgcttgtcttatatcccctattatagcacctgttgcatagaaagcttgtccatatcagcagccagggcct

SEQ ID NO: 411705 - DNA, 140 bp, Artificial Sequence
  Synthetic
aggccctggctgctgatatgtcagagtagcatgacaaaaatcttagaaccctttagggcacagaatccagaaatagttatctaccaatacatggatgacttgtatgtaggatctgacttagaccttttgggacagcggtg

SEQ ID NO: 411706 - DNA, 140 bp, Artificial Sequence
  Synthetic
caccgctgtcccaaaaggtctaagtcagatcctacatacaagtcatccatgtattggtagataactatttctggattctgtgccctaaagggttctaagatttttgtcatgctactctgacatatcagcagccagggcct

SEQ ID NO: 411707 - DNA, 140 bp, Artificial Sequence
  Synthetic
atacgccatgctgggtctcctaacactctcatgcaaaataaagcaaattgtaaggatgtggcagagagtaggacaagcaatgtatgcccctcccatccaaggaaagataatgtgtaactccgtacttgggagtcggccat

SEQ ID NO: 411708 - DNA, 140 bp, Artificial Sequence
  Synthetic
atggccgactcccaagtacggagttacacattatctttccttggatgggaggggcatacattgcttgtcctactctctgccacatccttacaatttgctttattttgcatgagagtgttaggagacccagcatggcgtat

SEQ ID NO: 411709 - DNA, 140 bp, Artificial Sequence
  Synthetic
aggccctggctgctgatatgcagataggattatagaagtagtacaaagaacttgtagagctattcgccacatacctagaagaataagacagggctttgaaagggctttgctataagatgggaccttttgggacagcggtg

SEQ ID NO: 411710 - DNA, 140 bp, Artificial Sequence
  Synthetic
caccgctgtcccaaaaggtcccatcttatagcaaagccctttcaaagccctgtcttattcttctaggtatgtggcgaatagctctacaagttctttgtactacttctataatcctatctgcatatcagcagccagggcct

SEQ ID NO: 411711 - DNA, 140 bp, Artificial Sequence
  Synthetic
aggccctggctgctgatatgatacctagaagaataagacagggctttgaaagggctttgctataagatggggggcaagtggtcaaaatatagtggatggtctgccataagggaaagaatggaccttttgggacagcggtg

SEQ ID NO: 411712 - DNA, 140 bp, Artificial Sequence
  Synthetic
caccgctgtcccaaaaggtccattctttcccttatggcagaccatccactatattttgaccacttgccccccatcttatagcaaagccctttcaaagccctgtcttattcttctaggtatcatatcagcagccagggcct

SEQ ID NO: 411713 - DNA, 140 bp, Artificial Sequence
  Synthetic
aggccctggctgctgatatgagcaatactagagccaataatcctgacttggcctggctggaagcacaagaggaagaggaagtaggctttccagtcagacctcaggtacctttaagaccaagaccttttgggacagcggtg

SEQ ID NO: 411714 - DNA, 140 bp, Artificial Sequence
  Synthetic
caccgctgtcccaaaaggtcttggtcttaaaggtacctgaggtctgactggaaagcctacttcctcttcctcttgtgcttccagccaggccaagtcaggattattggctctagtattgctcatatcagcagccagggcct

SEQ ID NO: 411715 - DNA, 140 bp, Artificial Sequence
  Synthetic
atacgccatgctgggtctccgaatcttacacagtattggagccaagaactgaagaatagtgctattagcctgcttaataccacagcaatagtagtagctgaaggaacagataggattatacgtacttgggagtcggccat

SEQ ID NO: 411716 - DNA, 140 bp, Artificial Sequence
  Synthetic
atggccgactcccaagtacgtataatcctatctgttccttcagctactactattgctgtggtattaagcaggctaatagcactattcttcagttcttggctccaatactgtgtaagattcggagacccagcatggcgtat

SEQ ID NO: 411717 - DNA, 140 bp, Artificial Sequence
  Synthetic
aggccctggctgctgatatgaaaagtagaatagtaggatggcctgagattagggaaagaataagacgaacttctccaacagcagcagcaccaggagtaggagcagtatctaaagatttaggaccttttgggacagcggtg

SEQ ID NO: 411718 - DNA, 140 bp, Artificial Sequence
  Synthetic
caccgctgtcccaaaaggtcctaaatctttagatactgctcctactcctggtgctgctgctgttggagaagttcgtcttattctttccctaatctcaggccatcctactattctacttttcatatcagcagccagggcct

SEQ ID NO: 411719 - DNA, 140 bp, Artificial Sequence
  Synthetic
aggccctggctgctgatatgagtttgctttcagaaaaaaggcttaggcatttcctatggcaggaagaagcggagacagcgacgaagcgctcctccaagcagtgaggatcatcaaaatcttgaccttttgggacagcggtg

SEQ ID NO: 411720 - DNA, 140 bp, Artificial Sequence
  Synthetic
caccgctgtcccaaaaggtcaagattttgatgatcctcactgcttggaggagcgcttcgtcgctgtctccgcttcttcctgccataggaaatgcctaagccttttttctgaaagcaaactcatatcagcagccagggcct

SEQ ID NO: 411721 - DNA, 140 bp, Artificial Sequence
  Synthetic
aggccctggctgctgatatgagccttttagaaacaggagaaggatgtaaacaaataatgggacaattacaaccagctctcgggacaggaacagaagaacttagatcattatataatacaggaccttttgggacagcggtg

SEQ ID NO: 411722 - DNA, 140 bp, Artificial Sequence
  Synthetic
caccgctgtcccaaaaggtcctgtattatataatgatctaagttcttctgttcctgtcccgagagctggttgtaattgtcccattatttgtttacatccttctcctgtttctaaaaggctcatatcagcagccagggcct

SEQ ID NO: 411723 - DNA, 140 bp, Artificial Sequence
  Synthetic
atacgccatgctgggtctcctagcagccctctattgtgtacatctcaggatagaggtaaaggacaccaaggaggctttagataaagtagaggaaatacaaaataagagcaagaaacagcacgtacttgggagtcggccat

SEQ ID NO: 411724 - DNA, 140 bp, Artificial Sequence
  Synthetic
atggccgactcccaagtacgtgctgtttcttgctcttattttgtatttcctctactttatctaaagcctccttggtgtcctttacctctatcctgagatgtacacaatagagggctgctaggagacccagcatggcgtat

SEQ ID NO: 411725 - DNA, 140 bp, Artificial Sequence
  Synthetic
aggccctggctgctgatatgtaaattgtacaagtgttaaggataccaagaataatactaccaagcacaatgatagcatgattcaagaaatgagtaattgctctttctatacaaccacagggaccttttgggacagcggtg

SEQ ID NO: 411726 - DNA, 140 bp, Artificial Sequence
  Synthetic
caccgctgtcccaaaaggtccctgtggttgtatagaaagagcaattactcatttcttgaatcatgctatcattgtgcttggtagtattattcttggtatccttaacacttgtacaatttacatatcagcagccagggcct

SEQ ID NO: 411727 - DNA, 140 bp, Artificial Sequence
  Synthetic
atacgccatgctgggtctcccctagcagaagaggatataataattaaatctgaaaatatgacaaacaatatcaaaacaataatagtccactttaatgaatctgtgcagattatgtgtgcacgtacttgggagtcggccat

SEQ ID NO: 411728 - DNA, 140 bp, Artificial Sequence
  Synthetic
atggccgactcccaagtacgtgcacacataatctgcacagattcattaaagtggactattattgttttgatattgtttgtcatattttcagatttaattattatatcctcttctgctaggggagacccagcatggcgtat

SEQ ID NO: 411729 - DNA, 140 bp, Artificial Sequence
  Synthetic
atacgccatgctgggtctccattctatacaaataacataataggagacataagacgagcacattgtaatattactagaaagcaatggaaccaaactttagaacgggtaaaggaaaaattacgtacttgggagtcggccat

SEQ ID NO: 411730 - DNA, 140 bp, Artificial Sequence
  Synthetic
atggccgactcccaagtacgtaatttttcctttacccgttctaaagtttggttccattgctttctagtaatattacaatgtgctcgtcttatgtctcctattatgttatttgtatagaatggagacccagcatggcgtat

SEQ ID NO: 411731 - DNA, 140 bp, Artificial Sequence
  Synthetic
aggccctggctgctgatatgttactagaaagcaatggaaccaaactttagaacgggtaaaggaaaaattaagaaaacattaccccaataaaacaataaaatttgacaaaccttcaggagggaccttttgggacagcggtg

SEQ ID NO: 411732 - DNA, 140 bp, Artificial Sequence
  Synthetic
caccgctgtcccaaaaggtccctcctgaaggtttgtcaaattttattgttttattggggtaatgttttcttaatttttcctttacccgttctaaagtttggttccattgctttctagtaacatatcagcagccagggcct

SEQ ID NO: 411733 - DNA, 140 bp, Artificial Sequence
  Synthetic
aggccctggctgctgatatgccaagaataagttcagaagtacacatcccactaggggatgctaaattagtaataacaacatattggggtctgcatacaggagaaagagaatggcatctgggaccttttgggacagcggtg

SEQ ID NO: 411734 - DNA, 140 bp, Artificial Sequence
  Synthetic
caccgctgtcccaaaaggtcccagatgccattctctttctcctgtatgcagaccccaatatgttgttattactaatttagcatcccctagtgggatgtgtacttctgaacttattcttggcatatcagcagccagggcct

SEQ ID NO: 411735 - DNA, 140 bp, Artificial Sequence
  Synthetic
atacgccatgctgggtctcctgccagctttgctttataaccaaaggcttaggcatatcctatggcaggaagaagcggagaccccgacgaggcacttctcggagcaatcaggatcatcaaacgtacttgggagtcggccat

SEQ ID NO: 411736 - DNA, 140 bp, Artificial Sequence
  Synthetic
atggccgactcccaagtacgtttgatgatcctgattgctccgagaagtgcctcgtcggggtctccgcttcttcctgccataggatatgcctaagcctttggttataaagcaaagctggcaggagacccagcatggcgtat

SEQ ID NO: 411737 - DNA, 140 bp, Artificial Sequence
  Synthetic
atacgccatgctgggtctccattgcaatacaacaaaactgtttaatgaaagtgaaacacagtttgcggcaaacaacagtgccaatagtaacatcacactcccatgcaagataaaacaaatcgtacttgggagtcggccat

SEQ ID NO: 411738 - DNA, 140 bp, Artificial Sequence
  Synthetic
atggccgactcccaagtacgatttgttttatcttgcatgggagtgtgatgttactattggcactgttgtttgccgcaaactgtgtttcactttcattaaacagttttgttgtattgcaatggagacccagcatggcgtat

SEQ ID NO: 411739 - DNA, 140 bp, Artificial Sequence
  Synthetic
aggccctggctgctgatatgaacaacagtgccaatagtaacatcacactcccatgcaagataaaacaaattataaacatgtggcagcaggtgggacgagcaatgtatgcccctcctgttcgaccttttgggacagcggtg

SEQ ID NO: 411740 - DNA, 140 bp, Artificial Sequence
  Synthetic
caccgctgtcccaaaaggtcgaacaggaggggcatacattgctcgtcccacctgctgccacatgtttataatttgttttatcttgcatgggagtgtgatgttactattggcactgttgttcatatcagcagccagggcct

SEQ ID NO: 411741 - DNA, 140 bp, Artificial Sequence
  Synthetic
aggccctggctgctgatatgcagtctattatggggtacctgtgtggagagatgcagaaaccaccctattctgtgcatcagatgctaaggcatatgatacagaagtgcataatgtctgggcgaccttttgggacagcggtg

SEQ ID NO: 411742 - DNA, 140 bp, Artificial Sequence
  Synthetic
caccgctgtcccaaaaggtcgcccagacattatgcacttctgtatcatatgccttagcatctgatgcacagaatagggtggtttctgcatctctccacacaggtaccccataatagactgcatatcagcagccagggcct

SEQ ID NO: 411743 - DNA, 140 bp, Artificial Sequence
  Synthetic
atacgccatgctgggtctccatagaactagcagaaaccatactgacataaacagggaaatgagaaactgctctttcaatatgaccacagtactaagagataagcaagagaaagtacatgccgtacttgggagtcggccat

SEQ ID NO: 411744 - DNA, 140 bp, Artificial Sequence
  Synthetic
atggccgactcccaagtacggcatgtactttctcttgcttatctcttagtactgtggtcatattgaaagagcagtttctcatttccctgtttatgtcagtatggtttctgctagttctatggagacccagcatggcgtat

SEQ ID NO: 411745 - DNA, 140 bp, Artificial Sequence
  Synthetic
aggccctggctgctgatatgcccagcaggttttgcaattctaaagtgtagagataaggattttaatggaacggggctatgcacaaatgtcagcacagtacaatgcacacatgggattaaggaccttttgggacagcggtg

SEQ ID NO: 411746 - DNA, 140 bp, Artificial Sequence
  Synthetic
caccgctgtcccaaaaggtccttaatcccatgtgtgcattgtactgtgctgacatttgtgcatagccccgttccattaaaatccttatctctacactttagaattgcaaaacctgctgggcatatcagcagccagggcct

SEQ ID NO: 411747 - DNA, 140 bp, Artificial Sequence
  Synthetic
atacgccatgctgggtctccagtaaaggttaggtctgaaaatttcacaaacaatgccaaaaacataatagtacagtttgataaggctgtagtaattaactgtagcagacccaacaacaatcgtacttgggagtcggccat

SEQ ID NO: 411748 - DNA, 140 bp, Artificial Sequence
  Synthetic
atggccgactcccaagtacgattgttgttgggtctgctacagttaattactacagccttatcaaactgtactattatgtttttggcattgtttgtgaaattttcagacctaacctttactggagacccagcatggcgtat

SEQ ID NO: 411749 - DNA, 140 bp, Artificial Sequence
  Synthetic
atacgccatgctgggtctccacaagaaaaagtatacatctaggaccaggacaatcattctatgcaacaggtgatataataggagacataagacaagctgcttgcaacatcagtagaaaagcgtacttgggagtcggccat

SEQ ID NO: 411750 - DNA, 140 bp, Artificial Sequence
  Synthetic
atggccgactcccaagtacgcttttctactgatgttgcaagcagcttgtcttatgtctcctattatatcacctgttgcatagaatgattgtcctggtcctagatgtatactttttcttgtggagacccagcatggcgtat

SEQ ID NO: 411751 - DNA, 140 bp, Artificial Sequence
  Synthetic
atacgccatgctgggtctccaccaataatagtagtacttcggaaaataatactaatcccactattagtggtggggaagggatgggggaaggagagatgaaaaactgctctttcaatgttacgtacttgggagtcggccat

SEQ ID NO: 411752 - DNA, 140 bp, Artificial Sequence
  Synthetic
atggccgactcccaagtacgtaacattgaaagagcagtttttcatctctccttcccccatcccttccccaccactaatagtgggattagtattattttccgaagtactactattattggtggagacccagcatggcgtat

SEQ ID NO: 411753 - DNA, 140 bp, Artificial Sequence
  Synthetic
aggccctggctgctgatatgcagggctttgaagcagctttgctataaaatggggggcaagtggtcaaaaagcagcaaaaataaatgggagaatgtaagagaaagaatgagacaaactgaggaccttttgggacagcggtg

SEQ ID NO: 411754 - DNA, 140 bp, Artificial Sequence
  Synthetic
caccgctgtcccaaaaggtcctcagtttgtctcattctttctcttacattctcccatttatttttgctgctttttgaccacttgccccccattttatagcaaagctgcttcaaagccctgcatatcagcagccagggcct

SEQ ID NO: 411755 - DNA, 140 bp, Artificial Sequence
  Synthetic
atacgccatgctgggtctcctaatgataccagtatccaggatagtgctaatgttaccagtatcaaaaatgaaatgcaaaattgctctttcaatgcaaccacagaaatagtagataaaaaacgtacttgggagtcggccat

SEQ ID NO: 411756 - DNA, 140 bp, Artificial Sequence
  Synthetic
atggccgactcccaagtacgttttttatctactatttctgtggttgcattgaaagagcaattttgcatttcatttttgatactggtaacattagcactatcctggatactggtatcattaggagacccagcatggcgtat

SEQ ID NO: 411757 - DNA, 140 bp, Artificial Sequence
  Synthetic
aggccctggctgctgatatgcattttatgcaacaggagccataataggagatataagacaagcacattgtaacattagtagagaaaaatggaatgacactttaaaacagctagttataaagaccttttgggacagcggtg

SEQ ID NO: 411758 - DNA, 140 bp, Artificial Sequence
  Synthetic
caccgctgtcccaaaaggtctttataactagctgttttaaagtgtcattccatttttctctactaatgttacaatgtgcttgtcttatatctcctattatggctcctgttgcataaaatgcatatcagcagccagggcct

SEQ ID NO: 411759 - DNA, 140 bp, Artificial Sequence
  Synthetic
aggccctggctgctgatatggctaccaccgcttgagagacttactcttgattgtaacgaggattgtggaacttctgggacgcagggggtgggaaatcctcaaatattggtggaatctcctgaccttttgggacagcggtg

SEQ ID NO: 411760 - DNA, 140 bp, Artificial Sequence
  Synthetic
caccgctgtcccaaaaggtcaggagattccaccaatatttgaggatttcccaccccctgcgtcccagaagttccacaatcctcgttacaatcaagagtaagtctctcaagcggtggtagccatatcagcagccagggcct

SEQ ID NO: 411761 - DNA, 140 bp, Artificial Sequence
  Synthetic
aggccctggctgctgatatggaggaactcaagcaggaagctgtcagacactttcctagaccatggctccatagcttaggacaatatatctatgaaacctatggggatacttggacaggaggaccttttgggacagcggtg

SEQ ID NO: 411762 - DNA, 140 bp, Artificial Sequence
  Synthetic
caccgctgtcccaaaaggtcctcctgtccaagtatccccataggtttcatagatatattgtcctaagctatggagccatggtctaggaaagtgtctgacagcttcctgcttgagttcctccatatcagcagccagggcct

SEQ ID NO: 411763 - DNA, 140 bp, Artificial Sequence
  Synthetic
atacgccatgctgggtctccataatacaagaaaaagtgtaaggataggaccaggacaaaccttctatgccacagatggcataataggggacataagaaaagcatattgtaacattagtgacgtacttgggagtcggccat

SEQ ID NO: 411764 - DNA, 140 bp, Artificial Sequence
  Synthetic
atggccgactcccaagtacgtcactaatgttacaatatgcttttcttatgtcccctattatgccatctgtggcatagaaggtttgtcctggtcctatccttacactttttcttgtattatggagacccagcatggcgtat

SEQ ID NO: 411765 - DNA, 140 bp, Artificial Sequence
  Synthetic
atacgccatgctgggtctccggacaccaaatgaaagactgtactgagaggcaggctaattttttagggagaatttggccttcccacaagggggggaggccagggaatttccttcagaacacgtacttgggagtcggccat

SEQ ID NO: 411766 - DNA, 140 bp, Artificial Sequence
  Synthetic
atggccgactcccaagtacgtgttctgaaggaaattccctggcctcccccccttgtgggaaggccaaattctccctaaaaaattagcctgcctctcagtacagtctttcatttggtgtccggagacccagcatggcgtat

SEQ ID NO: 411767 - DNA, 140 bp, Artificial Sequence
  Synthetic
aggccctggctgctgatatggaagttgcaacacatatctttaattgtagaggggaatttttctattgctatacctcaaagctgtttaatagtacatacacgtctaattcaaccagttccagaccttttgggacagcggtg

SEQ ID NO: 411768 - DNA, 140 bp, Artificial Sequence
  Synthetic
caccgctgtcccaaaaggtctggaactggttgaattagacgtgtatgtactattaaacagctttgaggtatagcaatagaaaaattcccctctacaattaaagatatgtgttgcaacttccatatcagcagccagggcct

SEQ ID NO: 411769 - DNA, 140 bp, Artificial Sequence
  Synthetic
aggccctggctgctgatatgctggtagcagtccatgtagccagtggctatatagaagcagaagttatcccagcagaaacaggacaggaaacagcatactttatattaaaattagcaggaagaccttttgggacagcggtg

SEQ ID NO: 411770 - DNA, 140 bp, Artificial Sequence
  Synthetic
caccgctgtcccaaaaggtcttcctgctaattttaatataaagtatgctgtttcctgtcctgtttctgctgggataacttctgcttctatatagccactggctacatggactgctaccagcatatcagcagccagggcct

SEQ ID NO: 411771 - DNA, 140 bp, Artificial Sequence
  Synthetic
aggccctggctgctgatatgccctctctgtgttgctttaaactgtagtaatgcaactataatcattaatagtactaacaatagcaccactaatagtactggcaatagcactgtgaagagtgaccttttgggacagcggtg

SEQ ID NO: 411772 - DNA, 140 bp, Artificial Sequence
  Synthetic
caccgctgtcccaaaaggtcactcttcacagtgctattgccagtactattagtggtgctattgttagtactattaatgattatagttgcattactacagtttaaagcaacacagagagggcatatcagcagccagggcct

SEQ ID NO: 411773 - DNA, 140 bp, Artificial Sequence
  Synthetic
aggccctggctgctgatatgctatcaaagcagtaagtagtacatgtaatgcaatctttacaaatattagcaatagtagcattagtagtagcagcaataatagcaatagttgtgtggaccagaccttttgggacagcggtg

SEQ ID NO: 411774 - DNA, 140 bp, Artificial Sequence
  Synthetic
caccgctgtcccaaaaggtctggtccacacaactattgctattattgctgctactactaatgctactattgctaatatttgtaaagattgcattacatgtactacttactgctttgatagcatatcagcagccagggcct

SEQ ID NO: 411775 - DNA, 140 bp, Artificial Sequence
  Synthetic
atacgccatgctgggtctccttagagagggctttgcaataaaatggggggcaagtggtcaaaaagcagcgtagtgggatggcctgaagtcagggaaagaatgagaaggactcctccagcacgtacttgggagtcggccat

SEQ ID NO: 411776 - DNA, 140 bp, Artificial Sequence
  Synthetic
atggccgactcccaagtacgtgctggaggagtccttctcattctttccctgacttcaggccatcccactacgctgctttttgaccacttgccccccattttattgcaaagccctctctaaggagacccagcatggcgtat

SEQ ID NO: 411777 - DNA, 140 bp, Artificial Sequence
  Synthetic
aggccctggctgctgatatgtagtgggatggcctgaagtcagggaaagaatgagaaggactcctccagcagcaacaggagtgggagcagtgtctagagatttagataaacatggagcagtgaccttttgggacagcggtg

SEQ ID NO: 411778 - DNA, 140 bp, Artificial Sequence
  Synthetic
caccgctgtcccaaaaggtcactgctccatgtttatctaaatctctagacactgctcccactcctgttgctgctggaggagtccttctcattctttccctgacttcaggccatcccactacatatcagcagccagggcct

SEQ ID NO: 411779 - DNA, 140 bp, Artificial Sequence
  Synthetic
aggccctggctgctgatatgagaagaaggtggagagcaagacagaagcagatccattcgcttagtgagcggattcttaccgcttgcctgggacgacctgcggagcctgtgcctcttcagcgaccttttgggacagcggtg

SEQ ID NO: 411780 - DNA, 140 bp, Artificial Sequence
  Synthetic
caccgctgtcccaaaaggtcgctgaagaggcacaggctccgcaggtcgtcccaggcaagcggtaagaatccgctcactaagcgaatggatctgcttctgtcttgctctccaccttcttctcatatcagcagccagggcct

SEQ ID NO: 411781 - DNA, 140 bp, Artificial Sequence
  Synthetic
atacgccatgctgggtctccaaatcattatataatgcagtagcagtcctctgctgtgtgcatcaaaaaataaatgtaaaagacaccaaggaagctttggatgaaatagagaaaatacaaacgtacttgggagtcggccat

SEQ ID NO: 411782 - DNA, 140 bp, Artificial Sequence
  Synthetic
atggccgactcccaagtacgtttgtattttctctatttcatccaaagcttccttggtgtcttttacatttattttttgatgcacacagcagaggactgctactgcattatataatgatttggagacccagcatggcgtat

SEQ ID NO: 411783 - DNA, 140 bp, Artificial Sequence
  Synthetic
atacgccatgctgggtctccaatgaaactcataataccaccctgaaggaagagtcaggggcaatacaaaactgttctttcaatatgaccacagcaataagagataagcagaggaaaggcccgtacttgggagtcggccat

SEQ ID NO: 411784 - DNA, 140 bp, Artificial Sequence
  Synthetic
atggccgactcccaagtacgggcctttcctctgcttatctcttattgctgtggtcatattgaaagaacagttttgtattgcccctgactcttccttcagggtggtattatgagtttcattggagacccagcatggcgtat

SEQ ID NO: 411785 - DNA, 140 bp, Artificial Sequence
  Synthetic
aggccctggctgctgatatgtctgggacacagcagcctcaggggactacagagggggtgggaagcccttaagtatctaggaagtcttgtgcagtattggggtctggaactaaaaaagagtgaccttttgggacagcggtg

SEQ ID NO: 411786 - DNA, 140 bp, Artificial Sequence
  Synthetic
caccgctgtcccaaaaggtcactcttttttagttccagaccccaatactgcacaagacttcctagatacttaagggcttcccaccccctctgtagtcccctgaggctgctgtgtcccagacatatcagcagccagggcct

SEQ ID NO: 411787 - DNA, 140 bp, Artificial Sequence
  Synthetic
aggccctggctgctgatatgtaggattatagaattcatacaagaaattggtagagctattctccacatacctagaagaatcagacagggttttgaagcagctttgctataataatggggggaccttttgggacagcggtg

SEQ ID NO: 411788 - DNA, 140 bp, Artificial Sequence
  Synthetic
caccgctgtcccaaaaggtccccccattattatagcaaagctgcttcaaaaccctgtctgattcttctaggtatgtggagaatagctctaccaatttcttgtatgaattctataatcctacatatcagcagccagggcct

SEQ ID NO: 411789 - DNA, 140 bp, Artificial Sequence
  Synthetic
aggccctggctgctgatatgagtggtatcaactcaattgttgttaaatggcagcctagcagaagaagatataataatcaggtctcaaaatatctcagataatgcaaaaaccataatagtagaccttttgggacagcggtg

SEQ ID NO: 411790 - DNA, 140 bp, Artificial Sequence
  Synthetic
caccgctgtcccaaaaggtctactattatggtttttgcattatctgagatattttgagacctgattattatatcttcttctgctaggctgccatttaacaacaattgagttgataccactcatatcagcagccagggcct

SEQ ID NO: 411791 - DNA, 140 bp, Artificial Sequence
  Synthetic
atacgccatgctgggtctcccagtgttattgtaaaaggtgttgctatcattgtcaacattgcttcttaaagaaaggcttaggcatttcctatggcaggaagaagtggagacagcgacgcacgtacttgggagtcggccat

SEQ ID NO: 411792 - DNA, 140 bp, Artificial Sequence
  Synthetic
atggccgactcccaagtacgtgcgtcgctgtctccacttcttcctgccataggaaatgcctaagcctttctttaagaagcaatgttgacaatgatagcaacaccttttacaataacactgggagacccagcatggcgtat

SEQ ID NO: 411793 - DNA, 140 bp, Artificial Sequence
  Synthetic
aggccctggctgctgatatggaaaggcttaggcatttcctatggcaggaagaagtggagacagcgacgcacagcttctcgcagcagcaagaatcatcaagatcctataccagagcagtgagaccttttgggacagcggtg

SEQ ID NO: 411794 - DNA, 140 bp, Artificial Sequence
  Synthetic
caccgctgtcccaaaaggtctcactgctctggtataggatcttgatgattcttgctgctgcgagaagctgtgcgtcgctgtctccacttcttcctgccataggaaatgcctaagcctttccatatcagcagccagggcct

SEQ ID NO: 411795 - DNA, 140 bp, Artificial Sequence
  Synthetic
atacgccatgctgggtctcctagcattagttagcagcatttattaatagcaataattgtgtggactatagcaggtatagaatatagaaggctgttaagacacaggaaatagatagattatcgtacttgggagtcggccat

SEQ ID NO: 411796 - DNA, 140 bp, Artificial Sequence
  Synthetic
atggccgactcccaagtacgataatctatctatttcctgtgtcttaacagccttctatattctatacctgctatagtccacacaattattgctattaataaatgctgctaactaatgctaggagacccagcatggcgtat

SEQ ID NO: 411797 - DNA, 140 bp, Artificial Sequence
  Synthetic
aggccctggctgctgatatgcaggtatagaatatagaaggctgttaagacacaggaaatagatagattattatagaataagagaagagcagaagacagtggcaatgagagtgaaggagacgaccttttgggacagcggtg

SEQ ID NO: 411798 - DNA, 140 bp, Artificial Sequence
  Synthetic
caccgctgtcccaaaaggtcgtctccttcactctcattgccactgtcttctgctcttctcttattctataataatctatctatttcctgtgtcttaacagccttctatattctatacctgcatatcagcagccagggcct

SEQ ID NO: 411799 - DNA, 140 bp, Artificial Sequence
  Synthetic
atacgccatgctgggtctcctgttaatgatctgtaatgcagaaaaaatgtgggtcacagtctattatggggtacctgtgtggagagatgcggataccattctattttgtgcatctgatgccgtacttgggagtcggccat

SEQ ID NO: 411800 - DNA, 140 bp, Artificial Sequence
  Synthetic
atggccgactcccaagtacggcatcagatgcacaaaatagaatggtatccgcatctctccacacaggtaccccataatagactgtgacccacattttttctgcattacagatcattaacaggagacccagcatggcgtat

SEQ ID NO: 411801 - DNA, 140 bp, Artificial Sequence
  Synthetic
aggccctggctgctgatatgattatcctatagtgcagaatctccaagggcaaatggtacaccaggccctatcacctagaactttgaatgcatgggtaaaagtaatagaggagaaggctttgaccttttgggacagcggtg

SEQ ID NO: 411802 - DNA, 140 bp, Artificial Sequence
  Synthetic
caccgctgtcccaaaaggtcaaagccttctcctctattacttttacccatgcattcaaagttctaggtgatagggcctggtgtaccatttgcccttggagattctgcactataggataatcatatcagcagccagggcct

SEQ ID NO: 411803 - DNA, 140 bp, Artificial Sequence
  Synthetic
aggccctggctgctgatatgtcacctagaactttgaatgcatgggtaaaagtaatagaggagaaggcttttagcccagaggtaatacccatgtttacagcattatcagaaggagccacccgaccttttgggacagcggtg

SEQ ID NO: 411804 - DNA, 140 bp, Artificial Sequence
  Synthetic
caccgctgtcccaaaaggtcgggtggctccttctgataatgctgtaaacatgggtattacctctgggctaaaagccttctcctctattacttttacccatgcattcaaagttctaggtgacatatcagcagccagggcct

SEQ ID NO: 411805 - DNA, 140 bp, Artificial Sequence
  Synthetic
atacgccatgctgggtctccaatcagcttatgggatgaaagcttaaaaccatgtgtaaagctaacccctctctgtgttgctttaaattgtactgatgcaagggataacgcaacagacatacgtacttgggagtcggccat

SEQ ID NO: 411806 - DNA, 140 bp, Artificial Sequence
  Synthetic
atggccgactcccaagtacgtatgtctgttgcgttatcccttgcatcagtacaatttaaagcaacacagagaggggttagctttacacatggttttaagctttcatcccataagctgattggagacccagcatggcgtat

SEQ ID NO: 411807 - DNA, 140 bp, Artificial Sequence
  Synthetic
atacgccatgctgggtctcccgaaagagcgcttttctatagacttgatgtagtaccaattaatgatagtagtagtaatataggtcagtataggctaataaattgtaatgtctcagcagtccgtacttgggagtcggccat

SEQ ID NO: 411808 - DNA, 140 bp, Artificial Sequence
  Synthetic
atggccgactcccaagtacggactgctgagacattacaatttattagcctatactgacctatattactactactatcattaattggtactacatcaagtctatagaaaagcgctctttcgggagacccagcatggcgtat

SEQ ID NO: 411809 - DNA, 140 bp, Artificial Sequence
  Synthetic
atacgccatgctgggtctccggatggagtgggaaagagagattagcaattactcaaatgaaatatacaggctaattgaagaatcgcagaaccagcaggaaaagaatgaacaagaattattcgtacttgggagtcggccat

SEQ ID NO: 411810 - DNA, 140 bp, Artificial Sequence
  Synthetic
atggccgactcccaagtacgaataattcttgttcattcttttcctgctggttctgcgattcttcaattagcctgtatatttcatttgagtaattgctaatctctctttcccactccatccggagacccagcatggcgtat

SEQ ID NO: 411811 - DNA, 140 bp, Artificial Sequence
  Synthetic
aggccctggctgctgatatgctaattgaagaatcgcagaaccagcaggaaaagaatgaacaagaattattggcattggacaaatgggcaaatctgtggaattggtttgacatatcaaactgaccttttgggacagcggtg

SEQ ID NO: 411812 - DNA, 140 bp, Artificial Sequence
  Synthetic
caccgctgtcccaaaaggtcagtttgatatgtcaaaccaattccacagatttgcccatttgtccaatgccaataattcttgttcattcttttcctgctggttctgcgattcttcaattagcatatcagcagccagggcct

SEQ ID NO: 411813 - DNA, 140 bp, Artificial Sequence
  Synthetic
aggccctggctgctgatatgattagtgactggattcttagcactcatctgggacgatctgcggagcctgtgcctcttcagctaccaccgcttgagagacttactcttgattgtagcgagggaccttttgggacagcggtg

SEQ ID NO: 411814 - DNA, 140 bp, Artificial Sequence
  Synthetic
caccgctgtcccaaaaggtccctcgctacaatcaagagtaagtctctcaagcggtggtagctgaagaggcacaggctccgcagatcgtcccagatgagtgctaagaatccagtcactaatcatatcagcagccagggcct

SEQ ID NO: 411815 - DNA, 140 bp, Artificial Sequence
  Synthetic
aggccctggctgctgatatgtagtacagcttaacagtactgtaagaattaattgtaccagacctaacaacaatacaagaaagggtatacatataggaccaggacaagctttttatgcaacgaccttttgggacagcggtg

SEQ ID NO: 411816 - DNA, 140 bp, Artificial Sequence
  Synthetic
caccgctgtcccaaaaggtcgttgcataaaaagcttgtcctggtcctatatgtataccctttcttgtattgttgttaggtctggtacaattaattcttacagtactgttaagctgtactacatatcagcagccagggcct

SEQ ID NO: 411817 - DNA, 140 bp, Artificial Sequence
  Synthetic
atacgccatgctgggtctcctgcttaatgccacagctatagcagtagctgaggggacagataggattatagaagtagtacaaagaatttgtagagctattcgccacatacctagaagaatcgtacttgggagtcggccat

SEQ ID NO: 411818 - DNA, 140 bp, Artificial Sequence
  Synthetic
atggccgactcccaagtacgattcttctaggtatgtggcgaatagctctacaaattctttgtactacttctataatcctatctgtcccctcagctactgctatagctgtggcattaagcaggagacccagcatggcgtat

SEQ ID NO: 411819 - DNA, 140 bp, Artificial Sequence
  Synthetic
aggccctggctgctgatatgtttaacaaaacaatagtatttaatgagcattcaggaggggatttagaagttacaacacatagttttaattgtggaggggaatttttctactgcaatacatgaccttttgggacagcggtg

SEQ ID NO: 411820 - DNA, 140 bp, Artificial Sequence
  Synthetic
caccgctgtcccaaaaggtcatgtattgcagtagaaaaattcccctccacaattaaaactatgtgttgtaacttctaaatcccctcctgaatgctcattaaatactattgttttgttaaacatatcagcagccagggcct

SEQ ID NO: 411821 - DNA, 140 bp, Artificial Sequence
  Synthetic
aggccctggctgctgatatgcagcgaggattgtggaacttctgggacgcagggggtgggaagtcctcaaatattggtggaatctcctacagtattggggtcaggaactaaagaatagtgcgaccttttgggacagcggtg

SEQ ID NO: 411822 - DNA, 140 bp, Artificial Sequence
  Synthetic
caccgctgtcccaaaaggtcgcactattctttagttcctgaccccaatactgtaggagattccaccaatatttgaggacttcccaccccctgcgtcccagaagttccacaatcctcgctgcatatcagcagccagggcct

SEQ ID NO: 411823 - DNA, 140 bp, Artificial Sequence
  Synthetic
aggccctggctgctgatatgagcagtcctctattttgtacatcaaaaggtagaggtaaaggacaccaaggaagctttagataagctagaggaagaacaaaacaaaagtcagcaaaagacagaccttttgggacagcggtg

SEQ ID NO: 411824 - DNA, 140 bp, Artificial Sequence
  Synthetic
caccgctgtcccaaaaggtctgtcttttgctgacttttgttttgttcttcctctagcttatctaaagcttccttggtgtcctttacctctaccttttgatgtacaaaatagaggactgctcatatcagcagccagggcct

SEQ ID NO: 411825 - DNA, 140 bp, Artificial Sequence
  Synthetic
aggccctggctgctgatatgtagtaacagactcacagtatgcattaggaatcattcaggcacaaccagacaggagtgaatcagagttagtcaatcaaataatagaaaaattaatagaaaagaccttttgggacagcggtg

SEQ ID NO: 411826 - DNA, 140 bp, Artificial Sequence
  Synthetic
caccgctgtcccaaaaggtcttttctattaatttttctattatttgattgactaactctgattcactcctgtctggttgtgcctgaatgattcctaatgcatactgtgagtctgttactacatatcagcagccagggcct

SEQ ID NO: 411827 - DNA, 140 bp, Artificial Sequence
  Synthetic
aggccctggctgctgatatgtgggacgcagggggtgggagagtctcaaatacctggggaatctagcacagtactggggccaagaactgaagagtagtgctattagtttgcttaatgccacgaccttttgggacagcggtg

SEQ ID NO: 411828 - DNA, 140 bp, Artificial Sequence
  Synthetic
caccgctgtcccaaaaggtcgtggcattaagcaaactaatagcactactcttcagttcttggccccagtactgtgctagattccccaggtatttgagactctcccaccccctgcgtcccacatatcagcagccagggcct

SEQ ID NO: 411829 - DNA, 140 bp, Artificial Sequence
  Synthetic
aggccctggctgctgatatgtactggggccaagaactgaagagtagtgctattagtttgcttaatgccacagcaatagcagtagctgaaggaacagataggattatagaggtagcacatagaccttttgggacagcggtg

SEQ ID NO: 411830 - DNA, 140 bp, Artificial Sequence
  Synthetic
caccgctgtcccaaaaggtctatgtgctacctctataatcctatctgttccttcagctactgctattgctgtggcattaagcaaactaatagcactactcttcagttcttggccccagtacatatcagcagccagggcct

SEQ ID NO: 411831 - DNA, 140 bp, Artificial Sequence
  Synthetic
aggccctggctgctgatatgtaattggagagcaatggctagtgattttaacctgccacctgtagtagcaaaagaaatagtagcctgctgtgataaatgtcagctaaaaggagaagccatggaccttttgggacagcggtg

SEQ ID NO: 411832 - DNA, 140 bp, Artificial Sequence
  Synthetic
caccgctgtcccaaaaggtccatggcttctccttttagctgacatttatcacagcaggctactatttcttttgctactacaggtggcaggttaaaatcactagccattgctctccaattacatatcagcagccagggcct

SEQ ID NO: 411833 - DNA, 140 bp, Artificial Sequence
  Synthetic
atacgccatgctgggtctcctagaagcagaagttattccagcagagacagggcaggaaacagcatactttctcttaaaattagcaggaagatggccagtaaaaacaatacatacagacaacgtacttgggagtcggccat

SEQ ID NO: 411834 - DNA, 140 bp, Artificial Sequence
  Synthetic
atggccgactcccaagtacgttgtctgtatgtattgtttttactggccatcttcctgctaattttaagagaaagtatgctgtttcctgccctgtctctgctggaataacttctgcttctaggagacccagcatggcgtat

SEQ ID NO: 411835 - DNA, 140 bp, Artificial Sequence
  Synthetic
  misc_feature (53)..(53): n is a, c, g, or t
  misc_feature (60)..(60): n is a, c, g, or t
aggccctggctgctgatatggaggctttagataaaatagaggagatacaaaanaagagcnagcaaaagaaacagcaggcagcagctgacacaggagacaacagcaaagtcagtcaaaattgaccttttgggacagcggtg

SEQ ID NO: 411836 - DNA, 140 bp, Artificial Sequence
  Synthetic
  misc_feature (81)..(81): n is a, c, g, or t
  misc_feature (88)..(88): n is a, c, g, or t
caccgctgtcccaaaaggtcaattttgactgactttgctgttgtctcctgtgtcagctgctgcctgctgtttcttttgctngctcttnttttgtatctcctctattttatctaaagcctccatatcagcagccagggcct

SEQ ID NO: 411837 - DNA, 140 bp, Artificial Sequence
  Synthetic
aggccctggctgctgatatgtagaccctgacctagcagatcaactaattcatctgcaatattttgactgtttttcagaatctgccataaggaaagccatattaggacaaaaaattattcagaccttttgggacagcggtg

SEQ ID NO: 411838 - DNA, 140 bp, Artificial Sequence
  Synthetic
caccgctgtcccaaaaggtctgaataattttttgtcctaatatggctttccttatggcagattctgaaaaacagtcaaaatattgcagatgaattagttgatctgctaggtcagggtctacatatcagcagccagggcct

SEQ ID NO: 411839 - DNA, 140 bp, Artificial Sequence
  Synthetic
aggccctggctgctgatatgttttcagaatctgccataaggaaagccatattaggacaaaaaattattcataggtgtgaatatcaaacaggacataagaaggtagggtctctgcaatatcgaccttttgggacagcggtg

SEQ ID NO: 411840 - DNA, 140 bp, Artificial Sequence
  Synthetic
caccgctgtcccaaaaggtcgatattgcagagaccctaccttcttatgtcctgtttgatattcacacctatgaataattttttgtcctaatatggctttccttatggcagattctgaaaacatatcagcagccagggcct

SEQ ID NO: 411841 - DNA, 140 bp, Artificial Sequence
  Synthetic
atacgccatgctgggtctccatgcaatcatagcagaataggtattactctccaagggagaagaggcagggatggagccggtagatcctagcctagagccatggaaccatccgggaagtcacgtacttgggagtcggccat

SEQ ID NO: 411842 - DNA, 140 bp, Artificial Sequence
  Synthetic
atggccgactcccaagtacgtgacttcccggatggttccatggctctaggctaggatctaccggctccatccctgcctcttctcccttggagagtaatacctattctgctatgattgcatggagacccagcatggcgtat

SEQ ID NO: 411843 - DNA, 140 bp, Artificial Sequence
  Synthetic
atacgccatgctgggtctccaggcaatactacctatggaggagaaatgagaaattgctctttcaatataaccacagaattaagagataagaaaaggcaagagagtgcacttttttatagacgtacttgggagtcggccat

SEQ ID NO: 411844 - DNA, 140 bp, Artificial Sequence
  Synthetic
atggccgactcccaagtacgtctataaaaaagtgcactctcttgccttttcttatctcttaattctgtggttatattgaaagagcaatttctcatttctcctccataggtagtattgcctggagacccagcatggcgtat

SEQ ID NO: 411845 - DNA, 140 bp, Artificial Sequence
  Synthetic
atacgccatgctgggtctcctcctgtaccaaagcagtaagtatcattaggtaatgttatctttgaaaatcgctgcaatagtaggactagtagtagcaataatcttagcaatagttgtgtgcgtacttgggagtcggccat

SEQ ID NO: 411846 - DNA, 140 bp, Artificial Sequence
  Synthetic
atggccgactcccaagtacgcacacaactattgctaagattattgctactactagtcctactattgcagcgattttcaaagataacattacctaatgatacttactgctttggtacaggaggagacccagcatggcgtat

SEQ ID NO: 411847 - DNA, 140 bp, Artificial Sequence
  Synthetic
atacgccatgctgggtctccgtattaatggtaccagaattaatgattccatgattgaagaaatgagaaattgctctttcaatacaaccacagaaataagagataagccacagaaagcgtacgtacttgggagtcggccat

SEQ ID NO: 411848 - DNA, 140 bp, Artificial Sequence
  Synthetic
atggccgactcccaagtacgtacgctttctgtggcttatctcttatttctgtggttgtattgaaagagcaatttctcatttcttcaatcatggaatcattaattctggtaccattaatacggagacccagcatggcgtat

SEQ ID NO: 411849 - DNA, 140 bp, Artificial Sequence
  Synthetic
aggccctggctgctgatatggcaagacaaagacagatcagtgcgattagtgaacggattcttagcacttttctgggacgacctgcggaacctgtgcctcttcagctaccaccgattgagagaccttttgggacagcggtg

SEQ ID NO: 411850 - DNA, 140 bp, Artificial Sequence
  Synthetic
caccgctgtcccaaaaggtctctcaatcggtggtagctgaagaggcacaggttccgcaggtcgtcccagaaaagtgctaagaatccgttcactaatcgcactgatctgtctttgtcttgccatatcagcagccagggcct

SEQ ID NO: 411851 - DNA, 140 bp, Artificial Sequence
  Synthetic
atacgccatgctgggtctccacagcctacaataatacaggctacaataatacagacgaaataaaaaattgcactttcaatatgaccacagtactaagagataagaaagaaaaggtacatgcgtacttgggagtcggccat

SEQ ID NO: 411852 - DNA, 140 bp, Artificial Sequence
  Synthetic
atggccgactcccaagtacgcatgtaccttttctttcttatctcttagtactgtggtcatattgaaagtgcaattttttatttcgtctgtattattgtagcctgtattattgtaggctgtggagacccagcatggcgtat

SEQ ID NO: 411853 - DNA, 140 bp, Artificial Sequence
  Synthetic
atacgccatgctgggtctccatcatagcattaatcatagcaataattgtgtggactatagcatatatagagtatagaaaattggtaagacaaagacaaatagacaggttaattgaaaggacgtacttgggagtcggccat

SEQ ID NO: 411854 - DNA, 140 bp, Artificial Sequence
  Synthetic
atggccgactcccaagtacgtcctttcaattaacctgtctatttgtctttgtcttaccaattttctatactctatatatgctatagtccacacaattattgctatgattaatgctatgatggagacccagcatggcgtat

SEQ ID NO: 411855 - DNA, 140 bp, Artificial Sequence
  Synthetic
atacgccatgctgggtctccatggaactaataatatcactagtagtagtgggaaagggatggaggaaggagagataaaaaactgctcattcaatattaccacaaacagaagaactaaggtcgtacttgggagtcggccat

SEQ ID NO: 411856 - DNA, 140 bp, Artificial Sequence
  Synthetic
atggccgactcccaagtacgaccttagttcttctgtttgtggtaatattgaatgagcagttttttatctctccttcctccatccctttcccactactactagtgatattattagttccatggagacccagcatggcgtat

SEQ ID NO: 411857 - DNA, 140 bp, Artificial Sequence
  Synthetic
atacgccatgctgggtctccaagaagtatccgtataggaccaggacaatcattccatgcaacaggtgcgataataggaaacataaggcaagctcattgcaacatcagtagcctagcttggcgtacttgggagtcggccat

SEQ ID NO: 411858 - DNA, 140 bp, Artificial Sequence
  Synthetic
atggccgactcccaagtacgccaagctaggctactgatgttgcaatgagcttgccttatgtttcctattatcgcacctgttgcatggaatgattgtcctggtcctatacggatacttcttggagacccagcatggcgtat

SEQ ID NO: 411859 - DNA, 140 bp, Artificial Sequence
  Synthetic
aggccctggctgctgatatgtaataggaaacataaggcaagctcattgcaacatcagtagcctagcttggaacagaactctgaccctggtagctaaacaattagaaaaacacttccgtaagaccttttgggacagcggtg

SEQ ID NO: 411860 - DNA, 140 bp, Artificial Sequence
  Synthetic
caccgctgtcccaaaaggtcttacggaagtgtttttctaattgtttagctaccagggtcagagttctgttccaagctaggctactgatgttgcaatgagcttgccttatgtttcctattacatatcagcagccagggcct

SEQ ID NO: 411861 - DNA, 140 bp, Artificial Sequence
  Synthetic
atacgccatgctgggtctccgtggcgcccgaacagggacttgaaagcgaaagtaagaccagaggagatctctcgacgcaggactcggcttgctgaagtgcacacggcaagaggcgagaggcgtacttgggagtcggccat

SEQ ID NO: 411862 - DNA, 140 bp, Artificial Sequence
  Synthetic
atggccgactcccaagtacgcctctcgcctcttgccgtgtgcacttcagcaagccgagtcctgcgtcgagagatctcctctggtcttactttcgctttcaagtccctgttcgggcgccacggagacccagcatggcgtat

SEQ ID NO: 411863 - DNA, 140 bp, Artificial Sequence
  Synthetic
atacgccatgctgggtctcctgcatagtttcaattgtaaaggagagtttttctattgtaatacatcaggcctgtttaatagcacttggaaaaatggagtttgggaaaggggcaggatgaacgtacttgggagtcggccat

SEQ ID NO: 411864 - DNA, 140 bp, Artificial Sequence
  Synthetic
atggccgactcccaagtacgttcatcctgcccctttcccaaactccatttttccaagtgctattaaacaggcctgatgtattacaatagaaaaactctcctttacaattgaaactatgcaggagacccagcatggcgtat

SEQ ID NO: 411865 - DNA, 140 bp, Artificial Sequence
  Synthetic
atacgccatgctgggtctccacctctaatgctaccaataatgttactgttgatgctgaaatgtgggaagaaataaaaaattgctctttcaatgtaaccacagaaataagagataagaaaacgtacttgggagtcggccat

SEQ ID NO: 411866 - DNA, 140 bp, Artificial Sequence
  Synthetic
atggccgactcccaagtacgttttcttatctcttatttctgtggttacattgaaagagcaattttttatttcttcccacatttcagcatcaacagtaacattattggtagcattagaggtggagacccagcatggcgtat

SEQ ID NO: 411867 - DNA, 140 bp, Artificial Sequence
  Synthetic
aggccctggctgctgatatgctaaaagaattgttaaatgtttcaactgtggcaaggaagggcacatagccagaaattgcagggcccctagaaaaaagggctgttggaaatgtggaaaagagaccttttgggacagcggtg

SEQ ID NO: 411868 - DNA, 140 bp, Artificial Sequence
  Synthetic
caccgctgtcccaaaaggtctcttttccacatttccaacagcccttttttctaggggccctgcaatttctggctatgtgcccttccttgccacagttgaaacatttaacaattcttttagcatatcagcagccagggcct

SEQ ID NO: 411869 - DNA, 140 bp, Artificial Sequence
  Synthetic
atacgccatgctgggtctcctggactgaaactttacaaaaggtaggaagaaaattaggcaaactctataatcagacaacaataaaatttaactcatcctcaggaggggacctagaaattgcgtacttgggagtcggccat

SEQ ID NO: 411870 - DNA, 140 bp, Artificial Sequence
  Synthetic
atggccgactcccaagtacgcaatttctaggtcccctcctgaggatgagttaaattttattgttgtctgattatagagtttgcctaattttcttcctaccttttgtaaagtttcagtccaggagacccagcatggcgtat

SEQ ID NO: 411871 - DNA, 140 bp, Artificial Sequence
  Synthetic
aggccctggctgctgatatgtcagacaacaataaaatttaactcatcctcaggaggggacctagaaattgtaacgcatagctttaattgtggaggagaatttttctattgtaatacatcagaccttttgggacagcggtg

SEQ ID NO: 411872 - DNA, 140 bp, Artificial Sequence
  Synthetic
caccgctgtcccaaaaggtctgatgtattacaatagaaaaattctcctccacaattaaagctatgcgttacaatttctaggtcccctcctgaggatgagttaaattttattgttgtctgacatatcagcagccagggcct

SEQ ID NO: 411873 - DNA, 140 bp, Artificial Sequence
  Synthetic
atacgccatgctgggtctccacagatacaatatataatctgcttgaaattgcgcagaaccagcaggaaaagaatgaacaagacttattggcactaaacaaatgggacagcctgttgaattcgtacttgggagtcggccat

SEQ ID NO: 411874 - DNA, 140 bp, Artificial Sequence
  Synthetic
atggccgactcccaagtacgaattcaacaggctgtcccatttgtttagtgccaataagtcttgttcattcttttcctgctggttctgcgcaatttcaagcagattatatattgtatctgtggagacccagcatggcgtat

SEQ ID NO: 411875 - DNA, 140 bp, Artificial Sequence
  Synthetic
aggccctggctgctgatatggaatgaacaagacttattggcactaaacaaatgggacagcctgttgaattggttcgatatatcaagatggctttggtatataaaaatatttataatgatagaccttttgggacagcggtg

SEQ ID NO: 411876 - DNA, 140 bp, Artificial Sequence
  Synthetic
caccgctgtcccaaaaggtctatcattataaatatttttatataccaaagccatcttgatatatcgaaccaattcaacaggctgtcccatttgtttagtgccaataagtcttgttcattccatatcagcagccagggcct

SEQ ID NO: 411877 - DNA, 140 bp, Artificial Sequence
  Synthetic
atacgccatgctgggtctccagcagcatagtgggatggcctactgtcagggaaagaatgagaagggctaggccagcagcagaaggagtgggagcagcagaaggagtgggagcagcgtctacgtacttgggagtcggccat

SEQ ID NO: 411878 - DNA, 140 bp, Artificial Sequence
  Synthetic
atggccgactcccaagtacgtagacgctgctcccactccttctgctgctcccactccttctgctgctggcctagcccttctcattctttccctgacagtaggccatcccactatgctgctggagacccagcatggcgtat

SEQ ID NO: 411879 - DNA, 140 bp, Artificial Sequence
  Synthetic
atacgccatgctgggtctccatagtagcaatagtagcattagtagtagcaacaataatagcaatagttgtgtggtccatagtactcatagaatataggaaaatattaagacaaagaaaaacgtacttgggagtcggccat

SEQ ID NO: 411880 - DNA, 140 bp, Artificial Sequence
  Synthetic
atggccgactcccaagtacgtttttctttgtcttaatattttcctatattctatgagtactatggaccacacaactattgctattattgttgctactactaatgctactattgctactatggagacccagcatggcgtat

SEQ ID NO: 411881 - DNA, 140 bp, Artificial Sequence
  Synthetic
atacgccatgctgggtctccaatcctgattgtgcctggttggaagcacaagaggaggagaacgaagtaggcttcccagtcagaccacaggtgcctcaaagaccaatgacttacaaggcagcgtacttgggagtcggccat

SEQ ID NO: 411882 - DNA, 140 bp, Artificial Sequence
  Synthetic
atggccgactcccaagtacgctgccttgtaagtcattggtctttgaggcacctgtggtctgactgggaagcctacttcgttctcctcctcttgtgcttccaaccaggcacaatcaggattggagacccagcatggcgtat

SEQ ID NO: 411883 - DNA, 140 bp, Artificial Sequence
  Synthetic
aggccctggctgctgatatgacatacctagaagaataagacagggcttggaaagggctttgctataagatgggtggcaagtggtcaaaacgtagtgtgcctggatggaatactataaggggaccttttgggacagcggtg

SEQ ID NO: 411884 - DNA, 140 bp, Artificial Sequence
  Synthetic
caccgctgtcccaaaaggtccccttatagtattccatccaggcacactacgttttgaccacttgccacccatcttatagcaaagccctttccaagccctgtcttattcttctaggtatgtcatatcagcagccagggcct

SEQ ID NO: 411885 - DNA, 140 bp, Artificial Sequence
  Synthetic
atacgccatgctgggtctccgacatgaaaaactgctctttcaatatcaccacaagcataagagataaggttcagcgagaatatgcacttttttataaacttgatgtagtacaagtagatgcgtacttgggagtcggccat

SEQ ID NO: 411886 - DNA, 140 bp, Artificial Sequence
  Synthetic
atggccgactcccaagtacgcatctacttgtactacatcaagtttataaaaaagtgcatattctcgctgaaccttatctcttatgcttgtggtgatattgaaagagcagtttttcatgtcggagacccagcatggcgtat

SEQ ID NO: 411887 - DNA, 140 bp, Artificial Sequence
  Synthetic
aggccctggctgctgatatgaagctcagaagtacacatcccactaggggatgcaaaattagtagtgacaacatattggggtctgcatacaggagaaagagaatggcatttgggtcagggggaccttttgggacagcggtg

SEQ ID NO: 411888 - DNA, 140 bp, Artificial Sequence
  Synthetic
caccgctgtcccaaaaggtccccctgacccaaatgccattctctttctcctgtatgcagaccccaatatgttgtcactactaattttgcatcccctagtgggatgtgtacttctgagcttcatatcagcagccagggcct

SEQ ID NO: 411889 - DNA, 140 bp, Artificial Sequence
  Synthetic
aggccctggctgctgatatggatgggtgcgagagcgtcagtattaagcggcggaaaattagatcaatgggaaaaaattcggttaagaccaggaggaaagaaaaaatataaattaaaacatgaccttttgggacagcggtg

SEQ ID NO: 411890 - DNA, 140 bp, Artificial Sequence
  Synthetic
caccgctgtcccaaaaggtcatgttttaatttatattttttctttcctcctggtcttaaccgaattttttcccattgatctaattttccgccgcttaatactgacgctctcgcacccatccatatcagcagccagggcct

SEQ ID NO: 411891 - DNA, 140 bp, Artificial Sequence
  Synthetic
atacgccatgctgggtctcctgtggagctatccgctatccgcaacatacttagaagaatcagacagggctttgagacagctttgcaataaaatggggggcaagtggtcaaaaagcagtctcgtacttgggagtcggccat

SEQ ID NO: 411892 - DNA, 140 bp, Artificial Sequence
  Synthetic
atggccgactcccaagtacgagactgctttttgaccacttgccccccattttattgcaaagctgtctcaaagccctgtctgattcttctaagtatgttgcggatagcggatagctccacaggagacccagcatggcgtat

SEQ ID NO: 411893 - DNA, 140 bp, Artificial Sequence
  Synthetic
aggccctggctgctgatatgaatgtaaggattataagaataggaccaggacgagcattccatgcaaataacataataggagacataagacaagcacattgtaacatcagtaaagcagactgaccttttgggacagcggtg

SEQ ID NO: 411894 - DNA, 140 bp, Artificial Sequence
  Synthetic
caccgctgtcccaaaaggtcagtctgctttactgatgttacaatgtgcttgtcttatgtctcctattatgttatttgcatggaatgctcgtcctggtcctattcttataatccttacattcatatcagcagccagggcct

SEQ ID NO: 411895 - DNA, 140 bp, Artificial Sequence
  Synthetic
atacgccatgctgggtctccgatataaaatgggtggcaagtggtcaaaactggctggatggcgtagagtaagggaaagaatggaaagaactgagccagcagcagtgggggtgggagcagtcgtacttgggagtcggccat

SEQ ID NO: 411896 - DNA, 140 bp, Artificial Sequence
  Synthetic
atggccgactcccaagtacgactgctcccacccccactgctgctggctcagttctttccattctttcccttactctacgccatccagccagttttgaccacttgccacccattttatatcggagacccagcatggcgtat

SEQ ID NO: 411897 - DNA, 140 bp, Artificial Sequence
  Synthetic
aggccctggctgctgatatggacgagcagcttctcgcagcagtaagaaccatcaagatcctataccagagcagtaagtataactaattagttctgtaatgaactctttgtacatagtaaggaccttttgggacagcggtg

SEQ ID NO: 411898 - DNA, 140 bp, Artificial Sequence
  Synthetic
caccgctgtcccaaaaggtccttactatgtacaaagagttcattacagaactaattagttatacttactgctctggtataggatcttgatggttcttactgctgcgagaagctgctcgtccatatcagcagccagggcct

SEQ ID NO: 411899 - DNA, 140 bp, Artificial Sequence
  Synthetic
aggccctggctgctgatatgtagcaactctctattgtgtacatagaaagatagaggtacgagacaccaaggaagccttagacaagatagaggaagaacaaaacaagagtcagcaaaaaacgaccttttgggacagcggtg

SEQ ID NO: 411900 - DNA, 140 bp, Artificial Sequence
  Synthetic
caccgctgtcccaaaaggtcgttttttgctgactcttgttttgttcttcctctatcttgtctaaggcttccttggtgtctcgtacctctatctttctatgtacacaatagagagttgctacatatcagcagccagggcct

SEQ ID NO: 411901 - DNA, 140 bp, Artificial Sequence
  Synthetic
aggccctggctgctgatatgttaattgatagaataagagaaagagcagaagacagtggcaatgagagtgaaggagacacagaggaattggcacaacttgtggaaatggggcctcatgatcgaccttttgggacagcggtg

SEQ ID NO: 411902 - DNA, 140 bp, Artificial Sequence
  Synthetic
caccgctgtcccaaaaggtcgatcatgaggccccatttccacaagttgtgccaattcctctgtgtctccttcactctcattgccactgtcttctgctctttctcttattctatcaattaacatatcagcagccagggcct

SEQ ID NO: 411903 - DNA, 140 bp, Artificial Sequence
  Synthetic
  misc_feature (34)..(34): n is a, c, g, or t
  misc_feature (67)..(67): n is a, c, g, or t
atacgccatgctgggtctcctgtgaatgtcaatngcgaagcagaaataaaaaactgctctttcaatntaactacagaaataaaagataagaagaaaaaagaatttgcgcttttctatagacgtacttgggagtcggccat

SEQ ID NO: 411904 - DNA, 140 bp, Artificial Sequence
  Synthetic
  misc_feature (74)..(74): n is a, c, g, or t
  misc_feature (107)..(107): n is a, c, g, or t
atggccgactcccaagtacgtctatagaaaagcgcaaattcttttttcttcttatcttttatttctgtagttanattgaaagagcagttttttatttctgcttcgcnattgacattcacaggagacccagcatggcgtat

SEQ ID NO: 411905 - DNA, 140 bp, Artificial Sequence
  Synthetic
  misc_feature (72)..(72): n is a, c, g, or t
atacgccatgctgggtctccaagtgagtataggctaataaattgtaatgtctcagctgtcaaacaggcttgnccaaaggtaacctttgagccaattcccatacattattgtgctccagctcgtacttgggagtcggccat

SEQ ID NO: 411906 - DNA, 140 bp, Artificial Sequence
  Synthetic
  misc_feature (69)..(69): n is a, c, g, or t
atggccgactcccaagtacgagctggagcacaataatgtatgggaattggctcaaaggttacctttggncaagcctgtttgacagctgagacattacaatttattagcctatactcacttggagacccagcatggcgtat

SEQ ID NO: 411907 - DNA, 140 bp, Artificial Sequence
  Synthetic
aggccctggctgctgatatgattttttagggaaaatttggccttcccacaaggggaggccagggaatttccttcagagcagaccagagccaacagccccaccagcagagagcttcaggttgaccttttgggacagcggtg

SEQ ID NO: 411908 - DNA, 140 bp, Artificial Sequence
  Synthetic
caccgctgtcccaaaaggtcaacctgaagctctctgctggtggggctgttggctctggtctgctctgaaggaaattccctggcctccccttgtgggaaggccaaattttccctaaaaaatcatatcagcagccagggcct

SEQ ID NO: 411909 - DNA, 140 bp, Artificial Sequence
  Synthetic
atacgccatgctgggtctccaaagtatacatataggacctggacaagctttctatgcaacaggtgatataataggagatataagacaagcacattgtaatgtcagtaaagcagaatggaacgtacttgggagtcggccat

SEQ ID NO: 411910 - DNA, 140 bp, Artificial Sequence
  Synthetic
atggccgactcccaagtacgttccattctgctttactgacattacaatgtgcttgtcttatatctcctattatatcacctgttgcatagaaagcttgtccaggtcctatatgtatactttggagacccagcatggcgtat

SEQ ID NO: 411911 - DNA, 140 bp, Artificial Sequence
  Synthetic
aggccctggctgctgatatgggagcagcatctcgagacttggaaaaacatggagcaatcacaagtagcaatacagcagctactaatgctgattgtgcctggctagaagcacaagaggagggaccttttgggacagcggtg

SEQ ID NO: 411912 - DNA, 140 bp, Artificial Sequence
  Synthetic
caccgctgtcccaaaaggtccctcctcttgtgcttctagccaggcacaatcagcattagtagctgctgtattgctacttgtgattgctccatgtttttccaagtctcgagatgctgctcccatatcagcagccagggcct

SEQ ID NO: 411913 - DNA, 140 bp, Artificial Sequence
  Synthetic
  misc_feature (34)..(34): n is a, c, g, or t
atacgccatgctgggtctccaaacaataatcttnactaaccactcaggaggggatatagaaattacaacacatagttttaactgcagaggggaattcttctattgcaatacaacaaacctcgtacttgggagtcggccat

SEQ ID NO: 411914 - DNA, 140 bp, Artificial Sequence
  Synthetic
  misc_feature (107)..(107): n is a, c, g, or t
atggccgactcccaagtacgaggtttgttgtattgcaatagaagaattcccctctgcagttaaaactatgtgttgtaatttctatatcccctcctgagtggttagtnaagattattgtttggagacccagcatggcgtat

SEQ ID NO: 411915 - DNA, 140 bp, Artificial Sequence
  Synthetic
aggccctggctgctgatatgcgaaagcgaaagtagaaccagaggagctctctcgacgcaggactcggcttgctgaagcgcgcacggcaagaggcgaggggcggcgactggtgagtacgccgaccttttgggacagcggtg

SEQ ID NO: 411916 - DNA, 140 bp, Artificial Sequence
  Synthetic
caccgctgtcccaaaaggtcggcgtactcaccagtcgccgcccctcgcctcttgccgtgcgcgcttcagcaagccgagtcctgcgtcgagagagctcctctggttctactttcgctttcgcatatcagcagccagggcct

SEQ ID NO: 411917 - DNA, 140 bp, Artificial Sequence
  Synthetic
aggccctggctgctgatatgggctttgctataaaatgggtggcaagtggtcaaaaagtagtatagttggatggcctgctataagggaaagaatgaggcgaacccctccagcagcagaagggaccttttgggacagcggtg

SEQ ID NO: 411918 - DNA, 140 bp, Artificial Sequence
  Synthetic
caccgctgtcccaaaaggtcccttctgctgctggaggggttcgcctcattctttcccttatagcaggccatccaactatactactttttgaccacttgccacccattttatagcaaagcccatatcagcagccagggcct

SEQ ID NO: 411919 - DNA, 140 bp, Artificial Sequence
  Synthetic
  misc_feature (66)..(66): n is a, c, g, or t
aggccctggctgctgatatgtgggaaaaaattcggttaaggccggggggaaagaaaaaatatagantgaaacatctagtatgggcaagcagggagctagaacgatttgcacttgatcctggaccttttgggacagcggtg

SEQ ID NO: 411920 - DNA, 140 bp, Artificial Sequence
  Synthetic
  misc_feature (75)..(75): n is a, c, g, or t
caccgctgtcccaaaaggtccaggatcaagtgcaaatcgttctagctccctgcttgcccatactagatgtttcantctatattttttctttccccccggccttaaccgaattttttcccacatatcagcagccagggcct

SEQ ID NO: 411921 - DNA, 140 bp, Artificial Sequence
  Synthetic
  misc_feature (69)..(69): n is a, c, g, or t
aggccctggctgctgatatgccatcccttcagacaggatcagaagagcttaaatcattatataatacantagtagtcctctattatgtacatcaaaaggtagagataaaggacaccaagggaccttttgggacagcggtg

SEQ ID NO: 411922 - DNA, 140 bp, Artificial Sequence
  Synthetic
  misc_feature (72)..(72): n is a, c, g, or t
caccgctgtcccaaaaggtcccttggtgtcctttatctctaccttttgatgtacataatagaggactactantgtattatataatgatttaagctcttctgatcctgtctgaagggatggcatatcagcagccagggcct

SEQ ID NO: 411923 - DNA, 140 bp, Artificial Sequence
  Synthetic
aggccctggctgctgatatgtggcattggacaagtgggcaagtctgtggaattggtttgacatatcaaattggctatggtatataaaaatatttataatgatagtaggaggcttaatagggaccttttgggacagcggtg

SEQ ID NO: 411924 - DNA, 140 bp, Artificial Sequence
  Synthetic
caccgctgtcccaaaaggtccctattaagcctcctactatcattataaatatttttatataccatagccaatttgatatgtcaaaccaattccacagacttgcccacttgtccaatgccacatatcagcagccagggcct

SEQ ID NO: 411925 - DNA, 140 bp, Artificial Sequence
  Synthetic
aggccctggctgctgatatgggcttaggcatttcctatggcaggaagaagcggagacagcgacgaagcgctcctccaagcagtgaggatcatcaaaatcctatatcaaagcagtaagtatgaccttttgggacagcggtg

SEQ ID NO: 411926 - DNA, 140 bp, Artificial Sequence
  Synthetic
caccgctgtcccaaaaggtcatacttactgctttgatataggattttgatgatcctcactgcttggaggagcgcttcgtcgctgtctccgcttcttcctgccataggaaatgcctaagcccatatcagcagccagggcct

SEQ ID NO: 411927 - DNA, 140 bp, Artificial Sequence
  Synthetic
  misc_feature (74)..(74): n is a, c, g, or t
aggccctggctgctgatatggcagcgaggattgtggagactctgggacacagggggtgggagattctcaaatanctggggaatctagcacagtattggggccaagaactgaagaatagtggaccttttgggacagcggtg

SEQ ID NO: 411928 - DNA, 140 bp, Artificial Sequence
  Synthetic
  misc_feature (67)..(67): n is a, c, g, or t
caccgctgtcccaaaaggtccactattcttcagttcttggccccaatactgtgctagattccccagntatttgagaatctcccaccccctgtgtcccagagtctccacaatcctcgctgccatatcagcagccagggcct

SEQ ID NO: 411929 - DNA, 140 bp, Artificial Sequence
  Synthetic
aggccctggctgctgatatgactaaactaggaaaagcagggtatgttactgacagaggaaggcagaaaattgtttctatgactgaaacaacaaatcagaagactgaattacaagcaattcgaccttttgggacagcggtg

SEQ ID NO: 411930 - DNA, 140 bp, Artificial Sequence
  Synthetic
caccgctgtcccaaaaggtcgaattgcttgtaattcagtcttctgatttgttgtttcagtcatagaaacaattttctgccttcctctgtcagtaacataccctgcttttcctagtttagtcatatcagcagccagggcct

SEQ ID NO: 411931 - DNA, 140 bp, Artificial Sequence
  Synthetic
  misc_feature (87)..(87): n is a, c, g, or t
atacgccatgctgggtctccaactggtcaaaaagtagcatagtgggatggcctgagattagagaaagattaagacgcactcccccgncgacagcagcagaaggagtaggagcagtatctacgtacttgggagtcggccat

SEQ ID NO: 411932 - DNA, 140 bp, Artificial Sequence
  Synthetic
  misc_feature (54)..(54): n is a, c, g, or t
atggccgactcccaagtacgtagatactgctcctactccttctgctgctgtcgncgggggagtgcgtcttaatctttctctaatctcaggccatcccactatgctactttttgaccagttggagacccagcatggcgtat

SEQ ID NO: 411933 - DNA, 140 bp, Artificial Sequence
  Synthetic
atacgccatgctgggtctccggggggccccaacagggacccgaaagccaaagttagaacccgagaagttctctcgacgcaggaactcggcttgctgaggtgcacacagcaagaggcgaaacgtacttgggagtcggccat

SEQ ID NO: 411934 - DNA, 140 bp, Artificial Sequence
  Synthetic
atggccgactcccaagtacgtttcgcctcttgctgtgtgcacctcagcaagccgagttcctgcgtcgagagaacttctcgggttctaactttggctttcgggtccctgttggggccccccggagacccagcatggcgtat

SEQ ID NO: 411935 - DNA, 140 bp, Artificial Sequence
  Synthetic
atacgccatgctgggtctccaatgttgacgagacccacgaaggtagcatgtctggagaaataaaaaattgttcttttaatataaccacagaaataagagataagaaaaataaggtgtatgcgtacttgggagtcggccat

SEQ ID NO: 411936 - DNA, 140 bp, Artificial Sequence
  Synthetic
atggccgactcccaagtacgcatacaccttatttttcttatctcttatttctgtggttatattaaaagaacaattttttatttctccagacatgctaccttcgtgggtctcgtcaacattggagacccagcatggcgtat

SEQ ID NO: 411937 - DNA, 140 bp, Artificial Sequence
  Synthetic
aggccctggctgctgatatgccagcagaaacaggacaagaaacagcatactttatactaaaattagcaggaagatggccagtcaaagtaatacatacagacaatggcagtaatttcaccagaccttttgggacagcggtg

SEQ ID NO: 411938 - DNA, 140 bp, Artificial Sequence
  Synthetic
caccgctgtcccaaaaggtctggtgaaattactgccattgtctgtatgtattactttgactggccatcttcctgctaattttagtataaagtatgctgtttcttgtcctgtttctgctggcatatcagcagccagggcct

SEQ ID NO: 411939 - DNA, 140 bp, Artificial Sequence
  Synthetic
atacgccatgctgggtctcccttaggacaacatatctatgaaacctatggggacacttgggaaggagttgaagctataataagaatgttgcagcaattactgtttgttcatttcagaattcgtacttgggagtcggccat

SEQ ID NO: 411940 - DNA, 140 bp, Artificial Sequence
  Synthetic
atggccgactcccaagtacgaattctgaaatgaacaaacagtaattgctgcaacattcttattatagcttcaactccttcccaagtgtccccataggtttcatagatatgttgtcctaagggagacccagcatggcgtat

SEQ ID NO: 411941 - DNA, 140 bp, Artificial Sequence
  Synthetic
aggccctggctgctgatatgggaagccagcctaaaactgcttgtaacaaatgctactgtaaaagatgttgctatcattgccagctttgcttcataaccaagggcttaggcatatcctatggaccttttgggacagcggtg

SEQ ID NO: 411942 - DNA, 140 bp, Artificial Sequence
  Synthetic
caccgctgtcccaaaaggtccataggatatgcctaagcccttggttatgaagcaaagctggcaatgatagcaacatcttttacagtagcatttgttacaagcagttttaggctggcttcccatatcagcagccagggcct

SEQ ID NO: 411943 - DNA, 140 bp, Artificial Sequence
  Synthetic
atacgccatgctgggtctcccatcaaaatcctgtaccaaagcagtaagtagcatagctaatgtcacctttggaaatctctgcaataacaggactagtagtagcactaatcatagcaatagcgtacttgggagtcggccat

SEQ ID NO: 411944 - DNA, 140 bp, Artificial Sequence
  Synthetic
atggccgactcccaagtacgctattgctatgattagtgctactactagtcctgttattgcagagatttccaaaggtgacattagctatgctacttactgctttggtacaggattttgatgggagacccagcatggcgtat

SEQ ID NO: 411945 - DNA, 140 bp, Artificial Sequence
  Synthetic
aggccctggctgctgatatggcagaccagagccaacagccccaccagcagagagcttcgggttcggagaggagatagccccctccccgaaacaggagccgaaggagaaggagaaggagctgaccttttgggacagcggtg

SEQ ID NO: 411946 - DNA, 140 bp, Artificial Sequence
  Synthetic
caccgctgtcccaaaaggtcagctccttctccttctccttcggctcctgtttcggggagggggctatctcctctccgaacccgaagctctctgctggtggggctgttggctctggtctgccatatcagcagccagggcct

SEQ ID NO: 411947 - DNA, 140 bp, Artificial Sequence
  Synthetic
atacgccatgctgggtctcccaacaataacagtagcaacagcagtgaaacaacagcagaggacatgggaagagaaataaaaaactgctcttttaatatgaccacaatactaaaagataagcgtacttgggagtcggccat

SEQ ID NO: 411948 - DNA, 140 bp, Artificial Sequence
  Synthetic
atggccgactcccaagtacgcttatcttttagtattgtggtcatattaaaagagcagttttttatttctcttcccatgtcctctgctgttgtttcactgctgttgctactgttattgttgggagacccagcatggcgtat

SEQ ID NO: 411949 - DNA, 140 bp, Artificial Sequence
  Synthetic
atacgccatgctgggtctccaagagttggatgacagacacattattaatacaaaatgctaatccagattgtaagcagattttgaaagctctgggaccaggggccaccttagaagaaatgacgtacttgggagtcggccat

SEQ ID NO: 411950 - DNA, 140 bp, Artificial Sequence
  Synthetic
atggccgactcccaagtacgtcatttcttctaaggtggcccctggtcccagagctttcaaaatctgcttacaatctggattagcattttgtattaataatgtgtctgtcatccaactcttggagacccagcatggcgtat

SEQ ID NO: 411951 - DNA, 140 bp, Artificial Sequence
  Synthetic
atacgccatgctgggtctccatggagagcggagaaataaaaaactgctctttcaatatcaccacaagcacaaaagataagaagaacacatatgcacttttttataaacttgatgtaacaccgtacttgggagtcggccat

SEQ ID NO: 411952 - DNA, 140 bp, Artificial Sequence
  Synthetic
atggccgactcccaagtacggtgttacatcaagtttataaaaaagtgcatatgtgttcttcttatcttttgtgcttgtggtgatattgaaagagcagttttttatttctccgctctccatggagacccagcatggcgtat

SEQ ID NO: 411953 - DNA, 140 bp, Artificial Sequence
  Synthetic
atacgccatgctgggtctcccaatggaacggggccatgcaaaaatgtcagctcagtacaatgcacacatggaattaagccagtggtatcaactcaactgttgttaaatggcagcctagcacgtacttgggagtcggccat

SEQ ID NO: 411954 - DNA, 140 bp, Artificial Sequence
  Synthetic
atggccgactcccaagtacgtgctaggctgccatttaacaacagttgagttgataccactggcttaattccatgtgtgcattgtactgagctgacatttttgcatggccccgttccattgggagacccagcatggcgtat

SEQ ID NO: 411955 - DNA, 140 bp, Artificial Sequence
  Synthetic
atacgccatgctgggtctcccataatagtacagcttgctgagcctgtagtaattaactgtactagacccaataacaacacaagaaaaagtatacgtattggaccagggcaatcattctatcgtacttgggagtcggccat

SEQ ID NO: 411956 - DNA, 140 bp, Artificial Sequence
  Synthetic
atggccgactcccaagtacgatagaatgattgccctggtccaatacgtatactttttcttgtgttgttattgggtctagtacagttaattactacaggctcagcaagctgtactattatgggagacccagcatggcgtat

SEQ ID NO: 411957 - DNA, 140 bp, Artificial Sequence
  Synthetic
atacgccatgctgggtctcccatagtgggagaaatgaaaaattgctctttcaatataaccacagaaataagagataagaaaaagaaagaacatgcacttttttataggcttgatatagcacgtacttgggagtcggccat

SEQ ID NO: 411958 - DNA, 140 bp, Artificial Sequence
  Synthetic
atggccgactcccaagtacgtgctatatcaagcctataaaaaagtgcatgttctttctttttcttatctcttatttctgtggttatattgaaagagcaatttttcatttctcccactatgggagacccagcatggcgtat

SEQ ID NO: 411959 - DNA, 140 bp, Artificial Sequence
  Synthetic
atacgccatgctgggtctcctacacttccctaataaaacaatagcctttaatcaatcctcaggaggggacctagaaattacaatgcatagtttcaattgtagaggagaatttttctattgcgtacttgggagtcggccat

SEQ ID NO: 411960 - DNA, 140 bp, Artificial Sequence
  Synthetic
atggccgactcccaagtacgcaatagaaaaattctcctctacaattgaaactatgcattgtaatttctaggtcccctcctgaggattgattaaaggctattgttttattagggaagtgtaggagacccagcatggcgtat

SEQ ID NO: 411961 - DNA, 140 bp, Artificial Sequence
  Synthetic
aggccctggctgctgatatgaagtatacatatggggccagggaaagcattttatacaacaggagacataataggagatataagaaaagcacattgcagcattaatagaacagattgggaagaccttttgggacagcggtg

SEQ ID NO: 411962 - DNA, 140 bp, Artificial Sequence
  Synthetic
caccgctgtcccaaaaggtcttcccaatctgttctattaatgctgcaatgtgcttttcttatatctcctattatgtctcctgttgtataaaatgctttccctggccccatatgtatacttcatatcagcagccagggcct

SEQ ID NO: 411963 - DNA, 140 bp, Artificial Sequence
  Synthetic
atacgccatgctgggtctccaacaatagtctttaagaactcctcaggaggggacccagaaattacaacacacagttttaattgtggaggggaatttttctactgtaatacatcagcactgcgtacttgggagtcggccat

SEQ ID NO: 411964 - DNA, 140 bp, Artificial Sequence
  Synthetic
atggccgactcccaagtacgcagtgctgatgtattacagtagaaaaattcccctccacaattaaaactgtgtgttgtaatttctgggtcccctcctgaggagttcttaaagactattgttggagacccagcatggcgtat

SEQ ID NO: 411965 - DNA, 140 bp, Artificial Sequence
  Synthetic
aggccctggctgctgatatgatttataatgatagtaggaggcttgataggcttaagaatagtttttgctgtgattgctgtagtaaatagagttaggcagggatactcacctttgtcattcgaccttttgggacagcggtg

SEQ ID NO: 411966 - DNA, 140 bp, Artificial Sequence
  Synthetic
caccgctgtcccaaaaggtcgaatgacaaaggtgagtatccctgcctaactctatttactacagcaatcacagcaaaaactattcttaagcctatcaagcctcctactatcattataaatcatatcagcagccagggcct

SEQ ID NO: 411967 - DNA, 140 bp, Artificial Sequence
  Synthetic
aggccctggctgctgatatgtgattgctgtagtaaatagagttaggcagggatactcacctttgtcattccagacccctgccccaagcccagagggagtcgccaggcccggaggaatcgagaccttttgggacagcggtg

SEQ ID NO: 411968 - DNA, 140 bp, Artificial Sequence
  Synthetic
caccgctgtcccaaaaggtctcgattcctccgggcctggcgactccctctgggcttggggcaggggtctggaatgacaaaggtgagtatccctgcctaactctatttactacagcaatcacatatcagcagccagggcct

SEQ ID NO: 411969 - DNA, 140 bp, Artificial Sequence
  Synthetic
aggccctggctgctgatatgagaattattggaattggataagtgggcaagtttgtggaattggtttgacataacaaaatggctgtggtatataaaaatattcataatgatagtaggaggcgaccttttgggacagcggtg

SEQ ID NO: 411970 - DNA, 140 bp, Artificial Sequence
  Synthetic
caccgctgtcccaaaaggtcgcctcctactatcattatgaatatttttatataccacagccattttgttatgtcaaaccaattccacaaacttgcccacttatccaattccaataattctcatatcagcagccagggcct

SEQ ID NO: 411971 - DNA, 140 bp, Artificial Sequence
  Synthetic
aggccctggctgctgatatgtctcgacgcaggactcggcttgctgagcgcgcacagcaagaggcgaggggcggcgaacggtgagtacgccaattttttgactagcggaggctagaaggaggaccttttgggacagcggtg

SEQ ID NO: 411972 - DNA, 140 bp, Artificial Sequence
  Synthetic
caccgctgtcccaaaaggtcctccttctagcctccgctagtcaaaaaattggcgtactcaccgttcgccgcccctcgcctcttgctgtgcgcgctcagcaagccgagtcctgcgtcgagacatatcagcagccagggcct

SEQ ID NO: 411973 - DNA, 140 bp, Artificial Sequence
  Synthetic
atacgccatgctgggtctccaatatctgtggaatctcctggcctattggggtcaggaactgaagaatagtgctgttagcttgcttgataccacagcagtagcagtagctgagtggacagacgtacttgggagtcggccat

SEQ ID NO: 411974 - DNA, 140 bp, Artificial Sequence
  Synthetic
atggccgactcccaagtacgtctgtccactcagctactgctactgctgtggtatcaagcaagctaacagcactattcttcagttcctgaccccaataggccaggagattccacagatattggagacccagcatggcgtat

SEQ ID NO: 411975 - DNA, 140 bp, Artificial Sequence
  Synthetic
atacgccatgctgggtctccgggaagccctcaaatatctgggaagtcttgtgcagtattgggttctggagctcaagagtagtgctattagtctgcttgataccatagcaatagcagtagccgtacttgggagtcggccat

SEQ ID NO: 411976 - DNA, 140 bp, Artificial Sequence
  Synthetic
atggccgactcccaagtacggctactgctattgctatggtatcaagcagactaatagcactactcttgagctccagaacccaatactgcacaagacttcccagatatttgagggcttcccggagacccagcatggcgtat

SEQ ID NO: 411977 - DNA, 140 bp, Artificial Sequence
  Synthetic
  misc_feature (33)..(33): n is a, c, g, or t
  misc_feature (103)..(103): n is a, c, g, or t
atacgccatgctgggtctccaccctggaggaanagcccgaggcaatacaaaactgttctttcaatatgaccacagaagtaagagataagcagctgaaagtcantgcacttttttataaggcgtacttgggagtcggccat

SEQ ID NO: 411978 - DNA, 140 bp, Artificial Sequence
  Synthetic
  misc_feature (38)..(38): n is a, c, g, or t
  misc_feature (108)..(108): n is a, c, g, or t
atggccgactcccaagtacgccttataaaaaagtgcantgactttcagctgcttatctcttacttctgtggtcatattgaaagaacagttttgtattgcctcgggctnttcctccagggtggagacccagcatggcgtat

SEQ ID NO: 411979 - DNA, 140 bp, Artificial Sequence
  Synthetic
aggccctggctgctgatatggaaggtggagagcaagacagagacagatccattcgattagtgagcggattcttagcacttgcctgggacgatctgcggagcctgtgcctcttcagctaccgaccttttgggacagcggtg

SEQ ID NO: 411980 - DNA, 140 bp, Artificial Sequence
  Synthetic
caccgctgtcccaaaaggtcggtagctgaagaggcacaggctccgcagatcgtcccaggcaagtgctaagaatccgctcactaatcgaatggatctgtctctgtcttgctctccaccttccatatcagcagccagggcct

SEQ ID NO: 411981 - DNA, 140 bp, Artificial Sequence
  Synthetic
aggccctggctgctgatatggtggaacttctgggacgcagggggtgggaagccctcaaatattggtggaatctcctgcagtattggagtcaggaactaaagaatagtgctgttagcttgcgaccttttgggacagcggtg

SEQ ID NO: 411982 - DNA, 140 bp, Artificial Sequence
  Synthetic
caccgctgtcccaaaaggtcgcaagctaacagcactattctttagttcctgactccaatactgcaggagattccaccaatatttgagggcttcccaccccctgcgtcccagaagttccaccatatcagcagccagggcct

SEQ ID NO: 411983 - DNA, 140 bp, Artificial Sequence
  Synthetic
atacgccatgctgggtctccgtggcgcccgaacagggacttgaaagcgaaagtaaaagggactcgaaagcggaagttccagagaagttctcttgacgcaggactcggcttgctgagtgcacgtacttgggagtcggccat

SEQ ID NO: 411984 - DNA, 140 bp, Artificial Sequence
  Synthetic
atggccgactcccaagtacgtgcactcagcaagccgagtcctgcgtcaagagaacttctctggaacttccgctttcgagtcccttttactttcgctttcaagtccctgttcgggcgccacggagacccagcatggcgtat

SEQ ID NO: 411985 - DNA, 140 bp, Artificial Sequence
  Synthetic
atacgccatgctgggtctccaggatggagaaataaaaaactgctctttcaatatcaccacaaacataagagataaggtgcagaaaaactatgcactgttttatgatcttgatgtagtacccgtacttgggagtcggccat

SEQ ID NO: 411986 - DNA, 140 bp, Artificial Sequence
  Synthetic
atggccgactcccaagtacgggtactacatcaagatcataaaacagtgcatagtttttctgcaccttatctcttatgtttgtggtgatattgaaagagcagttttttatttctccatcctggagacccagcatggcgtat

SEQ ID NO: 411987 - DNA, 140 bp, Artificial Sequence
  Synthetic
atacgccatgctgggtctcctaaatcattatttaatgcagtagcagtcctcttctgtgtacatcaaaggatagaggtaaaagacaccaaggaagctttggataaagtagaggaaatacaacgtacttgggagtcggccat

SEQ ID NO: 411988 - DNA, 140 bp, Artificial Sequence
  Synthetic
atggccgactcccaagtacgttgtatttcctctactttatccaaagcttccttggtgtcttttacctctatcctttgatgtacacagaagaggactgctactgcattaaataatgatttaggagacccagcatggcgtat

SEQ ID NO: 411989 - DNA, 140 bp, Artificial Sequence
  Synthetic
aggccctggctgctgatatgcagccatcccttcagacaggatcagaagaacttaaatcattatataatacagtagcaaccctctattgtgtacatcaaaaaatagatataagagacaccagaccttttgggacagcggtg

SEQ ID NO: 411990 - DNA, 140 bp, Artificial Sequence
  Synthetic
caccgctgtcccaaaaggtctggtgtctcttatatctattttttgatgtacacaatagagggttgctactgtattatataatgatttaagttcttctgatcctgtctgaagggatggctgcatatcagcagccagggcct

SEQ ID NO: 411991 - DNA, 140 bp, Artificial Sequence
  Synthetic
aggccctggctgctgatatgcaacatatctatgacacctatggggatacttgggaaggagttgaagctataataagaattttgcaacaactactgtttgtccatttcagaattgggtgccgaccttttgggacagcggtg

SEQ ID NO: 411992 - DNA, 140 bp, Artificial Sequence
  Synthetic
caccgctgtcccaaaaggtcggcacccaattctgaaatggacaaacagtagttgttgcaaaattcttattatagcttcaactccttcccaagtatccccataggtgtcatagatatgttgcatatcagcagccagggcct

SEQ ID NO: 411993 - DNA, 140 bp, Artificial Sequence
  Synthetic
atacgccatgctgggtctccataagatttaaggaatctgcaggaggggacccagaaattgcaatgcacagttttaattgtggaggggaatttttctactgtaattcaacaccactgtttacgtacttgggagtcggccat

SEQ ID NO: 411994 - DNA, 140 bp, Artificial Sequence
  Synthetic
atggccgactcccaagtacgtaaacagtggtgttgaattacagtagaaaaattcccctccacaattaaaactgtgcattgcaatttctgggtcccctcctgcagattccttaaatcttatggagacccagcatggcgtat

SEQ ID NO: 411995 - DNA, 140 bp, Artificial Sequence
  Synthetic
aggccctggctgctgatatgttttaattgtggaggggaatttttctactgtaattcaacaccactgtttaatagcacttggaacaagactgaagcgctagatgacactgaaggagaggtcgaccttttgggacagcggtg

SEQ ID NO: 411996 - DNA, 140 bp, Artificial Sequence
  Synthetic
caccgctgtcccaaaaggtcgacctctccttcagtgtcatctagcgcttcagtcttgttccaagtgctattaaacagtggtgttgaattacagtagaaaaattcccctccacaattaaaacatatcagcagccagggcct

SEQ ID NO: 411997 - DNA, 140 bp, Artificial Sequence
  Synthetic
aggccctggctgctgatatgtagcaactctctattgtgtacatagaaagatagatgtacgagacaccaaggaagccttagacaagatagaggaggaacaaaacaaaagtcagcaaaaaacgaccttttgggacagcggtg

SEQ ID NO: 411998 - DNA, 140 bp, Artificial Sequence
  Synthetic
caccgctgtcccaaaaggtcgttttttgctgacttttgttttgttcctcctctatcttgtctaaggcttccttggtgtctcgtacatctatctttctatgtacacaatagagagttgctacatatcagcagccagggcct

SEQ ID NO: 411999 - DNA, 140 bp, Artificial Sequence
  Synthetic
atacgccatgctgggtctccacaacgacgagcagcttctcacagcagtgaaaatcatcaagatcctataccaaagcagtaagtataattacttagttctgtaatgatacctttgcaaatacgtacttgggagtcggccat

SEQ ID NO: 412000 - DNA, 140 bp, Artificial Sequence
  Synthetic
atggccgactcccaagtacgtatttgcaaaggtatcattacagaactaagtaattatacttactgctttggtataggatcttgatgattttcactgctgtgagaagctgctcgtcgttgtggagacccagcatggcgtat

SEQ ID NO: 412001 - DNA, 140 bp, Artificial Sequence
  Synthetic
atacgccatgctgggtctccgactatagtattcatagaatatagaaagctgttaaagcaaaagaaaatagataggttaattgatagaataagagaaagagcagaagacagtggcaatgagcgtacttgggagtcggccat

SEQ ID NO: 412002 - DNA, 140 bp, Artificial Sequence
  Synthetic
atggccgactcccaagtacgctcattgccactgtcttctgctctttctcttattctatcaattaacctatctattttcttttgctttaacagctttctatattctatgaatactatagtcggagacccagcatggcgtat

SEQ ID NO: 412003 - DNA, 140 bp, Artificial Sequence
  Synthetic
atacgccatgctgggtctccacagtctattatggggtacctgtgtggaaagacgcaaacaccactctattttgtgcatctgatgctcaagcatatagtcctgaaaaacataatgtctgggcgtacttgggagtcggccat

SEQ ID NO: 412004 - DNA, 140 bp, Artificial Sequence
  Synthetic
atggccgactcccaagtacgcccagacattatgtttttcaggactatatgcttgagcatcagatgcacaaaatagagtggtgtttgcgtctttccacacaggtaccccataatagactgtggagacccagcatggcgtat

SEQ ID NO: 412005 - DNA, 140 bp, Artificial Sequence
  Synthetic
aggccctggctgctgatatggttaggcagggatactcaccattatcattccagacccacctcccagctccgaggggaccagacaggcccgacggaatcgaagaagaaggtggagacagaggaccttttgggacagcggtg

SEQ ID NO: 412006 - DNA, 140 bp, Artificial Sequence
  Synthetic
caccgctgtcccaaaaggtcctctgtctccaccttcttcttcgattccgtcgggcctgtctggtcccctcggagctgggaggtgggtctggaatgataatggtgagtatccctgcctaaccatatcagcagccagggcct

SEQ ID NO: 412007 - DNA, 140 bp, Artificial Sequence
  Synthetic
atacgccatgctgggtctccgatggagtgggaaagagaaattgacaattacacaagagaaatatacaccttaattgaagaatcgcagaaccaacaagaaaagaatgaactagaattattgcgtacttgggagtcggccat

SEQ ID NO: 412008 - DNA, 140 bp, Artificial Sequence
  Synthetic
atggccgactcccaagtacgcaataattctagttcattcttttcttgttggttctgcgattcttcaattaaggtgtatatttctcttgtgtaattgtcaatttctctttcccactccatcggagacccagcatggcgtat

SEQ ID NO: 412009 - DNA, 140 bp, Artificial Sequence
  Synthetic
atacgccatgctgggtctccgtagctacacaattacgaggaaagtttaacaaaacaataatctttgataacccctccccaggaggggatatagaaattacatcacatagctttaattgtacgtacttgggagtcggccat

SEQ ID NO: 412010 - DNA, 140 bp, Artificial Sequence
  Synthetic
atggccgactcccaagtacgtacaattaaagctatgtgatgtaatttctatatcccctcctggggaggggttatcaaagattattgttttgttaaactttcctcgtaattgtgtagctacggagacccagcatggcgtat

SEQ ID NO: 412011 - DNA, 140 bp, Artificial Sequence
  Synthetic
aggccctggctgctgatatgcccctccccaggaggggatatagaaattacatcacatagctttaattgtagaggagaatttttctattgtaatacatcaggactgtttaataacacttgggaccttttgggacagcggtg

SEQ ID NO: 412012 - DNA, 140 bp, Artificial Sequence
  Synthetic
caccgctgtcccaaaaggtcccaagtgttattaaacagtcctgatgtattacaatagaaaaattctcctctacaattaaagctatgtgatgtaatttctatatcccctcctggggaggggcatatcagcagccagggcct

SEQ ID NO: 412013 - DNA, 140 bp, Artificial Sequence
  Synthetic
aggccctggctgctgatatgtgggaaaaaattcggttacggccagggggaaagaaaaaatatagattaaaacatatagtatgggcaagcagggagctagaacgattcgcagttaatcctggaccttttgggacagcggtg

SEQ ID NO: 412014 - DNA, 140 bp, Artificial Sequence
  Synthetic
caccgctgtcccaaaaggtccaggattaactgcgaatcgttctagctccctgcttgcccatactatatgttttaatctatattttttctttccccctggccgtaaccgaattttttcccacatatcagcagccagggcct

SEQ ID NO: 412015 - DNA, 140 bp, Artificial Sequence
  Synthetic
atacgccatgctgggtctccaaatataactctcccatgcagaataaagcaaattgtaaggatgtggcagagagtaggacaagcaatgtacgcccctcccatccaaggagaaataaggtgtcgtacttgggagtcggccat

SEQ ID NO: 412016 - DNA, 140 bp, Artificial Sequence
  Synthetic
atggccgactcccaagtacgacaccttatttctccttggatgggaggggcgtacattgcttgtcctactctctgccacatccttacaatttgctttattctgcatgggagagttatatttggagacccagcatggcgtat

SEQ ID NO: 412017 - DNA, 140 bp, Artificial Sequence
  Synthetic
aggccctggctgctgatatggaagtgaattatataagtataaagtagtggaaattaaaccactaggagtagcacccaccagggcaaaaagaagagtggtggagagagaaaaaagagcagtgaccttttgggacagcggtg

SEQ ID NO: 412018 - DNA, 140 bp, Artificial Sequence
  Synthetic
caccgctgtcccaaaaggtcactgctcttttttctctctccaccactcttctttttgccctggtgggtgctactcctagtggtttaatttccactactttatacttatataattcacttccatatcagcagccagggcct

SEQ ID NO: 412019 - DNA, 140 bp, Artificial Sequence
  Synthetic
aggccctggctgctgatatgagacaaatgggcaagtctgtggagttggtttgacataacaaattggctatggtatataaaaatatttataatgatagtaggaggcttaataggtttaagagaccttttgggacagcggtg

SEQ ID NO: 412020 - DNA, 140 bp, Artificial Sequence
  Synthetic
caccgctgtcccaaaaggtctcttaaacctattaagcctcctactatcattataaatatttttatataccatagccaatttgttatgtcaaaccaactccacagacttgcccatttgtctcatatcagcagccagggcct

SEQ ID NO: 412021 - DNA, 140 bp, Artificial Sequence
  Synthetic
aggccctggctgctgatatgtagtaaaactatggtaccagttagaaaaagaacccataataggagcagaaactttctatgtagatggggcagctaatagggagactaaactaggaaaggcgaccttttgggacagcggtg

SEQ ID NO: 412022 - DNA, 140 bp, Artificial Sequence
  Synthetic
caccgctgtcccaaaaggtcgcctttcctagtttagtctccctattagctgccccatctacatagaaagtttctgctcctattatgggttctttttctaactggtaccatagttttactacatatcagcagccagggcct

SEQ ID NO: 412023 - DNA, 140 bp, Artificial Sequence
  Synthetic
atacgccatgctgggtctccacaacaggagaaataataggagatataagacaagcacattgtaacattagtagagaaaaatggaataacactttacaacaggtagctaaaaaattaagagcgtacttgggagtcggccat

SEQ ID NO: 412024 - DNA, 140 bp, Artificial Sequence
  Synthetic
atggccgactcccaagtacgctcttaattttttagctacctgttgtaaagtgttattccatttttctctactaatgttacaatgtgcttgtcttatatctcctattatttctcctgttgtggagacccagcatggcgtat

SEQ ID NO: 412025 - DNA, 140 bp, Artificial Sequence
  Synthetic
aggccctggctgctgatatgcaaaaagtagcatagtgggatggcctgagattagggaaagattaagacgcactcctccagcagcagcagcagacggagtaggagcagtatctaaagatttgaccttttgggacagcggtg

SEQ ID NO: 412026 - DNA, 140 bp, Artificial Sequence
  Synthetic
caccgctgtcccaaaaggtcaaatctttagatactgctcctactccgtctgctgctgctgctggaggagtgcgtcttaatctttccctaatctcaggccatcccactatgctactttttgcatatcagcagccagggcct

SEQ ID NO: 412027 - DNA, 140 bp, Artificial Sequence
  Synthetic
aggccctggctgctgatatgcaggtttggggaagagacaacaactccctctcagaagcaggagccgatagacaaggaactgtatcctttagcttccctcaaatcactctttggcaacgacgaccttttgggacagcggtg

SEQ ID NO: 412028 - DNA, 140 bp, Artificial Sequence
  Synthetic
caccgctgtcccaaaaggtcgtcgttgccaaagagtgatttgagggaagctaaaggatacagttccttgtctatcggctcctgcttctgagagggagttgttgtctcttccccaaacctgcatatcagcagccagggcct

SEQ ID NO: 412029 - DNA, 140 bp, Artificial Sequence
  Synthetic
aggccctggctgctgatatggaggaggtaggctttccagtcagaccacaggtacctttaagaccaatgacttataaggcagcttttgatcttggcttctttttaaaagaaaaggggggacgaccttttgggacagcggtg

SEQ ID NO: 412030 - DNA, 140 bp, Artificial Sequence
  Synthetic
caccgctgtcccaaaaggtcgtccccccttttcttttaaaaagaagccaagatcaaaagctgccttataagtcattggtcttaaaggtacctgtggtctgactggaaagcctacctcctccatatcagcagccagggcct

SEQ ID NO: 412031 - DNA, 140 bp, Artificial Sequence
  Synthetic
atacgccatgctgggtctccgtggcgcccgaacagggacttgaagcgaaagcgaaagccagagaagttctctcgacgcaggactcggcttgctgagcgcgcacagcaagaggcgaggggccgtacttgggagtcggccat

SEQ ID NO: 412032 - DNA, 140 bp, Artificial Sequence
  Synthetic
atggccgactcccaagtacggcccctcgcctcttgctgtgcgcgctcagcaagccgagtcctgcgtcgagagaacttctctggctttcgctttcgcttcaagtccctgttcgggcgccacggagacccagcatggcgtat

SEQ ID NO: 412033 - DNA, 140 bp, Artificial Sequence
  Synthetic
aggccctggctgctgatatgtagcagtcctctattgtgtacataaaaggatagagataaaagacaccaaagaagctctagaggaagtggagaaggcacaaaagaacaatcagcaaagaacgaccttttgggacagcggtg

SEQ ID NO: 412034 - DNA, 140 bp, Artificial Sequence
  Synthetic
caccgctgtcccaaaaggtcgttctttgctgattgttcttttgtgccttctccacttcctctagagcttctttggtgtcttttatctctatccttttatgtacacaatagaggactgctacatatcagcagccagggcct

SEQ ID NO: 412035 - DNA, 140 bp, Artificial Sequence
  Synthetic
aggccctggctgctgatatgaaacaaattataaacatgtggcaagaggtaggacgagcaatgtatgcccctcccattgcaggaaacataacatgtaaatcaaatatcacaggactactatgaccttttgggacagcggtg

SEQ ID NO: 412036 - DNA, 140 bp, Artificial Sequence
  Synthetic
caccgctgtcccaaaaggtcatagtagtcctgtgatatttgatttacatgttatgtttcctgcaatgggaggggcatacattgctcgtcctacctcttgccacatgtttataatttgtttcatatcagcagccagggcct

SEQ ID NO: 412037 - DNA, 140 bp, Artificial Sequence
  Synthetic
aggccctggctgctgatatggcaatattttgactgtttttcagaatctgccataaggaaagccatattaggacaaataattattcatagttgtgaatatcaagcaggacataataaggtagaccttttgggacagcggtg

SEQ ID NO: 412038 - DNA, 140 bp, Artificial Sequence
  Synthetic
caccgctgtcccaaaaggtctaccttattatgtcctgcttgatattcacaactatgaataattatttgtcctaatatggctttccttatggcagattctgaaaaacagtcaaaatattgccatatcagcagccagggcct

SEQ ID NO: 412039 - DNA, 140 bp, Artificial Sequence
  Synthetic
aggccctggctgctgatatggacaaataattattcatagttgtgaatatcaagcaggacataataaggtagggtctctgcaatatttggcactgaaagcattagtagcaccaaaaagaacgaccttttgggacagcggtg

SEQ ID NO: 412040 - DNA, 140 bp, Artificial Sequence
  Synthetic
caccgctgtcccaaaaggtcgttctttttggtgctactaatgctttcagtgccaaatattgcagagaccctaccttattatgtcctgcttgatattcacaactatgaataattatttgtccatatcagcagccagggcct

SEQ ID NO: 412041 - DNA, 140 bp, Artificial Sequence
  Synthetic
atacgccatgctgggtctccttcatttcagaattggttgcaatcatagcagaataggcattctcagaaggagaagaggcagggatggatccggtagaccctaacctagagccttggaacccgtacttgggagtcggccat

SEQ ID NO: 412042 - DNA, 140 bp, Artificial Sequence
  Synthetic
atggccgactcccaagtacgggttccaaggctctaggttagggtctaccggatccatccctgcctcttctccttctgagaatgcctattctgctatgattgcaaccaattctgaaatgaaggagacccagcatggcgtat

SEQ ID NO: 412043 - DNA, 140 bp, Artificial Sequence
  Synthetic
atacgccatgctgggtctccagaagaggcagggatggatccggtagaccctaacctagagccttggaaccacccgggaagtcagcctaaaactgcttgtaacaagtgctattgtaaaaagcgtacttgggagtcggccat

SEQ ID NO: 412044 - DNA, 140 bp, Artificial Sequence
  Synthetic
atggccgactcccaagtacgctttttacaatagcacttgttacaagcagttttaggctgacttcccgggtggttccaaggctctaggttagggtctaccggatccatccctgcctcttctggagacccagcatggcgtat

SEQ ID NO: 412045 - DNA, 140 bp, Artificial Sequence
  Synthetic
atacgccatgctgggtctccgcaattttaagggcccaaaaagaaatattaagtgctttaactgtggcaaagaaggacatctagccagaaattgcagggcccctaggaaaaggggctgttgcgtacttgggagtcggccat

SEQ ID NO: 412046 - DNA, 140 bp, Artificial Sequence
  Synthetic
atggccgactcccaagtacgcaacagccccttttcctaggggccctgcaatttctggctagatgtccttctttgccacagttaaagcacttaatatttctttttgggcccttaaaattgcggagacccagcatggcgtat

SEQ ID NO: 412047 - DNA, 140 bp, Artificial Sequence
  Synthetic
aggccctggctgctgatatgagtcaatcaaataatagagcaattaataaagaaggaaaaggtctacctgtcatgggtaccagcacacaaaggaattggaggaaatgaacaagtagataaagaccttttgggacagcggtg

SEQ ID NO: 412048 - DNA, 140 bp, Artificial Sequence
  Synthetic
caccgctgtcccaaaaggtctttatctacttgttcatttcctccaattcctttgtgtgctggtacccatgacaggtagaccttttccttctttattaattgctctattatttgattgactcatatcagcagccagggcct

SEQ ID NO: 412049 - DNA, 140 bp, Artificial Sequence
  Synthetic
atacgccatgctgggtctccctatggcaggaagaagtggagacagcgacgaggcgcttctcgaagcaataaagatcatcaaaatcctatacaaaagcagtaagtatcatatgtaatgacacgtacttgggagtcggccat

SEQ ID NO: 412050 - DNA, 140 bp, Artificial Sequence
  Synthetic
atggccgactcccaagtacgtgtcattacatatgatacttactgcttttgtataggattttgatgatctttattgcttcgagaagcgcctcgtcgctgtctccacttcttcctgccatagggagacccagcatggcgtat

SEQ ID NO: 412051 - DNA, 140 bp, Artificial Sequence
  Synthetic
atacgccatgctgggtctccaatagttgtgtgggctatagtaatagtagaatataggaagatactaaagcaaaggaaaatagacaggttacttgatagaataagagaaagagcagaagaccgtacttgggagtcggccat

SEQ ID NO: 412052 - DNA, 140 bp, Artificial Sequence
  Synthetic
atggccgactcccaagtacggtcttctgctctttctcttattctatcaagtaacctgtctattttcctttgctttagtatcttcctatattctactattactatagcccacacaactattggagacccagcatggcgtat

SEQ ID NO: 412053 - DNA, 140 bp, Artificial Sequence
  Synthetic
aggccctggctgctgatatgaaaggaaaatagacaggttacttgatagaataagagaaagagcagaagacagtggcaatgagagtgatggggacgcagaggaactgtcagcacttgtggagaccttttgggacagcggtg

SEQ ID NO: 412054 - DNA, 140 bp, Artificial Sequence
  Synthetic
caccgctgtcccaaaaggtctccacaagtgctgacagttcctctgcgtccccatcactctcattgccactgtcttctgctctttctcttattctatcaagtaacctgtctattttcctttcatatcagcagccagggcct

SEQ ID NO: 412055 - DNA, 140 bp, Artificial Sequence
  Synthetic
aggccctggctgctgatatgcatggtagagcagatgcatacagatataatcagcttatgggatcaaagcctaaagccatgtgtaaagttaacccctctctgtgtcactttaaactgtaccgaccttttgggacagcggtg

SEQ ID NO: 412056 - DNA, 140 bp, Artificial Sequence
  Synthetic
caccgctgtcccaaaaggtcggtacagtttaaagtgacacagagaggggttaactttacacatggctttaggctttgatcccataagctgattatatctgtatgcatctgctctaccatgcatatcagcagccagggcct

SEQ ID NO: 412057 - DNA, 140 bp, Artificial Sequence
  Synthetic
atacgccatgctgggtctccagacataaaaaactgttctttcaatatgaccacagtactaaaagataagaaagaaaaggtacatgctcttttttatagactagatatagtaccaattaatcgtacttgggagtcggccat

SEQ ID NO: 412058 - DNA, 140 bp, Artificial Sequence
  Synthetic
atggccgactcccaagtacgattaattggtactatatctagtctataaaaaagagcatgtaccttttctttcttatcttttagtactgtggtcatattgaaagaacagttttttatgtctggagacccagcatggcgtat

SEQ ID NO: 412059 - DNA, 140 bp, Artificial Sequence
  Synthetic
atacgccatgctgggtctcctgttgccaataccaataatagtagtgggttagaagggataacgggagaactaagaaactgctctttcaatgtcacagaggaaataaacaagaagatgcgacgtacttgggagtcggccat

SEQ ID NO: 412060 - DNA, 140 bp, Artificial Sequence
  Synthetic
atggccgactcccaagtacgtcgcatcttcttgtttatttcctctgtgacattgaaagagcagtttcttagttctcccgttatcccttctaacccactactattattggtattggcaacaggagacccagcatggcgtat

SEQ ID NO: 412061 - DNA, 140 bp, Artificial Sequence
  Synthetic
aggccctggctgctgatatgaaattgtaatacctcagccattacacaggcttgtccaaaggtatcctttgatccaattcctatacattattgtgccccagctggttttgcaattctaaaggaccttttgggacagcggtg

SEQ ID NO: 412062 - DNA, 140 bp, Artificial Sequence
  Synthetic
caccgctgtcccaaaaggtcctttagaattgcaaaaccagctggggcacaataatgtataggaattggatcaaaggatacctttggacaagcctgtgtaatggctgaggtattacaatttcatatcagcagccagggcct

SEQ ID NO: 412063 - DNA, 140 bp, Artificial Sequence
  Synthetic
aggccctggctgctgatatgggagaagtaggctttccagtcagacctcaggtgcctttaagaccaatgacttataaggcagcgttcgatctcagcttctttttaaaagaaaaggggggacgaccttttgggacagcggtg

SEQ ID NO: 412064 - DNA, 140 bp, Artificial Sequence
  Synthetic
caccgctgtcccaaaaggtcgtccccccttttcttttaaaaagaagctgagatcgaacgctgccttataagtcattggtcttaaaggcacctgaggtctgactggaaagcctacttctcccatatcagcagccagggcct

SEQ ID NO: 412065 - DNA, 140 bp, Artificial Sequence
  Synthetic
atacgccatgctgggtctccttatcagtaatacaggtaatgttacggaagaaataaaaaattgctcttttgatataaccacagaaataagagataggaaaaagaaagaaagtgctcttttcgtacttgggagtcggccat

SEQ ID NO: 412066 - DNA, 140 bp, Artificial Sequence
  Synthetic
atggccgactcccaagtacgaaaagagcactttctttctttttcctatctcttatttctgtggttatatcaaaagagcaattttttatttcttccgtaacattacctgtattactgataaggagacccagcatggcgtat

SEQ ID NO: 412067 - DNA, 140 bp, Artificial Sequence
  Synthetic
atacgccatgctgggtctccagtacaatgcacacatggaattaggccagtggtatcaactcaactgctgttgaatggcagtctagcaaaagaaggggtaaaagttaggtctgagaatttccgtacttgggagtcggccat

SEQ ID NO: 412068 - DNA, 140 bp, Artificial Sequence
  Synthetic
atggccgactcccaagtacggaaattctcagacctaacttttaccccttcttttgctagactgccattcaacagcagttgagttgataccactggcctaattccatgtgtgcattgtactggagacccagcatggcgtat

SEQ ID NO: 412069 - DNA, 140 bp, Artificial Sequence
  Synthetic
aggccctggctgctgatatgggaagaagcggagacagcgacgaagcgctcctccaagcagtaaggatcatcaaaatcctctaccaaagcagtaagtacccaatagtagatgtaatgttaagaccttttgggacagcggtg

SEQ ID NO: 412070 - DNA, 140 bp, Artificial Sequence
  Synthetic
caccgctgtcccaaaaggtcttaacattacatctactattgggtacttactgctttggtagaggattttgatgatccttactgcttggaggagcgcttcgtcgctgtctccgcttcttcccatatcagcagccagggcct

SEQ ID NO: 412071 - DNA, 140 bp, Artificial Sequence
  Synthetic
atacgccatgctgggtctcccaactgtaccagacccaacaacaatacaaggaaaagtatacgtataggaccaggacaatcattctatgcaacaggtgaagtaataggaaacataaggcaacgtacttgggagtcggccat

SEQ ID NO: 412072 - DNA, 140 bp, Artificial Sequence
  Synthetic
atggccgactcccaagtacgttgccttatgtttcctattacttcacctgttgcatagaatgattgtcctggtcctatacgtatacttttccttgtattgttgttgggtctggtacagttgggagacccagcatggcgtat

SEQ ID NO: 412073 - DNA, 140 bp, Artificial Sequence
  Synthetic
atacgccatgctgggtctccagctaaacaattaaggaaacacttctctaataaaacgataatctttaatccatcctcaggaggggacctagaaattacaatgcatagtttcaattgtagacgtacttgggagtcggccat

SEQ ID NO: 412074 - DNA, 140 bp, Artificial Sequence
  Synthetic
atggccgactcccaagtacgtctacaattgaaactatgcattgtaatttctaggtcccctcctgaggatggattaaagattatcgttttattagagaagtgtttccttaattgtttagctggagacccagcatggcgtat

SEQ ID NO: 412075 - DNA, 140 bp, Artificial Sequence
  Synthetic
aggccctggctgctgatatgcatcctcaggaggggacctagaaattacaatgcatagtttcaattgtagaggagagtttttctattgtaatacaacaaaactgtttaatagcacttggctgaccttttgggacagcggtg

SEQ ID NO: 412076 - DNA, 140 bp, Artificial Sequence
  Synthetic
caccgctgtcccaaaaggtcagccaagtgctattaaacagttttgttgtattacaatagaaaaactctcctctacaattgaaactatgcattgtaatttctaggtcccctcctgaggatgcatatcagcagccagggcct

SEQ ID NO: 412077 - DNA, 140 bp, Artificial Sequence
  Synthetic
atacgccatgctgggtctcccaataaaatttatgaactcctcaggaggggacccagaaattgtaacacacagttttaattgtgcaggggaattcttctactgtaatacatcaaagctgttcgtacttgggagtcggccat

SEQ ID NO: 412078 - DNA, 140 bp, Artificial Sequence
  Synthetic
atggccgactcccaagtacgaacagctttgatgtattacagtagaagaattcccctgcacaattaaaactgtgtgttacaatttctgggtcccctcctgaggagttcataaattttattgggagacccagcatggcgtat

SEQ ID NO: 412079 - DNA, 140 bp, Artificial Sequence
  Synthetic
atacgccatgctgggtctcctaacactcccatgcaggataaaacaaattgtaaacatgtggcagggagtaggacaagcaatgtatgcccctcctatcgcaggaatgatacagtgtgtatccgtacttgggagtcggccat

SEQ ID NO: 412080 - DNA, 140 bp, Artificial Sequence
  Synthetic
atggccgactcccaagtacggatacacactgtatcattcctgcgataggaggggcatacattgcttgtcctactccctgccacatgtttacaatttgttttatcctgcatgggagtgttaggagacccagcatggcgtat

SEQ ID NO: 412081 - DNA, 140 bp, Artificial Sequence
  Synthetic
aggccctggctgctgatatgaaaggcttaggcatctcctatggcaggaagaagcggagacagcgacgaagaactcctcaaggcagtcagactaatcaagtatctctaccaaagcagtaaggaccttttgggacagcggtg

SEQ ID NO: 412082 - DNA, 140 bp, Artificial Sequence
  Synthetic
caccgctgtcccaaaaggtccttactgctttggtagagatacttgattagtctgactgccttgaggagttcttcgtcgctgtctccgcttcttcctgccataggagatgcctaagcctttcatatcagcagccagggcct

SEQ ID NO: 412083 - DNA, 140 bp, Artificial Sequence
  Synthetic
aggccctggctgctgatatgcaacaataatacaagaaaaagtatacatataggaccaggaagagcattttatgcaacaggagacataataggagacatgagaaaggcatattgtagcgttgaccttttgggacagcggtg

SEQ ID NO: 412084 - DNA, 140 bp, Artificial Sequence
  Synthetic
caccgctgtcccaaaaggtcaacgctacaatatgcctttctcatgtctcctattatgtctcctgttgcataaaatgctcttcctggtcctatatgtatactttttcttgtattattgttgcatatcagcagccagggcct

SEQ ID NO: 412085 - DNA, 140 bp, Artificial Sequence
  Synthetic
aggccctggctgctgatatgcagggaaagattaagacggactactccagcagcagaaggagtgggagcagtgtctaaagatttagagaaacatggggcaatcacaagcagtaatacatcagaccttttgggacagcggtg

SEQ ID NO: 412086 - DNA, 140 bp, Artificial Sequence
  Synthetic
caccgctgtcccaaaaggtctgatgtattactgcttgtgattgccccatgtttctctaaatctttagacactgctcccactccttctgctgctggagtagtccgtcttaatctttccctgcatatcagcagccagggcct

SEQ ID NO: 412087 - DNA, 140 bp, Artificial Sequence
  Synthetic
atacgccatgctgggtctccaaagagctttgctataagatgggtggcaagtggtcaaaacgtatgagtggatggcctgctgtaagggaaagaatgagaagaactgagccaggggaaagaacgtacttgggagtcggccat

SEQ ID NO: 412088 - DNA, 140 bp, Artificial Sequence
  Synthetic
atggccgactcccaagtacgttctttcccctggctcagttcttctcattctttcccttacagcaggccatccactcatacgttttgaccacttgccacccatcttatagcaaagctctttggagacccagcatggcgtat

SEQ ID NO: 412089 - DNA, 140 bp, Artificial Sequence
  Synthetic
aggccctggctgctgatatgatggcctgctgtaagggaaagaatgagaagaactgagccaggggaaagaaggagacgaaatgagccagcagtagaaccagcagcagttggggtgggagcagaccttttgggacagcggtg

SEQ ID NO: 412090 - DNA, 140 bp, Artificial Sequence
  Synthetic
caccgctgtcccaaaaggtctgctcccaccccaactgctgctggttctactgctggctcatttcgtctccttctttcccctggctcagttcttctcattctttcccttacagcaggccatcatatcagcagccagggcct

SEQ ID NO: 412091 - DNA, 140 bp, Artificial Sequence
  Synthetic
aggccctggctgctgatatgagaaacaagaatatgcgcttttttataaagctgatctagtaccactagataataatactgattatgttctaataaattgtaatgttacaaccattaagcagaccttttgggacagcggtg

SEQ ID NO: 412092 - DNA, 140 bp, Artificial Sequence
  Synthetic
caccgctgtcccaaaaggtctgcttaatggttgtaacattacaatttattagaacataatcagtattattatctagtggtactagatcagctttataaaaaagcgcatattcttgtttctcatatcagcagccagggcct

SEQ ID NO: 412093 - DNA, 140 bp, Artificial Sequence
  Synthetic
atacgccatgctgggtctccaccccctattgtgtacatcagaggatagaggtaaaagacaccatggaagctttaaataaagtggaggaagagcaaaacaaacataagcaaaagacacagccgtacttgggagtcggccat

SEQ ID NO: 412094 - DNA, 140 bp, Artificial Sequence
  Synthetic
atggccgactcccaagtacggctgtgtcttttgcttatgtttgttttgctcttcctccactttatttaaagcttccatggtgtcttttacctctatcctctgatgtacacaatagggggtggagacccagcatggcgtat

SEQ ID NO: 412095 - DNA, 140 bp, Artificial Sequence
  Synthetic
atacgccatgctgggtctccttgtttactcatttcagaattgggtgccaccatagcagaataggtgtgcaaagaagaggtagaaatggatccagtagatcctaacatagaaccctggaaccgtacttgggagtcggccat

SEQ ID NO: 412096 - DNA, 140 bp, Artificial Sequence
  Synthetic
atggccgactcccaagtacggttccagggttctatgttaggatctactggatccatttctacctcttctttgcacacctattctgctatggtggcacccaattctgaaatgagtaaacaaggagacccagcatggcgtat

SEQ ID NO: 412097 - DNA, 140 bp, Artificial Sequence
  Synthetic
aggccctggctgctgatatgtgacctggatggagtgggaaaaagagattagcaattactcaaatgaaatatacaggttaattgaaaaatcgcaaaaccagcaggaaaagaatgaacaagagaccttttgggacagcggtg

SEQ ID NO: 412098 - DNA, 140 bp, Artificial Sequence
  Synthetic
caccgctgtcccaaaaggtctcttgttcattcttttcctgctggttttgcgatttttcaattaacctgtatatttcatttgagtaattgctaatctctttttcccactccatccaggtcacatatcagcagccagggcct

SEQ ID NO: 412099 - DNA, 140 bp, Artificial Sequence
  Synthetic
atacgccatgctgggtctccgtgttgctatcattgtcaatgttgcttcataaacaagggcttaggcatctcctatggcaggaagaagcggaagcagcgacgcagagcttctcacagtagtcgtacttgggagtcggccat

SEQ ID NO: 412100 - DNA, 140 bp, Artificial Sequence
  Synthetic
atggccgactcccaagtacgactactgtgagaagctctgcgtcgctgcttccgcttcttcctgccataggagatgcctaagcccttgtttatgaagcaacattgacaatgatagcaacacggagacccagcatggcgtat

SEQ ID NO: 412101 - DNA, 140 bp, Artificial Sequence
  Synthetic
atacgccatgctgggtctccaagaatcgcaaaaacaacaagaaaagaatgaacaagaattattagcattagatcagtgggcaaatttgtggaattggtttgacatatcaaattggctgtgcgtacttgggagtcggccat

SEQ ID NO: 412102 - DNA, 140 bp, Artificial Sequence
  Synthetic
atggccgactcccaagtacgcacagccaatttgatatgtcaaaccaattccacaaatttgcccactgatctaatgctaataattcttgttcattcttttcttgttgtttttgcgattcttggagacccagcatggcgtat

SEQ ID NO: 412103 - DNA, 140 bp, Artificial Sequence
  Synthetic
atacgccatgctgggtctcctgtaatgaatgatttaatagtagtaagcatagtagcattaatagtagcctttattatagcagtagttgtgtggactatagtatttatagaatatagaaagcgtacttgggagtcggccat

SEQ ID NO: 412104 - DNA, 140 bp, Artificial Sequence
  Synthetic
atggccgactcccaagtacgctttctatattctataaatactatagtccacacaactactgctataataaaggctactattaatgctactatgcttactactattaaatcattcattacaggagacccagcatggcgtat

SEQ ID NO: 412105 - DNA, 140 bp, Artificial Sequence
  Synthetic
atacgccatgctgggtctccacaccacctatgacaactccaccatggatgggaaagaagaattaaaaaactgctcttataatatgaccacagaattaagagataggagacggagagtatacgtacttgggagtcggccat

SEQ ID NO: 412106 - DNA, 140 bp, Artificial Sequence
  Synthetic
atggccgactcccaagtacgtatactctccgtctcctatctcttaattctgtggtcatattataagagcagttttttaattcttctttcccatccatggtggagttgtcataggtggtgtggagacccagcatggcgtat

SEQ ID NO: 412107 - DNA, 140 bp, Artificial Sequence
  Synthetic
atacgccatgctgggtctccgtggcgcccgaacagggactagaaagcgaaagtagaaccagagaagatctctcgacgcaggactcggcttgctgaagcgcacggcaagaggcgaggggcgcgtacttgggagtcggccat

SEQ ID NO: 412108 - DNA, 140 bp, Artificial Sequence
  Synthetic
atggccgactcccaagtacgcgcccctcgcctcttgccgtgcgcttcagcaagccgagtcctgcgtcgagagatcttctctggttctactttcgctttctagtccctgttcgggcgccacggagacccagcatggcgtat

SEQ ID NO: 412109 - DNA, 140 bp, Artificial Sequence
  Synthetic
aggccctggctgctgatatgaacaatacaagaaaaagtatacgtataggaccaggacaagcattctatgcaacaggtgaaataataggggagataagaaaagcacattgtaccatcaatagaccttttgggacagcggtg

SEQ ID NO: 412110 - DNA, 140 bp, Artificial Sequence
  Synthetic
caccgctgtcccaaaaggtctattgatggtacaatgtgcttttcttatctcccctattatttcacctgttgcatagaatgcttgtcctggtcctatacgtatactttttcttgtattgttcatatcagcagccagggcct

SEQ ID NO: 412111 - DNA, 140 bp, Artificial Sequence
  Synthetic
aggccctggctgctgatatgcatggaatagtttagtaaagcaccatatgtatgtttcaaagagagctagtggatggttttacagacatcattatgaaagcagacatccaaaaataagttcgaccttttgggacagcggtg

SEQ ID NO: 412112 - DNA, 140 bp, Artificial Sequence
  Synthetic
caccgctgtcccaaaaggtcgaacttatttttggatgtctgctttcataatgatgtctgtaaaaccatccactagctctctttgaaacatacatatggtgctttactaaactattccatgcatatcagcagccagggcct

SEQ ID NO: 412113 - DNA, 140 bp, Artificial Sequence
  Synthetic
aggccctggctgctgatatgaaagcaaattataaatatgtggcagagagtaggacaagcaatatatgcccctcccattgaaggagtaataaggtgtgaatcaaacattacaggactactagaccttttgggacagcggtg

SEQ ID NO: 412114 - DNA, 140 bp, Artificial Sequence
  Synthetic
caccgctgtcccaaaaggtctagtagtcctgtaatgtttgattcacaccttattactccttcaatgggaggggcatatattgcttgtcctactctctgccacatatttataatttgctttcatatcagcagccagggcct

SEQ ID NO: 412115 - DNA, 140 bp, Artificial Sequence
  Synthetic
atacgccatgctgggtctccccctaagagctgagcaagctacacaggaagtaaaaggttggatgacagacaccttgttggtccaaaatgcgaacccagattgtaaaaccattttaaaagccgtacttgggagtcggccat

SEQ ID NO: 412116 - DNA, 140 bp, Artificial Sequence
  Synthetic
atggccgactcccaagtacggcttttaaaatggttttacaatctgggttcgcattttggaccaacaaggtgtctgtcatccaaccttttacttcctgtgtagcttgctcagctcttagggggagacccagcatggcgtat

SEQ ID NO: 412117 - DNA, 140 bp, Artificial Sequence
  Synthetic
aggccctggctgctgatatgactgtatcctttgacttccctcaaatcactctttggcaacgacccatcgtcacaataaagataggggggcaactaaaggaagctctattagatacaggaggaccttttgggacagcggtg

SEQ ID NO: 412118 - DNA, 140 bp, Artificial Sequence
  Synthetic
caccgctgtcccaaaaggtcctcctgtatctaatagagcttcctttagttgcccccctatctttattgtgacgatgggtcgttgccaaagagtgatttgagggaagtcaaaggatacagtcatatcagcagccagggcct

SEQ ID NO: 412119 - DNA, 140 bp, Artificial Sequence
  Synthetic
aggccctggctgctgatatgaccactaatgtgccttggaactctagctggagtaataaatcacagagtgaaatatgggacaacatgacctggttacaatgggataaagaaattagtaattgaccttttgggacagcggtg

SEQ ID NO: 412120 - DNA, 140 bp, Artificial Sequence
  Synthetic
caccgctgtcccaaaaggtcaattactaatttctttatcccattgtaaccaggtcatgttgtcccatatttcactctgtgatttattactccagctagagttccaaggcacattagtggtcatatcagcagccagggcct

SEQ ID NO: 412121 - DNA, 140 bp, Artificial Sequence
  Synthetic
atacgccatgctgggtctccgcactcctccaagcagtgaggatcatcaagattctgtactcaagcagtaagtatatgtaatgttgaatttactagcaaaagtagattatagattaggaatcgtacttgggagtcggccat

SEQ ID NO: 412122 - DNA, 140 bp, Artificial Sequence
  Synthetic
atggccgactcccaagtacgattcctaatctataatctacttttgctagtaaattcaacattacatatacttactgcttgagtacagaatcttgatgatcctcactgcttggaggagtgcggagacccagcatggcgtat

SEQ ID NO: 412123 - DNA, 140 bp, Artificial Sequence
  Synthetic
aggccctggctgctgatatgagacagggcttcgaaagggctttgctataacatgggtggcaagtggtcaaaaagtagcatagtgggatggccagctataagggaaagaataaggagaactgaccttttgggacagcggtg

SEQ ID NO: 412124 - DNA, 140 bp, Artificial Sequence
  Synthetic
caccgctgtcccaaaaggtcagttctccttattctttcccttatagctggccatcccactatgctactttttgaccacttgccacccatgttatagcaaagccctttcgaagccctgtctcatatcagcagccagggcct

SEQ ID NO: 412125 - DNA, 140 bp, Artificial Sequence
  Synthetic
atacgccatgctgggtctccaaaaactaccacaggtcctgtagaaatgaaaaattgctctttcaatacaaccacagaactaagagataagaaacagagagcatatgcacttttttatagacgtacttgggagtcggccat

SEQ ID NO: 412126 - DNA, 140 bp, Artificial Sequence
  Synthetic
atggccgactcccaagtacgtctataaaaaagtgcatatgctctctgtttcttatctcttagttctgtggttgtattgaaagagcaatttttcatttctacaggacctgtggtagtttttggagacccagcatggcgtat

SEQ ID NO: 412127 - DNA, 140 bp, Artificial Sequence
  Synthetic
atacgccatgctgggtctcccctccaacagcatcaggagtaactcctccagcagcatcaggagtaggagcagtatctcaagatttagataaacatggagcagtcacaagcagtaacattacgtacttgggagtcggccat

SEQ ID NO: 412128 - DNA, 140 bp, Artificial Sequence
  Synthetic
atggccgactcccaagtacgtaatgttactgcttgtgactgctccatgtttatctaaatcttgagatactgctcctactcctgatgctgctggaggagttactcctgatgctgttggaggggagacccagcatggcgtat

SEQ ID NO: 412129 - DNA, 140 bp, Artificial Sequence
  Synthetic
aggccctggctgctgatatggaggaagtgggctttccagtcagacctcaggtaccattaagaccaatgacttataaaggagcttttgatctaggcttctttttaaaagaaaaggggggacgaccttttgggacagcggtg

SEQ ID NO: 412130 - DNA, 140 bp, Artificial Sequence
  Synthetic
caccgctgtcccaaaaggtcgtccccccttttcttttaaaaagaagcctagatcaaaagctcctttataagtcattggtcttaatggtacctgaggtctgactggaaagcccacttcctccatatcagcagccagggcct

SEQ ID NO: 412131 - DNA, 140 bp, Artificial Sequence
  Synthetic
atacgccatgctgggtctccgtggcgcccgaacagggaccagggaagcgaaagtgaaagcgacgcagaggactcggcttgctgagcgcgcacagcaagaggcgaggggcggcgactggtgcgtacttgggagtcggccat

SEQ ID NO: 412132 - DNA, 140 bp, Artificial Sequence
  Synthetic
atggccgactcccaagtacgcaccagtcgccgcccctcgcctcttgctgtgcgcgctcagcaagccgagtcctctgcgtcgctttcactttcgcttccctggtccctgttcgggcgccacggagacccagcatggcgtat

SEQ ID NO: 412133 - DNA, 140 bp, Artificial Sequence
  Synthetic
atacgccatgctgggtctccgaaggaaaaattagaagaacactataatagaacaatagaatttcaacaacactcaggaggggatctagaagttacaacacatagctttaattgtagaggacgtacttgggagtcggccat

SEQ ID NO: 412134 - DNA, 140 bp, Artificial Sequence
  Synthetic
atggccgactcccaagtacgtcctctacaattaaagctatgtgttgtaacttctagatcccctcctgagtgttgttgaaattctattgttctattatagtgttcttctaatttttccttcggagacccagcatggcgtat

SEQ ID NO: 412135 - DNA, 140 bp, Artificial Sequence
  Synthetic
atacgccatgctgggtctcctacacatcccactaggggacgctaaattagtagtaacaacatattggggtctacacataggagaaaaagaatggcagttgggccatggggtctccatagacgtacttgggagtcggccat

SEQ ID NO: 412136 - DNA, 140 bp, Artificial Sequence
  Synthetic
atggccgactcccaagtacgtctatggagaccccatggcccaactgccattctttttctcctatgtgtagaccccaatatgttgttactactaatttagcgtcccctagtgggatgtgtaggagacccagcatggcgtat

SEQ ID NO: 412137 - DNA, 140 bp, Artificial Sequence
  Synthetic
  misc_feature (120)..(120): n is a, c, g, or t
aggccctggctgctgatatgcggagacggcgacgaagagcttatccagacagtcagactgatcaggctcctctatcaaagcagtaagtagtacatgtaatgcaatctttaataatattangaccttttgggacagcggtg

SEQ ID NO: 412138 - DNA, 140 bp, Artificial Sequence
  Synthetic
  misc_feature (21)..(21): n is a, c, g, or t
caccgctgtcccaaaaggtcntaatattattaaagattgcattacatgtactacttactgctttgatagaggagcctgatcagtctgactgtctggataagctcttcgtcgccgtctccgcatatcagcagccagggcct

SEQ ID NO: 412139 - DNA, 140 bp, Artificial Sequence
  Synthetic
atacgccatgctgggtctccataagagaattaagaaggaaaggaaaatagactggttaattaagagaataagtgaaagagcagaagacagtggcaatgagagtgatggggacgcagaggacgtacttgggagtcggccat

SEQ ID NO: 412140 - DNA, 140 bp, Artificial Sequence
  Synthetic
atggccgactcccaagtacgtcctctgcgtccccatcactctcattgccactgtcttctgctctttcacttattctcttaattaaccagtctattttcctttccttcttaattctcttatggagacccagcatggcgtat

SEQ ID NO: 412141 - DNA, 140 bp, Artificial Sequence
  Synthetic
aggccctggctgctgatatgagtgaaagagcagaagacagtggcaatgagagtgatggggacgcagaggaaatatcaaaacttatggagatggggaatcttaattttgggtttgttaatggaccttttgggacagcggtg

SEQ ID NO: 412142 - DNA, 140 bp, Artificial Sequence
  Synthetic
caccgctgtcccaaaaggtccattaacaaacccaaaattaagattccccatctccataagttttgatatttcctctgcgtccccatcactctcattgccactgtcttctgctctttcactcatatcagcagccagggcct

SEQ ID NO: 412143 - DNA, 140 bp, Artificial Sequence
  Synthetic
aggccctggctgctgatatgacagggctttgaaacagctttgctataaaatggggggcaagtggtcaaaaagcagcatagttggatggcctgctgtaagagaaagaataagacaaactgagaccttttgggacagcggtg

SEQ ID NO: 412144 - DNA, 140 bp, Artificial Sequence
  Synthetic
caccgctgtcccaaaaggtctcagtttgtcttattctttctcttacagcaggccatccaactatgctgctttttgaccacttgccccccattttatagcaaagctgtttcaaagccctgtcatatcagcagccagggcct

SEQ ID NO: 412145 - DNA, 140 bp, Artificial Sequence
  Synthetic
atacgccatgctgggtctccattatactaataataatagctggaaaatgggagaaataaaaaattgctctttcaatatcaccacaagcataagtgataaagtgcaaaaaaactatgcattcgtacttgggagtcggccat

SEQ ID NO: 412146 - DNA, 140 bp, Artificial Sequence
  Synthetic
atggccgactcccaagtacgaatgcatagtttttttgcactttatcacttatgcttgtggtgatattgaaagagcaattttttatttctcccattttccagctattattattagtataatggagacccagcatggcgtat

SEQ ID NO: 412147 - DNA, 140 bp, Artificial Sequence
  Synthetic
aggccctggctgctgatatgcttacaacatgtcaacagaagtaaaagataagaaaaagcaggtctattcactgttttatgaacttgatgtagtaccacttggtaacagtagtagagagtagaccttttgggacagcggtg

SEQ ID NO: 412148 - DNA, 140 bp, Artificial Sequence
  Synthetic
caccgctgtcccaaaaggtctactctctactactgttaccaagtggtactacatcaagttcataaaacagtgaatagacctgctttttcttatcttttacttctgttgacatgttgtaagcatatcagcagccagggcct

SEQ ID NO: 412149 - DNA, 140 bp, Artificial Sequence
  Synthetic
atacgccatgctgggtctccctgttttatgaacttgatgtagtaccacttggtaacagtagtagagagtatagactaataagttgtaatacttcagcaatcacacaggcttgcccaaaagcgtacttgggagtcggccat

SEQ ID NO: 412150 - DNA, 140 bp, Artificial Sequence
  Synthetic
atggccgactcccaagtacgcttttgggcaagcctgtgtgattgctgaagtattacaacttattagtctatactctctactactgttaccaagtggtactacatcaagttcataaaacagggagacccagcatggcgtat

SEQ ID NO: 412151 - DNA, 140 bp, Artificial Sequence
  Synthetic
atacgccatgctgggtctccacaagtgttaccgcgaataataatactagtgacatgaaaaattgctccttcaatgcaaccacagaagtaacagataaaataagaaaagagaatgcactttcgtacttgggagtcggccat

SEQ ID NO: 412152 - DNA, 140 bp, Artificial Sequence
  Synthetic
atggccgactcccaagtacgaaagtgcattctcttttcttattttatctgttacttctgtggttgcattgaaggagcaatttttcatgtcactagtattattattcgcggtaacacttgtggagacccagcatggcgtat

SEQ ID NO: 412153 - DNA, 140 bp, Artificial Sequence
  Synthetic
atacgccatgctgggtctccattctaaagtgtaaggataaaaattttactggaacaggattatgcaagaatgttagctcagtacaatgtacacatggaattaggccattggcatcaactccgtacttgggagtcggccat

SEQ ID NO: 412154 - DNA, 140 bp, Artificial Sequence
  Synthetic
atggccgactcccaagtacggagttgatgccaatggcctaattccatgtgtacattgtactgagctaacattcttgcataatcctgttccagtaaaatttttatccttacactttagaatggagacccagcatggcgtat

SEQ ID NO: 412155 - DNA, 140 bp, Artificial Sequence
  Synthetic
aggccctggctgctgatatgatgtcagcacagtacaatgtacacatggaattaggccagtagtatcaactcaactgctgttaaatggcagtctagcagaagaagaggtagtgattagatcgaccttttgggacagcggtg

SEQ ID NO: 412156 - DNA, 140 bp, Artificial Sequence
  Synthetic
caccgctgtcccaaaaggtcgatctaatcactacctcttcttctgctagactgccatttaacagcagttgagttgatactactggcctaattccatgtgtacattgtactgtgctgacatcatatcagcagccagggcct

SEQ ID NO: 412157 - DNA, 140 bp, Artificial Sequence
  Synthetic
atacgccatgctgggtctccgcctgtacaaattaattgtaccagacccaacaacaatacaagggagagtgtacgcattggaccaggacaggtcttctttacaactggaataataggggatcgtacttgggagtcggccat

SEQ ID NO: 412158 - DNA, 140 bp, Artificial Sequence
  Synthetic
atggccgactcccaagtacgatcccctattattccagttgtaaagaagacctgtcctggtccaatgcgtacactctcccttgtattgttgttgggtctggtacaattaatttgtacaggcggagacccagcatggcgtat

SEQ ID NO: 412159 - DNA, 140 bp, Artificial Sequence
  Synthetic
aggccctggctgctgatatgtacgcattggaccaggacaggtcttctttacaactggaataataggggatataagaagagcatattgtcttatcaacagagaaaaatggaatactactttgaccttttgggacagcggtg

SEQ ID NO: 412160 - DNA, 140 bp, Artificial Sequence
  Synthetic
caccgctgtcccaaaaggtcaaagtagtattccatttttctctgttgataagacaatatgctcttcttatatcccctattattccagttgtaaagaagacctgtcctggtccaatgcgtacatatcagcagccagggcct

SEQ ID NO: 412161 - DNA, 140 bp, Artificial Sequence
  Synthetic
aggccctggctgctgatatgctttaatcaatcctcaggaggggacccagaaattgtaatgcacagttttaattgtggaggggaatttttctactgtaattcaacacaactgtttaatagtgaccttttgggacagcggtg

SEQ ID NO: 412162 - DNA, 140 bp, Artificial Sequence
  Synthetic
caccgctgtcccaaaaggtcactattaaacagttgtgttgaattacagtagaaaaattcccctccacaattaaaactgtgcattacaatttctgggtcccctcctgaggattgattaaagcatatcagcagccagggcct

SEQ ID NO: 412163 - DNA, 140 bp, Artificial Sequence
  Synthetic
aggccctggctgctgatatgtggaaagaagcaaccactactctattctgtgcatcagatgctaaatcatatgaaaaagaggtacataatgtctgggctacacatgcctgtgtacccacaggaccttttgggacagcggtg

SEQ ID NO: 412164 - DNA, 140 bp, Artificial Sequence
  Synthetic
caccgctgtcccaaaaggtcctgtgggtacacaggcatgtgtagcccagacattatgtacctctttttcatatgatttagcatctgatgcacagaatagagtagtggttgcttctttccacatatcagcagccagggcct

SEQ ID NO: 412165 - DNA, 140 bp, Artificial Sequence
  Synthetic
atacgccatgctgggtctccaccaatgatagcctgcaggaagagttaggggaaatacaaaattgtactttcaatatgactacagaagtaagagataagcagaagaaagtacaggcactttcgtacttgggagtcggccat

SEQ ID NO: 412166 - DNA, 140 bp, Artificial Sequence
  Synthetic
atggccgactcccaagtacgaaagtgcctgtactttcttctgcttatctcttacttctgtagtcatattgaaagtacaattttgtatttcccctaactcttcctgcaggctatcattggtggagacccagcatggcgtat

SEQ ID NO: 412167 - DNA, 140 bp, Artificial Sequence
  Synthetic
aggccctggctgctgatatgaaaggtatcttgggatccaattcccatacattattgtgctccagctggttatgcgattctaaagtgtaatgagaaaaagttcaatgggacggggccatgcgaccttttgggacagcggtg

SEQ ID NO: 412168 - DNA, 140 bp, Artificial Sequence
  Synthetic
caccgctgtcccaaaaggtcgcatggccccgtcccattgaactttttctcattacactttagaatcgcataaccagctggagcacaataatgtatgggaattggatcccaagatacctttcatatcagcagccagggcct

SEQ ID NO: 412169 - DNA, 140 bp, Artificial Sequence
  Synthetic
aggccctggctgctgatatggttggagtaataaaactcaggagcagatttgggacaatatgacttggttgcaatgggataaagaaattagcaattatacaggtataatatatgggctactgaccttttgggacagcggtg

SEQ ID NO: 412170 - DNA, 140 bp, Artificial Sequence
  Synthetic
caccgctgtcccaaaaggtcagtagcccatatattatacctgtataattgctaatttctttatcccattgcaaccaagtcatattgtcccaaatctgctcctgagttttattactccaaccatatcagcagccagggcct

SEQ ID NO: 412171 - DNA, 140 bp, Artificial Sequence
  Synthetic
aggccctggctgctgatatgggcttgataggtttaagaatagtttttactgtactttctatagtaaatagagttaggcagggatactcaccattgtcatttcagacccacctcccagcccgaccttttgggacagcggtg

SEQ ID NO: 412172 - DNA, 140 bp, Artificial Sequence
  Synthetic
caccgctgtcccaaaaggtcgggctgggaggtgggtctgaaatgacaatggtgagtatccctgcctaactctatttactatagaaagtacagtaaaaactattcttaaacctatcaagcccatatcagcagccagggcct

SEQ ID NO: 412173 - DNA, 140 bp, Artificial Sequence
  Synthetic
aggccctggctgctgatatgcaaacaaattgtaaacatgtggcaggaagtggggcgagcaatgtataccgctcccattgcaggaaacattacctgtagatcaaatattacaggtctactagaccttttgggacagcggtg

SEQ ID NO: 412174 - DNA, 140 bp, Artificial Sequence
  Synthetic
caccgctgtcccaaaaggtctagtagacctgtaatatttgatctacaggtaatgtttcctgcaatgggagcggtatacattgctcgccccacttcctgccacatgtttacaatttgtttgcatatcagcagccagggcct

SEQ ID NO: 412175 - DNA, 140 bp, Artificial Sequence
  Synthetic
aggccctggctgctgatatgtttccttggattcttgggagcagcaggaagcactatgggcgcggcgtcaataacgctgacggtacaggccagacaattattgtctggaatagtgcaacaggaccttttgggacagcggtg

SEQ ID NO: 412176 - DNA, 140 bp, Artificial Sequence
  Synthetic
caccgctgtcccaaaaggtcctgttgcactattccagacaataattgtctggcctgtaccgtcagcgttattgacgccgcgcccatagtgcttcctgctgctcccaagaatccaaggaaacatatcagcagccagggcct

SEQ ID NO: 412177 - DNA, 140 bp, Artificial Sequence
  Synthetic
atacgccatgctgggtctccagaagaataagacagggctttgaagcatctttgctatagaatggggagcaagtggtcaaaacgcagcacagctgggtggcctgctgtaagagaaagaatgcgtacttgggagtcggccat

SEQ ID NO: 412178 - DNA, 140 bp, Artificial Sequence
  Synthetic
atggccgactcccaagtacgcattctttctcttacagcaggccacccagctgtgctgcgttttgaccacttgctccccattctatagcaaagatgcttcaaagccctgtcttattcttctggagacccagcatggcgtat

SEQ ID NO: 412179 - DNA, 140 bp, Artificial Sequence
  Synthetic
aggccctggctgctgatatggaggaggtaggctttccagtcagacctcaggtacctttaaggccaatgacttacaaggcagcagtagatcttagccactttttaagagaaaaggggggacgaccttttgggacagcggtg

SEQ ID NO: 412180 - DNA, 140 bp, Artificial Sequence
  Synthetic
caccgctgtcccaaaaggtcgtccccccttttctcttaaaaagtggctaagatctactgctgccttgtaagtcattggccttaaaggtacctgaggtctgactggaaagcctacctcctccatatcagcagccagggcct

SEQ ID NO: 412181 - DNA, 140 bp, Artificial Sequence
  Synthetic
  misc_feature (97)..(97): n is a, c, g, or t
  misc_feature (105)..(105): n is a, c, g, or t
  misc_feature (114)..(114): n is a, c, g, or t
  misc_feature (117)..(117): n is a, c, g, or t
atacgccatgctgggtctccggctgcatgcaggagaacaagactggcatttgggtcagggagtctccatagagtggaggaaagagagatatagcacnccagaaanccctgaacnagnagacgtacttgggagtcggccat

SEQ ID NO: 412182 - DNA, 140 bp, Artificial Sequence
  Synthetic
  misc_feature (24)..(24): n is a, c, g, or t
  misc_feature (27)..(27): n is a, c, g, or t
  misc_feature (36)..(36): n is a, c, g, or t
  misc_feature (44)..(44): n is a, c, g, or t
atggccgactcccaagtacgtctnctngttcagggntttctggngtgctatatctctctttcctccactctatggagactccctgacccaaatgccagtcttgttctcctgcatgcagccggagacccagcatggcgtat

SEQ ID NO: 412183 - DNA, 140 bp, Artificial Sequence
  Synthetic
aggccctggctgctgatatggagaaagcaacctttgcccagtgttaagaaactgacagaggatagatggaacaagccccaggaaaccaagggccacagagagagccatacaatgaatggagaccttttgggacagcggtg

SEQ ID NO: 412184 - DNA, 140 bp, Artificial Sequence
  Synthetic
caccgctgtcccaaaaggtctccattcattgtatggctctctctgtggcccttggtttcctggggcttgttccatctatcctctgtcagtttcttaacactgggcaaaggttgctttctccatatcagcagccagggcct

SEQ ID NO: 412185 - DNA, 140 bp, Artificial Sequence
  Synthetic
aggccctggctgctgatatggttgctttcattgtcaagtttgcttcacaaaaaagggcttaggcatctcctatggcaggaagaagcggaggcagcgacgaagagcttcttcgagcagtcagaccttttgggacagcggtg

SEQ ID NO: 412186 - DNA, 140 bp, Artificial Sequence
  Synthetic
caccgctgtcccaaaaggtctgactgctcgaagaagctcttcgtcgctgcctccgcttcttcctgccataggagatgcctaagcccttttttgtgaagcaaacttgacaatgaaagcaaccatatcagcagccagggcct

SEQ ID NO: 412187 - DNA, 140 bp, Artificial Sequence
  Synthetic
  misc_feature (35)..(35): n is a, c, g, or t
  misc_feature (45)..(45): n is a, c, g, or t
atacgccatgctgggtctcctaatgaatgctttancaatagtaancatagtagcattaatagtagcatttattttagcagtagttgtgtggaccatagtatatatacagtatagaaggctcgtacttgggagtcggccat

SEQ ID NO: 412188 - DNA, 140 bp, Artificial Sequence
  Synthetic
  misc_feature (96)..(96): n is a, c, g, or t
  misc_feature (106)..(106): n is a, c, g, or t
atggccgactcccaagtacgagccttctatactgtatatatactatggtccacacaactactgctaaaataaatgctactattaatgctactatgnttactattgntaaagcattcattaggagacccagcatggcgtat

SEQ ID NO: 412189 - DNA, 140 bp, Artificial Sequence
  Synthetic
aggccctggctgctgatatggatgcagagaccaccctattttgtgcatcagatgctaaagcatatgatacagaaaaacataatgtctgggctacacatgcctgtgtacccacagaccccagaccttttgggacagcggtg

SEQ ID NO: 412190 - DNA, 140 bp, Artificial Sequence
  Synthetic
caccgctgtcccaaaaggtctggggtctgtgggtacacaggcatgtgtagcccagacattatgtttttctgtatcatatgctttagcatctgatgcacaaaatagggtggtctctgcatccatatcagcagccagggcct

SEQ ID NO: 412191 - DNA, 140 bp, Artificial Sequence
  Synthetic
aggccctggctgctgatatgaaaaacaagatggtagagcagatgcatacagatataattagtctatgggatcaaagcctaaagccatgtgtaagtttaactcctctctgcgttaccttacgaccttttgggacagcggtg

SEQ ID NO: 412192 - DNA, 140 bp, Artificial Sequence
  Synthetic
caccgctgtcccaaaaggtcgtaaggtaacgcagagaggagttaaacttacacatggctttaggctttgatcccatagactaattatatctgtatgcatctgctctaccatcttgtttttcatatcagcagccagggcct

SEQ ID NO: 412193 - DNA, 140 bp, Artificial Sequence
  Synthetic
atacgccatgctgggtctcctccaccatgagaggagaaatgaaaaactgctcttataatatgaccacaggattaagtgataggagactgaaagtatactcacttttctataaactagatacgtacttgggagtcggccat

SEQ ID NO: 412194 - DNA, 140 bp, Artificial Sequence
  Synthetic
atggccgactcccaagtacgtatctagtttatagaaaagtgagtatactttcagtctcctatcacttaatcctgtggtcatattataagagcagtttttcatttctcctctcatggtggaggagacccagcatggcgtat

SEQ ID NO: 412195 - DNA, 140 bp, Artificial Sequence
  Synthetic
atacgccatgctgggtctcccatgcagaataaaacaaattataaacatgtggcagagagtaggaaaagcaatgtatgctcctcccatcccaggagtaataaggtgtgtatcaaacattaccgtacttgggagtcggccat

SEQ ID NO: 412196 - DNA, 140 bp, Artificial Sequence
  Synthetic
atggccgactcccaagtacggtaatgtttgatacacaccttattactcctgggatgggaggagcatacattgcttttcctactctctgccacatgtttataatttgttttattctgcatgggagacccagcatggcgtat

SEQ ID NO: 412197 - DNA, 140 bp, Artificial Sequence
  Synthetic
aggccctggctgctgatatgtataaggataggaccaggacaaacattctatgcaacaggtgatataataggggatataagacaagcacattgtaacataagtaaaaaagattggaataacgaccttttgggacagcggtg

SEQ ID NO: 412198 - DNA, 140 bp, Artificial Sequence
  Synthetic
caccgctgtcccaaaaggtcgttattccaatcttttttacttatgttacaatgtgcttgtcttatatcccctattatatcacctgttgcatagaatgtttgtcctggtcctatccttatacatatcagcagccagggcct

SEQ ID NO: 412199 - DNA, 140 bp, Artificial Sequence
  Synthetic
aggccctggctgctgatatgttatgtaaactccttaggggaaccaaagcactaacagaagtaataccactaacagaagaagcagagctagaactggcagaaaacagggaaattctaaaaggaccttttgggacagcggtg

SEQ ID NO: 412200 - DNA, 140 bp, Artificial Sequence
  Synthetic
caccgctgtcccaaaaggtccttttagaatttccctgttttctgccagttctagctctgcttcttctgttagtggtattacttctgttagtgctttggttcccctaaggagtttacataacatatcagcagccagggcct

SEQ ID NO: 412201 - DNA, 140 bp, Artificial Sequence
  Synthetic
aggccctggctgctgatatggacctggatgcagtgggatagagaaattagtaattacacaaacacaatatacaggttgcttgaagactcgcaaaaccagcaggaaagaaatgaaaaagatgaccttttgggacagcggtg

SEQ ID NO: 412202 - DNA, 140 bp, Artificial Sequence
  Synthetic
caccgctgtcccaaaaggtcatctttttcatttctttcctgctggttttgcgagtcttcaagcaacctgtatattgtgtttgtgtaattactaatttctctatcccactgcatccaggtccatatcagcagccagggcct

SEQ ID NO: 412203 - DNA, 140 bp, Artificial Sequence
  Synthetic
aggccctggctgctgatatgtaggagcagcaggaagcactatgggcgcggcgtcaataacgctgacggtacaggccagacaattattgtctggcatagtgcaacagcagagcaatctgctgaccttttgggacagcggtg

SEQ ID NO: 412204 - DNA, 140 bp, Artificial Sequence
  Synthetic
caccgctgtcccaaaaggtcagcagattgctctgctgttgcactatgccagacaataattgtctggcctgtaccgtcagcgttattgacgccgcgcccatagtgcttcctgctgctcctacatatcagcagccagggcct

SEQ ID NO: 412205 - DNA, 140 bp, Artificial Sequence
  Synthetic
atacgccatgctgggtctcctaatgtgccttggaactctacctggagtaaggataaaaatcagagtgaaatatgggataacatgacctggctacaatgggataaagaaattagcaattaccgtacttgggagtcggccat

SEQ ID NO: 412206 - DNA, 140 bp, Artificial Sequence
  Synthetic
atggccgactcccaagtacggtaattgctaatttctttatcccattgtagccaggtcatgttatcccatatttcactctgatttttatccttactccaggtagagttccaaggcacattaggagacccagcatggcgtat

SEQ ID NO: 412207 - DNA, 140 bp, Artificial Sequence
  Synthetic
aggccctggctgctgatatggttggatggcctactataagggatagaatgagacgaacccctccagcagcagaaggggtgggagcagtgtctcaagacttagaaagacggggggcaattagaccttttgggacagcggtg

SEQ ID NO: 412208 - DNA, 140 bp, Artificial Sequence
  Synthetic
caccgctgtcccaaaaggtctaattgccccccgtctttctaagtcttgagacactgctcccaccccttctgctgctggaggggttcgtctcattctatcccttatagtaggccatccaaccatatcagcagccagggcct

SEQ ID NO: 412209 - DNA, 140 bp, Artificial Sequence
  Synthetic
atacgccatgctgggtctccgaggaagtaggcttcccagtcaggccacaggtgcctttaagacccatgacctacaagggagcttttgatctcagcttctttttaaaagaaaaggggggaccgtacttgggagtcggccat

SEQ ID NO: 412210 - DNA, 140 bp, Artificial Sequence
  Synthetic
atggccgactcccaagtacggtccccccttttcttttaaaaagaagctgagatcaaaagctcccttgtaggtcatgggtcttaaaggcacctgtggcctgactgggaagcctacttcctcggagacccagcatggcgtat

SEQ ID NO: 412211 - DNA, 140 bp, Artificial Sequence
  Synthetic
atacgccatgctgggtctccactactactgctaattacaataatagcatggatgaagaaataaatgaaataaaaaattgctctttcaatacaaccacagaaataagagataaggaaaagccgtacttgggagtcggccat

SEQ ID NO: 412212 - DNA, 140 bp, Artificial Sequence
  Synthetic
atggccgactcccaagtacggcttttccttatctcttatttctgtggttgtattgaaagagcaattttttatttcatttatttcttcatccatgctattattgtaattagcagtagtagtggagacccagcatggcgtat

SEQ ID NO: 412213 - DNA, 140 bp, Artificial Sequence
  Synthetic
aggccctggctgctgatatgagtctcaagggactgagactggggtgggaaggtctcaaatacctggggaatctcctgttgtattgggttcgggaactaagaaatagtgctgtttctttgcgaccttttgggacagcggtg

SEQ ID NO: 412214 - DNA, 140 bp, Artificial Sequence
  Synthetic
caccgctgtcccaaaaggtcgcaaagaaacagcactatttcttagttcccgaacccaatacaacaggagattccccaggtatttgagaccttcccaccccagtctcagtcccttgagactcatatcagcagccagggcct

SEQ ID NO: 412215 - DNA, 140 bp, Artificial Sequence
  Synthetic
aggccctggctgctgatatgagtagcatagtgggatggccagctgtaagggaaagaataaggagaactcctccaacagcaactcctccagcagcaactcctccagcagcaacaggagtaggaccttttgggacagcggtg

SEQ ID NO: 412216 - DNA, 140 bp, Artificial Sequence
  Synthetic
caccgctgtcccaaaaggtcctactcctgttgctgctggaggagttgctgctggaggagttgctgttggaggagttctccttattctttcccttacagctggccatcccactatgctactcatatcagcagccagggcct

SEQ ID NO: 412217 - DNA, 140 bp, Artificial Sequence
  Synthetic
atacgccatgctgggtctccggatatagtaattagatctgaaaatctgacaaacaatgtcaaaacaataatagtacaccttaatcaaactgtaaaaattgcgtgtataagacccggcaatcgtacttgggagtcggccat

SEQ ID NO: 412218 - DNA, 140 bp, Artificial Sequence
  Synthetic
atggccgactcccaagtacgattgccgggtcttatacacgcaatttttacagtttgattaaggtgtactattattgttttgacattgtttgtcagattttcagatctaattactatatccggagacccagcatggcgtat

SEQ ID NO: 412219 - DNA, 140 bp, Artificial Sequence
  Synthetic
atacgccatgctgggtctccaggtgaaataataggagacataagacaagcacattgtaatattagtaaaggggattggaacaacaccttagaccaggtaaggaataaattaaaagaacaccgtacttgggagtcggccat

SEQ ID NO: 412220 - DNA, 140 bp, Artificial Sequence
  Synthetic
atggccgactcccaagtacggtgttcttttaatttattccttacctggtctaaggtgttgttccaatcccctttactaatattacaatgtgcttgtcttatgtctcctattatttcacctggagacccagcatggcgtat

SEQ ID NO: 412221 - DNA, 140 bp, Artificial Sequence
  Synthetic
aggccctggctgctgatatgtaaataaaatagtaagaatgtatagccctgtcagcattttggacataagacaagggccaaaagaaccctttagagactatgtagataggttctttaaaacgaccttttgggacagcggtg

SEQ ID NO: 412222 - DNA, 140 bp, Artificial Sequence
  Synthetic
caccgctgtcccaaaaggtcgttttaaagaacctatctacatagtctctaaagggttcttttggcccttgtcttatgtccaaaatgctgacagggctatacattcttactattttatttacatatcagcagccagggcct

SEQ ID NO: 412223 - DNA, 140 bp, Artificial Sequence
  Synthetic
atacgccatgctgggtctccgtggcgcccgaacagggacttgaaagtgaaagctaaccagagaagttctctcgacgcaggactcggcttgctgagcgcgcacagcaagaggcgaggggcgcgtacttgggagtcggccat

SEQ ID NO: 412224 - DNA, 140 bp, Artificial Sequence
  Synthetic
atggccgactcccaagtacgcgcccctcgcctcttgctgtgcgcgctcagcaagccgagtcctgcgtcgagagaacttctctggttagctttcactttcaagtccctgttcgggcgccacggagacccagcatggcgtat

SEQ ID NO: 412225 - DNA, 140 bp, Artificial Sequence
  Synthetic
atacgccatgctgggtctccagaagttacaacacatatctttaattgtagaggagaatttttctattgcaatacgacaaagttatttaatgagaatataacaaagattaataagagtgatcgtacttgggagtcggccat

SEQ ID NO: 412226 - DNA, 140 bp, Artificial Sequence
  Synthetic
atggccgactcccaagtacgatcactcttattaatctttgttatattctcattaaataactttgtcgtattgcaatagaaaaattctcctctacaattaaagatatgtgttgtaacttctggagacccagcatggcgtat

SEQ ID NO: 412227 - DNA, 140 bp, Artificial Sequence
  Synthetic
aggccctggctgctgatatgtataaacatgtggcaggaggtaggacgagcaatgtatgctcctcccattgcaggaaacataacatgtaactcaaatatcacaggactactattgacacgtgaccttttgggacagcggtg

SEQ ID NO: 412228 - DNA, 140 bp, Artificial Sequence
  Synthetic
caccgctgtcccaaaaggtcacgtgtcaatagtagtcctgtgatatttgagttacatgttatgtttcctgcaatgggaggagcatacattgctcgtcctacctcctgccacatgtttatacatatcagcagccagggcct

SEQ ID NO: 412229 - DNA, 140 bp, Artificial Sequence
  Synthetic
atacgccatgctgggtctcctactaataccactagtagtagcggggttataatagagaaaggagaaataaaaaactgctctttcaagatcaacacaaacatgaaagataaggcgcagatacgtacttgggagtcggccat

SEQ ID NO: 412230 - DNA, 140 bp, Artificial Sequence
  Synthetic
atggccgactcccaagtacgtatctgcgccttatctttcatgtttgtgttgatcttgaaagagcagttttttatttctcctttctctattataaccccgctactactagtggtattagtaggagacccagcatggcgtat

SEQ ID NO: 412231 - DNA, 140 bp, Artificial Sequence
  Synthetic
atacgccatgctgggtctccaatagaagaaatgaaaaattgctctttcaatgtaaccacagtactaagagataagaaagaggagaaatatgcacttttttataaacttgatatagtacgacgtacttgggagtcggccat

SEQ ID NO: 412232 - DNA, 140 bp, Artificial Sequence
  Synthetic
atggccgactcccaagtacgtcgtactatatcaagtttataaaaaagtgcatatttctcctctttcttatctcttagtactgtggttacattgaaagagcaatttttcatttcttctattggagacccagcatggcgtat

SEQ ID NO: 412233 - DNA, 140 bp, Artificial Sequence
  Synthetic
aggccctggctgctgatatgacaacaatacaagaaaaggtatacatataggaccagggaaagcattttatgcaacaggacaaataataggagatataagacaagcacattgtaaccttaggaccttttgggacagcggtg

SEQ ID NO: 412234 - DNA, 140 bp, Artificial Sequence
  Synthetic
caccgctgtcccaaaaggtcctaaggttacaatgtgcttgtcttatatctcctattatttgtcctgttgcataaaatgctttccctggtcctatatgtataccttttcttgtattgttgtcatatcagcagccagggcct

SEQ ID NO: 412235 - DNA, 140 bp, Artificial Sequence
  Synthetic
atacgccatgctgggtctccctttcgatattgacacaaaaataggaaatatacgaaaagaacatgcaatttttaataaacttgatatagtaccaatagagcaagaagaaccgcatagaagcgtacttgggagtcggccat

SEQ ID NO: 412236 - DNA, 140 bp, Artificial Sequence
  Synthetic
atggccgactcccaagtacgcttctatgcggttcttcttgctctattggtactatatcaagtttattaaaaattgcatgttcttttcgtatatttcctatttttgtgtcaatatcgaaagggagacccagcatggcgtat

SEQ ID NO: 412237 - DNA, 140 bp, Artificial Sequence
  Synthetic
aggccctggctgctgatatgagatccctggaaccacccaggaagccagcctgcaacgccttgtaacaattgttattgtaaacgatgttgctttcattgttactactgctttgaaaaaaaggaccttttgggacagcggtg

SEQ ID NO: 412238 - DNA, 140 bp, Artificial Sequence
  Synthetic
caccgctgtcccaaaaggtcctttttttcaaagcagtagtaacaatgaaagcaacatcgtttacaataacaattgttacaaggcgttgcaggctggcttcctgggtggttccagggatctcatatcagcagccagggcct

SEQ ID NO: 412239 - DNA, 140 bp, Artificial Sequence
  Synthetic
atacgccatgctgggtctccagaacgcttccctaataaaacaataagatttaaatcacccgcaggaggggacctagaagttacaacacatatctttaattgcagaggagagtttttctatcgtacttgggagtcggccat

SEQ ID NO: 412240 - DNA, 140 bp, Artificial Sequence
  Synthetic
atggccgactcccaagtacgatagaaaaactctcctctgcaattaaagatatgtgttgtaacttctaggtcccctcctgcgggtgatttaaatcttattgttttattagggaagcgttctggagacccagcatggcgtat

SEQ ID NO: 412241 - DNA, 140 bp, Artificial Sequence
  Synthetic
atacgccatgctgggtctccttcttcaagcagcccaatacatcaagatcctgtaccaaagcagtgagtattgttaagtgatttatgtaatgtcagaattaaacttgttagcattaggcatcgtacttgggagtcggccat

SEQ ID NO: 412242 - DNA, 140 bp, Artificial Sequence
  Synthetic
atggccgactcccaagtacgatgcctaatgctaacaagtttaattctgacattacataaatcacttaacaatactcactgctttggtacaggatcttgatgtattgggctgcttgaagaaggagacccagcatggcgtat

SEQ ID NO: 412243 - DNA, 140 bp, Artificial Sequence
  Synthetic
atacgccatgctgggtctcctacatatgggatggggaagagcattttatgcaacaggaaagatcataggaaatataagacaagcatattgcaacattagtagaacaaaatggagtgacaccgtacttgggagtcggccat

SEQ ID NO: 412244 - DNA, 140 bp, Artificial Sequence
  Synthetic
atggccgactcccaagtacggtgtcactccattttgttctactaatgttgcaatatgcttgtcttatatttcctatgatctttcctgttgcataaaatgctcttccccatcccatatgtaggagacccagcatggcgtat

SEQ ID NO: 412245 - DNA, 140 bp, Artificial Sequence
  Synthetic
aggccctggctgctgatatgaatgctgattgtgcctggctgcaagcacaagaggaggaagaagaagtaggctttccagtcagacctcaggtgcctttaagaccaatgacttataaggcaggaccttttgggacagcggtg

SEQ ID NO: 412246 - DNA, 140 bp, Artificial Sequence
  Synthetic
caccgctgtcccaaaaggtcctgccttataagtcattggtcttaaaggcacctgaggtctgactggaaagcctacttcttcttcctcctcttgtgcttgcagccaggcacaatcagcattcatatcagcagccagggcct

SEQ ID NO: 412247 - DNA, 140 bp, Artificial Sequence
  Synthetic
aggccctggctgctgatatggggaatttggggttgctctggaaaactcatctgcaccactaatgtccgttggaatactacttggagtaataaaacctatgaggagatttggggtaacatggaccttttgggacagcggtg

SEQ ID NO: 412248 - DNA, 140 bp, Artificial Sequence
  Synthetic
caccgctgtcccaaaaggtccatgttaccccaaatctcctcataggttttattactccaagtagtattccaacggacattagtggtgcagatgagttttccagagcaaccccaaattccccatatcagcagccagggcct

SEQ ID NO: 412249 - DNA, 140 bp, Artificial Sequence
  Synthetic
aggccctggctgctgatatgcagagcagtaaggatcatcaaaaccctataccaaagcagtaagtagtgtaattaatatctgtaatgcaacctttagtgatattagcaatagtaggactgagaccttttgggacagcggtg

SEQ ID NO: 412250 - DNA, 140 bp, Artificial Sequence
  Synthetic
caccgctgtcccaaaaggtctcagtcctactattgctaatatcactaaaggttgcattacagatattaattacactacttactgctttggtatagggttttgatgatccttactgctctgcatatcagcagccagggcct

SEQ ID NO: 412251 - DNA, 140 bp, Artificial Sequence
  Synthetic
atacgccatgctgggtctcctataggaagattaggaagcaaaggaaaatagacaggttaattgagaaaataagagacagagcagaagacagtggcaatgagagtgatggggatacagatgcgtacttgggagtcggccat

SEQ ID NO: 412252 - DNA, 140 bp, Artificial Sequence
  Synthetic
atggccgactcccaagtacgcatctgtatccccatcactctcattgccactgtcttctgctctgtctcttattttctcaattaacctgtctattttcctttgcttcctaatcttcctataggagacccagcatggcgtat

SEQ ID NO: 412253 - DNA, 140 bp, Artificial Sequence
  Synthetic
atacgccatgctgggtctccacctagaagaataagacagggcttcgaaagggctttgctataaaatgggtagcaagtggtcaaaacctagagtgggatggtctgagataagggaaagaatcgtacttgggagtcggccat

SEQ ID NO: 412254 - DNA, 140 bp, Artificial Sequence
  Synthetic
atggccgactcccaagtacgattctttcccttatctcagaccatcccactctaggttttgaccacttgctacccattttatagcaaagccctttcgaagccctgtcttattcttctaggtggagacccagcatggcgtat

SEQ ID NO: 412255 - DNA, 140 bp, Artificial Sequence
  Synthetic
atacgccatgctgggtctccatgccaccattgccccaaacatgaaagaagaaataaaaaactgttcttacaatatgaccacagcatttaaggataagaaacagaaagtacattctcttttcgtacttgggagtcggccat

SEQ ID NO: 412256 - DNA, 140 bp, Artificial Sequence
  Synthetic
atggccgactcccaagtacgaaaagagaatgtactttctgtttcttatccttaaatgctgtggtcatattgtaagaacagttttttatttcttctttcatgtttggggcaatggtggcatggagacccagcatggcgtat

SEQ ID NO: 412257 - DNA, 140 bp, Artificial Sequence
  Synthetic
aggccctggctgctgatatgcaaagggcttaggcatctcctatggcaggaagaagcggaggcagcgacgaggagcttcttataacagtcagagccatcaagatcctgtaccaaagcagtggaccttttgggacagcggtg

SEQ ID NO: 412258 - DNA, 140 bp, Artificial Sequence
  Synthetic
caccgctgtcccaaaaggtccactgctttggtacaggatcttgatggctctgactgttataagaagctcctcgtcgctgcctccgcttcttcctgccataggagatgcctaagccctttgcatatcagcagccagggcct

SEQ ID NO: 412259 - DNA, 140 bp, Artificial Sequence
  Synthetic
aggccctggctgctgatatgaaggacacatagccaaaaattgcagggcccctagaaaaaagggctgttggaaatgtggaaaagaaggacaccaaatgaaagactgcactgaaagacaggcgaccttttgggacagcggtg

SEQ ID NO: 412260 - DNA, 140 bp, Artificial Sequence
  Synthetic
caccgctgtcccaaaaggtcgcctgtctttcagtgcagtctttcatttggtgtccttcttttccacatttccaacagcccttttttctaggggccctgcaatttttggctatgtgtccttcatatcagcagccagggcct

SEQ ID NO: 412261 - DNA, 140 bp, Artificial Sequence
  Synthetic
atacgccatgctgggtctcccaataccagtaataccagaaccaatagtgcagaagccaatataactctccaatgcaggataaagcaagttataaatatgtggcagagagtaggacaagcacgtacttgggagtcggccat

SEQ ID NO: 412262 - DNA, 140 bp, Artificial Sequence
  Synthetic
atggccgactcccaagtacgtgcttgtcctactctctgccacatatttataacttgctttatcctgcattggagagttatattggcttctgcactattggttctggtattactggtattgggagacccagcatggcgtat

SEQ ID NO: 412263 - DNA, 140 bp, Artificial Sequence
  Synthetic
atacgccatgctgggtctccttcaacaaaacaatagtctttactaactcctcaggaggggatatagaaattacaacacatagttttaattgtggaggagaatttttctattgcaatacatcgtacttgggagtcggccat

SEQ ID NO: 412264 - DNA, 140 bp, Artificial Sequence
  Synthetic
atggccgactcccaagtacgatgtattgcaatagaaaaattctcctccacaattaaaactatgtgttgtaatttctatatcccctcctgaggagttagtaaagactattgttttgttgaaggagacccagcatggcgtat

SEQ ID NO: 412265 - DNA, 140 bp, Artificial Sequence
  Synthetic
atacgccatgctgggtctcccagaaaattttaacatatggaaaaatgagatggtagagcagatgcatactgacataattagtctatgggatgaaagtctaaagccatgtgtacagttaaccgtacttgggagtcggccat

SEQ ID NO: 412266 - DNA, 140 bp, Artificial Sequence
  Synthetic
atggccgactcccaagtacggttaactgtacacatggctttagactttcatcccatagactaattatgtcagtatgcatctgctctaccatctcatttttccatatgttaaaattttctgggagacccagcatggcgtat

SEQ ID NO: 412267 - DNA, 140 bp, Artificial Sequence
  Synthetic
atacgccatgctgggtctccgggacatcattggtaacatcactgagaaagaaggaataaaaaactgctcttataatatgaccacagatttaagagacaggagagagaaagtatactcactcgtacttgggagtcggccat

SEQ ID NO: 412268 - DNA, 140 bp, Artificial Sequence
  Synthetic
atggccgactcccaagtacgagtgagtatactttctctctcctgtctcttaaatctgtggtcatattataagagcagttttttattccttctttctcagtgatgttaccaatgatgtcccggagacccagcatggcgtat

SEQ ID NO: 412269 - DNA, 140 bp, Artificial Sequence
  Synthetic
atacgccatgctgggtctccctctccgaagcagaagcaggagcagaagcaggaacagagagacgagggactgtatcctcctttagcttccctcaaatcactctttggcaacgaccaatagcgtacttgggagtcggccat

SEQ ID NO: 412270 - DNA, 140 bp, Artificial Sequence
  Synthetic
atggccgactcccaagtacgctattggtcgttgccaaagagtgatttgagggaagctaaaggaggatacagtccctcgtctctctgttcctgcttctgctcctgcttctgcttcggagagggagacccagcatggcgtat

SEQ ID NO: 412271 - DNA, 140 bp, Artificial Sequence
  Synthetic
atacgccatgctgggtctccaattgtaaaattatggcagagagtagggcaggcaatatatgcccctcccatccaaggagtaataaggtgtgaatcaaacattacagggctactattaacacgtacttgggagtcggccat

SEQ ID NO: 412272 - DNA, 140 bp, Artificial Sequence
  Synthetic
atggccgactcccaagtacgtgttaatagtagccctgtaatgtttgattcacaccttattactccttggatgggaggggcatatattgcctgccctactctctgccataattttacaattggagacccagcatggcgtat

SEQ ID NO: 412273 - DNA, 140 bp, Artificial Sequence
  Synthetic
atacgccatgctgggtctccgccttaaacatctgtggaatctaatattgtattggagtcaggaattaaaaggtagtgctatcagtttgtttaatgccatagcaatagcagtagctgagggcgtacttgggagtcggccat

SEQ ID NO: 412274 - DNA, 140 bp, Artificial Sequence
  Synthetic
atggccgactcccaagtacgccctcagctactgctattgctatggcattaaacaaactgatagcactaccttttaattcctgactccaatacaatattagattccacagatgtttaaggcggagacccagcatggcgtat

SEQ ID NO: 412275 - DNA, 140 bp, Artificial Sequence
  Synthetic
  misc_feature (101)..(101): n is a, c, g, or t
aggccctggctgctgatatgggtagtgctatcagtttgtttaatgccatagcaatagcagtagctgaggggacagacagagttatagaagttggacaaagngcttgcagagcttttctcagaccttttgggacagcggtg

SEQ ID NO: 412276 - DNA, 140 bp, Artificial Sequence
  Synthetic
  misc_feature (40)..(40): n is a, c, g, or t
caccgctgtcccaaaaggtctgagaaaagctctgcaagcnctttgtccaacttctataactctgtctgtcccctcagctactgctattgctatggcattaaacaaactgatagcactacccatatcagcagccagggcct

SEQ ID NO: 412277 - DNA, 140 bp, Artificial Sequence
  Synthetic
atacgccatgctgggtctccggggaacgtcttcagcagcagaaggaataggagaagagcctcagagggagtaggagcagtgtctcgagatttagatacacgtggagcagtcacaatcaggcgtacttgggagtcggccat

SEQ ID NO: 412278 - DNA, 140 bp, Artificial Sequence
  Synthetic
atggccgactcccaagtacgcctgattgtgactgctccacgtgtatctaaatctcgagacactgctcctactccctctgaggctcttctcctattccttctgctgctgaagacgttccccggagacccagcatggcgtat

SEQ ID NO: 412279 - DNA, 140 bp, Artificial Sequence
  Synthetic
atacgccatgctgggtctccggatgatggtgtaggcttcccagtcaggccacaggtacctttaagaccaatgaccttcaagggagcttttgatctcagctactttttaagagaaaaggggcgtacttgggagtcggccat

SEQ ID NO: 412280 - DNA, 140 bp, Artificial Sequence
  Synthetic
atggccgactcccaagtacgccccttttctcttaaaaagtagctgagatcaaaagctcccttgaaggtcattggtcttaaaggtacctgtggcctgactgggaagcctacaccatcatccggagacccagcatggcgtat

SEQ ID NO: 412281 - DNA, 140 bp, Artificial Sequence
  Synthetic
atacgccatgctgggtctcctaatagcatgaatggagaaatgaaaaattgctcttttaatataaccacagaaataagagataagaaacaaaaggtgtatgcattattttatagacctgatcgtacttgggagtcggccat

SEQ ID NO: 412282 - DNA, 140 bp, Artificial Sequence
  Synthetic
atggccgactcccaagtacgatcaggtctataaaataatgcatacaccttttgtttcttatctcttatttctgtggttatattaaaagagcaatttttcatttctccattcatgctattaggagacccagcatggcgtat

SEQ ID NO: 412283 - DNA, 140 bp, Artificial Sequence
  Synthetic
aggccctggctgctgatatgtggatgggttatgaactccatcctgataaatggacagtacagcctatagtactgccagaaaaagacagctggactgtcaatgacatacagaagttagtgggaccttttgggacagcggtg

SEQ ID NO: 412284 - DNA, 140 bp, Artificial Sequence
  Synthetic
caccgctgtcccaaaaggtcccactaacttctgtatgtcattgacagtccagctgtctttttctggcagtactataggctgtactgtccatttatcaggatggagttcataacccatccacatatcagcagccagggcct

SEQ ID NO: 412285 - DNA, 140 bp, Artificial Sequence
  Synthetic
aggccctggctgctgatatgaaccctctattgtgtacatcaaagaatagaggtaagagacaccaaggaagctctagataaattagaggaagaacaaaacaaacacaagcagaagacacaggaccttttgggacagcggtg

SEQ ID NO: 412286 - DNA, 140 bp, Artificial Sequence
  Synthetic
caccgctgtcccaaaaggtcctgtgtcttctgcttgtgtttgttttgttcttcctctaatttatctagagcttccttggtgtctcttacctctattctttgatgtacacaatagagggttcatatcagcagccagggcct

SEQ ID NO: 412287 - DNA, 140 bp, Artificial Sequence
  Synthetic
atacgccatgctgggtctcctaaggataggaccaggacaggcattctatacaaatgaaataataggaaacataagacaagcacattgtaacattactagatcaatatggaacaaaactttcgtacttgggagtcggccat

SEQ ID NO: 412288 - DNA, 140 bp, Artificial Sequence
  Synthetic
atggccgactcccaagtacgaaagttttgttccatattgatctagtaatgttacaatgtgcttgtcttatgtttcctattatttcatttgtatagaatgcctgtcctggtcctatccttaggagacccagcatggcgtat

SEQ ID NO: 412289 - DNA, 140 bp, Artificial Sequence
  Synthetic
atacgccatgctgggtctccagaaatggtaaagaggaaattagaagaacacttccctaataaaacaataacatttaatcaatcttcaggaggggacctagaagttacaacacacagttttcgtacttgggagtcggccat

SEQ ID NO: 412290 - DNA, 140 bp, Artificial Sequence
  Synthetic
atggccgactcccaagtacgaaaactgtgtgttgtaacttctaggtcccctcctgaagattgattaaatgttattgttttattagggaagtgttcttctaatttcctctttaccatttctggagacccagcatggcgtat

SEQ ID NO: 412291 - DNA, 140 bp, Artificial Sequence
  Synthetic
  misc_feature (86)..(86): n is a, c, g, or t
atacgccatgctgggtctcccaaaaagtagcatagtgggatggccagctgtaagagagagaataaggagaactcctccagcagcancctcagcagcaacaggagtaggagcagtatctcacgtacttgggagtcggccat

SEQ ID NO: 412292 - DNA, 140 bp, Artificial Sequence
  Synthetic
  misc_feature (55)..(55): n is a, c, g, or t
atggccgactcccaagtacgtgagatactgctcctactcctgttgctgctgaggntgctgctggaggagttctccttattctctctcttacagctggccatcccactatgctactttttgggagacccagcatggcgtat

SEQ ID NO: 412293 - DNA, 140 bp, Artificial Sequence
  Synthetic
aggccctggctgctgatatgtgggaaaaaattcggttgaggccagggggaaagaaaaaatatagaatgaaacatctagtatgggcaagcagggaactggagagatttgcacttaaccctggaccttttgggacagcggtg

SEQ ID NO: 412294 - DNA, 140 bp, Artificial Sequence
  Synthetic
caccgctgtcccaaaaggtccagggttaagtgcaaatctctccagttccctgcttgcccatactagatgtttcattctatattttttctttccccctggcctcaaccgaattttttcccacatatcagcagccagggcct

SEQ ID NO: 412295 - DNA, 140 bp, Artificial Sequence
  Synthetic
aggccctggctgctgatatgagccagaaattgcagggcccctaggaaaaagggctgctggaaatgtgggaaggaaggacatcaaatgaaagactgcactgagagacaggctaattttttagaccttttgggacagcggtg

SEQ ID NO: 412296 - DNA, 140 bp, Artificial Sequence
  Synthetic
caccgctgtcccaaaaggtctaaaaaattagcctgtctctcagtgcagtctttcatttgatgtccttccttcccacatttccagcagccctttttcctaggggccctgcaatttctggctcatatcagcagccagggcct

SEQ ID NO: 412297 - DNA, 140 bp, Artificial Sequence
  Synthetic
aggccctggctgctgatatggtacaatgtacacatggaattaggccagtagtgtcaactcaactgctgttaaatggcagtctagcagaagaagaggtagtaattagatctgacaatttcagaccttttgggacagcggtg

SEQ ID NO: 412298 - DNA, 140 bp, Artificial Sequence
  Synthetic
caccgctgtcccaaaaggtctgaaattgtcagatctaattactacctcttcttctgctagactgccatttaacagcagttgagttgacactactggcctaattccatgtgtacattgtaccatatcagcagccagggcct

SEQ ID NO: 412299 - DNA, 140 bp, Artificial Sequence
  Synthetic
aggccctggctgctgatatgaagaacagaataaaaaagatttattagcattagacagttagaacaatctgtagaattagtttgacatatcaaattaactgtagtatataagaatattcatgaccttttgggacagcggtg

SEQ ID NO: 412300 - DNA, 140 bp, Artificial Sequence
  Synthetic
caccgctgtcccaaaaggtcatgaatattcttatatactacagttaatttgatatgtcaaactaattctacagattgttctaactgtctaatgctaataaatcttttttattctgttcttcatatcagcagccagggcct

SEQ ID NO: 412301 - DNA, 140 bp, Artificial Sequence
  Synthetic
atacgccatgctgggtctcccagcaggcagcaagggctgaaggaaacagcaaccaagtcagtcaaaattatcctatagtgcagaatgcacaaggacaaatggtacaccaggccatatcaccgtacttgggagtcggccat

SEQ ID NO: 412302 - DNA, 140 bp, Artificial Sequence
  Synthetic
atggccgactcccaagtacggtgatatggcctggtgtaccatttgtccttgtgcattctgcactataggataattttgactgacttggttgctgtttccttcagcccttgctgcctgctgggagacccagcatggcgtat

SEQ ID NO: 412303 - DNA, 140 bp, Artificial Sequence
  Synthetic
atacgccatgctgggtctccgaaggccatcaaaatcctatatcaaagcagtaagtatatgtaatgttaagtttgctatacaaagtagattataggataggggtaggagcattagtaatagcgtacttgggagtcggccat

SEQ ID NO: 412304 - DNA, 140 bp, Artificial Sequence
  Synthetic
atggccgactcccaagtacgctattactaatgctcctacccctatcctataatctactttgtatagcaaacttaacattacatatacttactgctttgatataggattttgatggccttcggagacccagcatggcgtat

SEQ ID NO: 412305 - DNA, 140 bp, Artificial Sequence
  Synthetic
aggccctggctgctgatatgatcctcaggaggggacccagaaattgtaaggcatagttttaattgtggaggggaatttttctactgtgatacaacacaactgtttaatagtacttggaatgaccttttgggacagcggtg

SEQ ID NO: 412306 - DNA, 140 bp, Artificial Sequence
  Synthetic
caccgctgtcccaaaaggtcattccaagtactattaaacagttgtgttgtatcacagtagaaaaattcccctccacaattaaaactatgccttacaatttctgggtcccctcctgaggatcatatcagcagccagggcct

SEQ ID NO: 412307 - DNA, 140 bp, Artificial Sequence
  Synthetic
atacgccatgctgggtctccgtagtacaaatgttagtcagagtagtaatagcagtcaggataatactaccattgatgagagcatgcgtgaagaaataaaaaattgctcgtacaactcaaccgtacttgggagtcggccat

SEQ ID NO: 412308 - DNA, 140 bp, Artificial Sequence
  Synthetic
atggccgactcccaagtacggttgagttgtacgagcaattttttatttcttcacgcatgctctcatcaatggtagtattatcctgactgctattactactctgactaacatttgtactacggagacccagcatggcgtat

SEQ ID NO: 412309 - DNA, 140 bp, Artificial Sequence
  Synthetic
aggccctggctgctgatatgggaaaactcatttgcaccactgctgtgccttggaatactagttggagtaataaatctctggatgagatttgggataacatgacctggatgcagtgggaaagaccttttgggacagcggtg

SEQ ID NO: 412310 - DNA, 140 bp, Artificial Sequence
  Synthetic
caccgctgtcccaaaaggtctttcccactgcatccaggtcatgttatcccaaatctcatccagagatttattactccaactagtattccaaggcacagcagtggtgcaaatgagttttcccatatcagcagccagggcct

SEQ ID NO: 412311 - DNA, 140 bp, Artificial Sequence
  Synthetic
aggccctggctgctgatatgatgggaaagaattaggttaaggccagggggaaagaaacattatatgttaaaacacatagtatgggcaagcagggagctggaaagatttgcacttaaccctgaccttttgggacagcggtg

SEQ ID NO: 412312 - DNA, 140 bp, Artificial Sequence
  Synthetic
caccgctgtcccaaaaggtcagggttaagtgcaaatctttccagctccctgcttgcccatactatgtgttttaacatataatgtttctttccccctggccttaacctaattctttcccatcatatcagcagccagggcct

SEQ ID NO: 412313 - DNA, 140 bp, Artificial Sequence
  Synthetic
atacgccatgctgggtctccgaagccttagacaagatagaggaagaacaaaacaaaagtcagcaaaaaacacagcaggcaaaagcggctgacgggaaagtcagtcaaaattatcctatagcgtacttgggagtcggccat

SEQ ID NO: 412314 - DNA, 140 bp, Artificial Sequence
  Synthetic
atggccgactcccaagtacgctataggataattttgactgactttcccgtcagccgcttttgcctgctgtgttttttgctgacttttgttttgttcttcctctatcttgtctaaggcttcggagacccagcatggcgtat

SEQ ID NO: 412315 - DNA, 140 bp, Artificial Sequence
  Synthetic
atacgccatgctgggtctccatgcaacaggagaaataataggagatataagacaagcacattgtaaccttagtagagaaaaatgggaaaacactttaaaacaggtagttacaaaattaggcgtacttgggagtcggccat

SEQ ID NO: 412316 - DNA, 140 bp, Artificial Sequence
  Synthetic
atggccgactcccaagtacgcctaattttgtaactacctgttttaaagtgttttcccatttttctctactaaggttacaatgtgcttgtcttatatctcctattatttctcctgttgcatggagacccagcatggcgtat

SEQ ID NO: 412317 - DNA, 140 bp, Artificial Sequence
  Synthetic
aggccctggctgctgatatggcagaataagacaaattataaacaggtggcaggaagtaggaaaagcaatgtatgcccctcccatcagaggacaaattagatgttcatcaaatattacagggaccttttgggacagcggtg

SEQ ID NO: 412318 - DNA, 140 bp, Artificial Sequence
  Synthetic
caccgctgtcccaaaaggtccctgtaatatttgatgaacatctaatttgtcctctgatgggaggggcatacattgcttttcctacttcctgccacctgtttataatttgtcttattctgccatatcagcagccagggcct

SEQ ID NO: 412319 - DNA, 140 bp, Artificial Sequence
  Synthetic
atacgccatgctgggtctcctaaatagtactaagaccaataccactaacaccacggacagtctgaaggaaactccaggagcaatacaaaactgtactttcaatatgagcacagaaataagcgtacttgggagtcggccat

SEQ ID NO: 412320 - DNA, 140 bp, Artificial Sequence
  Synthetic
atggccgactcccaagtacgcttatttctgtgctcatattgaaagtacagttttgtattgctcctggagtttccttcagactgtccgtggtgttagtggtattggtcttagtactatttaggagacccagcatggcgtat

SEQ ID NO: 412321 - DNA, 140 bp, Artificial Sequence
  Synthetic
atacgccatgctgggtctcccccaccagcagagagcttcaggttcgaggagacaacccccgccccgaagcaggagccgaaagacagggaacccttaacttccctcaaatcactctttggccgtacttgggagtcggccat

SEQ ID NO: 412322 - DNA, 140 bp, Artificial Sequence
  Synthetic
atggccgactcccaagtacggccaaagagtgatttgagggaagttaagggttccctgtctttcggctcctgcttcggggcgggggttgtctcctcgaacctgaagctctctgctggtgggggagacccagcatggcgtat

SEQ ID NO: 412323 - DNA, 140 bp, Artificial Sequence
  Synthetic
atacgccatgctgggtctccagtattttatgcaacaggagacataataggagacatcagacaggcacattgtaacgtcagtagagaacaatggaataaaaccttagaaaagataagggcacgtacttgggagtcggccat

SEQ ID NO: 412324 - DNA, 140 bp, Artificial Sequence
  Synthetic
atggccgactcccaagtacgtgcccttatcttttctaaggttttattccattgttctctactgacgttacaatgtgcctgtctgatgtctcctattatgtctcctgttgcataaaatactggagacccagcatggcgtat

SEQ ID NO: 412325 - DNA, 140 bp, Artificial Sequence
  Synthetic
atacgccatgctgggtctccagtggtcaaaatgtgggtggcctgcagtaagagaaagaataagacaaactgagccagcggagggagtaggaccagcatctcaagacttagctagacatggcgtacttgggagtcggccat

SEQ ID NO: 412326 - DNA, 140 bp, Artificial Sequence
  Synthetic
atggccgactcccaagtacgccatgtctagctaagtcttgagatgctggtcctactccctccgctggctcagtttgtcttattctttctcttactgcaggccacccacattttgaccactggagacccagcatggcgtat

SEQ ID NO: 412327 - DNA, 140 bp, Artificial Sequence
  Synthetic
atacgccatgctgggtctcctaagttcagaggtacacatcccgctagggggggctaaaataatagtaaaaacatattggggtctgcacccaggagaaaaagactggcacttgggtcagggcgtacttgggagtcggccat

SEQ ID NO: 412328 - DNA, 140 bp, Artificial Sequence
  Synthetic
atggccgactcccaagtacgccctgacccaagtgccagtctttttctcctgggtgcagaccccaatatgtttttactattattttagccccccctagcgggatgtgtacctctgaacttaggagacccagcatggcgtat

SEQ ID NO: 412329 - DNA, 140 bp, Artificial Sequence
  Synthetic
atacgccatgctgggtctcctaaacaaaggcttaggcatctcctatggcaggaagaagcggagaccccgacgaagacctcctcagggcggtacgggccatcagaatcctataccagagcacgtacttgggagtcggccat

SEQ ID NO: 412330 - DNA, 140 bp, Artificial Sequence
  Synthetic
atggccgactcccaagtacgtgctctggtataggattctgatggcccgtaccgccctgaggaggtcttcgtcggggtctccgcttcttcctgccataggagatgcctaagcctttgtttaggagacccagcatggcgtat

SEQ ID NO: 412331 - DNA, 140 bp, Artificial Sequence
  Synthetic
aggccctggctgctgatatggaggtggagagcaaggcaaagacagatccgtgagattagtgagcggattcttagctcttgtctgggacgacctgcggaacctgtgcctcttctgctaccagaccttttgggacagcggtg

SEQ ID NO: 412332 - DNA, 140 bp, Artificial Sequence
  Synthetic
caccgctgtcccaaaaggtctggtagcagaagaggcacaggttccgcaggtcgtcccagacaagagctaagaatccgctcactaatctcacggatctgtctttgccttgctctccacctccatatcagcagccagggcct

SEQ ID NO: 412333 - DNA, 140 bp, Artificial Sequence
  Synthetic
aggccctggctgctgatatgtaattaagagaataagtgaaagagcagaagatagtggcaatgagagtgagggggatacagaggaattatcaacacttatggaaatggggaatcttgatttgaccttttgggacagcggtg

SEQ ID NO: 412334 - DNA, 140 bp, Artificial Sequence
  Synthetic
caccgctgtcccaaaaggtcaaatcaagattccccatttccataagtgttgataattcctctgtatccccctcactctcattgccactatcttctgctctttcacttattctcttaattacatatcagcagccagggcct

SEQ ID NO: 412335 - DNA, 140 bp, Artificial Sequence
  Synthetic
aggccctggctgctgatatgatgcctgtgtacccacagaccccaacccacaagaaataaacctggaaaatgtaacagaaaattttaacatgtggaaaaatggcatggtagaacagatgcagaccttttgggacagcggtg

SEQ ID NO: 412336 - DNA, 140 bp, Artificial Sequence
  Synthetic
caccgctgtcccaaaaggtctgcatctgttctaccatgccatttttccacatgttaaaattttctgttacattttccaggtttatttcttgtgggttggggtctgtgggtacacaggcatcatatcagcagccagggcct

SEQ ID NO: 412337 - DNA, 140 bp, Artificial Sequence
  Synthetic
atacgccatgctgggtctccagggctttgctataaaatgggtgccaagtggtcaaaaagtagtatagtgggatggcctaacataagggaaagaatgagacgagctgagccagcagcagaacgtacttgggagtcggccat

SEQ ID NO: 412338 - DNA, 140 bp, Artificial Sequence
  Synthetic
atggccgactcccaagtacgttctgctgctggctcagctcgtctcattctttcccttatgttaggccatcccactatactactttttgaccacttggcacccattttatagcaaagccctggagacccagcatggcgtat

SEQ ID NO: 412339 - DNA, 140 bp, Artificial Sequence
  Synthetic
atacgccatgctgggtctccagtagcacccagagccccgatagcaataacaccatgaactgctcttttgagactaccacagaactaagagataagaaacagaaagtccaagcactattttcgtacttgggagtcggccat

SEQ ID NO: 412340 - DNA, 140 bp, Artificial Sequence
  Synthetic
atggccgactcccaagtacgaaaatagtgcttggactttctgtttcttatctcttagttctgtggtagtctcaaaagagcagttcatggtgttattgctatcggggctctgggtgctactggagacccagcatggcgtat

SEQ ID NO: 412341 - DNA, 140 bp, Artificial Sequence
  Synthetic
aggccctggctgctgatatgaggcatctcctatggcaggaagaagcggaggcagcgacgaagagcttctcgcagcagtcaaagtcatcaagatcttgtaccaaagtagtgagtataattggaccttttgggacagcggtg

SEQ ID NO: 412342 - DNA, 140 bp, Artificial Sequence
  Synthetic
caccgctgtcccaaaaggtccaattatactcactactttggtacaagatcttgatgactttgactgctgcgagaagctcttcgtcgctgcctccgcttcttcctgccataggagatgcctcatatcagcagccagggcct

SEQ ID NO: 412343 - DNA, 140 bp, Artificial Sequence
  Synthetic
atacgccatgctgggtctcccaataattagatctgcaaatattacagacaatactaaaaacataatagtacagtttactaagcctgtacaaattaattgtaccagacccgacgtcggtcacgtacttgggagtcggccat

SEQ ID NO: 412344 - DNA, 140 bp, Artificial Sequence
  Synthetic
atggccgactcccaagtacgtgaccgacgtcgggtctggtacaattaatttgtacaggcttagtaaactgtactattatgtttttagtattgtctgtaatatttgcagatctaattattgggagacccagcatggcgtat

SEQ ID NO: 412345 - DNA, 140 bp, Artificial Sequence
  Synthetic
aggccctggctgctgatatgcagtttactaagcctgtacaaattaattgtaccagacccgacgtcggtcaaagaaggagtgtacgcattggaccaggacgagccttctatacaaggcaaagaccttttgggacagcggtg

SEQ ID NO: 412346 - DNA, 140 bp, Artificial Sequence
  Synthetic
caccgctgtcccaaaaggtctttgccttgtatagaaggctcgtcctggtccaatgcgtacactccttctttgaccgacgtcgggtctggtacaattaatttgtacaggcttagtaaactgcatatcagcagccagggcct

SEQ ID NO: 412347 - DNA, 140 bp, Artificial Sequence
  Synthetic
atacgccatgctgggtctccctcaaccaacttaaatgaaacaataactctcccatgcagaataaagcaatttgtaaggatgtggcagagggtaggacgagcaatgtatgctcctcccatccgtacttgggagtcggccat

SEQ ID NO: 412348 - DNA, 140 bp, Artificial Sequence
  Synthetic
atggccgactcccaagtacggatgggaggagcatacattgctcgtcctaccctctgccacatccttacaaattgctttattctgcatgggagagttattgtttcatttaagttggttgagggagacccagcatggcgtat

SEQ ID NO: 412349 - DNA, 140 bp, Artificial Sequence
  Synthetic
atacgccatgctgggtctccagcagcagacaatggaatgacactttacaaaaggtagctgagcagttaagaaaatacttctctaataaaacaataatctttaccaactcctcgggaggggcgtacttgggagtcggccat

SEQ ID NO: 412350 - DNA, 140 bp, Artificial Sequence
  Synthetic
atggccgactcccaagtacgcccctcccgaggagttggtaaagattattgttttattagagaagtattttcttaactgctcagctaccttttgtaaagtgtcattccattgtctgctgctggagacccagcatggcgtat

SEQ ID NO: 412351 - DNA, 140 bp, Artificial Sequence
  Synthetic
aggccctggctgctgatatgaaaatacttctctaataaaacaataatctttaccaactcctcgggaggggacatagaaattacaacacatagtgtcaattgtggaggagaatttttctatgaccttttgggacagcggtg

SEQ ID NO: 412352 - DNA, 140 bp, Artificial Sequence
  Synthetic
caccgctgtcccaaaaggtcatagaaaaattctcctccacaattgacactatgtgttgtaatttctatgtcccctcccgaggagttggtaaagattattgttttattagagaagtattttcatatcagcagccagggcct

SEQ ID NO: 412353 - DNA, 140 bp, Artificial Sequence
  Synthetic
aggccctggctgctgatatgtgtgtggagagatgcagagaccaccctattttgtgcatcagatgctaaagcatatactacagaaaaacataatgtctgggctacacatgcctgtgtacccgaccttttgggacagcggtg

SEQ ID NO: 412354 - DNA, 140 bp, Artificial Sequence
  Synthetic
caccgctgtcccaaaaggtcgggtacacaggcatgtgtagcccagacattatgtttttctgtagtatatgctttagcatctgatgcacaaaatagggtggtctctgcatctctccacacacatatcagcagccagggcct

SEQ ID NO: 412355 - DNA, 140 bp, Artificial Sequence
  Synthetic
atacgccatgctgggtctccggagaatgaggagaaagatcgcaatgtgactctcccatgcagaataaaacaaattgtaaacatgtggcagagagtaggacgagcaatgtatgcccctccccgtacttgggagtcggccat

SEQ ID NO: 412356 - DNA, 140 bp, Artificial Sequence
  Synthetic
atggccgactcccaagtacggggaggggcatacattgctcgtcctactctctgccacatgtttacaatttgttttattctgcatgggagagtcacattgcgatctttctcctcattctccggagacccagcatggcgtat

SEQ ID NO: 412357 - DNA, 140 bp, Artificial Sequence
  Synthetic
atacgccatgctgggtctccagatgaaataaaaaactgctcttataatatgaccacaggattaagagataggagacagaaagtatactcacttttctataaacttgatatagaaccaattcgtacttgggagtcggccat

SEQ ID NO: 412358 - DNA, 140 bp, Artificial Sequence
  Synthetic
atggccgactcccaagtacgaattggttctatatcaagtttatagaaaagtgagtatactttctgtctcctatctcttaatcctgtggtcatattataagagcagttttttatttcatctggagacccagcatggcgtat

SEQ ID NO: 412359 - DNA, 140 bp, Artificial Sequence
  Synthetic
aggccctggctgctgatatgaagagcaagaaatggagccaatagatcctaacctagagccctggaatcatccaggaagtcagcctaaaactccttgtaataagtgttattgtaaatactggaccttttgggacagcggtg

SEQ ID NO: 412360 - DNA, 140 bp, Artificial Sequence
  Synthetic
caccgctgtcccaaaaggtccagtatttacaataacacttattacaaggagttttaggctgacttcctggatgattccagggctctaggttaggatctattggctccatttcttgctcttcatatcagcagccagggcct

SEQ ID NO: 412361 - DNA, 140 bp, Artificial Sequence
  Synthetic
aggccctggctgctgatatgggtttgacatatcaaactggctgtggtatataaaaatattcataatgatagtaggaggcttgataggattaagaatagttatggctataatttctgtagtgaccttttgggacagcggtg

SEQ ID NO: 412362 - DNA, 140 bp, Artificial Sequence
  Synthetic
caccgctgtcccaaaaggtcactacagaaattatagccataactattcttaatcctatcaagcctcctactatcattatgaatatttttatataccacagccagtttgatatgtcaaacccatatcagcagccagggcct

SEQ ID NO: 412363 - DNA, 140 bp, Artificial Sequence
  Synthetic
atacgccatgctgggtctcccatagattcctgagtaagagtttgttaatgcccctcccctagtgaaattatagtaccagctggagaaagaacccatagcagaggcagaaactttctatgtcgtacttgggagtcggccat

SEQ ID NO: 412364 - DNA, 140 bp, Artificial Sequence
  Synthetic
atggccgactcccaagtacgacatagaaagtttctgcctctgctatgggttctttctccagctggtactataatttcactaggggaggggcattaacaaactcttactcaggaatctatgggagacccagcatggcgtat

SEQ ID NO: 412365 - DNA, 140 bp, Artificial Sequence
  Synthetic
atacgccatgctgggtctccatagtacaaagagcttgcagagctattatcaacatacctagaagaatcagacagggcttagagagagctttactataaaatggggggcaagtggtcaaaacgtacttgggagtcggccat

SEQ ID NO: 412366 - DNA, 140 bp, Artificial Sequence
  Synthetic
atggccgactcccaagtacgttttgaccacttgccccccattttatagtaaagctctctctaagccctgtctgattcttctaggtatgttgataatagctctgcaagctctttgtactatggagacccagcatggcgtat

SEQ ID NO: 412367 - DNA, 140 bp, Artificial Sequence
  Synthetic
atacgccatgctgggtctcctccagcagcagaacgaacccctccagcagcagcagcagaaggagtaggagcagtatctcaagatttagctacacgtggggcagtcacaattaataatacacgtacttgggagtcggccat

SEQ ID NO: 412368 - DNA, 140 bp, Artificial Sequence
  Synthetic
atggccgactcccaagtacgtgtattattaattgtgactgccccacgtgtagctaaatcttgagatactgctcctactccttctgctgctgctgctggaggggttcgttctgctgctggaggagacccagcatggcgtat

SEQ ID NO: 412369 - DNA, 140 bp, Artificial Sequence
  Synthetic
aggccctggctgctgatatgacaacaatacaaggaaaggtatacgtataggaccaggaagagtgatttatgcaacaagtgccataacaggagacataagacaggcacattgtaacatcaggaccttttgggacagcggtg

SEQ ID NO: 412370 - DNA, 140 bp, Artificial Sequence
  Synthetic
caccgctgtcccaaaaggtcctgatgttacaatgtgcctgtcttatgtctcctgttatggcacttgttgcataaatcactcttcctggtcctatacgtatacctttccttgtattgttgtcatatcagcagccagggcct

SEQ ID NO: 412371 - DNA, 140 bp, Artificial Sequence
  Synthetic
aggccctggctgctgatatgaagcgaaagtaacagggactcgaaagcgaaagttccagaggagttctctcgacgcaggactcggcttgctgaggtgcacacggcaagaggcgaggggcgggaccttttgggacagcggtg

SEQ ID NO: 412372 - DNA, 140 bp, Artificial Sequence
  Synthetic
caccgctgtcccaaaaggtcccgcccctcgcctcttgccgtgtgcacctcagcaagccgagtcctgcgtcgagagaactcctctggaactttcgctttcgagtccctgttactttcgcttcatatcagcagccagggcct

SEQ ID NO: 412373 - DNA, 140 bp, Artificial Sequence
  Synthetic
atacgccatgctgggtctccagctctccaaacaggaacagaagaacttaaatcattatataatacagtagtagtcctctactgggtacatcaaagggtagatgtaaaagacaccaaggaacgtacttgggagtcggccat

SEQ ID NO: 412374 - DNA, 140 bp, Artificial Sequence
  Synthetic
atggccgactcccaagtacgttccttggtgtcttttacatctaccctttgatgtacccagtagaggactactactgtattatataatgatttaagttcttctgttcctgtttggagagctggagacccagcatggcgtat

SEQ ID NO: 412375 - DNA, 140 bp, Artificial Sequence
  Synthetic
atacgccatgctgggtctccaatataacctttgaaccacaaccactctcgggaggggacctagaaattacaacacatagttttaactgtggaggagaatttttctattgcaatacatcaacgtacttgggagtcggccat

SEQ ID NO: 412376 - DNA, 140 bp, Artificial Sequence
  Synthetic
atggccgactcccaagtacgttgatgtattgcaatagaaaaattctcctccacagttaaaactatgtgttgtaatttctaggtcccctcccgagagtggttgtggttcaaaggttatattggagacccagcatggcgtat

SEQ ID NO: 412377 - DNA, 140 bp, Artificial Sequence
  Synthetic
atacgccatgctgggtctccacagataggattatagagataggacaaagaattgggagaggtattctccacatacctagaagaatcagacaaggcttcgaaagggctttacaataacatgcgtacttgggagtcggccat

SEQ ID NO: 412378 - DNA, 140 bp, Artificial Sequence
  Synthetic
atggccgactcccaagtacgcatgttattgtaaagccctttcgaagccttgtctgattcttctaggtatgtggagaatacctctcccaattctttgtcctatctctataatcctatctgtggagacccagcatggcgtat

SEQ ID NO: 412379 - DNA, 140 bp, Artificial Sequence
  Synthetic
aggccctggctgctgatatgaccatcaatgaggaagctgcagaatgggacagggtacatccagtacatgcagggcctattccaccaggccagatgagagaaccaaggggaagtgacataggaccttttgggacagcggtg

SEQ ID NO: 412380 - DNA, 140 bp, Artificial Sequence
  Synthetic
caccgctgtcccaaaaggtcctatgtcacttccccttggttctctcatctggcctggtggaataggccctgcatgtactggatgtaccctgtcccattctgcagcttcctcattgatggtcatatcagcagccagggcct

SEQ ID NO: 412381 - DNA, 140 bp, Artificial Sequence
  Synthetic
atacgccatgctgggtctccaatatgacaaatgaaagttgcacctggctagaagcacaagaggacgaggatgtgggctttccagtcagacctcaggtaccattaagaccaatgacttatacgtacttgggagtcggccat

SEQ ID NO: 412382 - DNA, 140 bp, Artificial Sequence
  Synthetic
atggccgactcccaagtacgtataagtcattggtcttaatggtacctgaggtctgactggaaagcccacatcctcgtcctcttgtgcttctagccaggtgcaactttcatttgtcatattggagacccagcatggcgtat

SEQ ID NO: 412383 - DNA, 140 bp, Artificial Sequence
  Synthetic
aggccctggctgctgatatgtaggaaaagcaatgtatgcccctcccatcagcggaccaattagatgttcatcaaatattacagggctaatattaacaagagatggtggtaaaagcaagaagaccttttgggacagcggtg

SEQ ID NO: 412384 - DNA, 140 bp, Artificial Sequence
  Synthetic
caccgctgtcccaaaaggtcttcttgcttttaccaccatctcttgttaatattagccctgtaatatttgatgaacatctaattggtccgctgatgggaggggcatacattgcttttcctacatatcagcagccagggcct

SEQ ID NO: 412385 - DNA, 140 bp, Artificial Sequence
  Synthetic
aggccctggctgctgatatgcaatggctagtgattttaatctgccacctgtagtagcaaaagaaatagtagctagctgtgataagtgtcagctaaaaggggaagccatgcatggacaagtgaccttttgggacagcggtg

SEQ ID NO: 412386 - DNA, 140 bp, Artificial Sequence
  Synthetic
caccgctgtcccaaaaggtcacttgtccatgcatggcttccccttttagctgacacttatcacagctagctactatttcttttgctactacaggtggcagattaaaatcactagccattgcatatcagcagccagggcct

SEQ ID NO: 412387 - DNA, 140 bp, Artificial Sequence
  Synthetic
atacgccatgctgggtctccgtaatgctactgctaacaggattggtaaggctacccacaatcccatggagggagaaataaaaaattgctctttcaatgcaaccacagaaataaaagatagcgtacttgggagtcggccat

SEQ ID NO: 412388 - DNA, 140 bp, Artificial Sequence
  Synthetic
atggccgactcccaagtacgctatcttttatttctgtggttgcattgaaagagcaattttttatttctccctccatgggattgtgggtagccttaccaatcctgttagcagtagcattacggagacccagcatggcgtat

SEQ ID NO: 412389 - DNA, 140 bp, Artificial Sequence
  Synthetic
aggccctggctgctgatatggccttttagaaacatcagaaggctgtaaacaaataataggacagctacaaccagctattcagacaggatcagaggaaattaaatcattatataatacagtgaccttttgggacagcggtg

SEQ ID NO: 412390 - DNA, 140 bp, Artificial Sequence
  Synthetic
caccgctgtcccaaaaggtcactgtattatataatgatttaatttcctctgatcctgtctgaatagctggttgtagctgtcctattatttgtttacagccttctgatgtttctaaaaggccatatcagcagccagggcct

SEQ ID NO: 412391 - DNA, 140 bp, Artificial Sequence
  Synthetic
atacgccatgctgggtctccaaatgctactgttacctctaatacgcccatagatagaagaataaacatgaaagaagaaatacaaaattgctctttcaatgcaaccacagaaataagagatcgtacttgggagtcggccat

SEQ ID NO: 412392 - DNA, 140 bp, Artificial Sequence
  Synthetic
atggccgactcccaagtacgatctcttatttctgtggttgcattgaaagagcaattttgtatttcttctttcatgtttattcttctatctatgggcgtattagaggtaacagtagcatttggagacccagcatggcgtat

SEQ ID NO: 412393 - DNA, 140 bp, Artificial Sequence
  Synthetic
atacgccatgctgggtctccaaataaaagaaataaaaaactgctctttcaatatcaccacaaacataagagataagatgcagagagaatatgcacttttgtataagcatgatgtagtatccgtacttgggagtcggccat

SEQ ID NO: 412394 - DNA, 140 bp, Artificial Sequence
  Synthetic
atggccgactcccaagtacggatactacatcatgcttatacaaaagtgcatattctctctgcatcttatctcttatgtttgtggtgatattgaaagagcagttttttatttcttttatttggagacccagcatggcgtat

SEQ ID NO: 412395 - DNA, 140 bp, Artificial Sequence
  Synthetic
atacgccatgctgggtctccattttcttcagagcagaccaggaccaacagccccaccagagagcagaccagagccaacagccccaccagcagagagcttcgggttcggagaggagatagccgtacttgggagtcggccat

SEQ ID NO: 412396 - DNA, 140 bp, Artificial Sequence
  Synthetic
atggccgactcccaagtacggctatctcctctccgaacccgaagctctctgctggtggggctgttggctctggtctgctctctggtggggctgttggtcctggtctgctctgaagaaaatggagacccagcatggcgtat

SEQ ID NO: 412397 - DNA, 140 bp, Artificial Sequence
  Synthetic
aggccctggctgctgatatgcagacaaaaaacatcagaaagaacctccatttctttggatgggatatgagcttcatcctgacaaatggacagtccagcctataaagctgccagaaaaagagaccttttgggacagcggtg

SEQ ID NO: 412398 - DNA, 140 bp, Artificial Sequence
  Synthetic
caccgctgtcccaaaaggtctctttttctggcagctttataggctggactgtccatttgtcaggatgaagctcatatcccatccaaagaaatggaggttctttctgatgttttttgtctgcatatcagcagccagggcct

SEQ ID NO: 412399 - DNA, 140 bp, Artificial Sequence
  Synthetic
  misc_feature (42)..(42): n is a, c, g, or t
  misc_feature (44)..(44): n is a, c, g, or t
  misc_feature (71)..(71): n is a, c, g, or t
atacgccatgctgggtctccgcaactggagatataataggananataagaagagcatattgtaccattaanaaaacaaaatgggaaaacatgctaaaacaagtagttgaaaaattaagagcgtacttgggagtcggccat

SEQ ID NO: 412400 - DNA, 140 bp, Artificial Sequence
  Synthetic
  misc_feature (70)..(70): n is a, c, g, or t
  misc_feature (97)..(97): n is a, c, g, or t
  misc_feature (99)..(99): n is a, c, g, or t
atggccgactcccaagtacgctcttaatttttcaactacttgttttagcatgttttcccattttgttttnttaatggtacaatatgctcttcttatntntcctattatatctccagttgcggagacccagcatggcgtat

SEQ ID NO: 412401 - DNA, 140 bp, Artificial Sequence
  Synthetic
  misc_feature (87)..(87): n is a, c, g, or t
atacgccatgctgggtctccataagacaaattgtaaacaggtggcaagaagtaggaaaagcaatgtatgcccctcccatccgaggantaattaactgtgtatcaaatattacagggttaccgtacttgggagtcggccat

SEQ ID NO: 412402 - DNA, 140 bp, Artificial Sequence
  Synthetic
  misc_feature (54)..(54): n is a, c, g, or t
atggccgactcccaagtacggtaaccctgtaatatttgatacacagttaattantcctcggatgggaggggcatacattgcttttcctacttcttgccacctgtttacaatttgtcttatggagacccagcatggcgtat

SEQ ID NO: 412403 - DNA, 140 bp, Artificial Sequence
  Synthetic
atacgccatgctgggtctcctaaactaggaaaggcagggtatgtcactgacagaggaagacaaaaaattgtctccctgacggagacaacaaatcaaaagactgaattacatgcaatctatcgtacttgggagtcggccat

SEQ ID NO: 412404 - DNA, 140 bp, Artificial Sequence
  Synthetic
atggccgactcccaagtacgatagattgcatgtaattcagtcttttgatttgttgtctccgtcagggagacaattttttgtcttcctctgtcagtgacataccctgcctttcctagtttaggagacccagcatggcgtat

SEQ ID NO: 412405 - DNA, 140 bp, Artificial Sequence
  Synthetic
atacgccatgctgggtctcccctggaagagaagatatgaaggacaactagagaagtgaattatacaaatataaagtagtagaaattaaaccattaagaatagctccaactgaggcaagaacgtacttgggagtcggccat

SEQ ID NO: 412406 - DNA, 140 bp, Artificial Sequence
  Synthetic
atggccgactcccaagtacgttcttgcctcagttggagctattcttaatggtttaatttctactactttatatttgtataattcacttctctagttgtccttcatatcttctcttccaggggagacccagcatggcgtat

SEQ ID NO: 412407 - DNA, 140 bp, Artificial Sequence
  Synthetic
aggccctggctgctgatatgtcatgggtaccagcacacaaagggattggaggaaatgaacaagtagacaaattagtcagttctggaatcaggaaagtgctatttttagatgggatagatagaccttttgggacagcggtg

SEQ ID NO: 412408 - DNA, 140 bp, Artificial Sequence
  Synthetic
caccgctgtcccaaaaggtctatctatcccatctaaaaatagcactttcctgattccagaactgactaatttgtctacttgttcatttcctccaatccctttgtgtgctggtacccatgacatatcagcagccagggcct

SEQ ID NO: 412409 - DNA, 140 bp, Artificial Sequence
  Synthetic
aggccctggctgctgatatgtcatttgcaccactgctgtaccttggaatactagttggagtaatagaagtctgagtagcatttgggataacatgacctggatggagtgggaaaaagaaatgaccttttgggacagcggtg

SEQ ID NO: 412410 - DNA, 140 bp, Artificial Sequence
  Synthetic
caccgctgtcccaaaaggtcatttctttttcccactccatccaggtcatgttatcccaaatgctactcagacttctattactccaactagtattccaaggtacagcagtggtgcaaatgacatatcagcagccagggcct

SEQ ID NO: 412411 - DNA, 140 bp, Artificial Sequence
  Synthetic
aggccctggctgctgatatgcctaagagatcaacagctcctaaggctttaaggctgctctagaaaactcatctgcaccactaatttgccttagaacaccagttggagtaataaatctaaagaccttttgggacagcggtg

SEQ ID NO: 412412 - DNA, 140 bp, Artificial Sequence
  Synthetic
caccgctgtcccaaaaggtctttagatttattactccaactggtgttctaaggcaaattagtggtgcagatgagttttctagagcagccttaaagccttaggagctgttgatctcttaggcatatcagcagccagggcct

SEQ ID NO: 412413 - DNA, 140 bp, Artificial Sequence
  Synthetic
atacgccatgctgggtctccaaccactgatagcaccctggaagagaaaggggcaataaaaaactgtactttcaatatgaccacagaaataagagataagcagctaaaagtacaatcactccgtacttgggagtcggccat

SEQ ID NO: 412414 - DNA, 140 bp, Artificial Sequence
  Synthetic
atggccgactcccaagtacggagtgattgtacttttagctgcttatctcttatttctgtggtcatattgaaagtacagttttttattgcccctttctcttccagggtgctatcagtggttggagacccagcatggcgtat

SEQ ID NO: 412415 - DNA, 140 bp, Artificial Sequence
  Synthetic
aggccctggctgctgatatggaatagtgctattagtttgcttaatgccacagctgtagcagtagctgaggggacagatagggttatagaagtagcacaaagaatttgtaggggtatcctcgaccttttgggacagcggtg

SEQ ID NO: 412416 - DNA, 140 bp, Artificial Sequence
  Synthetic
caccgctgtcccaaaaggtcgaggatacccctacaaattctttgtgctacttctataaccctatctgtcccctcagctactgctacagctgtggcattaagcaaactaatagcactattccatatcagcagccagggcct

SEQ ID NO: 412417 - DNA, 140 bp, Artificial Sequence
  Synthetic
atacgccatgctgggtctccaattaaagaaaatcatagggcaggtaagagatcaagctgaacaccttaagacagcagtacaaatggcagtattcattcacaattttaaaagaaaagggggcgtacttgggagtcggccat

SEQ ID NO: 412418 - DNA, 140 bp, Artificial Sequence
  Synthetic
atggccgactcccaagtacgcccccttttcttttaaaattgtgaatgaatactgccatttgtactgctgtcttaaggtgttcagcttgatctcttacctgccctatgattttctttaattggagacccagcatggcgtat

SEQ ID NO: 412419 - DNA, 140 bp, Artificial Sequence
  Synthetic
aggccctggctgctgatatgtaaaatttaactcatcctcaggaggggacctagaaattacaatgcatagttttaattgtagaggagaatttttctactgcaatacatcaaaactgtttaagaccttttgggacagcggtg

SEQ ID NO: 412420 - DNA, 140 bp, Artificial Sequence
  Synthetic
caccgctgtcccaaaaggtcttaaacagttttgatgtattgcagtagaaaaattctcctctacaattaaaactatgcattgtaatttctaggtcccctcctgaggatgagttaaattttacatatcagcagccagggcct

SEQ ID NO: 412421 - DNA, 140 bp, Artificial Sequence
  Synthetic
  misc_feature (104)..(104): n is a, c, g, or t
atacgccatgctgggtctccaaaagaagaggaggaagtgggttttccagtcagaccccaggtacctttaagaccaatgacttacaaagcagcttttgatcttancttctttttaaaagaacgtacttgggagtcggccat

SEQ ID NO: 412422 - DNA, 140 bp, Artificial Sequence
  Synthetic
  misc_feature (37)..(37): n is a, c, g, or t
atggccgactcccaagtacgttcttttaaaaagaagntaagatcaaaagctgctttgtaagtcattggtcttaaaggtacctggggtctgactggaaaacccacttcctcctcttcttttggagacccagcatggcgtat

SEQ ID NO: 412423 - DNA, 140 bp, Artificial Sequence
  Synthetic
aggccctggctgctgatatgagaagtacacatcccgctaggggaggctagaataatagtaagaacatattggggtctgcacataggagaaaaagactggcacttgggtcatggagtctccgaccttttgggacagcggtg

SEQ ID NO: 412424 - DNA, 140 bp, Artificial Sequence
  Synthetic
caccgctgtcccaaaaggtcggagactccatgacccaagtgccagtctttttctcctatgtgcagaccccaatatgttcttactattattctagcctcccctagcgggatgtgtacttctcatatcagcagccagggcct

SEQ ID NO: 412425 - DNA, 140 bp, Artificial Sequence
  Synthetic
aggccctggctgctgatatgatgggaaaaaattaggttaaggccagggggaaagaaacattatatgctaaaacacatagtatgggcaagcagggagctggaaagatttgcacttaaccctgaccttttgggacagcggtg

SEQ ID NO: 412426 - DNA, 140 bp, Artificial Sequence
  Synthetic
caccgctgtcccaaaaggtcagggttaagtgcaaatctttccagctccctgcttgcccatactatgtgttttagcatataatgtttctttccccctggccttaacctaattttttcccatcatatcagcagccagggcct

SEQ ID NO: 412427 - DNA, 140 bp, Artificial Sequence
  Synthetic
aggccctggctgctgatatgtaatacctatggggatacctgggaaggagttgaagttatcataagatatctgcaacaactactgtttgtccatttcagaattgggtgccaacatagcagggaccttttgggacagcggtg

SEQ ID NO: 412428 - DNA, 140 bp, Artificial Sequence
  Synthetic
caccgctgtcccaaaaggtccctgctatgttggcacccaattctgaaatggacaaacagtagttgttgcagatatcttatgataacttcaactccttcccaggtatccccataggtattacatatcagcagccagggcct

SEQ ID NO: 412429 - DNA, 140 bp, Artificial Sequence
  Synthetic
atacgccatgctgggtctccataggcattattcgaagaagaagagtaagggatggagccagtagaccctaaactagagccctggaaccatccgggaagtcagcctaaaactgcttgtacccgtacttgggagtcggccat

SEQ ID NO: 412430 - DNA, 140 bp, Artificial Sequence
  Synthetic
atggccgactcccaagtacgggtacaagcagttttaggctgacttcccggatggttccagggctctagtttagggtctactggctccatcccttactcttcttcttcgaataatgcctatggagacccagcatggcgtat

SEQ ID NO: 412431 - DNA, 140 bp, Artificial Sequence
  Synthetic
atacgccatgctgggtctcccaaaggcttaggcatctcctacggcaggaagaagcgacgaccccgacgaaagccttctccaagcaataaggaccatcaaaatcctataccaaagcagtaacgtacttgggagtcggccat

SEQ ID NO: 412432 - DNA, 140 bp, Artificial Sequence
  Synthetic
atggccgactcccaagtacgttactgctttggtataggattttgatggtccttattgcttggagaaggctttcgtcggggtcgtcgcttcttcctgccgtaggagatgcctaagcctttgggagacccagcatggcgtat

SEQ ID NO: 412433 - DNA, 140 bp, Artificial Sequence
  Synthetic
atacgccatgctgggtctcctaggactgatagtagctttaatcttagcaatagttgtatggactatagtattcatagaatataagaaaattaagaagcaaaggaaaatagactggttaatcgtacttgggagtcggccat

SEQ ID NO: 412434 - DNA, 140 bp, Artificial Sequence
  Synthetic
atggccgactcccaagtacgattaaccagtctattttcctttgcttcttaattttcttatattctatgaatactatagtccatacaactattgctaagattaaagctactatcagtcctaggagacccagcatggcgtat

SEQ ID NO: 412435 - DNA, 140 bp, Artificial Sequence
  Synthetic
atacgccatgctgggtctccatagcagtagcacccagagccccattaatgaagaaataaaaaactgctcttacaatactaccacaatactaagagataagacacaaaaagtttattcactcgtacttgggagtcggccat

SEQ ID NO: 412436 - DNA, 140 bp, Artificial Sequence
  Synthetic
atggccgactcccaagtacgagtgaataaactttttgtgtcttatctcttagtattgtggtagtattgtaagagcagttttttatttcttcattaatggggctctgggtgctactgctatggagacccagcatggcgtat

SEQ ID NO: 412437 - DNA, 140 bp, Artificial Sequence
  Synthetic
atacgccatgctgggtctccaccactaataacaataccaatagtaatagttgggaaacgatggagagaggagaaataaaaaactgctctttcaatgtctccacagacataagagatatgccgtacttgggagtcggccat

SEQ ID NO: 412438 - DNA, 140 bp, Artificial Sequence
  Synthetic
atggccgactcccaagtacggcatatctcttatgtctgtggagacattgaaagagcagttttttatttctcctctctccatcgtttcccaactattactattggtattgttattagtggtggagacccagcatggcgtat

SEQ ID NO: 412439 - DNA, 140 bp, Artificial Sequence
  Synthetic
aggccctggctgctgatatgatagtagcattagtagtagcaacaataatagcaatagttgtgtggtccatagtattcatagaatataggagaatattaagacaaagaatagtaccctgtggaccttttgggacagcggtg

SEQ ID NO: 412440 - DNA, 140 bp, Artificial Sequence
  Synthetic
caccgctgtcccaaaaggtccacagggtactattctttgtcttaatattctcctatattctatgaatactatggaccacacaactattgctattattgttgctactactaatgctactatcatatcagcagccagggcct

SEQ ID NO: 412441 - DNA, 140 bp, Artificial Sequence
  Synthetic
atacgccatgctgggtctccacataatagttcagtttactaagcctgtactaattacttgtatcagacccaacaacaatacaagaaaaagtatacgctttggaccaggacaagccttctacgtacttgggagtcggccat

SEQ ID NO: 412442 - DNA, 140 bp, Artificial Sequence
  Synthetic
atggccgactcccaagtacgtagaaggcttgtcctggtccaaagcgtatactttttcttgtattgttgttgggtctgatacaagtaattagtacaggcttagtaaactgaactattatgtggagacccagcatggcgtat

SEQ ID NO: 412443 - DNA, 140 bp, Artificial Sequence
  Synthetic
atacgccatgctgggtctccagtagcatttattttagcagtagttgtgtggaccatagcatatatagaatatagaaagctggtacatcagaagaaaatagaaaagttattggatagaatacgtacttgggagtcggccat

SEQ ID NO: 412444 - DNA, 140 bp, Artificial Sequence
  Synthetic
atggccgactcccaagtacgtattctatccaataacttttctattttcttctgatgtaccagctttctatattctatatatgctatggtccacacaactactgctaaaataaatgctactggagacccagcatggcgtat

SEQ ID NO: 412445 - DNA, 140 bp, Artificial Sequence
  Synthetic
atacgccatgctgggtctccaaattccctaagaaaaccataatctttactaactcctcaggaggggacccagaaattacaacacttagttttaattgtgcaggagaatttttctattgcacgtacttgggagtcggccat

SEQ ID NO: 412446 - DNA, 140 bp, Artificial Sequence
  Synthetic
atggccgactcccaagtacgtgcaatagaaaaattctcctgcacaattaaaactaagtgttgtaatttctgggtcccctcctgaggagttagtaaagattatggttttcttagggaatttggagacccagcatggcgtat

SEQ ID NO: 412447 - DNA, 140 bp, Artificial Sequence
  Synthetic
aggccctggctgctgatatgagaaattacaacacttagttttaattgtgcaggagaatttttctattgcaatacaacaggcctgtttaatggtacgtggtggaacaatggtacgtggaacgaccttttgggacagcggtg

SEQ ID NO: 412448 - DNA, 140 bp, Artificial Sequence
  Synthetic
caccgctgtcccaaaaggtcgttccacgtaccattgttccaccacgtaccattaaacaggcctgttgtattgcaatagaaaaattctcctgcacaattaaaactaagtgttgtaatttctcatatcagcagccagggcct

SEQ ID NO: 412449 - DNA, 140 bp, Artificial Sequence
  Synthetic
aggccctggctgctgatatgaataaaacaaattataaacatgtggcagagagtaggaagagcaatgtatgcccctcccattgcaggaataataaagtgtacatcaaacattacaggaatagaccttttgggacagcggtg

SEQ ID NO: 412450 - DNA, 140 bp, Artificial Sequence
  Synthetic
caccgctgtcccaaaaggtctattcctgtaatgtttgatgtacactttattattcctgcaatgggaggggcatacattgctcttcctactctctgccacatgtttataatttgttttattcatatcagcagccagggcct

SEQ ID NO: 412451 - DNA, 140 bp, Artificial Sequence
  Synthetic
atacgccatgctgggtctccattacacaaacataatatataggttacttgaagaatcgcaaaaccagcaggaaaagaatgagcaagacttattggcattagacaaatgggcagatttgtgcgtacttgggagtcggccat

SEQ ID NO: 412452 - DNA, 140 bp, Artificial Sequence
  Synthetic
atggccgactcccaagtacgcacaaatctgcccatttgtctaatgccaataagtcttgctcattcttttcctgctggttttgcgattcttcaagtaacctatatattatgtttgtgtaatggagacccagcatggcgtat

SEQ ID NO: 412453 - DNA, 140 bp, Artificial Sequence
  Synthetic
atacgccatgctgggtctcccaacaataatctttgctaatccctcaggaggggatttagaagttacaacacatagttttaattgtggaggagaatttttctattgcaatacatcagccctcgtacttgggagtcggccat

SEQ ID NO: 412454 - DNA, 140 bp, Artificial Sequence
  Synthetic
atggccgactcccaagtacgagggctgatgtattgcaatagaaaaattctcctccacaattaaaactatgtgttgtaacttctaaatcccctcctgagggattagcaaagattattgttgggagacccagcatggcgtat

SEQ ID NO: 412455 - DNA, 140 bp, Artificial Sequence
  Synthetic
aggccctggctgctgatatgtaattggaagaaatctgttgactcagcttggttgcactttaaattttcccattagtcctattgaaactgtaccagtaaaattaaagccaggaatggatgggaccttttgggacagcggtg

SEQ ID NO: 412456 - DNA, 140 bp, Artificial Sequence
  Synthetic
caccgctgtcccaaaaggtcccatccattcctggctttaattttactggtacagtttcaataggactaatgggaaaatttaaagtgcaaccaagctgagtcaacagatttcttccaattacatatcagcagccagggcct

SEQ ID NO: 412457 - DNA, 140 bp, Artificial Sequence
  Synthetic
atacgccatgctgggtctcctgttcaaggtcaaatgatactgatccccgtaataatagaacaattgaggacagcatgaagggagaaataaaaaattgctctttcaatacaaccacagagacgtacttgggagtcggccat

SEQ ID NO: 412458 - DNA, 140 bp, Artificial Sequence
  Synthetic
atggccgactcccaagtacgtctctgtggttgtattgaaagagcaattttttatttctcccttcatgctgtcctcaattgttctattattacggggatcagtatcatttgaccttgaacaggagacccagcatggcgtat

SEQ ID NO: 412459 - DNA, 140 bp, Artificial Sequence
  Synthetic
aggccctggctgctgatatgatcagacagggcttagaaagggctttactataaaatggggggcaagtggtcaaaaaggagcataccaggatggcctgctattagggagagaatgagaagagaccttttgggacagcggtg

SEQ ID NO: 412460 - DNA, 140 bp, Artificial Sequence
  Synthetic
caccgctgtcccaaaaggtctcttctcattctctccctaatagcaggccatcctggtatgctcctttttgaccacttgccccccattttatagtaaagccctttctaagccctgtctgatcatatcagcagccagggcct

SEQ ID NO: 412461 - DNA, 140 bp, Artificial Sequence
  Synthetic
atacgccatgctgggtctccagtaggagcagtgtctcaagatttagctactcatggagcagtcacaagcagtaatacagcagctactaatcctgattgcgcctgggtggaagcgcaagaacgtacttgggagtcggccat

SEQ ID NO: 412462 - DNA, 140 bp, Artificial Sequence
  Synthetic
atggccgactcccaagtacgttcttgcgcttccacccaggcgcaatcaggattagtagctgctgtattactgcttgtgactgctccatgagtagctaaatcttgagacactgctcctactggagacccagcatggcgtat

SEQ ID NO: 412463 - DNA, 140 bp, Artificial Sequence
  Synthetic
atacgccatgctgggtctccggaatgatactaagatctttaatgagaccatggatggaggaataaacatgaaagaagaaatacaaaattgctctttcaatgcaaccacagaaataagggacgtacttgggagtcggccat

SEQ ID NO: 412464 - DNA, 140 bp, Artificial Sequence
  Synthetic
atggccgactcccaagtacgtcccttatttctgtggttgcattgaaagagcaattttgtatttcttctttcatgtttattcctccatccatggtctcattaaagatcttagtatcattccggagacccagcatggcgtat

SEQ ID NO: 412465 - DNA, 140 bp, Artificial Sequence
  Synthetic
atacgccatgctgggtctccgaggagagtgaagtaggcttcccagtcaggccacaggtacctttaaggccaatgaccttcaagggagcgtttgatctcagcttctttttaaaagaaaaggcgtacttgggagtcggccat

SEQ ID NO: 412466 - DNA, 140 bp, Artificial Sequence
  Synthetic
atggccgactcccaagtacgccttttcttttaaaaagaagctgagatcaaacgctcccttgaaggtcattggccttaaaggtacctgtggcctgactgggaagcctacttcactctcctcggagacccagcatggcgtat

SEQ ID NO: 412467 - DNA, 140 bp, Artificial Sequence
  Synthetic
atacgccatgctgggtctccgaagcgaagtaccagggaagttctctcgacgcaagactcggcttgctgaggtgcacacggcaagaggcgagaagcgacggctggtgagtacgcctaaaatcgtacttgggagtcggccat

SEQ ID NO: 412468 - DNA, 140 bp, Artificial Sequence
  Synthetic
atggccgactcccaagtacgattttaggcgtactcaccagccgtcgcttctcgcctcttgccgtgtgcacctcagcaagccgagtcttgcgtcgagagaacttccctggtacttcgcttcggagacccagcatggcgtat

SEQ ID NO: 412469 - DNA, 140 bp, Artificial Sequence
  Synthetic
aggccctggctgctgatatgaacttagatcattatataatacaatagcagtcctctactttgttcatcaaaagatagaggtaaaagacaccaaggaagctctagataaaatagaggaagagaccttttgggacagcggtg

SEQ ID NO: 412470 - DNA, 140 bp, Artificial Sequence
  Synthetic
caccgctgtcccaaaaggtctcttcctctattttatctagagcttccttggtgtcttttacctctatcttttgatgaacaaagtagaggactgctattgtattatataatgatctaagttcatatcagcagccagggcct

SEQ ID NO: 412471 - DNA, 140 bp, Artificial Sequence
  Synthetic
atacgccatgctgggtctcctggaaaggcttttgctataaaatgggtggcaagtggtcaaaacgtagtgtgtttggatggtctgctataagggaaagaatgagacgagctgagccagcagcgtacttgggagtcggccat

SEQ ID NO: 412472 - DNA, 140 bp, Artificial Sequence
  Synthetic
atggccgactcccaagtacgctgctggctcagctcgtctcattctttcccttatagcagaccatccaaacacactacgttttgaccacttgccacccattttatagcaaaagcctttccaggagacccagcatggcgtat

SEQ ID NO: 412473 - DNA, 140 bp, Artificial Sequence
  Synthetic
atacgccatgctgggtctccacgtagcacagtgggatggccagctgtaagggaaagaatagcagcaacaggagtaggagcagtatctcaagatttagataggcatggagccgtcacaagccgtacttgggagtcggccat

SEQ ID NO: 412474 - DNA, 140 bp, Artificial Sequence
  Synthetic
atggccgactcccaagtacggcttgtgacggctccatgcctatctaaatcttgagatactgctcctactcctgttgctgctattctttcccttacagctggccatcccactgtgctacgtggagacccagcatggcgtat

SEQ ID NO: 412475 - DNA, 140 bp, Artificial Sequence
  Synthetic
aggccctggctgctgatatgataaaacaagggccaaaagaaccctttagagactatgtagataggttctttaaaactctcagagctgagcaagctacacaggaggtaaaaaattggatgagaccttttgggacagcggtg

SEQ ID NO: 412476 - DNA, 140 bp, Artificial Sequence
  Synthetic
caccgctgtcccaaaaggtctcatccaattttttacctcctgtgtagcttgctcagctctgagagttttaaagaacctatctacatagtctctaaagggttcttttggcccttgttttatcatatcagcagccagggcct

SEQ ID NO: 412477 - DNA, 140 bp, Artificial Sequence
  Synthetic
atacgccatgctgggtctcccagatacagccagctcttcagacaggaacagaagaaattaaatcgttatttaatctagtagcagtcctctattgtgtacatcagaaaatagaggtacaagcgtacttgggagtcggccat

SEQ ID NO: 412478 - DNA, 140 bp, Artificial Sequence
  Synthetic
atggccgactcccaagtacgcttgtacctctattttctgatgtacacaatagaggactgctactagattaaataacgatttaatttcttctgttcctgtctgaagagctggctgtatctgggagacccagcatggcgtat

SEQ ID NO: 412479 - DNA, 140 bp, Artificial Sequence
  Synthetic
aggccctggctgctgatatgtaatctagtagcagtcctctattgtgtacatcagaaaatagaggtacaagataccagtgaagctttaaataaggtaaaggagatacagaacaagaaccaggaccttttgggacagcggtg

SEQ ID NO: 412480 - DNA, 140 bp, Artificial Sequence
  Synthetic
caccgctgtcccaaaaggtcctggttcttgttctgtatctcctttaccttatttaaagcttcactggtatcttgtacctctattttctgatgtacacaatagaggactgctactagattacatatcagcagccagggcct

SEQ ID NO: 412481 - DNA, 140 bp, Artificial Sequence
  Synthetic
aggccctggctgctgatatgaataagacagggctttgaagcagctttgctataaaatggggagcaagttatcaaagagcagaatagttggatggcccgctataagagaaagaataagaaggaccttttgggacagcggtg

SEQ ID NO: 412482 - DNA, 140 bp, Artificial Sequence
  Synthetic
caccgctgtcccaaaaggtccttcttattctttctcttatagcgggccatccaactattctgctctttgataacttgctccccattttatagcaaagctgcttcaaagccctgtcttattcatatcagcagccagggcct

SEQ ID NO: 412483 - DNA, 140 bp, Artificial Sequence
  Synthetic
atacgccatgctgggtctccgagctatctgcaacatacctagaagaataagacagggctttgaagcagctttgctataaaatggggaacaagtggtcaaaaagctggcctgctgtgagagcgtacttgggagtcggccat

SEQ ID NO: 412484 - DNA, 140 bp, Artificial Sequence
  Synthetic
atggccgactcccaagtacgctctcacagcaggccagctttttgaccacttgttccccattttatagcaaagctgcttcaaagccctgtcttattcttctaggtatgttgcagatagctcggagacccagcatggcgtat

SEQ ID NO: 412485 - DNA, 140 bp, Artificial Sequence
  Synthetic
aggccctggctgctgatatgcacagcccaaaataatcctgattgtgcctggctggaagcacaagaggaggaagaagtaggctttccagtcagaccccaggtgcctttaagaccaatgaccgaccttttgggacagcggtg

SEQ ID NO: 412486 - DNA, 140 bp, Artificial Sequence
  Synthetic
caccgctgtcccaaaaggtcggtcattggtcttaaaggcacctggggtctgactggaaagcctacttcttcctcctcttgtgcttccagccaggcacaatcaggattattttgggctgtgcatatcagcagccagggcct

SEQ ID NO: 412487 - DNA, 140 bp, Artificial Sequence
  Synthetic
aggccctggctgctgatatgggcttaggcatctcctatggcaggaagaagcggagacaacgacgcagacctcctcaaagcagtcaaatacatcaagatcctgtaccaaagcagtaagtatgaccttttgggacagcggtg

SEQ ID NO: 412488 - DNA, 140 bp, Artificial Sequence
  Synthetic
caccgctgtcccaaaaggtcatacttactgctttggtacaggatcttgatgtatttgactgctttgaggaggtctgcgtcgttgtctccgcttcttcctgccataggagatgcctaagcccatatcagcagccagggcct

SEQ ID NO: 412489 - DNA, 140 bp, Artificial Sequence
  Synthetic
atacgccatgctgggtctcccaccctgctgaaggaagagacaggggcaatacaaaactgttctttcaatatgaccacagaaataagagacaagcagaaaaaagtacatgcacttttttatcgtacttgggagtcggccat

SEQ ID NO: 412490 - DNA, 140 bp, Artificial Sequence
  Synthetic
atggccgactcccaagtacgataaaaaagtgcatgtacttttttctgcttgtctcttatttctgtggtcatattgaaagaacagttttgtattgcccctgtctcttccttcagcagggtgggagacccagcatggcgtat

SEQ ID NO: 412491 - DNA, 140 bp, Artificial Sequence
  Synthetic
atacgccatgctgggtctcccagtggaatatacaggctaatacattgtaatacctcaaccattacacaggcttgtccaaaggtatcttgggatccaattcccatacattattgtgctccacgtacttgggagtcggccat

SEQ ID NO: 412492 - DNA, 140 bp, Artificial Sequence
  Synthetic
atggccgactcccaagtacgtggagcacaataatgtatgggaattggatcccaagatacctttggacaagcctgtgtaatggttgaggtattacaatgtattagcctgtatattccactgggagacccagcatggcgtat

SEQ ID NO: 412493 - DNA, 140 bp, Artificial Sequence
  Synthetic
atacgccatgctgggtctccgaaaaggtatatcgataggaccagggcgaacattttatgcaacagaaaaaataataggagacatcagaaaggcacattgtaacattagtagaacacaatgcgtacttgggagtcggccat

SEQ ID NO: 412494 - DNA, 140 bp, Artificial Sequence
  Synthetic
atggccgactcccaagtacgcattgtgttctactaatgttacaatgtgcctttctgatgtctcctattattttttctgttgcataaaatgttcgccctggtcctatcgatataccttttcggagacccagcatggcgtat

SEQ ID NO: 412495 - DNA, 140 bp, Artificial Sequence
  Synthetic
atacgccatgctgggtctccatcagttagaaacagaacccatagtaggagcagaaacttactatgtagatggggcagctaatagggaaactaaaatagggagagcaggatatgtcactgacgtacttgggagtcggccat

SEQ ID NO: 412496 - DNA, 140 bp, Artificial Sequence
  Synthetic
atggccgactcccaagtacgtcagtgacatatcctgctctccctattttagtttccctattagctgccccatctacatagtaagtttctgctcctactatgggttctgtttctaactgatggagacccagcatggcgtat

SEQ ID NO: 412497 - DNA, 140 bp, Artificial Sequence
  Synthetic
aggccctggctgctgatatggaatctgtaacaattaattgtacaagacccaacaacaatacaagaaaaggtatacatataggaccagggagagcattttatacaacaggagaaataataggaccttttgggacagcggtg

SEQ ID NO: 412498 - DNA, 140 bp, Artificial Sequence
  Synthetic
caccgctgtcccaaaaggtcctattatttctcctgttgtataaaatgctctccctggtcctatatgtataccttttcttgtattgttgttgggtcttgtacaattaattgttacagattccatatcagcagccagggcct

SEQ ID NO: 412499 - DNA, 140 bp, Artificial Sequence
  Synthetic
  misc_feature (35)..(35): n is a, c, g, or t
  misc_feature (44)..(44): n is a, c, g, or t
  misc_feature (74)..(74): n is a, c, g, or t
  misc_feature (80)..(80): n is a, c, g, or t
aggccctggctgctgatatggggacaattagatanatgggaganaattcggttacggccagggggaaagaaganatatanattaaaacatatagtatgggcaagcagggagctagaaagagaccttttgggacagcggtg

SEQ ID NO: 412500 - DNA, 140 bp, Artificial Sequence
  Synthetic
  misc_feature (61)..(61): n is a, c, g, or t
  misc_feature (67)..(67): n is a, c, g, or t
  misc_feature (97)..(97): n is a, c, g, or t
  misc_feature (106)..(106): n is a, c, g, or t
caccgctgtcccaaaaggtctctttctagctccctgcttgcccatactatatgttttaatntatatntcttctttccccctggccgtaaccgaattntctcccatntatctaattgtccccatatcagcagccagggcct

SEQ ID NO: 412501 - DNA, 140 bp, Artificial Sequence
  Synthetic
aggccctggctgctgatatgcggatcatcaaaatcctgtaccaaagcagtaagtagtagtaatcaatataggtaatgtcacctttagcaatactgtcaatagtaggactggtagtagcatgaccttttgggacagcggtg

SEQ ID NO: 412502 - DNA, 140 bp, Artificial Sequence
  Synthetic
caccgctgtcccaaaaggtcatgctactaccagtcctactattgacagtattgctaaaggtgacattacctatattgattactactacttactgctttggtacaggattttgatgatccgcatatcagcagccagggcct

SEQ ID NO: 412503 - DNA, 140 bp, Artificial Sequence
  Synthetic
atacgccatgctgggtctccactcatccaaagataagttcagaagtacacattccattaggggaagctaggttagtcataataacatactggggtctgaatacaggagaaagagactggccgtacttgggagtcggccat

SEQ ID NO: 412504 - DNA, 140 bp, Artificial Sequence
  Synthetic
atggccgactcccaagtacggccagtctctttctcctgtattcagaccccagtatgttattatgactaacctagcttcccctaatggaatgtgtacttctgaacttatctttggatgagtggagacccagcatggcgtat

SEQ ID NO: 412505 - DNA, 140 bp, Artificial Sequence
  Synthetic
atacgccatgctgggtctccattaagaagcaaaggaaaatagactggttacttgagagaataagtgaaagagcagaagacagtggcaacgagagtgatggggacacagaggaattgtcaacgtacttgggagtcggccat

SEQ ID NO: 412506 - DNA, 140 bp, Artificial Sequence
  Synthetic
atggccgactcccaagtacgttgacaattcctctgtgtccccatcactctcgttgccactgtcttctgctctttcacttattctctcaagtaaccagtctattttcctttgcttcttaatggagacccagcatggcgtat

SEQ ID NO: 412507 - DNA, 140 bp, Artificial Sequence
  Synthetic
atacgccatgctgggtctccggctgcagatttgtgggtcacagtatactatggagtacctgtgtggagagatgcagataccaccctattttgtgcatcagacgctaaagcatatgctacacgtacttgggagtcggccat

SEQ ID NO: 412508 - DNA, 140 bp, Artificial Sequence
  Synthetic
atggccgactcccaagtacgtgtagcatatgctttagcgtctgatgcacaaaatagggtggtatctgcatctctccacacaggtactccatagtatactgtgacccacaaatctgcagccggagacccagcatggcgtat

SEQ ID NO: 412509 - DNA, 140 bp, Artificial Sequence
  Synthetic
aggccctggctgctgatatggggtgggagcagtgtctcaagacttagaaagacggggggcaattacaagcaacaataccagtgctaataatcctgccttggcctggctggaagcacaagagaccttttgggacagcggtg

SEQ ID NO: 412510 - DNA, 140 bp, Artificial Sequence
  Synthetic
caccgctgtcccaaaaggtctcttgtgcttccagccaggccaaggcaggattattagcactggtattgttgcttgtaattgccccccgtctttctaagtcttgagacactgctcccaccccatatcagcagccagggcct

SEQ ID NO: 412511 - DNA, 140 bp, Artificial Sequence
  Synthetic
aggccctggctgctgatatgaagagcttaagagtgaagctgtcaggcattttcctcgtgcatggctccaccaactaggacagtatatctataatacctatggggatacctggagaggagtgaccttttgggacagcggtg

SEQ ID NO: 412512 - DNA, 140 bp, Artificial Sequence
  Synthetic
caccgctgtcccaaaaggtcactcctctccaggtatccccataggtattatagatatactgtcctagttggtggagccatgcacgaggaaaatgcctgacagcttcactcttaagctcttcatatcagcagccagggcct

SEQ ID NO: 412513 - DNA, 140 bp, Artificial Sequence
  Synthetic
aggccctggctgctgatatgttgtagcaatgccaacaccactaacaccaatagcactgaagaaataaaaaactgctcttacaatatgcccacagaactaaaagataaaacacagaaagtcgaccttttgggacagcggtg

SEQ ID NO: 412514 - DNA, 140 bp, Artificial Sequence
  Synthetic
caccgctgtcccaaaaggtcgactttctgtgttttatcttttagttctgtgggcatattgtaagagcagttttttatttcttcagtgctattggtgttagtggtgttggcattgctacaacatatcagcagccagggcct

SEQ ID NO: 412515 - DNA, 140 bp, Artificial Sequence
  Synthetic
aggccctggctgctgatatgtcgggtgccaacatagcagaataggcattactcggcaaagaagagtaaggaatggacccagtagatcctaaactagagccctggaaccatccaggaagtcgaccttttgggacagcggtg

SEQ ID NO: 412516 - DNA, 140 bp, Artificial Sequence
  Synthetic
caccgctgtcccaaaaggtcgacttcctggatggttccagggctctagtttaggatctactgggtccattccttactcttctttgccgagtaatgcctattctgctatgttggcacccgacatatcagcagccagggcct

SEQ ID NO: 412517 - DNA, 140 bp, Artificial Sequence
  Synthetic
aggccctggctgctgatatgaatggacccagtagatcctaaactagagccctggaaccatccaggaagtcaacccaaaactgcttgtaacggctgttattgtaaaaattgctgctatcatgaccttttgggacagcggtg

SEQ ID NO: 412518 - DNA, 140 bp, Artificial Sequence
  Synthetic
caccgctgtcccaaaaggtcatgatagcagcaatttttacaataacagccgttacaagcagttttgggttgacttcctggatggttccagggctctagtttaggatctactgggtccattcatatcagcagccagggcct

SEQ ID NO: 412519 - DNA, 140 bp, Artificial Sequence
  Synthetic
atacgccatgctgggtctccagcccttcaaacaggaacagaagagcttaggtcattatataacacaatagtggtcctgtattatgtacatcaaaggatagatataaaggacaccaaagatcgtacttgggagtcggccat

SEQ ID NO: 412520 - DNA, 140 bp, Artificial Sequence
  Synthetic
atggccgactcccaagtacgatctttggtgtcctttatatctatcctttgatgtacataatacaggaccactattgtgttatataatgacctaagctcttctgttcctgtttgaagggctggagacccagcatggcgtat

SEQ ID NO: 412521 - DNA, 140 bp, Artificial Sequence
  Synthetic
aggccctggctgctgatatgatcctataccaaagcagtaagtaccataaatgtacatattaggaataggaataggagcgctaatagtagcaggtatcttatgtataatagtgtggactatgaccttttgggacagcggtg

SEQ ID NO: 412522 - DNA, 140 bp, Artificial Sequence
  Synthetic
caccgctgtcccaaaaggtcatagtccacactattatacataagatacctgctactattagcgctcctattcctattcctaatatgtacatttatggtacttactgctttggtataggatcatatcagcagccagggcct

SEQ ID NO: 412523 - DNA, 140 bp, Artificial Sequence
  Synthetic
atacgccatgctgggtctccatacaagaaaaagtatacgctttggaccaggacaggccttctatacaaataataacataataggggatataagacaagcacattgtaatatcagcataaccgtacttgggagtcggccat

SEQ ID NO: 412524 - DNA, 140 bp, Artificial Sequence
  Synthetic
atggccgactcccaagtacggttatgctgatattacaatgtgcttgtcttatatcccctattatgttattatttgtatagaaggcctgtcctggtccaaagcgtatactttttcttgtatggagacccagcatggcgtat

SEQ ID NO: 412525 - DNA, 140 bp, Artificial Sequence
  Synthetic
atacgccatgctgggtctcctccctaataaaacaataatctttaatagctcctcaggaggggacctagaaattacaacacatagttttaattgtggaggagaatttttctattgcaataccgtacttgggagtcggccat

SEQ ID NO: 412526 - DNA, 140 bp, Artificial Sequence
  Synthetic
atggccgactcccaagtacggtattgcaatagaaaaattctcctccacaattaaaactatgtgttgtaatttctaggtcccctcctgaggagctattaaagattattgttttattagggaggagacccagcatggcgtat

SEQ ID NO: 412527 - DNA, 140 bp, Artificial Sequence
  Synthetic
aggccctggctgctgatatgggtcatggagtctccatagaatggagattgagaagatatagcacacaagtagaccctggcctggcagaccagctaattcatatgcattattttgattgttgaccttttgggacagcggtg

SEQ ID NO: 412528 - DNA, 140 bp, Artificial Sequence
  Synthetic
caccgctgtcccaaaaggtcaacaatcaaaataatgcatatgaattagctggtctgccaggccagggtctacttgtgtgctatatcttctcaatctccattctatggagactccatgacccatatcagcagccagggcct

SEQ ID NO: 412529 - DNA, 140 bp, Artificial Sequence
  Synthetic
aggccctggctgctgatatgcagagaagagcaagaaatggagccaatagatcctaacctagagccctggaaccatccaggaagtcagcctataactccttgtaataaatgctattgtaaagaccttttgggacagcggtg

SEQ ID NO: 412530 - DNA, 140 bp, Artificial Sequence
  Synthetic
caccgctgtcccaaaaggtctttacaatagcatttattacaaggagttataggctgacttcctggatggttccagggctctaggttaggatctattggctccatttcttgctcttctctgcatatcagcagccagggcct

SEQ ID NO: 412531 - DNA, 140 bp, Artificial Sequence
  Synthetic
atacgccatgctgggtctccctgctctttcaatgtaactacagcaataagggataggaagaagaaagtacaggcactcttttatagaattgatgtagtaccaattaatgatgaagattatcgtacttgggagtcggccat

SEQ ID NO: 412532 - DNA, 140 bp, Artificial Sequence
  Synthetic
atggccgactcccaagtacgataatcttcatcattaattggtactacatcaattctataaaagagtgcctgtactttcttcttcctatcccttattgctgtagttacattgaaagagcagggagacccagcatggcgtat

SEQ ID NO: 412533 - DNA, 140 bp, Artificial Sequence
  Synthetic
aggccctggctgctgatatggctcctaggaatttggggctgctctggaaaactcatctgcgccactgatgtgagatggaactctagttggagtaataagactcaggagcagatttggaaagaccttttgggacagcggtg

SEQ ID NO: 412534 - DNA, 140 bp, Artificial Sequence
  Synthetic
caccgctgtcccaaaaggtctttccaaatctgctcctgagtcttattactccaactagagttccatctcacatcagtggcgcagatgagttttccagagcagccccaaattcctaggagccatatcagcagccagggcct

SEQ ID NO: 412535 - DNA, 140 bp, Artificial Sequence
  Synthetic
atacgccatgctgggtctcccagaccaaacaataatacaagaaaaggtatacatatagggccaggacaagcattctatgtaacaggtgaagtcataggaaacataagacaagcacattgtcgtacttgggagtcggccat

SEQ ID NO: 412536 - DNA, 140 bp, Artificial Sequence
  Synthetic
atggccgactcccaagtacgacaatgtgcttgtcttatgtttcctatgacttcacctgttacatagaatgcttgtcctggccctatatgtataccttttcttgtattattgtttggtctgggagacccagcatggcgtat

SEQ ID NO: 412537 - DNA, 140 bp, Artificial Sequence
  Synthetic
atacgccatgctgggtctccattaagaaagcactttaataaaacaataatttttgaaccatcttcaggaggggatatagagattacatcacatacttttaattgtggaggagaatttttccgtacttgggagtcggccat

SEQ ID NO: 412538 - DNA, 140 bp, Artificial Sequence
  Synthetic
atggccgactcccaagtacggaaaaattctcctccacaattaaaagtatgtgatgtaatctctatatcccctcctgaagatggttcaaaaattattgttttattaaagtgctttcttaatggagacccagcatggcgtat

SEQ ID NO: 412539 - DNA, 140 bp, Artificial Sequence
  Synthetic
aggccctggctgctgatatgaaaatagataggttaattgaaagaattagggaaagagcagaagacagtggcaatgagagtgagggggatactgaggaattgtccacaatggtggatatgggaccttttgggacagcggtg

SEQ ID NO: 412540 - DNA, 140 bp, Artificial Sequence
  Synthetic
caccgctgtcccaaaaggtcccatatccaccattgtggacaattcctcagtatccccctcactctcattgccactgtcttctgctctttccctaattctttcaattaacctatctattttcatatcagcagccagggcct

SEQ ID NO: 412541 - DNA, 140 bp, Artificial Sequence
  Synthetic
atacgccatgctgggtctccaaactgtacagatgcacaagttaatgctaccaaaaataataccctccctaatgacagggaaggaggcatgaaaaactgctctttcaatacaaccacagaacgtacttgggagtcggccat

SEQ ID NO: 412542 - DNA, 140 bp, Artificial Sequence
  Synthetic
atggccgactcccaagtacgttctgtggttgtattgaaagagcagtttttcatgcctccttccctgtcattagggagggtattatttttggtagcattaacttgtgcatctgtacagtttggagacccagcatggcgtat

SEQ ID NO: 412543 - DNA, 140 bp, Artificial Sequence
  Synthetic
atacgccatgctgggtctcctaataatgctaccattgatggtgccatgaaggaaggaatgaaaaattgctctttcaatacaaccacagaagtaagagataagaaaaacaaacagtatgtacgtacttgggagtcggccat

SEQ ID NO: 412544 - DNA, 140 bp, Artificial Sequence
  Synthetic
atggccgactcccaagtacgtacatactgtttgtttttcttatctcttacttctgtggttgtattgaaagagcaatttttcattccttccttcatggcaccatcaatggtagcattattaggagacccagcatggcgtat

SEQ ID NO: 412545 - DNA, 140 bp, Artificial Sequence
  Synthetic
atacgccatgctgggtctcctcgaaagggcgttactataaaatggggggcaagtggtcaaaaagaaccatagtgggatggcctgagattagggaaagaatgagacgaactcctccagcagcgtacttgggagtcggccat

SEQ ID NO: 412546 - DNA, 140 bp, Artificial Sequence
  Synthetic
atggccgactcccaagtacgctgctggaggagttcgtctcattctttccctaatctcaggccatcccactatggttctttttgaccacttgccccccattttatagtaacgccctttcgaggagacccagcatggcgtat

SEQ ID NO: 412547 - DNA, 140 bp, Artificial Sequence
  Synthetic
aggccctggctgctgatatggacccggcaataatacaagaaaaagtataaggataggaccaggacaaacattctatgcaaatgacataataggagacataagacaagcacattgtaacatgaccttttgggacagcggtg

SEQ ID NO: 412548 - DNA, 140 bp, Artificial Sequence
  Synthetic
caccgctgtcccaaaaggtcatgttacaatgtgcttgtcttatgtctcctattatgtcatttgcatagaatgtttgtcctggtcctatccttatactttttcttgtattattgccgggtccatatcagcagccagggcct

SEQ ID NO: 412549 - DNA, 140 bp, Artificial Sequence
  Synthetic
  misc_feature (43)..(43): n is a, c, g, or t
  misc_feature (87)..(87): n is a, c, g, or t
aggccctggctgctgatatggaatgaacaagacttattatcantggacaaatggtcaagcctatggaattggtttgatatatcaaantggctgtggtatataaaaatattcataatggtagaccttttgggacagcggtg

SEQ ID NO: 412550 - DNA, 140 bp, Artificial Sequence
  Synthetic
  misc_feature (54)..(54): n is a, c, g, or t
  misc_feature (98)..(98): n is a, c, g, or t
caccgctgtcccaaaaggtctaccattatgaatatttttatataccacagccantttgatatatcaaaccaattccataggcttgaccatttgtccantgataataagtcttgttcattccatatcagcagccagggcct

SEQ ID NO: 412551 - DNA, 140 bp, Artificial Sequence
  Synthetic
atacgccatgctgggtctccaaatagtgttaggcagggatactcacctttgtcgtttcagacccttaccccgaacgcgcggagacccgacaggcccgaaggaatagaagaagaaggtggccgtacttgggagtcggccat

SEQ ID NO: 412552 - DNA, 140 bp, Artificial Sequence
  Synthetic
atggccgactcccaagtacggccaccttcttcttctattccttcgggcctgtcgggtctccgcgcgttcggggtaagggtctgaaacgacaaaggtgagtatccctgcctaacactatttggagacccagcatggcgtat

SEQ ID NO: 412553 - DNA, 140 bp, Artificial Sequence
  Synthetic
  misc_feature (46)..(46): n is a, c, g, or t
atacgccatgctgggtctcctagctgagggaacagataggattatngaactagtgcaaagagctgggagagctattatccacatacctagaagaataagacagggctttgaaagggctttcgtacttgggagtcggccat

SEQ ID NO: 412554 - DNA, 140 bp, Artificial Sequence
  Synthetic
  misc_feature (95)..(95): n is a, c, g, or t
atggccgactcccaagtacgaaagccctttcaaagccctgtcttattcttctaggtatgtggataatagctctcccagctctttgcactagttcnataatcctatctgttccctcagctaggagacccagcatggcgtat

SEQ ID NO: 412555 - DNA, 140 bp, Artificial Sequence
  Synthetic
  misc_feature (24)..(24): n is a, c, g, or t
  misc_feature (63)..(63): n is a, c, g, or t
  misc_feature (95)..(95): n is a, c, g, or t
  misc_feature (98)..(98): n is a, c, g, or t
atacgccatgctgggtctcctagnataagggaaagaataaggcgcgctgagccagcagcaganggggtaggaccagtatctcgagatttggatanacntggagcagtcacaatcaataatcgtacttgggagtcggccat

SEQ ID NO: 412556 - DNA, 140 bp, Artificial Sequence
  Synthetic
  misc_feature (43)..(43): n is a, c, g, or t
  misc_feature (46)..(46): n is a, c, g, or t
  misc_feature (78)..(78): n is a, c, g, or t
  misc_feature (117)..(117): n is a, c, g, or t
atggccgactcccaagtacgattattgattgtgactgctccangtntatccaaatctcgagatactggtcctaccccntctgctgctggctcagcgcgccttattctttcccttatnctaggagacccagcatggcgtat

SEQ ID NO: 412557 - DNA, 140 bp, Artificial Sequence
  Synthetic
aggccctggctgctgatatggaggaagtaggctttccagtcagacctcaggtacctttaagaccaatgacctataagggagctttggatctcagccactttttaaaagaaaaggggggacgaccttttgggacagcggtg

SEQ ID NO: 412558 - DNA, 140 bp, Artificial Sequence
  Synthetic
caccgctgtcccaaaaggtcgtccccccttttcttttaaaaagtggctgagatccaaagctcccttataggtcattggtcttaaaggtacctgaggtctgactggaaagcctacttcctccatatcagcagccagggcct

SEQ ID NO: 412559 - DNA, 140 bp, Artificial Sequence
  Synthetic
  misc_feature (24)..(24): n is a, c, g, or t
  misc_feature (32)..(32): n is a, c, g, or t
  misc_feature (88)..(88): n is a, c, g, or t
atacgccatgctgggtctcctganatatacangttgcttgaaatctcacaaaaccagcaggaaaagaatgaacaagacttattatcantggacaaatggtcaagcctatggaattggtttcgtacttgggagtcggccat

SEQ ID NO: 412560 - DNA, 140 bp, Artificial Sequence
  Synthetic
  misc_feature (53)..(53): n is a, c, g, or t
  misc_feature (109)..(109): n is a, c, g, or t
  misc_feature (117)..(117): n is a, c, g, or t
atggccgactcccaagtacgaaaccaattccataggcttgaccatttgtccantgataataagtcttgttcattcttttcctgctggttttgtgagatttcaagcaacntgtatatntcaggagacccagcatggcgtat

SEQ ID NO: 412561 - DNA, 140 bp, Artificial Sequence
  Synthetic
atacgccatgctgggtctcccagaagaacttaaatcattatttaatctagtagcagtcctctattgcgtacatcgaaaaatagatgtgaaagacaccaaggaggctttagataagatagacgtacttgggagtcggccat

SEQ ID NO: 412562 - DNA, 140 bp, Artificial Sequence
  Synthetic
atggccgactcccaagtacgtctatcttatctaaagcctccttggtgtctttcacatctatttttcgatgtacgcaatagaggactgctactagattaaataatgatttaagttcttctgggagacccagcatggcgtat

SEQ ID NO: 412563 - DNA, 140 bp, Artificial Sequence
  Synthetic
aggccctggctgctgatatgaccagtgctgcagttaaggcagcctgttggtgggcaggtatccagcaggaatttggaattccctacaatccccaaagtcaaggagtagtagaatctatgagaccttttgggacagcggtg

SEQ ID NO: 412564 - DNA, 140 bp, Artificial Sequence
  Synthetic
caccgctgtcccaaaaggtctcatagattctactactccttgactttggggattgtagggaattccaaattcctgctggatacctgcccaccaacaggctgccttaactgcagcactggtcatatcagcagccagggcct

SEQ ID NO: 412565 - DNA, 140 bp, Artificial Sequence
  Synthetic
atacgccatgctgggtctcctggacactagagcttttagaggagcttaaaattgaagctgtcagacattttcctagggtgtggctacatggcttagggcaacatatctatgaaacttatgcgtacttgggagtcggccat

SEQ ID NO: 412566 - DNA, 140 bp, Artificial Sequence
  Synthetic
atggccgactcccaagtacgcataagtttcatagatatgttgccctaagccatgtagccacaccctaggaaaatgtctgacagcttcaattttaagctcctctaaaagctctagtgtccaggagacccagcatggcgtat

SEQ ID NO: 412567 - DNA, 140 bp, Artificial Sequence
  Synthetic
aggccctggctgctgatatgtccaaaggtatcctttgagccaattcccatacattattgtaccccggctggttttgcgcttctaaagtgtaatgataagaagttcaatggaacaggaccagaccttttgggacagcggtg

SEQ ID NO: 412568 - DNA, 140 bp, Artificial Sequence
  Synthetic
caccgctgtcccaaaaggtctggtcctgttccattgaacttcttatcattacactttagaagcgcaaaaccagccggggtacaataatgtatgggaattggctcaaaggatacctttggacatatcagcagccagggcct

SEQ ID NO: 412569 - DNA, 140 bp, Artificial Sequence
  Synthetic
aggccctggctgctgatatgccctcaaatcactctttggcaacgaccccttgtcacagtaaaaatagaaggacagctgaaagaagctctattagatacaggagcagatgatacagtgttagaccttttgggacagcggtg

SEQ ID NO: 412570 - DNA, 140 bp, Artificial Sequence
  Synthetic
caccgctgtcccaaaaggtctaacactgtatcatctgctcctgtatctaatagagcttctttcagctgtccttctatttttactgtgacaaggggtcgttgccaaagagtgatttgagggcatatcagcagccagggcct

SEQ ID NO: 412571 - DNA, 140 bp, Artificial Sequence
  Synthetic
aggccctggctgctgatatgtggccttccagcaaagggaggccaggaaattttctccagagcaggccagaaccaacagccccaccagcagagagcttcgggttcggagaggagatgacccgaccttttgggacagcggtg

SEQ ID NO: 412572 - DNA, 140 bp, Artificial Sequence
  Synthetic
caccgctgtcccaaaaggtcgggtcatctcctctccgaacccgaagctctctgctggtggggctgttggttctggcctgctctggagaaaatttcctggcctccctttgctggaaggccacatatcagcagccagggcct

SEQ ID NO: 412573 - DNA, 140 bp, Artificial Sequence
  Synthetic
aggccctggctgctgatatgatatcctttgatccaattcctatacattattgtactccagctggttatgcgattttaaagtgtaatgataaaaatttcactgggacagggctatgtaaaagaccttttgggacagcggtg

SEQ ID NO: 412574 - DNA, 140 bp, Artificial Sequence
  Synthetic
caccgctgtcccaaaaggtcttttacatagccctgtcccagtgaaatttttatcattacactttaaaatcgcataaccagctggagtacaataatgtataggaattggatcaaaggatatcatatcagcagccagggcct

SEQ ID NO: 412575 - DNA, 140 bp, Artificial Sequence
  Synthetic
aggccctggctgctgatatgtgtaacaaatgctattgtaaacgatgttgctttcattgtcaatggtgctttacaacgaagggcttaggcatctcctatggcaggaagaagcggagacagcgaccttttgggacagcggtg

SEQ ID NO: 412576 - DNA, 140 bp, Artificial Sequence
  Synthetic
caccgctgtcccaaaaggtcgctgtctccgcttcttcctgccataggagatgcctaagcccttcgttgtaaagcaccattgacaatgaaagcaacatcgtttacaatagcatttgttacacatatcagcagccagggcct

SEQ ID NO: 412577 - DNA, 140 bp, Artificial Sequence
  Synthetic
aggccctggctgctgatatgttagtcctattgaaactgtaccagtaaaattaaagccaggaatggatggcccaaaggttaaacaatggccattgacagaagaaaaaataaaagcattaacgaccttttgggacagcggtg

SEQ ID NO: 412578 - DNA, 140 bp, Artificial Sequence
  Synthetic
caccgctgtcccaaaaggtcgttaatgcttttattttttcttctgtcaatggccattgtttaacctttgggccatccattcctggctttaattttactggtacagtttcaataggactaacatatcagcagccagggcct

SEQ ID NO: 412579 - DNA, 140 bp, Artificial Sequence
  Synthetic
atacgccatgctgggtctccaagaaaagcatattgtaccattaatcaaacaaaatggaataacatgctaaaacaagtagttggaaaattaagagaacaatttcagaataaaacaatagtccgtacttgggagtcggccat

SEQ ID NO: 412580 - DNA, 140 bp, Artificial Sequence
  Synthetic
atggccgactcccaagtacggactattgttttattctgaaattgttctcttaattttccaactacttgttttagcatgttattccattttgtttgattaatggtacaatatgcttttcttggagacccagcatggcgtat

SEQ ID NO: 412581 - DNA, 140 bp, Artificial Sequence
  Synthetic
atacgccatgctgggtctccttgtggaggggagtttttctactgcaattcaacacaactgtttaacagtacttggaatagtactgaagaggcaaataacaatacaggaaataacccaatccgtacttgggagtcggccat

SEQ ID NO: 412582 - DNA, 140 bp, Artificial Sequence
  Synthetic
atggccgactcccaagtacggattgggttatttcctgtattgttatttgcctcttcagtactattccaagtactgttaaacagttgtgttgaattgcagtagaaaaactcccctccacaaggagacccagcatggcgtat

SEQ ID NO: 412583 - DNA, 140 bp, Artificial Sequence
  Synthetic
  misc_feature (55)..(55): n is a, c, g, or t
  misc_feature (115)..(115): n is a, c, g, or t
atacgccatgctgggtctccatactcccatgtagaataagacaaattgtaaacangtggcagaaggtaggaaaagcaatgtatgcccctcccatccgaggagtaattaactgttnatcaacgtacttgggagtcggccat

SEQ ID NO: 412584 - DNA, 140 bp, Artificial Sequence
  Synthetic
  misc_feature (26)..(26): n is a, c, g, or t
  misc_feature (86)..(86): n is a, c, g, or t
atggccgactcccaagtacgttgatnaacagttaattactcctcggatgggaggggcatacattgcttttcctaccttctgccacntgtttacaatttgtcttattctacatgggagtatggagacccagcatggcgtat

SEQ ID NO: 412585 - DNA, 140 bp, Artificial Sequence
  Synthetic
aggccctggctgctgatatgtgatttgtatgtaggatctgacttagaaatagggcaacatagagcaaaaatagaggagttaagagctcatttgttgaaatggggatttaccacaccagacgaccttttgggacagcggtg

SEQ ID NO: 412586 - DNA, 140 bp, Artificial Sequence
  Synthetic
caccgctgtcccaaaaggtcgtctggtgtggtaaatccccatttcaacaaatgagctcttaactcctctatttttgctctatgttgccctatttctaagtcagatcctacatacaaatcacatatcagcagccagggcct

SEQ ID NO: 412587 - DNA, 140 bp, Artificial Sequence
  Synthetic
atacgccatgctgggtctccaggaaaatagcaccctgaaggaagacccaggggaaatacaagactgtactttcaatgtgaccacagaaataagagataagaagcagaaagtacgggcactcgtacttgggagtcggccat

SEQ ID NO: 412588 - DNA, 140 bp, Artificial Sequence
  Synthetic
atggccgactcccaagtacgagtgcccgtactttctgcttcttatctcttatttctgtggtcacattgaaagtacagtcttgtatttcccctgggtcttccttcagggtgctattttcctggagacccagcatggcgtat

SEQ ID NO: 412589 - DNA, 140 bp, Artificial Sequence
  Synthetic
aggccctggctgctgatatgatacagcagctaacaatgctgcttgtgcctggctagaagcacaagaggaggaggaggtgggttttccagtcagacctcaggtacctttaagaccaatgacgaccttttgggacagcggtg

SEQ ID NO: 412590 - DNA, 140 bp, Artificial Sequence
  Synthetic
caccgctgtcccaaaaggtcgtcattggtcttaaaggtacctgaggtctgactggaaaacccacctcctcctcctcttgtgcttctagccaggcacaagcagcattgttagctgctgtatcatatcagcagccagggcct

SEQ ID NO: 412591 - DNA, 140 bp, Artificial Sequence
  Synthetic
aggccctggctgctgatatgagcgtcagtactaagcgggggaaaattagataaatgggaaaaaattcggttaaggccagggggaaagaaaaaatataaattaaaacatatagtatgggcagaccttttgggacagcggtg

SEQ ID NO: 412592 - DNA, 140 bp, Artificial Sequence
  Synthetic
caccgctgtcccaaaaggtctgcccatactatatgttttaatttatattttttctttccccctggccttaaccgaattttttcccatttatctaattttcccccgcttagtactgacgctcatatcagcagccagggcct

SEQ ID NO: 412593 - DNA, 140 bp, Artificial Sequence
  Synthetic
atacgccatgctgggtctccggtatatatttaggaccaggacgagcaatttatacagcagataaaataataggagacataagaaaggcacattgtaacattagtgtaatacaatggaatacgtacttgggagtcggccat

SEQ ID NO: 412594 - DNA, 140 bp, Artificial Sequence
  Synthetic
atggccgactcccaagtacgtattccattgtattacactaatgttacaatgtgcctttcttatgtctcctattattttatctgctgtataaattgctcgtcctggtcctaaatatataccggagacccagcatggcgtat

SEQ ID NO: 412595 - DNA, 140 bp, Artificial Sequence
  Synthetic
aggccctggctgctgatatgtccctacaatccccaaagtcaaggagtagtagaatctatgaataaagaattaaagaaaatcatagggcaggtaagagatcaagctgaacaccttaagacagaccttttgggacagcggtg

SEQ ID NO: 412596 - DNA, 140 bp, Artificial Sequence
  Synthetic
caccgctgtcccaaaaggtctgtcttaaggtgttcagcttgatctcttacctgccctatgattttctttaattctttattcatagattctactactccttgactttggggattgtagggacatatcagcagccagggcct

SEQ ID NO: 412597 - DNA, 140 bp, Artificial Sequence
  Synthetic
atacgccatgctgggtctccctaacggaaacaacaaatcagaagactgaattacaagcaatttatctagctttgcaagattcagggttagaagtgaacatagtgacagattcacagtatgcgtacttgggagtcggccat

SEQ ID NO: 412598 - DNA, 140 bp, Artificial Sequence
  Synthetic
atggccgactcccaagtacgcatactgtgaatctgtcactatgttcacttctaaccctgaatcttgcaaagctagataaattgcttgtaattcagtcttctgatttgttgtttccgttagggagacccagcatggcgtat

SEQ ID NO: 412599 - DNA, 140 bp, Artificial Sequence
  Synthetic
aggccctggctgctgatatgtgtcgaataagacaaattgtaaatatgtggcagggagtaggacaagcaatgtatgcccctcccgttgcaggaaacattgcctgtaactcaactattacaggaccttttgggacagcggtg

SEQ ID NO: 412600 - DNA, 140 bp, Artificial Sequence
  Synthetic
caccgctgtcccaaaaggtcctgtaatagttgagttacaggcaatgtttcctgcaacgggaggggcatacattgcttgtcctactccctgccacatatttacaatttgtcttattcgacacatatcagcagccagggcct

SEQ ID NO: 412601 - DNA, 140 bp, Artificial Sequence
  Synthetic
  misc_feature (53)..(53): n is a, c, g, or t
  misc_feature (55)..(55): n is a, c, g, or t
aggccctggctgctgatatgagatagggttatagaagtagcacagagagcctngngagctgttctccacatacctagaagaataagacagggcttggaaaggactttgttataacatggggaccttttgggacagcggtg

SEQ ID NO: 412602 - DNA, 140 bp, Artificial Sequence
  Synthetic
  misc_feature (86)..(86): n is a, c, g, or t
  misc_feature (88)..(88): n is a, c, g, or t
caccgctgtcccaaaaggtccccatgttataacaaagtcctttccaagccctgtcttattcttctaggtatgtggagaacagctcncnaggctctctgtgctacttctataaccctatctcatatcagcagccagggcct

SEQ ID NO: 412603 - DNA, 140 bp, Artificial Sequence
  Synthetic
aggccctggctgctgatatgaccttcagacctgggggaggagatatgaaggacaattggagaagtgaactatataaatataaagtagtagaaattgaaccactaggaatagcacccaccagaccttttgggacagcggtg

SEQ ID NO: 412604 - DNA, 140 bp, Artificial Sequence
  Synthetic
caccgctgtcccaaaaggtctggtgggtgctattcctagtggttcaatttctactactttatatttatatagttcacttctccaattgtccttcatatctcctcccccaggtctgaaggtcatatcagcagccagggcct

SEQ ID NO: 412605 - DNA, 140 bp, Artificial Sequence
  Synthetic
aggccctggctgctgatatgcacagaaccagcaggaaaagaatgaacaagaattattggcattggacaagtgggcaagtctgtggaattggtttgacatatcaaactggctgtggtatatgaccttttgggacagcggtg

SEQ ID NO: 412606 - DNA, 140 bp, Artificial Sequence
  Synthetic
caccgctgtcccaaaaggtcatataccacagccagtttgatatgtcaaaccaattccacagacttgcccacttgtccaatgccaataattcttgttcattcttttcctgctggttctgtgcatatcagcagccagggcct

SEQ ID NO: 412607 - DNA, 140 bp, Artificial Sequence
  Synthetic
aggccctggctgctgatatgaggactgttaagtgtttcaattgtggcaaagaagggcacatagccaaaaattgcagggcccctaggaaaaagggctgttggaaatgtggaaaggaaggacgaccttttgggacagcggtg

SEQ ID NO: 412608 - DNA, 140 bp, Artificial Sequence
  Synthetic
caccgctgtcccaaaaggtcgtccttcctttccacatttccaacagccctttttcctaggggccctgcaatttttggctatgtgcccttctttgccacaattgaaacacttaacagtcctcatatcagcagccagggcct

SEQ ID NO: 412609 - DNA, 140 bp, Artificial Sequence
  Synthetic
aggccctggctgctgatatgaggcttaggcatctcctatggcaggaagaagcggagaccccgacgaagatcttctcaaaacagtgaggatcatcaaaatcctataccaaagcagtaagtagaccttttgggacagcggtg

SEQ ID NO: 412610 - DNA, 140 bp, Artificial Sequence
  Synthetic
caccgctgtcccaaaaggtctacttactgctttggtataggattttgatgatcctcactgttttgagaagatcttcgtcggggtctccgcttcttcctgccataggagatgcctaagcctcatatcagcagccagggcct

SEQ ID NO: 412611 - DNA, 140 bp, Artificial Sequence
  Synthetic
aggccctggctgctgatatgaaaattttaacatgtggaaaaatgacatggtggatcagatgcatgaggatataatcagtttatgggatcaaagcctaaagccatgtgtaaaattaaccccgaccttttgggacagcggtg

SEQ ID NO: 412612 - DNA, 140 bp, Artificial Sequence
  Synthetic
caccgctgtcccaaaaggtcggggttaattttacacatggctttaggctttgatcccataaactgattatatcctcatgcatctgatccaccatgtcatttttccacatgttaaaattttcatatcagcagccagggcct

SEQ ID NO: 412613 - DNA, 140 bp, Artificial Sequence
  Synthetic
atacgccatgctgggtctccccactgaagaaataaaaaactgctcttacaggactaccacagaactaaaagataagacgcagagagtctattcactgttttataaacttgatgtagtacacgtacttgggagtcggccat

SEQ ID NO: 412614 - DNA, 140 bp, Artificial Sequence
  Synthetic
atggccgactcccaagtacgtgtactacatcaagtttataaaacagtgaatagactctctgcgtcttatcttttagttctgtggtagtcctgtaagagcagttttttatttcttcagtggggagacccagcatggcgtat

SEQ ID NO: 412615 - DNA, 140 bp, Artificial Sequence
  Synthetic
aggccctggctgctgatatgggaactagaacgatttgcacttgatcctggccttctagaaacagcagaaggctgtcgaaaaataataggacagctacaaccatcccttcagacaggatcagaccttttgggacagcggtg

SEQ ID NO: 412616 - DNA, 140 bp, Artificial Sequence
  Synthetic
caccgctgtcccaaaaggtctgatcctgtctgaagggatggttgtagctgtcctattatttttcgacagccttctgctgtttctagaaggccaggatcaagtgcaaatcgttctagttcccatatcagcagccagggcct

SEQ ID NO: 412617 - DNA, 140 bp, Artificial Sequence
  Synthetic
atacgccatgctgggtctcccctgcaagtttgcaagatcatcaaaattctatatcaaagcagtaagtattatcataaatgtatatattaggattaggaataggagcgctagtagtaacatcgtacttgggagtcggccat

SEQ ID NO: 412618 - DNA, 140 bp, Artificial Sequence
  Synthetic
atggccgactcccaagtacgatgttactactagcgctcctattcctaatcctaatatatacatttatgataatacttactgctttgatatagaattttgatgatcttgcaaacttgcaggggagacccagcatggcgtat

SEQ ID NO: 412619 - DNA, 140 bp, Artificial Sequence
  Synthetic
aggccctggctgctgatatgatcataaatgtatatattaggattaggaataggagcgctagtagtaacatttatcatagccgtaattgtgtggaccatagtatatatagaatataaaaaagaccttttgggacagcggtg

SEQ ID NO: 412620 - DNA, 140 bp, Artificial Sequence
  Synthetic
caccgctgtcccaaaaggtcttttttatattctatatatactatggtccacacaattacggctatgataaatgttactactagcgctcctattcctaatcctaatatatacatttatgatcatatcagcagccagggcct

SEQ ID NO: 412621 - DNA, 140 bp, Artificial Sequence
  Synthetic
atacgccatgctgggtctccattcaatggaacagggtcatgcaagaatgttagctcagtacaatgtacacatggaattaggccagtagtatcaactcaactgctgttgaatggcagtctacgtacttgggagtcggccat

SEQ ID NO: 412622 - DNA, 140 bp, Artificial Sequence
  Synthetic
atggccgactcccaagtacgtagactgccattcaacagcagttgagttgatactactggcctaattccatgtgtacattgtactgagctaacattcttgcatgaccctgttccattgaatggagacccagcatggcgtat

SEQ ID NO: 412623 - DNA, 140 bp, Artificial Sequence
  Synthetic
atacgccatgctgggtctccagcagaagacagtggcaacgagagtgatggagacacagaggaattatccaagcttatggagatggggcaccttaatcttgggtatgttgctgatctgtagcgtacttgggagtcggccat

SEQ ID NO: 412624 - DNA, 140 bp, Artificial Sequence
  Synthetic
atggccgactcccaagtacgctacagatcagcaacatacccaagattaaggtgccccatctccataagcttggataattcctctgtgtctccatcactctcgttgccactgtcttctgctggagacccagcatggcgtat

SEQ ID NO: 412625 - DNA, 140 bp, Artificial Sequence
  Synthetic
atacgccatgctgggtctccccggcaacaatacaagaagaagtatccgctttggaccaggacaagccttctatacaaatgacataataggggatataagacaagcatattgtagtatcaacgtacttgggagtcggccat

SEQ ID NO: 412626 - DNA, 140 bp, Artificial Sequence
  Synthetic
atggccgactcccaagtacgttgatactacaatatgcttgtcttatatcccctattatgtcatttgtatagaaggcttgtcctggtccaaagcggatacttcttcttgtattgttgccggggagacccagcatggcgtat

SEQ ID NO: 412627 - DNA, 140 bp, Artificial Sequence
  Synthetic
aggccctggctgctgatatgtattatgacccatcaaaagacttaatagcagaaatacagaagcaggggcaaggccaatggacatatcaaatttatcaagagccatttaaaaatctgaaaagaccttttgggacagcggtg

SEQ ID NO: 412628 - DNA, 140 bp, Artificial Sequence
  Synthetic
caccgctgtcccaaaaggtcttttcagatttttaaatggctcttgataaatttgatatgtccattggccttgcccctgcttctgtatttctgctattaagtcttttgatgggtcataatacatatcagcagccagggcct

SEQ ID NO: 412629 - DNA, 140 bp, Artificial Sequence
  Synthetic
aggccctggctgctgatatgacagaaaagcataatgtctgggctacacatgcatgtgtacccacagaccccaacccacaagagatggtcatggagaatgtaacagagagctttaatatgtgaccttttgggacagcggtg

SEQ ID NO: 412630 - DNA, 140 bp, Artificial Sequence
  Synthetic
caccgctgtcccaaaaggtcacatattaaagctctctgttacattctccatgaccatctcttgtgggttggggtctgtgggtacacatgcatgtgtagcccagacattatgcttttctgtcatatcagcagccagggcct

SEQ ID NO: 412631 - DNA, 140 bp, Artificial Sequence
  Synthetic
atacgccatgctgggtctccgatcaaagcttgaaaccatgtgtaaaattaaccccactctgtgttactctaaactgtactaatgtcagaaacaatacctctaacagcactagcagtatggcgtacttgggagtcggccat

SEQ ID NO: 412632 - DNA, 140 bp, Artificial Sequence
  Synthetic
atggccgactcccaagtacgccatactgctagtgctgttagaggtattgtttctgacattagtacagtttagagtaacacagagtggggttaattttacacatggtttcaagctttgatcggagacccagcatggcgtat

SEQ ID NO: 412633 - DNA, 140 bp, Artificial Sequence
  Synthetic
atacgccatgctgggtctccaggcaggaggggaactaacaaattgctctttcaatgtaactacagtactaagagataagcagcagaaagtacatgcactcttttatagacttgatgtagtcgtacttgggagtcggccat

SEQ ID NO: 412634 - DNA, 140 bp, Artificial Sequence
  Synthetic
atggccgactcccaagtacgactacatcaagtctataaaagagtgcatgtactttctgctgcttatctcttagtactgtagttacattgaaagagcaatttgttagttcccctcctgcctggagacccagcatggcgtat

SEQ ID NO: 412635 - DNA, 140 bp, Artificial Sequence
  Synthetic
atacgccatgctgggtctcccaaagcagtaagtatatgtaatgttgaagtttctagaacaagtagattataagttaggagtaggagctctgataatagcattaatcatagcaatagttgtcgtacttgggagtcggccat

SEQ ID NO: 412636 - DNA, 140 bp, Artificial Sequence
  Synthetic
atggccgactcccaagtacgacaactattgctatgattaatgctattatcagagctcctactcctaacttataatctacttgttctagaaacttcaacattacatatacttactgctttgggagacccagcatggcgtat

SEQ ID NO: 412637 - DNA, 140 bp, Artificial Sequence
  Synthetic
atacgccatgctgggtctccgcagaagaacagatcataattagaactaaaaatatctcagacaataccaaaaacataatagtacagcttaagacaccagtaaacattacatgtaccaggccgtacttgggagtcggccat

SEQ ID NO: 412638 - DNA, 140 bp, Artificial Sequence
  Synthetic
atggccgactcccaagtacggcctggtacatgtaatgtttactggtgtcttaagctgtactattatgtttttggtattgtctgagatatttttagttctaattatgatctgttcttctgcggagacccagcatggcgtat

SEQ ID NO: 412639 - DNA, 140 bp, Artificial Sequence
  Synthetic
aggccctggctgctgatatgaaacataatagtacagcttaagacaccagtaaacattacatgtaccaggcctaacaataatacgagaacaagtatacatttagggccaggacgagcattcgaccttttgggacagcggtg

SEQ ID NO: 412640 - DNA, 140 bp, Artificial Sequence
  Synthetic
caccgctgtcccaaaaggtcgaatgctcgtcctggccctaaatgtatacttgttctcgtattattgttaggcctggtacatgtaatgtttactggtgtcttaagctgtactattatgtttcatatcagcagccagggcct

SEQ ID NO: 412641 - DNA, 140 bp, Artificial Sequence
  Synthetic
atacgccatgctgggtctcctagtagaacagactggaataagactttacaccaggtagttacacaattaggaatacacttgaacaatagaacaataagctttaagccaaactcaggagggcgtacttgggagtcggccat

SEQ ID NO: 412642 - DNA, 140 bp, Artificial Sequence
  Synthetic
atggccgactcccaagtacgccctcctgagtttggcttaaagcttattgttctattgttcaagtgtattcctaattgtgtaactacctggtgtaaagtcttattccagtctgttctactaggagacccagcatggcgtat

SEQ ID NO: 412643 - DNA, 140 bp, Artificial Sequence
  Synthetic
atacgccatgctgggtctccgacatggaagttagaacacatagttttaattgtagaggagaatttttctattgcaatacatcagggctgtttaatagtagttgggaaatgcatactaattcgtacttgggagtcggccat

SEQ ID NO: 412644 - DNA, 140 bp, Artificial Sequence
  Synthetic
atggccgactcccaagtacgaattagtatgcatttcccaactactattaaacagccctgatgtattgcaatagaaaaattctcctctacaattaaaactatgtgttctaacttccatgtcggagacccagcatggcgtat

SEQ ID NO: 412645 - DNA, 140 bp, Artificial Sequence
  Synthetic
atacgccatgctgggtctccggaagaagtaaaaaattgctctttcaatgcaaccacagaaataagagataagaaacaaaaggtgtatgcacttttttataaacctgatctagtaccacttcgtacttgggagtcggccat

SEQ ID NO: 412646 - DNA, 140 bp, Artificial Sequence
  Synthetic
atggccgactcccaagtacgaagtggtactagatcaggtttataaaaaagtgcatacaccttttgtttcttatctcttatttctgtggttgcattgaaagagcaattttttacttcttccggagacccagcatggcgtat

SEQ ID NO: 412647 - DNA, 140 bp, Artificial Sequence
  Synthetic
atacgccatgctgggtctccccccactctgtgtcactttagagtgtgataagctcaatgatatcagtaaaatcaatgccacggaaatgaaaaattgctctttcaatgcaaccacagaagtcgtacttgggagtcggccat

SEQ ID NO: 412648 - DNA, 140 bp, Artificial Sequence
  Synthetic
atggccgactcccaagtacgacttctgtggttgcattgaaagagcaatttttcatttccgtggcattgattttactgatatcattgagcttatcacactctaaagtgacacagagtggggggagacccagcatggcgtat

SEQ ID NO: 412649 - DNA, 140 bp, Artificial Sequence
  Synthetic
atacgccatgctgggtctcccttgataccatagcaatagcagtagctgagtggacagataggattatagaaataggacaaagagcttgcagagctattcgcaatatacctacaagaataacgtacttgggagtcggccat

SEQ ID NO: 412650 - DNA, 140 bp, Artificial Sequence
  Synthetic
atggccgactcccaagtacgttattcttgtaggtatattgcgaatagctctgcaagctctttgtcctatttctataatcctatctgtccactcagctactgctattgctatggtatcaagggagacccagcatggcgtat

SEQ ID NO: 412651 - DNA, 140 bp, Artificial Sequence
  Synthetic
atacgccatgctgggtctccaagtagcatagtgggatggcctgaagttagggagagaatgaaaagaactcctccagcagcagaaggagtaggagcagtgtctcaagatttagctgcacgtcgtacttgggagtcggccat

SEQ ID NO: 412652 - DNA, 140 bp, Artificial Sequence
  Synthetic
atggccgactcccaagtacgacgtgcagctaaatcttgagacactgctcctactccttctgctgctggaggagttcttttcattctctccctaacttcaggccatcccactatgctacttggagacccagcatggcgtat

SEQ ID NO: 412653 - DNA, 140 bp, Artificial Sequence
  Synthetic
atacgccatgctgggtctccagaaagggtgaagaaaaaattaggagaacacttctctaataagacaacaataaaattccaaccaccctcaggaggggacctggaaattacaatgcatagtcgtacttgggagtcggccat

SEQ ID NO: 412654 - DNA, 140 bp, Artificial Sequence
  Synthetic
atggccgactcccaagtacgactatgcattgtaatttccaggtcccctcctgagggtggttggaattttattgttgtcttattagagaagtgttctcctaattttttcttcaccctttctggagacccagcatggcgtat

SEQ ID NO: 412655 - DNA, 140 bp, Artificial Sequence
  Synthetic
aggccctggctgctgatatggtggcgcccgaacagggacttgaaagtgaaaccagtgtctgaatcctccgacgcacgggctcggctcagcggagtgcacctgctgagaggcgagaggagagaccttttgggacagcggtg

SEQ ID NO: 412656 - DNA, 140 bp, Artificial Sequence
  Synthetic
caccgctgtcccaaaaggtctctcctctcgcctctcagcaggtgcactccgctgagccgagcccgtgcgtcggaggattcagacactggtttcactttcaagtccctgttcgggcgccaccatatcagcagccagggcct

SEQ ID NO: 412657 - DNA, 140 bp, Artificial Sequence
  Synthetic
atacgccatgctgggtctccacgcacgggctcggctcagcggagtgcacctgctgagaggcgagaggagagctcacagcggtgagtacattttgtcagtggtggctgaccctagaggaagcgtacttgggagtcggccat

SEQ ID NO: 412658 - DNA, 140 bp, Artificial Sequence
  Synthetic
atggccgactcccaagtacgcttcctctagggtcagccaccactgacaaaatgtactcaccgctgtgagctctcctctcgcctctcagcaggtgcactccgctgagccgagcccgtgcgtggagacccagcatggcgtat

SEQ ID NO: 412659 - DNA, 140 bp, Artificial Sequence
  Synthetic
aggccctggctgctgatatggctcacagcggtgagtacattttgtcagtggtggctgaccctagaggaaggggcgaagtctctaggggaggagatgggtgcgagagcgtcagtgttgacagaccttttgggacagcggtg

SEQ ID NO: 412660 - DNA, 140 bp, Artificial Sequence
  Synthetic
caccgctgtcccaaaaggtctgtcaacactgacgctctcgcacccatctcctcccctagagacttcgccccttcctctagggtcagccaccactgacaaaatgtactcaccgctgtgagccatatcagcagccagggcct

SEQ ID NO: 412661 - DNA, 140 bp, Artificial Sequence
  Synthetic
aggccctggctgctgatatgcatggggtatattatgacccatcaaaagacttaatagcagaaatacagaaacaaggacaagaccaatggacatatcaaatttatcaagagccatttaaaagaccttttgggacagcggtg

SEQ ID NO: 412662 - DNA, 140 bp, Artificial Sequence
  Synthetic
caccgctgtcccaaaaggtcttttaaatggctcttgataaatttgatatgtccattggtcttgtccttgtttctgtatttctgctattaagtcttttgatgggtcataatataccccatgcatatcagcagccagggcct

SEQ ID NO: 412663 - DNA, 140 bp, Artificial Sequence
  Synthetic
aggccctggctgctgatatggaaaaaatatatgctaaaacatatagtatgggcaagcagagagctggaaagatttgcatgtaatcctgagcttatggaaacagcagaaggctgtgaaaaagaccttttgggacagcggtg

SEQ ID NO: 412664 - DNA, 140 bp, Artificial Sequence
  Synthetic
caccgctgtcccaaaaggtctttttcacagccttctgctgtttccataagctcaggattacatgcaaatctttccagctctctgcttgcccatactatatgttttagcatatattttttccatatcagcagccagggcct

SEQ ID NO: 412665 - DNA, 140 bp, Artificial Sequence
  Synthetic
atacgccatgctgggtctccgatttgcatgtaatcctgagcttatggaaacagcagaaggctgtgaaaaattattagagcagttagaaccagctctcagaacaggttctgatggcctgcacgtacttgggagtcggccat

SEQ ID NO: 412666 - DNA, 140 bp, Artificial Sequence
  Synthetic
atggccgactcccaagtacgtgcaggccatcagaacctgttctgagagctggttctaactgctctaataatttttcacagccttctgctgtttccataagctcaggattacatgcaaatcggagacccagcatggcgtat

SEQ ID NO: 412667 - DNA, 140 bp, Artificial Sequence
  Synthetic
atacgccatgctgggtctccggggacaggaactaaagaatagtgctattgatttgcttaacaccacagcaatagcagtagctgagggaacagatgggattatagtaatagtgcaaagagccgtacttgggagtcggccat

SEQ ID NO: 412668 - DNA, 140 bp, Artificial Sequence
  Synthetic
atggccgactcccaagtacggctctttgcactattactataatcccatctgttccctcagctactgctattgctgtggtgttaagcaaatcaatagcactattctttagttcctgtccccggagacccagcatggcgtat

SEQ ID NO: 412669 - DNA, 140 bp, Artificial Sequence
  Synthetic
aggccctggctgctgatatgatagcagtagctgagggaacagatgggattatagtaatagtgcaaagagcttggagagctattctccacatacctagaagaataagacagggctttgaaagaccttttgggacagcggtg

SEQ ID NO: 412670 - DNA, 140 bp, Artificial Sequence
  Synthetic
caccgctgtcccaaaaggtctttcaaagccctgtcttattcttctaggtatgtggagaatagctctccaagctctttgcactattactataatcccatctgttccctcagctactgctatcatatcagcagccagggcct

SEQ ID NO: 412671 - DNA, 140 bp, Artificial Sequence
  Synthetic
aggccctggctgctgatatgatataagtgacacacagcaggccattacaaaatggaaggaggaaatgcagagaagaaagaaagcactagagggcagcactggaactggaacaagtcaaaagaccttttgggacagcggtg

SEQ ID NO: 412672 - DNA, 140 bp, Artificial Sequence
  Synthetic
caccgctgtcccaaaaggtcttttgacttgttccagttccagtgctgccctctagtgctttctttcttctctgcatttcctccttccattttgtaatggcctgctgtgtgtcacttatatcatatcagcagccagggcct

SEQ ID NO: 412673 - DNA, 140 bp, Artificial Sequence
  Synthetic
atacgccatgctgggtctccagaagaaagaaagcactagagggcagcactggaactggaacaagtcaaaactatcctattgtgcagaatgcccaggggcaaatgacccatctgccgctgtcgtacttgggagtcggccat

SEQ ID NO: 412674 - DNA, 140 bp, Artificial Sequence
  Synthetic
atggccgactcccaagtacgacagcggcagatgggtcatttgcccctgggcattctgcacaataggatagttttgacttgttccagttccagtgctgccctctagtgctttctttcttctggagacccagcatggcgtat

SEQ ID NO: 412675 - DNA, 140 bp, Artificial Sequence
  Synthetic
atacgccatgctgggtctccggtggtctactataagggaaagaatgaggcgagctgaaccagtagcagaaggggtaggagcagtgtctcgagatttggatagacgcggggcagtcacaatcgtacttgggagtcggccat

SEQ ID NO: 412676 - DNA, 140 bp, Artificial Sequence
  Synthetic
atggccgactcccaagtacgattgtgactgccccgcgtctatccaaatctcgagacactgctcctaccccttctgctactggttcagctcgcctcattctttcccttatagtagaccaccggagacccagcatggcgtat

SEQ ID NO: 412677 - DNA, 140 bp, Artificial Sequence
  Synthetic
  misc_feature (119)..(119): n is a, c, g, or t
aggccctggctgctgatatgaaccctgaaattatccctatgtttatggccttgtcagaagggtctatacccgatgacattaatactatgctcaatgcagtaggcggacatcagggagcntgaccttttgggacagcggtg

SEQ ID NO: 412678 - DNA, 140 bp, Artificial Sequence
  Synthetic
  misc_feature (22)..(22): n is a, c, g, or t
caccgctgtcccaaaaggtcangctccctgatgtccgcctactgcattgagcatagtattaatgtcatcgggtatagacccttctgacaaggccataaacatagggataatttcagggttcatatcagcagccagggcct

SEQ ID NO: 412679 - DNA, 140 bp, Artificial Sequence
  Synthetic
  misc_feature (69)..(69): n is a, c, g, or t
  misc_feature (72)..(72): n is a, c, g, or t
  misc_feature (87)..(87): n is a, c, g, or t
atacgccatgctgggtctcccgatgacattaatactatgctcaatgcagtaggcggacatcagggagcnttncaggtgttgaaagangtgattaatgaagaggctgcagaatgggatagacgtacttgggagtcggccat

SEQ ID NO: 412680 - DNA, 140 bp, Artificial Sequence
  Synthetic
  misc_feature (54)..(54): n is a, c, g, or t
  misc_feature (69)..(69): n is a, c, g, or t
  misc_feature (72)..(72): n is a, c, g, or t
atggccgactcccaagtacgtctatcccattctgcagcctcttcattaatcacntctttcaacacctgnaangctccctgatgtccgcctactgcattgagcatagtattaatgtcatcgggagacccagcatggcgtat

SEQ ID NO: 412681 - DNA, 140 bp, Artificial Sequence
  Synthetic
aggccctggctgctgatatgaacaggaggggatattgcaggaaccactagtaacaagcaggaacagataacctggacaacaaggaacaataatcctataccagtaggagatatctatagagaccttttgggacagcggtg

SEQ ID NO: 412682 - DNA, 140 bp, Artificial Sequence
  Synthetic
caccgctgtcccaaaaggtctctatagatatctcctactggtataggattattgttccttgttgtccaggttatctgttcctgcttgttactagtggttcctgcaatatcccctcctgttcatatcagcagccagggcct

SEQ ID NO: 412683 - DNA, 140 bp, Artificial Sequence
  Synthetic
aggccctggctgctgatatgagcaatagcagcattagtaatagcagcaataatagcaatagttgtgtggaccatagtactcatagaatataggaaaatattaagacaaaggaaaatagacgaccttttgggacagcggtg

SEQ ID NO: 412684 - DNA, 140 bp, Artificial Sequence
  Synthetic
caccgctgtcccaaaaggtcgtctattttcctttgtcttaatattttcctatattctatgagtactatggtccacacaactattgctattattgctgctattactaatgctgctattgctcatatcagcagccagggcct

SEQ ID NO: 412685 - DNA, 140 bp, Artificial Sequence
  Synthetic
aggccctggctgctgatatgccatagtactcatagaatataggaaaatattaagacaaaggaaaatagacaggctaattaagagaatagcagaaagagcagaagacagtggcaatgaaaggaccttttgggacagcggtg

SEQ ID NO: 412686 - DNA, 140 bp, Artificial Sequence
  Synthetic
caccgctgtcccaaaaggtcctttcattgccactgtcttctgctctttctgctattctcttaattagcctgtctattttcctttgtcttaatattttcctatattctatgagtactatggcatatcagcagccagggcct

SEQ ID NO: 412687 - DNA, 140 bp, Artificial Sequence
  Synthetic
aggccctggctgctgatatgtgaaacatctagtatgggcaagcagggagctggaaagattcgcacttaaccctggccttttagaaacagcagaaggatgtcaacaaataatggaacagttgaccttttgggacagcggtg

SEQ ID NO: 412688 - DNA, 140 bp, Artificial Sequence
  Synthetic
caccgctgtcccaaaaggtcaactgttccattatttgttgacatccttctgctgtttctaaaaggccagggttaagtgcgaatctttccagctccctgcttgcccatactagatgtttcacatatcagcagccagggcct

SEQ ID NO: 412689 - DNA, 140 bp, Artificial Sequence
  Synthetic
aggccctggctgctgatatgcctggccttttagaaacagcagaaggatgtcaacaaataatggaacagttacaatcagctctcaagacagggtcagaagaacttagatcattatataatagaccttttgggacagcggtg

SEQ ID NO: 412690 - DNA, 140 bp, Artificial Sequence
  Synthetic
caccgctgtcccaaaaggtctattatataatgatctaagttcttctgaccctgtcttgagagctgattgtaactgttccattatttgttgacatccttctgctgtttctaaaaggccaggcatatcagcagccagggcct

SEQ ID NO: 412691 - DNA, 140 bp, Artificial Sequence
  Synthetic
aggccctggctgctgatatgttgtaacacatgttactgtaaaaagtgttgctatcattgccaagtgtgctttttgaacaaaggcttaggcatctcctatggcaggaagaagcggagacaggaccttttgggacagcggtg

SEQ ID NO: 412692 - DNA, 140 bp, Artificial Sequence
  Synthetic
caccgctgtcccaaaaggtcctgtctccgcttcttcctgccataggagatgcctaagcctttgttcaaaaagcacacttggcaatgatagcaacactttttacagtaacatgtgttacaacatatcagcagccagggcct

SEQ ID NO: 412693 - DNA, 140 bp, Artificial Sequence
  Synthetic
aggccctggctgctgatatgcagtagcaaccctctattgtgtacatcaaaggatagaggtaaaagacaccaaggaagctttagataaaatagaggaaatacaaaataagagcaagcaaaagaccttttgggacagcggtg

SEQ ID NO: 412694 - DNA, 140 bp, Artificial Sequence
  Synthetic
caccgctgtcccaaaaggtcttttgcttgctcttattttgtatttcctctattttatctaaagcttccttggtgtcttttacctctatcctttgatgtacacaatagagggttgctactgcatatcagcagccagggcct

SEQ ID NO: 412695 - DNA, 140 bp, Artificial Sequence
  Synthetic
  misc_feature (105)..(105): n is a, c, g, or t
aggccctggctgctgatatggcagaagctatggcagcagctaatcaagctaaccaagatttaaaaggagggtatacaactgttttcatgcagagtggacagaganagccagttaagtgctgaccttttgggacagcggtg

SEQ ID NO: 412696 - DNA, 140 bp, Artificial Sequence
  Synthetic
  misc_feature (36)..(36): n is a, c, g, or t
caccgctgtcccaaaaggtcagcacttaactggctntctctgtccactctgcatgaaaacagttgtataccctccttttaaatcttggttagcttgattagctgctgccatagcttctgccatatcagcagccagggcct

SEQ ID NO: 412697 - DNA, 140 bp, Artificial Sequence
  Synthetic
  misc_feature (55)..(55): n is a, c, g, or t
atacgccatgctgggtctccgtatacaactgttttcatgcagagtggacagaganagccagttaagtgctttaactgtggaaaaataggacacatagcaaagaactgtaaggcacctaggcgtacttgggagtcggccat

SEQ ID NO: 412698 - DNA, 140 bp, Artificial Sequence
  Synthetic
  misc_feature (86)..(86): n is a, c, g, or t
atggccgactcccaagtacgcctaggtgccttacagttctttgctatgtgtcctatttttccacagttaaagcacttaactggctntctctgtccactctgcatgaaaacagttgtatacggagacccagcatggcgtat

SEQ ID NO: 412699 - DNA, 140 bp, Artificial Sequence
  Synthetic
aggccctggctgctgatatgaatttggaattccctacaatccccaaagtcaaggagtagtagaatctatgaataaagaattaaagaaaatcataggacaggtaagagatcaagctgaacagaccttttgggacagcggtg

SEQ ID NO: 412700 - DNA, 140 bp, Artificial Sequence
  Synthetic
caccgctgtcccaaaaggtctgttcagcttgatctcttacctgtcctatgattttctttaattctttattcatagattctactactccttgactttggggattgtagggaattccaaattcatatcagcagccagggcct

SEQ ID NO: 412701 - DNA, 140 bp, Artificial Sequence
  Synthetic
aggccctggctgctgatatgcaaatcaggaagacaggcaaattttttaggaaagatctggcctcctgggggcaagaggccaggcaactatgtacagaaacaagtacaaccaacagccccagaccttttgggacagcggtg

SEQ ID NO: 412702 - DNA, 140 bp, Artificial Sequence
  Synthetic
caccgctgtcccaaaaggtctggggctgttggttgtacttgtttctgtacatagttgcctggcctcttgcccccaggaggccagatctttcctaaaaaatttgcctgtcttcctgatttgcatatcagcagccagggcct

SEQ ID NO: 412703 - DNA, 140 bp, Artificial Sequence
  Synthetic
  misc_feature (113)..(113): n is a, c, g, or t
atacgccatgctgggtctccgcaagaggccaggcaactatgtacagaaacaagtacaaccaacagccccacctatggaggaggacgagatgacccgggacaagcagagggagnaggaggacgtacttgggagtcggccat

SEQ ID NO: 412704 - DNA, 140 bp, Artificial Sequence
  Synthetic
  misc_feature (28)..(28): n is a, c, g, or t
atggccgactcccaagtacgtcctcctnctccctctgcttgtcccgggtcatctcgtcctcctccataggtggggctgttggttgtacttgtttctgtacatagttgcctggcctcttgcggagacccagcatggcgtat

SEQ ID NO: 412705 - DNA, 140 bp, Artificial Sequence
  Synthetic
aggccctggctgctgatatgtgctaaaaccataatagtacagctgaatgaatctgtagaaattaattgtacaagacccaacaacaatacaagaaaaagtatacctataggaccggggagagaccttttgggacagcggtg

SEQ ID NO: 412706 - DNA, 140 bp, Artificial Sequence
  Synthetic
caccgctgtcccaaaaggtctctccccggtcctataggtatactttttcttgtattgttgttgggtcttgtacaattaatttctacagattcattcagctgtactattatggttttagcacatatcagcagccagggcct

SEQ ID NO: 412707 - DNA, 140 bp, Artificial Sequence
  Synthetic
aggccctggctgctgatatgaccagtaataccagtaagagtaggggggcatatttgtgaggctttattagatacaggagctgatgacacagtagtagataaattacctttagaaggaagagaccttttgggacagcggtg

SEQ ID NO: 412708 - DNA, 140 bp, Artificial Sequence
  Synthetic
caccgctgtcccaaaaggtctcttccttctaaaggtaatttatctactactgtgtcatcagctcctgtatctaataaagcctcacaaatatgcccccctactcttactggtattactggtcatatcagcagccagggcct

SEQ ID NO: 412709 - DNA, 140 bp, Artificial Sequence
  Synthetic
  misc_feature (119)..(119): n is a, c, g, or t
atacgccatgctgggtctccatacaggagctgatgacacagtagtagataaattacctttagaaggaagatggaaaccaaatatgataggaggaatagggggttttataacagtaaaanacgtacttgggagtcggccat

SEQ ID NO: 412710 - DNA, 140 bp, Artificial Sequence
  Synthetic
  misc_feature (22)..(22): n is a, c, g, or t
atggccgactcccaagtacgtnttttactgttataaaaccccctattcctcctatcatatttggtttccatcttccttctaaaggtaatttatctactactgtgtcatcagctcctgtatggagacccagcatggcgtat

SEQ ID NO: 412711 - DNA, 140 bp, Artificial Sequence
  Synthetic
  misc_feature (28)..(28): n is a, c, g, or t
  misc_feature (46)..(46): n is a, c, g, or t
aggccctggctgctgatatgtattagtnggcccaaccccagtaaanataataggaagaaatattttgacattaattggatgtactctaagtttccccatcagctccatagaaatagtaccgaccttttgggacagcggtg

SEQ ID NO: 412712 - DNA, 140 bp, Artificial Sequence
  Synthetic
  misc_feature (95)..(95): n is a, c, g, or t
  misc_feature (113)..(113): n is a, c, g, or t
caccgctgtcccaaaaggtcggtactatttctatggagctgatggggaaacttagagtacatccaattaatgtcaaaatatttcttcctattatntttactggggttgggccnactaatacatatcagcagccagggcct

SEQ ID NO: 412713 - DNA, 140 bp, Artificial Sequence
  Synthetic
  misc_feature (74)..(74): n is a, c, g, or t
  misc_feature (76)..(76): n is a, c, g, or t
  misc_feature (91)..(91): n is a, c, g, or t
  misc_feature (112)..(112): n is a, c, g, or t
atacgccatgctgggtctccttaattggatgtactctaagtttccccatcagctccatagaaatagtaccagtnanattaaaggcaggaanggatgggcctaaggtaaagcnatggccctcgtacttgggagtcggccat

SEQ ID NO: 412714 - DNA, 140 bp, Artificial Sequence
  Synthetic
  misc_feature (29)..(29): n is a, c, g, or t
  misc_feature (50)..(50): n is a, c, g, or t
  misc_feature (65)..(65): n is a, c, g, or t
  misc_feature (67)..(67): n is a, c, g, or t
atggccgactcccaagtacgagggccatngctttaccttaggcccatccnttcctgcctttaatntnactggtactatttctatggagctgatggggaaacttagagtacatccaattaaggagacccagcatggcgtat

SEQ ID NO: 412715 - DNA, 140 bp, Artificial Sequence
  Synthetic
  misc_feature (38)..(38): n is a, c, g, or t
  misc_feature (104)..(104): n is a, c, g, or t
  misc_feature (120)..(120): n is a, c, g, or t
aggccctggctgctgatatgcaggaaggaaaaataacnaaaattgggcctgaaaatccatataacacccccatctttgcaataaaaaagaaagatagcagcaantggaggaaattagtangaccttttgggacagcggtg

SEQ ID NO: 412716 - DNA, 140 bp, Artificial Sequence
  Synthetic
  misc_feature (21)..(21): n is a, c, g, or t
  misc_feature (37)..(37): n is a, c, g, or t
  misc_feature (103)..(103): n is a, c, g, or t
caccgctgtcccaaaaggtcntactaatttcctccanttgctgctatctttcttttttattgcaaagatgggggtgttatatggattttcaggcccaattttngttatttttccttcctgcatatcagcagccagggcct

SEQ ID NO: 412717 - DNA, 140 bp, Artificial Sequence
  Synthetic
  misc_feature (54)..(54): n is a, c, g, or t
  misc_feature (70)..(70): n is a, c, g, or t
atacgccatgctgggtctcccatctttgcaataaaaaagaaagatagcagcaantggaggaaattagtanacttcagagaactaaataagagaacacaagatttttgggaagtacaghtgcgtacttgggagtcggccat

SEQ ID NO: 412718 - DNA, 140 bp, Artificial Sequence
  Synthetic
  misc_feature (71)..(71): n is a, c, g, or t
  misc_feature (87)..(87): n is a, c, g, or t
atggccgactcccaagtacgcahctgtacttcccaaaaatcttgtgttctcttatttagttctctgaagtntactaatttcctccanttgctgctatctttcttttttattgcaaagatgggagacccagcatggcgtat

SEQ ID NO: 412719 - DNA, 140 bp, Artificial Sequence
  Synthetic
aggccctggctgctgatatgagatgtgggggatgcttatttctcctgtcctttagatccagattttagaaaatatacagcttttactatacctagtgtaaataatgagacaccaggaattgaccttttgggacagcggtg

SEQ ID NO: 412720 - DNA, 140 bp, Artificial Sequence
  Synthetic
caccgctgtcccaaaaggtcaattcctggtgtctcattatttacactaggtatagtaaaagctgtatattttctaaaatctggatctaaaggacaggagaaataagcatcccccacatctcatatcagcagccagggcct

SEQ ID NO: 412721 - DNA, 140 bp, Artificial Sequence
  Synthetic
atacgccatgctgggtctccaatatacagcttttactatacctagtgtaaataatgagacaccaggaattagatatcagtataatgttctgcctcagggatggaaaggatcgccagccatcgtacttgggagtcggccat

SEQ ID NO: 412722 - DNA, 140 bp, Artificial Sequence
  Synthetic
atggccgactcccaagtacgatggctggcgatcctttccatccctgaggcagaacattatactgatatctaattcctggtgtctcattatttacactaggtatagtaaaagctgtatattggagacccagcatggcgtat

SEQ ID NO: 412723 - DNA, 140 bp, Artificial Sequence
  Synthetic
aggccctggctgctgatatgcagaagtagaaatctatcaatacatggatgatctatatgtagggtcagatttgcctttgtctgaacatagacagcgggtagagaaacttagggaacacctgaccttttgggacagcggtg

SEQ ID NO: 412724 - DNA, 140 bp, Artificial Sequence
  Synthetic
caccgctgtcccaaaaggtcaggtgttccctaagtttctctacccgctgtctatgttcagacaaaggcaaatctgaccctacatatagatcatccatgtattgatagatttctacttctgcatatcagcagccagggcct

SEQ ID NO: 412725 - DNA, 140 bp, Artificial Sequence
  Synthetic
atacgccatgctgggtctccttgcctttgtctgaacatagacagcgggtagagaaacttagggaacacctctatgtatgggggtttacaactcctgacaaaaaacatcaaaaggagcctccgtacttgggagtcggccat

SEQ ID NO: 412726 - DNA, 140 bp, Artificial Sequence
  Synthetic
atggccgactcccaagtacggaggctccttttgatgttttttgtcaggagttgtaaacccccatacatagaggtgttccctaagtttctctacccgctgtctatgttcagacaaaggcaaggagacccagcatggcgtat

SEQ ID NO: 412727 - DNA, 140 bp, Artificial Sequence
  Synthetic
atacgccatgctgggtctccttacaacgaagggcttaggcatctcatatggcaggaagaagcggagaaagagacgcagaactccttacagcagtccgaatcatcaaaatcctgtaccaaacgtacttgggagtcggccat

SEQ ID NO: 412728 - DNA, 140 bp, Artificial Sequence
  Synthetic
atggccgactcccaagtacgtttggtacaggattttgatgattcggactgctgtaaggagttctgcgtctctttctccgcttcttcctgccatatgagatgcctaagcccttcgttgtaaggagacccagcatggcgtat

SEQ ID NO: 412729 - DNA, 140 bp, Artificial Sequence
  Synthetic
  misc_feature (81)..(81): n is a, c, g, or t
atacgccatgctgggtctccgctagtaggaaagttaaattgggcaagtcagatttatccaggaataagggtaaaagaattntgcaaactaattagaggaactaaatccttaacagaagtacgtacttgggagtcggccat

SEQ ID NO: 412730 - DNA, 140 bp, Artificial Sequence
  Synthetic
  misc_feature (60)..(60): n is a, c, g, or t
atggccgactcccaagtacgtacttctgttaaggatttagttcctctaattagtttgcanaattcttttacccttattcctggataaatctgacttgcccaatttaactttcctactagcggagacccagcatggcgtat

SEQ ID NO: 412731 - DNA, 140 bp, Artificial Sequence
  Synthetic
aggccctggctgctgatatggagtgggaggacctagccacaaagcaagagtgttggctgaggcaatgagccaagcaaacagtacaaacataatgatgcagagaagtaattttaaaggctcgaccttttgggacagcggtg

SEQ ID NO: 412732 - DNA, 140 bp, Artificial Sequence
  Synthetic
caccgctgtcccaaaaggtcgagcctttaaaattacttctctgcatcattatgtttgtactgtttgcttggctcattgcctcagccaacactcttgctttgtggctaggtcctcccactccatatcagcagccagggcct

SEQ ID NO: 412733 - DNA, 140 bp, Artificial Sequence
  Synthetic
aggccctggctgctgatatgtttaaaagaaccagtgcatggagtttattaccaaccagaaaaggaattaatagtagacatacagaaacagggagagggacaatggacttatcagatatacgaccttttgggacagcggtg

SEQ ID NO: 412734 - DNA, 140 bp, Artificial Sequence
  Synthetic
caccgctgtcccaaaaggtcgtatatctgataagtccattgtccctctccctgtttctgtatgtctactattaattccttttctggttggtaataaactccatgcactggttcttttaaacatatcagcagccagggcct

SEQ ID NO: 412735 - DNA, 140 bp, Artificial Sequence
  Synthetic
atacgccatgctgggtctcctagtagacatacagaaacagggagagggacaatggacttatcagatataccaggaagaacataaaaacttgaagacagggaaatatgccaggcaaaaggccgtacttgggagtcggccat

SEQ ID NO: 412736 - DNA, 140 bp, Artificial Sequence
  Synthetic
atggccgactcccaagtacggccttttgcctggcatatttccctgtcttcaagtttttatgttcttcctggtatatctgataagtccattgtccctctccctgtttctgtatgtctactaggagacccagcatggcgtat

SEQ ID NO: 412737 - DNA, 140 bp, Artificial Sequence
  Synthetic
aggccctggctgctgatatgaagaaaagaatgaacaagaattattggaattggataagtgggcaagtttgtggaattggtttagcatatcaaattggctgtggtatataaaaatattcatgaccttttgggacagcggtg

SEQ ID NO: 412738 - DNA, 140 bp, Artificial Sequence
  Synthetic
caccgctgtcccaaaaggtcatgaatatttttatataccacagccaatttgatatgctaaaccaattccacaaacttgcccacttatccaattccaataattcttgttcattcttttcttcatatcagcagccagggcct

SEQ ID NO: 412739 - DNA, 140 bp, Artificial Sequence
  Synthetic
aggccctggctgctgatatgcacaagaaagcatagtaatatggggaaaattacccaagtttagactaccagtaaatagaagtatgtgggagacttggtggtcagactattggcaagccacgaccttttgggacagcggtg

SEQ ID NO: 412740 - DNA, 140 bp, Artificial Sequence
  Synthetic
caccgctgtcccaaaaggtcgtggcttgccaatagtctgaccaccaagtctcccacatacttctatttactggtagtctaaacttgggtaattttccccatattactatgctttcttgtgcatatcagcagccagggcct

SEQ ID NO: 412741 - DNA, 140 bp, Artificial Sequence
  Synthetic
atacgccatgctgggtctccgtaaatagaagtatgtgggagacttggtggtcagactattggcaagccacctggatacctgaatgggaatttgttagtacaccccctcttattaagctctcgtacttgggagtcggccat

SEQ ID NO: 412742 - DNA, 140 bp, Artificial Sequence
  Synthetic
atggccgactcccaagtacgagagcttaataagagggggtgtactaacaaattcccattcaggtatccaggtggcttgccaatagtctgaccaccaagtctcccacatacttctatttacggagacccagcatggcgtat

SEQ ID NO: 412743 - DNA, 140 bp, Artificial Sequence
  Synthetic
  misc_feature (53)..(53): n is a, c, g, or t
  misc_feature (86)..(86): n is a, c, g, or t
aggccctggctgctgatatggatggggcagcaaacagagagactaaattaggnaaagctggatatgtaacagataggggtaggcanaagataatcaaactagaaggaacaaccaatcaaagaccttttgggacagcggtg

SEQ ID NO: 412744 - DNA, 140 bp, Artificial Sequence
  Synthetic
  misc_feature (55)..(55): n is a, c, g, or t
  misc_feature (88)..(88): n is a, c, g, or t
caccgctgtcccaaaaggtctttgattggttgttccttctagtttgattatcttntgcctacccctatctgttacatatccagctttncctaatttagtctctctgtttgctgccccatccatatcagcagccagggcct

SEQ ID NO: 412745 - DNA, 140 bp, Artificial Sequence
  Synthetic
aggccctggctgctgatatgtagcacttatctgggacgacctacggagcctgtgcctcttcagctaccaccgcttgagagacttactcttgattgcagcgaggattgtggaacttctggggaccttttgggacagcggtg

SEQ ID NO: 412746 - DNA, 140 bp, Artificial Sequence
  Synthetic
caccgctgtcccaaaaggtccccagaagttccacaatcctcgctgcaatcaagagtaagtctctcaagcggtggtagctgaagaggcacaggctccgtaggtcgtcccagataagtgctacatatcagcagccagggcct

SEQ ID NO: 412747 - DNA, 140 bp, Artificial Sequence
  Synthetic
atacgccatgctgggtctccacccaaaacgacaacatgacggaagaacgaggggtactaaaaaactgttctttcaatatgaccacagaagtaaaagataagagattgaaagtatctgcaccgtacttgggagtcggccat

SEQ ID NO: 412748 - DNA, 140 bp, Artificial Sequence
  Synthetic
atggccgactcccaagtacggtgcagatactttcaatctcttatcttttacttctgtggtcatattgaaagaacagttttttagtacccctcgttcttccgtcatgttgtcgttttgggtggagacccagcatggcgtat

SEQ ID NO: 412749 - DNA, 140 bp, Artificial Sequence
  Synthetic
  misc_feature (75)..(75): n is a, c, g, or t
aggccctggctgctgatatgtccagatcaaagtgactcccccctagtgcaaaaaataatagaagaaatgacaaanaaggaaaaagtatacctatcatgggtaccagcacacaaaggcatagaccttttgggacagcggtg

SEQ ID NO: 412750 - DNA, 140 bp, Artificial Sequence
  Synthetic
  misc_feature (66)..(66): n is a, c, g, or t
caccgctgtcccaaaaggtctatgcctttgtgtgctggtacccatgataggtatactttttccttntttgtcatttcttctattattttttgcactaggggggagtcactttgatctggacatatcagcagccagggcct

SEQ ID NO: 412751 - DNA, 140 bp, Artificial Sequence
  Synthetic
  misc_feature (25)..(25): n is a, c, g, or t
  misc_feature (91)..(91): n is a, c, g, or t
  misc_feature (95)..(95): n is a, c, g, or t
  misc_feature (118)..(118): n is a, c, g, or t
atacgccatgctgggtctcccaaanaaggaaaaagtatacctatcatgggtaccagcacacaaaggcatagggggtaatgaagatataganaaantagtcagtaaagacattagaagngtcgtacttgggagtcggccat

SEQ ID NO: 412752 - DNA, 140 bp, Artificial Sequence
  Synthetic
  misc_feature (23)..(23): n is a, c, g, or t
  misc_feature (46)..(46): n is a, c, g, or t
  misc_feature (50)..(50): n is a, c, g, or t
  misc_feature (116)..(116): n is a, c, g, or t
atggccgactcccaagtacgacncttctaatgtctttactgactantttntctatatcttcattaccccctatgcctttgtgtgctggtacccatgataggtatactttttccttntttgggagacccagcatggcgtat

SEQ ID NO: 412753 - DNA, 140 bp, Artificial Sequence
  Synthetic
  misc_feature (85)..(85): n is a, c, g, or t
aggccctggctgctgatatgacagtaattggaaagccctagctagtgactttggccttccaccaatagtggcaaaagagattatnaacaattgtcccaaatgtcatgtaaaaggggaagcgaccttttgggacagcggtg

SEQ ID NO: 412754 - DNA, 140 bp, Artificial Sequence
  Synthetic
  misc_feature (56)..(56): n is a, c, g, or t
caccgctgtcccaaaaggtcgcttccccttttacatgacatttgggacaattgttnataatctcttttgccactattggtggaaggccaaagtcactagctagggctttccaattactgtcatatcagcagccagggcct

SEQ ID NO: 412755 - DNA, 140 bp, Artificial Sequence
  Synthetic
  misc_feature (35)..(35): n is a, c, g, or t
  misc_feature (110)..(110): n is a, c, g, or t
atacgccatgctgggtctccgcaaaagagattatnaacaattgtcccaaatgtcatgtaaaaggggaagccatgcatggacaggtagactgcagtccaggaatttggcanctggactgtacgtacttgggagtcggccat

SEQ ID NO: 412756 - DNA, 140 bp, Artificial Sequence
  Synthetic
  misc_feature (31)..(31): n is a, c, g, or t
  misc_feature (106)..(106): n is a, c, g, or t
atggccgactcccaagtacgtacagtccagntgccaaattcctggactgcagtctacctgtccatgcatggcttccccttttacatgacatttgggacaattgttnataatctcttttgcggagacccagcatggcgtat

SEQ ID NO: 412757 - DNA, 140 bp, Artificial Sequence
  Synthetic
atacgccatgctgggtctccgatgtcaaaatatctcagataatacaaaaaccataatagtgcatttgaatgaatctgtacagattaactgtacaagacccaacaacaatgtagtggaaagcgtacttgggagtcggccat

SEQ ID NO: 412758 - DNA, 140 bp, Artificial Sequence
  Synthetic
atggccgactcccaagtacgctttccactacattgttgttgggtcttgtacagttaatctgtacagattcattcaaatgcactattatggtttttgtattatctgagatattttgacatcggagacccagcatggcgtat

SEQ ID NO: 412759 - DNA, 140 bp, Artificial Sequence
  Synthetic
  misc_feature (59)..(59): n is a, c, g, or t
  misc_feature (71)..(71): n is a, c, g, or t
aggccctggctgctgatatgttcctggaagcagaagtgattccagcagaaacaggacangaaactgcatantttgtgctcaaattggcagcaagatggcctgtaaaagtgatacacacaggaccttttgggacagcggtg

SEQ ID NO: 412760 - DNA, 140 bp, Artificial Sequence
  Synthetic
  misc_feature (70)..(70): n is a, c, g, or t
  misc_feature (82)..(82): n is a, c, g, or t
caccgctgtcccaaaaggtcctgtgtgtatcacttttacaggccatcttgctgccaatttgagcacaaantatgcagtttcntgtcctgtttctgctggaatcacttctgcttccaggaacatatcagcagccagggcct

SEQ ID NO: 412761 - DNA, 140 bp, Artificial Sequence
  Synthetic
atacgccatgctgggtctccgaaacataagaaaggcatattgtaacattaatggaacacagtggaataacactttagaacgagtaaagacaaagttaaagacttatttcaataaaacaatcgtacttgggagtcggccat

SEQ ID NO: 412762 - DNA, 140 bp, Artificial Sequence
  Synthetic
atggccgactcccaagtacgattgttttattgaaataagtctttaactttgtctttactcgttctaaagtgttattccactgtgttccattaatgttacaatatgcctttcttatgtttcggagacccagcatggcgtat

SEQ ID NO: 412763 - DNA, 140 bp, Artificial Sequence
  Synthetic
aggccctggctgctgatatgactttagaacgagtaaagacaaagttaaagacttatttcaataaaacaataacatttaactcagcctcaggaggagacctagaagttacaatgcatagttgaccttttgggacagcggtg

SEQ ID NO: 412764 - DNA, 140 bp, Artificial Sequence
  Synthetic
caccgctgtcccaaaaggtcaactatgcattgtaacttctaggtctcctcctgaggctgagttaaatgttattgttttattgaaataagtctttaactttgtctttactcgttctaaagtcatatcagcagccagggcct

SEQ ID NO: 412765 - DNA, 140 bp, Artificial Sequence
  Synthetic
aggccctggctgctgatatgagtagtggaatcaatgaataaagaattaaagaaaatcatacttcaagtacgagatcaagctgaacacttaaagacagcagttcaaatggcagtatttgttgaccttttgggacagcggtg

SEQ ID NO: 412766 - DNA, 140 bp, Artificial Sequence
  Synthetic
caccgctgtcccaaaaggtcaacaaatactgccatttgaactgctgtctttaagtgttcagcttgatctcgtacttgaagtatgattttctttaattctttattcattgattccactactcatatcagcagccagggcct

SEQ ID NO: 412767 - DNA, 140 bp, Artificial Sequence
  Synthetic
atacgccatgctgggtctccaatgccatcacacccaatgtcactatcattctccaatgtagaataaaacaaattatcaacatgtggcagggagtaggacaagcaatgtatgcttctcccacgtacttgggagtcggccat

SEQ ID NO: 412768 - DNA, 140 bp, Artificial Sequence
  Synthetic
atggccgactcccaagtacgtgggagaagcatacattgcttgtcctactccctgccacatgttgataatttgttttattctacattggagaatgatagtgacattgggtgtgatggcattggagacccagcatggcgtat

SEQ ID NO: 412769 - DNA, 140 bp, Artificial Sequence
  Synthetic
aggccctggctgctgatatgaattatcaacatgtggcagggagtaggacaagcaatgtatgcttctcccattgcaggaagcattacctgtaactcaagtattacaggcctactattaacggaccttttgggacagcggtg

SEQ ID NO: 412770 - DNA, 140 bp, Artificial Sequence
  Synthetic
caccgctgtcccaaaaggtccgttaatagtaggcctgtaatacttgagttacaggtaatgcttcctgcaatgggagaagcatacattgcttgtcctactccctgccacatgttgataattcatatcagcagccagggcct

SEQ ID NO: 412771 - DNA, 140 bp, Artificial Sequence
  Synthetic
aggccctggctgctgatatgcattatcagaaggagccaccccacaagatttaaacaccatgctaaacacagtggggggacatcaagcagccatgcaaatgttaaaagagaccatcaatgagaccttttgggacagcggtg

SEQ ID NO: 412772 - DNA, 140 bp, Artificial Sequence
  Synthetic
caccgctgtcccaaaaggtctcattgatggtctcttttaacatttgcatggctgcttgatgtccccccactgtgtttagcatggtgtttaaatcttgtggggtggctccttctgataatgcatatcagcagccagggcct

SEQ ID NO: 412773 - DNA, 140 bp, Artificial Sequence
  Synthetic
aggccctggctgctgatatggatatccagagagaaagtgaaagcctggaatagtctggtcaaatatcacaaatataggtctaaaaagacaaagaattggttttataggcatcattatgaggaccttttgggacagcggtg

SEQ ID NO: 412774 - DNA, 140 bp, Artificial Sequence
  Synthetic
caccgctgtcccaaaaggtcctcataatgatgcctataaaaccaattctttgtctttttagacctatatttgtgatatttgaccagactattccaggctttcactttctctctggatatccatatcagcagccagggcct

SEQ ID NO: 412775 - DNA, 140 bp, Artificial Sequence
  Synthetic
atacgccatgctgggtctccaatataggtctaaaaagacaaagaattggttttataggcatcattatgagacagtccatcctaggattagttcaggagtttacattccagtaggagcagccgtacttgggagtcggccat

SEQ ID NO: 412776 - DNA, 140 bp, Artificial Sequence
  Synthetic
atggccgactcccaagtacggctgctcctactggaatgtaaactcctgaactaatcctaggatggactgtctcataatgatgcctataaaaccaattctttgtctttttagacctatattggagacccagcatggcgtat

SEQ ID NO: 412777 - DNA, 140 bp, Artificial Sequence
  Synthetic
aggccctggctgctgatatgaacaattaggacatggagcaagtgtggagtggagacaaggtaaatacaccacccagatagatccagaaacagcagataggctaattcatctccactacttgaccttttgggacagcggtg

SEQ ID NO: 412778 - DNA, 140 bp, Artificial Sequence
  Synthetic
caccgctgtcccaaaaggtcaagtagtggagatgaattagcctatctgctgtttctggatctatctgggtggtgtatttaccttgtctccactccacacttgctccatgtcctaattgttcatatcagcagccagggcct

SEQ ID NO: 412779 - DNA, 140 bp, Artificial Sequence
  Synthetic
atacgccatgctgggtctccacccagatagatccagaaacagcagataggctaattcatctccactactttcaatgtttttcagattcggctgtgaggagggcaatactaggggacagggcgtacttgggagtcggccat

SEQ ID NO: 412780 - DNA, 140 bp, Artificial Sequence
  Synthetic
atggccgactcccaagtacgccctgtcccctagtattgccctcctcacagccgaatctgaaaaacattgaaagtagtggagatgaattagcctatctgctgtttctggatctatctgggtggagacccagcatggcgtat

SEQ ID NO: 412781 - DNA, 140 bp, Artificial Sequence
  Synthetic
  misc_feature (112)..(112): n is a, c, g, or t
aggccctggctgctgatatgcagtttttagccttaaaagtggtagtagggaaagtaaaaaggaagccacccctccctagtgtccagatattgacacaagatatatggagcangccccagagaccttttgggacagcggtg

SEQ ID NO: 412782 - DNA, 140 bp, Artificial Sequence
  Synthetic
  misc_feature (29)..(29): n is a, c, g, or t
caccgctgtcccaaaaggtctctggggcntgctccatatatcttgtgtcaatatctggacactagggaggggtggcttcctttttactttccctactaccacttttaaggctaaaaactgcatatcagcagccagggcct

SEQ ID NO: 412783 - DNA, 140 bp, Artificial Sequence
  Synthetic
  misc_feature (62)..(62): n is a, c, g, or t
  misc_feature (77)..(77): n is a, c, g, or t
atacgccatgctgggtctcccctccctagtgtccagatattgacacaagatatatggagcangccccagaggaccangggccgccaagagagccattcaatgagtggatgctacaaacctcgtacttgggagtcggccat

SEQ ID NO: 412784 - DNA, 140 bp, Artificial Sequence
  Synthetic
  misc_feature (64)..(64): n is a, c, g, or t
  misc_feature (79)..(79): n is a, c, g, or t
atggccgactcccaagtacgaggtttgtagcatccactcattgaatggctctcttggcggcccntggtcctctggggcntgctccatatatcttgtgtcaatatctggacactagggaggggagacccagcatggcgtat

SEQ ID NO: 412785 - DNA, 140 bp, Artificial Sequence
  Synthetic
atacgccatgctgggtctccaaaattagaaaacaataatgagaatagtactacttataagttgctaagttgtaatacctcagtcgttacacaggcctgtccaaagataacctttgagccacgtacttgggagtcggccat

SEQ ID NO: 412786 - DNA, 140 bp, Artificial Sequence
  Synthetic
atggccgactcccaagtacgtggctcaaaggttatctttggacaggcctgtgtaacgactgaggtattacaacttagcaacttataagtagtactattctcattattgttttctaattttggagacccagcatggcgtat

SEQ ID NO: 412787 - DNA, 140 bp, Artificial Sequence
  Synthetic
  misc_feature (97)..(97): n is a, c, g, or t
aggccctggctgctgatatgcactcattaggacaatacatctataatacctatggggacacctgggagggagtaactgcaattattaggatcctacnacaattaatttttatccattatagaccttttgggacagcggtg

SEQ ID NO: 412788 - DNA, 140 bp, Artificial Sequence
  Synthetic
  misc_feature (44)..(44): n is a, c, g, or t
caccgctgtcccaaaaggtctataatggataaaaattaattgtngtaggatcctaataattgcagttactccctcccaggtgtccccataggtattatagatgtattgtcctaatgagtgcatatcagcagccagggcct

SEQ ID NO: 412789 - DNA, 140 bp, Artificial Sequence
  Synthetic
  misc_feature (47)..(47): n is a, c, g, or t
  misc_feature (84)..(84): n is a, c, g, or t
atacgccatgctgggtctccagtaactgcaattattaggatcctacnacaattaatttttatccattatagaattggatgtcancatagtagaataggtatattgccaccctctcgaagacgtacttgggagtcggccat

SEQ ID NO: 412790 - DNA, 140 bp, Artificial Sequence
  Synthetic
  misc_feature (57)..(57): n is a, c, g, or t
  misc_feature (94)..(94): n is a, c, g, or t
atggccgactcccaagtacgtcttcgagagggtggcaatatacctattctactatgntgacatccaattctataatggataaaaattaattgtngtaggatcctaataattgcagttactggagacccagcatggcgtat

SEQ ID NO: 412791 - DNA, 140 bp, Artificial Sequence
  Synthetic
aggccctggctgctgatatgatagtgaaataaaggtagtgccaagaagaaaagcaaagatcattagagattatggaaaacagatggcaggtgatgattgtgtggcaggtagacaggatgagaccttttgggacagcggtg

SEQ ID NO: 412792 - DNA, 140 bp, Artificial Sequence
  Synthetic
caccgctgtcccaaaaggtctcatcctgtctacctgccacacaatcatcacctgccatctgttttccataatctctaatgatctttgcttttcttcttggcactacctttatttcactatcatatcagcagccagggcct

SEQ ID NO: 412793 - DNA, 140 bp, Artificial Sequence
  Synthetic
aggccctggctgctgatatgcagggagtcagccctcaagcccatgtaacaattgctactgcaaagcctgctgctatcattgctatgtttgtttcacaaagaagggtttggggatctcctagaccttttgggacagcggtg

SEQ ID NO: 412794 - DNA, 140 bp, Artificial Sequence
  Synthetic
caccgctgtcccaaaaggtctaggagatccccaaacccttctttgtgaaacaaacatagcaatgatagcagcaggctttgcagtagcaattgttacatgggcttgagggctgactccctgcatatcagcagccagggcct

SEQ ID NO: 412795 - DNA, 140 bp, Artificial Sequence
  Synthetic
atacgccatgctgggtctcctgctatcattgctatgtttgtttcacaaagaagggtttggggatctcctatggcaggaagaagcgacgaagacctgcgagagctgataacaacaatcagacgtacttgggagtcggccat

SEQ ID NO: 412796 - DNA, 140 bp, Artificial Sequence
  Synthetic
atggccgactcccaagtacgtctgattgttgttatcagctctcgcaggtcttcgtcgcttcttcctgccataggagatccccaaacccttctttgtgaaacaaacatagcaatgatagcaggagacccagcatggcgtat

SEQ ID NO: 412797 - DNA, 140 bp, Artificial Sequence
  Synthetic
aggccctggctgctgatatgaatgcatcctagagatgaggcagtattaataatagctggggtattactaatttgcattatagtagtttgggggaaggtcctgctatttgtgctaaaagaggaccttttgggacagcggtg

SEQ ID NO: 412798 - DNA, 140 bp, Artificial Sequence
  Synthetic
caccgctgtcccaaaaggtcctcttttagcacaaatagcaggaccttcccccaaactactataatgcaaattagtaataccccagctattattaatactgcctcatctctaggatgcattcatatcagcagccagggcct

SEQ ID NO: 412799 - DNA, 140 bp, Artificial Sequence
  Synthetic
atacgccatgctgggtctcctttgcattatagtagtttgggggaaggtcctgctatttgtgctaaaagagagagaaagggataagtttgtacaaaggctagtaaggtggagagaaaggcacgtacttgggagtcggccat

SEQ ID NO: 412800 - DNA, 140 bp, Artificial Sequence
  Synthetic
atggccgactcccaagtacgtgcctttctctccaccttactagcctttgtacaaacttatccctttctctctcttttagcacaaatagcaggaccttcccccaaactactataatgcaaaggagacccagcatggcgtat

SEQ ID NO: 412801 - DNA, 140 bp, Artificial Sequence
  Synthetic
aggccctggctgctgatatgaacttgggaatttgcttggctttggtaatatactttaatgctattagctgtgctagtggaatacactatgttactgtatattatggggttccagtttggagaccttttgggacagcggtg

SEQ ID NO: 412802 - DNA, 140 bp, Artificial Sequence
  Synthetic
caccgctgtcccaaaaggtctccaaactggaaccccataatatacagtaacatagtgtattccactagcacagctaatagcattaaagtatattaccaaagccaagcaaattcccaagttcatatcagcagccagggcct

SEQ ID NO: 412803 - DNA, 140 bp, Artificial Sequence
  Synthetic
atacgccatgctgggtctccaagcgaaagcgaaccgagaatttctctcgacgcaggactcggcttgctgtaagtgccacggcaagaggcgagagcggcggctggtgagtacgccaattttcgtacttgggagtcggccat

SEQ ID NO: 412804 - DNA, 140 bp, Artificial Sequence
  Synthetic
atggccgactcccaagtacgaaaattggcgtactcaccagccgccgctctcgcctcttgccgtggcacttacagcaagccgagtcctgcgtcgagagaaattctcggttcgctttcgcttggagacccagcatggcgtat

SEQ ID NO: 412805 - DNA, 140 bp, Artificial Sequence
  Synthetic
aggccctggctgctgatatgtacaccaatagagatcccgataaatgtaacagagtcttttaatatttggaaaaattatatggtgacacaaatgcaggaagacatcattagcttatgggatgaccttttgggacagcggtg

SEQ ID NO: 412806 - DNA, 140 bp, Artificial Sequence
  Synthetic
caccgctgtcccaaaaggtcatcccataagctaatgatgtcttcctgcatttgtgtcaccatataatttttccaaatattaaaagactctgttacatttatcgggatctctattggtgtacatatcagcagccagggcct

SEQ ID NO: 412807 - DNA, 140 bp, Artificial Sequence
  Synthetic
atacgccatgctgggtctcctaagaacactgcaacaactactgtttattcatttcagaatcgggtgtcaccatagcagaataggcattattcgacagagaagagggagaaatggagccagcgtacttgggagtcggccat

SEQ ID NO: 412808 - DNA, 140 bp, Artificial Sequence
  Synthetic
atggccgactcccaagtacgctggctccatttctccctcttctctgtcgaataatgcctattctgctatggtgacacccgattctgaaatgaataaacagtagttgttgcagtgttcttaggagacccagcatggcgtat

SEQ ID NO: 412809 - DNA, 140 bp, Artificial Sequence
  Synthetic
  misc_feature (30)..(30): n is a, c, g, or t
aggccctggctgctgatatgctgtgaatancaccgccgacaatccattagatctatttaagtgcagttttaatacaaccacagtattgaaagataaaaagcagggacagcaagcactcttgaccttttgggacagcggtg

SEQ ID NO: 412810 - DNA, 140 bp, Artificial Sequence
  Synthetic
  misc_feature (111)..(111): n is a, c, g, or t
caccgctgtcccaaaaggtcaagagtgcttgctgtccctgctttttatctttcaatactgtggttgtattaaaactgcacttaaatagatctaatggattgtcggcggtgntattcacagcatatcagcagccagggcct

SEQ ID NO: 412811 - DNA, 140 bp, Artificial Sequence
  Synthetic
atacgccatgctgggtctccaatacaaccacagtattgaaagataaaaagcagggacagcaagcactcttctatagaacagacctaatagcactgaatgagacagcaaataatacactatcgtacttgggagtcggccat

SEQ ID NO: 412812 - DNA, 140 bp, Artificial Sequence
  Synthetic
atggccgactcccaagtacgatagtgtattatttgctgtctcattcagtgctattaggtctgttctatagaagagtgcttgctgtccctgctttttatctttcaatactgtggttgtattggagacccagcatggcgtat

SEQ ID NO: 412813 - DNA, 140 bp, Artificial Sequence
  Synthetic
atacgccatgctgggtctccgagcagtaagtaaaaccaattatatgtgatgagacctttacaaatagcagcaatagtaggagtaatagtagcaattttcttagcaatagttgtgtggacccgtacttgggagtcggccat

SEQ ID NO: 412814 - DNA, 140 bp, Artificial Sequence
  Synthetic
atggccgactcccaagtacgggtccacacaactattgctaagaaaattgctactattactcctactattgctgctatttgtaaaggtctcatcacatataattggttttacttactgctcggagacccagcatggcgtat

SEQ ID NO: 412815 - DNA, 140 bp, Artificial Sequence
  Synthetic
aggccctggctgctgatatggtgacttttgagccactacccatacagtattgtgcaccagcagggtatgcactaatgaaatgcaatcagaaaggatttaatggtacaggaccttgtaatcgaccttttgggacagcggtg

SEQ ID NO: 412816 - DNA, 140 bp, Artificial Sequence
  Synthetic
caccgctgtcccaaaaggtcgattacaaggtcctgtaccattaaatcctttctgattgcatttcattagtgcataccctgctggtgcacaatactgtatgggtagtggctcaaaagtcaccatatcagcagccagggcct

SEQ ID NO: 412817 - DNA, 140 bp, Artificial Sequence
  Synthetic
atacgccatgctgggtctccactaatgaaatgcaatcagaaaggatttaatggtacaggaccttgtaatcagacagtcataacacactgtacacatggaattaagccaacagtatcaacacgtacttgggagtcggccat

SEQ ID NO: 412818 - DNA, 140 bp, Artificial Sequence
  Synthetic
atggccgactcccaagtacgtgttgatactgttggcttaattccatgtgtacagtgtgttatgactgtctgattacaaggtcctgtaccattaaatcctttctgattgcatttcattagtggagacccagcatggcgtat

SEQ ID NO: 412819 - DNA, 140 bp, Artificial Sequence
  Synthetic
atacgccatgctgggtctccatggagacactgatgaactgcacaaacttgtggagatggggcctcatgatctttggaatgttaatgacttgtagtgctacaggaaacatgtgggtcacagcgtacttgggagtcggccat

SEQ ID NO: 412820 - DNA, 140 bp, Artificial Sequence
  Synthetic
atggccgactcccaagtacgctgtgacccacatgtttcctgtagcactacaagtcattaacattccaaagatcatgaggccccatctccacaagtttgtgcagttcatcagtgtctccatggagacccagcatggcgtat

SEQ ID NO: 412821 - DNA, 140 bp, Artificial Sequence
  Synthetic
aggccctggctgctgatatgagaagacagtggcaatgaaagtgaaggggatcaagaagaattgtcagcacttgtggtggagatggggcacgatgctccttgggatgttaatgatttgtaggaccttttgggacagcggtg

SEQ ID NO: 412822 - DNA, 140 bp, Artificial Sequence
  Synthetic
caccgctgtcccaaaaggtcctacaaatcattaacatcccaaggagcatcgtgccccatctccaccacaagtgctgacaattcttcttgatccccttcactttcattgccactgtcttctcatatcagcagccagggcct

SEQ ID NO: 412823 - DNA, 140 bp, Artificial Sequence
  Synthetic
atacgccatgctgggtctccatgtgtcaatcacctgtgtaagaccaggtaataacacaagaggacaagtgcaaataggacccatgacctggtataatatgaaattctacacaggtgatatcgtacttgggagtcggccat

SEQ ID NO: 412824 - DNA, 140 bp, Artificial Sequence
  Synthetic
atggccgactcccaagtacgatatcacctgtgtagaatttcatattataccaggtcatgggtcctatttgcacttgtcctcttgtgttattacctggtcttacacaggtgattgacacatggagacccagcatggcgtat

SEQ ID NO: 412825 - DNA, 140 bp, Artificial Sequence
  Synthetic
atacgccatgctgggtctccgcatctaatgctaaagcatatagtactgaaggccataatatctgggctacacatgcttgtgtacccacagacccaaacccacaagagataattctggaaacgtacttgggagtcggccat

SEQ ID NO: 412826 - DNA, 140 bp, Artificial Sequence
  Synthetic
atggccgactcccaagtacgtttccagaattatctcttgtgggtttgggtctgtgggtacacaagcatgtgtagcccagatattatggccttcagtactatatgctttagcattagatgcggagacccagcatggcgtat

SEQ ID NO: 412827 - DNA, 140 bp, Artificial Sequence
  Synthetic
aggccctggctgctgatatgaatctgtcagtgaggccatctggaaagcttatcctcaaccccccaaccaaaaccatacatttgtctttcgaaacagtacagggggagacccagaggtttcgaccttttgggacagcggtg

SEQ ID NO: 412828 - DNA, 140 bp, Artificial Sequence
  Synthetic
caccgctgtcccaaaaggtcgaaacctctgggtctccccctgtactgtttcgaaagacaaatgtatggttttggttggggggttgaggataagctttccagatggcctcactgacagattcatatcagcagccagggcct

SEQ ID NO: 412829 - DNA, 140 bp, Artificial Sequence
  Synthetic
  misc_feature (82)..(82): n is a, c, g, or t
atacgccatgctgggtctccaaccatacatttgtctttcgaaacagtacagggggagacccagaggtttcttttctgcactncaattgtcatggggaattcttttattgtaacaccagtacgtacttgggagtcggccat

SEQ ID NO: 412830 - DNA, 140 bp, Artificial Sequence
  Synthetic
  misc_feature (59)..(59): n is a, c, g, or t
atggccgactcccaagtacgtactggtgttacaataaaagaattccccatgacaattgnagtgcagaaaagaaacctctgggtctccccctgtactgtttcgaaagacaaatgtatggttggagacccagcatggcgtat

SEQ ID NO: 412831 - DNA, 140 bp, Artificial Sequence
  Synthetic
atacgccatgctgggtctcccatttcaatataactggaggaggtaggaggaagaaagaatatgcgcttttctataaagaagatatagcactaattaaagataggcctaataatagtaattcgtacttgggagtcggccat

SEQ ID NO: 412832 - DNA, 140 bp, Artificial Sequence
  Synthetic
atggccgactcccaagtacgaattactattattaggcctatctttaattagtgctatatcttctttatagaaaagcgcatattctttcttcctcctacctcctccagttatattgaaatgggagacccagcatggcgtat

SEQ ID NO: 412833 - DNA, 140 bp, Artificial Sequence
  Synthetic
aggccctggctgctgatatggtgcatttgctagcaagagtagattatagattaggagtagcagctctgataatagcattgatcatagcaatagttgtgtggatcatagtatacatagaatgaccttttgggacagcggtg

SEQ ID NO: 412834 - DNA, 140 bp, Artificial Sequence
  Synthetic
caccgctgtcccaaaaggtcattctatgtatactatgatccacacaactattgctatgatcaatgctattatcagagctgctactcctaatctataatctactcttgctagcaaatgcaccatatcagcagccagggcct

SEQ ID NO: 412835 - DNA, 140 bp, Artificial Sequence
  Synthetic
aggccctggctgctgatatgtcagcacagtacaatgtacacatggaattaagccagtagtgtcaactcaactgctgttaaatggcagtctagcagaagacggggtagtaattagatctgagaccttttgggacagcggtg

SEQ ID NO: 412836 - DNA, 140 bp, Artificial Sequence
  Synthetic
caccgctgtcccaaaaggtctcagatctaattactaccccgtcttctgctagactgccatttaacagcagttgagttgacactactggcttaattccatgtgtacattgtactgtgctgacatatcagcagccagggcct

SEQ ID NO: 412837 - DNA, 140 bp, Artificial Sequence
  Synthetic
atacgccatgctgggtctcctagttcaagtaaaggctctggctgtggcacctacaagagtctccagacctacaatcatggctcatgatgctcataggaaaaaaaggggagcaggcctaggcgtacttgggagtcggccat

SEQ ID NO: 412838 - DNA, 140 bp, Artificial Sequence
  Synthetic
atggccgactcccaagtacgcctaggcctgctcccctttttttcctatgagcatcatgagccatgattgtaggtctggagactcttgtaggtgccacagccagagcctttacttgaactaggagacccagcatggcgtat

SEQ ID NO: 412839 - DNA, 140 bp, Artificial Sequence
  Synthetic
atacgccatgctgggtctccgtatcaactcaactactgctgaatgggagtatagcagaagaagaaataataattagatctgaaaatattacaaacaatgctaagaccataatagttcaaccgtacttgggagtcggccat

SEQ ID NO: 412840 - DNA, 140 bp, Artificial Sequence
  Synthetic
atggccgactcccaagtacggttgaactattatggtcttagcattgtttgtaatattttcagatctaattattatttcttcttctgctatactcccattcagcagtagttgagttgatacggagacccagcatggcgtat

SEQ ID NO: 412841 - DNA, 140 bp, Artificial Sequence
  Synthetic
atacgccatgctgggtctccactcctaaacctatggggctgtaaaggaaatctaatctgctacacatcagtaaaatggaacaatacatggggcggagatagggacttaggaaacatttggcgtacttgggagtcggccat

SEQ ID NO: 412842 - DNA, 140 bp, Artificial Sequence
  Synthetic
atggccgactcccaagtacgccaaatgtttcctaagtccctatctccgccccatgtattgttccattttactgatgtgtagcagattagatttcctttacagccccataggtttaggagtggagacccagcatggcgtat

SEQ ID NO: 412843 - DNA, 140 bp, Artificial Sequence
  Synthetic
aggccctggctgctgatatgcggcagttacgctgacggtacaggccaggcaattattgcatggtatagtgcagcagcagaacaatatgctacgagctatagaggcacagcaagaattgctgaccttttgggacagcggtg

SEQ ID NO: 412844 - DNA, 140 bp, Artificial Sequence
  Synthetic
caccgctgtcccaaaaggtcagcaattcttgctgtgcctctatagctcgtagcatattgttctgctgctgcactataccatgcaataattgcctggcctgtaccgtcagcgtaactgccgcatatcagcagccagggcct

SEQ ID NO: 412845 - DNA, 140 bp, Artificial Sequence
  Synthetic
atacgccatgctgggtctccaaaggtatacacacgggaccaggacaagtgctctatgcaacaggggcagtagtaggagatataagacaagcacattgtaatgttagtagaaagaactggacgtacttgggagtcggccat

SEQ ID NO: 412846 - DNA, 140 bp, Artificial Sequence
  Synthetic
atggccgactcccaagtacgtccagttctttctactaacattacaatgtgcttgtcttatatctcctactactgcccctgttgcatagagcacttgtcctggtcccgtgtgtatacctttggagacccagcatggcgtat

SEQ ID NO: 412847 - DNA, 140 bp, Artificial Sequence
  Synthetic
aggccctggctgctgatatgagtaggagatataagacaagcacattgtaatgttagtagaaagaactggaccgacaccctacataaggtaactgcaaaactaaaggaatactttaatacagaccttttgggacagcggtg

SEQ ID NO: 412848 - DNA, 140 bp, Artificial Sequence
  Synthetic
caccgctgtcccaaaaggtctgtattaaagtattcctttagttttgcagttaccttatgtagggtgtcggtccagttctttctactaacattacaatgtgcttgtcttatatctcctactcatatcagcagccagggcct

SEQ ID NO: 412849 - DNA, 140 bp, Artificial Sequence
  Synthetic
aggccctggctgctgatatgggacaaacagtatgttatactaatgtgccatggaataggagctggaccaacaaaagtgagactgaattagatggcatttggactaatctaacatggcagggaccttttgggacagcggtg

SEQ ID NO: 412850 - DNA, 140 bp, Artificial Sequence
  Synthetic
caccgctgtcccaaaaggtccctgccatgttagattagtccaaatgccatctaattcagtctcacttttgttggtccagctcctattccatggcacattagtataacatactgtttgtcccatatcagcagccagggcct

SEQ ID NO: 412851 - DNA, 140 bp, Artificial Sequence
  Synthetic
aggccctggctgctgatatgaaaagcaatgtatgcccctcccatccgaggagtaattaactgttcatcaaatattacagggctactattaatgagagatggtggtaatgagaccaacaccgaccttttgggacagcggtg

SEQ ID NO: 412852 - DNA, 140 bp, Artificial Sequence
  Synthetic
caccgctgtcccaaaaggtcggtgttggtctcattaccaccatctctcattaatagtagccctgtaatatttgatgaacagttaattactcctcggatgggaggggcatacattgcttttcatatcagcagccagggcct

SEQ ID NO: 412853 - DNA, 140 bp, Artificial Sequence
  Synthetic
aggccctggctgctgatatgttaataaatcattattgaatgagactagtaatgagactacagatggtgcaaataatactatcacactcacatgtagaataaagcaaattgtaagaatgtggaccttttgggacagcggtg

SEQ ID NO: 412854 - DNA, 140 bp, Artificial Sequence
  Synthetic
caccgctgtcccaaaaggtccacattcttacaatttgctttattctacatgtgagtgtgatagtattatttgcaccatctgtagtctcattactagtctcattcaataatgatttattaacatatcagcagccagggcct

SEQ ID NO: 412855 - DNA, 140 bp, Artificial Sequence
  Synthetic
aggccctggctgctgatatgagaccaatgggcacaattgtggaactggttggacataacacaatggttgtggtacataaagattttcattatgatagtaggaggaataataggactaagagaccttttgggacagcggtg

SEQ ID NO: 412856 - DNA, 140 bp, Artificial Sequence
  Synthetic
caccgctgtcccaaaaggtctcttagtcctattattcctcctactatcataatgaaaatctttatgtaccacaaccattgtgttatgtccaaccagttccacaattgtgcccattggtctcatatcagcagccagggcct

SEQ ID NO: 412857 - DNA, 140 bp, Artificial Sequence
  Synthetic
aggccctggctgctgatatgacagtacttggcactagcagcattaataacaccaaaaaagataaagccacctttgcctagtgttacgaaactgacagaggatagatggaacaagccccaggaccttttgggacagcggtg

SEQ ID NO: 412858 - DNA, 140 bp, Artificial Sequence
  Synthetic
caccgctgtcccaaaaggtcctggggcttgttccatctatcctctgtcagtttcgtaacactaggcaaaggtggctttatcttttttggtgttattaatgctgctagtgccaagtactgtcatatcagcagccagggcct

SEQ ID NO: 412859 - DNA, 140 bp, Artificial Sequence
  Synthetic
aggccctggctgctgatatgcaccaggaacaaacgaagaaggtggagaagcaggcaacggcagatcgatcagattgctggacggattcttgcctctcgtctgggacgacctgaagaacctgaccttttgggacagcggtg

SEQ ID NO: 412860 - DNA, 140 bp, Artificial Sequence
  Synthetic
caccgctgtcccaaaaggtcaggttcttcaggtcgtcccagacgagaggcaagaatccgtccagcaatctgatcgatctgccgttgcctgcttctccaccttcttcgtttgttcctggtgcatatcagcagccagggcct

SEQ ID NO: 412861 - DNA, 140 bp, Artificial Sequence
  Synthetic
atacgccatgctgggtctccagattgctggacggattcttgcctctcgtctgggacgacctgaagaacctggtggtgcagatctaccagatcttagtcggctgcatattggggatcaaggcgtacttgggagtcggccat

SEQ ID NO: 412862 - DNA, 140 bp, Artificial Sequence
  Synthetic
atggccgactcccaagtacgccttgatccccaatatgcagccgactaagatctggtagatctgcaccaccaggttcttcaggtcgtcccagacgagaggcaagaatccgtccagcaatctggagacccagcatggcgtat

SEQ ID NO: 412863 - DNA, 140 bp, Artificial Sequence
  Synthetic
atacgccatgctgggtctcccaaggagaagtctaaggataggaccaggacaaacattctatacaaatgacataataggagacataagacaagcacattgtaatgttagtaaaggaacatgcgtacttgggagtcggccat

SEQ ID NO: 412864 - DNA, 140 bp, Artificial Sequence
  Synthetic
atggccgactcccaagtacgcatgttcctttactaacattacaatgtgcttgtcttatgtctcctattatgtcatttgtatagaatgtttgtcctggtcctatccttagacttctccttgggagacccagcatggcgtat

SEQ ID NO: 412865 - DNA, 140 bp, Artificial Sequence
  Synthetic
aggccctggctgctgatatgcttaactgcctgcgagactgctttgctgcgtgtggctattggactcaagaattaaaacaaagtgcaaccagcttattggacactgttgctatatcagttggaccttttgggacagcggtg

SEQ ID NO: 412866 - DNA, 140 bp, Artificial Sequence
  Synthetic
caccgctgtcccaaaaggtccaactgatatagcaacagtgtccaataagctggttgcactttgttttaattcttgagtccaatagccacacgcagcaaagcagtctcgcaggcagttaagcatatcagcagccagggcct

SEQ ID NO: 412867 - DNA, 140 bp, Artificial Sequence
  Synthetic
atacgccatgctgggtctccattaaaacaaagtgcaaccagcttattggacactgttgctatatcagttgcagggtggactgatcaagtaataatagtagggcaacaaataggaagaggccgtacttgggagtcggccat

SEQ ID NO: 412868 - DNA, 140 bp, Artificial Sequence
  Synthetic
atggccgactcccaagtacggcctcttcctatttgttgccctactattattacttgatcagtccaccctgcaactgatatagcaacagtgtccaataagctggttgcactttgttttaatggagacccagcatggcgtat

SEQ ID NO: 412869 - DNA, 140 bp, Artificial Sequence
  Synthetic
aggccctggctgctgatatgttggataagtgggcaagtttgtggaattggtttagcatatcaaattggctgtggtatataaaaatattcataatgatagtaggaggcttgataggtttaagaccttttgggacagcggtg

SEQ ID NO: 412870 - DNA, 140 bp, Artificial Sequence
  Synthetic
caccgctgtcccaaaaggtcttaaacctatcaagcctcctactatcattatgaatatttttatataccacagccaatttgatatgctaaaccaattccacaaacttgcccacttatccaacatatcagcagccagggcct

SEQ ID NO: 412871 - DNA, 140 bp, Artificial Sequence
  Synthetic
aggccctggctgctgatatgataatggggaatgcatggaagaaaagtagcttagtgggctggccagcagtcagagaaagaatgaatcagactgccccagaaacacctgcatctggggttggaccttttgggacagcggtg

SEQ ID NO: 412872 - DNA, 140 bp, Artificial Sequence
  Synthetic
caccgctgtcccaaaaggtccaaccccagatgcaggtgtttctggggcagtctgattcattctttctctgactgctggccagcccactaagctacttttcttccatgcattccccattatcatatcagcagccagggcct

SEQ ID NO: 412873 - DNA, 140 bp, Artificial Sequence
  Synthetic
aggccctggctgctgatatgatagacaggttaattgatagaataagtgaaagagcagaagacagtggcaatgagagtgaaggggatcaggaagaattatcagcacttgtggagatggggcgaccttttgggacagcggtg

SEQ ID NO: 412874 - DNA, 140 bp, Artificial Sequence
  Synthetic
caccgctgtcccaaaaggtcgccccatctccacaagtgctgataattcttcctgatccccttcactctcattgccactgtcttctgctctttcacttattctatcaattaacctgtctatcatatcagcagccagggcct

SEQ ID NO: 412875 - DNA, 140 bp, Artificial Sequence
  Synthetic
atacgccatgctgggtctccgaagaagtaggattcccagtcaggcctcaagtacccgtaagacccatgacatacaaggcagcatttgacctcagcttctttttaaaagaaaaggggggaccgtacttgggagtcggccat

SEQ ID NO: 412876 - DNA, 140 bp, Artificial Sequence
  Synthetic
atggccgactcccaagtacggtccccccttttcttttaaaaagaagctgaggtcaaatgctgccttgtatgtcatgggtcttacgggtacttgaggcctgactgggaatcctacttcttcggagacccagcatggcgtat

SEQ ID NO: 412877 - DNA, 140 bp, Artificial Sequence
  Synthetic
atacgccatgctgggtctccgtggcgcccgaacagggacttgaaagtgaaagtaaaaccagggaagaaaacctccgacgcaacgggctcggcttagcggagtgcacctgctaagaggcgacgtacttgggagtcggccat

SEQ ID NO: 412878 - DNA, 140 bp, Artificial Sequence
  Synthetic
atggccgactcccaagtacgtcgcctcttagcaggtgcactccgctaagccgagcccgttgcgtcggaggttttcttccctggttttactttcactttcaagtccctgttcgggcgccacggagacccagcatggcgtat

SEQ ID NO: 412879 - DNA, 140 bp, Artificial Sequence
  Synthetic
aggccctggctgctgatatgcctccgacgcaacgggctcggcttagcggagtgcacctgctaagaggcgagagggactcacaagagggtgagtaaatttgctggcggtggccagacctaggaccttttgggacagcggtg

SEQ ID NO: 412880 - DNA, 140 bp, Artificial Sequence
  Synthetic
caccgctgtcccaaaaggtcctaggtctggccaccgccagcaaatttactcaccctcttgtgagtccctctcgcctcttagcaggtgcactccgctaagccgagcccgttgcgtcggaggcatatcagcagccagggcct

SEQ ID NO: 412881 - DNA, 140 bp, Artificial Sequence
  Synthetic
  misc_feature (75)..(75): n is a, c, g, or t
  misc_feature (92)..(92): n is a, c, g, or t
atacgccatgctgggtctccagttggatggcctgcagtaagggatagaataagacgaacccctctaacagcaganagagcagcagaaggagnaggagcagtatctcaagatttagctaagcgtacttgggagtcggccat

SEQ ID NO: 412882 - DNA, 140 bp, Artificial Sequence
  Synthetic
  misc_feature (49)..(49): n is a, c, g, or t
  misc_feature (66)..(66): n is a, c, g, or t
atggccgactcccaagtacgcttagctaaatcttgagatactgctcctnctccttctgctgctctntctgctgttagaggggttcgtcttattctatcccttactgcaggccatccaactggagacccagcatggcgtat

SEQ ID NO: 412883 - DNA, 140 bp, Artificial Sequence
  Synthetic
atacgccatgctgggtctccagatcctcaagtatctggggaatcttgccctatattgggggagggaactaaagaatagtgctattagtttgctcgataccatagcaataacagtagctgacgtacttgggagtcggccat

SEQ ID NO: 412884 - DNA, 140 bp, Artificial Sequence
  Synthetic
atggccgactcccaagtacgtcagctactgttattgctatggtatcgagcaaactaatagcactattctttagttccctcccccaatatagggcaagattccccagatacttgaggatctggagacccagcatggcgtat

SEQ ID NO: 412885 - DNA, 140 bp, Artificial Sequence
  Synthetic
aggccctggctgctgatatgaagaatagtgctattagtttgctcgataccatagcaataacagtagctgaagcaacagataggatcatagaaatagcacaaagagcctttagggcgattcgaccttttgggacagcggtg

SEQ ID NO: 412886 - DNA, 140 bp, Artificial Sequence
  Synthetic
caccgctgtcccaaaaggtcgaatcgccctaaaggctctttgtgctatttctatgatcctatctgttgcttcagctactgttattgctatggtatcgagcaaactaatagcactattcttcatatcagcagccagggcct

SEQ ID NO: 412887 - DNA, 140 bp, Artificial Sequence
  Synthetic
atacgccatgctgggtctccagccagcagcagagccagcggcagagggggtgggagcagtatctcgggacctggaaaaacatggagcaatcacaagcagcaatgctaatcatcctgataacgtacttgggagtcggccat

SEQ ID NO: 412888 - DNA, 140 bp, Artificial Sequence
  Synthetic
atggccgactcccaagtacgttatcaggatgattagcattgctgcttgtgattgctccatgtttttccaggtcccgagatactgctcccaccccctctgccgctggctctgctgctggctggagacccagcatggcgtat

SEQ ID NO: 412889 - DNA, 140 bp, Artificial Sequence
  Synthetic
aggccctggctgctgatatgcctgcaatcactctggaacacaatagcagtactctggtgtgttcacaaacgatacaaagttgaagacacacagcaggcaatacaaaaacttaaggaagtagaccttttgggacagcggtg

SEQ ID NO: 412890 - DNA, 140 bp, Artificial Sequence
  Synthetic
caccgctgtcccaaaaggtctacttccttaagtttttgtattgcctgctgtgtgtcttcaactttgtatcgtttgtgaacacaccagagtactgctattgtgttccagagtgattgcaggcatatcagcagccagggcct

SEQ ID NO: 412891 - DNA, 140 bp, Artificial Sequence
  Synthetic
atacgccatgctgggtctccatggggagcaactggtcaaaaagcagtataattggatggccgcaggtaagggaaagaatgaagcgagctcctgctccagcagcagagggagtaggagcagcgtacttgggagtcggccat

SEQ ID NO: 412892 - DNA, 140 bp, Artificial Sequence
  Synthetic
atggccgactcccaagtacgctgctcctactccctctgctgctggagcaggagctcgcttcattctttcccttacctgcggccatccaattatactgctttttgaccagttgctccccatggagacccagcatggcgtat

SEQ ID NO: 412893 - DNA, 140 bp, Artificial Sequence
  Synthetic
aggccctggctgctgatatgggaaagaatgaagcgagctcctgctccagcagcagagggagtaggagcagtgtctcgagatttggataagcatggggcaatcacaagcagcaatacaccagaccttttgggacagcggtg

SEQ ID NO: 412894 - DNA, 140 bp, Artificial Sequence
  Synthetic
caccgctgtcccaaaaggtctggtgtattgctgcttgtgattgccccatgcttatccaaatctcgagacactgctcctactccctctgctgctggagcaggagctcgcttcattctttcccatatcagcagccagggcct

SEQ ID NO: 412895 - DNA, 140 bp, Artificial Sequence
  Synthetic
aggccctggctgctgatatgttgataggtttgagaataattttaggtgtgctctctatagtaaaaagagttaggcagggatactcacctttgtcgtttcagacccttaccccaaacccgagaccttttgggacagcggtg

SEQ ID NO: 412896 - DNA, 140 bp, Artificial Sequence
  Synthetic
caccgctgtcccaaaaggtctcgggtttggggtaagggtctgaaacgacaaaggtgagtatccctgcctaactctttttactatagagagcacacctaaaattattctcaaacctatcaacatatcagcagccagggcct

SEQ ID NO: 412897 - DNA, 140 bp, Artificial Sequence
  Synthetic
aggccctggctgctgatatgtaggcagggatactcacctttgtcgtttcagacccttaccccaaacccgaggggacccgacaggctcggaagaatcgaagaagaaggtggagagcaagacgaccttttgggacagcggtg

SEQ ID NO: 412898 - DNA, 140 bp, Artificial Sequence
  Synthetic
caccgctgtcccaaaaggtcgtcttgctctccaccttcttcttcgattcttccgagcctgtcgggtcccctcgggtttggggtaagggtctgaaacgacaaaggtgagtatccctgcctacatatcagcagccagggcct

SEQ ID NO: 412899 - DNA, 140 bp, Artificial Sequence
  Synthetic
aggccctggctgctgatatgtacaatgtacacatggaattaggccagtagtatcaactcaactgctgttaaatggcagtctagcagaaggagaggtaataattagatctgaaaatatcacgaccttttgggacagcggtg

SEQ ID NO: 412900 - DNA, 140 bp, Artificial Sequence
  Synthetic
caccgctgtcccaaaaggtcgtgatattttcagatctaattattacctctccttctgctagactgccatttaacagcagttgagttgatactactggcctaattccatgtgtacattgtacatatcagcagccagggcct

SEQ ID NO: 412901 - DNA, 140 bp, Artificial Sequence
  Synthetic
atacgccatgctgggtctccgagctttacaagtgttaaaagaagtaatcaatgatgaagcagccgaatgggatagaattcacccacaaccggtagggccgttaccaccaggacagataagcgtacttgggagtcggccat

SEQ ID NO: 412902 - DNA, 140 bp, Artificial Sequence
  Synthetic
atggccgactcccaagtacgcttatctgtcctggtggtaacggccctaccggttgtgggtgaattctatcccattcggctgcttcatcattgattacttcttttaacacttgtaaagctcggagacccagcatggcgtat

SEQ ID NO: 412903 - DNA, 140 bp, Artificial Sequence
  Synthetic
aggccctggctgctgatatggatagaattcacccacaaccggtagggccgttaccaccaggacagataagggaaccaacaggaagtgacattgctggaacaactagcacacagcaagaacgaccttttgggacagcggtg

SEQ ID NO: 412904 - DNA, 140 bp, Artificial Sequence
  Synthetic
caccgctgtcccaaaaggtcgttcttgctgtgtgctagttgttccagcaatgtcacttcctgttggttcccttatctgtcctggtggtaacggccctaccggttgtgggtgaattctatccatatcagcagccagggcct

SEQ ID NO: 412905 - DNA, 140 bp, Artificial Sequence
  Synthetic
  misc_feature (73)..(73): n is a, c, g, or t
atacgccatgctgggtctccctgagatcattattcaatacagtagcaaccctctgttgtgtacatctaagagnagatgtaaaagataccaaggaagctttagataaaatagaggagataccgtacttgggagtcggccat

SEQ ID NO: 412906 - DNA, 140 bp, Artificial Sequence
  Synthetic
  misc_feature (68)..(68): n is a, c, g, or t
atggccgactcccaagtacggtatctcctctattttatctaaagcttccttggtatcttttacatctnctcttagatgtacacaacagagggttgctactgtattgaataatgatctcagggagacccagcatggcgtat

SEQ ID NO: 412907 - DNA, 140 bp, Artificial Sequence
  Synthetic
atacgccatgctgggtctccagatgatggtagcctgtcaaggagtaggagggccaactcataaggcaaaaatactagcagaagctatggcctcagcccaccaagacataaaaggaggatacgtacttgggagtcggccat

SEQ ID NO: 412908 - DNA, 140 bp, Artificial Sequence
  Synthetic
atggccgactcccaagtacgtatcctccttttatgtcttggtgggctgaggccatagcttctgctagtatttttgccttatgagttggccctcctactccttgacaggctaccatcatctggagacccagcatggcgtat

SEQ ID NO: 412909 - DNA, 140 bp, Artificial Sequence
  Synthetic
atacgccatgctgggtctcctaaagtgtttcaactgtggaaaagagggacatgtagcaagaaattgtcgagcacctaggaaaaaaggttgctggaaatgtggacaggaaggtcaccaaatcgtacttgggagtcggccat

SEQ ID NO: 412910 - DNA, 140 bp, Artificial Sequence
  Synthetic
atggccgactcccaagtacgatttggtgaccttcctgtccacatttccagcaaccttttttcctaggtgctcgacaatttcttgctacatgtccctcttttccacagttgaaacactttaggagacccagcatggcgtat

SEQ ID NO: 412911 - DNA, 140 bp, Artificial Sequence
  Synthetic
atacgccatgctgggtctccgaaagattgtaaacatcaggcaaattttttagggagatactggcctccagggggcacgaggccaggcaattatttacagaaacaagtgtccccatcagcacgtacttgggagtcggccat

SEQ ID NO: 412912 - DNA, 140 bp, Artificial Sequence
  Synthetic
atggccgactcccaagtacgtgctgatggggacacttgtttctgtaaataattgcctggcctcgtgccccctggaggccagtatctccctaaaaaatttgcctgatgtttacaatctttcggagacccagcatggcgtat

SEQ ID NO: 412913 - DNA, 140 bp, Artificial Sequence
  Synthetic
aggccctggctgctgatatgcggaaaggtcagtcaaaattatcctatagtgcagaatctccaagggcaaatggtacatcaggccatatcacctagaactttgaatgcatgggtaaaagtagaccttttgggacagcggtg

SEQ ID NO: 412914 - DNA, 140 bp, Artificial Sequence
  Synthetic
caccgctgtcccaaaaggtctacttttacccatgcattcaaagttctaggtgatatggcctgatgtaccatttgcccttggagattctgcactataggataattttgactgacctttccgcatatcagcagccagggcct

SEQ ID NO: 412915 - DNA, 140 bp, Artificial Sequence
  Synthetic
aggccctggctgctgatatgggggatacttgggagggagttgaagctataataaggatgttgcaacaactactgtttatccatttcagaattgggtgccatcatagcagaataggcattagaccttttgggacagcggtg

SEQ ID NO: 412916 - DNA, 140 bp, Artificial Sequence
  Synthetic
caccgctgtcccaaaaggtctaatgcctattctgctatgatggcacccaattctgaaatggataaacagtagttgttgcaacatccttattatagcttcaactccctcccaagtatcccccatatcagcagccagggcct

SEQ ID NO: 412917 - DNA, 140 bp, Artificial Sequence
  Synthetic
atacgccatgctgggtctcccatatttcaaagttcaatgacgaaaattctagatccatttaggaaagataacccagaaatagaaatttgccagtacatggatgacttatatgtaggatcacgtacttgggagtcggccat

SEQ ID NO: 412918 - DNA, 140 bp, Artificial Sequence
  Synthetic
atggccgactcccaagtacgtgatcctacatataagtcatccatgtactggcaaatttctatttctgggttatctttcctaaatggatctagaattttcgtcattgaactttgaaatatgggagacccagcatggcgtat

SEQ ID NO: 412919 - DNA, 140 bp, Artificial Sequence
  Synthetic
atacgccatgctgggtctccaggtagtcgaatacatcaagatcttgtaccaaagcagtaagtattgttaagcaagtatatgtaatgtcttatatattagcagtaagcttagtagcattaacgtacttgggagtcggccat

SEQ ID NO: 412920 - DNA, 140 bp, Artificial Sequence
  Synthetic
atggccgactcccaagtacgttaatgctactaagcttactgctaatatataagacattacatatacttgcttaacaatacttactgctttggtacaagatcttgatgtattcgactacctggagacccagcatggcgtat

SEQ ID NO: 412921 - DNA, 140 bp, Artificial Sequence
  Synthetic
aggccctggctgctgatatggagtaagagaattgtgcaaattgattaggggaaccaaatcactgacagaagtggtacctttaagtaaagaggcagagttagaattggaagaaaacagagagaccttttgggacagcggtg

SEQ ID NO: 412922 - DNA, 140 bp, Artificial Sequence
  Synthetic
caccgctgtcccaaaaggtctctctgttttcttccaattctaactctgcctctttacttaaaggtaccacttctgtcagtgatttggttcccctaatcaatttgcacaattctcttactccatatcagcagccagggcct

SEQ ID NO: 412923 - DNA, 140 bp, Artificial Sequence
  Synthetic
aggccctggctgctgatatgtatgggttaatattcagaagcaaggagaagggcaatggacttaccagatatatcaggatgaacataagaatctaaaaacaggaaaatatgctaggcaaaagaccttttgggacagcggtg

SEQ ID NO: 412924 - DNA, 140 bp, Artificial Sequence
  Synthetic
caccgctgtcccaaaaggtcttttgcctagcatattttcctgtttttagattcttatgttcatcctgatatatctggtaagtccattgcccttctccttgcttctgaatattaacccatacatatcagcagccagggcct

SEQ ID NO: 412925 - DNA, 140 bp, Artificial Sequence
  Synthetic
aggccctggctgctgatatggacaacaaatcaaaagactgaattacatgcgatatatttagccttgcaggattcaggatcagaagtaaatatagtaacagactcacagtatgcattaggagaccttttgggacagcggtg

SEQ ID NO: 412926 - DNA, 140 bp, Artificial Sequence
  Synthetic
caccgctgtcccaaaaggtctcctaatgcatactgtgagtctgttactatatttacttctgatcctgaatcctgcaaggctaaatatatcgcatgtaattcagtcttttgatttgttgtccatatcagcagccagggcct

SEQ ID NO: 412927 - DNA, 140 bp, Artificial Sequence
  Synthetic
atacgccatgctgggtctccctatttcctgttaaaattagcagcaagatggcctgttaaaataatacatacagacaatgggcctaattttacaagtgcagccatgaaagctgcatgctggcgtacttgggagtcggccat

SEQ ID NO: 412928 - DNA, 140 bp, Artificial Sequence
  Synthetic
atggccgactcccaagtacgccagcatgcagctttcatggctgcacttgtaaaattaggcccattgtctgtatgtattattttaacaggccatcttgctgctaattttaacaggaaatagggagacccagcatggcgtat

SEQ ID NO: 412929 - DNA, 140 bp, Artificial Sequence
  Synthetic
aggccctggctgctgatatgatgagcacttgggacatggggttagtatagaatggcaatacaaaaggtataaaacacagattgacccaggaacagcggacaggatgatacatcagtattagaccttttgggacagcggtg

SEQ ID NO: 412930 - DNA, 140 bp, Artificial Sequence
  Synthetic
caccgctgtcccaaaaggtctaatactgatgtatcatcctgtccgctgttcctgggtcaatctgtgttttataccttttgtattgccattctatactaaccccatgtcccaagtgctcatcatatcagcagccagggcct

SEQ ID NO: 412931 - DNA, 140 bp, Artificial Sequence
  Synthetic
atacgccatgctgggtctccgagtgctgaccaggtgtgaatacgcagcaggacatagtcaggtagggacattgcaactcctagccttgagagtaatagtaaagggaaacaaaaacaagcccgtacttgggagtcggccat

SEQ ID NO: 412932 - DNA, 140 bp, Artificial Sequence
  Synthetic
atggccgactcccaagtacgggcttgtttttgtttccctttactattactctcaaggctaggagttgcaatgtccctacctgactatgtcctgctgcgtattcacacctggtcagcactcggagacccagcatggcgtat

SEQ ID NO: 412933 - DNA, 140 bp, Artificial Sequence
  Synthetic
atacgccatgctgggtctcctgaaaaccagagaccaaccagggggccacccaatgaagggacactagagcttctagaagagataaaagcagaagcagtaagacatttccctaggccttggcgtacttgggagtcggccat

SEQ ID NO: 412934 - DNA, 140 bp, Artificial Sequence
  Synthetic
atggccgactcccaagtacgccaaggcctagggaaatgtcttactgcttctgcttttatctcttctagaagctctagtgtcccttcattgggtggccccctggttggtctctggttttcaggagacccagcatggcgtat

SEQ ID NO: 412935 - DNA, 140 bp, Artificial Sequence
  Synthetic
aggccctggctgctgatatgttctagaagagataaaagcagaagcagtaagacatttccctaggccttggctacaagccttgggccaatacatttatgagacatatggagacacatgggagaccttttgggacagcggtg

SEQ ID NO: 412936 - DNA, 140 bp, Artificial Sequence
  Synthetic
caccgctgtcccaaaaggtctcccatgtgtctccatatgtctcataaatgtattggcccaaggcttgtagccaaggcctagggaaatgtcttactgcttctgcttttatctcttctagaacatatcagcagccagggcct

SEQ ID NO: 412937 - DNA, 140 bp, Artificial Sequence
  Synthetic
atacgccatgctgggtctccattatgtaaactccttaggggaaccaaagcactaacagaagtagtaccactaacaaaagaagcagagctagaactggcagaaaacagggaaattctaaaacgtacttgggagtcggccat

SEQ ID NO: 412938 - DNA, 140 bp, Artificial Sequence
  Synthetic
atggccgactcccaagtacgttttagaatttccctgttttctgccagttctagctctgcttcttttgttagtggtactacttctgttagtgctttggttcccctaaggagtttacataatggagacccagcatggcgtat

SEQ ID NO: 412939 - DNA, 140 bp, Artificial Sequence
  Synthetic
atacgccatgctgggtctcccgccacttgagagacttactattaattgcagcgaggattgtgggcaagggactgacaagggggtgggaagccctcaaatatctggggaatctcacacagtcgtacttgggagtcggccat

SEQ ID NO: 412940 - DNA, 140 bp, Artificial Sequence
  Synthetic
atggccgactcccaagtacgactgtgtgagattccccagatatttgagggcttcccacccccttgtcagtcccttgcccacaatcctcgctgcaattaatagtaagtctctcaagtggcgggagacccagcatggcgtat

SEQ ID NO: 412941 - DNA, 140 bp, Artificial Sequence
  Synthetic
aggccctggctgctgatatgagaggaagaggaagaagaaatggatccagtagatcctgaattgcccccttggcatcaccctggaagcaagccccagaccccttgtaataattgctattgcgaccttttgggacagcggtg

SEQ ID NO: 412942 - DNA, 140 bp, Artificial Sequence
  Synthetic
caccgctgtcccaaaaggtcgcaatagcaattattacaaggggtctggggcttgcttccagggtgatgccaagggggcaattcaggatctactggatccatttcttcttcctcttcctctcatatcagcagccagggcct

SEQ ID NO: 412943 - DNA, 140 bp, Artificial Sequence
  Synthetic
atacgccatgctgggtctccggcatcaccctggaagcaagccccagaccccttgtaataattgctattgcaaaagctgctgctatcattgttacctctgttttgaaagaaagggtttgggcgtacttgggagtcggccat

SEQ ID NO: 412944 - DNA, 140 bp, Artificial Sequence
  Synthetic
atggccgactcccaagtacgcccaaaccctttctttcaaaacagaggtaacaatgatagcagcagcttttgcaatagcaattattacaaggggtctggggcttgcttccagggtgatgccggagacccagcatggcgtat

SEQ ID NO: 412945 - DNA, 140 bp, Artificial Sequence
  Synthetic
aggccctggctgctgatatgagctggtagagctatccttaacatacctagaagaataagacagggcttggaaagggctttgctataaagagctttgctataaaatgggtggcaagtggtcgaccttttgggacagcggtg

SEQ ID NO: 412946 - DNA, 140 bp, Artificial Sequence
  Synthetic
caccgctgtcccaaaaggtcgaccacttgccacccattttatagcaaagctctttatagcaaagccctttccaagccctgtcttattcttctaggtatgttaaggatagctctaccagctcatatcagcagccagggcct

SEQ ID NO: 412947 - DNA, 140 bp, Artificial Sequence
  Synthetic
atacgccatgctgggtctcctgccgaataatacaaatcctgtaccaaagcagtaagtaacgctaatgtataaggaccagataatactcataataattttctgtgttgtgtttcttatagccgtacttgggagtcggccat

SEQ ID NO: 412948 - DNA, 140 bp, Artificial Sequence
  Synthetic
atggccgactcccaagtacggctataagaaacacaacacagaaaattattatgagtattatctggtccttatacattagcgttacttactgctttggtacaggatttgtattattcggcaggagacccagcatggcgtat

SEQ ID NO: 412949 - DNA, 140 bp, Artificial Sequence
  Synthetic
  misc_feature (105)..(105): n is a, c, g, or t
aggccctggctgctgatatgaaggaccagataatactcataataattttctgtgttgtgtttcttatagctgcatgtatatggctgtttattcttaaaacctatntagaacaaaagaaacgaccttttgggacagcggtg

SEQ ID NO: 412950 - DNA, 140 bp, Artificial Sequence
  Synthetic
  misc_feature (36)..(36): n is a, c, g, or t
caccgctgtcccaaaaggtcgtttcttttgttctanataggttttaagaataaacagccatatacatgcagctataagaaacacaacacagaaaattattatgagtattatctggtccttcatatcagcagccagggcct

SEQ ID NO: 412951 - DNA, 140 bp, Artificial Sequence
  Synthetic
atacgccatgctgggtctccataagagatgatagtgactatgaaagcaatggggaagaggaacaagaggtcatggatctggtacatgagcatggctttgttaatcccatgtttgagctgtcgtacttgggagtcggccat

SEQ ID NO: 412952 - DNA, 140 bp, Artificial Sequence
  Synthetic
atggccgactcccaagtacgacagctcaaacatgggattaacaaagccatgctcatgtaccagatccatgacctcttgttcctcttccccattgctttcatagtcactatcatctcttatggagacccagcatggcgtat

SEQ ID NO: 412953 - DNA, 140 bp, Artificial Sequence
  Synthetic
  misc_feature (91)..(91): n is a, c, g, or t
aggccctggctgctgatatgcatggatctggtacatgagcatggctttgttaatcccatgtttgagctgtaaacagctatatgctgcagtntattctggggtgcctgtgtgggaagatgcgaccttttgggacagcggtg

SEQ ID NO: 412954 - DNA, 140 bp, Artificial Sequence
  Synthetic
  misc_feature (50)..(50): n is a, c, g, or t
caccgctgtcccaaaaggtcgcatcttcccacacaggcaccccagaatanactgcagcatatagctgtttacagctcaaacatgggattaacaaagccatgctcatgtaccagatccatgcatatcagcagccagggcct

SEQ ID NO: 412955 - DNA, 140 bp, Artificial Sequence
  Synthetic
atacgccatgctgggtctccagcataatatttgggcctcacaagcctgcgttcctacagaccccgctcctcatgaatatgtgttacagaatgtgacagataaattcaacatatgggaaaacgtacttgggagtcggccat

SEQ ID NO: 412956 - DNA, 140 bp, Artificial Sequence
  Synthetic
atggccgactcccaagtacgttttcccatatgttgaatttatctgtcacattctgtaacacatattcatgaggagcggggtctgtaggaacgcaggcttgtgaggcccaaatattatgctggagacccagcatggcgtat

SEQ ID NO: 412957 - DNA, 140 bp, Artificial Sequence
  Synthetic
aggccctggctgctgatatgcatgaatatgtgttacagaatgtgacagataaattcaacatatgggaaaattacatggtagaccaaatgcaagaagacatcattagcttatgggatcagagaccttttgggacagcggtg

SEQ ID NO: 412958 - DNA, 140 bp, Artificial Sequence
  Synthetic
caccgctgtcccaaaaggtctctgatcccataagctaatgatgtcttcttgcatttggtctaccatgtaattttcccatatgttgaatttatctgtcacattctgtaacacatattcatgcatatcagcagccagggcct

SEQ ID NO: 412959 - DNA, 140 bp, Artificial Sequence
  Synthetic
aggccctggctgctgatatgagaaggaaaagttatcctggtagcagttcatgtagccagtggatatatagaagcagaagttattccagcagagacagggcaggaaacagcatactttctcgaccttttgggacagcggtg

SEQ ID NO: 412960 - DNA, 140 bp, Artificial Sequence
  Synthetic
caccgctgtcccaaaaggtcgagaaagtatgctgtttcctgccctgtctctgctggaataacttctgcttctatatatccactggctacatgaactgctaccaggataacttttccttctcatatcagcagccagggcct

SEQ ID NO: 412961 - DNA, 140 bp, Artificial Sequence
  Synthetic
atacgccatgctgggtctccacagatgtcacaaataacaaagctacaaactcatcagaggaggaaacactcgtaaagaagtgtgactttaatgtaactacagttgttaaagacaaacatgcgtacttgggagtcggccat

SEQ ID NO: 412962 - DNA, 140 bp, Artificial Sequence
  Synthetic
atggccgactcccaagtacgcatgtttgtctttaacaactgtagttacattaaagtcacacttctttacgagtgtttcctcctctgatgagtttgtagctttgttatttgtgacatctgtggagacccagcatggcgtat

SEQ ID NO: 412963 - DNA, 140 bp, Artificial Sequence
  Synthetic
atacgccatgctgggtctccactactattaataatagtagggattggattgagatgaagaaagtaatgaaaaactgctctttcaatatcgccacaagcataagaaataagatgcaaagagcgtacttgggagtcggccat

SEQ ID NO: 412964 - DNA, 140 bp, Artificial Sequence
  Synthetic
atggccgactcccaagtacgctctttgcatcttatttcttatgcttgtggcgatattgaaagagcagtttttcattactttcttcatctcaatccaatccctactattattaatagtagtggagacccagcatggcgtat

SEQ ID NO: 412965 - DNA, 140 bp, Artificial Sequence
  Synthetic
atacgccatgctgggtctccggaaaataagaaaacagaaaaagatagaaaagttatttgagagaatacaggcaagagcagaagacagtggcaatgagagtgatggagatacagaggagttcgtacttgggagtcggccat

SEQ ID NO: 412966 - DNA, 140 bp, Artificial Sequence
  Synthetic
atggccgactcccaagtacgaactcctctgtatctccatcactctcattgccactgtcttctgctcttgcctgtattctctcaaataacttttctatctttttctgttttcttattttccggagacccagcatggcgtat

SEQ ID NO: 412967 - DNA, 140 bp, Artificial Sequence
  Synthetic
aggccctggctgctgatatggcaagagcagaagacagtggcaatgagagtgatggagatacagaggagttatccaaacttttggaaatgggggactttgatcattgggttggtaatgattgaccttttgggacagcggtg

SEQ ID NO: 412968 - DNA, 140 bp, Artificial Sequence
  Synthetic
caccgctgtcccaaaaggtcaatcattaccaacccaatgatcaaagtcccccatttccaaaagtttggataactcctctgtatctccatcactctcattgccactgtcttctgctcttgccatatcagcagccagggcct

SEQ ID NO: 412969 - DNA, 140 bp, Artificial Sequence
  Synthetic
aggccctggctgctgatatgttgggaccaggggctacactagaagaaatgatgacagcatgtcagggagtgggaggacctagccataaagcaagagttttggctgaggcaatgagccaaggaccttttgggacagcggtg

SEQ ID NO: 412970 - DNA, 140 bp, Artificial Sequence
  Synthetic
caccgctgtcccaaaaggtccttggctcattgcctcagccaaaactcttgctttatggctaggtcctcccactccctgacatgctgtcatcatttcttctagtgtagcccctggtcccaacatatcagcagccagggcct

SEQ ID NO: 412971 - DNA, 140 bp, Artificial Sequence
  Synthetic
aggccctggctgctgatatggtgctccagcaggatatgccatctttaaatgtaatgacaagaaatttaatggaacaggatcatgcaacaacatttcagtggttacatgtacacatggtatgaccttttgggacagcggtg

SEQ ID NO: 412972 - DNA, 140 bp, Artificial Sequence
  Synthetic
caccgctgtcccaaaaggtcataccatgtgtacatgtaaccactgaaatgttgttgcatgatcctgttccattaaatttcttgtcattacatttaaagatggcatatcctgctggagcaccatatcagcagccagggcct

SEQ ID NO: 412973 - DNA, 140 bp, Artificial Sequence
  Synthetic
atacgccatgctgggtctccacaaaataagaattatgggaaaagatattaaagataataccaagaatatcctagtgaccctgaactctactataaatataacttgtgagagaccaggaaacgtacttgggagtcggccat

SEQ ID NO: 412974 - DNA, 140 bp, Artificial Sequence
  Synthetic
atggccgactcccaagtacgtttcctggtctctcacaagttatatttatagtagagttcagggtcactaggatattcttggtattatctttaatatcttttcccataattcttattttgtggagacccagcatggcgtat

SEQ ID NO: 412975 - DNA, 140 bp, Artificial Sequence
  Synthetic
aggccctggctgctgatatgctagtgaccctgaactctactataaatataacttgtgagagaccaggaaatcagaaggtacaaaagataaagacaggtccactggcttggtacagcatgggaccttttgggacagcggtg

SEQ ID NO: 412976 - DNA, 140 bp, Artificial Sequence
  Synthetic
caccgctgtcccaaaaggtcccatgctgtaccaagccagtggacctgtctttatcttttgtaccttctgatttcctggtctctcacaagttatatttatagtagagttcagggtcactagcatatcagcagccagggcct

SEQ ID NO: 412977 - DNA, 140 bp, Artificial Sequence
  Synthetic
atacgccatgctgggtctccaagaaaaggtatacgtataggaccggggagagcatttattgcaacagaaaaaataataggagacataagacaagcacattgtaaccttagcagggcagaacgtacttgggagtcggccat

SEQ ID NO: 412978 - DNA, 140 bp, Artificial Sequence
  Synthetic
atggccgactcccaagtacgttctgccctgctaaggttacaatgtgcttgtcttatgtctcctattattttttctgttgcaataaatgctctccccggtcctatacgtataccttttcttggagacccagcatggcgtat

SEQ ID NO: 412979 - DNA, 140 bp, Artificial Sequence
  Synthetic
atacgccatgctgggtctcctagtagccctgtgaacaaagaagaaataaaaaactgctctttcagtgcaaccacagaaataaaaaataggaaaagggaagaatacgcacttttttatagacgtacttgggagtcggccat

SEQ ID NO: 412980 - DNA, 140 bp, Artificial Sequence
  Synthetic
atggccgactcccaagtacgtctataaaaaagtgcgtattcttcccttttcctattttttatttctgtggttgcactgaaagagcagttttttatttcttctttgttcacagggctactaggagacccagcatggcgtat

SEQ ID NO: 412981 - DNA, 140 bp, Artificial Sequence
  Synthetic
aggccctggctgctgatatgtgtaaaccatacaggacctagtaacataacttttgctacaagctctggtggagatatagagataagaaccttacatttcagctgtcatggagaattctttgaccttttgggacagcggtg

SEQ ID NO: 412982 - DNA, 140 bp, Artificial Sequence
  Synthetic
caccgctgtcccaaaaggtcaaagaattctccatgacagctgaaatgtaaggttcttatctctatatctccaccagagcttgtagcaaaagttatgttactaggtcctgtatggtttacacatatcagcagccagggcct

SEQ ID NO: 412983 - DNA, 140 bp, Artificial Sequence
  Synthetic
atacgccatgctgggtctcccaaatgtaacttaagcagtaaccacaacagcaatgacagtcacataccttgcaagttgaaacaggtagtaaggtcatggatgagaggaggatcgggaatccgtacttgggagtcggccat

SEQ ID NO: 412984 - DNA, 140 bp, Artificial Sequence
  Synthetic
atggccgactcccaagtacggattcccgatcctcctctcatccatgaccttactacctgtttcaacttgcaaggtatgtgactgtcattgctgttgtggttactgcttaagttacatttgggagacccagcatggcgtat

SEQ ID NO: 412985 - DNA, 140 bp, Artificial Sequence
  Synthetic
aggccctggctgctgatatggcaagttgaaacaggtagtaaggtcatggatgagaggaggatcgggaatctatgcacctcctatcagcggtagcttaacctgtaggtcaaacataactgggaccttttgggacagcggtg

SEQ ID NO: 412986 - DNA, 140 bp, Artificial Sequence
  Synthetic
caccgctgtcccaaaaggtcccagttatgtttgacctacaggttaagctaccgctgataggaggtgcatagattcccgatcctcctctcatccatgaccttactacctgtttcaacttgccatatcagcagccagggcct

SEQ ID NO: 412987 - DNA, 140 bp, Artificial Sequence
  Synthetic
atacgccatgctgggtctccccatggaatcaagccagtagtatcaactcaactgctgttaaatggtagcctatcagaagaagagatagtaattagatctgagaatatttcagacaatgcccgtacttgggagtcggccat

SEQ ID NO: 412988 - DNA, 140 bp, Artificial Sequence
  Synthetic
atggccgactcccaagtacgggcattgtctgaaatattctcagatctaattactatctcttcttctgataggctaccatttaacagcagttgagttgatactactggcttgattccatggggagacccagcatggcgtat

SEQ ID NO: 412989 - DNA, 140 bp, Artificial Sequence
  Synthetic
  misc_feature (76)..(76): n is a, c, g, or t
atacgccatgctgggtctcccatttagaccaatagggggagacatgaaagatatatggaggactaaattgtacaantacaaggtaataaagataaaaccttttagtgtagcacctacaaacgtacttgggagtcggccat

SEQ ID NO: 412990 - DNA, 140 bp, Artificial Sequence
  Synthetic
  misc_feature (65)..(65): n is a, c, g, or t
atggccgactcccaagtacgtttgtaggtgctacactaaaaggttttatctttattaccttgtanttgtacaatttagtcctccatatatctttcatgtctccccctattggtctaaatgggagacccagcatggcgtat

SEQ ID NO: 412991 - DNA, 140 bp, Artificial Sequence
  Synthetic
aggccctggctgctgatatgacctaacaacaatacaagaaaaagtttgcatttagggccaggacaaacattctatgcaacaggtgccataataggagatataagacaagcacattgtaatgaccttttgggacagcggtg

SEQ ID NO: 412992 - DNA, 140 bp, Artificial Sequence
  Synthetic
caccgctgtcccaaaaggtcattacaatgtgcttgtcttatatctcctattatggcacctgttgcatagaatgtttgtcctggccctaaatgcaaactttttcttgtattgttgttaggtcatatcagcagccagggcct

SEQ ID NO: 412993 - DNA, 140 bp, Artificial Sequence
  Synthetic
atacgccatgctgggtctccagccacaaggccagtcataggtactggcgctcatagagaaaaaagggcagcagggttgggaatgctattctttgggattctaagtgcagcaggtagcactcgtacttgggagtcggccat

SEQ ID NO: 412994 - DNA, 140 bp, Artificial Sequence
  Synthetic
atggccgactcccaagtacgagtgctacctgctgcacttagaatcccaaagaatagcattcccaaccctgctgcccttttttctctatgagcgccagtacctatgactggccttgtggctggagacccagcatggcgtat

SEQ ID NO: 412995 - DNA, 140 bp, Artificial Sequence
  Synthetic
aggccctggctgctgatatgccctatagtgcagaaccttcaggggcaaatggtacatcagcccatatcacctagaactttaaatgcatgggtaaaagtaatagaagagaaggcttttagcgaccttttgggacagcggtg

SEQ ID NO: 412996 - DNA, 140 bp, Artificial Sequence
  Synthetic
caccgctgtcccaaaaggtcgctaaaagccttctcttctattacttttacccatgcatttaaagttctaggtgatatgggctgatgtaccatttgcccctgaaggttctgcactatagggcatatcagcagccagggcct

SEQ ID NO: 412997 - DNA, 140 bp, Artificial Sequence
  Synthetic
atacgccatgctgggtctccatactgcagttaggcctactgttagcaacaatagtagtatgtatgaagaagtaagaaattgctctttcaatacaaccacaacaataagagataagaaacacgtacttgggagtcggccat

SEQ ID NO: 412998 - DNA, 140 bp, Artificial Sequence
  Synthetic
atggccgactcccaagtacgtgtttcttatctcttattgttgtggttgtattgaaagagcaatttcttacttcttcatacatactactattgttgctaacagtaggcctaactgcagtatggagacccagcatggcgtat

SEQ ID NO: 412999 - DNA, 140 bp, Artificial Sequence
  Synthetic
  misc_feature (98)..(98): n is a, c, g, or t
atacgccatgctgggtctccgggctgtagaggaaggcaaatctgttacacatcagtaaaatggaatacctcatggggaggaaatgactcaatttggantgacctaacatggcaggaatggcgtacttgggagtcggccat

SEQ ID NO: 413000 - DNA, 140 bp, Artificial Sequence
  Synthetic
  misc_feature (43)..(43): n is a, c, g, or t
atggccgactcccaagtacgccattcctgccatgttaggtcantccaaattgagtcatttcctccccatgaggtattccattttactgatgtgtaacagatttgccttcctctacagcccggagacccagcatggcgtat

SEQ ID NO: 413001 - DNA, 140 bp, Artificial Sequence
  Synthetic
  misc_feature (48)..(48): n is a, c, g, or t
aggccctggctgctgatatgcatggggaggaaatgactcaatttggantgacctaacatggcaggaatgggatcaacagataagcaacataagcagcattatatatgaccagatacaagagaccttttgggacagcggtg

SEQ ID NO: 413002 - DNA, 140 bp, Artificial Sequence
  Synthetic
  misc_feature (93)..(93): n is a, c, g, or t
caccgctgtcccaaaaggtctcttgtatctggtcatatataatgctgcttatgttgcttatctgttgatcccattcctgccatgttaggtcantccaaattgagtcatttcctccccatgcatatcagcagccagggcct

SEQ ID NO: 413003 - DNA, 140 bp, Artificial Sequence
  Synthetic
aggccctggctgctgatatgatagtattcatagaatataggaaaatattaagacaaagaaaaatagacaggttaattgatagaataagagaaagagcagaagacagtggcaatgagagtggaccttttgggacagcggtg

SEQ ID NO: 413004 - DNA, 140 bp, Artificial Sequence
  Synthetic
caccgctgtcccaaaaggtccactctcattgccactgtcttctgctctttctcttattctatcaattaacctgtctatttttctttgtcttaatattttcctatattctatgaatactatcatatcagcagccagggcct

SEQ ID NO: 413005 - DNA, 140 bp, Artificial Sequence
  Synthetic
aggccctggctgctgatatgataaaaatagctataataatagtaggagcactgataggtataagaattatcatggtagtacttaatctagtgaagaacattaggcagggatatcaaccccgaccttttgggacagcggtg

SEQ ID NO: 413006 - DNA, 140 bp, Artificial Sequence
  Synthetic
caccgctgtcccaaaaggtcggggttgatatccctgcctaatgttcttcactagattaagtactaccatgataattcttatacctatcagtgctcctactattattatagctatttttatcatatcagcagccagggcct

SEQ ID NO: 413007 - DNA, 140 bp, Artificial Sequence
  Synthetic
atacgccatgctgggtctccagaacaggagaagaaggtggagaaagagacagaggcaggtggagcatcttgcagccagggttcttgcaactgttgtacacggacagcaggacaatcatctcgtacttgggagtcggccat

SEQ ID NO: 413008 - DNA, 140 bp, Artificial Sequence
  Synthetic
atggccgactcccaagtacgagatgattgtcctgctgtccgtgtacaacagttgcaagaaccctggctgcaagatgctccacctgcctctgtctctttctccaccttcttctcctgttctggagacccagcatggcgtat

SEQ ID NO: 413009 - DNA, 140 bp, Artificial Sequence
  Synthetic
aggccctggctgctgatatggcagccagggttcttgcaactgttgtacacggacagcaggacaatcatcttgtggatttaccacctcttgagcaacttaatatcagggatccagaagctggaccttttgggacagcggtg

SEQ ID NO: 413010 - DNA, 140 bp, Artificial Sequence
  Synthetic
caccgctgtcccaaaaggtccagcttctggatccctgatattaagttgctcaagaggtggtaaatccacaagatgattgtcctgctgtccgtgtacaacagttgcaagaaccctggctgccatatcagcagccagggcct

SEQ ID NO: 413011 - DNA, 140 bp, Artificial Sequence
  Synthetic
aggccctggctgctgatatgcatgaggatataatcagtttatgggatcaaagcctaaagccatgtgtaaaattaaccccactctgtgttactttaaattgcactgatgtgaagaatgctagaccttttgggacagcggtg

SEQ ID NO: 413012 - DNA, 140 bp, Artificial Sequence
  Synthetic
caccgctgtcccaaaaggtctagcattcttcacatcagtgcaatttaaagtaacacagagtggggttaattttacacatggctttaggctttgatcccataaactgattatatcctcatgcatatcagcagccagggcct

SEQ ID NO: 413013 - DNA, 140 bp, Artificial Sequence
  Synthetic
  misc_feature (97)..(97): n is a, c, g, or t
atacgccatgctgggtctccaacccttagcctctggaaagctgtaatacaatactggctacaggaattgcgaaatagtgctacaaatctactagatnccattgcagtggcaactgccaatcgtacttgggagtcggccat

SEQ ID NO: 413014 - DNA, 140 bp, Artificial Sequence
  Synthetic
  misc_feature (44)..(44): n is a, c, g, or t
atggccgactcccaagtacgattggcagttgccactgcaatggnatctagtagatttgtagcactatttcgcaattcctgtagccagtattgtattacagctttccagaggctaagggttggagacccagcatggcgtat

SEQ ID NO: 413015 - DNA, 140 bp, Artificial Sequence
  Synthetic
atacgccatgctgggtctcctaacatcccaaggagaattagacaagggttagaaagaagcttattgtaacatgggaaatatactaacaaaaagtaaatattcaggatggccagcagtactcgtacttgggagtcggccat

SEQ ID NO: 413016 - DNA, 140 bp, Artificial Sequence
  Synthetic
atggccgactcccaagtacgagtactgctggccatcctgaatatttactttttgttagtatatttcccatgttacaataagcttctttctaacccttgtctaattctccttgggatgttaggagacccagcatggcgtat

SEQ ID NO: 413017 - DNA, 140 bp, Artificial Sequence
  Synthetic
  misc_feature (85)..(85): n is a, c, g, or t
  misc_feature (100)..(100): n is a, c, g, or t
aggccctggctgctgatatgatgggaaatatactaacaaaaagtaaatattcaggatggccagcagtactaaacagaatgagacnaacttcccctacccntgaccctcaaccagcacccggaccttttgggacagcggtg

SEQ ID NO: 413018 - DNA, 140 bp, Artificial Sequence
  Synthetic
  misc_feature (41)..(41): n is a, c, g, or t
  misc_feature (56)..(56): n is a, c, g, or t
caccgctgtcccaaaaggtccgggtgctggttgagggtcangggtaggggaagttngtctcattctgtttagtactgctggccatcctgaatatttactttttgttagtatatttcccatcatatcagcagccagggcct

SEQ ID NO: 413019 - DNA, 140 bp, Artificial Sequence
  Synthetic
atacgccatgctgggtctccgagttaggcagggatattcacctctgtctttccagacccttacccaccaccaacaggaaccagacaggcccggaagaatcgaagaagaagatggcgagcacgtacttgggagtcggccat

SEQ ID NO: 413020 - DNA, 140 bp, Artificial Sequence
  Synthetic
atggccgactcccaagtacgtgctcgccatcttcttcttcgattcttccgggcctgtctggttcctgttggtggtgggtaagggtctggaaagacagaggtgaatatccctgcctaactcggagacccagcatggcgtat

SEQ ID NO: 413021 - DNA, 140 bp, Artificial Sequence
  Synthetic
aggccctggctgctgatatggcttgaagactcgcaaaaccagcaggagaaaaatgaaaaagatttattagcattggacagttggaaaaatctgtggaattggtttgacataacaaagtgggaccttttgggacagcggtg

SEQ ID NO: 413022 - DNA, 140 bp, Artificial Sequence
  Synthetic
caccgctgtcccaaaaggtcccactttgttatgtcaaaccaattccacagatttttccaactgtccaatgctaataaatctttttcatttttctcctgctggttttgcgagtcttcaagccatatcagcagccagggcct

SEQ ID NO: 413023 - DNA, 140 bp, Artificial Sequence
  Synthetic
aggccctggctgctgatatgagaggacgaagtaggtttcccagtaagacctcaagtgcctctacgtccaatgacctataaaggcgcttttgacctcagtttctttttaaaagaaaagggagaccttttgggacagcggtg

SEQ ID NO: 413024 - DNA, 140 bp, Artificial Sequence
  Synthetic
caccgctgtcccaaaaggtctcccttttcttttaaaaagaaactgaggtcaaaagcgcctttataggtcattggacgtagaggcacttgaggtcttactgggaaacctacttcgtcctctcatatcagcagccagggcct

SEQ ID NO: 413025 - DNA, 140 bp, Artificial Sequence
  Synthetic
atacgccatgctgggtctccacaagacccagcaacagtacaggacaaagtatacgtataggacaaaggagagcattttatgcaacagggaaaataataggtgatataagacatgcacattcgtacttgggagtcggccat

SEQ ID NO: 413026 - DNA, 140 bp, Artificial Sequence
  Synthetic
atggccgactcccaagtacgaatgtgcatgtcttatatcacctattattttccctgttgcataaaatgctctcctttgtcctatacgtatactttgtcctgtactgttgctgggtcttgtggagacccagcatggcgtat

SEQ ID NO: 413027 - DNA, 140 bp, Artificial Sequence
  Synthetic
atacgccatgctgggtctcctgttgtattggggtcgggagctaaggaatagtgctattaatttgcttgatacactagcaatagctactgctaactggacagatagggttatagaagtagtcgtacttgggagtcggccat

SEQ ID NO: 413028 - DNA, 140 bp, Artificial Sequence
  Synthetic
atggccgactcccaagtacgactacttctataaccctatctgtccagttagcagtagctattgctagtgtatcaagcaaattaatagcactattccttagctcccgaccccaatacaacaggagacccagcatggcgtat

SEQ ID NO: 413029 - DNA, 140 bp, Artificial Sequence
  Synthetic
aggccctggctgctgatatgtggaactccagttggagtaataaaacttatgaagatatttggggtaacatgacctggatgcaatgggaaggagaaattgataattacacaggtgcaatatgaccttttgggacagcggtg

SEQ ID NO: 413030 - DNA, 140 bp, Artificial Sequence
  Synthetic
caccgctgtcccaaaaggtcatattgcacctgtgtaattatcaatttctccttcccattgcatccaggtcatgttaccccaaatatcttcataagttttattactccaactggagttccacatatcagcagccagggcct

SEQ ID NO: 413031 - DNA, 140 bp, Artificial Sequence
  Synthetic
atacgccatgctgggtctccaaagaaatatcaactaaaacatttagtatgggcaagcaaggagctagaaagatttgcatgtaatcctgatctgttagaaactgcagaaggtaatgagcaacgtacttgggagtcggccat

SEQ ID NO: 413032 - DNA, 140 bp, Artificial Sequence
  Synthetic
atggccgactcccaagtacgttgctcattaccttctgcagtttctaacagatcaggattacatgcaaatctttctagctccttgcttgcccatactaaatgttttagttgatatttctttggagacccagcatggcgtat

SEQ ID NO: 413033 - DNA, 140 bp, Artificial Sequence
  Synthetic
  misc_feature (27)..(27): n is a, c, g, or t
aggccctggctgctgatatgcatagtnggatggcctgaagtaagggaaagaataaatcaaacccctccagcagcggcagcaggagtaggagcagtatctcaagatttagccaaacatggagaccttttgggacagcggtg

SEQ ID NO: 413034 - DNA, 140 bp, Artificial Sequence
  Synthetic
  misc_feature (114)..(114): n is a, c, g, or t
caccgctgtcccaaaaggtctccatgtttggctaaatcttgagatactgctcctactcctgctgccgctgctggaggggtttgatttattctttcccttacttcaggccatccnactatgcatatcagcagccagggcct

SEQ ID NO: 413035 - DNA, 140 bp, Artificial Sequence
  Synthetic
  misc_feature (25)..(25): n is a, c, g, or t
  misc_feature (44)..(44): n is a, c, g, or t
  misc_feature (55)..(55): n is a, c, g, or t
  misc_feature (102)..(102): n is a, c, g, or t
atacgccatgctgggtctccagcangaagtctgcggacaataangaagacacaancacaaagcagacaagtcaaaattaccctatagtgacaaatgcgcagngacaagctgtacatcagccgtacttgggagtcggccat

SEQ ID NO: 413036 - DNA, 140 bp, Artificial Sequence
  Synthetic
  misc_feature (39)..(39): n is a, c, g, or t
  misc_feature (86)..(86): n is a, c, g, or t
  misc_feature (97)..(97): n is a, c, g, or t
  misc_feature (116)..(116): n is a, c, g, or t
atggccgactcccaagtacggctgatgtacagcttgtcnctgcgcatttgtcactatagggtaattttgacttgtctgctttgtgnttgtgtcttcnttattgtccgcagacttcntgctggagacccagcatggcgtat

SEQ ID NO: 413037 - DNA, 140 bp, Artificial Sequence
  Synthetic
atacgccatgctgggtctccaagaaaggcttaggcatttcctatggcaggaagaagcggagacagcgacgagcagctccttacgacagtaagaatcatcaagatcttataccagagcagtcgtacttgggagtcggccat

SEQ ID NO: 413038 - DNA, 140 bp, Artificial Sequence
  Synthetic
atggccgactcccaagtacgactgctctggtataagatcttgatgattcttactgtcgtaaggagctgctcgtcgctgtctccgcttcttcctgccataggaaatgcctaagcctttcttggagacccagcatggcgtat

SEQ ID NO: 413039 - DNA, 140 bp, Artificial Sequence
  Synthetic
aggccctggctgctgatatggcctttaaccctgaaattatccctatgtttatggcactatcagaaggagctatttcctatgatatcaatgttatgctaaatgccataggaggacaccaaggaccttttgggacagcggtg

SEQ ID NO: 413040 - DNA, 140 bp, Artificial Sequence
  Synthetic
caccgctgtcccaaaaggtccttggtgtcctcctatggcatttagcataacattgatatcataggaaatagctccttctgatagtgccataaacatagggataatttcagggttaaaggccatatcagcagccagggcct

SEQ ID NO: 413041 - DNA, 140 bp, Artificial Sequence
  Synthetic
aggccctggctgctgatatgtacagagggggtgggaagcccttaaatatctaggaagtcttgtgcagtattggggtctagagctaaaaaagagtgctattagtctgcttgataccatagcgaccttttgggacagcggtg

SEQ ID NO: 413042 - DNA, 140 bp, Artificial Sequence
  Synthetic
caccgctgtcccaaaaggtcgctatggtatcaagcagactaatagcactcttttttagctctagaccccaatactgcacaagacttcctagatatttaagggcttcccaccccctctgtacatatcagcagccagggcct

SEQ ID NO: 413043 - DNA, 140 bp, Artificial Sequence
  Synthetic
atacgccatgctgggtctccaccacagcaatagtagtagctgcagggacagatagggttatagaaatcttgcaaagagctggtagagctatccttaacatacctagaagaataagacaggcgtacttgggagtcggccat

SEQ ID NO: 413044 - DNA, 140 bp, Artificial Sequence
  Synthetic
atggccgactcccaagtacgcctgtcttattcttctaggtatgttaaggatagctctaccagctctttgcaagatttctataaccctatctgtccctgcagctactactattgctgtggtggagacccagcatggcgtat

SEQ ID NO: 413045 - DNA, 140 bp, Artificial Sequence
  Synthetic
  misc_feature (31)..(31): n is a, c, g, or t
  misc_feature (74)..(74): n is a, c, g, or t
  misc_feature (79)..(79): n is a, c, g, or t
atacgccatgctgggtctccaaatcattatntaatacagtagcaactctctattgtgtacatcagagaatagangtaanagacaccaaggaagctttagataaaatagaggagatacaaacgtacttgggagtcggccat

SEQ ID NO: 413046 - DNA, 140 bp, Artificial Sequence
  Synthetic
  misc_feature (62)..(62): n is a, c, g, or t
  misc_feature (67)..(67): n is a, c, g, or t
  misc_feature (110)..(110): n is a, c, g, or t
atggccgactcccaagtacgtttgtatctcctctattttatctaaagcttccttggtgtctnttacntctattctctgatgtacacaatagagagttgctactgtattanataatgatttggagacccagcatggcgtat

SEQ ID NO: 413047 - DNA, 140 bp, Artificial Sequence
  Synthetic
  misc_feature (40)..(40): n is a, c, g, or t
atacgccatgctgggtctccagatgatggtagcctgtcanggagtaggagggccaactcataaggcaaaaatattggcagaagcaatggcctcagcccagcaagatctaaaaggaggatacgtacttgggagtcggccat

SEQ ID NO: 413048 - DNA, 140 bp, Artificial Sequence
  Synthetic
  misc_feature (101)..(101): n is a, c, g, or t
atggccgactcccaagtacgtatcctccttttagatcttgctgggctgaggccattgcttctgccaatatttttgccttatgagttggccctcctactccntgacaggctaccatcatctggagacccagcatggcgtat

SEQ ID NO: 413049 - DNA, 140 bp, Artificial Sequence
  Synthetic
aggccctggctgctgatatgtaaaatgtttcaattgtggaaaagagggacatgtagcaagaaattgtcgagcacctagaaagaaaggttgctggaaatgtggacaggaaggtcaccaaatgaccttttgggacagcggtg

SEQ ID NO: 413050 - DNA, 140 bp, Artificial Sequence
  Synthetic
caccgctgtcccaaaaggtcatttggtgaccttcctgtccacatttccagcaacctttctttctaggtgctcgacaatttcttgctacatgtccctcttttccacaattgaaacattttacatatcagcagccagggcct

SEQ ID NO: 413051 - DNA, 140 bp, Artificial Sequence
  Synthetic
  misc_feature (109)..(109): n is a, c, g, or t
  misc_feature (115)..(115): n is a, c, g, or t
  misc_feature (118)..(118): n is a, c, g, or t
atacgccatgctgggtctccctccggggggcgagaggccaggcaattttatgcagaagcaaatgccccctccagccccatcagccccaccaatggaggaggtagtgaangggcanganaacgtacttgggagtcggccat

SEQ ID NO: 413052 - DNA, 140 bp, Artificial Sequence
  Synthetic
  misc_feature (23)..(23): n is a, c, g, or t
  misc_feature (26)..(26): n is a, c, g, or t
  misc_feature (32)..(32): n is a, c, g, or t
atggccgactcccaagtacgttntcntgcccnttcactacctcctccattggtggggctgatggggctggagggggcatttgcttctgcataaaattgcctggcctctcgccccccggagggagacccagcatggcgtat

SEQ ID NO: 413053 - DNA, 140 bp, Artificial Sequence
  Synthetic
atacgccatgctgggtctcctgtgggttactgtctactatggggtgcctgtgtggaaggacgcagagaccaccctattttgtgcatcagatgctaaagcatataaggcagaagcgcataacgtacttgggagtcggccat

SEQ ID NO: 413054 - DNA, 140 bp, Artificial Sequence
  Synthetic
atggccgactcccaagtacgttatgcgcttctgccttatatgctttagcatctgatgcacaaaatagggtggtctctgcgtccttccacacaggcaccccatagtagacagtaacccacaggagacccagcatggcgtat

SEQ ID NO: 413055 - DNA, 140 bp, Artificial Sequence
  Synthetic
  misc_feature (85)..(85): n is a, c, g, or t
  misc_feature (119)..(119): n is a, c, g, or t
aggccctggctgctgatatgaagtaaaacaatggcccctatctagagaaaaaatagaagccttaactgcaatatgtcaggaaatngagcaagaaggaaaaatttcaagaatagggcctnagaccttttgggacagcggtg

SEQ ID NO: 413056 - DNA, 140 bp, Artificial Sequence
  Synthetic
  misc_feature (22)..(22): n is a, c, g, or t
  misc_feature (56)..(56): n is a, c, g, or t
caccgctgtcccaaaaggtctnaggccctattcttgaaatttttccttcttgctcnatttcctgacatattgcagttaaggcttctattttttctctagataggggccattgttttacttcatatcagcagccagggcct

SEQ ID NO: 413057 - DNA, 140 bp, Artificial Sequence
  Synthetic
  misc_feature (47)..(47): n is a, c, g, or t
  misc_feature (97)..(97): n is a, c, g, or t
aggccctggctgctgatatgcagccccacctgcagagagcctcgggntcggggaggagatagccccctccccgaagcaagagcagagagaaaagganctatatcccttgacttccctcaagaccttttgggacagcggtg

SEQ ID NO: 413058 - DNA, 140 bp, Artificial Sequence
  Synthetic
  misc_feature (44)..(44): n is a, c, g, or t
  misc_feature (94)..(94): n is a, c, g, or t
caccgctgtcccaaaaggtcttgagggaagtcaagggatatagntccttttctctctgctcttgcttcggggagggggctatctcctccccgancccgaggctctctgcaggtggggctgcatatcagcagccagggcct

SEQ ID NO: 413059 - DNA, 140 bp, Artificial Sequence
  Synthetic
  misc_feature (47)..(47): n is a, c, g, or t
  misc_feature (98)..(98): n is a, c, g, or t
atacgccatgctgggtctccttatatgtaggatcagatttaccattnggagaacatagaaaaagagttgaattgctcagagaacatttatataaatgnggattcactacccctgataaaacgtacttgggagtcggccat

SEQ ID NO: 413060 - DNA, 140 bp, Artificial Sequence
  Synthetic
  misc_feature (43)..(43): n is a, c, g, or t
  misc_feature (94)..(94): n is a, c, g, or t
atggccgactcccaagtacgttttatcaggggtagtgaatccncatttatataaatgttctctgagcaattcaactctttttctatgttctccnaatggtaaatctgatcctacatataaggagacccagcatggcgtat

SEQ ID NO: 413061 - DNA, 140 bp, Artificial Sequence
  Synthetic
  misc_feature (43)..(43): n is a, c, g, or t
atacgccatgctgggtctcctctatcaaggaattagagtaaangaattgtgtaaattaatcagaggaaccaaatcattgacagaagtagtacctttaagtcaagaggcagaactagaattcgtacttgggagtcggccat

SEQ ID NO: 413062 - DNA, 140 bp, Artificial Sequence
  Synthetic
  misc_feature (98)..(98): n is a, c, g, or t
atggccgactcccaagtacgaattctagttctgcctcttgacttaaaggtactacttctgtcaatgatttggttcctctgattaatttacacaattcntttactctaattccttgatagaggagacccagcatggcgtat

SEQ ID NO: 413063 - DNA, 140 bp, Artificial Sequence
  Synthetic
  misc_feature (49)..(49): n is a, c, g, or t
atacgccatgctgggtctccaacctgacaaagacttatgggttaacatncagaagcaaggagaagggcaatggtcttaccaggtataccaggatgaacataagaatctcaaaacaggaaacgtacttgggagtcggccat

SEQ ID NO: 413064 - DNA, 140 bp, Artificial Sequence
  Synthetic
  misc_feature (92)..(92): n is a, c, g, or t
atggccgactcccaagtacgtttcctgttttgagattcttatgttcatcctggtatacctggtaagaccattgcccttctccttgcttctgnatgttaacccataagtctttgtcaggttggagacccagcatggcgtat

SEQ ID NO: 413065 - DNA, 140 bp, Artificial Sequence
  Synthetic
aggccctggctgctgatatgtggtcttaccaggtataccaggatgaacataagaatctcaaaacaggaaaatatactagacagaaggcctcccacacaaatgatataagacaactagcaggaccttttgggacagcggtg

SEQ ID NO: 413066 - DNA, 140 bp, Artificial Sequence
  Synthetic
caccgctgtcccaaaaggtcctgctagttgtcttatatcatttgtgtgggaggccttctgtctagtatattttcctgttttgagattcttatgttcatcctggtatacctggtaagaccacatatcagcagccagggcct

SEQ ID NO: 413067 - DNA, 140 bp, Artificial Sequence
  Synthetic
aggccctggctgctgatatgcctaaatttaagctgccagtcactagagaaacttgggaaacatggtgggcagattattggcaagccacctggattcctgaatgggaatttgtcagcacacgaccttttgggacagcggtg

SEQ ID NO: 413068 - DNA, 140 bp, Artificial Sequence
  Synthetic
caccgctgtcccaaaaggtcgtgtgctgacaaattcccattcaggaatccaggtggcttgccaataatctgcccaccatgtttcccaagtttctctagtgactggcagcttaaatttaggcatatcagcagccagggcct

SEQ ID NO: 413069 - DNA, 140 bp, Artificial Sequence
  Synthetic
  misc_feature (71)..(71): n is a, c, g, or t
atacgccatgctgggtctcccaggactctaaagagagagtaaacatagtaacagattcacaatatgtattnggcatcatatcctcccaacctacacagagtgactcccctatagttcaaccgtacttgggagtcggccat

SEQ ID NO: 413070 - DNA, 140 bp, Artificial Sequence
  Synthetic
  misc_feature (70)..(70): n is a, c, g, or t
atggccgactcccaagtacggttgaactataggggagtcactctgtgtaggttgggaggatatgatgccnaatacatattgtgaatctgttactatgtttactctctctttagagtcctgggagacccagcatggcgtat

SEQ ID NO: 413071 - DNA, 140 bp, Artificial Sequence
  Synthetic
  misc_feature (48)..(48): n is a, c, g, or t
aggccctggctgctgatatgaagatcatgaaaagtatcatagcaattngagagcattagccagtgattttggattaccaccagtagtagccaaggaaatcattgctagttgtcctaaatggaccttttgggacagcggtg

SEQ ID NO: 413072 - DNA, 140 bp, Artificial Sequence
  Synthetic
  misc_feature (93)..(93): n is a, c, g, or t
caccgctgtcccaaaaggtccatttaggacaactagcaatgatttccttggctactactggtggtaatccaaaatcactggctaatgctctcnaattgctatgatacttttcatgatcttcatatcagcagccagggcct

SEQ ID NO: 413073 - DNA, 140 bp, Artificial Sequence
  Synthetic
atacgccatgctgggtctcctcaataccactgccaatgtctctaatgtcgctgaggacatgaaaggagaaataaaaaactgctctttcaatgtgaccacagtactaagggataagcaacacgtacttgggagtcggccat

SEQ ID NO: 413074 - DNA, 140 bp, Artificial Sequence
  Synthetic
atggccgactcccaagtacgtgttgcttatcccttagtactgtggtcacattgaaagagcagttttttatttctcctttcatgtcctcagcgacattagagacattggcagtggtattgaggagacccagcatggcgtat

SEQ ID NO: 413075 - DNA, 140 bp, Artificial Sequence
  Synthetic
aggccctggctgctgatatggtccatgtagcaagtggattcatagaagcagaagtgataccagcagaaacaggacaagaaactgcctatttcctgttaaaattagcagcaagatggcctggaccttttgggacagcggtg

SEQ ID NO: 413076 - DNA, 140 bp, Artificial Sequence
  Synthetic
caccgctgtcccaaaaggtccaggccatcttgctgctaattttaacaggaaataggcagtttcttgtcctgtttctgctggtatcacttctgcttctatgaatccacttgctacatggaccatatcagcagccagggcct

SEQ ID NO: 413077 - DNA, 140 bp, Artificial Sequence
  Synthetic
atacgccatgctgggtctcctaccaagaagaaaggcaaaaataattagggattatggaaaacagatggcaggtactgattgtatggcaagtggacagacagaaagtgaaaacatggaacacgtacttgggagtcggccat

SEQ ID NO: 413078 - DNA, 140 bp, Artificial Sequence
  Synthetic
atggccgactcccaagtacgtgttccatgttttcactttctgtctgtccacttgccatacaatcagtacctgccatctgttttccataatccctaattatttttgcctttcttcttggtaggagacccagcatggcgtat

SEQ ID NO: 413079 - DNA, 140 bp, Artificial Sequence
  Synthetic
atacgccatgctgggtctcctatagacatcattatgaaactagaaatccaagaatcagttcaggtgtctatattccagtaggaggagccatgatagtggtaactacatattggggattaacgtacttgggagtcggccat

SEQ ID NO: 413080 - DNA, 140 bp, Artificial Sequence
  Synthetic
atggccgactcccaagtacgttaatccccaatatgtagttaccactatcatggctcctcctactggaatatagacacctgaactgattcttggatttctagtttcataatgatgtctataggagacccagcatggcgtat

SEQ ID NO: 413081 - DNA, 140 bp, Artificial Sequence
  Synthetic
aggccctggctgctgatatggatacatctgcactacttcacctgttttacagattcagcaatcaggaaagcctgtctagggcagaaagtgctgaccaggtgtgaattccataaaggacatgaccttttgggacagcggtg

SEQ ID NO: 413082 - DNA, 140 bp, Artificial Sequence
  Synthetic
caccgctgtcccaaaaggtcatgtcctttatggaattcacacctggtcagcactttctgccctagacaggctttcctgattgctgaatctgtaaaacaggtgaagtagtgcagatgtatccatatcagcagccagggcct

SEQ ID NO: 413083 - DNA, 140 bp, Artificial Sequence
  Synthetic
atacgccatgctgggtctccaaaaacaagtagacctccagtacccagtgtccagaagttaacaggagataggtggaacaggtgtcagaagatcaaggaccagctagagagccattcaatgcgtacttgggagtcggccat

SEQ ID NO: 413084 - DNA, 140 bp, Artificial Sequence
  Synthetic
atggccgactcccaagtacgcattgaatggctctctagctggtccttgatcttctgacacctgttccacctatctcctgttaacttctggacactgggtactggaggtctacttgtttttggagacccagcatggcgtat

SEQ ID NO: 413085 - DNA, 140 bp, Artificial Sequence
  Synthetic
aggccctggctgctgatatgggtggaacaggtgtcagaagatcaaggaccagctagagagccattcaatgaatggacaatacagctcttagaagagctaaaaacagaagcagtaaggcatgaccttttgggacagcggtg

SEQ ID NO: 413086 - DNA, 140 bp, Artificial Sequence
  Synthetic
caccgctgtcccaaaaggtcatgccttactgcttctgtttttagctcttctaagagctgtattgtccattcattgaatggctctctagctggtccttgatcttctgacacctgttccacccatatcagcagccagggcct

SEQ ID NO: 413087 - DNA, 140 bp, Artificial Sequence
  Synthetic
aggccctggctgctgatatgtactatttacccactatagaattggatgccagcatagtagaataggaattatcccatctaacacaagaggaagaggaagaagagatggatccagtagaccgaccttttgggacagcggtg

SEQ ID NO: 413088 - DNA, 140 bp, Artificial Sequence
  Synthetic
caccgctgtcccaaaaggtcggtctactggatccatctcttcttcctcttcctcttgtgttagatgggataattcctattctactatgctggcatccaattctatagtgggtaaatagtacatatcagcagccagggcct

SEQ ID NO: 413089 - DNA, 140 bp, Artificial Sequence
  Synthetic
atacgccatgctgggtctccaatacctgctattgcaaaagttgctgctatcattgcattgtttgtttcacaaagaagggtttgggaatctcctatggcaggaagaagcggcgaagaccaacgtacttgggagtcggccat

SEQ ID NO: 413090 - DNA, 140 bp, Artificial Sequence
  Synthetic
atggccgactcccaagtacgttggtcttcgccgcttcttcctgccataggagattcccaaacccttctttgtgaaacaaacaatgcaatgatagcagcaacttttgcaatagcaggtattggagacccagcatggcgtat

SEQ ID NO: 413091 - DNA, 140 bp, Artificial Sequence
  Synthetic
aggccctggctgctgatatgaaagaagggtttgggaatctcctatggcaggaagaagcggcgaagaccaacaactgctgaacgccatacagataataaagatcctgtaccagagcagtaagaccttttgggacagcggtg

SEQ ID NO: 413092 - DNA, 140 bp, Artificial Sequence
  Synthetic
caccgctgtcccaaaaggtcttactgctctggtacaggatctttattatctgtatggcgttcagcagttgttggtcttcgccgcttcttcctgccataggagattcccaaacccttctttcatatcagcagccagggcct

SEQ ID NO: 413093 - DNA, 140 bp, Artificial Sequence
  Synthetic
  misc_feature (101)..(101): n is a, c, g, or t
  misc_feature (116)..(116): n is a, c, g, or t
atacgccatgctgggtctccatcccactagaggatgctgaattggtagtgataacatattggggtctgcatacaggagaaagagaatggcatttgggtcanggggtctccatagantggacgtacttgggagtcggccat

SEQ ID NO: 413094 - DNA, 140 bp, Artificial Sequence
  Synthetic
  misc_feature (25)..(25): n is a, c, g, or t
  misc_feature (40)..(40): n is a, c, g, or t
atggccgactcccaagtacgtccantctatggagaccccntgacccaaatgccattctctttctcctgtatgcagaccccaatatgttatcactaccaattcagcatcctctagtgggatggagacccagcatggcgtat

SEQ ID NO: 413095 - DNA, 140 bp, Artificial Sequence
  Synthetic
atacgccatgctgggtctcctttgtttcttacaaccgcgcttatatggatgtttgtgcttaaactttgcttagaacaaaagagacaaggaaaaagggaaagagaaatacttgatagattacgtacttgggagtcggccat

SEQ ID NO: 413096 - DNA, 140 bp, Artificial Sequence
  Synthetic
atggccgactcccaagtacgtaatctatcaagtatttctctttccctttttccttgtctcttttgttctaagcaaagtttaagcacaaacatccatataagcgcggttgtaagaaacaaaggagacccagcatggcgtat

SEQ ID NO: 413097 - DNA, 140 bp, Artificial Sequence
  Synthetic
  misc_feature (82)..(82): n is a, c, g, or t
  misc_feature (85)..(85): n is a, c, g, or t
  misc_feature (120)..(120): n is a, c, g, or t
aggccctggctgctgatatgtagaacaaaagagacaaggaaaaagggaaagagaaatacttgatagattaagaagaataagnganatcagggatgacagtgattatgaaagcaatggagngaccttttgggacagcggtg

SEQ ID NO: 413098 - DNA, 140 bp, Artificial Sequence
  Synthetic
  misc_feature (21)..(21): n is a, c, g, or t
  misc_feature (56)..(56): n is a, c, g, or t
  misc_feature (59)..(59): n is a, c, g, or t
caccgctgtcccaaaaggtcnctccattgctttcataatcactgtcatccctgatntcncttattcttcttaatctatcaagtatttctctttccctttttccttgtctcttttgttctacatatcagcagccagggcct

SEQ ID NO: 413099 - DNA, 140 bp, Artificial Sequence
  Synthetic
atacgccatgctgggtctccccatgtttgaactctgaacagctatatgccacagtctattctggggtgcctgtgtgggaagatgcaagccctacactattctgtgcttcagatgttaattcgtacttgggagtcggccat

SEQ ID NO: 413100 - DNA, 140 bp, Artificial Sequence
  Synthetic
atggccgactcccaagtacgaattaacatctgaagcacagaatagtgtagggcttgcatcttcccacacaggcaccccagaatagactgtggcatatagctgttcagagttcaaacatggggagacccagcatggcgtat

SEQ ID NO: 413101 - DNA, 140 bp, Artificial Sequence
  Synthetic
aggccctggctgctgatatgtgtgtgggaagatgcaagccctacactattctgtgcttcagatgttaatttaacaagcactgagcagcataatatttgggcatcacaagcctgcgttcccgaccttttgggacagcggtg

SEQ ID NO: 413102 - DNA, 140 bp, Artificial Sequence
  Synthetic
caccgctgtcccaaaaggtcgggaacgcaggcttgtgatgcccaaatattatgctgctcagtgcttgttaaattaacatctgaagcacagaatagtgtagggcttgcatcttcccacacacatatcagcagccagggcct

SEQ ID NO: 413103 - DNA, 140 bp, Artificial Sequence
  Synthetic
atacgccatgctgggtctcctgctaatgataccactagtactactagttcccctaataatagtacccctagtaatagtagtctggaaaataatagtgacataaaaaactgctctttcaatcgtacttgggagtcggccat

SEQ ID NO: 413104 - DNA, 140 bp, Artificial Sequence
  Synthetic
atggccgactcccaagtacgattgaaagagcagttttttatgtcactattattttccagactactattactaggggtactattattaggggaactagtagtactagtggtatcattagcaggagacccagcatggcgtat

SEQ ID NO: 413105 - DNA, 140 bp, Artificial Sequence
  Synthetic
aggccctggctgctgatatgactgtttatccatttcaggattgggtgccaacatagcagaataggcattcttccacagagaagagggagaaatggatccagtagatcctaacatagagccgaccttttgggacagcggtg

SEQ ID NO: 413106 - DNA, 140 bp, Artificial Sequence
  Synthetic
caccgctgtcccaaaaggtcggctctatgttaggatctactggatccatttctccctcttctctgtggaagaatgcctattctgctatgttggcacccaatcctgaaatggataaacagtcatatcagcagccagggcct

SEQ ID NO: 413107 - DNA, 140 bp, Artificial Sequence
  Synthetic
atacgccatgctgggtctcccgcaaagacaacaaacccagaggaagagaccaatccggtaaaaaaatgtgattttaatgtaactacggttgtgaaagacaaacaggagaaaaaacaggctcgtacttgggagtcggccat

SEQ ID NO: 413108 - DNA, 140 bp, Artificial Sequence
  Synthetic
atggccgactcccaagtacgagcctgttttttctcctgtttgtctttcacaaccgtagttacattaaaatcacatttttttaccggattggtctcttcctctgggtttgttgtctttgcgggagacccagcatggcgtat

SEQ ID NO: 413109 - DNA, 140 bp, Artificial Sequence
  Synthetic
atacgccatgctgggtctccgtaaagtgtgttgctttcattgccaagtttgctttctaaataagggcttaggcatctcctatggcaggaagaagcggagacaacgacgaggaactcctcacgtacttgggagtcggccat

SEQ ID NO: 413110 - DNA, 140 bp, Artificial Sequence
  Synthetic
atggccgactcccaagtacgtgaggagttcctcgtcgttgtctccgcttcttcctgccataggagatgcctaagcccttatttagaaagcaaacttggcaatgaaagcaacacactttacggagacccagcatggcgtat

SEQ ID NO: 413111 - DNA, 140 bp, Artificial Sequence
  Synthetic
  misc_feature (33)..(33): n is a, c, g, or t
atacgccatgctgggtctccgggcagtaaggancatcaaaatcctgtaccaaagcagtaagtagtaatactcagtatatgtaatgcagcctttagaaatagcttcaatagtaggattagtcgtacttgggagtcggccat

SEQ ID NO: 413112 - DNA, 140 bp, Artificial Sequence
  Synthetic
  misc_feature (108)..(108): n is a, c, g, or t
atggccgactcccaagtacgactaatcctactattgaagctatttctaaaggctgcattacatatactgagtattactacttactgctttggtacaggattttgatgntccttactgcccggagacccagcatggcgtat

SEQ ID NO: 413113 - DNA, 140 bp, Artificial Sequence
  Synthetic
atacgccatgctgggtctccacctaatatttaatgggacaatctctaaaggaaaaataagaattatggcaaaaaacatttcgagcaactcagataatatcttagtgaccctaaattctaccgtacttgggagtcggccat

SEQ ID NO: 413114 - DNA, 140 bp, Artificial Sequence
  Synthetic
atggccgactcccaagtacggtagaatttagggtcactaagatattatctgagttgctcgaaatgttttttgccataattcttatttttcctttagagattgtcccattaaatattaggtggagacccagcatggcgtat

SEQ ID NO: 413115 - DNA, 140 bp, Artificial Sequence
  Synthetic
aggccctggctgctgatatgaaaaacatttcgagcaactcagataatatcttagtgaccctaaattctactataaacatgacctgcatgaggccaggaaataattcagtacaagagatgagaccttttgggacagcggtg

SEQ ID NO: 413116 - DNA, 140 bp, Artificial Sequence
  Synthetic
caccgctgtcccaaaaggtctcatctcttgtactgaattatttcctggcctcatgcaggtcatgtttatagtagaatttagggtcactaagatattatctgagttgctcgaaatgtttttcatatcagcagccagggcct

SEQ ID NO: 413117 - DNA, 140 bp, Artificial Sequence
  Synthetic
  misc_feature (23)..(23): n is a, c, g, or t
  misc_feature (32)..(32): n is a, c, g, or t
atacgccatgctgggtctccatntgtagtgcntcagacaaattgtgggtcacagtctattatggagtacctgtgtggaaagatgcagagacccccctattttgtgcatccgatgctaaagcgtacttgggagtcggccat

SEQ ID NO: 413118 - DNA, 140 bp, Artificial Sequence
  Synthetic
  misc_feature (109)..(109): n is a, c, g, or t
  misc_feature (118)..(118): n is a, c, g, or t
atggccgactcccaagtacgctttagcatcggatgcacaaaataggggggtctctgcatctttccacacaggtactccataatagactgtgacccacaatttgtctgangcactacanatggagacccagcatggcgtat

SEQ ID NO: 413119 - DNA, 140 bp, Artificial Sequence
  Synthetic
atacgccatgctgggtctccaatagatcaagaatagctttttgtacctataatgccacggaatggaaagaaaccttgcaaggaatagctgaaaggtatttagaacttgtaaattatacagcgtacttgggagtcggccat

SEQ ID NO: 413120 - DNA, 140 bp, Artificial Sequence
  Synthetic
atggccgactcccaagtacgctgtataatttacaagttctaaatacctttcagctattccttgcaaggtttctttccattccgtggcattataggtacaaaaagctattcttgatctattggagacccagcatggcgtat

SEQ ID NO: 413121 - DNA, 140 bp, Artificial Sequence
  Synthetic
aggccctggctgctgatatgaaccttgcaaggaatagctgaaaggtatttagaacttgtaaattatacagaaaaaattaacataacattcaagaacagcactgatggagatatcgaagtagaccttttgggacagcggtg

SEQ ID NO: 413122 - DNA, 140 bp, Artificial Sequence
  Synthetic
caccgctgtcccaaaaggtctacttcgatatctccatcagtgctgttcttgaatgttatgttaattttttctgtataatttacaagttctaaatacctttcagctattccttgcaaggttcatatcagcagccagggcct

SEQ ID NO: 413123 - DNA, 140 bp, Artificial Sequence
  Synthetic
aggccctggctgctgatatgcatgacaaaaatcttagagccttttagaaaacaaaatccagacatagttatttatcaatacatggatgatttgtatgtaggatctgacttagaaataggggaccttttgggacagcggtg

SEQ ID NO: 413124 - DNA, 140 bp, Artificial Sequence
  Synthetic
caccgctgtcccaaaaggtcccctatttctaagtcagatcctacatacaaatcatccatgtattgataaataactatgtctggattttgttttctaaaaggctctaagatttttgtcatgcatatcagcagccagggcct

SEQ ID NO: 413125 - DNA, 140 bp, Artificial Sequence
  Synthetic
atacgccatgctgggtctcctcaaatgtttaattatacattcgaatgtaataactccaactgtaggattcagaatgacaataatacttatgaaaacagtacaagaacaatatattgccggcgtacttgggagtcggccat

SEQ ID NO: 413126 - DNA, 140 bp, Artificial Sequence
  Synthetic
atggccgactcccaagtacgccggcaatatattgttcttgtactgttttcataagtattattgtcattctgaatcctacagttggagttattacattcgaatgtataattaaacatttgaggagacccagcatggcgtat

SEQ ID NO: 413127 - DNA, 140 bp, Artificial Sequence
  Synthetic
aggccctggctgctgatatgagaatgacaataatacttatgaaaacagtacaagaacaatatattgccggttgagacaggtagtaaggtcatggatgaggggagggtcaggcctctatgcgaccttttgggacagcggtg

SEQ ID NO: 413128 - DNA, 140 bp, Artificial Sequence
  Synthetic
caccgctgtcccaaaaggtcgcatagaggcctgaccctcccctcatccatgaccttactacctgtctcaaccggcaatatattgttcttgtactgttttcataagtattattgtcattctcatatcagcagccagggcct

SEQ ID NO: 413129 - DNA, 140 bp, Artificial Sequence
  Synthetic
  misc_feature (45)..(45): n is a, c, g, or t
  misc_feature (63)..(63): n is a, c, g, or t
atacgccatgctgggtctcctagcactgaagaagccaacaatatnaccaaaggaatggctgangaaatgagaaactgctctttcaatgtgacctcagtactaagagataagaaaaagacacgtacttgggagtcggccat

SEQ ID NO: 413130 - DNA, 140 bp, Artificial Sequence
  Synthetic
  misc_feature (78)..(78): n is a, c, g, or t
  misc_feature (96)..(96): n is a, c, g, or t
atggccgactcccaagtacgtgtctttttcttatctcttagtactgaggtcacattgaaagagcagtttctcatttcntcagccattcctttggtnatattgttggcttcttcagtgctaggagacccagcatggcgtat

SEQ ID NO: 413131 - DNA, 140 bp, Artificial Sequence
  Synthetic
  misc_feature (46)..(46): n is a, c, g, or t
  misc_feature (51)..(51): n is a, c, g, or t
  misc_feature (100)..(100): n is a, c, g, or t
atacgccatgctgggtctcctcctaacaagagatgcactaataaanagaanctccagcaaccccaacatcacatttagaccaacaggaggagatatgaangatatatggagaacccaattcgtacttgggagtcggccat

SEQ ID NO: 413132 - DNA, 140 bp, Artificial Sequence
  Synthetic
  misc_feature (41)..(41): n is a, c, g, or t
  misc_feature (90)..(90): n is a, c, g, or t
  misc_feature (95)..(95): n is a, c, g, or t
atggccgactcccaagtacgaattgggttctccatatatcnttcatatctcctcctgttggtctaaatgtgatgttggggttgctggagnttctntttattagtgcatctcttgttaggaggagacccagcatggcgtat

SEQ ID NO: 413133 - DNA, 140 bp, Artificial Sequence
  Synthetic
atacgccatgctgggtctccctggcacgaatgttactaatgacatgaaagatagcatgaaaaattgcactttcaatacaaccacagatctaagagataaaaaacagaaagagagggcactcgtacttgggagtcggccat

SEQ ID NO: 413134 - DNA, 140 bp, Artificial Sequence
  Synthetic
atggccgactcccaagtacgagtgccctctctttctgttttttatctcttagatctgtggttgtattgaaagtgcaatttttcatgctatctttcatgtcattagtaacattcgtgccagggagacccagcatggcgtat

SEQ ID NO: 413135 - DNA, 140 bp, Artificial Sequence
  Synthetic
atacgccatgctgggtctccagattagtagaccagttataggcactaaccatcaaagagaaaaaagggcagtaggattgggaatgctattcttgggggttctaagtgcagcaggtagcaccgtacttgggagtcggccat

SEQ ID NO: 413136 - DNA, 140 bp, Artificial Sequence
  Synthetic
atggccgactcccaagtacggtgctacctgctgcacttagaacccccaagaatagcattcccaatcctactgcccttttttctctttgatggttagtgcctataactggtctactaatctggagacccagcatggcgtat

SEQ ID NO: 413137 - DNA, 140 bp, Artificial Sequence
  Synthetic
atacgccatgctgggtctccgctactaattggaccaatagtaaaatcaatactactgatacctatgttggtaatgtcaatattagcagcagggaaccgataaacaactgctcttttaatacgtacttgggagtcggccat

SEQ ID NO: 413138 - DNA, 140 bp, Artificial Sequence
  Synthetic
atggccgactcccaagtacgtattaaaagagcagttgtttatcggttccctgctgctaatattgacattaccaacataggtatcagtagtattgattttactattggtccaattagtagcggagacccagcatggcgtat

SEQ ID NO: 413139 - DNA, 140 bp, Artificial Sequence
  Synthetic
atacgccatgctgggtctccacatggggaggaaatctctcaatttgggacagcttaacatggcagcaatgggatcaacaggtatccaatgtaagctctttcatatatgacaaaatacaagcgtacttgggagtcggccat

SEQ ID NO: 413140 - DNA, 140 bp, Artificial Sequence
  Synthetic
atggccgactcccaagtacgcttgtattttgtcatatatgaaagagcttacattggatacctgttgatcccattgctgccatgttaagctgtcccaaattgagagatttcctccccatgtggagacccagcatggcgtat

SEQ ID NO: 413141 - DNA, 140 bp, Artificial Sequence
  Synthetic
atacgccatgctgggtctccacacatagttttaattgtggaggagagtttttctattgtaatacatcactcttgtttaatagcagttggaaaggaaatgacagcatacaagagtcagaggcgtacttgggagtcggccat

SEQ ID NO: 413142 - DNA, 140 bp, Artificial Sequence
  Synthetic
atggccgactcccaagtacgcctctgactcttgtatgctgtcatttcctttccaactgctattaaacaagagtgatgtattacaatagaaaaactctcctccacaattaaaactatgtgtggagacccagcatggcgtat

SEQ ID NO: 413143 - DNA, 140 bp, Artificial Sequence
  Synthetic
atacgccatgctgggtctccaacctataactctcccgtgcagaataaaacaaattgtaaatctgtggcaggaagtaggacgagcaatatatgcccctcccatcccaggaataataaactgcgtacttgggagtcggccat

SEQ ID NO: 413144 - DNA, 140 bp, Artificial Sequence
  Synthetic
atggccgactcccaagtacgcagtttattattcctgggatgggaggggcatatattgctcgtcctacttcctgccacagatttacaatttgttttattctgcacgggagagttataggttggagacccagcatggcgtat

SEQ ID NO: 413145 - DNA, 140 bp, Artificial Sequence
  Synthetic
atacgccatgctgggtctcctcatgatagtacttaacctagtaaagaacattaggcagggatatcaacccctctcgttacagatccccaaccatcaccagcaggaagtaggaacgccagacgtacttgggagtcggccat

SEQ ID NO: 413146 - DNA, 140 bp, Artificial Sequence
  Synthetic
atggccgactcccaagtacgtctggcgttcctacttcctgctggtgatggttggggatctgtaacgagaggggttgatatccctgcctaatgttctttactaggttaagtactatcatgaggagacccagcatggcgtat

SEQ ID NO: 413147 - DNA, 140 bp, Artificial Sequence
  Synthetic
atacgccatgctgggtctcccgccacccggattcttgcaactattgtacacggacctccggacaataatcctgtggagttaccagatcttgagcagcttaacatcagggatccagaagttcgtacttgggagtcggccat

SEQ ID NO: 413148 - DNA, 140 bp, Artificial Sequence
  Synthetic
atggccgactcccaagtacgaacttctggatccctgatgttaagctgctcaagatctggtaactccacaggattattgtccggaggtccgtgtacaatagttgcaagaatccgggtggcgggagacccagcatggcgtat

SEQ ID NO: 413149 - DNA, 140 bp, Artificial Sequence
  Synthetic
aggccctggctgctgatatgctgtggagttaccagatcttgagcagcttaacatcagggatccagaagttgatcagcctgctgggacttggactgtgcactctatggcaaaggataactggaccttttgggacagcggtg

SEQ ID NO: 413150 - DNA, 140 bp, Artificial Sequence
  Synthetic
caccgctgtcccaaaaggtccagttatcctttgccatagagtgcacagtccaagtcccagcaggctgatcaacttctggatccctgatgttaagctgctcaagatctggtaactccacagcatatcagcagccagggcct

SEQ ID NO: 413151 - DNA, 140 bp, Artificial Sequence
  Synthetic
atacgccatgctgggtctccgatttaggataatggtcaacaacaagtcaatgagaagtataaaaacacattgtaaccttagtatagaaaattgggagaccactttaaaacgggtagttgacgtacttgggagtcggccat

SEQ ID NO: 413152 - DNA, 140 bp, Artificial Sequence
  Synthetic
atggccgactcccaagtacgtcaactacccgttttaaagtggtctcccaattttctatactaaggttacaatgtgtttttatacttctcattgacttgttgttgaccattatcctaaatcggagacccagcatggcgtat

SEQ ID NO: 413153 - DNA, 140 bp, Artificial Sequence
  Synthetic
atacgccatgctgggtctccaaaattagtgctacaagcttactagatactgttgcagtggcagttggcagttggactgacaacattatctcaggtgtgcaaaggataggaagaggaattccgtacttgggagtcggccat

SEQ ID NO: 413154 - DNA, 140 bp, Artificial Sequence
  Synthetic
atggccgactcccaagtacggaattcctcttcctatcctttgcacacctgagataatgttgtcagtccaactgccaactgccactgcaacagtatctagtaagcttgtagcactaattttggagacccagcatggcgtat

SEQ ID NO: 413155 - DNA, 140 bp, Artificial Sequence
  Synthetic
atacgccatgctgggtctccagggtaaaggaaaagttaaaggttcatttccctaataaaacaataaattttacctcatcctcaggaggggacctagaagttacaatgcataattttaattcgtacttgggagtcggccat

SEQ ID NO: 413156 - DNA, 140 bp, Artificial Sequence
  Synthetic
atggccgactcccaagtacgaattaaaattatgcattgtaacttctaggtcccctcctgaggatgaggtaaaatttattgttttattagggaaatgaacctttaacttttcctttaccctggagacccagcatggcgtat

SEQ ID NO: 413157 - DNA, 140 bp, Artificial Sequence
  Synthetic
aggccctggctgctgatatgtacctcatcctcaggaggggacctagaagttacaatgcataattttaattgtagaggagaattcttttactgcaatacatcaggactgtttaataataatgaccttttgggacagcggtg

SEQ ID NO: 413158 - DNA, 140 bp, Artificial Sequence
  Synthetic
caccgctgtcccaaaaggtcattattattaaacagtcctgatgtattgcagtaaaagaattctcctctacaattaaaattatgcattgtaacttctaggtcccctcctgaggatgaggtacatatcagcagccagggcct

SEQ ID NO: 413159 - DNA, 140 bp, Artificial Sequence
  Synthetic
atacgccatgctgggtctccgaagaagaatgagacaaacttcccctgatcctcaaccatgtgcacctggagtaggagaggtatccagggcattggcaggtagaggagggataccaaattccgtacttgggagtcggccat

SEQ ID NO: 413160 - DNA, 140 bp, Artificial Sequence
  Synthetic
atggccgactcccaagtacggaatttggtatccctcctctacctgccaatgccctggatacctctcctactccaggtgcacatggttgaggatcaggggaagtttgtctcattcttcttcggagacccagcatggcgtat

SEQ ID NO: 413161 - DNA, 140 bp, Artificial Sequence
  Synthetic
atacgccatgctgggtctccatgaggacgtaggtttcccagtaagacctcaagtgcctctacagccaatgacctttaaagcagcacatgatctcagtcattttttaaaagaaaacggaggcgtacttgggagtcggccat

SEQ ID NO: 413162 - DNA, 140 bp, Artificial Sequence
  Synthetic
atggccgactcccaagtacgcctccgttttcttttaaaaaatgactgagatcatgtgctgctttaaaggtcattggctgtagaggcacttgaggtcttactgggaaacctacgtcctcatggagacccagcatggcgtat

SEQ ID NO: 413163 - DNA, 140 bp, Artificial Sequence
  Synthetic
  misc_feature (111)..(111): n is a, c, g, or t
atacgccatgctgggtctcctgcagtcactctagaacgcaatagtagtacttaggtgtgttcacaaaagatatagagttaaagacacacagcaggcaatacaaaaattaanggaagtaatcgtacttgggagtcggccat

SEQ ID NO: 413164 - DNA, 140 bp, Artificial Sequence
  Synthetic
  misc_feature (30)..(30): n is a, c, g, or t
atggccgactcccaagtacgattacttccnttaatttttgtattgcctgctgtgtgtctttaactctatatcttttgtgaacacacctaagtactactattgcgttctagagtgactgcaggagacccagcatggcgtat

SEQ ID NO: 413165 - DNA, 140 bp, Artificial Sequence
  Synthetic
aggccctggctgctgatatgaagacagggctttgaagcagctttgctataaaatggggggcaagtggtcaaaaagcagcatagttggatggcctgctgtaagagaaagaataagacgagcgaccttttgggacagcggtg

SEQ ID NO: 413166 - DNA, 140 bp, Artificial Sequence
  Synthetic
caccgctgtcccaaaaggtcgctcgtcttattctttctcttacagcaggccatccaactatgctgctttttgaccacttgccccccattttatagcaaagctgcttcaaagccctgtcttcatatcagcagccagggcct

SEQ ID NO: 413167 - DNA, 140 bp, Artificial Sequence
  Synthetic
  misc_feature (46)..(46): n is a, c, g, or t
  misc_feature (63)..(63): n is a, c, g, or t
  misc_feature (67)..(67): n is a, c, g, or t
  misc_feature (70)..(70): n is a, c, g, or t
  misc_feature (74)..(74): n is a, c, g, or t
  misc_feature (77)..(77): n is a, c, g, or t
  misc_feature (93)..(93): n is a, c, g, or t
  misc_feature (95)..(95): n is a, c, g, or t
atacgccatgctgggtctcctggtagacttcagagagttaaacaanagaacacaagacttttnggangtncagntangtatcccacatccagngngtttaaagcaaaggcaatctgttaccgtacttgggagtcggccat

SEQ ID NO: 413168 - DNA, 140 bp, Artificial Sequence
  Synthetic
  misc_feature (46)..(46): n is a, c, g, or t
  misc_feature (48)..(48): n is a, c, g, or t
  misc_feature (64)..(64): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (78)..(78): n is a, c, g, or t
  misc_feature (95)..(95): n is a, c, g, or t
atggccgactcccaagtacggtaacagattgcctttgctttaaacncnctggatgtgggatacntanctgnacntccnaaaagtcttgtgttctnttgtttaactctctgaagtctaccaggagacccagcatggcgtat

SEQ ID NO: 413169 - DNA, 140 bp, Artificial Sequence
  Synthetic
aggccctggctgctgatatggtggcgcccgaacagggaccaaaagtgaaaccagggaagaaaacctccgacgcaacaggctcggcttagcggagtgcacccgctaagaggcaagaagaacgaccttttgggacagcggtg

SEQ ID NO: 413170 - DNA, 140 bp, Artificial Sequence
  Synthetic
caccgctgtcccaaaaggtcgttcttcttgcctcttagcgggtgcactccgctaagccgagcctgttgcgtcggaggttttcttccctggtttcacttttggtccctgttcgggcgccaccatatcagcagccagggcct

SEQ ID NO: 413171 - DNA, 140 bp, Artificial Sequence
  Synthetic
atacgccatgctgggtctcccgcaacaggctcggcttagcggagtgcacccgctaagaggcaagaagaactcacaagaaagtaagtaattttgctggcagtggccagacctagaggaaagcgtacttgggagtcggccat

SEQ ID NO: 413172 - DNA, 140 bp, Artificial Sequence
  Synthetic
atggccgactcccaagtacgctttcctctaggtctggccactgccagcaaaattacttactttcttgtgagttcttcttgcctcttagcgggtgcactccgctaagccgagcctgttgcgggagacccagcatggcgtat

SEQ ID NO: 413173 - DNA, 140 bp, Artificial Sequence
  Synthetic
aggccctggctgctgatatggggaactaaagaatggtgccattaatttgtttgacacaacagcaatagcagtagctaactggacagataggggcatagaagtagtacaaagaattggtaggaccttttgggacagcggtg

SEQ ID NO: 413174 - DNA, 140 bp, Artificial Sequence
  Synthetic
caccgctgtcccaaaaggtcctaccaattctttgtactacttctatgcccctatctgtccagttagctactgctattgctgttgtgtcaaacaaattaatggcaccattctttagttccccatatcagcagccagggcct

SEQ ID NO: 413175 - DNA, 140 bp, Artificial Sequence
  Synthetic
aggccctggctgctgatatgagactaaattaaatgcatagaaacaaattaagttaaagccaggatctaaaaagaaatataagctaaaacatttaatataggcaagcaaagagctggacaggaccttttgggacagcggtg

SEQ ID NO: 413176 - DNA, 140 bp, Artificial Sequence
  Synthetic
caccgctgtcccaaaaggtcctgtccagctctttgcttgcctatattaaatgttttagcttatatttctttttagatcctggctttaacttaatttgtttctatgcatttaatttagtctcatatcagcagccagggcct

SEQ ID NO: 413177 - DNA, 140 bp, Artificial Sequence
  Synthetic
atacgccatgctgggtctcctcactctagaacgctatagcagtgctctggtgtgttcataacagatataaagttaaagatacacagcaggcagtaagaaaattaaaggaagaaatggagacgtacttgggagtcggccat

SEQ ID NO: 413178 - DNA, 140 bp, Artificial Sequence
  Synthetic
atggccgactcccaagtacgtctccatttcttcctttaattttcttactgcctgctgtgtatctttaactttatatctgttatgaacacaccagagcactgctatagcgttctagagtgaggagacccagcatggcgtat

SEQ ID NO: 413179 - DNA, 140 bp, Artificial Sequence
  Synthetic
aggccctggctgctgatatgggtcaaaattaccctgtagtagcaaatgcacaaagacaaatagtacatcaggccctctcccccagaactctaaatgcataggtaaaggcagtagaaaaaagaccttttgggacagcggtg

SEQ ID NO: 413180 - DNA, 140 bp, Artificial Sequence
  Synthetic
caccgctgtcccaaaaggtcttttttctactgcctttacctatgcatttagagttctgggggagagggcctgatgtactatttgtctttgtgcatttgctactacagggtaattttgacccatatcagcagccagggcct

SEQ ID NO: 413181 - DNA, 140 bp, Artificial Sequence
  Synthetic
atacgccatgctgggtctccggccctctcccccagaactctaaatgcataggtaaaggcagtagaaaaaaaagcctttaaccctgagatcattcctatgtttatggcattgtcagaaggacgtacttgggagtcggccat

SEQ ID NO: 413182 - DNA, 140 bp, Artificial Sequence
  Synthetic
atggccgactcccaagtacgtccttctgacaatgccataaacataggaatgatctcagggttaaaggcttttttttctactgcctttacctatgcatttagagttctgggggagagggccggagacccagcatggcgtat

SEQ ID NO: 413183 - DNA, 140 bp, Artificial Sequence
  Synthetic
aggccctggctgctgatatgttggtggaatctcctgcagtattggagtcaggaactaaagaatagtgctgttagcttgcttaacgccacagccatagtagtagctgaggggacagatagggaccttttgggacagcggtg

SEQ ID NO: 413184 - DNA, 140 bp, Artificial Sequence
  Synthetic
caccgctgtcccaaaaggtccctatctgtcccctcagctactactatggctgtggcgttaagcaagctaacagcactattctttagttcctgactccaatactgcaggagattccaccaacatatcagcagccagggcct

SEQ ID NO: 413185 - DNA, 140 bp, Artificial Sequence
  Synthetic
aggccctggctgctgatatgagaggctttacaagtattgaaggaagtaatcaatgataaggcagcagactaagatagaactcatccaccagtagtaggaccattaccaccagggcagatagaccttttgggacagcggtg

SEQ ID NO: 413186 - DNA, 140 bp, Artificial Sequence
  Synthetic
caccgctgtcccaaaaggtctatctgccctggtggtaatggtcctactactggtggatgagttctatcttagtctgctgccttatcattgattacttccttcaatacttgtaaagcctctcatatcagcagccagggcct

SEQ ID NO: 413187 - DNA, 140 bp, Artificial Sequence
  Synthetic
atacgccatgctgggtctccaagatagaactcatccaccagtagtaggaccattaccaccagggcagataaaagaaccaacaggaagtgacattgctagaacaacaagcaccctgcaagacgtacttgggagtcggccat

SEQ ID NO: 413188 - DNA, 140 bp, Artificial Sequence
  Synthetic
atggccgactcccaagtacgtcttgcagggtgcttgttgttctagcaatgtcacttcctgttggttcttttatctgccctggtggtaatggtcctactactggtggatgagttctatcttggagacccagcatggcgtat

SEQ ID NO: 413189 - DNA, 140 bp, Artificial Sequence
  Synthetic
atacgccatgctgggtctcctaggtagagcaattcttaacatacctagaagaataagacagggcttggaaaggcttttgctataaaatgggtaacaagtggtcaagaaatagtataccagcgtacttgggagtcggccat

SEQ ID NO: 413190 - DNA, 140 bp, Artificial Sequence
  Synthetic
atggccgactcccaagtacgctggtatactatttcttgaccacttgttacccattttatagcaaaagcctttccaagccctgtcttattcttctaggtatgttaagaattgctctacctaggagacccagcatggcgtat

SEQ ID NO: 413191 - DNA, 140 bp, Artificial Sequence
  Synthetic
aggccctggctgctgatatgaaacatttagtatgggcaagcagggagctggaaagatttgcacttaaccctggccttttagaaacagcagatggctgtaaacaaataataaaacagctacgaccttttgggacagcggtg

SEQ ID NO: 413192 - DNA, 140 bp, Artificial Sequence
  Synthetic
caccgctgtcccaaaaggtcgtagctgttttattatttgtttacagccatctgctgtttctaaaaggccagggttaagtgcaaatctttccagctccctgcttgcccatactaaatgtttcatatcagcagccagggcct

SEQ ID NO: 413193 - DNA, 140 bp, Artificial Sequence
  Synthetic
atacgccatgctgggtctccagtccagtgagcatcttagatattaagcaaagaccaaaagaaccatttagaaattatgtaaatcagttctacaaaacattaagagctaagcaagcaactccgtacttgggagtcggccat

SEQ ID NO: 413194 - DNA, 140 bp, Artificial Sequence
  Synthetic
atggccgactcccaagtacggagttgcttgcttagctcttaatgttttgtagaactgatttacataatttctaaatggttcttttggtctttgcttaatatctaagatgctcactggactggagacccagcatggcgtat

SEQ ID NO: 413195 - DNA, 140 bp, Artificial Sequence
  Synthetic
aggccctggctgctgatatgccagattgcaaacaaattttaaaagcattaaggccagaagctagcctagaagaaataatagtagcttgtcaaggagtaagaagaccaactcataaggctagaccttttgggacagcggtg

SEQ ID NO: 413196 - DNA, 140 bp, Artificial Sequence
  Synthetic
caccgctgtcccaaaaggtctagccttatgagttggtcttcttactccttgacaagctactattatttcttctaggctagcttctggccttaatgcttttaaaatttgtttgcaatctggcatatcagcagccagggcct

SEQ ID NO: 413197 - DNA, 140 bp, Artificial Sequence
  Synthetic
aggccctggctgctgatatgtacacatcagtattcatgcaaaaaagacaaaaaccaattaaaaaaggacctataaaatgtttcaattgtagaaaagaaggacatgtagcaaaaaattgtagaccttttgggacagcggtg

SEQ ID NO: 413198 - DNA, 140 bp, Artificial Sequence
  Synthetic
caccgctgtcccaaaaggtctacaattttttgctacatgtccttcttttctacaattgaaacattttataggtccttttttaattggtttttgtcttttttgcatgaatactgatgtgtacatatcagcagccagggcct

SEQ ID NO: 413199 - DNA, 140 bp, Artificial Sequence
  Synthetic
aggccctggctgctgatatgatgaaagattgcaaaaatagaagacagacaaattttttaaagaaatactggcctccaaaaggcacgaggccaggcaattatgtgcagaaacaagtgtcccgaccttttgggacagcggtg

SEQ ID NO: 413200 - DNA, 140 bp, Artificial Sequence
  Synthetic
caccgctgtcccaaaaggtcgggacacttgtttctgcacataattgcctggcctcgtgccttttggaggccagtatttctttaaaaaatttgtctgtcttctatttttgcaatctttcatcatatcagcagccagggcct

SEQ ID NO: 413201 - DNA, 140 bp, Artificial Sequence
  Synthetic
atacgccatgctgggtctccgcctccaaaaggcacgaggccaggcaattatgtgcagaaacaagtgtccccatcagccccaccaataaaagagatgataaaaaggcaaaaaaaggatcagcgtacttgggagtcggccat

SEQ ID NO: 413202 - DNA, 140 bp, Artificial Sequence
  Synthetic
atggccgactcccaagtacgctgatcctttttttgcctttttatcatctcttttattggtggggctgatggggacacttgtttctgcacataattgcctggcctcgtgccttttggaggcggagacccagcatggcgtat

SEQ ID NO: 413203 - DNA, 140 bp, Artificial Sequence
  Synthetic
aggccctggctgctgatatgcctctttaagacagaccaatagtcacagcaagagttgggggccagctatgtgaagttttactaaatacagaggcagataatacagtactaaacaacatacgaccttttgggacagcggtg

SEQ ID NO: 413204 - DNA, 140 bp, Artificial Sequence
  Synthetic
caccgctgtcccaaaaggtcgtatgttgtttagtactgtattatctgcctctgtatttagtaaaacttcacatagctggcccccaactcttgctgtgactattggtctgtcttaaagaggcatatcagcagccagggcct

SEQ ID NO: 413205 - DNA, 140 bp, Artificial Sequence
  Synthetic
aggccctggctgctgatatgaattaaaaaaaaaataggcaccaaaaatgatagggggtataagaagttttataaaggtaaaaaaatattataatgtggctgtaaaattaaaaagaaaagagaccttttgggacagcggtg

SEQ ID NO: 413206 - DNA, 140 bp, Artificial Sequence
  Synthetic
caccgctgtcccaaaaggtctcttttctttttaattttacagccacattataatatttttttacctttataaaacttcttataccccctatcatttttggtgcctattttttttttaattcatatcagcagccagggcct

SEQ ID NO: 413207 - DNA, 140 bp, Artificial Sequence
  Synthetic
aggccctggctgctgatatgataaagaattagaacaggaaaaaaaaatttcaaaaataagacctaaaaatccttataatacacctatctttactataaaaaagaaagataaaactaaatggaccttttgggacagcggtg

SEQ ID NO: 413208 - DNA, 140 bp, Artificial Sequence
  Synthetic
caccgctgtcccaaaaggtccatttagttttatctttcttttttatagtaaagataggtgtattataaggatttttaggtcttatttttgaaatttttttttcctgttctaattctttatcatatcagcagccagggcct

SEQ ID NO: 413209 - DNA, 140 bp, Artificial Sequence
  Synthetic
atacgccatgctgggtctccccttataatacacctatctttactataaaaaagaaagataaaactaaatgaaaaaaattagtaaacttcaaaaaactaaacaaaagaacacaagatttctcgtacttgggagtcggccat

SEQ ID NO: 413210 - DNA, 140 bp, Artificial Sequence
  Synthetic
atggccgactcccaagtacgagaaatcttgtgttcttttgtttagttttttgaagtttactaatttttttcatttagttttatctttcttttttatagtaaagataggtgtattataaggggagacccagcatggcgtat

SEQ ID NO: 413211 - DNA, 140 bp, Artificial Sequence
  Synthetic
aggccctggctgctgatatgtctgttacagtcttagatgtaaaagatgcatatttctcatgccccctagacccaaagtttaaaaaatatactgctttcactattcctagtgtgaacaatggaccttttgggacagcggtg

SEQ ID NO: 413212 - DNA, 140 bp, Artificial Sequence
  Synthetic
caccgctgtcccaaaaggtccattgttcacactaggaatagtgaaagcagtatattttttaaactttgggtctagggggcatgagaaatatgcatcttttacatctaagactgtaacagacatatcagcagccagggcct

SEQ ID NO: 413213 - DNA, 140 bp, Artificial Sequence
  Synthetic
aggccctggctgctgatatgcagacagggcttcgaaagagctttgctataaaatggggggcaagtggtcaaaaagtagactagggggatggcctgctgtctgggaaagaatgcagcgaacgaccttttgggacagcggtg

SEQ ID NO: 413214 - DNA, 140 bp, Artificial Sequence
  Synthetic
caccgctgtcccaaaaggtcgttcgctgcattctttcccagacagcaggccatccccctagtctactttttgaccacttgccccccattttatagcaaagctctttcgaagccctgtctgcatatcagcagccagggcct

SEQ ID NO: 413215 - DNA, 140 bp, Artificial Sequence
  Synthetic
atacgccatgctgggtctcctaagaaaaacaacccagaattagaaatttatcaatacatagatgacttatatgtaagatcagatttaccactggcagaacataagaaaaaagttaaactacgtacttgggagtcggccat

SEQ ID NO: 413216 - DNA, 140 bp, Artificial Sequence
  Synthetic
atggccgactcccaagtacgtagtttaacttttttcttatgttctgccagtggtaaatctgatcttacatataagtcatctatgtattgataaatttctaattctgggttgtttttcttaggagacccagcatggcgtat

SEQ ID NO: 413217 - DNA, 140 bp, Artificial Sequence
  Synthetic
aggccctggctgctgatatgtcaaaaaaaaccaccctttcagtaaataaagtatgaactccacccagacaagtagacagtacagcccatccaattgcctgacaaagaagtgtagacagtagaccttttgggacagcggtg

SEQ ID NO: 413218 - DNA, 140 bp, Artificial Sequence
  Synthetic
caccgctgtcccaaaaggtctactgtctacacttctttgtcaggcaattggatgggctgtactgtctacttgtctgggtggagttcatactttatttactgaaagggtggttttttttgacatatcagcagccagggcct

SEQ ID NO: 413219 - DNA, 140 bp, Artificial Sequence
  Synthetic
aggccctggctgctgatatgtcataaaattaaagtaaaaaaattgtgtaagttaattagaagaactaagtcattgacagaagtagtaccattaagcaaagaggcagaactagaattaaaagaccttttgggacagcggtg

SEQ ID NO: 413220 - DNA, 140 bp, Artificial Sequence
  Synthetic
caccgctgtcccaaaaggtcttttaattctagttctgcctctttgcttaatggtactacttctgtcaatgacttagttcttctaattaacttacacaatttttttactttaattttatgacatatcagcagccagggcct

SEQ ID NO: 413221 - DNA, 140 bp, Artificial Sequence
  Synthetic
atacgccatgctgggtctcccattgacagaagtagtaccattaagcaaagaggcagaactagaattaaaaaagaacaaaaaaaagctgaaaaagccagtacataaggtatactatcaacccgtacttgggagtcggccat

SEQ ID NO: 413222 - DNA, 140 bp, Artificial Sequence
  Synthetic
atggccgactcccaagtacgggttgatagtataccttatgtactggctttttcagcttttttttgttcttttttaattctagttctgcctctttgcttaatggtactacttctgtcaatgggagacccagcatggcgtat

SEQ ID NO: 413223 - DNA, 140 bp, Artificial Sequence
  Synthetic
atacgccatgctgggtctccgctaggcaaaaagcctcccacacaaatgatataagacaattagcaaatgtaatccagaaagtgtctcaagaagctataatcatatgaagaaaattgcccacgtacttgggagtcggccat

SEQ ID NO: 413224 - DNA, 140 bp, Artificial Sequence
  Synthetic
atggccgactcccaagtacgtgggcaattttcttcatatgattatagcttcttgagacactttctggattacatttgctaattgtcttatatcatttgtgtgggaggctttttgcctagcggagacccagcatggcgtat

SEQ ID NO: 413225 - DNA, 140 bp, Artificial Sequence
  Synthetic
aggccctggctgctgatatgagaacagggaaattctaaaaaaccctgtgcatggagtctattatgacccatcaaaagaattaatagcagaagtacagaagcaagggcaagaccaatggacgaccttttgggacagcggtg

SEQ ID NO: 413226 - DNA, 140 bp, Artificial Sequence
  Synthetic
caccgctgtcccaaaaggtcgtccattggtcttgcccttgcttctgtacttctgctattaattcttttgatgggtcataatagactccatgcacagggttttttagaatttccctgttctcatatcagcagccagggcct

SEQ ID NO: 413227 - DNA, 140 bp, Artificial Sequence
  Synthetic
aggccctggctgctgatatgtattggcaagccacctagattcctaaataaaaatttgtcagcacacctccattgatcaaattatgatacaagttaaaaaataagcctatcataaaggcaagaccttttgggacagcggtg

SEQ ID NO: 413228 - DNA, 140 bp, Artificial Sequence
  Synthetic
caccgctgtcccaaaaggtcttgcctttatgataggcttattttttaacttgtatcataatttgatcaatggaggtgtgctgacaaatttttatttaggaatctaggtggcttgccaatacatatcagcagccagggcct

SEQ ID NO: 413229 - DNA, 140 bp, Artificial Sequence
  Synthetic
atacgccatgctgggtctccgactttaaactgtactaatgccaccaataacagtcaggaaaagccaggggcaatgcaaaactgttctttcaatatgaccacagaagtaagagataagaagcgtacttgggagtcggccat

SEQ ID NO: 413230 - DNA, 140 bp, Artificial Sequence
  Synthetic
atggccgactcccaagtacgcttcttatctcttacttctgtggtcatattgaaagaacagttttgcattgcccctggcttttcctgactgttattggtggcattagtacagtttaaagtcggagacccagcatggcgtat

SEQ ID NO: 413231 - DNA, 140 bp, Artificial Sequence
  Synthetic
aggccctggctgctgatatgattctaaaaaaaaagtaaacatagtaacagattcacaatatgtactaagcatcatatcttcccaacctacacagagtgactcccctatagttcagcaaatgaccttttgggacagcggtg

SEQ ID NO: 413232 - DNA, 140 bp, Artificial Sequence
  Synthetic
caccgctgtcccaaaaggtcatttgctgaactataggggagtcactctgtgtaggttgggaagatatgatgcttagtacatattgtgaatctgttactatgtttactttttttttagaatcatatcagcagccagggcct

SEQ ID NO: 413233 - DNA, 140 bp, Artificial Sequence
  Synthetic
aggccctggctgctgatatgaataaaaaaactgacaaaaaaaaaacaagtgtatcttacataagttcctgctcataaaagtataagagaaaataaaaaaatagataaattaataagtaaagaccttttgggacagcggtg

SEQ ID NO: 413234 - DNA, 140 bp, Artificial Sequence
  Synthetic
caccgctgtcccaaaaggtctttacttattaatttatctatttttttattttctcttatacttttatgagcaggaacttatgtaagatacacttgttttttttttgtcagtttttttattcatatcagcagccagggcct

SEQ ID NO: 413235 - DNA, 140 bp, Artificial Sequence
  Synthetic
atacgccatgctgggtctcctaccaccagtagtagccaaaaaaatcattgcaagttgtcctaagtgtcatataaaaaaaaaagcaatgcatagccaagtagactacagtccaaaaatatgcgtacttgggagtcggccat

SEQ ID NO: 413236 - DNA, 140 bp, Artificial Sequence
  Synthetic
atggccgactcccaagtacgcatatttttggactgtagtctacttggctatgcattgcttttttttttatatgacacttaggacaacttgcaatgatttttttggctactactggtggtaggagacccagcatggcgtat

SEQ ID NO: 413237 - DNA, 140 bp, Artificial Sequence
  Synthetic
aggccctggctgctgatatgatgtgacaagtaaattcataaaagcagaagtcataccagcaaagacaagacaaaaaactgcctacttcctgttaaaattagcagcaaaatggcctattaagaccttttgggacagcggtg

SEQ ID NO: 413238 - DNA, 140 bp, Artificial Sequence
  Synthetic
caccgctgtcccaaaaggtcttaataggccattttgctgctaattttaacaggaagtaggcagttttttgtcttgtctttgctggtatgacttctgcttttatgaatttacttgtcacatcatatcagcagccagggcct

SEQ ID NO: 413239 - DNA, 140 bp, Artificial Sequence
  Synthetic
aggccctggctgctgatatgaatactacatacagacaataggcctaactttacaagtgcagccataaaagctgcatgttagtagacaaacatacaacataagtttaaaataccatataatgaccttttgggacagcggtg

SEQ ID NO: 413240 - DNA, 140 bp, Artificial Sequence
  Synthetic
caccgctgtcccaaaaggtcattatatggtattttaaacttatgttgtatgtttgtctactaacatgcagcttttatggctgcacttgtaaagttaggcctattgtctgtatgtagtattcatatcagcagccagggcct

SEQ ID NO: 413241 - DNA, 140 bp, Artificial Sequence
  Synthetic
atacgccatgctgggtctccctgatagtgtggcaagtggacagacagaaggtgaaagcgtggaacagcctagtgaaataccataaatacaggtctaaaaaggccaaagattagtattatacgtacttgggagtcggccat

SEQ ID NO: 413242 - DNA, 140 bp, Artificial Sequence
  Synthetic
atggccgactcccaagtacgtataatactaatctttggcctttttagacctgtatttatggtatttcactaggctgttccacgctttcaccttctgtctgtccacttgccacactatcagggagacccagcatggcgtat

SEQ ID NO: 413243 - DNA, 140 bp, Artificial Sequence
  Synthetic
aggccctggctgctgatatgagtgaaataccataaatacaggtctaaaaaggccaaagattagtattataaacatcattatgaaattataaatccaaaggtcagttcaaaggtatatattgaccttttgggacagcggtg

SEQ ID NO: 413244 - DNA, 140 bp, Artificial Sequence
  Synthetic
caccgctgtcccaaaaggtcaatatatacctttgaactgacctttggatttataatttcataatgatgtttataatactaatctttggcctttttagacctgtatttatggtatttcactcatatcagcagccagggcct

SEQ ID NO: 413245 - DNA, 140 bp, Artificial Sequence
  Synthetic
aggccctggctgctgatatgattcggttaaggccaggagggaagaaaaaatataaactaaaacatatagtatgggcaagcagggagctagaacgatttgcagttaatcctggcctgttaggaccttttgggacagcggtg

SEQ ID NO: 413246 - DNA, 140 bp, Artificial Sequence
  Synthetic
caccgctgtcccaaaaggtcctaacaggccaggattaactgcaaatcgttctagctccctgcttgcccatactatatgttttagtttatattttttcttccctcctggccttaaccgaatcatatcagcagccagggcct

SEQ ID NO: 413247 - DNA, 140 bp, Artificial Sequence
  Synthetic
aggccctggctgctgatatgtctaaggcagagagtgctaccccagtaagaataccctgaaggacatagtcaggtaaggacactacagctcctagccttaagagtagtagtaaaagcaaaggaccttttgggacagcggtg

SEQ ID NO: 413248 - DNA, 140 bp, Artificial Sequence
  Synthetic
caccgctgtcccaaaaggtcctttgcttttactactactcttaaggctaggagctgtagtgtccttacctgactatgtccttcagggtattcttactggggtagcactctctgccttagacatatcagcagccagggcct

SEQ ID NO: 413249 - DNA, 140 bp, Artificial Sequence
  Synthetic
aggccctggctgctgatatggaacaggcacctgaggatcaaagaccagccaaggagccagttaatgcataggcactagagctcctagaagagctaaaggcagaagcagtaagacattttcgaccttttgggacagcggtg

SEQ ID NO: 413250 - DNA, 140 bp, Artificial Sequence
  Synthetic
caccgctgtcccaaaaggtcgaaaatgtcttactgcttctgcctttagctcttctaggagctctagtgcctatgcattaactggctccttggctggtctttgatcctcaggtgcctgttccatatcagcagccagggcct

SEQ ID NO: 413251 - DNA, 140 bp, Artificial Sequence
  Synthetic
atacgccatgctgggtctccatttgtattactttgattgtttttcagaatctgccataaggaaagccttattaggacagatagttaggcctaagtgtgaatatccagcaggacattgtaacgtacttgggagtcggccat

SEQ ID NO: 413252 - DNA, 140 bp, Artificial Sequence
  Synthetic
atggccgactcccaagtacgttacaatgtcctgctggatattcacacttaggcctaactatctgtcctaataaggctttccttatggcagattctgaaaaacaatcaaagtaatacaaatggagacccagcatggcgtat

SEQ ID NO: 413253 - DNA, 140 bp, Artificial Sequence
  Synthetic
aggccctggctgctgatatggaagcagaagttatcccagcagaaacaggacaagaaacagcctacttcatactaaagttagcaggaagatggccagtaaaagtaatacatacagacaatggaccttttgggacagcggtg

SEQ ID NO: 413254 - DNA, 140 bp, Artificial Sequence
  Synthetic
caccgctgtcccaaaaggtccattgtctgtatgtattacttttactggccatcttcctgctaactttagtatgaagtaggctgtttcttgtcctgtttctgctgggataacttctgcttccatatcagcagccagggcct

SEQ ID NO: 413255 - DNA, 140 bp, Artificial Sequence
  Synthetic
aggccctggctgctgatatggacacttaggaaagagtaatagcaattacaagaatcttacaacaaataatatttacccattatagaattagaagccaacatagtaaaataggaattattcgaccttttgggacagcggtg

SEQ ID NO: 413256 - DNA, 140 bp, Artificial Sequence
  Synthetic
caccgctgtcccaaaaggtcgaataattcctattttactatgttggcttctaattctataatgggtaaatattatttgttgtaagattcttgtaattgctattactctttcctaagtgtccatatcagcagccagggcct

SEQ ID NO: 413257 - DNA, 140 bp, Artificial Sequence
  Synthetic
aggccctggctgctgatatgagacaaagccacctttgcctagtgttaagaaattaacagaagatagatggaacaagccccagaagaccaggggccacagagagaaccaaacaatgaatgggaccttttgggacagcggtg

SEQ ID NO: 413258 - DNA, 140 bp, Artificial Sequence
  Synthetic
caccgctgtcccaaaaggtcccattcattgtttggttctctctgtggcccctggtcttctggggcttgttccatctatcttctgttaatttcttaacactaggcaaaggtggctttgtctcatatcagcagccagggcct

SEQ ID NO: 413259 - DNA, 140 bp, Artificial Sequence
  Synthetic
aggccctggctgctgatatgcatctaacgcaagaagaaaaagaagaaaagatagatcccatagatcctgaaatgcccccttggcatcaccctggaagccaaccccagaccccttgtaacggaccttttgggacagcggtg

SEQ ID NO: 413260 - DNA, 140 bp, Artificial Sequence
  Synthetic
caccgctgtcccaaaaggtccgttacaaggggtctggggttggcttccagggtgatgccaagggggcatttcaggatctatgggatctatcttttcttctttttcttcttgcgttagatgcatatcagcagccagggcct

SEQ ID NO: 413261 - DNA, 140 bp, Artificial Sequence
  Synthetic
aggccctggctgctgatatgggatataatcagtttgtgggatcaaagcttaaagccatgtgtaaaattaaccccactctgtgttactttacattgcactgattatgaggggaataataaggaccttttgggacagcggtg

SEQ ID NO: 413262 - DNA, 140 bp, Artificial Sequence
  Synthetic
caccgctgtcccaaaaggtccttattattcccctcataatcagtgcaatgtaaagtaacacagagtggggttaattttacacatggctttaagctttgatcccacaaactgattatatcccatatcagcagccagggcct

SEQ ID NO: 413263 - DNA, 140 bp, Artificial Sequence
  Synthetic
atacgccatgctgggtctcccttgctattgcaaacaatgctgctatcattgctatctttgtttcacaaagaagggtttggggatctcccatggcaggaagaagcgaagaagaccagcagccgtacttgggagtcggccat

SEQ ID NO: 413264 - DNA, 140 bp, Artificial Sequence
  Synthetic
atggccgactcccaagtacggctgctggtcttcttcgcttcttcctgccatgggagatccccaaacccttctttgtgaaacaaagatagcaatgatagcagcattgtttgcaatagcaagggagacccagcatggcgtat

SEQ ID NO: 413265 - DNA, 140 bp, Artificial Sequence
  Synthetic
atacgccatgctgggtctcctgcaactggtagtaataatgcaactggtaataatagtgtttctgataattctgaagaaataaaaaactgctctttcaatgcaaccacagaaataaaagatcgtacttgggagtcggccat

SEQ ID NO: 413266 - DNA, 140 bp, Artificial Sequence
  Synthetic
atggccgactcccaagtacgatcttttatttctgtggttgcattgaaagagcagttttttatttcttcagaattatcagaaacactattattaccagttgcattattactaccagttgcaggagacccagcatggcgtat

SEQ ID NO: 413267 - DNA, 140 bp, Artificial Sequence
  Synthetic
aggccctggctgctgatatgacaaaagaaacaagataaaacagcaaaaaaaatacttaaaagaataagaagaataagaaaagttgaagatgacagcgattatgaaagcaatagaaaagaggaccttttgggacagcggtg

SEQ ID NO: 413268 - DNA, 140 bp, Artificial Sequence
  Synthetic
caccgctgtcccaaaaggtcctcttttctattgctttcataatcgctgtcatcttcaacttttcttattcttcttattcttttaagtattttttttgctgttttatcttgtttcttttgtcatatcagcagccagggcct

SEQ ID NO: 413269 - DNA, 140 bp, Artificial Sequence
  Synthetic
aggccctggctgctgatatgcaattcccatacattattgtgccccggctggttttgcgattctaaagtgtaataataagacattcaatggaacaggaccatgtacaaatgtcagcacagtgaccttttgggacagcggtg

SEQ ID NO: 413270 - DNA, 140 bp, Artificial Sequence
  Synthetic
caccgctgtcccaaaaggtcactgtgctgacatttgtacatggtcctgttccattgaatgtcttattattacactttagaatcgcaaaaccagccggggcacaataatgtatgggaattgcatatcagcagccagggcct

SEQ ID NO: 413271 - DNA, 140 bp, Artificial Sequence
  Synthetic
aggccctggctgctgatatggtttgagctgtaaccaactatatgccacagtctattctaaggtacctgtataagaagatgcaaaaccaacattgttctgtgcttcagatgctaacttgacgaccttttgggacagcggtg

SEQ ID NO: 413272 - DNA, 140 bp, Artificial Sequence
  Synthetic
caccgctgtcccaaaaggtcgtcaagttagcatctgaagcacagaacaatgttggttttgcatcttcttatacaggtaccttagaatagactgtggcatatagttggttacagctcaaaccatatcagcagccagggcct

SEQ ID NO: 413273 - DNA, 140 bp, Artificial Sequence
  Synthetic
aggccctggctgctgatatgaagcactgaacagcataatatttaggcaacacaagcctgtgttcccacagaccccagtccaaatgaatataagctaaaaaatgtgacagataaattcaatgaccttttgggacagcggtg

SEQ ID NO: 413274 - DNA, 140 bp, Artificial Sequence
  Synthetic
caccgctgtcccaaaaggtcattgaatttatctgtcacattttttagcttatattcatttggactggggtctgtgggaacacaggcttgtgttgcctaaatattatgctgttcagtgcttcatatcagcagccagggcct

SEQ ID NO: 413275 - DNA, 140 bp, Artificial Sequence
  Synthetic
aggccctggctgctgatatggtaagaccagagtttaaaaccttgtgttcaaatgactttcttgtgtgtacaaatgaattgtacaaatatcaaaaatagtattactaccacaaacagtcccgaccttttgggacagcggtg

SEQ ID NO: 413276 - DNA, 140 bp, Artificial Sequence
  Synthetic
caccgctgtcccaaaaggtcgggactgtttgtggtagtaatactatttttgatatttgtacaattcatttgtacacacaagaaagtcatttgaacacaaggttttaaactctggtcttaccatatcagcagccagggcct

SEQ ID NO: 413277 - DNA, 140 bp, Artificial Sequence
  Synthetic
atacgccatgctgggtctccaaatgaattgtacaaatatcaaaaatagtattactaccacaaacagtcccttaaactcaaacaatacaaaagaagtaaaacagtgtgactttaatgtaaccgtacttgggagtcggccat

SEQ ID NO: 413278 - DNA, 140 bp, Artificial Sequence
  Synthetic
atggccgactcccaagtacggttacattaaagtcacactgttttacttcttttgtattgtttgagtttaagggactgtttgtggtagtaatactatttttgatatttgtacaattcatttggagacccagcatggcgtat

SEQ ID NO: 413279 - DNA, 140 bp, Artificial Sequence
  Synthetic
aggccctggctgctgatatgcagatttagttaagattaacgccacatcaaatgaaacaatgtatagattaattaattgtaactccacaaccatcaagcaggcctgtccaaaagtatctttgaccttttgggacagcggtg

SEQ ID NO: 413280 - DNA, 140 bp, Artificial Sequence
  Synthetic
caccgctgtcccaaaaggtcaaagatacttttggacaggcctgcttgatggttgtggagttacaattaattaatctatacattgtttcatttgatgtggcgttaatcttaactaaatctgcatatcagcagccagggcct

SEQ ID NO: 413281 - DNA, 140 bp, Artificial Sequence
  Synthetic
atacgccatgctgggtctcctacaatgtactaacataaccatcaatatgacaggaaacagcaatagtaatacaaccaacaatagtactgtggatagtgtagaagatatgaaaaattgctccgtacttgggagtcggccat

SEQ ID NO: 413282 - DNA, 140 bp, Artificial Sequence
  Synthetic
atggccgactcccaagtacggagcaatttttcatatcttctacactatccacagtactattgttggttgtattactattgctgtttcctgtcatattgatggttatgttagtacattgtaggagacccagcatggcgtat

SEQ ID NO: 413283 - DNA, 140 bp, Artificial Sequence
  Synthetic
aggccctggctgctgatatgagtgtaatgaaacaagatttaatagaacaagtctctgtaaaaacgttacagtagttacttgtacacatagcatcaaaccaacagtaagtacccaactaatgaccttttgggacagcggtg

SEQ ID NO: 413284 - DNA, 140 bp, Artificial Sequence
  Synthetic
caccgctgtcccaaaaggtcattagttgggtacttactgttggtttgatgctatgtgtacaagtaactactgtaacgtttttacagagacttgttctattaaatcttgtttcattacactcatatcagcagccagggcct

SEQ ID NO: 413285 - DNA, 140 bp, Artificial Sequence
  Synthetic
aggccctggctgctgatatgactaaataagacactctctaaaagaaatataacaatcataagaaagaatatttcagacagtaaggagaacatcctaataaccctaaatactaatataacagaccttttgggacagcggtg

SEQ ID NO: 413286 - DNA, 140 bp, Artificial Sequence
  Synthetic
caccgctgtcccaaaaggtctgttatattagtatttagggttattaggatgttctccttactgtctgaaatattctttcttatgattgttatatttcttttagagagtgtcttatttagtcatatcagcagccagggcct

SEQ ID NO: 413287 - DNA, 140 bp, Artificial Sequence
  Synthetic
aggccctggctgctgatatgtccaatagcttagtacagcatggcccttagtaatacaaaggaggatacaaaggcagcttattgtaattatagtgccactgactagaacaaagccttaaaagaccttttgggacagcggtg

SEQ ID NO: 413288 - DNA, 140 bp, Artificial Sequence
  Synthetic
caccgctgtcccaaaaggtcttttaaggctttgttctagtcagtggcactataattacaataagctgcctttgtatcctcctttgtattactaagggccatgctgtactaagctattggacatatcagcagccagggcct

SEQ ID NO: 413289 - DNA, 140 bp, Artificial Sequence
  Synthetic
atacgccatgctgggtctccaggcagcttattgtaattatagtgccactgactagaacaaagccttaaaaaacataactaaaaaatatttaaaacttgtaaaatataatcaaactgatgtcgtacttgggagtcggccat

SEQ ID NO: 413290 - DNA, 140 bp, Artificial Sequence
  Synthetic
atggccgactcccaagtacgacatcagtttgattatattttacaagttttaaatattttttagttatgttttttaaggctttgttctagtcagtggcactataattacaataagctgcctggagacccagcatggcgtat

SEQ ID NO: 413291 - DNA, 140 bp, Artificial Sequence
  Synthetic
atacgccatgctgggtctccttcaatgtaaccacagaaataaaagataggaaaagaaaagagtatgcacttttttatagacttgatatagtaccactaccacctgagggggaaagtagcacgtacttgggagtcggccat

SEQ ID NO: 413292 - DNA, 140 bp, Artificial Sequence
  Synthetic
atggccgactcccaagtacgtgctactttccccctcaggtggtagtggtactatatcaagtctataaaaaagtgcatactcttttcttttcctatcttttatttctgtggttacattgaaggagacccagcatggcgtat

SEQ ID NO: 413293 - DNA, 140 bp, Artificial Sequence
  Synthetic
aggccctggctgctgatatgtcttttttaactgtcataaagaattcttttattataacacaaatcagctgtttaatcataccttttcctgcaagaaaaatatgaccaataacaagatcaagaccttttgggacagcggtg

SEQ ID NO: 413294 - DNA, 140 bp, Artificial Sequence
  Synthetic
caccgctgtcccaaaaggtcttgatcttgttattggtcatatttttcttgcaggaaaaggtatgattaaacagctgatttgtgttataataaaagaattctttatgacagttaaaaaagacatatcagcagccagggcct

SEQ ID NO: 413295 - DNA, 140 bp, Artificial Sequence
  Synthetic
atacgccatgctgggtctcctttaatcataccttttcctgcaagaaaaatatgaccaataacaagatcaattgtactaatattagcaataataacaatggcactcaggcaataccttgcacgtacttgggagtcggccat

SEQ ID NO: 413296 - DNA, 140 bp, Artificial Sequence
  Synthetic
atggccgactcccaagtacgtgcaaggtattgcctgagtgccattgttattattgctaatattagtacaattgatcttgttattggtcatatttttcttgcaggaaaaggtatgattaaaggagacccagcatggcgtat

SEQ ID NO: 413297 - DNA, 140 bp, Artificial Sequence
  Synthetic
atacgccatgctgggtctccaataagactttacaagaagtagctaaaaaattaagaaattactttaataaaacaataaactttactcagtcctcagggggagatttagaacttacaacaccgtacttgggagtcggccat

SEQ ID NO: 413298 - DNA, 140 bp, Artificial Sequence
  Synthetic
atggccgactcccaagtacggtgttgtaagttctaaatctccccctgaggactgagtaaagtttattgttttattaaagtaatttcttaattttttagctacttcttgtaaagtcttattggagacccagcatggcgtat

SEQ ID NO: 413299 - DNA, 140 bp, Artificial Sequence
  Synthetic
aggccctggctgctgatatggcacctcccatcccaaaaaacctagtatgcaagtcaaacataactagaatgattctacaattagacacgccataaaataaaacacatcctaacagcaccagaccttttgggacagcggtg

SEQ ID NO: 413300 - DNA, 140 bp, Artificial Sequence
  Synthetic
caccgctgtcccaaaaggtctggtgctgttaggatgtgttttattttatggcgtgtctaattgtagaatcattctagttatgtttgacttgcatactaggttttttgggatgggaggtgccatatcagcagccagggcct

SEQ ID NO: 413301 - DNA, 140 bp, Artificial Sequence
  Synthetic
atacgccatgctgggtctccgattctacaattagacacgccataaaataaaacacatcctaacagcaccacccttagaccaggagggggaaatataaaagatatacaaaaaactcaattgcgtacttgggagtcggccat

SEQ ID NO: 413302 - DNA, 140 bp, Artificial Sequence
  Synthetic
atggccgactcccaagtacgcaattgagttttttgtatatcttttatatttccccctcctggtctaagggtggtgctgttaggatgtgttttattttatggcgtgtctaattgtagaatcggagacccagcatggcgtat

SEQ ID NO: 413303 - DNA, 140 bp, Artificial Sequence
  Synthetic
atacgccatgctgggtctccagagtcaaatgacaatataactctccagtgcagaataaaacaaattataaggctgtggcagagagtaggacaagcaatgtatgcccctcccatccaaggacgtacttgggagtcggccat

SEQ ID NO: 413304 - DNA, 140 bp, Artificial Sequence
  Synthetic
atggccgactcccaagtacgtccttggatgggaggggcatacattgcttgtcctactctctgccacagccttataatttgttttattctgcactggagagttatattgtcatttgactctggagacccagcatggcgtat

SEQ ID NO: 413305 - DNA, 140 bp, Artificial Sequence
  Synthetic
aggccctggctgctgatatgaattgcaaggccaactataaaaactggcactcataaaaagaaaaaagcagcaggtttagcaatgctattcttgaagattctaagtgcagcaagaagcactgaccttttgggacagcggtg

SEQ ID NO: 413306 - DNA, 140 bp, Artificial Sequence
  Synthetic
caccgctgtcccaaaaggtcagtgcttcttgctgcacttagaatcttcaagaatagcattgctaaacctgctgcttttttctttttatgagtgccagtttttatagttggccttgcaattcatatcagcagccagggcct

SEQ ID NO: 413307 - DNA, 140 bp, Artificial Sequence
  Synthetic
atacgccatgctgggtctccatcactgatgctgccaccccctcaccctctcttgacaccctgaaggaagagtcaggagcaatacaaaactgttcttttaacatgaccacagatgtaggtgcgtacttgggagtcggccat

SEQ ID NO: 413308 - DNA, 140 bp, Artificial Sequence
  Synthetic
atggccgactcccaagtacgcacctacatctgtggtcatgttaaaagaacagttttgtattgctcctgactcttccttcagggtgtcaagagagggtgagggggtggcagcatcagtgatggagacccagcatggcgtat

SEQ ID NO: 413309 - DNA, 140 bp, Artificial Sequence
  Synthetic
atacgccatgctgggtctcctaataaaacaagaataaaatttgacaaacattcaggaggggatccagaaattacagcacatagctttaattgtggaggagaatttttctattgtgatacacgtacttgggagtcggccat

SEQ ID NO: 413310 - DNA, 140 bp, Artificial Sequence
  Synthetic
atggccgactcccaagtacgtgtatcacaatagaaaaattctcctccacaattaaagctatgtgctgtaatttctggatcccctcctgaatgtttgtcaaattttattcttgttttattaggagacccagcatggcgtat

SEQ ID NO: 413311 - DNA, 140 bp, Artificial Sequence
  Synthetic
atacgccatgctgggtctccctgctagccttaaaaacctttatacaaaatcagcaactccataacctgtaaagctgcaaaaatagactaatctgctacacatcagtaaagtaaaataaaacgtacttgggagtcggccat

SEQ ID NO: 413312 - DNA, 140 bp, Artificial Sequence
  Synthetic
atggccgactcccaagtacgttttattttactttactgatgtgtagcagattagtctatttttgcagctttacaggttatggagttgctgattttgtataaaggtttttaaggctagcagggagacccagcatggcgtat

SEQ ID NO: 413313 - DNA, 140 bp, Artificial Sequence
  Synthetic
aggccctggctgctgatatgtaagatcaacagataaacaacgtaagctccttcatatataaaaaaatacaagaagcacaaaaacaacaaaagaaaaataaaaaaaaattactaaagttaggaccttttgggacagcggtg

SEQ ID NO: 413314 - DNA, 140 bp, Artificial Sequence
  Synthetic
caccgctgtcccaaaaggtcctaactttagtaatttttttttatttttcttttgttgtttttgtgcttcttgtatttttttatatatgaaggagcttacgttgtttatctgttgatcttacatatcagcagccagggcct

SEQ ID NO: 413315 - DNA, 140 bp, Artificial Sequence
  Synthetic
atacgccatgctgggtctccagaagcacaaaaacaacaaaagaaaaataaaaaaaaattactaaagttagataaataggcctctatttaaaattagcttgacataactaaatagttgtagcgtacttgggagtcggccat

SEQ ID NO: 413316 - DNA, 140 bp, Artificial Sequence
  Synthetic
atggccgactcccaagtacgctacaactatttagttatgtcaagctaattttaaatagaggcctatttatctaactttagtaatttttttttatttttcttttgttgtttttgtgcttctggagacccagcatggcgtat

SEQ ID NO: 413317 - DNA, 140 bp, Artificial Sequence
  Synthetic
aggccctggctgctgatatgagttatattagtacttaatctagtaaagaacattaagcagagatatcaacccctctcgttacagatccccatccaacaacaagcagaagtaagaacgccagaccttttgggacagcggtg

SEQ ID NO: 413318 - DNA, 140 bp, Artificial Sequence
  Synthetic
caccgctgtcccaaaaggtctggcgttcttacttctgcttgttgttggatggggatctgtaacgagaggggttgatatctctgcttaatgttctttactagattaagtactaatataactcatatcagcagccagggcct

SEQ ID NO: 413319 - DNA, 140 bp, Artificial Sequence
  Synthetic
aggccctggctgctgatatgattgccgcaaaagttcttgcatctgttgtacacagacctcaagacaataatcttgtagatttaccacctcttgagcaacttagcctcaaagatccagaaggaccttttgggacagcggtg

SEQ ID NO: 413320 - DNA, 140 bp, Artificial Sequence
  Synthetic
caccgctgtcccaaaaggtccttctggatctttgaggctaagttgctcaagaggtggtaaatctacaagattattgtcttgaggtctgtgtacaacagatgcaagaacttttgcggcaatcatatcagcagccagggcct

SEQ ID NO: 413321 - DNA, 140 bp, Artificial Sequence
  Synthetic
atacgccatgctgggtctccaaatatcactctcccatgtagaataaaacaagttataaacatgtggcaggaagtaggacgagcaatgtatgccgctcctattgaaggaaaaatttattgtcgtacttgggagtcggccat

SEQ ID NO: 413322 - DNA, 140 bp, Artificial Sequence
  Synthetic
atggccgactcccaagtacgacaataaatttttccttcaataggagcggcatacattgctcgtcctacttcctgccacatgtttataacttgttttattctacatgggagagtgatatttggagacccagcatggcgtat

SEQ ID NO: 413323 - DNA, 140 bp, Artificial Sequence
  Synthetic
aggccctggctgctgatatgtgaagcttgcagactctttaaagctataatacaatactagctacaaaaattgcaaactagtgctacaaatctactagatactgttgcagtagcagttactgaccttttgggacagcggtg

SEQ ID NO: 413324 - DNA, 140 bp, Artificial Sequence
  Synthetic
caccgctgtcccaaaaggtcagtaactgctactgcaacagtatctagtagatttgtagcactagtttgcaatttttgtagctagtattgtattatagctttaaagagtctgcaagcttcacatatcagcagccagggcct

SEQ ID NO: 413325 - DNA, 140 bp, Artificial Sequence
  Synthetic
atacgccatgctgggtctcctgcaaactagtgctacaaatctactagatactgttgcagtagcagttactaattaaactgacagcatcatcctaggcatacaaagcataaaaaaaaaaatcgtacttgggagtcggccat

SEQ ID NO: 413326 - DNA, 140 bp, Artificial Sequence
  Synthetic
atggccgactcccaagtacgatttttttttttatgctttgtatgcctaggatgatgctgtcagtttaattagtaactgctactgcaacagtatctagtagatttgtagcactagtttgcaggagacccagcatggcgtat

SEQ ID NO: 413327 - DNA, 140 bp, Artificial Sequence
  Synthetic
aggccctggctgctgatatgattggagaagtgaattatataaatataaggtagtaagaattgaaccactaggagtagcacccaccaaggcaaaaagacaagtggtgcagagagaaaaaaggaccttttgggacagcggtg

SEQ ID NO: 413328 - DNA, 140 bp, Artificial Sequence
  Synthetic
caccgctgtcccaaaaggtccttttttctctctgcaccacttgtctttttgccttggtgggtgctactcctagtggttcaattcttactaccttatatttatataattcacttctccaatcatatcagcagccagggcct

SEQ ID NO: 413329 - DNA, 140 bp, Artificial Sequence
  Synthetic
aggccctggctgctgatatgaacatgaagattgcattaaaaaaaagtaaatagacaaaatagccagaagtaaaaaaaaaaataagacaaacttcccctgacccccagtcctctgacacccgaccttttgggacagcggtg

SEQ ID NO: 413330 - DNA, 140 bp, Artificial Sequence
  Synthetic
caccgctgtcccaaaaggtcgggtgtcagaggactgggggtcaggggaagtttgtcttatttttttttttacttctggctattttgtctatttacttttttttaatgcaatcttcatgttcatatcagcagccagggcct

SEQ ID NO: 413331 - DNA, 140 bp, Artificial Sequence
  Synthetic
atacgccatgctgggtctccaaaaaaaaaaataagacaaacttcccctgacccccagtcctctgacacccaacctgcacctaaagtaagagcagtatccaaagcattagcagacagaaaacgtacttgggagtcggccat

SEQ ID NO: 413332 - DNA, 140 bp, Artificial Sequence
  Synthetic
atggccgactcccaagtacgttttctgtctgctaatgctttggatactgctcttactttaggtgcaggttgggtgtcagaggactgggggtcaggggaagtttgtcttatttttttttttggagacccagcatggcgtat

SEQ ID NO: 413333 - DNA, 140 bp, Artificial Sequence
  Synthetic
atacgccatgctgggtctcccagcaatagcagtagctaactggacagattggggtatagaagtagtacaaagaattggtagagctatttgcaacatacctagaagaataagacagggattcgtacttgggagtcggccat

SEQ ID NO: 413334 - DNA, 140 bp, Artificial Sequence
  Synthetic
atggccgactcccaagtacgaatccctgtcttattcttctaggtatgttgcaaatagctctaccaattctttgtactacttctataccccaatctgtccagttagctactgctattgctgggagacccagcatggcgtat

SEQ ID NO: 413335 - DNA, 140 bp, Artificial Sequence
  Synthetic
aggccctggctgctgatatgagaaaaccaccaagataaagaaataaagttcccagtaagaccccaagtgcctctaaggccgataacctataaaagagcatttgacctcagcttctttttagaccttttgggacagcggtg

SEQ ID NO: 413336 - DNA, 140 bp, Artificial Sequence
  Synthetic
caccgctgtcccaaaaggtctaaaaagaagctgaggtcaaatgctcttttataggttatcggccttagaggcacttggggtcttactgggaactttatttctttatcttggtggttttctcatatcagcagccagggcct

SEQ ID NO: 413337 - DNA, 140 bp, Artificial Sequence
  Synthetic
atacgccatgctgggtctccgctaaatggcctgaggtaagggaaagaatgagacaaacccctccagcagcagcagaaggagcaggagcagtatctcaagatttagctagacatggagcaacgtacttgggagtcggccat

SEQ ID NO: 413338 - DNA, 140 bp, Artificial Sequence
  Synthetic
atggccgactcccaagtacgttgctccatgtctagctaaatcttgagatactgctcctgctccttctgctgctgctggaggggtttgtctcattctttcccttacctcaggccatttagcggagacccagcatggcgtat

SEQ ID NO: 413339 - DNA, 140 bp, Artificial Sequence
  Synthetic
atacgccatgctgggtctccgaggaatcagaggaagtaggctttccagtcagaccacaggtaccattgagaccaataacctataaggctgcttttgatctcagcttctttttaaaagaaacgtacttgggagtcggccat

SEQ ID NO: 413340 - DNA, 140 bp, Artificial Sequence
  Synthetic
atggccgactcccaagtacgtttcttttaaaaagaagctgagatcaaaagcagccttataggttattggtctcaatggtacctgtggtctgactggaaagcctacttcctctgattcctcggagacccagcatggcgtat

SEQ ID NO: 413341 - DNA, 140 bp, Artificial Sequence
  Synthetic
aggccctggctgctgatatggcgaagtctctaggggaggaagatgggtgcgagagcgtctgtgttgacagggactaaattggatgcatgggaacaaattaggttaaagccaggatctaaagaccttttgggacagcggtg

SEQ ID NO: 413342 - DNA, 140 bp, Artificial Sequence
  Synthetic
caccgctgtcccaaaaggtctttagatcctggctttaacctaatttgttcccatgcatccaatttagtccctgtcaacacagacgctctcgcacccatcttcctcccctagagacttcgccatatcagcagccagggcct

SEQ ID NO: 413343 - DNA, 140 bp, Artificial Sequence
  Synthetic
aggccctggctgctgatatgataaaatggggggcaagtggtcaaaaagcaagaggagtgactggccagttgtgagagaaagaataagacaaactgagccagcagcagagggagtaggggcgaccttttgggacagcggtg

SEQ ID NO: 413344 - DNA, 140 bp, Artificial Sequence
  Synthetic
caccgctgtcccaaaaggtcgcccctactccctctgctgctggctcagtttgtcttattctttctctcacaactggccagtcactcctcttgctttttgaccacttgccccccattttatcatatcagcagccagggcct

SEQ ID NO: 413345 - DNA, 140 bp, Artificial Sequence
  Synthetic
aggccctggctgctgatatgggagccaccccacaagatttaaacaccatgttaaatacagtagggggacatcaagcagccatgcaaatgttaaaagataccatcaatgaagaggctgcaggaccttttgggacagcggtg

SEQ ID NO: 413346 - DNA, 140 bp, Artificial Sequence
  Synthetic
caccgctgtcccaaaaggtcctgcagcctcttcattgatggtatcttttaacatttgcatggctgcttgatgtccccctactgtatttaacatggtgtttaaatcttgtggggtggctcccatatcagcagccagggcct

SEQ ID NO: 413347 - DNA, 140 bp, Artificial Sequence
  Synthetic
atacgccatgctgggtctccatacccccattgttagttcaggagagataaaaaactgctcttttaataccaccacaagcataagagataagataaagaaagaatatgcactcttttataacgtacttgggagtcggccat

SEQ ID NO: 413348 - DNA, 140 bp, Artificial Sequence
  Synthetic
atggccgactcccaagtacgttataaaagagtgcatattctttctttatcttatctcttatgcttgtggtggtattaaaagagcagttttttatctctcctgaactaacaatgggggtatggagacccagcatggcgtat

SEQ ID NO: 413349 - DNA, 140 bp, Artificial Sequence
  Synthetic
aggccctggctgctgatatggaaatatattgacaggattaggttgtacactaaatttccctataagccccataaccccagtaccagtaaaactaaaaccaggaatggatggaccaaaagtgaccttttgggacagcggtg

SEQ ID NO: 413350 - DNA, 140 bp, Artificial Sequence
  Synthetic
caccgctgtcccaaaaggtcacttttggtccatccattcctggttttagttttactggtactggggttatggggcttatagggaaatttagtgtacaacctaatcctgtcaatatatttccatatcagcagccagggcct

SEQ ID NO: 413351 - DNA, 140 bp, Artificial Sequence
  Synthetic
atacgccatgctgggtctcccacggacaatgcgaaaaatataatagtacagctgaataaatctgtgaacattacctgcacaagacccagcaataatacaagaagaagtatatcgatgggacgtacttgggagtcggccat

SEQ ID NO: 413352 - DNA, 140 bp, Artificial Sequence
  Synthetic
atggccgactcccaagtacgtcccatcgatatacttcttcttgtattattgctgggtcttgtgcaggtaatgttcacagatttattcagctgtactattatatttttcgcattgtccgtgggagacccagcatggcgtat

SEQ ID NO: 413353 - DNA, 140 bp, Artificial Sequence
  Synthetic
aggccctggctgctgatatgggttctccagctatattccaaagttcaatgacaaaaattctagatccatttaggaaaaacaacccagaattagaaatttatcaatacatggatgacttatgaccttttgggacagcggtg

SEQ ID NO: 413354 - DNA, 140 bp, Artificial Sequence
  Synthetic
caccgctgtcccaaaaggtcataagtcatccatgtattgataaatttctaattctgggttgtttttcctaaatggatctagaatttttgtcattgaactttggaatatagctggagaacccatatcagcagccagggcct

SEQ ID NO: 413355 - DNA, 140 bp, Artificial Sequence
  Synthetic
atacgccatgctgggtctcctaggaaaaacaacccagaattagaaatttatcaatacatggatgacttatatgtaggatcagatttaccactggcagaacataggaaaagggttgaactacgtacttgggagtcggccat

SEQ ID NO: 413356 - DNA, 140 bp, Artificial Sequence
  Synthetic
atggccgactcccaagtacgtagttcaacccttttcctatgttctgccagtggtaaatctgatcctacatataagtcatccatgtattgataaatttctaattctgggttgtttttcctaggagacccagcatggcgtat

SEQ ID NO: 413357 - DNA, 140 bp, Artificial Sequence
  Synthetic
atacgccatgctgggtctccaggggaatttttctactgtaattcatcacaactgtttaatagtacttggaacagtaacagtaccttaactttaactggtcctgaagagtcaaacagcactcgtacttgggagtcggccat

SEQ ID NO: 413358 - DNA, 140 bp, Artificial Sequence
  Synthetic
atggccgactcccaagtacgagtgctgtttgactcttcaggaccagttaaagttaaggtactgttactgttccaagtactattaaacagttgtgatgaattacagtagaaaaattcccctggagacccagcatggcgtat

SEQ ID NO: 413359 - DNA, 140 bp, Artificial Sequence
  Synthetic
aggccctggctgctgatatgcccttagcctccctcaaatcactctttggcaacgacccttggtcacaataaaagtagggggacagctaagggaagctctattagacacaggagcagatgagaccttttgggacagcggtg

SEQ ID NO: 413360 - DNA, 140 bp, Artificial Sequence
  Synthetic
caccgctgtcccaaaaggtctcatctgctcctgtgtctaatagagcttcccttagctgtccccctacttttattgtgaccaagggtcgttgccaaagagtgatttgagggaggctaagggcatatcagcagccagggcct

SEQ ID NO: 413361 - DNA, 140 bp, Artificial Sequence
  Synthetic
aggccctggctgctgatatgcattgacagaagtggtaccattaagcaaagaggcagaactagaattagaagagaacagggaaaagctgaaagagccagtacatggggtatactatcaaccgaccttttgggacagcggtg

SEQ ID NO: 413362 - DNA, 140 bp, Artificial Sequence
  Synthetic
caccgctgtcccaaaaggtcggttgatagtataccccatgtactggctctttcagcttttccctgttctcttctaattctagttctgcctctttgcttaatggtaccacttctgtcaatgcatatcagcagccagggcct

SEQ ID NO: 413363 - DNA, 140 bp, Artificial Sequence
  Synthetic
aggccctggctgctgatatgcttaccagatatatcaggatgaacataagaacctcaaaacagggaaatatgctaggcaaaaagcctcccacacaaatgatataagacaattagcaaatgtgaccttttgggacagcggtg

SEQ ID NO: 413364 - DNA, 140 bp, Artificial Sequence
  Synthetic
caccgctgtcccaaaaggtcacatttgctaattgtcttatatcatttgtgtgggaggctttttgcctagcatatttccctgttttgaggttcttatgttcatcctgatatatctggtaagcatatcagcagccagggcct

SEQ ID NO: 413365 - DNA, 140 bp, Artificial Sequence
  Synthetic
aggccctggctgctgatatgaataagaagaactgagccagcagcagagggagtaggagcagcgtctcaagacttagataaacatggagcacttacaagcagcaacacagctgccactaatgaccttttgggacagcggtg

SEQ ID NO: 413366 - DNA, 140 bp, Artificial Sequence
  Synthetic
caccgctgtcccaaaaggtcattagtggcagctgtgttgctgcttgtaagtgctccatgtttatctaagtcttgagacgctgctcctactccctctgctgctggctcagttcttcttattcatatcagcagccagggcct

SEQ ID NO: 413367 - DNA, 140 bp, Artificial Sequence
  Synthetic
aggccctggctgctgatatggaggcgcaacagcatctgttgcaactcacagtctggggcattaaacagctccaggcaagagtcctggctgtggaaagatacctaaaggatcaacagctccgaccttttgggacagcggtg

SEQ ID NO: 413368 - DNA, 140 bp, Artificial Sequence
  Synthetic
caccgctgtcccaaaaggtcggagctgttgatcctttaggtatctttccacagccaggactcttgcctggagctgtttaatgccccagactgtgagttgcaacagatgctgttgcgcctccatatcagcagccagggcct

SEQ ID NO: 413369 - DNA, 140 bp, Artificial Sequence
  Synthetic
aggccctggctgctgatatggaggaggttggctttccagtcaagcctcaggtgcctttaagaccaatgacttacaaggcagctgtagatcttagccactttttaaaagaaaaggggggacgaccttttgggacagcggtg

SEQ ID NO: 413370 - DNA, 140 bp, Artificial Sequence
  Synthetic
caccgctgtcccaaaaggtcgtccccccttttcttttaaaaagtggctaagatctacagctgccttgtaagtcattggtcttaaaggcacctgaggcttgactggaaagccaacctcctccatatcagcagccagggcct

SEQ ID NO: 413371 - DNA, 140 bp, Artificial Sequence
  Synthetic
aggccctggctgctgatatgaaaccttttatgtagatggagcagctaatagagacacaaaactaggaaaggcaggatatattacagaacaagggaaacagaaaataataaaattagatgagaccttttgggacagcggtg

SEQ ID NO: 413372 - DNA, 140 bp, Artificial Sequence
  Synthetic
caccgctgtcccaaaaggtctcatctaattttattattttctgtttcccttgttctgtaatatatcctgcctttcctagttttgtgtctctattagctgctccatctacataaaaggtttcatatcagcagccagggcct

SEQ ID NO: 413373 - DNA, 140 bp, Artificial Sequence
  Synthetic
aggccctggctgctgatatgtgtcaagtttgcttcataacaaaaggcttaggcatctcctatggcaggaagaagcggagacagcgacgaagagctcctcaagacagtcagaatcatcaaggaccttttgggacagcggtg

SEQ ID NO: 413374 - DNA, 140 bp, Artificial Sequence
  Synthetic
caccgctgtcccaaaaggtccttgatgattctgactgtcttgaggagctcttcgtcgctgtctccgcttcttcctgccataggagatgcctaagccttttgttatgaagcaaacttgacacatatcagcagccagggcct

SEQ ID NO: 413375 - DNA, 140 bp, Artificial Sequence
  Synthetic
aggccctggctgctgatatggatattagaagagtcctattcctagaaggaatagatcaggcacaagaagatcatgaaaaatatcatagtaattggagagcattagctagtgactttggacgaccttttgggacagcggtg

SEQ ID NO: 413376 - DNA, 140 bp, Artificial Sequence
  Synthetic
caccgctgtcccaaaaggtcgtccaaagtcactagctaatgctctccaattactatgatatttttcatgatcttcttgtgcctgatctattccttctaggaataggactcttctaatatccatatcagcagccagggcct

SEQ ID NO: 413377 - DNA, 140 bp, Artificial Sequence
  Synthetic
aggccctggctgctgatatgtcatgaaaaatatcatagtaattggagagcattagctagtgactttggactaccaccagtagtagccaaagaaatcattgcaagttgtcctaagtgtcatgaccttttgggacagcggtg

SEQ ID NO: 413378 - DNA, 140 bp, Artificial Sequence
  Synthetic
caccgctgtcccaaaaggtcatgacacttaggacaacttgcaatgatttctttggctactactggtggtagtccaaagtcactagctaatgctctccaattactatgatatttttcatgacatatcagcagccagggcct

SEQ ID NO: 413379 - DNA, 140 bp, Artificial Sequence
  Synthetic
aggccctggctgctgatatgagataggattctagaagcagtacaaagagcttgtagagctttcctgcatatacctagaagaataagacagggcttagaaaggcttttgctataagatggggaccttttgggacagcggtg

SEQ ID NO: 413380 - DNA, 140 bp, Artificial Sequence
  Synthetic
caccgctgtcccaaaaggtccccatcttatagcaaaagcctttctaagccctgtcttattcttctaggtatatgcaggaaagctctacaagctctttgtactgcttctagaatcctatctcatatcagcagccagggcct

SEQ ID NO: 413381 - DNA, 140 bp, Artificial Sequence
  Synthetic
aggccctggctgctgatatgcatggggcaatcacaagtagcaatacagcagctaataatgctgattgtgcttggctagaagcacaagaggaagaggaggtgggttttccagtcagacctcgaccttttgggacagcggtg

SEQ ID NO: 413382 - DNA, 140 bp, Artificial Sequence
  Synthetic
caccgctgtcccaaaaggtcgaggtctgactggaaaacccacctcctcttcctcttgtgcttctagccaagcacaatcagcattattagctgctgtattgctacttgtgattgccccatgcatatcagcagccagggcct

SEQ ID NO: 413383 - DNA, 140 bp, Artificial Sequence
  Synthetic
atacgccatgctgggtctccgtggcgccggaccagggccttgaaaaggaaataagaaccggaggacctctctggccccaggactgggcttctggaagcgcccccgccaagagggagggggcgtacttgggagtcggccat

SEQ ID NO: 413384 - DNA, 140 bp, Artificial Sequence
  Synthetic
atggccgactcccaagtacgccccctccctcttggcgggggcgcttccagaagcccagtcctggggccagagaggtcctccggttcttatttccttttcaaggccctggtccggcgccacggagacccagcatggcgtat

SEQ ID NO: 413385 - DNA, 140 bp, Artificial Sequence
  Synthetic
aggccctggctgctgatatgagtgaaataccataaatacaggtctagaaaggccacggattggtattataaacatcattatgaatctataaatccaagggtcagttcaagggtatatattgaccttttgggacagcggtg

SEQ ID NO: 413386 - DNA, 140 bp, Artificial Sequence
  Synthetic
caccgctgtcccaaaaggtcaatatatacccttgaactgacccttggatttatagattcataatgatgtttataataccaatccgtggcctttctagacctgtatttatggtatttcactcatatcagcagccagggcct

SEQ ID NO: 413387 - DNA, 140 bp, Artificial Sequence
  Synthetic
atacgccatgctgggtctccatgctactatcagtaccaaaattgaaggagtaaaaaattgctctttcaatataaccacagaaataagagataagaaacagaatgtgtatgcactgttttacgtacttgggagtcggccat

SEQ ID NO: 413388 - DNA, 140 bp, Artificial Sequence
  Synthetic
atggccgactcccaagtacgtaaaacagtgcatacacattctgtttcttatctcttatttctgtggttatattgaaagagcaattttttactccttcaattttggtactgatagtagcatggagacccagcatggcgtat

SEQ ID NO: 413389 - DNA, 140 bp, Artificial Sequence
  Synthetic
aggccctggctgctgatatgctaacagaagatagatggaacaagccccagaagaccaagggccacagagagaaccccataatgaatggacactagaactgttagaagagcttaagaatgagaccttttgggacagcggtg

SEQ ID NO: 413390 - DNA, 140 bp, Artificial Sequence
  Synthetic
caccgctgtcccaaaaggtctcattcttaagctcttctaacagttctagtgtccattcattatggggttctctctgtggcccttggtcttctggggcttgttccatctatcttctgttagcatatcagcagccagggcct

SEQ ID NO: 413391 - DNA, 140 bp, Artificial Sequence
  Synthetic
aggccctggctgctgatatgacaaaagaaacaagatagaacagcaagagaaatacttgaaagaataagaagaataagagaagttgaggatgacagcgattatgaaagcaatggggaagaggaccttttgggacagcggtg

SEQ ID NO: 413392 - DNA, 140 bp, Artificial Sequence
  Synthetic
caccgctgtcccaaaaggtcctcttccccattgctttcataatcgctgtcatcctcaacttctcttattcttcttattctttcaagtatttctcttgctgttctatcttgtttcttttgtcatatcagcagccagggcct

SEQ ID NO: 413393 - DNA, 140 bp, Artificial Sequence
  Synthetic
aggccctggctgctgatatgttgtgtgtacaagacctggcaataatacaagaaaaagtgtgaggataggaccagggcaagcattctttgcaacaggtgaaataataggagatataagacagaccttttgggacagcggtg

SEQ ID NO: 413394 - DNA, 140 bp, Artificial Sequence
  Synthetic
caccgctgtcccaaaaggtctgtcttatatctcctattatttcacctgttgcaaagaatgcttgccctggtcctatcctcacactttttcttgtattattgccaggtcttgtacacacaacatatcagcagccagggcct

SEQ ID NO: 413395 - DNA, 140 bp, Artificial Sequence
  Synthetic
atacgccatgctgggtctcccctaatctagagccctggaatcatccggggagtcagcctaaaactgcttgtaacaactgttattgtaaagtgtgttgctggcattgtcaagtttgctttccgtacttgggagtcggccat

SEQ ID NO: 413396 - DNA, 140 bp, Artificial Sequence
  Synthetic
atggccgactcccaagtacggaaagcaaacttgacaatgccagcaacacactttacaataacagttgttacaagcagttttaggctgactccccggatgattccagggctctagattaggggagacccagcatggcgtat

SEQ ID NO: 413397 - DNA, 140 bp, Artificial Sequence
  Synthetic
aggccctggctgctgatatgactaaatggggcactctctaaggggaatataacaatcatggggaaggatatttcagacagtggggagaacatcctgataaccctgaatactgatatgacagaccttttgggacagcggtg

SEQ ID NO: 413398 - DNA, 140 bp, Artificial Sequence
  Synthetic
caccgctgtcccaaaaggtctgtcatatcagtattcagggttatcaggatgttctccccactgtctgaaatatccttccccatgattgttatattccccttagagagtgccccatttagtcatatcagcagccagggcct

SEQ ID NO: 413399 - DNA, 140 bp, Artificial Sequence
  Synthetic
atacgccatgctgggtctccaatcataatgaaactacaaatgttactgtgaacaatgaagaagaaataaaaaactgctcttttaatataaccacagaaataagagataagagaaggaaagcgtacttgggagtcggccat

SEQ ID NO: 413400 - DNA, 140 bp, Artificial Sequence
  Synthetic
atggccgactcccaagtacgctttccttctcttatctcttatttctgtggttatattaaaagagcagttttttatttcttcttcattgttcacagtaacatttgtagtttcattatgattggagacccagcatggcgtat

SEQ ID NO: 413401 - DNA, 140 bp, Artificial Sequence
  Synthetic
aggccctggctgctgatatgattaagcgggggagaattagatagatgggaaaaaattcggttaaggccagggggaaagaaaaaatatagattaaaacatatagtatgggcaagcagggaggaccttttgggacagcggtg

SEQ ID NO: 413402 - DNA, 140 bp, Artificial Sequence
  Synthetic
caccgctgtcccaaaaggtcctccctgcttgcccatactatatgttttaatctatattttttctttccccctggccttaaccgaattttttcccatctatctaattctcccccgcttaatcatatcagcagccagggcct

SEQ ID NO: 413403 - DNA, 140 bp, Artificial Sequence
  Synthetic
aggccctggctgctgatatgggggaaagaaaaaatatagattaaaacatatagtatgggcaagcagggagctagaacgattcgcagttaaccctggcctgttagaaacatcagaaggctggaccttttgggacagcggtg

SEQ ID NO: 413404 - DNA, 140 bp, Artificial Sequence
  Synthetic
caccgctgtcccaaaaggtccagccttctgatgtttctaacaggccagggttaactgcgaatcgttctagctccctgcttgcccatactatatgttttaatctatattttttctttcccccatatcagcagccagggcct

SEQ ID NO: 413405 - DNA, 140 bp, Artificial Sequence
  Synthetic
aggccctggctgctgatatggcacctcccatcccaggaaacctagtatgcaggtcaaacataactggaatgattctacaattggacacgccatggaataaaacacatcctaacagcaccagaccttttgggacagcggtg

SEQ ID NO: 413406 - DNA, 140 bp, Artificial Sequence
  Synthetic
caccgctgtcccaaaaggtctggtgctgttaggatgtgttttattccatggcgtgtccaattgtagaatcattccagttatgtttgacctgcatactaggtttcctgggatgggaggtgccatatcagcagccagggcct

SEQ ID NO: 413407 - DNA, 140 bp, Artificial Sequence
  Synthetic
aggccctggctgctgatatgtaatgattagatctaaaaatatcacagacaataccaaaatcataatagtgcaacttaaagaacctataaatattacatgtgtcagacccagcaacaatacgaccttttgggacagcggtg

SEQ ID NO: 413408 - DNA, 140 bp, Artificial Sequence
  Synthetic
caccgctgtcccaaaaggtcgtattgttgctgggtctgacacatgtaatatttataggttctttaagttgcactattatgattttggtattgtctgtgatatttttagatctaatcattacatatcagcagccagggcct

SEQ ID NO: 413409 - DNA, 140 bp, Artificial Sequence
  Synthetic
aggccctggctgctgatatgaacttagatcattatataatacagtagcaaccctctattgtgtacatcaaaagatagaggtaagagacaccaaggaagctttagaaaagatagaggaagagaccttttgggacagcggtg

SEQ ID NO: 413410 - DNA, 140 bp, Artificial Sequence
  Synthetic
caccgctgtcccaaaaggtctcttcctctatcttttctaaagcttccttggtgtctcttacctctatcttttgatgtacacaatagagggttgctactgtattatataatgatctaagttcatatcagcagccagggcct

SEQ ID NO: 413411 - DNA, 140 bp, Artificial Sequence
  Synthetic
atacgccatgctgggtctccacataataggaaatataagacaggcatattgtaatgttaataaaacacaatgggaaaacatggtaagagaggtaaagggaaaactacaaaaaatttttaacgtacttgggagtcggccat

SEQ ID NO: 413412 - DNA, 140 bp, Artificial Sequence
  Synthetic
atggccgactcccaagtacgttaaaaattttttgtagttttccctttacctctcttaccatgttttcccattgtgttttattaacattacaatatgcctgtcttatatttcctattatgtggagacccagcatggcgtat

SEQ ID NO: 413413 - DNA, 140 bp, Artificial Sequence
  Synthetic
aggccctggctgctgatatgtgggaaaacatggtaagagaggtaaagggaaaactacaaaaaatttttaatacaacaaacataatctttaacaaatctgcaggaggggacctagaaattagaccttttgggacagcggtg

SEQ ID NO: 413414 - DNA, 140 bp, Artificial Sequence
  Synthetic
caccgctgtcccaaaaggtctaatttctaggtcccctcctgcagatttgttaaagattatgtttgttgtattaaaaattttttgtagttttccctttacctctcttaccatgttttcccacatatcagcagccagggcct

SEQ ID NO: 413415 - DNA, 140 bp, Artificial Sequence
  Synthetic
atacgccatgctgggtctccggcactcaaagtagcactactgccactcccacccctgacacactgaaggaagagaaaggatatataaaaaactgttctttcaatatgactacagaagtaacgtacttgggagtcggccat

SEQ ID NO: 413416 - DNA, 140 bp, Artificial Sequence
  Synthetic
atggccgactcccaagtacgttacttctgtagtcatattgaaagaacagttttttatatatcctttctcttccttcagtgtgtcaggggtgggagtggcagtagtgctactttgagtgccggagacccagcatggcgtat

SEQ ID NO: 413417 - DNA, 140 bp, Artificial Sequence
  Synthetic
atacgccatgctgggtctccaaactgtttaatagtaatgagactaatagtactaagaataatagtactaaggagatcacactcccatgtaagataaaacaaattgtgagaatgtggcagacgtacttgggagtcggccat

SEQ ID NO: 413418 - DNA, 140 bp, Artificial Sequence
  Synthetic
atggccgactcccaagtacgtctgccacattctcacaatttgttttatcttacatgggagtgtgatctccttagtactattattcttagtactattagtctcattactattaaacagtttggagacccagcatggcgtat

SEQ ID NO: 413419 - DNA, 140 bp, Artificial Sequence
  Synthetic
aggccctggctgctgatatgggagatcacactcccatgtaagataaaacaaattgtgagaatgtggcagaaagtaggacaagcaatgtatgcccctcctattgaaggaagcattaaatgtgaccttttgggacagcggtg

SEQ ID NO: 413420 - DNA, 140 bp, Artificial Sequence
  Synthetic
caccgctgtcccaaaaggtcacatttaatgcttccttcaataggaggggcatacattgcttgtcctactttctgccacattctcacaatttgttttatcttacatgggagtgtgatctcccatatcagcagccagggcct

SEQ ID NO: 413421 - DNA, 140 bp, Artificial Sequence
  Synthetic
aggccctggctgctgatatggggctgcaagaatagactaatctgctacacatcagtaaagtggaataaaacatggggaggagataatgaatcaatttgggatgagttaacatggcagcaggaccttttgggacagcggtg

SEQ ID NO: 413422 - DNA, 140 bp, Artificial Sequence
  Synthetic
caccgctgtcccaaaaggtcctgctgccatgttaactcatcccaaattgattcattatctcctccccatgttttattccactttactgatgtgtagcagattagtctattcttgcagccccatatcagcagccagggcct

SEQ ID NO: 413423 - DNA, 140 bp, Artificial Sequence
  Synthetic
aggccctggctgctgatatggcatagtaatatggggaaagactcctaaatttaaactacccatacaaaaagaaacatgggaagcatggtggacagaatattggcaagccacctggattccgaccttttgggacagcggtg

SEQ ID NO: 413424 - DNA, 140 bp, Artificial Sequence
  Synthetic
caccgctgtcccaaaaggtcggaatccaggtggcttgccaatattctgtccaccatgcttcccatgtttctttttgtatgggtagtttaaatttaggagtctttccccatattactatgccatatcagcagccagggcct

SEQ ID NO: 413425 - DNA, 140 bp, Artificial Sequence
  Synthetic
aggccctggctgctgatatgatgaatgggcctctatttggaattggcttgacataactaaatggttgtggtacataaaaatagctataatcatagtaggagcactaataggtgtaagagtgaccttttgggacagcggtg

SEQ ID NO: 413426 - DNA, 140 bp, Artificial Sequence
  Synthetic
caccgctgtcccaaaaggtcactcttacacctattagtgctcctactatgattatagctatttttatgtaccacaaccatttagttatgtcaagccaattccaaatagaggcccattcatcatatcagcagccagggcct

SEQ ID NO: 413427 - DNA, 140 bp, Artificial Sequence
  Synthetic
atacgccatgctgggtctcctgcaaactagtgctacaaatctactagatactgttgcagtggcagttgctaattggactgacagcatcatcctaggtatacaaagcatagggagaggaatcgtacttgggagtcggccat

SEQ ID NO: 413428 - DNA, 140 bp, Artificial Sequence
  Synthetic
atggccgactcccaagtacgattcctctccctatgctttgtatacctaggatgatgctgtcagtccaattagcaactgccactgcaacagtatctagtagatttgtagcactagtttgcaggagacccagcatggcgtat

SEQ ID NO: 413429 - DNA, 140 bp, Artificial Sequence
  Synthetic
aggccctggctgctgatatgaacatgggaaatgtattaggaaaaagtaaatgggcaggatggtcagaagtaagaagaagaatgagacaaacttcccctgacccccagtcctctgacacccgaccttttgggacagcggtg

SEQ ID NO: 413430 - DNA, 140 bp, Artificial Sequence
  Synthetic
caccgctgtcccaaaaggtcgggtgtcagaggactgggggtcaggggaagtttgtctcattcttcttcttacttctgaccatcctgcccatttactttttcctaatacatttcccatgttcatatcagcagccagggcct

SEQ ID NO: 413431 - DNA, 140 bp, Artificial Sequence
  Synthetic
atacgccatgctgggtctccaagaagaagaatgagacaaacttcccctgacccccagtcctctgacacccaacctgcacctggggtaagagcagtatccagggcattagcagacagaagacgtacttgggagtcggccat

SEQ ID NO: 413432 - DNA, 140 bp, Artificial Sequence
  Synthetic
atggccgactcccaagtacgtcttctgtctgctaatgccctggatactgctcttaccccaggtgcaggttgggtgtcagaggactgggggtcaggggaagtttgtctcattcttcttcttggagacccagcatggcgtat

SEQ ID NO: 413433 - DNA, 140 bp, Artificial Sequence
  Synthetic
aggccctggctgctgatatgaggaagccaccagggtaaaggaatagggttcccagtaagaccccaagtgcctctaaggccgatgacctataaaggagcatttgacctcagcttctttttagaccttttgggacagcggtg

SEQ ID NO: 413434 - DNA, 140 bp, Artificial Sequence
  Synthetic
caccgctgtcccaaaaggtctaaaaagaagctgaggtcaaatgctcctttataggtcatcggccttagaggcacttggggtcttactgggaaccctattcctttaccctggtggcttcctcatatcagcagccagggcct

SEQ ID NO: 413435 - DNA, 140 bp, Artificial Sequence
  Synthetic
aggccctggctgctgatatgctagggctttggggatgctctggaaagctcatctgcaccactaatgtgccctggaattatagttggagtaataaatcgcaagatgagatttgggggaacagaccttttgggacagcggtg

SEQ ID NO: 413436 - DNA, 140 bp, Artificial Sequence
  Synthetic
caccgctgtcccaaaaggtctgttcccccaaatctcatcttgcgatttattactccaactataattccagggcacattagtggtgcagatgagctttccagagcatccccaaagccctagcatatcagcagccagggcct

SEQ ID NO: 413437 - DNA, 140 bp, Artificial Sequence
  Synthetic
aggccctggctgctgatatgtagcaatagcagtagctaactggacagatagagttatagaagtagcacaaagagcttgtagagctattctcaacatacctagaaggataagacagggcttgaccttttgggacagcggtg

SEQ ID NO: 413438 - DNA, 140 bp, Artificial Sequence
  Synthetic
caccgctgtcccaaaaggtcaagccctgtcttatccttctaggtatgttgagaatagctctacaagctctttgtgctacttctataactctatctgtccagttagctactgctattgctacatatcagcagccagggcct

SEQ ID NO: 413439 - DNA, 140 bp, Artificial Sequence
  Synthetic
aggccctggctgctgatatgagagcttgtagagctattctcaacatacctagaaggataagacagggcttggaaagagcattgatataaaatgggaggcaagtggtcaaaaagcagcatagaccttttgggacagcggtg

SEQ ID NO: 413440 - DNA, 140 bp, Artificial Sequence
  Synthetic
caccgctgtcccaaaaggtctatgctgctttttgaccacttgcctcccattttatatcaatgctctttccaagccctgtcttatccttctaggtatgttgagaatagctctacaagctctcatatcagcagccagggcct

SEQ ID NO: 413441 - DNA, 140 bp, Artificial Sequence
  Synthetic
atacgccatgctgggtctccagcagcagaaggagcaggagcagtatctcaagatttagctaagcatggagcaatcacaagcagcaacacatcatctactaactctgcttgtgcctggctgcgtacttgggagtcggccat

SEQ ID NO: 413442 - DNA, 140 bp, Artificial Sequence
  Synthetic
atggccgactcccaagtacgcagccaggcacaagcagagttagtagatgatgtgttgctgcttgtgattgctccatgcttagctaaatcttgagatactgctcctgctccttctgctgctggagacccagcatggcgtat

SEQ ID NO: 413443 - DNA, 140 bp, Artificial Sequence
  Synthetic
atacgccatgctgggtctccgagcaactgttacagcagttagaaccagctctcaagacagggtcagaggacctaaaatctctttggaacgcaatagcagtactctggtgcgttcacaacacgtacttgggagtcggccat

SEQ ID NO: 413444 - DNA, 140 bp, Artificial Sequence
  Synthetic
atggccgactcccaagtacgtgttgtgaacgcaccagagtactgctattgcgttccaaagagattttaggtcctctgaccctgtcttgagagctggttctaactgctgtaacagttgctcggagacccagcatggcgtat

SEQ ID NO: 413445 - DNA, 140 bp, Artificial Sequence
  Synthetic
atacgccatgctgggtctccgaagcacaggaggaagactcagaggtgggctttccagtcagaccgcaggtacctttgagaccaatgacttataaagcggccgttgatctcagcttcttttcgtacttgggagtcggccat

SEQ ID NO: 413446 - DNA, 140 bp, Artificial Sequence
  Synthetic
atggccgactcccaagtacgaaaagaagctgagatcaacggccgctttataagtcattggtctcaaaggtacctgcggtctgactggaaagcccacctctgagtcttcctcctgtgcttcggagacccagcatggcgtat

SEQ ID NO: 413447 - DNA, 140 bp, Artificial Sequence
  Synthetic
aggccctggctgctgatatgaaaagtgtggggataggaccaggacaaacaatctatgcaacaggacaaataataggagatataagacaagcacattgcaacattagtagtagtgaatggagaccttttgggacagcggtg

SEQ ID NO: 413448 - DNA, 140 bp, Artificial Sequence
  Synthetic
caccgctgtcccaaaaggtctccattcactactactaatgttgcaatgtgcttgtcttatatctcctattatttgtcctgttgcatagattgtttgtcctggtcctatccccacacttttcatatcagcagccagggcct

SEQ ID NO: 413449 - DNA, 140 bp, Artificial Sequence
  Synthetic
atacgccatgctgggtctccgaagaaaaggcctttaaccctgaaattattcctatgtttatggcattatcagaaggagctgttccctatgatatcaataccatgctaaatgccataggagcgtacttgggagtcggccat

SEQ ID NO: 413450 - DNA, 140 bp, Artificial Sequence
  Synthetic
atggccgactcccaagtacgctcctatggcatttagcatggtattgatatcatagggaacagctccttctgataatgccataaacataggaataatttcagggttaaaggccttttcttcggagacccagcatggcgtat

SEQ ID NO: 413451 - DNA, 140 bp, Artificial Sequence
  Synthetic
atacgccatgctgggtctccgcagaatgggatagaactcatccaccagcaatggggccgttaccaccagggcagctaagagatccaacaggaagtgacattgctggaacaactagcacaccgtacttgggagtcggccat

SEQ ID NO: 413452 - DNA, 140 bp, Artificial Sequence
  Synthetic
atggccgactcccaagtacggtgtgctagttgttccagcaatgtcacttcctgttggatctcttagctgccctggtggtaacggccccattgctggtggatgagttctatcccattctgcggagacccagcatggcgtat

SEQ ID NO: 413453 - DNA, 140 bp, Artificial Sequence
  Synthetic
aggccctggctgctgatatgccagctcttcagacaggaacagaggaacttagatcattattcaacacagtagcaactctctattgtgtacataaagggatagaggtacgagacaccaagggaccttttgggacagcggtg

SEQ ID NO: 413454 - DNA, 140 bp, Artificial Sequence
  Synthetic
caccgctgtcccaaaaggtcccttggtgtctcgtacctctatccctttatgtacacaatagagagttgctactgtgttgaataatgatctaagttcctctgttcctgtctgaagagctggcatatcagcagccagggcct

SEQ ID NO: 413455 - DNA, 140 bp, Artificial Sequence
  Synthetic
atacgccatgctgggtctccgatcattatttaatacaatagcaaccctttggtgcgtgcatcaaaggatgggtgtaaaagataccaaggaagccttagataaggtagaggaaatgaaaaacgtacttgggagtcggccat

SEQ ID NO: 413456 - DNA, 140 bp, Artificial Sequence
  Synthetic
atggccgactcccaagtacgtttttcatttcctctaccttatctaaggcttccttggtatcttttacacccatcctttgatgcacgcaccaaagggttgctattgtattaaataatgatcggagacccagcatggcgtat

SEQ ID NO: 413457 - DNA, 140 bp, Artificial Sequence
  Synthetic
aggccctggctgctgatatggctactcaggaagtaaaaaattggatgacagaaaccttgcttgttcagaattccaaccctgattgtaaacaaattttgaaagcattaggaccaggagctagaccttttgggacagcggtg

SEQ ID NO: 413458 - DNA, 140 bp, Artificial Sequence
  Synthetic
caccgctgtcccaaaaggtctagctcctggtcctaatgctttcaaaatttgtttacaatcagggttggaattctgaacaagcaaggtttctgtcatccaattttttacttcctgagtagccatatcagcagccagggcct

SEQ ID NO: 413459 - DNA, 140 bp, Artificial Sequence
  Synthetic
aggccctggctgctgatatgaaggcaaaaatactagcagaagcaatggttactgcccagcaagaattaaaaggaggatacacagcagtattcatgcaaagagggcaaaatccaaatagaagaccttttgggacagcggtg

SEQ ID NO: 413460 - DNA, 140 bp, Artificial Sequence
  Synthetic
caccgctgtcccaaaaggtcttctatttggattttgccctctttgcatgaatactgctgtgtatcctccttttaattcttgctgggcagtaaccattgcttctgctagtatttttgccttcatatcagcagccagggcct

SEQ ID NO: 413461 - DNA, 140 bp, Artificial Sequence
  Synthetic
aggccctggctgctgatatgatagtagcattagtagtagcaacaataatagcaataattgtgtggaccatagtgcttatagaatataggagaatattaaaacaaagaaaaatagataggtgaccttttgggacagcggtg

SEQ ID NO: 413462 - DNA, 140 bp, Artificial Sequence
  Synthetic
caccgctgtcccaaaaggtcacctatctatttttctttgttttaatattctcctatattctataagcactatggtccacacaattattgctattattgttgctactactaatgctactatcatatcagcagccagggcct

SEQ ID NO: 413463 - DNA, 140 bp, Artificial Sequence
  Synthetic
atacgccatgctgggtctccagtactggcctccagggggcacgaggccaggcaattatgtgcagaaacaagtgtccccatcagctccaccaatggaggaggaagtgaaggagctagagaacgtacttgggagtcggccat

SEQ ID NO: 413464 - DNA, 140 bp, Artificial Sequence
  Synthetic
atggccgactcccaagtacgttctctagctccttcacttcctcctccattggtggagctgatggggacacttgtttctgcacataattgcctggcctcgtgccccctggaggccagtactggagacccagcatggcgtat

SEQ ID NO: 413465 - DNA, 140 bp, Artificial Sequence
  Synthetic
atacgccatgctgggtctccagcaatagtagtgggatacacaacgggaagggagaaatacaaaactgctctttcaatatcaccacaggcatacaaggtaagaataggaacgaatatgcgccgtacttgggagtcggccat

SEQ ID NO: 413466 - DNA, 140 bp, Artificial Sequence
  Synthetic
atggccgactcccaagtacggcgcatattcgttcctattcttaccttgtatgcctgtggtgatattgaaagagcagttttgtatttctcccttcccgttgtgtatcccactactattgctggagacccagcatggcgtat

SEQ ID NO: 413467 - DNA, 140 bp, Artificial Sequence
  Synthetic
atacgccatgctgggtctccctggaatcagaaaggtgctgtttttagatgggatagataaggctcaagaagaacatgaaagatatcacagcaattggagagcaatggctagtgattttaacgtacttgggagtcggccat

SEQ ID NO: 413468 - DNA, 140 bp, Artificial Sequence
  Synthetic
atggccgactcccaagtacgttaaaatcactagccattgctctccaattgctgtgatatctttcatgttcttcttgagccttatctatcccatctaaaaacagcacctttctgattccagggagacccagcatggcgtat

SEQ ID NO: 413469 - DNA, 140 bp, Artificial Sequence
  Synthetic
aggccctggctgctgatatgtacaagaaaaggtataccagtagtagggaggacattatatgcaacaggggctataataggagatataagacaagcacattgtaaccttagcagctcacaagaccttttgggacagcggtg

SEQ ID NO: 413470 - DNA, 140 bp, Artificial Sequence
  Synthetic
caccgctgtcccaaaaggtcttgtgagctgctaaggttacaatgtgcttgtcttatatctcctattatagcccctgttgcatataatgtcctccctactactggtataccttttcttgtacatatcagcagccagggcct

SEQ ID NO: 413471 - DNA, 140 bp, Artificial Sequence
  Synthetic
aggccctggctgctgatatgttatatgtagggtcagatttaccattgacagaacatagaaagaaggtagaattgcttagagaacatttatatcagtggggattcactacccctgataaaagaccttttgggacagcggtg

SEQ ID NO: 413472 - DNA, 140 bp, Artificial Sequence
  Synthetic
caccgctgtcccaaaaggtcttttatcaggggtagtgaatccccactgatataaatgttctctaagcaattctaccttctttctatgttctgtcaatggtaaatctgaccctacatataacatatcagcagccagggcct

SEQ ID NO: 413473 - DNA, 140 bp, Artificial Sequence
  Synthetic
aggccctggctgctgatatgcaaggtaggatctctacagtacttggcactagcagcattaataacaccaaaaaggataaagccacctttgcctagtgttacgaaactgacagaggatagagaccttttgggacagcggtg

SEQ ID NO: 413474 - DNA, 140 bp, Artificial Sequence
  Synthetic
caccgctgtcccaaaaggtctctatcctctgtcagtttcgtaacactaggcaaaggtggctttatcctttttggtgttattaatgctgctagtgccaagtactgtagagatcctaccttgcatatcagcagccagggcct

SEQ ID NO: 413475 - DNA, 140 bp, Artificial Sequence
  Synthetic
atacgccatgctgggtctccagaagaaaacagagaaaagctaaaagagccagtacatggagtatactaccaacctgacaaagacttatgggttaatattcagaagcatggacaagggcaacgtacttgggagtcggccat

SEQ ID NO: 413476 - DNA, 140 bp, Artificial Sequence
  Synthetic
atggccgactcccaagtacgttgcccttgtccatgcttctgaatattaacccataagtctttgtcaggttggtagtatactccatgtactggctcttttagcttttctctgttttcttctggagacccagcatggcgtat

SEQ ID NO: 413477 - DNA, 140 bp, Artificial Sequence
  Synthetic
aggccctggctgctgatatggcatctcctatggcaggaagaagcggagacagcgacgaagagctcctcaaagcagtcagactcatcaagtttctctatcaaagcagtaagtagtacatgtgaccttttgggacagcggtg

SEQ ID NO: 413478 - DNA, 140 bp, Artificial Sequence
  Synthetic
caccgctgtcccaaaaggtcacatgtactacttactgctttgatagagaaacttgatgagtctgactgctttgaggagctcttcgtcgctgtctccgcttcttcctgccataggagatgccatatcagcagccagggcct

SEQ ID NO: 413479 - DNA, 140 bp, Artificial Sequence
  Synthetic
atacgccatgctgggtctccgcagaaacttattatgtagatggagcagctaatagaaatacaaaactaggaaaggcgggatatgttacagaacaaggaaaacaaaaagtaataaagttagcgtacttgggagtcggccat

SEQ ID NO: 413480 - DNA, 140 bp, Artificial Sequence
  Synthetic
atggccgactcccaagtacgctaactttattactttttgttttccttgttctgtaacatatcccgcctttcctagttttgtatttctattagctgctccatctacataataagtttctgcggagacccagcatggcgtat

SEQ ID NO: 413481 - DNA, 140 bp, Artificial Sequence
  Synthetic
aggccctggctgctgatatgttaagacaaagaaaaatagacaggttaattgatagaataagagaaagagcagaagacagtggcaatgaaagtgaaggggatcaggaagaattatcagcacgaccttttgggacagcggtg

SEQ ID NO: 413482 - DNA, 140 bp, Artificial Sequence
  Synthetic
caccgctgtcccaaaaggtcgtgctgataattcttcctgatccccttcactttcattgccactgtcttctgctctttctcttattctatcaattaacctgtctatttttctttgtcttaacatatcagcagccagggcct

SEQ ID NO: 413483 - DNA, 140 bp, Artificial Sequence
  Synthetic
atacgccatgctgggtctccaaataatagaagaattaacaaaaaaggaacaagtgtatcttacatgggttcccgctcacaaaggcataggaggaaatgaaaaaatagataaattagtaagcgtacttgggagtcggccat

SEQ ID NO: 413484 - DNA, 140 bp, Artificial Sequence
  Synthetic
atggccgactcccaagtacgcttactaatttatctattttttcatttcctcctatgcctttgtgagcgggaacccatgtaagatacacttgttccttttttgttaattcttctattatttggagacccagcatggcgtat

SEQ ID NO: 413485 - DNA, 140 bp, Artificial Sequence
  Synthetic
atacgccatgctgggtctcctatggcaaatggattgcacacatttagaaggcaaaatcataatagttgctgtccatgtagcaagtggctttatagaagcagaggtgataccagcagaaaccgtacttgggagtcggccat

SEQ ID NO: 413486 - DNA, 140 bp, Artificial Sequence
  Synthetic
atggccgactcccaagtacggtttctgctggtatcacctctgcttctataaagccacttgctacatggacagcaactattatgattttgccttctaaatgtgtgcaatccatttgccataggagacccagcatggcgtat

SEQ ID NO: 413487 - DNA, 140 bp, Artificial Sequence
  Synthetic
atacgccatgctgggtctccttgcactgattggaagaatactactaataccactagtagtggcggggaaatgatgggggaaggagaaatgaaaaactgctctttcaacatcaccacaagccgtacttgggagtcggccat

SEQ ID NO: 413488 - DNA, 140 bp, Artificial Sequence
  Synthetic
atggccgactcccaagtacggcttgtggtgatgttgaaagagcagtttttcatttctccttcccccatcatttccccgccactactagtggtattagtagtattcttccaatcagtgcaaggagacccagcatggcgtat

SEQ ID NO: 413489 - DNA, 140 bp, Artificial Sequence
  Synthetic
aggccctggctgctgatatgtcaaaataatacatacagacaatgggcctaattttacaagtgcagccatgaaagctgcatgttggtggacaggcatacaacatgagtttggaataccatagaccttttgggacagcggtg

SEQ ID NO: 413490 - DNA, 140 bp, Artificial Sequence
  Synthetic
caccgctgtcccaaaaggtctatggtattccaaactcatgttgtatgcctgtccaccaacatgcagctttcatggctgcacttgtaaaattaggcccattgtctgtatgtattattttgacatatcagcagccagggcct

SEQ ID NO: 413491 - DNA, 140 bp, Artificial Sequence
  Synthetic
aggccctggctgctgatatgagggaaagaatgagaagaactgagccagcagcagagggggtgggagcagcatctcgagacttggagaaacatggagcaatcacaagtagcaatacagcaggaccttttgggacagcggtg

SEQ ID NO: 413492 - DNA, 140 bp, Artificial Sequence
  Synthetic
caccgctgtcccaaaaggtcctgctgtattgctacttgtgattgctccatgtttctccaagtctcgagatgctgctcccaccccctctgctgctggctcagttcttctcattctttccctcatatcagcagccagggcct

SEQ ID NO: 413493 - DNA, 140 bp, Artificial Sequence
  Synthetic
atacgccatgctgggtctccgcctggtgaaataccataagtacaggtctaagaaggccaacaaatggcagtataggcatcattatgagtgcagaaatccaaaagtcagttcagttgtatacgtacttgggagtcggccat

SEQ ID NO: 413494 - DNA, 140 bp, Artificial Sequence
  Synthetic
atggccgactcccaagtacgtatacaactgaactgacttttggatttctgcactcataatgatgcctatactgccatttgttggccttcttagacctgtacttatggtatttcaccaggcggagacccagcatggcgtat

SEQ ID NO: 413495 - DNA, 140 bp, Artificial Sequence
  Synthetic
aggccctggctgctgatatgcaatacaagaagtatagaacacagattgatcctgaaacagcagacaggatgatacatctgcattatttcaactgttttacagagtcagcaatcaggaggggaccttttgggacagcggtg

SEQ ID NO: 413496 - DNA, 140 bp, Artificial Sequence
  Synthetic
caccgctgtcccaaaaggtcccctcctgattgctgactctgtaaaacagttgaaataatgcagatgtatcatcctgtctgctgtttcaggatcaatctgtgttctatacttcttgtattgcatatcagcagccagggcct

SEQ ID NO: 413497 - DNA, 140 bp, Artificial Sequence
  Synthetic
aggccctggctgctgatatgccattctagggcagagagtgctgaccaggtgtgaatactctgcaggacatagtcaggtagggacactgcaattcttagccttgaaagcactggtgaaggtgaccttttgggacagcggtg

SEQ ID NO: 413498 - DNA, 140 bp, Artificial Sequence
  Synthetic
caccgctgtcccaaaaggtcaccttcaccagtgctttcaaggctaagaattgcagtgtccctacctgactatgtcctgcagagtattcacacctggtcagcactctctgccctagaatggcatatcagcagccagggcct

SEQ ID NO: 413499 - DNA, 140 bp, Artificial Sequence
  Synthetic
aggccctggctgctgatatgattagggattatggaaaacagatggcaggtgatgattgtgtggcaggtagacaggatgaggattagaacatggaacagtttagtaaaacatcatatgtatgaccttttgggacagcggtg

SEQ ID NO: 413500 - DNA, 140 bp, Artificial Sequence
  Synthetic
caccgctgtcccaaaaggtcatacatatgatgttttactaaactgttccatgttctaatcctcatcctgtctacctgccacacaatcatcacctgccatctgttttccataatccctaatcatatcagcagccagggcct

SEQ ID NO: 413501 - DNA, 140 bp, Artificial Sequence
  Synthetic
atacgccatgctgggtctccgatggaacaagccccagaagatcaagggccagctagggagccattcaatgaatgggcactagagcttctggaggagctaaaagaagaagcagtaagacatcgtacttgggagtcggccat

SEQ ID NO: 413502 - DNA, 140 bp, Artificial Sequence
  Synthetic
atggccgactcccaagtacgatgtcttactgcttcttcttttagctcctccagaagctctagtgcccattcattgaatggctccctagctggcccttgatcttctggggcttgttccatcggagacccagcatggcgtat

SEQ ID NO: 413503 - DNA, 140 bp, Artificial Sequence
  Synthetic
aggccctggctgctgatatgcctaggtgtgaatatcaagcaggacataataaggtaggatctctacaatatttggcactgaaagcattagtaacaccaacaaggagaaagccacctttgcgaccttttgggacagcggtg

SEQ ID NO: 413504 - DNA, 140 bp, Artificial Sequence
  Synthetic
caccgctgtcccaaaaggtcgcaaaggtggctttctccttgttggtgttactaatgctttcagtgccaaatattgtagagatcctaccttattatgtcctgcttgatattcacacctaggcatatcagcagccagggcct

SEQ ID NO: 413505 - DNA, 140 bp, Artificial Sequence
  Synthetic
aggccctggctgctgatatgcagctgctgcaagctatccagataataaagatcctgtaccagagcagtaagtaacgctgatgcatcaaagggacctgctagccataatagctttaagtgcgaccttttgggacagcggtg

SEQ ID NO: 413506 - DNA, 140 bp, Artificial Sequence
  Synthetic
caccgctgtcccaaaaggtcgcacttaaagctattatggctagcaggtccctttgatgcatcagcgttacttactgctctggtacaggatctttattatctggatagcttgcagcagctgcatatcagcagccagggcct

SEQ ID NO: 413507 - DNA, 140 bp, Artificial Sequence
  Synthetic
aggccctggctgctgatatgaagctgtcagacactttcctagaccatggctccatagcttaggacaatatatctatgaaacctatggggatacttggacgggagttgaagctataataaggaccttttgggacagcggtg

SEQ ID NO: 413508 - DNA, 140 bp, Artificial Sequence
  Synthetic
caccgctgtcccaaaaggtccttattatagcttcaactcccgtccaagtatccccataggtttcatagatatattgtcctaagctatggagccatggtctaggaaagtgtctgacagcttcatatcagcagccagggcct

SEQ ID NO: 413509 - DNA, 140 bp, Artificial Sequence
  Synthetic
atacgccatgctgggtctcctagagcaaagaaaacaagatagaagggagcaggaaatacttgaaagattaagaagagtaagggaaatcaaggatgacagtgactatgacagtaatggagacgtacttgggagtcggccat

SEQ ID NO: 413510 - DNA, 140 bp, Artificial Sequence
  Synthetic
atggccgactcccaagtacgtctccattactgtcatagtcactgtcatccttgatttcccttactcttcttaatctttcaagtatttcctgctcccttctatcttgttttctttgctctaggagacccagcatggcgtat

SEQ ID NO: 413511 - DNA, 140 bp, Artificial Sequence
  Synthetic
aggccctggctgctgatatgagaagagtaagggaaatcaaggatgacagtgactatgacagtaatggagaagaagagcaagaagtcatggatcttatgcatagccatggctttgataatcgaccttttgggacagcggtg

SEQ ID NO: 413512 - DNA, 140 bp, Artificial Sequence
  Synthetic
caccgctgtcccaaaaggtcgattatcaaagccatggctatgcataagatccatgacttcttgctcttcttctccattactgtcatagtcactgtcatccttgatttcccttactcttctcatatcagcagccagggcct

SEQ ID NO: 413513 - DNA, 140 bp, Artificial Sequence
  Synthetic
aggccctggctgctgatatgattggagtcaggaactaaagaatagtgctattagcttgctcaatgccacagccatagcagtagctgaggggacagatagggttatagaagtattacaaaggaccttttgggacagcggtg

SEQ ID NO: 413514 - DNA, 140 bp, Artificial Sequence
  Synthetic
caccgctgtcccaaaaggtcctttgtaatacttctataaccctatctgtcccctcagctactgctatggctgtggcattgagcaagctaatagcactattctttagttcctgactccaatcatatcagcagccagggcct

SEQ ID NO: 413515 - DNA, 140 bp, Artificial Sequence
  Synthetic
atacgccatgctgggtctcctgatatatggaaaaattacatggtggaccaaatgcatgaagacattattagtttatgggatcaaagtttaaagccttgtgtgcaaatgactttcttatgtcgtacttgggagtcggccat

SEQ ID NO: 413516 - DNA, 140 bp, Artificial Sequence
  Synthetic
atggccgactcccaagtacgacataagaaagtcatttgcacacaaggctttaaactttgatcccataaactaataatgtcttcatgcatttggtccaccatgtaatttttccatatatcaggagacccagcatggcgtat

SEQ ID NO: 413517 - DNA, 140 bp, Artificial Sequence
  Synthetic
aggccctggctgctgatatggtagattatagattaggagtaggagcattgatagtagcactaatcatagcaataatagtgtggaccatagcatatatagaatataggaaattggtaagacgaccttttgggacagcggtg

SEQ ID NO: 413518 - DNA, 140 bp, Artificial Sequence
  Synthetic
caccgctgtcccaaaaggtcgtcttaccaatttcctatattctatatatgctatggtccacactattattgctatgattagtgctactatcaatgctcctactcctaatctataatctaccatatcagcagccagggcct

SEQ ID NO: 413519 - DNA, 140 bp, Artificial Sequence
  Synthetic
aggccctggctgctgatatgaataatagtgtggaccatagcatatatagaatataggaaattggtaagacaaaagaaaatagactggttaattaaaagaattagggaaagagcagaagacgaccttttgggacagcggtg

SEQ ID NO: 413520 - DNA, 140 bp, Artificial Sequence
  Synthetic
caccgctgtcccaaaaggtcgtcttctgctctttccctaattcttttaattaaccagtctattttcttttgtcttaccaatttcctatattctatatatgctatggtccacactattattcatatcagcagccagggcct

SEQ ID NO: 413521 - DNA, 140 bp, Artificial Sequence
  Synthetic
atacgccatgctgggtctccttaatataactacagtcctcaaagataaaaaggagaaaaggcaggctctattctatgtatcagatttggttaagattgacaacagctcaacaatatatagcgtacttgggagtcggccat

SEQ ID NO: 413522 - DNA, 140 bp, Artificial Sequence
  Synthetic
atggccgactcccaagtacgctatatattgttgagctgttgtcaatcttaaccaaatctgatacatagaatagagcctgccttttctcctttttatctttgaggactgtagttatattaaggagacccagcatggcgtat

SEQ ID NO: 413523 - DNA, 140 bp, Artificial Sequence
  Synthetic
atacgccatgctgggtctccgctttgagcccatccccatacattattgtgctccagcaggatatgccatctttaagtgtaataacacagactttaatggaacaggcctatgccccaatatcgtacttgggagtcggccat

SEQ ID NO: 413524 - DNA, 140 bp, Artificial Sequence
  Synthetic
atggccgactcccaagtacgatattggggcataggcctgttccattaaagtctgtgttattacacttaaagatggcatatcctgctggagcacaataatgtatggggatgggctcaaagcggagacccagcatggcgtat

SEQ ID NO: 413525 - DNA, 140 bp, Artificial Sequence
  Synthetic
aggccctggctgctgatatgtaataatgaatgggacactctctagagggaagataagaattatgggaagaaatattacagacaatacaaagaatattatagtaaccttaaacacttctatgaccttttgggacagcggtg

SEQ ID NO: 413526 - DNA, 140 bp, Artificial Sequence
  Synthetic
caccgctgtcccaaaaggtcatagaagtgtttaaggttactataatattctttgtattgtctgtaatatttcttcccataattcttatcttccctctagagagtgtcccattcattattacatatcagcagccagggcct

SEQ ID NO: 413527 - DNA, 140 bp, Artificial Sequence
  Synthetic
atacgccatgctgggtctcctaacttttacaaatcatactacgtgtaataattgcacagtacaggacagagaagaagtaaaaaactgctctttcaatgtaaccacagaaataagagacaacgtacttgggagtcggccat

SEQ ID NO: 413528 - DNA, 140 bp, Artificial Sequence
  Synthetic
atggccgactcccaagtacgttgtctcttatttctgtggttacattgaaagagcagttttttacttcttctctgtcctgtactgtgcaattattacacgtagtatgatttgtaaaagttaggagacccagcatggcgtat

SEQ ID NO: 413529 - DNA, 140 bp, Artificial Sequence
  Synthetic
atacgccatgctgggtctcctattgcaaatgctacatataagtatgaagaaatgaaaaattgctctttcaatgcaaccacagaattaagagataagaaacataaagagtatgcactctttcgtacttgggagtcggccat

SEQ ID NO: 413530 - DNA, 140 bp, Artificial Sequence
  Synthetic
atggccgactcccaagtacgaaagagtgcatactctttatgtttcttatctcttaattctgtggttgcattgaaagagcaatttttcatttcttcatacttatatgtagcatttgcaataggagacccagcatggcgtat

SEQ ID NO: 413531 - DNA, 140 bp, Artificial Sequence
  Synthetic
aggccctggctgctgatatgacagggtcaaggatagcttattgtatgtataataacactgaatggataaataccttaaaacaaacagctgaaagatatttagaactcgtaaacaagacaggaccttttgggacagcggtg

SEQ ID NO: 413532 - DNA, 140 bp, Artificial Sequence
  Synthetic
caccgctgtcccaaaaggtcctgtcttgtttacgagttctaaatatctttcagctgtttgttttaaggtatttatccattcagtgttattatacatacaataagctatccttgaccctgtcatatcagcagccagggcct

SEQ ID NO: 413533 - DNA, 140 bp, Artificial Sequence
  Synthetic
atacgccatgctgggtctccagtggtggagatgtagaagcaagttctctacattttaactgtcatggagaattcttttattgtgacacatctcggctgtttaactatacttttaagtgtacgtacttgggagtcggccat

SEQ ID NO: 413534 - DNA, 140 bp, Artificial Sequence
  Synthetic
atggccgactcccaagtacgtacacttaaaagtatagttaaacagccgagatgtgtcacaataaaagaattctccatgacagttaaaatgtagagaacttgcttctacatctccaccactggagacccagcatggcgtat

SEQ ID NO: 413535 - DNA, 140 bp, Artificial Sequence
  Synthetic
aggccctggctgctgatatgggaattaagccagtggtatcaacccaactactgctaaatggcagtttagcagaaggagatttaaaaatcagaactgagaatgccacagacaataccaaaggaccttttgggacagcggtg

SEQ ID NO: 413536 - DNA, 140 bp, Artificial Sequence
  Synthetic
caccgctgtcccaaaaggtcctttggtattgtctgtggcattctcagttctgatttttaaatctccttctgctaaactgccatttagcagtagttgggttgataccactggcttaattcccatatcagcagccagggcct

SEQ ID NO: 413537 - DNA, 140 bp, Artificial Sequence
  Synthetic
atacgccatgctgggtctccggaaatactataataccttgcaagataagacaggtagtaagatcatggataaagggagagttaggactctatgcacctcccatcccaggtgatctaacatcgtacttgggagtcggccat

SEQ ID NO: 413538 - DNA, 140 bp, Artificial Sequence
  Synthetic
atggccgactcccaagtacgatgttagatcacctgggatgggaggtgcatagagtcctaactctccctttatccatgatcttactacctgtcttatcttgcaaggtattatagtatttccggagacccagcatggcgtat

SEQ ID NO: 413539 - DNA, 140 bp, Artificial Sequence
  Synthetic
atacgccatgctgggtctccaacaacaatacaagaaaaagtataacatttggaccaggacaagcgttctatgcaacaaatgatatcataggagacataagacaagcatattgtaatgttacgtacttgggagtcggccat

SEQ ID NO: 413540 - DNA, 140 bp, Artificial Sequence
  Synthetic
atggccgactcccaagtacgtaacattacaatatgcttgtcttatgtctcctatgatatcatttgttgcatagaacgcttgtcctggtccaaatgttatactttttcttgtattgttgttggagacccagcatggcgtat

SEQ ID NO: 413541 - DNA, 140 bp, Artificial Sequence
  Synthetic
aggccctggctgctgatatgccagcagcagagggagtaggagcagcatctcaagacttagataaatatggagcacttacaagcagcaacacagctcacaataatgctgattgtgcctggtgaccttttgggacagcggtg

SEQ ID NO: 413542 - DNA, 140 bp, Artificial Sequence
  Synthetic
caccgctgtcccaaaaggtcaccaggcacaatcagcattattgtgagctgtgttgctgcttgtaagtgctccatatttatctaagtcttgagatgctgctcctactccctctgctgctggcatatcagcagccagggcct

SEQ ID NO: 413543 - DNA, 140 bp, Artificial Sequence
  Synthetic
atacgccatgctgggtctccatgactccctgaaagaagatgtaggggcaataaaaaattgttctttcaaaataaccacagaagtaagagataagactagagaagcagcggcacttttttacgtacttgggagtcggccat

SEQ ID NO: 413544 - DNA, 140 bp, Artificial Sequence
  Synthetic
atggccgactcccaagtacgtaaaaaagtgccgctgcttctctagtcttatctcttacttctgtggttattttgaaagaacaattttttattgcccctacatcttctttcagggagtcatggagacccagcatggcgtat

SEQ ID NO: 413545 - DNA, 140 bp, Artificial Sequence
  Synthetic
atacgccatgctgggtctccggacctagaaattacaacacatagtttcaattgccaaggagagtttttctattgtaatacaacaggactgtttaatatatcaagtaatgaactaaataatcgtacttgggagtcggccat

SEQ ID NO: 413546 - DNA, 140 bp, Artificial Sequence
  Synthetic
atggccgactcccaagtacgattatttagttcattacttgatatattaaacagtcctgttgtattacaatagaaaaactctccttggcaattgaaactatgtgttgtaatttctaggtccggagacccagcatggcgtat

SEQ ID NO: 413547 - DNA, 140 bp, Artificial Sequence
  Synthetic
aggccctggctgctgatatgaattgtagaggagaatttttctattgcaatacatcaaacctgtttaatagtacatactaccctaagaatggtacatacaaatacaatggtaattcaagctgaccttttgggacagcggtg

SEQ ID NO: 413548 - DNA, 140 bp, Artificial Sequence
  Synthetic
caccgctgtcccaaaaggtcagcttgaattaccattgtatttgtatgtaccattcttagggtagtatgtactattaaacaggtttgatgtattgcaatagaaaaattctcctctacaattcatatcagcagccagggcct

SEQ ID NO: 413549 - DNA, 140 bp, Artificial Sequence
  Synthetic
atacgccatgctgggtctccagacatttggaataacatgacctggatgcagtgggataaagaaattaataattacacaaacataatatacatgttgcttgaagaatcgcaggtccagcagcgtacttgggagtcggccat

SEQ ID NO: 413550 - DNA, 140 bp, Artificial Sequence
  Synthetic
atggccgactcccaagtacgctgctggacctgcgattcttcaagcaacatgtatattatgtttgtgtaattattaatttctttatcccactgcatccaggtcatgttattccaaatgtctggagacccagcatggcgtat

SEQ ID NO: 413551 - DNA, 140 bp, Artificial Sequence
  Synthetic
atacgccatgctgggtctccacatcagcaaaatggaacaacacatgggcaaactggactgacagtgcttgggacaacttaacatggcagcaatgggaccaacaaatagatgaatatagcgcgtacttgggagtcggccat

SEQ ID NO: 413552 - DNA, 140 bp, Artificial Sequence
  Synthetic
atggccgactcccaagtacgcgctatattcatctatttgttggtcccattgctgccatgttaagttgtcccaagcactgtcagtccagtttgcccatgtgttgttccattttgctgatgtggagacccagcatggcgtat

SEQ ID NO: 413553 - DNA, 140 bp, Artificial Sequence
  Synthetic
atacgccatgctgggtctccatatatttaggaccagggcatgcatttcatgcaacagaaaatataataggagacatcagaaaggcacattgtaacgttagtggagaacaatggaataaaacgtacttgggagtcggccat

SEQ ID NO: 413554 - DNA, 140 bp, Artificial Sequence
  Synthetic
atggccgactcccaagtacgttttattccattgttctccactaacgttacaatgtgcctttctgatgtctcctattatattttctgttgcatgaaatgcatgccctggtcctaaatatatggagacccagcatggcgtat

SEQ ID NO: 413555 - DNA, 140 bp, Artificial Sequence
  Synthetic
atacgccatgctgggtctccaacattaggcagggatatcaacccctctcgttgcagatccccatcccacaccaggaggaagcagaaacgccaggaagaacaggagaagaaggtggaggcgcgtacttgggagtcggccat

SEQ ID NO: 413556 - DNA, 140 bp, Artificial Sequence
  Synthetic
atggccgactcccaagtacgcgcctccaccttcttctcctgttcttcctggcgtttctgcttcctcctggtgtgggatggggatctgcaacgagaggggttgatatccctgcctaatgttggagacccagcatggcgtat

SEQ ID NO: 413557 - DNA, 140 bp, Artificial Sequence
  Synthetic
atacgccatgctgggtctcctacacggatctcaggacaataatcttgtggacttaccacctcttgagcaacttagcatcagggatccagaggctgatcagctacctgggacttggactgtcgtacttgggagtcggccat

SEQ ID NO: 413558 - DNA, 140 bp, Artificial Sequence
  Synthetic
atggccgactcccaagtacgacagtccaagtcccaggtagctgatcagcctctggatccctgatgctaagttgctcaagaggtggtaagtccacaagattattgtcctgagatccgtgtaggagacccagcatggcgtat

SEQ ID NO: 413559 - DNA, 140 bp, Artificial Sequence
  Synthetic
aggccctggctgctgatatggaaaagaatgaacaagatttattggcattggacaagtgggcaagtttgtggaattggtttgacatatcaaattggctatggtatataaaaatctttataagaccttttgggacagcggtg

SEQ ID NO: 413560 - DNA, 140 bp, Artificial Sequence
  Synthetic
caccgctgtcccaaaaggtcttataaagatttttatataccatagccaatttgatatgtcaaaccaattccacaaacttgcccacttgtccaatgccaataaatcttgttcattcttttccatatcagcagccagggcct

SEQ ID NO: 413561 - DNA, 140 bp, Artificial Sequence
  Synthetic
atacgccatgctgggtctccacacaatactggttacaagaattgcgggctagcgctacaaatctgcttgatactattgcagtggcagttggcaattggactgacagcatcatcttaggtacgtacttgggagtcggccat

SEQ ID NO: 413562 - DNA, 140 bp, Artificial Sequence
  Synthetic
atggccgactcccaagtacgtacctaagatgatgctgtcagtccaattgccaactgccactgcaatagtatcaagcagatttgtagcgctagcccgcaattcttgtaaccagtattgtgtggagacccagcatggcgtat

SEQ ID NO: 413563 - DNA, 140 bp, Artificial Sequence
  Synthetic
aggccctggctgctgatatgaatttgcaggatggtcagaagtaagaaggagaattagacaatcctcccctgatcctcaaccatgtgcacctggagtaggagcagtctccagagagctagcgaccttttgggacagcggtg

SEQ ID NO: 413564 - DNA, 140 bp, Artificial Sequence
  Synthetic
caccgctgtcccaaaaggtcgctagctctctggagactgctcctactccaggtgcacatggttgaggatcaggggaggattgtctaattctccttcttacttctgaccatcctgcaaattcatatcagcagccagggcct

SEQ ID NO: 413565 - DNA, 140 bp, Artificial Sequence
  Synthetic
atacgccatgctgggtctccttgcatttctagaaagccacacagatgaggaggtaggtttcccagtaaaacctcaagtgcctctaaggccaatgacctataaagcagcttttgacctcagcgtacttgggagtcggccat

SEQ ID NO: 413566 - DNA, 140 bp, Artificial Sequence
  Synthetic
atggccgactcccaagtacgctgaggtcaaaagctgctttataggtcattggccttagaggcacttgaggttttactgggaaacctacctcctcatctgtgtggctttctagaaatgcaaggagacccagcatggcgtat

SEQ ID NO: 413567 - DNA, 140 bp, Artificial Sequence
  Synthetic
aggccctggctgctgatatgtagaagtagtacaaagagcttgcagagctattcgcaacgtaccaagaagaataagacaagggtttgaaagagctttgctataaaatgggaggcaagtggtgaccttttgggacagcggtg

SEQ ID NO: 413568 - DNA, 140 bp, Artificial Sequence
  Synthetic
caccgctgtcccaaaaggtcaccacttgcctcccattttatagcaaagctctttcaaacccttgtcttattcttcttggtacgttgcgaatagctctgcaagctctttgtactacttctacatatcagcagccagggcct

SEQ ID NO: 413569 - DNA, 140 bp, Artificial Sequence
  Synthetic
atacgccatgctgggtctccacccctgtagcagcagaagaaggagcagcagaaggagtaggaccagcatctcaagatttagctaggcatggagcgatcacaagcagcaatacagctgccacgtacttgggagtcggccat

SEQ ID NO: 413570 - DNA, 140 bp, Artificial Sequence
  Synthetic
atggccgactcccaagtacgtggcagctgtattgctgcttgtgatcgctccatgcctagctaaatcttgagatgctggtcctactccttctgctgctccttcttctgctgctacaggggtggagacccagcatggcgtat

SEQ ID NO: 413571 - DNA, 140 bp, Artificial Sequence
  Synthetic
atacgccatgctgggtctcctcaggggtaggctttccagtcaaaccacaggtacctttaagaccaatgacttttaaagcggcttttgatctcagcttctttttaaaagaaaaggggggaccgtacttgggagtcggccat

SEQ ID NO: 413572 - DNA, 140 bp, Artificial Sequence
  Synthetic
atggccgactcccaagtacggtccccccttttcttttaaaaagaagctgagatcaaaagccgctttaaaagtcattggtcttaaaggtacctgtggtttgactggaaagcctacccctgaggagacccagcatggcgtat

SEQ ID NO: 413573 - DNA, 140 bp, Artificial Sequence
  Synthetic
atacgccatgctgggtctcctgagccttatctgggacgacctgaggaacctgtgccttttcagctaccgccacttgagagacttcatattgattgtagcgaggattgtgaaccggatcctcgtacttgggagtcggccat

SEQ ID NO: 413574 - DNA, 140 bp, Artificial Sequence
  Synthetic
atggccgactcccaagtacgaggatccggttcacaatcctcgctacaatcaatatgaagtctctcaagtggcggtagctgaaaaggcacaggttcctcaggtcgtcccagataaggctcaggagacccagcatggcgtat

SEQ ID NO: 413575 - DNA, 140 bp, Artificial Sequence
  Synthetic
aggccctggctgctgatatgattcggttaaggccagggggaaagaaaaaatatagactgaaacatttagtatgggcaagcagggagctggaaaaattctcaattaaccctggccttttaggaccttttgggacagcggtg

SEQ ID NO: 413576 - DNA, 140 bp, Artificial Sequence
  Synthetic
caccgctgtcccaaaaggtcctaaaaggccagggttaattgagaatttttccagctccctgcttgcccatactaaatgtttcagtctatattttttctttccccctggccttaaccgaatcatatcagcagccagggcct

SEQ ID NO: 413577 - DNA, 140 bp, Artificial Sequence
  Synthetic
aggccctggctgctgatatgtagcaactctctattgtgtacatgcaaagatagaggtacgagacaccaaggaagccttagacaagatagaggaagaacaaaacaaaagtcagcaaaaaacgaccttttgggacagcggtg

SEQ ID NO: 413578 - DNA, 140 bp, Artificial Sequence
  Synthetic
caccgctgtcccaaaaggtcgttttttgctgacttttgttttgttcttcctctatcttgtctaaggcttccttggtgtctcgtacctctatctttgcatgtacacaatagagagttgctacatatcagcagccagggcct

SEQ ID NO: 413579 - DNA, 140 bp, Artificial Sequence
  Synthetic
aggccctggctgctgatatgtcaaaattaccctatagtgcaaaatgcacaagggcaaatggtacaccaggctatatcacctaggactttgaatgcatgggtcaaagtagtagaagaaaaggaccttttgggacagcggtg

SEQ ID NO: 413580 - DNA, 140 bp, Artificial Sequence
  Synthetic
caccgctgtcccaaaaggtccttttcttctactactttgacccatgcattcaaagtcctaggtgatatagcctggtgtaccatttgcccttgtgcattttgcactatagggtaattttgacatatcagcagccagggcct

SEQ ID NO: 413581 - DNA, 140 bp, Artificial Sequence
  Synthetic
aggccctggctgctgatatgaaataggatggatgaccagcaacccacctatcccagtgggagaaatctataaaagatggataatcctgggattaaataaaatagtaagaatgtatagcccgaccttttgggacagcggtg

SEQ ID NO: 413582 - DNA, 140 bp, Artificial Sequence
  Synthetic
caccgctgtcccaaaaggtcgggctatacattcttactattttatttaatcccaggattatccatcttttatagatttctcccactgggataggtgggttgctggtcatccatcctatttcatatcagcagccagggcct

SEQ ID NO: 413583 - DNA, 140 bp, Artificial Sequence
  Synthetic
aggccctggctgctgatatggaaaaaattcggttaaggccggggggaaagaaaaaatatagaatgaagcatctaatatgggcaagcagggagctagaacgatttgcaattgatcctggccgaccttttgggacagcggtg

SEQ ID NO: 413584 - DNA, 140 bp, Artificial Sequence
  Synthetic
caccgctgtcccaaaaggtcggccaggatcaattgcaaatcgttctagctccctgcttgcccatattagatgcttcattctatattttttctttccccccggccttaaccgaattttttccatatcagcagccagggcct

SEQ ID NO: 413585 - DNA, 140 bp, Artificial Sequence
  Synthetic
aggccctggctgctgatatgtgtcagcattttggacataagacaagggccaaaagaaccctttagagactatgtagataggttctttaaaactctcagagctgagcaagctacacaggaggaccttttgggacagcggtg

SEQ ID NO: 413586 - DNA, 140 bp, Artificial Sequence
  Synthetic
caccgctgtcccaaaaggtcctcctgtgtagcttgctcagctctgagagttttaaagaacctatctacatagtctctaaagggttcttttggcccttgtcttatgtccaaaatgctgacacatatcagcagccagggcct

SEQ ID NO: 413587 - DNA, 140 bp, Artificial Sequence
  Synthetic
atacgccatgctgggtctccagtcctctactttgtacatcaaaaggtagatgtaaaagataccaaggaagctttagagaagctagagcaagaacaaaacagaagtcagcaaaagacacagcgtacttgggagtcggccat

SEQ ID NO: 413588 - DNA, 140 bp, Artificial Sequence
  Synthetic
atggccgactcccaagtacgctgtgtcttttgctgacttctgttttgttcttgctctagcttctctaaagcttccttggtatcttttacatctaccttttgatgtacaaagtagaggactggagacccagcatggcgtat

SEQ ID NO: 413589 - DNA, 140 bp, Artificial Sequence
  Synthetic
atacgccatgctgggtctccgataatacaagctatacattgataaattgtaacacctcagtcattacgcaggcctgtccaaaggtatcctttgaaccaattcccatacattattgtgccccgtacttgggagtcggccat

SEQ ID NO: 413590 - DNA, 140 bp, Artificial Sequence
  Synthetic
atggccgactcccaagtacggggcacaataatgtatgggaattggttcaaaggatacctttggacaggcctgcgtaatgactgaggtgttacaatttatcaatgtatagcttgtattatcggagacccagcatggcgtat

SEQ ID NO: 413591 - DNA, 140 bp, Artificial Sequence
  Synthetic
aggccctggctgctgatatgtgcacagttttacttgtggaggggaatttttttactgtaatacaacaaagctgtttaatagtacttggaatgataatagtactggagaggctactagtacgaccttttgggacagcggtg

SEQ ID NO: 413592 - DNA, 140 bp, Artificial Sequence
  Synthetic
caccgctgtcccaaaaggtcgtactagtagcctctccagtactattatcattccaagtactattaaacagctttgttgtattacagtaaaaaaattcccctccacaagtaaaactgtgcacatatcagcagccagggcct

SEQ ID NO: 413593 - DNA, 140 bp, Artificial Sequence
  Synthetic
atacgccatgctgggtctccgacactaatatcagtattggtagcgggggaacaatggagaaaggagaaatgacaaactgctctttcaatgtcaccacagaaataagagataaggtgcagacgtacttgggagtcggccat

SEQ ID NO: 413594 - DNA, 140 bp, Artificial Sequence
  Synthetic
atggccgactcccaagtacgtctgcaccttatctcttatttctgtggtgacattgaaagagcagtttgtcatttctcctttctccattgttcccccgctaccaatactgatattagtgtcggagacccagcatggcgtat

SEQ ID NO: 413595 - DNA, 140 bp, Artificial Sequence
  Synthetic
atacgccatgctgggtctcctgtatgggaagatgcaacaccagtactattctgtgcttcagatgctaatttgacaagcactgaaaagcataatgtttgggcatcacaagcctgcgttccccgtacttgggagtcggccat

SEQ ID NO: 413596 - DNA, 140 bp, Artificial Sequence
  Synthetic
atggccgactcccaagtacggggaacgcaggcttgtgatgcccaaacattatgcttttcagtgcttgtcaaattagcatctgaagcacagaatagtactggtgttgcatcttcccatacaggagacccagcatggcgtat

SEQ ID NO: 413597 - DNA, 140 bp, Artificial Sequence
  Synthetic
aggccctggctgctgatatggtttatgggatcaaagtttaaagccttgtgtgcaaatgactttcttatgtgtacaaatgaactgtacagagctgagtaatagcagtgcatcaaacacaacgaccttttgggacagcggtg

SEQ ID NO: 413598 - DNA, 140 bp, Artificial Sequence
  Synthetic
caccgctgtcccaaaaggtcgttgtgtttgatgcactgctattactcagctctgtacagttcatttgtacacataagaaagtcatttgcacacaaggctttaaactttgatcccataaaccatatcagcagccagggcct

SEQ ID NO: 413599 - DNA, 140 bp, Artificial Sequence
  Synthetic
aggccctggctgctgatatgatagtacagctgaacgaatctgtagtaattaattgtacaagacccaacaacaatacaagaaaaggtatacatataggaccagggagagcattttatgcaagaccttttgggacagcggtg

SEQ ID NO: 413600 - DNA, 140 bp, Artificial Sequence
  Synthetic
caccgctgtcccaaaaggtcttgcataaaatgctctccctggtcctatatgtataccttttcttgtattgttgttgggtcttgtacaattaattactacagattcgttcagctgtactatcatatcagcagccagggcct

SEQ ID NO: 413601 - DNA, 140 bp, Artificial Sequence
  Synthetic
atacgccatgctgggtctccatttgccaggaaaatggaaaccaaaaatgatagggggaattggaggttttatcaaagtaaaacagtatgataacatacccatagaaatttgtggacacaacgtacttgggagtcggccat

SEQ ID NO: 413602 - DNA, 140 bp, Artificial Sequence
  Synthetic
atggccgactcccaagtacgttgtgtccacaaatttctatgggtatgttatcatactgttttactttgataaaacctccaattccccctatcatttttggtttccattttcctggcaaatggagacccagcatggcgtat

SEQ ID NO: 413603 - DNA, 140 bp, Artificial Sequence
  Synthetic
aggccctggctgctgatatggacttagaaatagggcagcatagagcaaaaatagaggagttaagagaacatctattgagatggggatttaccacaccagataaaaaacatcagaaagaacgaccttttgggacagcggtg

SEQ ID NO: 413604 - DNA, 140 bp, Artificial Sequence
  Synthetic
caccgctgtcccaaaaggtcgttctttctgatgttttttatctggtgtggtaaatccccatctcaatagatgttctcttaactcctctatttttgctctatgctgccctatttctaagtccatatcagcagccagggcct

SEQ ID NO: 413605 - DNA, 140 bp, Artificial Sequence
  Synthetic
aggccctggctgctgatatgctccattcctttggatgggatatgagctccatcctgacaaatggacagtacaacctatacagctgccagacaaggaaagctggactgtcaatgatatacagaccttttgggacagcggtg

SEQ ID NO: 413606 - DNA, 140 bp, Artificial Sequence
  Synthetic
caccgctgtcccaaaaggtctgtatatcattgacagtccagctttccttgtctggcagctgtataggttgtactgtccatttgtcaggatggagctcatatcccatccaaaggaatggagcatatcagcagccagggcct

SEQ ID NO: 413607 - DNA, 140 bp, Artificial Sequence
  Synthetic
aggccctggctgctgatatgttataaacatgtggcaggaagtaggaaaagcaatgtatgcccctcccatcagaggacaaattagatgttcatcaaatattacagggctgctattaacaaggaccttttgggacagcggtg

SEQ ID NO: 413608 - DNA, 140 bp, Artificial Sequence
  Synthetic
caccgctgtcccaaaaggtccttgttaatagcagccctgtaatatttgatgaacatctaatttgtcctctgatgggaggggcatacattgcttttcctacttcctgccacatgtttataacatatcagcagccagggcct

SEQ ID NO: 413609 - DNA, 140 bp, Artificial Sequence
  Synthetic
aggccctggctgctgatatgcaaagaatttgtagaggtatcctcaacatacctagaagaataagacagggcttagaaagggctttgctataagatgggtggcaagtggtcaaaatgtagtgaccttttgggacagcggtg

SEQ ID NO: 413610 - DNA, 140 bp, Artificial Sequence
  Synthetic
caccgctgtcccaaaaggtcactacattttgaccacttgccacccatcttatagcaaagccctttctaagccctgtcttattcttctaggtatgttgaggatacctctacaaattctttgcatatcagcagccagggcct

SEQ ID NO: 413611 - DNA, 140 bp, Artificial Sequence
  Synthetic
aggccctggctgctgatatgtagacaactccgagctcgcctgcaagccttagaaacccttatacagaatcagcaacgcctaagcctatggggatgtaaaggaaggataatatgttacacagaccttttgggacagcggtg

SEQ ID NO: 413612 - DNA, 140 bp, Artificial Sequence
  Synthetic
caccgctgtcccaaaaggtctgtgtaacatattatccttcctttacatccccataggcttaggcgttgctgattctgtataagggtttctaaggcttgcaggcgagctcggagttgtctacatatcagcagccagggcct

SEQ ID NO: 413613 - DNA, 140 bp, Artificial Sequence
  Synthetic
aggccctggctgctgatatggtgtcactttaaattgtacaaaagttacctacaacacaagtgttacccacaatactagtgacgaagtaagaaattgctctttcaatgcaaccacagaaatgaccttttgggacagcggtg

SEQ ID NO: 413614 - DNA, 140 bp, Artificial Sequence
  Synthetic
caccgctgtcccaaaaggtcatttctgtggttgcattgaaagagcaatttcttacttcgtcactagtattgtgggtaacacttgtgttgtaggtaacttttgtacaatttaaagtgacaccatatcagcagccagggcct

SEQ ID NO: 413615 - DNA, 140 bp, Artificial Sequence
  Synthetic
aggccctggctgctgatatgtaaggtcatggataaaaggagaatcaggactctatgcacctcccatccaaggtcaattaacatgtagatcaaacataactggaatgattctacaaatggagaccttttgggacagcggtg

SEQ ID NO: 413616 - DNA, 140 bp, Artificial Sequence
  Synthetic
caccgctgtcccaaaaggtctccatttgtagaatcattccagttatgtttgatctacatgttaattgaccttggatgggaggtgcatagagtcctgattctccttttatccatgaccttacatatcagcagccagggcct

SEQ ID NO: 413617 - DNA, 140 bp, Artificial Sequence
  Synthetic
aggccctggctgctgatatgcccaacaataatacaagaaaaagtataaggataggaccaggacaaacattctatgcaacaggtgaaataataggaaacataagacaagcatattgtaacagaccttttgggacagcggtg

SEQ ID NO: 413618 - DNA, 140 bp, Artificial Sequence
  Synthetic
caccgctgtcccaaaaggtctgttacaatatgcttgtcttatgtttcctattatttcacctgttgcatagaatgtttgtcctggtcctatccttatactttttcttgtattattgttgggcatatcagcagccagggcct

SEQ ID NO: 413619 - DNA, 140 bp, Artificial Sequence
  Synthetic
atacgccatgctgggtctccaaagaacatttccctaataaaaatataacattcgacaaacacgcaggaggggatctagaagttacaacacatagctttaattgtagaggagaatttttctcgtacttgggagtcggccat

SEQ ID NO: 413620 - DNA, 140 bp, Artificial Sequence
  Synthetic
atggccgactcccaagtacgagaaaaattctcctctacaattaaagctatgtgttgtaacttctagatcccctcctgcgtgtttgtcgaatgttatatttttattagggaaatgttctttggagacccagcatggcgtat

SEQ ID NO: 413621 - DNA, 140 bp, Artificial Sequence
  Synthetic
aggccctggctgctgatatgcctgaaatctctctggaacgcaatagcagtactctggtgcgttcacaacagatttgacatccgagatacacagcaggcaatacaaaagttaaaggaagtagaccttttgggacagcggtg

SEQ ID NO: 413622 - DNA, 140 bp, Artificial Sequence
  Synthetic
caccgctgtcccaaaaggtctacttcctttaacttttgtattgcctgctgtgtatctcggatgtcaaatctgttgtgaacgcaccagagtactgctattgcgttccagagagatttcaggcatatcagcagccagggcct

SEQ ID NO: 413623 - DNA, 140 bp, Artificial Sequence
  Synthetic
atacgccatgctgggtctccggagacatctatagaaaatggatagtgctaggactaaacaaaatggtaaaaatgtacagtccagtgagcatcttagatattaggcagggaccaaaagaaccgtacttgggagtcggccat

SEQ ID NO: 413624 - DNA, 140 bp, Artificial Sequence
  Synthetic
atggccgactcccaagtacggttcttttggtccctgcctaatatctaagatgctcactggactgtacatttttaccattttgtttagtcctagcactatccattttctatagatgtctccggagacccagcatggcgtat

SEQ ID NO: 413625 - DNA, 140 bp, Artificial Sequence
  Synthetic
atacgccatgctgggtctccctttagaagaaatgatggtagcctgtcaaggagtaggagggccaactcacaaggcaaaaatactagcagaagcaatggcttctgcccagcaagatttaaacgtacttgggagtcggccat

SEQ ID NO: 413626 - DNA, 140 bp, Artificial Sequence
  Synthetic
atggccgactcccaagtacgtttaaatcttgctgggcagaagccattgcttctgctagtatttttgccttgtgagttggccctcctactccttgacaggctaccatcatttcttctaaagggagacccagcatggcgtat

SEQ ID NO: 413627 - DNA, 140 bp, Artificial Sequence
  Synthetic
atacgccatgctgggtctccataccaggattgaagaaatgaaaaattgctctttcaatacaaccacagaaatacaagataaaaaaaggaaagagcatgcacttttttataaacttgatatcgtacttgggagtcggccat

SEQ ID NO: 413628 - DNA, 140 bp, Artificial Sequence
  Synthetic
atggccgactcccaagtacgatatcaagtttataaaaaagtgcatgctctttcctttttttatcttgtatttctgtggttgtattgaaagagcaatttttcatttcttcaatcctggtatggagacccagcatggcgtat

SEQ ID NO: 413629 - DNA, 140 bp, Artificial Sequence
  Synthetic
atacgccatgctgggtctccaagaaatgaaaaactgctcttacaatattaccacagaactaagagataagacaaagacagtcaggtcattgttttatacacttgatatagtacaaattaacgtacttgggagtcggccat

SEQ ID NO: 413630 - DNA, 140 bp, Artificial Sequence
  Synthetic
atggccgactcccaagtacgttaatttgtactatatcaagtgtataaaacaatgacctgactgtctttgtcttatctcttagttctgtggtaatattgtaagagcagtttttcatttcttggagacccagcatggcgtat

SEQ ID NO: 413631 - DNA, 140 bp, Artificial Sequence
  Synthetic
aggccctggctgctgatatgaggaggaaggagaagtaggctttccagtcagacctcaggtgcctttaagaccaatgacttataaaggagcatttgatctcagcttctttttaaaagaaaagaccttttgggacagcggtg

SEQ ID NO: 413632 - DNA, 140 bp, Artificial Sequence
  Synthetic
caccgctgtcccaaaaggtcttttcttttaaaaagaagctgagatcaaatgctcctttataagtcattggtcttaaaggcacctgaggtctgactggaaagcctacttctccttcctcctcatatcagcagccagggcct

SEQ ID NO: 413633 - DNA, 140 bp, Artificial Sequence
  Synthetic
aggccctggctgctgatatgatacaagaaaaagtatacgctttggaccaggacaagccttctatacaaacagcataataggggatataagacaagcatattgtaacatcagcaaagcagggaccttttgggacagcggtg

SEQ ID NO: 413634 - DNA, 140 bp, Artificial Sequence
  Synthetic
caccgctgtcccaaaaggtccctgctttgctgatgttacaatatgcttgtcttatatcccctattatgctgtttgtatagaaggcttgtcctggtccaaagcgtatactttttcttgtatcatatcagcagccagggcct

SEQ ID NO: 413635 - DNA, 140 bp, Artificial Sequence
  Synthetic
aggccctggctgctgatatgtagatccagactttagaaaatacactgccttcactattcctagtgtgaacaatgagaccccaggagtaagataccagtacaatgtcctcccgcaagggtggaccttttgggacagcggtg

SEQ ID NO: 413636 - DNA, 140 bp, Artificial Sequence
  Synthetic
caccgctgtcccaaaaggtccacccttgcgggaggacattgtactggtatcttactcctggggtctcattgttcacactaggaatagtgaaggcagtgtattttctaaagtctggatctacatatcagcagccagggcct

SEQ ID NO: 413637 - DNA, 140 bp, Artificial Sequence
  Synthetic
atacgccatgctgggtctccgacaaaggggcaataaaaaactgctctttcaatatgaccacagaagtaagagataaacagcagaaagtacaggcacttttttataaacttgatatggtaccgtacttgggagtcggccat

SEQ ID NO: 413638 - DNA, 140 bp, Artificial Sequence
  Synthetic
atggccgactcccaagtacggtaccatatcaagtttataaaaaagtgcctgtactttctgctgtttatctcttacttctgtggtcatattgaaagagcagttttttattgcccctttgtcggagacccagcatggcgtat

SEQ ID NO: 413639 - DNA, 140 bp, Artificial Sequence
  Synthetic
atacgccatgctgggtctcccatttagaaaaagcaacccagaagtagaaatttatcagtacatagatgacttatatgtaggatcagatttaccattggcagaacatagaaagagggtcgacgtacttgggagtcggccat

SEQ ID NO: 413640 - DNA, 140 bp, Artificial Sequence
  Synthetic
atggccgactcccaagtacgtcgaccctctttctatgttctgccaatggtaaatctgatcctacatataagtcatctatgtactgataaatttctacttctgggttgctttttctaaatgggagacccagcatggcgtat

SEQ ID NO: 413641 - DNA, 140 bp, Artificial Sequence
  Synthetic
aggccctggctgctgatatggacaagtggacagtacagcccatccaattgcctgacaaagaagtgtggacagtaaatgatatacaaaaattagtaggaaaattaaattgggcaagtcaaagaccttttgggacagcggtg

SEQ ID NO: 413642 - DNA, 140 bp, Artificial Sequence
  Synthetic
caccgctgtcccaaaaggtctttgacttgcccaatttaattttcctactaatttttgtatatcatttactgtccacacttctttgtcaggcaattggatgggctgtactgtccacttgtccatatcagcagccagggcct

SEQ ID NO: 413643 - DNA, 140 bp, Artificial Sequence
  Synthetic
aggccctggctgctgatatgagtaaatgatatacaaaaattagtaggaaaattaaattgggcaagtcaaatctatcaaggaattagagtaaaagaattgtgcaagttaatcagaggaaccgaccttttgggacagcggtg

SEQ ID NO: 413644 - DNA, 140 bp, Artificial Sequence
  Synthetic
caccgctgtcccaaaaggtcggttcctctgattaacttgcacaattcttttactctaattccttgatagatttgacttgcccaatttaattttcctactaatttttgtatatcatttactcatatcagcagccagggcct

SEQ ID NO: 413645 - DNA, 140 bp, Artificial Sequence
  Synthetic
atacgccatgctgggtctccaagtatacatataggaccaggacgtgcatttcatacaacagacagaatagtaggagacatcagaaaagcacattgtaacgttagtagaggagaatggagtcgtacttgggagtcggccat

SEQ ID NO: 413646 - DNA, 140 bp, Artificial Sequence
  Synthetic
atggccgactcccaagtacgactccattctcctctactaacgttacaatgtgcttttctgatgtctcctactattctgtctgttgtatgaaatgcacgtcctggtcctatatgtatacttggagacccagcatggcgtat

SEQ ID NO: 413647 - DNA, 140 bp, Artificial Sequence
  Synthetic
atacgccatgctgggtctcctggacttaccaggtatatcaggatgaacataagaaccttaaaacaggaaaatatgctaggcaaaaggcctcccacacaaatgatataagacaattggcagcgtacttgggagtcggccat

SEQ ID NO: 413648 - DNA, 140 bp, Artificial Sequence
  Synthetic
atggccgactcccaagtacgctgccaattgtcttatatcatttgtgtgggaggccttttgcctagcatattttcctgttttaaggttcttatgttcatcctgatatacctggtaagtccaggagacccagcatggcgtat

SEQ ID NO: 413649 - DNA, 140 bp, Artificial Sequence
  Synthetic
aggccctggctgctgatatgtatagaagcagcacaaggagcttgtagagctattcgcaacgtaccaagaagaataagacaaggcttagaaagagctttgctataaaatggggagcaagtggaccttttgggacagcggtg

SEQ ID NO: 413650 - DNA, 140 bp, Artificial Sequence
  Synthetic
caccgctgtcccaaaaggtccacttgctccccattttatagcaaagctctttctaagccttgtcttattcttcttggtacgttgcgaatagctctacaagctccttgtgctgcttctatacatatcagcagccagggcct

SEQ ID NO: 413651 - DNA, 140 bp, Artificial Sequence
  Synthetic
aggccctggctgctgatatgaaacccctccagcagcagaaggagtaggagcagtatctcaagatttagctaggcatggagcaatcacaagcagcaatacagcagctaataatcctgattggaccttttgggacagcggtg

SEQ ID NO: 413652 - DNA, 140 bp, Artificial Sequence
  Synthetic
caccgctgtcccaaaaggtccaatcaggattattagctgctgtattgctgcttgtgattgctccatgcctagctaaatcttgagatactgctcctactccttctgctgctggaggggtttcatatcagcagccagggcct

SEQ ID NO: 413653 - DNA, 140 bp, Artificial Sequence
  Synthetic
atacgccatgctgggtctcctaaccccactctgtgttactttaaattgcactgacttgaagaatgctactaataccactagtagcagcggaataatagagggaggagaaataaaaaactgcgtacttgggagtcggccat

SEQ ID NO: 413654 - DNA, 140 bp, Artificial Sequence
  Synthetic
atggccgactcccaagtacgcagttttttatttctcctccctctattattccgctgctactagtggtattagtagcattcttcaagtcagtgcaatttaaagtaacacagagtggggttaggagacccagcatggcgtat

SEQ ID NO: 413655 - DNA, 140 bp, Artificial Sequence
  Synthetic
atacgccatgctgggtctcccacttttttataaacttgatgtagtaccactagaagatgctaatgatagtaccagctataggttgataagttgtaatacctcagtcactacacaggcctgcgtacttgggagtcggccat

SEQ ID NO: 413656 - DNA, 140 bp, Artificial Sequence
  Synthetic
atggccgactcccaagtacgcaggcctgtgtagtgactgaggtattacaacttatcaacctatagctggtactatcattagcatcttctagtggtactacatcaagtttataaaaaagtgggagacccagcatggcgtat

SEQ ID NO: 413657 - DNA, 140 bp, Artificial Sequence
  Synthetic
aggccctggctgctgatatgaaagaatagtgctattagcttgcttaacaccacagcaatagtagtagctgaggggacagatagaattatagaagctttgcaaagagctggtagagctgttgaccttttgggacagcggtg

SEQ ID NO: 413658 - DNA, 140 bp, Artificial Sequence
  Synthetic
caccgctgtcccaaaaggtcaacagctctaccagctctttgcaaagcttctataattctatctgtcccctcagctactactattgctgtggtgttaagcaagctaatagcactattctttcatatcagcagccagggcct

SEQ ID NO: 413659 - DNA, 140 bp, Artificial Sequence
  Synthetic
atacgccatgctgggtctccgcctggtgaaataccataaatacatgtctaagaaggccgcgaactggcgttataggcatcattatgaatccaggaatccaaaagtcagttcggcggtgtacgtacttgggagtcggccat

SEQ ID NO: 413660 - DNA, 140 bp, Artificial Sequence
  Synthetic
atggccgactcccaagtacgtacaccgccgaactgacttttggattcctggattcataatgatgcctataacgccagttcgcggccttcttagacatgtatttatggtatttcaccaggcggagacccagcatggcgtat

SEQ ID NO: 413661 - DNA, 140 bp, Artificial Sequence
  Synthetic
aggccctggctgctgatatgaggggtgggagcagtgtctcgagacttagaaagacggggggcagttacaagcagcaatactagagataataatcctgatgtggcctggctggaagcacaagaccttttgggacagcggtg

SEQ ID NO: 413662 - DNA, 140 bp, Artificial Sequence
  Synthetic
caccgctgtcccaaaaggtcttgtgcttccagccaggccacatcaggattattatctctagtattgctgcttgtaactgccccccgtctttctaagtctcgagacactgctcccacccctcatatcagcagccagggcct

SEQ ID NO: 413663 - DNA, 140 bp, Artificial Sequence
  Synthetic
aggccctggctgctgatatgtgccaggggaaagagaggaacacttgggacatggggttagtatagaatggcaatacaaggagtataaaacacagattgatcctgaaacagcagacaggatgaccttttgggacagcggtg

SEQ ID NO: 413664 - DNA, 140 bp, Artificial Sequence
  Synthetic
caccgctgtcccaaaaggtcatcctgtctgctgtttcaggatcaatctgtgttttatactccttgtattgccattctatactaaccccatgtcccaagtgttcctctctttcccctggcacatatcagcagccagggcct

SEQ ID NO: 413665 - DNA, 140 bp, Artificial Sequence
  Synthetic
atacgccatgctgggtctccagtcaggtagggacactacaattcttagccttgaaagcagtagtgaaagtaaaaagaaataagcctcccctacccagtgtccagagattaacagaagatacgtacttgggagtcggccat

SEQ ID NO: 413666 - DNA, 140 bp, Artificial Sequence
  Synthetic
atggccgactcccaagtacgtatcttctgttaatctctggacactgggtaggggaggcttatttctttttactttcactactgctttcaaggctaagaattgtagtgtccctacctgactggagacccagcatggcgtat

SEQ ID NO: 413667 - DNA, 140 bp, Artificial Sequence
  Synthetic
atacgccatgctgggtctccgatggaacaagccctggaaaatcagggaccagctagggagccattcaatgaatggacactagagctcctggaagagctgaaagaagaagcagtaagacatcgtacttgggagtcggccat

SEQ ID NO: 413668 - DNA, 140 bp, Artificial Sequence
  Synthetic
atggccgactcccaagtacgatgtcttactgcttcttctttcagctcttccaggagctctagtgtccattcattgaatggctccctagctggtccctgattttccagggcttgttccatcggagacccagcatggcgtat

SEQ ID NO: 413669 - DNA, 140 bp, Artificial Sequence
  Synthetic
aggccctggctgctgatatggtaatgctacagaaaacttgtgggtcacagtctattatggggtacctgtgtggaaagaagcaaccactactctattctgtgcatcagatgctaaagcatagaccttttgggacagcggtg

SEQ ID NO: 413670 - DNA, 140 bp, Artificial Sequence
  Synthetic
caccgctgtcccaaaaggtctatgctttagcatctgatgcacagaatagagtagtggttgcttctttccacacaggtaccccataatagactgtgacccacaagttttctgtagcattaccatatcagcagccagggcct

SEQ ID NO: 413671 - DNA, 140 bp, Artificial Sequence
  Synthetic
atacgccatgctgggtctccacccttgcgcaggaggagagggaaataaaaaactgcactttcaatatcacaacaggcttaaaagatagggtgaaacaagactatgcactttttaatagcccgtacttgggagtcggccat

SEQ ID NO: 413672 - DNA, 140 bp, Artificial Sequence
  Synthetic
atggccgactcccaagtacgggctattaaaaagtgcatagtcttgtttcaccctatcttttaagcctgttgtgatattgaaagtgcagttttttatttccctctcctcctgcgcaagggtggagacccagcatggcgtat

SEQ ID NO: 413673 - DNA, 140 bp, Artificial Sequence
  Synthetic
atacgccatgctgggtctcctagtgcaaagaaaacaagatagaagggagcaggaaatacttgaaagattaaggagaataaaggaaatcagggatgacagtgactatgaaagtaatgaagacgtacttgggagtcggccat

SEQ ID NO: 413674 - DNA, 140 bp, Artificial Sequence
  Synthetic
atggccgactcccaagtacgtcttcattactttcatagtcactgtcatccctgatttcctttattctccttaatctttcaagtatttcctgctcccttctatcttgttttctttgcactaggagacccagcatggcgtat

SEQ ID NO: 413675 - DNA, 140 bp, Artificial Sequence
  Synthetic
atacgccatgctgggtctccccatgtttgagttatagtaaacaattgtatgccacagtttattctggggtacctgtatgggaagaggcagcaccagtactattctgtgcttcagatgctacgtacttgggagtcggccat

SEQ ID NO: 413676 - DNA, 140 bp, Artificial Sequence
  Synthetic
atggccgactcccaagtacgtagcatctgaagcacagaatagtactggtgctgcctcttcccatacaggtaccccagaataaactgtggcatacaattgtttactataactcaaacatggggagacccagcatggcgtat

SEQ ID NO: 413677 - DNA, 140 bp, Artificial Sequence
  Synthetic
atacgccatgctgggtctccaaatgagacaataaatgagatgagaaattgtagttttaatgtaactacagtcctcacagacaaaaaggagcaaaaacaggctctattctatgtatcagatcgtacttgggagtcggccat

SEQ ID NO: 413678 - DNA, 140 bp, Artificial Sequence
  Synthetic
atggccgactcccaagtacgatctgatacatagaatagagcctgtttttgctcctttttgtctgtgaggactgtagttacattaaaactacaatttctcatctcatttattgtctcatttggagacccagcatggcgtat

SEQ ID NO: 413679 - DNA, 140 bp, Artificial Sequence
  Synthetic
aggccctggctgctgatatgtcctcacagacaaaaaggagcaaaaacaggctctattctatgtatcagatctgagtaaggttaatgactcaaatgcagtaaatggaacaacatatatgttgaccttttgggacagcggtg

SEQ ID NO: 413680 - DNA, 140 bp, Artificial Sequence
  Synthetic
caccgctgtcccaaaaggtcaacatatatgttgttccatttactgcatttgagtcattaaccttactcagatctgatacatagaatagagcctgtttttgctcctttttgtctgtgaggacatatcagcagccagggcct

SEQ ID NO: 413681 - DNA, 140 bp, Artificial Sequence
  Synthetic
atacgccatgctgggtctccagtggttacttgtacacatggcatcaagccaacagtaagtactcaactaatactgaatgggacactctctagagaaaagataagaattatgggaaaaaatcgtacttgggagtcggccat

SEQ ID NO: 413682 - DNA, 140 bp, Artificial Sequence
  Synthetic
atggccgactcccaagtacgattttttcccataattcttatcttttctctagagagtgtcccattcagtattagttgagtacttactgttggcttgatgccatgtgtacaagtaaccactggagacccagcatggcgtat

SEQ ID NO: 413683 - DNA, 140 bp, Artificial Sequence
  Synthetic
aggccctggctgctgatatgtactgaatgggacactctctagagaaaagataagaattatgggaaaaaatattacagaatcagcaaagaatatcatagtaaccctaaacactcctataaagaccttttgggacagcggtg

SEQ ID NO: 413684 - DNA, 140 bp, Artificial Sequence
  Synthetic
caccgctgtcccaaaaggtctttataggagtgtttagggttactatgatattctttgctgattctgtaatattttttcccataattcttatcttttctctagagagtgtcccattcagtacatatcagcagccagggcct

SEQ ID NO: 413685 - DNA, 140 bp, Artificial Sequence
  Synthetic
atacgccatgctgggtctccgtccaatgagatggcgcagtatgacacttaaaagaagtaacaatacatcaccaagatcaagggtagcttattgtacatataataagactgtatgggaaaacgtacttgggagtcggccat

SEQ ID NO: 413686 - DNA, 140 bp, Artificial Sequence
  Synthetic
atggccgactcccaagtacgttttcccatacagtcttattatatgtacaataagctacccttgatcttggtgatgtattgttacttcttttaagtgtcatactgcgccatctcattggacggagacccagcatggcgtat

SEQ ID NO: 413687 - DNA, 140 bp, Artificial Sequence
  Synthetic
aggccctggctgctgatatgccaagatcaagggtagcttattgtacatataataagactgtatgggaaaatgccctacaacaaacagctataaggtatttaaatcttgtaaaccaaacaggaccttttgggacagcggtg

SEQ ID NO: 413688 - DNA, 140 bp, Artificial Sequence
  Synthetic
caccgctgtcccaaaaggtcctgtttggtttacaagatttaaataccttatagctgtttgttgtagggcattttcccatacagtcttattatatgtacaataagctacccttgatcttggcatatcagcagccagggcct

SEQ ID NO: 413689 - DNA, 140 bp, Artificial Sequence
  Synthetic
atacgccatgctgggtctccagccatttacattttaactgtcatggagaattcttttattgtaacacatctgggatgtttaactatacttttatcaactgtacaaagtccggatgccaggcgtacttgggagtcggccat

SEQ ID NO: 413690 - DNA, 140 bp, Artificial Sequence
  Synthetic
atggccgactcccaagtacgcctggcatccggactttgtacagttgataaaagtatagttaaacatcccagatgtgttacaataaaagaattctccatgacagttaaaatgtaaatggctggagacccagcatggcgtat

SEQ ID NO: 413691 - DNA, 140 bp, Artificial Sequence
  Synthetic
atacgccatgctgggtctccttaagacagctagtaagatcatggatgaagggagagtcgagaatctatgcacctcccatccccggcaacttaacatgtcattccaacataactggaatgacgtacttgggagtcggccat

SEQ ID NO: 413692 - DNA, 140 bp, Artificial Sequence
  Synthetic
atggccgactcccaagtacgtcattccagttatgttggaatgacatgttaagttgccggggatgggaggtgcatagattctcgactctcccttcatccatgatcttactagctgtcttaaggagacccagcatggcgtat

SEQ ID NO: 413693 - DNA, 140 bp, Artificial Sequence
  Synthetic
atacgccatgctgggtctccccagtagggggagatatgaaagatatatggagaactaaattgtacaactacaaagtagtacagataaaaccttttagtgtagcacctacaaaaatgtcaacgtacttgggagtcggccat

SEQ ID NO: 413694 - DNA, 140 bp, Artificial Sequence
  Synthetic
atggccgactcccaagtacgttgacatttttgtaggtgctacactaaaaggttttatctgtactactttgtagttgtacaatttagttctccatatatctttcatatctccccctactggggagacccagcatggcgtat

SEQ ID NO: 413695 - DNA, 140 bp, Artificial Sequence
  Synthetic
atacgccatgctgggtctccatgggaccaacacataaacaatgtaagctccattatatatgatgaaatacaagcagcacaagaccaacaggaaaagaatgtaaaagcattgttggagctacgtacttgggagtcggccat

SEQ ID NO: 413696 - DNA, 140 bp, Artificial Sequence
  Synthetic
atggccgactcccaagtacgtagctccaacaatgcttttacattcttttcctgttggtcttgtgctgcttgtatttcatcatatataatggagcttacattgtttatgtgttggtcccatggagacccagcatggcgtat

SEQ ID NO: 413697 - DNA, 140 bp, Artificial Sequence
  Synthetic
aggccctggctgctgatatgttgtacacatttagaaggaaaagtcatcctggtagcagtccatgtagccagtggctacatagaagcagaagttatcccagcagaaacaggacaagaaacagaccttttgggacagcggtg

SEQ ID NO: 413698 - DNA, 140 bp, Artificial Sequence
  Synthetic
caccgctgtcccaaaaggtctgtttcttgtcctgtttctgctgggataacttctgcttctatgtagccactggctacatggactgctaccaggatgacttttccttctaaatgtgtacaacatatcagcagccagggcct

SEQ ID NO: 413699 - DNA, 140 bp, Artificial Sequence
  Synthetic
atacgccatgctgggtctccttgaagcttgtagactttgtggagctgtaatgcaatattggctacaagaattgaaaaatagtgctacaaacctgcttgatactattgcagtgtcagttgccgtacttgggagtcggccat

SEQ ID NO: 413700 - DNA, 140 bp, Artificial Sequence
  Synthetic
atggccgactcccaagtacggcaactgacactgcaatagtatcaagcaggtttgtagcactatttttcaattcttgtagccaatattgcattacagctccacaaagtctacaagcttcaaggagacccagcatggcgtat

SEQ ID NO: 413701 - DNA, 140 bp, Artificial Sequence
  Synthetic
atacgccatgctgggtctcctccttcacatcccaagaagaattagacaaggtgcagaaagaatcttagtgtaacatggggaatgcatggagcaaaagcaaatttgcaggatggtcagaagcgtacttgggagtcggccat

SEQ ID NO: 413702 - DNA, 140 bp, Artificial Sequence
  Synthetic
atggccgactcccaagtacgcttctgaccatcctgcaaatttgcttttgctccatgcattccccatgttacactaagattctttctgcaccttgtctaattcttcttgggatgtgaaggaggagacccagcatggcgtat

SEQ ID NO: 413703 - DNA, 140 bp, Artificial Sequence
  Synthetic
atacgccatgctgggtctcctaagagatagaatgagacgatcctcctctgatcctcaacaaccatgtgcacctggagtaggagctgtctccagggagttagcaactagagggggaatatccgtacttgggagtcggccat

SEQ ID NO: 413704 - DNA, 140 bp, Artificial Sequence
  Synthetic
atggccgactcccaagtacggatattccccctctagttgctaactccctggagacagctcctactccaggtgcacatggttgttgaggatcagaggaggatcgtctcattctatctcttaggagacccagcatggcgtat

SEQ ID NO: 413705 - DNA, 140 bp, Artificial Sequence
  Synthetic
atacgccatgctgggtctccatctaaaaagaaatataggctaaaacatttaatatgggcaagcaaagagctggaaagattcgaatgtaatcctggtctactagaatatgcagaagggaatcgtacttgggagtcggccat

SEQ ID NO: 413706 - DNA, 140 bp, Artificial Sequence
  Synthetic
atggccgactcccaagtacgattcccttctgcatattctagtagaccaggattacattcgaatctttccagctctttgcttgcccatattaaatgttttagcctatatttctttttagatggagacccagcatggcgtat

SEQ ID NO: 413707 - DNA, 140 bp, Artificial Sequence
  Synthetic
atacgccatgctgggtctcccttgaaatctctctggaacttattagcagtactctggtgtgttcatagcagaattgacattcaggatacacagcaggcagtacaaaaggtaaaagaaaaacgtacttgggagtcggccat

SEQ ID NO: 413708 - DNA, 140 bp, Artificial Sequence
  Synthetic
atggccgactcccaagtacgtttttcttttaccttttgtactgcctgctgtgtatcctgaatgtcaattctgctatgaacacaccagagtactgctaataagttccagagagatttcaagggagacccagcatggcgtat

SEQ ID NO: 413709 - DNA, 140 bp, Artificial Sequence
  Synthetic
aggccctggctgctgatatggtatcctttaacttccctcaaatcactctttggcaacgacccctcgtcacaataaagataggggggcaactaaaggaagctctattagatacaggagcaggaccttttgggacagcggtg

SEQ ID NO: 413710 - DNA, 140 bp, Artificial Sequence
  Synthetic
caccgctgtcccaaaaggtcctgctcctgtatctaatagagcttcctttagttgcccccctatctttattgtgacgaggggtcgttgccaaagagtgatttgagggaagttaaaggataccatatcagcagccagggcct

SEQ ID NO: 413711 - DNA, 140 bp, Artificial Sequence
  Synthetic
aggccctggctgctgatatgagcagaataggcattattccacagaggagaagagtaagggatggatccggtagatcctaaactagagccctggaagcatccggggagtcagcctaaaactgaccttttgggacagcggtg

SEQ ID NO: 413712 - DNA, 140 bp, Artificial Sequence
  Synthetic
caccgctgtcccaaaaggtcagttttaggctgactccccggatgcttccagggctctagtttaggatctaccggatccatcccttactcttctcctctgtggaataatgcctattctgctcatatcagcagccagggcct

SEQ ID NO: 413713 - DNA, 140 bp, Artificial Sequence
  Synthetic
atacgccatgctgggtctccatagtatttatagaatatagaaaaataagaaaacagaaaagaatagaaaagttacttgataggataagagaaagagcagaagacagtggaaatgagagtgcgtacttgggagtcggccat

SEQ ID NO: 413714 - DNA, 140 bp, Artificial Sequence
  Synthetic
atggccgactcccaagtacgcactctcatttccactgtcttctgctctttctcttatcctatcaagtaacttttctattcttttctgttttcttatttttctatattctataaatactatggagacccagcatggcgtat

SEQ ID NO: 413715 - DNA, 140 bp, Artificial Sequence
  Synthetic
atacgccatgctgggtctccccttgggttggtgataatttgtagtgcagaaaaattgtgggtcacagtctattatggagtacctgtgtgggaagatgcaaatgcccctctattttgtgcacgtacttgggagtcggccat

SEQ ID NO: 413716 - DNA, 140 bp, Artificial Sequence
  Synthetic
atggccgactcccaagtacgtgcacaaaatagaggggcatttgcatcttcccacacaggtactccataatagactgtgacccacaatttttctgcactacaaattatcaccaacccaaggggagacccagcatggcgtat

SEQ ID NO: 413717 - DNA, 140 bp, Artificial Sequence
  Synthetic
atacgccatgctgggtctccgggggagaaataaaaaattgctctttcaatataaccacagaactaagagataagaaacagaaagtgcatgcacttttttatagacttgatatagtaccaccgtacttgggagtcggccat

SEQ ID NO: 413718 - DNA, 140 bp, Artificial Sequence
  Synthetic
atggccgactcccaagtacggtggtactatatcaagtctataaaaaagtgcatgcactttctgtttcttatctcttagttctgtggttatattgaaagagcaattttttatttctcccccggagacccagcatggcgtat

SEQ ID NO: 413719 - DNA, 140 bp, Artificial Sequence
  Synthetic
  misc_feature (25)..(25): n is a, c, g, or t
  misc_feature (58)..(58): n is a, c, g, or t
  misc_feature (92)..(92): n is a, c, g, or t
atacgccatgctgggtctccagtantggcctccggggggcacgaggccaggcaattanttgcagaaacaagtgtccccaacagccccaccantggaggagatagtaaaggggcaggagaacgtacttgggagtcggccat

SEQ ID NO: 413720 - DNA, 140 bp, Artificial Sequence
  Synthetic
  misc_feature (49)..(49): n is a, c, g, or t
  misc_feature (83)..(83): n is a, c, g, or t
  misc_feature (116)..(116): n is a, c, g, or t
atggccgactcccaagtacgttctcctgcccctttactatctcctccantggtggggctgttggggacacttgtttctgcaantaattgcctggcctcgtgccccccggaggccantactggagacccagcatggcgtat

SEQ ID NO: 413721 - DNA, 140 bp, Artificial Sequence
  Synthetic
atacgccatgctgggtctccctcggaatatcactgaggagtacagaatgacaaactgctctttcaatatgaccacagaactgagagataagaagaaggcagaatacgcgcttttctatagcgtacttgggagtcggccat

SEQ ID NO: 413722 - DNA, 140 bp, Artificial Sequence
  Synthetic
atggccgactcccaagtacgctatagaaaagcgcgtattctgccttcttcttatctctcagttctgtggtcatattgaaagagcagtttgtcattctgtactcctcagtgatattccgagggagacccagcatggcgtat

SEQ ID NO: 413723 - DNA, 140 bp, Artificial Sequence
  Synthetic
atacgccatgctgggtctccatacaattagaaggaagatggacaccaaaaatgatagggggtataggaggctttataaaggtaaaagaatataacaatgtgacagtagaagtacaaggaacgtacttgggagtcggccat

SEQ ID NO: 413724 - DNA, 140 bp, Artificial Sequence
  Synthetic
atggccgactcccaagtacgttccttgtacttctactgtcacattgttatattcttttacctttataaagcctcctataccccctatcatttttggtgtccatcttccttctaattgtatggagacccagcatggcgtat

SEQ ID NO: 413725 - DNA, 140 bp, Artificial Sequence
  Synthetic
atacgccatgctgggtctccaaactcctcaggaggggacctagaaattacaacacatagctttaattgtaaaggagaatttttctattgcaatacaacaccattgtttaatggcacctaccgtacttgggagtcggccat

SEQ ID NO: 413726 - DNA, 140 bp, Artificial Sequence
  Synthetic
atggccgactcccaagtacggtaggtgccattaaacaatggtgttgtattgcaatagaaaaattctcctttacaattaaagctatgtgttgtaatttctaggtcccctcctgaggagtttggagacccagcatggcgtat

SEQ ID NO: 413727 - DNA, 140 bp, Artificial Sequence
  Synthetic
atacgccatgctgggtctccaataagagcatagaatttaactcatcttcaggaggggacctagaaattacaacacatagtttcaattgtggaggggaatttttctattgtaatacatcagcgtacttgggagtcggccat

SEQ ID NO: 413728 - DNA, 140 bp, Artificial Sequence
  Synthetic
atggccgactcccaagtacgctgatgtattacaatagaaaaattcccctccacaattgaaactatgtgttgtaatttctaggtcccctcctgaagatgagttaaattctatgctcttattggagacccagcatggcgtat

SEQ ID NO: 413729 - DNA, 140 bp, Artificial Sequence
  Synthetic
aggccctggctgctgatatgactatcacacttaattgtaagataaaacaaattgtgagaatgtggcagagagtgggacaagcaatgtatgcccctcccattgcaggaaacattacatgtagaccttttgggacagcggtg

SEQ ID NO: 413730 - DNA, 140 bp, Artificial Sequence
  Synthetic
caccgctgtcccaaaaggtctacatgtaatgtttcctgcaatgggaggggcatacattgcttgtcccactctctgccacattctcacaatttgttttatcttacaattaagtgtgatagtcatatcagcagccagggcct

SEQ ID NO: 413731 - DNA, 140 bp, Artificial Sequence
  Synthetic
atacgccatgctgggtctccagaatgggaaagggaaattgacaattacacataccacatatacagcctgattgaacaatcgcaaatccagcaggaaaagaatgaacaagacttattggcacgtacttgggagtcggccat

SEQ ID NO: 413732 - DNA, 140 bp, Artificial Sequence
  Synthetic
atggccgactcccaagtacgtgccaataagtcttgttcattcttttcctgctggatttgcgattgttcaatcaggctgtatatgtggtatgtgtaattgtcaatttccctttcccattctggagacccagcatggcgtat

SEQ ID NO: 413733 - DNA, 140 bp, Artificial Sequence
  Synthetic
atacgccatgctgggtctccgcacaaaccttttatgtagatggagcagctagtagggatacaaaattaggaaaggcgggatatgttacagaacaaggaaaacagaaaataatagagctaacgtacttgggagtcggccat

SEQ ID NO: 413734 - DNA, 140 bp, Artificial Sequence
  Synthetic
atggccgactcccaagtacgttagctctattattttctgttttccttgttctgtaacatatcccgcctttcctaattttgtatccctactagctgctccatctacataaaaggtttgtgcggagacccagcatggcgtat

SEQ ID NO: 413735 - DNA, 140 bp, Artificial Sequence
  Synthetic
aggccctggctgctgatatgttcgattagtgagcggattcttagcacttgcctgggacgacctgaggagcctgtgcctcttcagctaccaccgcttgagagacttcatcttgattgcagcgaccttttgggacagcggtg

SEQ ID NO: 413736 - DNA, 140 bp, Artificial Sequence
  Synthetic
caccgctgtcccaaaaggtcgctgcaatcaagatgaagtctctcaagcggtggtagctgaagaggcacaggctcctcaggtcgtcccaggcaagtgctaagaatccgctcactaatcgaacatatcagcagccagggcct

SEQ ID NO: 413737 - DNA, 140 bp, Artificial Sequence
  Synthetic
atacgccatgctgggtctcccaggattccaaagagaaagtaaacatagtaacagactcacaatatgtattgggcatcatatcctcccaaccaacacaaagtgactcccctatagttcagccgtacttgggagtcggccat

SEQ ID NO: 413738 - DNA, 140 bp, Artificial Sequence
  Synthetic
atggccgactcccaagtacggctgaactataggggagtcactttgtgttggttgggaggatatgatgcccaatacatattgtgagtctgttactatgtttactttctctttggaatcctgggagacccagcatggcgtat

SEQ ID NO: 413739 - DNA, 140 bp, Artificial Sequence
  Synthetic
aggccctggctgctgatatgtttgcaataaaatggggagcaagtggtcaaaaagcagtctggttggatggcctgatataagagaaaggatgagaagagctcaaccagcagcagagggagtgaccttttgggacagcggtg

SEQ ID NO: 413740 - DNA, 140 bp, Artificial Sequence
  Synthetic
caccgctgtcccaaaaggtcactccctctgctgctggttgagctcttctcatcctttctcttatatcaggccatccaaccagactgctttttgaccacttgctccccattttattgcaaacatatcagcagccagggcct

SEQ ID NO: 413741 - DNA, 140 bp, Artificial Sequence
  Synthetic
aggccctggctgctgatatggaactaaagaatagtgctattaatttgcttgatacaatagcaatagcagtagctaactggacagatagggttatagaagtagcacaaagagctggtagaggaccttttgggacagcggtg

SEQ ID NO: 413742 - DNA, 140 bp, Artificial Sequence
  Synthetic
caccgctgtcccaaaaggtcctctaccagctctttgtgctacttctataaccctatctgtccagttagctactgctattgctattgtatcaagcaaattaatagcactattctttagttccatatcagcagccagggcct

SEQ ID NO: 413743 - DNA, 140 bp, Artificial Sequence
  Synthetic
atacgccatgctgggtctccaggtaagggaaagactaagacaacaccctgcagcagcagaaggagtaggagcagtatctcaagatttagataggcatggagccatcacaagtagaaataccgtacttgggagtcggccat

SEQ ID NO: 413744 - DNA, 140 bp, Artificial Sequence
  Synthetic
atggccgactcccaagtacggtatttctacttgtgatggctccatgcctatctaaatcttgagatactgctcctactccttctgctgctgcagggtgttgtcttagtctttcccttacctggagacccagcatggcgtat

SEQ ID NO: 413745 - DNA, 140 bp, Artificial Sequence
  Synthetic
atacgccatgctgggtctccggtaagaaaaagggtacatataggaggggggagaacattttatgcaacaggcatagaaggagatataagaaaagcatattgtacccttagtttaacaaaacgtacttgggagtcggccat

SEQ ID NO: 413746 - DNA, 140 bp, Artificial Sequence
  Synthetic
atggccgactcccaagtacgttttgttaaactaagggtacaatatgcttttcttatatctccttctatgcctgttgcataaaatgttctcccccctcctatatgtaccctttttcttaccggagacccagcatggcgtat

SEQ ID NO: 413747 - DNA, 140 bp, Artificial Sequence
  Synthetic
atacgccatgctgggtctccgcttggtgaaacaccataagtacatatctaagaaggccaagaactggcattataagcatcattatgaattcaggagcccaagaattggttcaggtgtatacgtacttgggagtcggccat

SEQ ID NO: 413748 - DNA, 140 bp, Artificial Sequence
  Synthetic
atggccgactcccaagtacgtatacacctgaaccaattcttgggctcctgaattcataatgatgcttataatgccagttcttggccttcttagatatgtacttatggtgtttcaccaagcggagacccagcatggcgtat

SEQ ID NO: 413749 - DNA, 140 bp, Artificial Sequence
  Synthetic
atacgccatgctgggtctccccactgctactcctcccactttgaagcttgagaaaggagaagtaaaaaactgctctttcaatgccaccacaaacataagcgataaggtgcagagacaatacgtacttgggagtcggccat

SEQ ID NO: 413750 - DNA, 140 bp, Artificial Sequence
  Synthetic
atggccgactcccaagtacgtattgtctctgcaccttatcgcttatgtttgtggtggcattgaaagagcagttttttacttctcctttctcaagcttcaaagtgggaggagtagcagtggggagacccagcatggcgtat

SEQ ID NO: 413751 - DNA, 140 bp, Artificial Sequence
  Synthetic
aggccctggctgctgatatgcaatacaagaattatacaacacagattgatcctgaaacagcagacaggatgatacatctacattattttgactgttttacagactccgcaatcagaaagggaccttttgggacagcggtg

SEQ ID NO: 413752 - DNA, 140 bp, Artificial Sequence
  Synthetic
caccgctgtcccaaaaggtccctttctgattgcggagtctgtaaaacagtcaaaataatgtagatgtatcatcctgtctgctgtttcaggatcaatctgtgttgtataattcttgtattgcatatcagcagccagggcct

SEQ ID NO: 413753 - DNA, 140 bp, Artificial Sequence
  Synthetic
atacgccatgctgggtctccagtcaggtagggacactacaatttttagccttaaaggcaatagagaaagtaaaaaggaataaacctcccctacccagtgtccagaagttaacagaagatacgtacttgggagtcggccat

SEQ ID NO: 413754 - DNA, 140 bp, Artificial Sequence
  Synthetic
atggccgactcccaagtacgtatcttctgttaacttctggacactgggtaggggaggtttattcctttttactttctctattgcctttaaggctaaaaattgtagtgtccctacctgactggagacccagcatggcgtat

SEQ ID NO: 413755 - DNA, 140 bp, Artificial Sequence
  Synthetic
aggccctggctgctgatatgaaaatgtcagcacagtacaatgtacacatggaattagaccagtagtgtcaactcaactgctgttaaatggcagtctagcagaagaagagatagtaattaggaccttttgggacagcggtg

SEQ ID NO: 413756 - DNA, 140 bp, Artificial Sequence
  Synthetic
caccgctgtcccaaaaggtcctaattactatctcttcttctgctagactgccatttaacagcagttgagttgacactactggtctaattccatgtgtacattgtactgtgctgacattttcatatcagcagccagggcct

SEQ ID NO: 413757 - DNA, 140 bp, Artificial Sequence
  Synthetic
atacgccatgctgggtctccgatggaacaagcaccagaaaaccagggaccagctagggagccattcaatgagtggacattagagcttctagaagagctaaaagaagaagcagtaagacatcgtacttgggagtcggccat

SEQ ID NO: 413758 - DNA, 140 bp, Artificial Sequence
  Synthetic
atggccgactcccaagtacgatgtcttactgcttcttcttttagctcttctagaagctctaatgtccactcattgaatggctccctagctggtccctggttttctggtgcttgttccatcggagacccagcatggcgtat

SEQ ID NO: 413759 - DNA, 140 bp, Artificial Sequence
  Synthetic
aggccctggctgctgatatgaatgtatagccctgtcagcattttggacataagacaagggccaaaagaaccctttagagattatgtagacaggttctttaaaactctaagagctgagcaagaccttttgggacagcggtg

SEQ ID NO: 413760 - DNA, 140 bp, Artificial Sequence
  Synthetic
caccgctgtcccaaaaggtcttgctcagctcttagagttttaaagaacctgtctacataatctctaaagggttcttttggcccttgtcttatgtccaaaatgctgacagggctatacattcatatcagcagccagggcct

SEQ ID NO: 413761 - DNA, 140 bp, Artificial Sequence
  Synthetic
atacgccatgctgggtctccaatctgtacaaattaattgtacaaggcccagcaacaatacaagaaaaggtatacctataggaccagggagagcatggtatgcaacaggagatataacaggcgtacttgggagtcggccat

SEQ ID NO: 413762 - DNA, 140 bp, Artificial Sequence
  Synthetic
atggccgactcccaagtacgcctgttatatctcctgttgcataccatgctctccctggtcctataggtataccttttcttgtattgttgctgggccttgtacaattaatttgtacagattggagacccagcatggcgtat

SEQ ID NO: 413763 - DNA, 140 bp, Artificial Sequence
  Synthetic
aggccctggctgctgatatgatgatagtaggaggcttggtaggtttaagaatagtttttactgtactttctatagtgaatagagttaggcagggatactcaccattatcgtttcagacccgaccttttgggacagcggtg

SEQ ID NO: 413764 - DNA, 140 bp, Artificial Sequence
  Synthetic
caccgctgtcccaaaaggtcgggtctgaaacgataatggtgagtatccctgcctaactctattcactatagaaagtacagtaaaaactattcttaaacctaccaagcctcctactatcatcatatcagcagccagggcct

SEQ ID NO: 413765 - DNA, 140 bp, Artificial Sequence
  Synthetic
atacgccatgctgggtctcctattgctcaaaacagcaccctgaaggaagatgaaggggcaataaaaaactgttctttcaatatgaccacagaattattagataagcagcagcaagtacttcgtacttgggagtcggccat

SEQ ID NO: 413766 - DNA, 140 bp, Artificial Sequence
  Synthetic
atggccgactcccaagtacgaagtacttgctgctgcttatctaataattctgtggtcatattgaaagaacagttttttattgccccttcatcttccttcagggtgctgttttgagcaataggagacccagcatggcgtat

SEQ ID NO: 413767 - DNA, 140 bp, Artificial Sequence
  Synthetic
  misc_feature (113)..(113): n is a, c, g, or t
atacgccatgctgggtctcctagagcatagaaaacaagataaaagagagcgggaaatacttgaaagattaaggagagtaagggaaatcagggatgacagtgactatgagagtnatggagacgtacttgggagtcggccat

SEQ ID NO: 413768 - DNA, 140 bp, Artificial Sequence
  Synthetic
  misc_feature (28)..(28): n is a, c, g, or t
atggccgactcccaagtacgtctccatnactctcatagtcactgtcatccctgatttcccttactctccttaatctttcaagtatttcccgctctcttttatcttgttttctatgctctaggagacccagcatggcgtat

SEQ ID NO: 413769 - DNA, 140 bp, Artificial Sequence
  Synthetic
aggccctggctgctgatatgcatcccttcagacaggatcagaagaacttaaatcattatataatacaatagcagtcctctattgtgtgcatcaaaagatagatataaaagacaccaaggagaccttttgggacagcggtg

SEQ ID NO: 413770 - DNA, 140 bp, Artificial Sequence
  Synthetic
caccgctgtcccaaaaggtctccttggtgtcttttatatctatcttttgatgcacacaatagaggactgctattgtattatataatgatttaagttcttctgatcctgtctgaagggatgcatatcagcagccagggcct

SEQ ID NO: 413771 - DNA, 140 bp, Artificial Sequence
  Synthetic
atacgccatgctgggtctcccaagaaaaaggataacaatgggaccaggacgagtatattatgcaacaggagacatagtaggagacatcagaaaggcacattgtaacgttagtgaagcacacgtacttgggagtcggccat

SEQ ID NO: 413772 - DNA, 140 bp, Artificial Sequence
  Synthetic
atggccgactcccaagtacgtgtgcttcactaacgttacaatgtgcctttctgatgtctcctactatgtctcctgttgcataatatactcgtcctggtcccattgttatcctttttcttgggagacccagcatggcgtat

SEQ ID NO: 413773 - DNA, 140 bp, Artificial Sequence
  Synthetic
atacgccatgctgggtctcctacagggaagaatagtacagggaataatagtacagtagatagcacgacagaaccaggaacacctatgaaaaactgtagttttaatataactacattcctccgtacttgggagtcggccat

SEQ ID NO: 413774 - DNA, 140 bp, Artificial Sequence
  Synthetic
atggccgactcccaagtacggaggaatgtagttatattaaaactacagtttttcataggtgttcctggttctgtcgtgctatctactgtactattattccctgtactattcttccctgtaggagacccagcatggcgtat

SEQ ID NO: 413775 - DNA, 140 bp, Artificial Sequence
  Synthetic
aggccctggctgctgatatgaaccaggaacacctatgaaaaactgtagttttaatataactacattcctcaaagacaaaaaggagcaaaaacaggctctattctatatatcagatctgacgaccttttgggacagcggtg

SEQ ID NO: 413776 - DNA, 140 bp, Artificial Sequence
  Synthetic
caccgctgtcccaaaaggtcgtcagatctgatatatagaatagagcctgtttttgctcctttttgtctttgaggaatgtagttatattaaaactacagtttttcataggtgttcctggttcatatcagcagccagggcct

SEQ ID NO: 413777 - DNA, 140 bp, Artificial Sequence
  Synthetic
aggccctggctgctgatatgaatgggacactctctagaggagggataagaattatgggaacaaacattacagacagtgcaaagaatatcatagtaaccctaaacactcctgtaaacatgagaccttttgggacagcggtg

SEQ ID NO: 413778 - DNA, 140 bp, Artificial Sequence
  Synthetic
caccgctgtcccaaaaggtctcatgtttacaggagtgtttagggttactatgatattctttgcactgtctgtaatgtttgttcccataattcttatccctcctctagagagtgtcccattcatatcagcagccagggcct

SEQ ID NO: 413779 - DNA, 140 bp, Artificial Sequence
  Synthetic
atacgccatgctgggtctccgcagaacactaccctaagaaaacaacaataaagtttgaaccacactcaggaggggatctagaaattacaacacatagctttaattgtagaggagaattttcgtacttgggagtcggccat

SEQ ID NO: 413780 - DNA, 140 bp, Artificial Sequence
  Synthetic
atggccgactcccaagtacgaaaattctcctctacaattaaagctatgtgttgtaatttctagatcccctcctgagtgtggttcaaactttattgttgttttcttagggtagtgttctgcggagacccagcatggcgtat

SEQ ID NO: 413781 - DNA, 140 bp, Artificial Sequence
  Synthetic
atacgccatgctgggtctccagatggcgcagtatggcaagtgtgcaggagaacagaaaatcatcaagggcagctaattgtacatataatagcactgaatggagaaacaccttagaaaaaacgtacttgggagtcggccat

SEQ ID NO: 413782 - DNA, 140 bp, Artificial Sequence
  Synthetic
atggccgactcccaagtacgttttttctaaggtgtttctccattcagtgctattatatgtacaattagctgcccttgatgattttctgttctcctgcacacttgccatactgcgccatctggagacccagcatggcgtat

SEQ ID NO: 413783 - DNA, 140 bp, Artificial Sequence
  Synthetic
aggccctggctgctgatatgagctaattgtacatataatagcactgaatggagaaacaccttagaaaaaacagctaaaaggtatctagaacttgtaagcaagacaggaaatggtgcaggagaccttttgggacagcggtg

SEQ ID NO: 413784 - DNA, 140 bp, Artificial Sequence
  Synthetic
caccgctgtcccaaaaggtctcctgcaccatttcctgtcttgcttacaagttctagataccttttagctgttttttctaaggtgtttctccattcagtgctattatatgtacaattagctcatatcagcagccagggcct

SEQ ID NO: 413785 - DNA, 140 bp, Artificial Sequence
  Synthetic
atacgccatgctgggtctcccaatttgcattttaactgtcatggggaattcttttattgtaacacatctcaaatgtttaactatacttgtaactgtacaagctcagaatgcaactgtacacgtacttgggagtcggccat

SEQ ID NO: 413786 - DNA, 140 bp, Artificial Sequence
  Synthetic
atggccgactcccaagtacgtgtacagttgcattctgagcttgtacagttacaagtatagttaaacatttgagatgtgttacaataaaagaattccccatgacagttaaaatgcaaattgggagacccagcatggcgtat

SEQ ID NO: 413787 - DNA, 140 bp, Artificial Sequence
  Synthetic
atacgccatgctgggtctcctagtattagcagtgacatgaaaggagaaataaaaaactgctctttcaatatgaccacagaattaagggataagcaacagaaaatacattcacttttttatcgtacttgggagtcggccat

SEQ ID NO: 413788 - DNA, 140 bp, Artificial Sequence
  Synthetic
atggccgactcccaagtacgataaaaaagtgaatgtattttctgttgcttatcccttaattctgtggtcatattgaaagagcagttttttatttctcctttcatgtcactgctaatactaggagacccagcatggcgtat

SEQ ID NO: 413789 - DNA, 140 bp, Artificial Sequence
  Synthetic
aggccctggctgctgatatgtcttaacatacctagaagaataagacagggcttagaaagggctttgctataaaatgggtggcaagtggtcaaaaagtagtatagttggatggcctgctatgaccttttgggacagcggtg

SEQ ID NO: 413790 - DNA, 140 bp, Artificial Sequence
  Synthetic
caccgctgtcccaaaaggtcatagcaggccatccaactatactactttttgaccacttgccacccattttatagcaaagccctttctaagccctgtcttattcttctaggtatgttaagacatatcagcagccagggcct

SEQ ID NO: 413791 - DNA, 140 bp, Artificial Sequence
  Synthetic
aggccctggctgctgatatgatagggggaattggaggttttatcaaagtaagacagtatgatcagatacccatagaaatctgtggacataaagctataggtacagtattagtaggacctagaccttttgggacagcggtg

SEQ ID NO: 413792 - DNA, 140 bp, Artificial Sequence
  Synthetic
caccgctgtcccaaaaggtctaggtcctactaatactgtacctatagctttatgtccacagatttctatgggtatctgatcatactgtcttactttgataaaacctccaattccccctatcatatcagcagccagggcct

SEQ ID NO: 413793 - DNA, 140 bp, Artificial Sequence
  Synthetic
aggccctggctgctgatatgcatagaaatctgtggacataaagctataggtacagtattagtaggacctacacctgtcaacataattggaagaaatctgttgactcagattggttgcactgaccttttgggacagcggtg

SEQ ID NO: 413794 - DNA, 140 bp, Artificial Sequence
  Synthetic
caccgctgtcccaaaaggtcagtgcaaccaatctgagtcaacagatttcttccaattatgttgacaggtgtaggtcctactaatactgtacctatagctttatgtccacagatttctatgcatatcagcagccagggcct

SEQ ID NO: 413795 - DNA, 140 bp, Artificial Sequence
  Synthetic
aggccctggctgctgatatgaacagataggattattgaagtaatacaaagaatttgtagagctatcctcaacatacctagaagaataagacagggctttgaagcagctttgctataaaatgaccttttgggacagcggtg

SEQ ID NO: 413796 - DNA, 140 bp, Artificial Sequence
  Synthetic
caccgctgtcccaaaaggtcattttatagcaaagctgcttcaaagccctgtcttattcttctaggtatgttgaggatagctctacaaattctttgtattacttcaataatcctatctgttcatatcagcagccagggcct

SEQ ID NO: 413797 - DNA, 140 bp, Artificial Sequence
  Synthetic
aggccctggctgctgatatgggggggcaagtggtcaaaaagcagcatagttggatggcctgatgtaagagaaagaataagacgaactgagccagcagcagagggagtaggagcagcgtctgaccttttgggacagcggtg

SEQ ID NO: 413798 - DNA, 140 bp, Artificial Sequence
  Synthetic
caccgctgtcccaaaaggtcagacgctgctcctactccctctgctgctggctcagttcgtcttattctttctcttacatcaggccatccaactatgctgctttttgaccacttgcccccccatatcagcagccagggcct

SEQ ID NO: 413799 - DNA, 140 bp, Artificial Sequence
  Synthetic
atacgccatgctgggtctcctgcagactttgtggagctgtaatacaatactggctacaagaattgcagaatagtgctataagcttgtttgatactattgcagtggcagctgccaattggacgtacttgggagtcggccat

SEQ ID NO: 413800 - DNA, 140 bp, Artificial Sequence
  Synthetic
atggccgactcccaagtacgtccaattggcagctgccactgcaatagtatcaaacaagcttatagcactattctgcaattcttgtagccagtattgtattacagctccacaaagtctgcaggagacccagcatggcgtat

SEQ ID NO: 413801 - DNA, 140 bp, Artificial Sequence
  Synthetic
atacgccatgctgggtctccggaatgcatggagcaaaagcaaatttgcaggatggtcagaagtaagaaatagaatgagacaatcctcccctgaccctcaaccatgtgcacctggagtaggcgtacttgggagtcggccat

SEQ ID NO: 413802 - DNA, 140 bp, Artificial Sequence
  Synthetic
atggccgactcccaagtacgcctactccaggtgcacatggttgagggtcaggggaggattgtctcattctatttcttacttctgaccatcctgcaaatttgcttttgctccatgcattccggagacccagcatggcgtat

SEQ ID NO: 413803 - DNA, 140 bp, Artificial Sequence
  Synthetic
atacgccatgctgggtctccgtctaaaaccatgtgtaaagctaacccctctctgtgttactttaagctgtactaatgtaaacagtaccagaaataatcatgtaaacagtgccggagatggcgtacttgggagtcggccat

SEQ ID NO: 413804 - DNA, 140 bp, Artificial Sequence
  Synthetic
atggccgactcccaagtacgccatctccggcactgtttacatgattatttctggtactgtttacattagtacagcttaaagtaacacagagaggggttagctttacacatggttttagacggagacccagcatggcgtat

SEQ ID NO: 413805 - DNA, 140 bp, Artificial Sequence
  Synthetic
aggccctggctgctgatatggaccagggcaaacgttctatgcaacaggtgatataataggggatataagacaagcacattgtaatgtcagtgaaaaagagtggaataacactttacaaaagaccttttgggacagcggtg

SEQ ID NO: 413806 - DNA, 140 bp, Artificial Sequence
  Synthetic
caccgctgtcccaaaaggtcttttgtaaagtgttattccactctttttcactgacattacaatgtgcttgtcttatatcccctattatatcacctgttgcatagaacgtttgccctggtccatatcagcagccagggcct

SEQ ID NO: 413807 - DNA, 140 bp, Artificial Sequence
  Synthetic
aggccctggctgctgatatgtgaagtcactctggaacgcaatagcagtactctggtgcgttcataacagatataaagttggagatacacagcaagcagtgcaaaaattaaaagaagtaatgaccttttgggacagcggtg

SEQ ID NO: 413808 - DNA, 140 bp, Artificial Sequence
  Synthetic
caccgctgtcccaaaaggtcattacttcttttaatttttgcactgcttgctgtgtatctccaactttatatctgttatgaacgcaccagagtactgctattgcgttccagagtgacttcacatatcagcagccagggcct

SEQ ID NO: 413809 - DNA, 140 bp, Artificial Sequence
  Synthetic
atacgccatgctgggtctccagacaagtcaaaattacccagtagtagcaaacatgcaagggcaaatgatacatcagcccctctcccccaggactttaaatgcatgggtaaaggcagtagacgtacttgggagtcggccat

SEQ ID NO: 413810 - DNA, 140 bp, Artificial Sequence
  Synthetic
atggccgactcccaagtacgtctactgcctttacccatgcatttaaagtcctgggggagaggggctgatgtatcatttgcccttgcatgtttgctactactgggtaattttgacttgtctggagacccagcatggcgtat

SEQ ID NO: 413811 - DNA, 140 bp, Artificial Sequence
  Synthetic
aggccctggctgctgatatgcaagcagtaatgtaaaccaccctagttgcgtctggctggaggcgcaagaggaagaggaggtaggctttccagtcagaccacaggtacctctaagaccaatgaccttttgggacagcggtg

SEQ ID NO: 413812 - DNA, 140 bp, Artificial Sequence
  Synthetic
caccgctgtcccaaaaggtcattggtcttagaggtacctgtggtctgactggaaagcctacctcctcttcctcttgcgcctccagccagacgcaactagggtggtttacattactgcttgcatatcagcagccagggcct

SEQ ID NO: 413813 - DNA, 140 bp, Artificial Sequence
  Synthetic
  misc_feature (55)..(55): n is a, c, g, or t
  misc_feature (101)..(101): n is a, c, g, or t
aggccctggctgctgatatgatcatccggggagtcagcctaaaactgcttgtaanaagtgctattgtaaaaaatgttgctgtcattgccaagtatgctttntgaacaaaggcttaggcatgaccttttgggacagcggtg

SEQ ID NO: 413814 - DNA, 140 bp, Artificial Sequence
  Synthetic
  misc_feature (40)..(40): n is a, c, g, or t
  misc_feature (86)..(86): n is a, c, g, or t
caccgctgtcccaaaaggtcatgcctaagcctttgttcanaaagcatacttggcaatgacagcaacattttttacaatagcacttnttacaagcagttttaggctgactccccggatgatcatatcagcagccagggcct

SEQ ID NO: 413815 - DNA, 140 bp, Artificial Sequence
  Synthetic
atacgccatgctgggtctcctttagagattatgtggataggttctacaaaacattaagagctgaacaagcaacccaggaagtaaaaaattggatgacagaaaccctacttgttcagaatgcgtacttgggagtcggccat

SEQ ID NO: 413816 - DNA, 140 bp, Artificial Sequence
  Synthetic
atggccgactcccaagtacgcattctgaacaagtagggtttctgtcatccaattttttacttcctgggttgcttgttcagctcttaatgttttgtagaacctatccacataatctctaaaggagacccagcatggcgtat

SEQ ID NO: 413817 - DNA, 140 bp, Artificial Sequence
  Synthetic
atacgccatgctgggtctccttagaagaaatgatggtagcatgtcagggagtaggagggccaactcataaggcaaaaatactagcagaagcaatggcctcagtccaacaagatctaaaagcgtacttgggagtcggccat

SEQ ID NO: 413818 - DNA, 140 bp, Artificial Sequence
  Synthetic
atggccgactcccaagtacgcttttagatcttgttggactgaggccattgcttctgctagtatttttgccttatgagttggccctcctactccctgacatgctaccatcatttcttctaaggagacccagcatggcgtat

SEQ ID NO: 413819 - DNA, 140 bp, Artificial Sequence
  Synthetic
aggccctggctgctgatatgggattgtggaacttctgggacgcagggggtgggaagccctcaaatatctgtggaatctcctgcagtattggattcaggaactaaggaatagtgctgttaggaccttttgggacagcggtg

SEQ ID NO: 413820 - DNA, 140 bp, Artificial Sequence
  Synthetic
caccgctgtcccaaaaggtcctaacagcactattccttagttcctgaatccaatactgcaggagattccacagatatttgagggcttcccaccccctgcgtcccagaagttccacaatcccatatcagcagccagggcct

SEQ ID NO: 413821 - DNA, 140 bp, Artificial Sequence
  Synthetic
atacgccatgctgggtctcctggagaaataaaaaattgctctttcaatacaaccacagaaataagagataagaaacagaatgtgtatgcacttttttatagaactgatgtagtaccacttcgtacttgggagtcggccat

SEQ ID NO: 413822 - DNA, 140 bp, Artificial Sequence
  Synthetic
atggccgactcccaagtacgaagtggtactacatcagttctataaaaaagtgcatacacattctgtttcttatctcttatttctgtggttgtattgaaagagcaattttttatttctccaggagacccagcatggcgtat

SEQ ID NO: 413823 - DNA, 140 bp, Artificial Sequence
  Synthetic
  misc_feature (29)..(29): n is a, c, g, or t
atacgccatgctgggtctcctaaaggctnaaggagaactaaaaaactgctctttcaatataaccacagaactaagagatagaaaaagtcaagagtacgcgattttctataaacttgatatcgtacttgggagtcggccat

SEQ ID NO: 413824 - DNA, 140 bp, Artificial Sequence
  Synthetic
  misc_feature (112)..(112): n is a, c, g, or t
atggccgactcccaagtacgatatcaagtttatagaaaatcgcgtactcttgactttttctatctcttagttctgtggttatattgaaagagcagttttttagttctccttnagcctttaggagacccagcatggcgtat

SEQ ID NO: 413825 - DNA, 140 bp, Artificial Sequence
  Synthetic
atacgccatgctgggtctccgcccccatcagcccctccaatggaggaggtagtgaagggacaagagaatcagaatcagaatcaagggggggaccagaacgagctatatccgtttgcctcccgtacttgggagtcggccat

SEQ ID NO: 413826 - DNA, 140 bp, Artificial Sequence
  Synthetic
atggccgactcccaagtacgggaggcaaacggatatagctcgttctggtcccccccttgattctgattctgattctcttgtcccttcactacctcctccattggaggggctgatgggggcggagacccagcatggcgtat

SEQ ID NO: 413827 - DNA, 140 bp, Artificial Sequence
  Synthetic
aggccctggctgctgatatgctcaaatccctctttgggacagaccaatagtcacagcaaaggttgggggccatctatgtgaggttttgctggatacaggggcagatgatacagtactaaagaccttttgggacagcggtg

SEQ ID NO: 413828 - DNA, 140 bp, Artificial Sequence
  Synthetic
caccgctgtcccaaaaggtctttagtactgtatcatctgcccctgtatccagcaaaacctcacatagatggcccccaacctttgctgtgactattggtctgtcccaaagagggatttgagcatatcagcagccagggcct

SEQ ID NO: 413829 - DNA, 140 bp, Artificial Sequence
  Synthetic
aggccctggctgctgatatgaatggcagtatagcagaagaagaagtaatgattagatctgaaaacatcacaaacagtgccaaaaacataatagtgcagtttaataaaactgtagaaattagaccttttgggacagcggtg

SEQ ID NO: 413830 - DNA, 140 bp, Artificial Sequence
  Synthetic
caccgctgtcccaaaaggtctaatttctacagttttattaaactgcactattatgtttttggcactgtttgtgatgttttcagatctaatcattacttcttcttctgctatactgccattcatatcagcagccagggcct

SEQ ID NO: 413831 - DNA, 140 bp, Artificial Sequence
  Synthetic
aggccctggctgctgatatgcaacaataatacaaggaaaagtgtgaggataggaccaggacaaacattttatgcaacaggaataataggaaacataagacaagcacattgtaatgttagcgaccttttgggacagcggtg

SEQ ID NO: 413832 - DNA, 140 bp, Artificial Sequence
  Synthetic
caccgctgtcccaaaaggtcgctaacattacaatgtgcttgtcttatgtttcctattattcctgttgcataaaatgtttgtcctggtcctatcctcacacttttccttgtattattgttgcatatcagcagccagggcct

SEQ ID NO: 413833 - DNA, 140 bp, Artificial Sequence
  Synthetic
atacgccatgctgggtctccggacaagcgttctatgcaacaggtgccataataggaaatataagacaagcacattgtaatgttagtgaaacagcatggagagagaggatgaaggaggtaacgtacttgggagtcggccat

SEQ ID NO: 413834 - DNA, 140 bp, Artificial Sequence
  Synthetic
atggccgactcccaagtacgttacctccttcatcctctctctccatgctgtttcactaacattacaatgtgcttgtcttatatttcctattatggcacctgttgcatagaacgcttgtccggagacccagcatggcgtat

SEQ ID NO: 413835 - DNA, 140 bp, Artificial Sequence
  Synthetic
atacgccatgctgggtctccaggcaaaattagaaggaatctttaataacaaaagtatcatttttaactcatcttcaggaggggatatagaaattacatcacatagttttaattgtagaggcgtacttgggagtcggccat

SEQ ID NO: 413836 - DNA, 140 bp, Artificial Sequence
  Synthetic
atggccgactcccaagtacgcctctacaattaaaactatgtgatgtaatttctatatcccctcctgaagatgagttaaaaatgatacttttgttattaaagattccttctaattttgcctggagacccagcatggcgtat

SEQ ID NO: 413837 - DNA, 140 bp, Artificial Sequence
  Synthetic
aggccctggctgctgatatgctgaaaatccttataatacacccatctttgctataaaaaagaaagatagtactaagtggagaaaattggtagacttcagagaattaaataaaagaacacagaccttttgggacagcggtg

SEQ ID NO: 413838 - DNA, 140 bp, Artificial Sequence
  Synthetic
caccgctgtcccaaaaggtctgtgttcttttatttaattctctgaagtctaccaattttctccacttagtactatctttcttttttatagcaaagatgggtgtattataaggattttcagcatatcagcagccagggcct

SEQ ID NO: 413839 - DNA, 140 bp, Artificial Sequence
  Synthetic
atacgccatgctgggtctccactaagtggagaaaattggtagacttcagagaattaaataaaagaacacaagacttctgggaggtacagttaggtatcccacatccggggggtttaaagccgtacttgggagtcggccat

SEQ ID NO: 413840 - DNA, 140 bp, Artificial Sequence
  Synthetic
atggccgactcccaagtacggctttaaaccccccggatgtgggatacctaactgtacctcccagaagtcttgtgttcttttatttaattctctgaagtctaccaattttctccacttagtggagacccagcatggcgtat

SEQ ID NO: 413841 - DNA, 140 bp, Artificial Sequence
  Synthetic
aggccctggctgctgatatgaagaatactgcaacaactgctgtttattcatttcagaattgggtgtcgacatagcagaataggcattactctacagaggagagcaagaaatggagccagtgaccttttgggacagcggtg

SEQ ID NO: 413842 - DNA, 140 bp, Artificial Sequence
  Synthetic
caccgctgtcccaaaaggtcactggctccatttcttgctctcctctgtagagtaatgcctattctgctatgtcgacacccaattctgaaatgaataaacagcagttgttgcagtattcttcatatcagcagccagggcct

SEQ ID NO: 413843 - DNA, 140 bp, Artificial Sequence
  Synthetic
aggccctggctgctgatatgaccacaccagacaaaaaacatcagaaagaacctccattcctttggatgggttatgaactccatccggataaatggacagtgcagcctataaagttaccaggaccttttgggacagcggtg

SEQ ID NO: 413844 - DNA, 140 bp, Artificial Sequence
  Synthetic
caccgctgtcccaaaaggtcctggtaactttataggctgcactgtccatttatccggatggagttcataacccatccaaaggaatggaggttctttctgatgttttttgtctggtgtggtcatatcagcagccagggcct

SEQ ID NO: 413845 - DNA, 140 bp, Artificial Sequence
  Synthetic
aggccctggctgctgatatggatggaaagggtcaccagctatattccaaagttcaatgacaaaaattctagatccattcagaaaaaacaatccagaaatagaaatttgtcagtacatggagaccttttgggacagcggtg

SEQ ID NO: 413846 - DNA, 140 bp, Artificial Sequence
  Synthetic
caccgctgtcccaaaaggtctccatgtactgacaaatttctatttctggattgttttttctgaatggatctagaatttttgtcattgaactttggaatatagctggtgaccctttccatccatatcagcagccagggcct

SEQ ID NO: 413847 - DNA, 140 bp, Artificial Sequence
  Synthetic
atacgccatgctgggtctcctaatacaaaaagaaaaagtctacctgtcacaagtaccagcacacaaaaaaattagaggaaatgaacaagtagataaattagtcagtgctagagtcagaaacgtacttgggagtcggccat

SEQ ID NO: 413848 - DNA, 140 bp, Artificial Sequence
  Synthetic
atggccgactcccaagtacgtttctgactctagcactgactaatttatctacttgttcatttcctctaatttttttgtgtgctggtacttgtgacaggtagactttttctttttgtattaggagacccagcatggcgtat

SEQ ID NO: 413849 - DNA, 140 bp, Artificial Sequence
  Synthetic
aggccctggctgctgatatgcagatatatcagggaattagagtaaaagaattatgcaagttaatcagaggaaccaagtcattgacagaagtggtacctttgagtaaagaggcagaactaggaccttttgggacagcggtg

SEQ ID NO: 413850 - DNA, 140 bp, Artificial Sequence
  Synthetic
caccgctgtcccaaaaggtcctagttctgcctctttactcaaaggtaccacttctgtcaatgacttggttcctctgattaacttgcataattcttttactctaattccctgatatatctgcatatcagcagccagggcct

SEQ ID NO: 413851 - DNA, 140 bp, Artificial Sequence
  Synthetic
atacgccatgctgggtctccaatgctactaataccactgttggtagcgagggaatacaaaagggagaagcaatgaaaaactgctctttcaatatcaccacaagtataagagataaggtgccgtacttgggagtcggccat

SEQ ID NO: 413852 - DNA, 140 bp, Artificial Sequence
  Synthetic
atggccgactcccaagtacggcaccttatctcttatacttgtggtgatattgaaagagcagtttttcattgcttctcccttttgtattccctcgctaccaacagtggtattagtagcattggagacccagcatggcgtat

SEQ ID NO: 413853 - DNA, 140 bp, Artificial Sequence
  Synthetic
aggccctggctgctgatatgaatgaaaaactgctctttcaatatcaccacaagtataagagataaggtgcagaaagaatatgcacttttttataaccttgatgtagtacaaatagaaagtgaccttttgggacagcggtg

SEQ ID NO: 413854 - DNA, 140 bp, Artificial Sequence
  Synthetic
caccgctgtcccaaaaggtcactttctatttgtactacatcaaggttataaaaaagtgcatattctttctgcaccttatctcttatacttgtggtgatattgaaagagcagtttttcattcatatcagcagccagggcct

SEQ ID NO: 413855 - DNA, 140 bp, Artificial Sequence
  Synthetic
aggccctggctgctgatatgggaacaggaccatgtaaaaatgtcagcacagtacaatgtacacatggaattaggccagtagtatcaactcaactgctgttaaatggcagtctagcagaaggaccttttgggacagcggtg

SEQ ID NO: 413856 - DNA, 140 bp, Artificial Sequence
  Synthetic
caccgctgtcccaaaaggtccttctgctagactgccatttaacagcagttgagttgatactactggcctaattccatgtgtacattgtactgtgctgacatttttacatggtcctgttcccatatcagcagccagggcct

SEQ ID NO: 413857 - DNA, 140 bp, Artificial Sequence
  Synthetic
aggccctggctgctgatatgtattgggcatcatctcctcccaacctacacaaagtgattcccctatagttcagcagataatagaagaactgacaaaaaaggaacaaacgtatattacatggaccttttgggacagcggtg

SEQ ID NO: 413858 - DNA, 140 bp, Artificial Sequence
  Synthetic
caccgctgtcccaaaaggtccatgtaatatacgtttgttccttttttgtcagttcttctattatctgctgaactataggggaatcactttgtgtaggttgggaggagatgatgcccaatacatatcagcagccagggcct

SEQ ID NO: 413859 - DNA, 140 bp, Artificial Sequence
  Synthetic
aggccctggctgctgatatgagacttagataaatatggagcacttacaagcagcaacacacccgccaataatgcggactgtgcctggctgcaagcacaagaggaggaagaagaagtaggcgaccttttgggacagcggtg

SEQ ID NO: 413860 - DNA, 140 bp, Artificial Sequence
  Synthetic
caccgctgtcccaaaaggtcgcctacttcttcttcctcctcttgtgcttgcagccaggcacagtccgcattattggcgggtgtgttgctgcttgtaagtgctccatatttatctaagtctcatatcagcagccagggcct

SEQ ID NO: 413861 - DNA, 140 bp, Artificial Sequence
  Synthetic
  misc_feature (29)..(29): n is a, c, g, or t
  misc_feature (42)..(42): n is a, c, g, or t
  misc_feature (65)..(65): n is a, c, g, or t
  misc_feature (91)..(91): n is a, c, g, or t
atacgccatgctgggtctccactccactntgtgttactttanactgcactaatgccaatattagnagtaatgctactatgaccaatactantattagtggggaaatagataaaggagaaacgtacttgggagtcggccat

SEQ ID NO: 413862 - DNA, 140 bp, Artificial Sequence
  Synthetic
  misc_feature (50)..(50): n is a, c, g, or t
  misc_feature (76)..(76): n is a, c, g, or t
  misc_feature (99)..(99): n is a, c, g, or t
  misc_feature (112)..(112): n is a, c, g, or t
atggccgactcccaagtacgtttctcctttatctatttccccactaatantagtattggtcatagtagcattactnctaatattggcattagtgcagtntaaagtaacacanagtggagtggagacccagcatggcgtat

SEQ ID NO: 413863 - DNA, 140 bp, Artificial Sequence
  Synthetic
  misc_feature (41)..(41): n is a, c, g, or t
aggccctggctgctgatatgtgctactatgaccaatactantattagtggggaaatagataaaggagaaataaaaaactgttctttcaatatcaccacaagcataagagataagtatcaggaccttttgggacagcggtg

SEQ ID NO: 413864 - DNA, 140 bp, Artificial Sequence
  Synthetic
  misc_feature (100)..(100): n is a, c, g, or t
caccgctgtcccaaaaggtcctgatacttatctcttatgcttgtggtgatattgaaagaacagttttttatttctcctttatctatttccccactaatantagtattggtcatagtagcacatatcagcagccagggcct

SEQ ID NO: 413865 - DNA, 140 bp, Artificial Sequence
  Synthetic
aggccctggctgctgatatgggcaggtgctgatagtatggcaagtggacagacagaaagtgaaagcatggaatagcctggtgaaataccataagtacaggtctaaaaaggcccagagatggaccttttgggacagcggtg

SEQ ID NO: 413866 - DNA, 140 bp, Artificial Sequence
  Synthetic
caccgctgtcccaaaaggtccatctctgggcctttttagacctgtacttatggtatttcaccaggctattccatgctttcactttctgtctgtccacttgccatactatcagcacctgcccatatcagcagccagggcct

SEQ ID NO: 413867 - DNA, 140 bp, Artificial Sequence
  Synthetic
atacgccatgctgggtctcctatatattccagtaggtacagctaatatagtggtgactacatattggggattaatgccaggggaaagagatgagcatttaggacatggagtcagtatagacgtacttgggagtcggccat

SEQ ID NO: 413868 - DNA, 140 bp, Artificial Sequence
  Synthetic
atggccgactcccaagtacgtctatactgactccatgtcctaaatgctcatctctttcccctggcattaatccccaatatgtagtcaccactatattagctgtacctactggaatatataggagacccagcatggcgtat

SEQ ID NO: 413869 - DNA, 140 bp, Artificial Sequence
  Synthetic
  misc_feature (83)..(83): n is a, c, g, or t
  misc_feature (120)..(120): n is a, c, g, or t
atacgccatgctgggtctccgctaaatgaatctataacaatgacttgtgtgagaccccacaacaatacaaggaaaagtatacncataggaccagggagagcatggtatgcaacaggagancgtacttgggagtcggccat

SEQ ID NO: 413870 - DNA, 140 bp, Artificial Sequence
  Synthetic
  misc_feature (21)..(21): n is a, c, g, or t
  misc_feature (58)..(58): n is a, c, g, or t
atggccgactcccaagtacgntctcctgttgcataccatgctctccctggtcctatgngtatacttttccttgtattgttgtggggtctcacacaagtcattgttatagattcatttagcggagacccagcatggcgtat

SEQ ID NO: 413871 - DNA, 140 bp, Artificial Sequence
  Synthetic
  misc_feature (23)..(23): n is a, c, g, or t
  misc_feature (25)..(25): n is a, c, g, or t
  misc_feature (58)..(58): n is a, c, g, or t
atacgccatgctgggtctccgantnatacatctgcattatttcacctgttttacaganacagcaatcaggagtgccattttagggcagagagtgctgatcaggtgtgaataccctgcaggcgtacttgggagtcggccat

SEQ ID NO: 413872 - DNA, 140 bp, Artificial Sequence
  Synthetic
  misc_feature (83)..(83): n is a, c, g, or t
  misc_feature (116)..(116): n is a, c, g, or t
  misc_feature (118)..(118): n is a, c, g, or t
atggccgactcccaagtacgcctgcagggtattcacacctgatcagcactctctgccctaaaatggcactcctgattgctgtntctgtaaaacaggtgaaataatgcagatgtatnantcggagacccagcatggcgtat

SEQ ID NO: 413873 - DNA, 140 bp, Artificial Sequence
  Synthetic
aggccctggctgctgatatgaatgaatgggcattagagaccctggaagaactaaaagcagaagcagtaagacactttcctaggccttggctacaaaacttaggacaatacatctatgatagaccttttgggacagcggtg

SEQ ID NO: 413874 - DNA, 140 bp, Artificial Sequence
  Synthetic
caccgctgtcccaaaaggtctatcatagatgtattgtcctaagttttgtagccaaggcctaggaaagtgtcttactgcttctgcttttagttcttccagggtctctaatgcccattcattcatatcagcagccagggcct

SEQ ID NO: 413875 - DNA, 140 bp, Artificial Sequence
  Synthetic
atacgccatgctgggtctcctggaggaggagcaggggataataaactgctgttttttcatgatgaccacagaagtaaaagataagatgatgaaagttgctgtttttttttatattgttgacgtacttgggagtcggccat

SEQ ID NO: 413876 - DNA, 140 bp, Artificial Sequence
  Synthetic
atggccgactcccaagtacgtcaacaatataaaaaaaaacagcaactttcatcatcttatcttttacttctgtggtcatcatgaaaaaacagcagtttattatcccctgctcctcctccaggagacccagcatggcgtat

SEQ ID NO: 413877 - DNA, 140 bp, Artificial Sequence
  Synthetic
aggccctggctgctgatatgccacagccatagcagtagctgaggggacagataggattatagaagtattacaaagaatttttagagctattctccacatacctagaagaataagacaggggaccttttgggacagcggtg

SEQ ID NO: 413878 - DNA, 140 bp, Artificial Sequence
  Synthetic
caccgctgtcccaaaaggtcccctgtcttattcttctaggtatgtggagaatagctctaaaaattctttgtaatacttctataatcctatctgtcccctcagctactgctatggctgtggcatatcagcagccagggcct

SEQ ID NO: 413879 - DNA, 140 bp, Artificial Sequence
  Synthetic
aggccctggctgctgatatgtcacaaagaagggtttgggaatctcccatggcaggaagaagcgacgacgaccggcagctgctgcaagctgttcgaataataaggatcttgtatcaaagcagaccttttgggacagcggtg

SEQ ID NO: 413880 - DNA, 140 bp, Artificial Sequence
  Synthetic
caccgctgtcccaaaaggtctgctttgatacaagatccttattattcgaacagcttgcagcagctgccggtcgtcgtcgcttcttcctgccatgggagattcccaaacccttctttgtgacatatcagcagccagggcct

SEQ ID NO: 413881 - DNA, 140 bp, Artificial Sequence
  Synthetic
atacgccatgctgggtctcctacactggtaggccagcccgcaatattagcatgaatgaagaaatgacaaattgctctttcaatacgaccacagaaataagagataagaaacagaaagcgtcgtacttgggagtcggccat

SEQ ID NO: 413882 - DNA, 140 bp, Artificial Sequence
  Synthetic
atggccgactcccaagtacgacgctttctgtttcttatctcttatttctgtggtcgtattgaaagagcaatttgtcatttcttcattcatgctaatattgcgggctggcctaccagtgtaggagacccagcatggcgtat

SEQ ID NO: 413883 - DNA, 140 bp, Artificial Sequence
  Synthetic
  misc_feature (56)..(56): n is a, c, g, or t
  misc_feature (62)..(62): n is a, c, g, or t
  misc_feature (94)..(94): n is a, c, g, or t
atacgccatgctgggtctccctgctgtgccttggaatgctagttggagtaataaancccagnaagagatttgggaaaacatgacctggatgcantgggaaagagaaattgacaattacaccgtacttgggagtcggccat

SEQ ID NO: 413884 - DNA, 140 bp, Artificial Sequence
  Synthetic
  misc_feature (47)..(47): n is a, c, g, or t
  misc_feature (79)..(79): n is a, c, g, or t
  misc_feature (85)..(85): n is a, c, g, or t
atggccgactcccaagtacggtgtaattgtcaatttctctttcccantgcatccaggtcatgttttcccaaatctcttnctgggntttattactccaactagcattccaaggcacagcagggagacccagcatggcgtat

SEQ ID NO: 413885 - DNA, 140 bp, Artificial Sequence
  Synthetic
  misc_feature (87)..(87): n is a, c, g, or t
atacgccatgctgggtctccaataaaaagaataagagaagtcagggatgacagtgattatgagagtaatggagaggaagaacaagangttatgcatcttgtgcatactcatggttttgctcgtacttgggagtcggccat

SEQ ID NO: 413886 - DNA, 140 bp, Artificial Sequence
  Synthetic
  misc_feature (54)..(54): n is a, c, g, or t
atggccgactcccaagtacgagcaaaaccatgagtatgcacaagatgcataacntcttgttcttcctctccattactctcataatcactgtcatccctgacttctcttattctttttattggagacccagcatggcgtat

SEQ ID NO: 413887 - DNA, 140 bp, Artificial Sequence
  Synthetic
  misc_feature (42)..(42): n is a, c, g, or t
atacgccatgctgggtctcctgcctgtgtgggaagatgcaancccaacattattctgtgcttcagatgttaaccttactagcactgagagccataatatttgggcatcacaggcctgcgtcgtacttgggagtcggccat

SEQ ID NO: 413888 - DNA, 140 bp, Artificial Sequence
  Synthetic
  misc_feature (99)..(99): n is a, c, g, or t
atggccgactcccaagtacgacgcaggcctgtgatgcccaaatattatggctctcagtgctagtaaggttaacatctgaagcacagaataatgttgggnttgcatcttcccacacaggcaggagacccagcatggcgtat

SEQ ID NO: 413889 - DNA, 140 bp, Artificial Sequence
  Synthetic
  misc_feature (49)..(49): n is a, c, g, or t
  misc_feature (52)..(52): n is a, c, g, or t
  misc_feature (72)..(72): n is a, c, g, or t
  misc_feature (84)..(84): n is a, c, g, or t
aggccctggctgctgatatgacagagttaggcaggggtactcaccattntcnttgcagacccacctcccagncaggaggggacncgacaggcccgaaggaatcgaagaagaaggtggagagaccttttgggacagcggtg

SEQ ID NO: 413890 - DNA, 140 bp, Artificial Sequence
  Synthetic
  misc_feature (57)..(57): n is a, c, g, or t
  misc_feature (69)..(69): n is a, c, g, or t
  misc_feature (89)..(89): n is a, c, g, or t
  misc_feature (92)..(92): n is a, c, g, or t
caccgctgtcccaaaaggtctctccaccttcttcttcgattccttcgggcctgtcgngtcccctcctgnctgggaggtgggtctgcaanganaatggtgagtacccctgcctaactctgtcatatcagcagccagggcct

SEQ ID NO: 413891 - DNA, 140 bp, Artificial Sequence
  Synthetic
atacgccatgctgggtctcccacaagggatggaagtaaaaaagtgtgaatttaatgtaactacagttttaaaagacaaaaaggaaaagaaacaggctctattctatgtatcagatttggccgtacttgggagtcggccat

SEQ ID NO: 413892 - DNA, 140 bp, Artificial Sequence
  Synthetic
atggccgactcccaagtacggccaaatctgatacatagaatagagcctgtttcttttcctttttgtcttttaaaactgtagttacattaaattcacacttttttacttccatcccttgtgggagacccagcatggcgtat

SEQ ID NO: 413893 - DNA, 140 bp, Artificial Sequence
  Synthetic
aggccctggctgctgatatgggaaaggatcaccagcaatattccagagtagcatgacaaaaatcttagagccctttagggcacaaaatccagaaatagtcatctatcaatatatggatgagaccttttgggacagcggtg

SEQ ID NO: 413894 - DNA, 140 bp, Artificial Sequence
  Synthetic
caccgctgtcccaaaaggtctcatccatatattgatagatgactatttctggattttgtgccctaaagggctctaagatttttgtcatgctactctggaatattgctggtgatcctttcccatatcagcagccagggcct

SEQ ID NO: 413895 - DNA, 140 bp, Artificial Sequence
  Synthetic
atacgccatgctgggtctccattccacaaccatcaagcaagcctgcccaaaggtttcttttgagcccatcccaatacattattgtgctccagcaggatatgccatctttaagtgtaatgacgtacttgggagtcggccat

SEQ ID NO: 413896 - DNA, 140 bp, Artificial Sequence
  Synthetic
atggccgactcccaagtacgtcattacacttaaagatggcatatcctgctggagcacaataatgtattgggatgggctcaaaagaaacctttgggcaggcttgcttgatggttgtggaatggagacccagcatggcgtat

SEQ ID NO: 413897 - DNA, 140 bp, Artificial Sequence
  Synthetic
  misc_feature (44)..(44): n is a, c, g, or t
  misc_feature (50)..(50): n is a, c, g, or t
aggccctggctgctgatatggcctggctagaagcacaagaggangaggangtggggtttccagtcagacctcaggtccccttaagaccaatgactttcaagggagctctagatcttagccgaccttttgggacagcggtg

SEQ ID NO: 413898 - DNA, 140 bp, Artificial Sequence
  Synthetic
  misc_feature (91)..(91): n is a, c, g, or t
  misc_feature (97)..(97): n is a, c, g, or t
caccgctgtcccaaaaggtcggctaagatctagagctcccttgaaagtcattggtcttaaggggacctgaggtctgactggaaaccccacntcctcntcctcttgtgcttctagccaggccatatcagcagccagggcct

SEQ ID NO: 413899 - DNA, 140 bp, Artificial Sequence
  Synthetic
aggccctggctgctgatatgacaatctctgaaggaaacataagaatgctgggaaaaaatctgacaagtaatgagaatatcctagtgactctaaattccactataagcataacctgtgagagaccttttgggacagcggtg

SEQ ID NO: 413900 - DNA, 140 bp, Artificial Sequence
  Synthetic
caccgctgtcccaaaaggtctctcacaggttatgcttatagtggaatttagagtcactaggatattctcattacttgtcagattttttcccagcattcttatgtttccttcagagattgtcatatcagcagccagggcct

SEQ ID NO: 413901 - DNA, 140 bp, Artificial Sequence
  Synthetic
atacgccatgctgggtctcctacagcatgacattagaacaaaacaaaacaggcagtaacataaggacagcttattgcaattataatggctctgactgggaaggtacattaaaaggagtagcgtacttgggagtcggccat

SEQ ID NO: 413902 - DNA, 140 bp, Artificial Sequence
  Synthetic
atggccgactcccaagtacgctactccttttaatgtaccttcccagtcagagccattataattgcaataagctgtccttatgttactgcctgttttgttttgttctaatgtcatgctgtaggagacccagcatggcgtat

SEQ ID NO: 413903 - DNA, 140 bp, Artificial Sequence
  Synthetic
aggccctggctgctgatatgttattgcaattataatggctctgactgggaaggtacattaaaaggagtagctgaaagatatttagaacttataaatcagacaaacaatgctaccgtgacagaccttttgggacagcggtg

SEQ ID NO: 413904 - DNA, 140 bp, Artificial Sequence
  Synthetic
caccgctgtcccaaaaggtctgtcacggtagcattgtttgtctgatttataagttctaaatatctttcagctactccttttaatgtaccttcccagtcagagccattataattgcaataacatatcagcagccagggcct

SEQ ID NO: 413905 - DNA, 140 bp, Artificial Sequence
  Synthetic
atacgccatgctgggtctccacagcacatctatgaaacctatggggatacttggacaggagttgaagctctaataagaatactgcaacaactactgtttattcatttcagaattgggtgccgtacttgggagtcggccat

SEQ ID NO: 413906 - DNA, 140 bp, Artificial Sequence
  Synthetic
atggccgactcccaagtacggcacccaattctgaaatgaataaacagtagttgttgcagtattcttattagagcttcaactcctgtccaagtatccccataggtttcatagatgtgctgtggagacccagcatggcgtat

SEQ ID NO: 413907 - DNA, 140 bp, Artificial Sequence
  Synthetic
atacgccatgctgggtctccctgtcatggagaattcttttattgtgacacaagtaagatgtttaattatacctttaattgtaacaagaccaaatgtaataatagtaaaaatagtacccatcgtacttgggagtcggccat

SEQ ID NO: 413908 - DNA, 140 bp, Artificial Sequence
  Synthetic
atggccgactcccaagtacgatgggtactatttttactattattacatttggtcttgttacaattaaaggtataattaaacatcttacttgtgtcacaataaaagaattctccatgacagggagacccagcatggcgtat

SEQ ID NO: 413909 - DNA, 140 bp, Artificial Sequence
  Synthetic
aggccctggctgctgatatgcctttaattgtaacaagaccaaatgtaataatagtaaaaatagtacccataataacactatgacaacaataccttgcagaataaaacaggtagtaaggtcgaccttttgggacagcggtg

SEQ ID NO: 413910 - DNA, 140 bp, Artificial Sequence
  Synthetic
caccgctgtcccaaaaggtcgaccttactacctgttttattctgcaaggtattgttgtcatagtgttattatgggtactatttttactattattacatttggtcttgttacaattaaaggcatatcagcagccagggcct

SEQ ID NO: 413911 - DNA, 140 bp, Artificial Sequence
  Synthetic
aggccctggctgctgatatgaaagagttaatagcagaagtacaaaaacaagaacaaggacaatggacatatcaaatttaccaagagccatacaaaaatctgaaaacaggaaaatatgcaagaccttttgggacagcggtg

SEQ ID NO: 413912 - DNA, 140 bp, Artificial Sequence
  Synthetic
caccgctgtcccaaaaggtcttgcatattttcctgttttcagatttttgtatggctcttggtaaatttgatatgtccattgtccttgttcttgtttttgtacttctgctattaactctttcatatcagcagccagggcct

SEQ ID NO: 413913 - DNA, 140 bp, Artificial Sequence
  Synthetic
atacgccatgctgggtctcctaacctgcatatcaaacataactggaatgattctattaagggacgagccagggaataacagcagacacacccttaggccagtagggggagatatgaaagacgtacttgggagtcggccat

SEQ ID NO: 413914 - DNA, 140 bp, Artificial Sequence
  Synthetic
atggccgactcccaagtacgtctttcatatctccccctactggcctaagggtgtgtctgctgttattccctggctcgtcccttaatagaatcattccagttatgtttgatatgcaggttaggagacccagcatggcgtat

SEQ ID NO: 413915 - DNA, 140 bp, Artificial Sequence
  Synthetic
aggccctggctgctgatatggggaataacagcagacacacccttaggccagtagggggagatatgaaagatatatggagaactgaattagtcaattacaaagtagtaaaaataaaaccttgaccttttgggacagcggtg

SEQ ID NO: 413916 - DNA, 140 bp, Artificial Sequence
  Synthetic
caccgctgtcccaaaaggtcaaggttttatttttactactttgtaattgactaattcagttctccatatatctttcatatctccccctactggcctaagggtgtgtctgctgttattccccatatcagcagccagggcct

SEQ ID NO: 413917 - DNA, 140 bp, Artificial Sequence
  Synthetic
aggccctggctgctgatatgatacaggcccagcaacagttgctgaggttatctgtatggggtatcagacaactccgagctcgcctgcaagccttagaaacctttatacagaatcagcaacgaccttttgggacagcggtg

SEQ ID NO: 413918 - DNA, 140 bp, Artificial Sequence
  Synthetic
caccgctgtcccaaaaggtcgttgctgattctgtataaaggtttctaaggcttgcaggcgagctcggagttgtctgataccccatacagataacctcagcaactgttgctgggcctgtatcatatcagcagccagggcct

SEQ ID NO: 413919 - DNA, 140 bp, Artificial Sequence
  Synthetic
aggccctggctgctgatatgaataatcctgacttggcctggctggaagcacaagaggaagaggaagtaggctttccagtcagacctcaggtacctttaagaccaatgacttataaggcaggaccttttgggacagcggtg

SEQ ID NO: 413920 - DNA, 140 bp, Artificial Sequence
  Synthetic
caccgctgtcccaaaaggtcctgccttataagtcattggtcttaaaggtacctgaggtctgactggaaagcctacttcctcttcctcttgtgcttccagccaggccaagtcaggattattcatatcagcagccagggcct

SEQ ID NO: 413921 - DNA, 140 bp, Artificial Sequence
  Synthetic
aggccctggctgctgatatggaggaagtaggctttccagtcagacctcaggtacctttaagaccaatgacttataaggcagctctagatctcagtcactttttaaaagaaaaggggggacgaccttttgggacagcggtg

SEQ ID NO: 413922 - DNA, 140 bp, Artificial Sequence
  Synthetic
caccgctgtcccaaaaggtcgtccccccttttcttttaaaaagtgactgagatctagagctgccttataagtcattggtcttaaaggtacctgaggtctgactggaaagcctacttcctccatatcagcagccagggcct

SEQ ID NO: 413923 - DNA, 140 bp, Artificial Sequence
  Synthetic
atacgccatgctgggtctccatggcagcagtgggatcagcagatagagaatgtaagctccatcatatatgaagaaatacaaaaggcacaagaacaacaggaacaaaatgagaagaagttgcgtacttgggagtcggccat

SEQ ID NO: 413924 - DNA, 140 bp, Artificial Sequence
  Synthetic
atggccgactcccaagtacgcaacttcttctcattttgttcctgttgttcttgtgccttttgtatttcttcatatatgatggagcttacattctctatctgctgatcccactgctgccatggagacccagcatggcgtat

SEQ ID NO: 413925 - DNA, 140 bp, Artificial Sequence
  Synthetic
aggccctggctgctgatatgtttgttataagatgggtggcaagtggtcaaaaagtagtatctttggatggcctgctgtaagggaaagaatgagacgagcagaaccagcagctgaaccagcgaccttttgggacagcggtg

SEQ ID NO: 413926 - DNA, 140 bp, Artificial Sequence
  Synthetic
caccgctgtcccaaaaggtcgctggttcagctgctggttctgctcgtctcattctttcccttacagcaggccatccaaagatactactttttgaccacttgccacccatcttataacaaacatatcagcagccagggcct

SEQ ID NO: 413927 - DNA, 140 bp, Artificial Sequence
  Synthetic
atacgccatgctgggtctcccggacgataatcctgtggagttaccgtctcttgaccagcttagcatcagggatctggagagtgaacagttacctgggacttggactggggattctgggaccgtacttgggagtcggccat

SEQ ID NO: 413928 - DNA, 140 bp, Artificial Sequence
  Synthetic
atggccgactcccaagtacggtcccagaatccccagtccaagtcccaggtaactgttcactctccagatccctgatgctaagctggtcaagagacggtaactccacaggattatcgtccgggagacccagcatggcgtat

SEQ ID NO: 413929 - DNA, 140 bp, Artificial Sequence
  Synthetic
atacgccatgctgggtctccctacaagaattgcaaaaaagtgctacaagcttgctagataccattgcaataatagttggcaattggactgatagtatcatcttaggactacaaagaatagcgtacttgggagtcggccat

SEQ ID NO: 413930 - DNA, 140 bp, Artificial Sequence
  Synthetic
atggccgactcccaagtacgctattctttgtagtcctaagatgatactatcagtccaattgccaactattattgcaatggtatctagcaagcttgtagcacttttttgcaattcttgtagggagacccagcatggcgtat

SEQ ID NO: 413931 - DNA, 140 bp, Artificial Sequence
  Synthetic
aggccctggctgctgatatgaatagttggcaattggactgatagtatcatcttaggactacaaagaataggaaggggaattcttaacatcccaagaagaattagacagggccttgaacgcgaccttttgggacagcggtg

SEQ ID NO: 413932 - DNA, 140 bp, Artificial Sequence
  Synthetic
caccgctgtcccaaaaggtcgcgttcaaggccctgtctaattcttcttgggatgttaagaattccccttcctattctttgtagtcctaagatgatactatcagtccaattgccaactattcatatcagcagccagggcct

SEQ ID NO: 413933 - DNA, 140 bp, Artificial Sequence
  Synthetic
  misc_feature (70)..(70): n is a, c, g, or t
  misc_feature (97)..(97): n is a, c, g, or t
atacgccatgctgggtctccggtcagcagtaagagatagaatgagacaaacctcccctaatcctgagccntgtgcacctggggtaggagaaatttcnagacagttatcagaaagagggggcgtacttgggagtcggccat

SEQ ID NO: 413934 - DNA, 140 bp, Artificial Sequence
  Synthetic
  misc_feature (44)..(44): n is a, c, g, or t
  misc_feature (71)..(71): n is a, c, g, or t
atggccgactcccaagtacgccccctctttctgataactgtctngaaatttctcctaccccaggtgcacanggctcaggattaggggaggtttgtctcattctatctcttactgctgaccggagacccagcatggcgtat

SEQ ID NO: 413935 - DNA, 140 bp, Artificial Sequence
  Synthetic
atacgccatgctgggtctccaaagccaccaagaggaggaagaagtagggttcccagtaagacctcaagtgcctctaaggccaatgacctataaaggagcatttgacctcggcttctttttcgtacttgggagtcggccat

SEQ ID NO: 413936 - DNA, 140 bp, Artificial Sequence
  Synthetic
atggccgactcccaagtacgaaaaagaagccgaggtcaaatgctcctttataggtcattggccttagaggcacttgaggtcttactgggaaccctacttcttcctcctcttggtggctttggagacccagcatggcgtat

SEQ ID NO: 413937 - DNA, 140 bp, Artificial Sequence
  Synthetic
aggccctggctgctgatatgaggatctctacaatatttggcactgaaagcattagtaacaccaacaaagacaaggccacctttgcctagtgttaggaaattaacagaagatagatggaacgaccttttgggacagcggtg

SEQ ID NO: 413938 - DNA, 140 bp, Artificial Sequence
  Synthetic
caccgctgtcccaaaaggtcgttccatctatcttctgttaatttcctaacactaggcaaaggtggccttgtctttgttggtgttactaatgctttcagtgccaaatattgtagagatcctcatatcagcagccagggcct

SEQ ID NO: 413939 - DNA, 140 bp, Artificial Sequence
  Synthetic
  misc_feature (61)..(61): n is a, c, g, or t
  misc_feature (63)..(63): n is a, c, g, or t
atacgccatgctgggtctcctgttacaacagttagaaccagctctcaagacagggtcagangntctgaagtcactctggaacacaatagcggtactctggtgcgttcataacagatttaacgtacttgggagtcggccat

SEQ ID NO: 413940 - DNA, 140 bp, Artificial Sequence
  Synthetic
  misc_feature (78)..(78): n is a, c, g, or t
  misc_feature (80)..(80): n is a, c, g, or t
atggccgactcccaagtacgttaaatctgttatgaacgcaccagagtaccgctattgtgttccagagtgacttcagancntctgaccctgtcttgagagctggttctaactgttgtaacaggagacccagcatggcgtat

SEQ ID NO: 413941 - DNA, 140 bp, Artificial Sequence
  Synthetic
aggccctggctgctgatatgtcactctggaacacaatagcggtactctggtgcgttcataacagatttaaagttgaagatacgcagcaggcaatacagaaattaaaagaagtaatgggaagaccttttgggacagcggtg

SEQ ID NO: 413942 - DNA, 140 bp, Artificial Sequence
  Synthetic
caccgctgtcccaaaaggtcttcccattacttcttttaatttctgtattgcctgctgcgtatcttcaactttaaatctgttatgaacgcaccagagtaccgctattgtgttccagagtgacatatcagcagccagggcct

SEQ ID NO: 413943 - DNA, 140 bp, Artificial Sequence
  Synthetic
aggccctggctgctgatatgcctctcccccaggactttaaatgcatgggtaaaggcagtagaagaaaaggcctttaaccctgaaattattcctatgtttatggcattgtcagaaggagctgaccttttgggacagcggtg

SEQ ID NO: 413944 - DNA, 140 bp, Artificial Sequence
  Synthetic
caccgctgtcccaaaaggtcagctccttctgacaatgccataaacataggaataatttcagggttaaaggccttttcttctactgcctttacccatgcatttaaagtcctgggggagaggcatatcagcagccagggcct

SEQ ID NO: 413945 - DNA, 140 bp, Artificial Sequence
  Synthetic
atacgccatgctgggtctccaactttacggatacaacaaatggagaaataaagaattgctctttcaatataaccacagaagtaagagataggaaaaagaatgaacatgcacttttttatacgtacttgggagtcggccat

SEQ ID NO: 413946 - DNA, 140 bp, Artificial Sequence
  Synthetic
atggccgactcccaagtacgtataaaaaagtgcatgttcattctttttcctatctcttacttctgtggttatattgaaagagcaattctttatttctccatttgttgtatccgtaaagttggagacccagcatggcgtat

SEQ ID NO: 413947 - DNA, 140 bp, Artificial Sequence
  Synthetic
atacgccatgctgggtctcccctgtacaaattgtgtgtacaaggcctaacaataatacaaggagaagtgtgaggataggaccaggacaaacattctatgcaagaggggacataataggaacgtacttgggagtcggccat

SEQ ID NO: 413948 - DNA, 140 bp, Artificial Sequence
  Synthetic
atggccgactcccaagtacgttcctattatgtcccctcttgcatagaatgtttgtcctggtcctatcctcacacttctccttgtattattgttaggccttgtacacacaatttgtacaggggagacccagcatggcgtat

SEQ ID NO: 413949 - DNA, 140 bp, Artificial Sequence
  Synthetic
atacgccatgctgggtctcctagaaagaggaaagaatacgcgcttttctatagacttgatgtaataccaattaatgatgatagtagtaatagtacaggtaattatagtaattataggctacgtacttgggagtcggccat

SEQ ID NO: 413950 - DNA, 140 bp, Artificial Sequence
  Synthetic
atggccgactcccaagtacgtagcctataattactataattacctgtactattactactatcatcattaattggtattacatcaagtctatagaaaagcgcgtattctttcctctttctaggagacccagcatggcgtat

SEQ ID NO: 413951 - DNA, 140 bp, Artificial Sequence
  Synthetic
aggccctggctgctgatatgaacatttgcaccatcctcaggaggggacctagaaattacaacacatagctttaattgtagaggagaatttttctattgcaatacatcaaacttgtttaatgaccttttgggacagcggtg

SEQ ID NO: 413952 - DNA, 140 bp, Artificial Sequence
  Synthetic
caccgctgtcccaaaaggtcattaaacaagtttgatgtattgcaatagaaaaattctcctctacaattaaagctatgtgttgtaatttctaggtcccctcctgaggatggtgcaaatgttcatatcagcagccagggcct

SEQ ID NO: 413953 - DNA, 140 bp, Artificial Sequence
  Synthetic
aggccctggctgctgatatgacaatgtacacatggaattaggccagtagtatcaactcaactgctgttaaatggcagtctagcagaagaagaggtagtaattagatctgaaaatttcacggaccttttgggacagcggtg

SEQ ID NO: 413954 - DNA, 140 bp, Artificial Sequence
  Synthetic
caccgctgtcccaaaaggtccgtgaaattttcagatctaattactacctcttcttctgctagactgccatttaacagcagttgagttgatactactggcctaattccatgtgtacattgtcatatcagcagccagggcct

SEQ ID NO: 413955 - DNA, 140 bp, Artificial Sequence
  Synthetic
aggccctggctgctgatatgatcagtgacagtactggatgtgggggatgcatatttttcagttcctttagatgaagacttcaggaagtatactgcattcaccatacctagtataaacaatgaccttttgggacagcggtg

SEQ ID NO: 413956 - DNA, 140 bp, Artificial Sequence
  Synthetic
caccgctgtcccaaaaggtcattgtttatactaggtatggtgaatgcagtatacttcctgaagtcttcatctaaaggaactgaaaaatatgcatcccccacatccagtactgtcactgatcatatcagcagccagggcct

SEQ ID NO: 413957 - DNA, 140 bp, Artificial Sequence
  Synthetic
atacgccatgctgggtctccattacgtgtgtcagacccaacaacaatacaagaaaaagtatacacctcgggccaggacaagcgctctatgcaacaggggacataataggaaatataagaccgtacttgggagtcggccat

SEQ ID NO: 413958 - DNA, 140 bp, Artificial Sequence
  Synthetic
atggccgactcccaagtacggtcttatatttcctattatgtcccctgttgcatagagcgcttgtcctggcccgaggtgtatactttttcttgtattgttgttgggtctgacacacgtaatggagacccagcatggcgtat

SEQ ID NO: 413959 - DNA, 140 bp, Artificial Sequence
  Synthetic
aggccctggctgctgatatggccaggacaagcgctctatgcaacaggggacataataggaaatataagacaggcacattgtgatgttagtagaagaaattggagtaacatgatagagaaggaccttttgggacagcggtg

SEQ ID NO: 413960 - DNA, 140 bp, Artificial Sequence
  Synthetic
caccgctgtcccaaaaggtccttctctatcatgttactccaatttcttctactaacatcacaatgtgcctgtcttatatttcctattatgtcccctgttgcatagagcgcttgtcctggccatatcagcagccagggcct

SEQ ID NO: 413961 - DNA, 140 bp, Artificial Sequence
  Synthetic
aggccctggctgctgatatgaaaagcaggatatgttactgacagaggaagacaaaaagttgtctccctaactgagaccacaaatcagaaggctgagttacaagcaattcagttagctttagaccttttgggacagcggtg

SEQ ID NO: 413962 - DNA, 140 bp, Artificial Sequence
  Synthetic
caccgctgtcccaaaaggtctaaagctaactgaattgcttgtaactcagccttctgatttgtggtctcagttagggagacaactttttgtcttcctctgtcagtaacatatcctgcttttcatatcagcagccagggcct

SEQ ID NO: 413963 - DNA, 140 bp, Artificial Sequence
  Synthetic
aggccctggctgctgatatgaaataaaacaaattataaacatgtggcaggaagtaggaaaagcaatgtatgcccctcccatcgaaggacaaattagatgttcatcaaatattacagggctgaccttttgggacagcggtg

SEQ ID NO: 413964 - DNA, 140 bp, Artificial Sequence
  Synthetic
caccgctgtcccaaaaggtcagccctgtaatatttgatgaacatctaatttgtccttcgatgggaggggcatacattgcttttcctacttcctgccacatgtttataatttgttttatttcatatcagcagccagggcct

SEQ ID NO: 413965 - DNA, 140 bp, Artificial Sequence
  Synthetic
atacgccatgctgggtctcccttagagaacatttatatcggtggggattcactacccctgataaaaagcatcaaaaggaacctccctttctgtggatggggtatgagctccacccagacacgtacttgggagtcggccat

SEQ ID NO: 413966 - DNA, 140 bp, Artificial Sequence
  Synthetic
atggccgactcccaagtacgtgtctgggtggagctcataccccatccacagaaagggaggttccttttgatgctttttatcaggggtagtgaatccccaccgatataaatgttctctaagggagacccagcatggcgtat

SEQ ID NO: 413967 - DNA, 140 bp, Artificial Sequence
  Synthetic
aggccctggctgctgatatgtatggcaattagattgtacacatttagaaggaaaagttatcctggtagcagtccatgtagctagtgggtacctagaagcagaagttatcccagcagaaacgaccttttgggacagcggtg

SEQ ID NO: 413968 - DNA, 140 bp, Artificial Sequence
  Synthetic
caccgctgtcccaaaaggtcgtttctgctgggataacttctgcttctaggtacccactagctacatggactgctaccaggataacttttccttctaaatgtgtacaatctaattgccatacatatcagcagccagggcct

SEQ ID NO: 413969 - DNA, 140 bp, Artificial Sequence
  Synthetic
atacgccatgctgggtctcctaacaaagacttatgggttaatattcagaagcatggaaaagggcaatggacttatcagatatatcaggatgaacataaaaacctcaaaacaggaaaatatcgtacttgggagtcggccat

SEQ ID NO: 413970 - DNA, 140 bp, Artificial Sequence
  Synthetic
atggccgactcccaagtacgatattttcctgttttgaggtttttatgttcatcctgatatatctgataagtccattgcccttttccatgcttctgaatattaacccataagtctttgttaggagacccagcatggcgtat

SEQ ID NO: 413971 - DNA, 140 bp, Artificial Sequence
  Synthetic
aggccctggctgctgatatgaaatggggaacaagtggtcaaaaagctggcctgctgtaagagaaagaataagaagaactaggccagcaagaggaaatgagccagcagcagagggagtagggaccttttgggacagcggtg

SEQ ID NO: 413972 - DNA, 140 bp, Artificial Sequence
  Synthetic
caccgctgtcccaaaaggtccctactccctctgctgctggctcatttcctcttgctggcctagttcttcttattctttctcttacagcaggccagctttttgaccacttgttccccatttcatatcagcagccagggcct

SEQ ID NO: 413973 - DNA, 140 bp, Artificial Sequence
  Synthetic
aggccctggctgctgatatggtttagtaaaataccatatgcatgtttcaaagaaagccaaaaaatgggtttatagacatcactttgaaagcaggcatccaagagtaagttcagaagtacagaccttttgggacagcggtg

SEQ ID NO: 413974 - DNA, 140 bp, Artificial Sequence
  Synthetic
caccgctgtcccaaaaggtctgtacttctgaacttactcttggatgcctgctttcaaagtgatgtctataaacccattttttggctttctttgaaacatgcatatggtattttactaaaccatatcagcagccagggcct

SEQ ID NO: 413975 - DNA, 140 bp, Artificial Sequence
  Synthetic
atacgccatgctgggtctccttagaaagagctttgctataaaatgggaggcagatggtcaaaaagaggatggcctgcggtaagggaaagaataagacaaaccccaataagacaaccccctcgtacttgggagtcggccat

SEQ ID NO: 413976 - DNA, 140 bp, Artificial Sequence
  Synthetic
atggccgactcccaagtacgagggggttgtcttattggggtttgtcttattctttcccttaccgcaggccatcctctttttgaccatctgcctcccattttatagcaaagctctttctaaggagacccagcatggcgtat

SEQ ID NO: 413977 - DNA, 140 bp, Artificial Sequence
  Synthetic
  misc_feature (66)..(66): n is a, c, g, or t
aggccctggctgctgatatgacgagctgagccagcagcagatggggtgggaccagtatcgcgaganctggaacgacatggagcaatcacaagtagcaatacagcagctactaatgctgatgaccttttgggacagcggtg

SEQ ID NO: 413978 - DNA, 140 bp, Artificial Sequence
  Synthetic
  misc_feature (75)..(75): n is a, c, g, or t
caccgctgtcccaaaaggtcatcagcattagtagctgctgtattgctacttgtgattgctccatgtcgttccagntctcgcgatactggtcccaccccatctgctgctggctcagctcgtcatatcagcagccagggcct

SEQ ID NO: 413979 - DNA, 140 bp, Artificial Sequence
  Synthetic
aggccctggctgctgatatggcaaatggattgcacacatttagaaggcaaagtcataatagttgctgtccatgtggcaagtggattcatagaagcagaagtgataccagcagaaacaggagaccttttgggacagcggtg

SEQ ID NO: 413980 - DNA, 140 bp, Artificial Sequence
  Synthetic
caccgctgtcccaaaaggtctcctgtttctgctggtatcacttctgcttctatgaatccacttgccacatggacagcaactattatgactttgccttctaaatgtgtgcaatccatttgccatatcagcagccagggcct

SEQ ID NO: 413981 - DNA, 140 bp, Artificial Sequence
  Synthetic
aggccctggctgctgatatggaggaggtgggttttccagtcagacctcaggtacctttaagaccaatgacttacaaggcagctgtagatcttagccactttttaaaagaaaaggggggacgaccttttgggacagcggtg

SEQ ID NO: 413982 - DNA, 140 bp, Artificial Sequence
  Synthetic
caccgctgtcccaaaaggtcgtccccccttttcttttaaaaagtggctaagatctacagctgccttgtaagtcattggtcttaaaggtacctgaggtctgactggaaaacccacctcctccatatcagcagccagggcct

SEQ ID NO: 413983 - DNA, 140 bp, Artificial Sequence
  Synthetic
aggccctggctgctgatatgcagaaggagccaccccacaagatttaaataccatgctaaacacagtgggggggcatcaagcagctatgcaaatgctaaaagatactatcaatgaggaagcgaccttttgggacagcggtg

SEQ ID NO: 413984 - DNA, 140 bp, Artificial Sequence
  Synthetic
caccgctgtcccaaaaggtcgcttcctcattgatagtatcttttagcatttgcatagctgcttgatgcccccccactgtgtttagcatggtatttaaatcttgtggggtggctccttctgcatatcagcagccagggcct

SEQ ID NO: 413985 - DNA, 140 bp, Artificial Sequence
  Synthetic
atacgccatgctgggtctcccatctgcattatttcacctgttttacagggtcagcaatcaggagagccattctagggcagagagtgctgaccaggtgtgaataccctgcaggacatagtccgtacttgggagtcggccat

SEQ ID NO: 413986 - DNA, 140 bp, Artificial Sequence
  Synthetic
atggccgactcccaagtacggactatgtcctgcagggtattcacacctggtcagcactctctgccctagaatggctctcctgattgctgaccctgtaaaacaggtgaaataatgcagatgggagacccagcatggcgtat

SEQ ID NO: 413987 - DNA, 140 bp, Artificial Sequence
  Synthetic
atacgccatgctgggtctccgtactactactgatagtaatagaatgattggagaaatgaaaaactgctctttcaatacaactacagaaataagggataagaatcagaaagcgtatgcactcgtacttgggagtcggccat

SEQ ID NO: 413988 - DNA, 140 bp, Artificial Sequence
  Synthetic
atggccgactcccaagtacgagtgcatacgctttctgattcttatcccttatttctgtagttgtattgaaagagcagtttttcatttctccaatcattctattactatcagtagtagtacggagacccagcatggcgtat

SEQ ID NO: 413989 - DNA, 140 bp, Artificial Sequence
  Synthetic
atacgccatgctgggtctcccttcttgcagctatagtgatatggatgtttattcttaagaaatatttagaacagaaggaacaagatagaagggaaagagagctgcttaaaagaatagaaacgtacttgggagtcggccat

SEQ ID NO: 413990 - DNA, 140 bp, Artificial Sequence
  Synthetic
atggccgactcccaagtacgtttctattcttttaagcagctctctttcccttctatcttgttccttctgttctaaatatttcttaagaataaacatccatatcactatagctgcaagaagggagacccagcatggcgtat

SEQ ID NO: 413991 - DNA, 140 bp, Artificial Sequence
  Synthetic
  misc_feature (27)..(27): n is a, c, g, or t
  misc_feature (33)..(33): n is a, c, g, or t
atacgccatgctgggtctccgactaanagaagncagggatgatagtgactatgaaagtaatggagatgaagaacaagaagttatgcatcttgtgcatactcatggctttgctaatcccatcgtacttgggagtcggccat

SEQ ID NO: 413992 - DNA, 140 bp, Artificial Sequence
  Synthetic
  misc_feature (108)..(108): n is a, c, g, or t
  misc_feature (114)..(114): n is a, c, g, or t
atggccgactcccaagtacgatgggattagcaaagccatgagtatgcacaagatgcataacttcttgttcttcatctccattactttcatagtcactatcatccctgncttctnttagtcggagacccagcatggcgtat

SEQ ID NO: 413993 - DNA, 140 bp, Artificial Sequence
  Synthetic
atacgccatgctgggtctccactaatactgcaacaagtacaccagggatagaggagatgaaagtaaaaaaatgtgaatttaatgtaactacaattttaaaagacaaaaaggaaaagaaaccgtacttgggagtcggccat

SEQ ID NO: 413994 - DNA, 140 bp, Artificial Sequence
  Synthetic
atggccgactcccaagtacggtttcttttcctttttgtcttttaaaattgtagttacattaaattcacatttttttactttcatctcctctatccctggtgtacttgttgcagtattagtggagacccagcatggcgtat

SEQ ID NO: 413995 - DNA, 140 bp, Artificial Sequence
  Synthetic
aggccctggctgctgatatgatgtgaatttaatgtaactacaattttaaaagacaaaaaggaaaagaaacaggctctattctatgtatcagatttgactaaggttaataatagtgaaacggaccttttgggacagcggtg

SEQ ID NO: 413996 - DNA, 140 bp, Artificial Sequence
  Synthetic
caccgctgtcccaaaaggtccgtttcactattattaaccttagtcaaatctgatacatagaatagagcctgtttcttttcctttttgtcttttaaaattgtagttacattaaattcacatcatatcagcagccagggcct

SEQ ID NO: 413997 - DNA, 140 bp, Artificial Sequence
  Synthetic
atacgccatgctgggtctcccatgacctggatgcagtgggaaaaagagattgacaatcatacagaatacatatacaggttaattgaaaaatcgcagaatcagcaagaaataaatgaacaacgtacttgggagtcggccat

SEQ ID NO: 413998 - DNA, 140 bp, Artificial Sequence
  Synthetic
atggccgactcccaagtacgttgttcatttatttcttgctgattctgcgatttttcaattaacctgtatatgtattctgtatgattgtcaatctctttttcccactgcatccaggtcatgggagacccagcatggcgtat

SEQ ID NO: 413999 - DNA, 140 bp, Artificial Sequence
  Synthetic
aggccctggctgctgatatgaaggaaaaataagaatgctgggaaaaaatctttcaaatactgataatatcctagtgaccctaaattccactctaaacataacctgcgagagaccatacgagaccttttgggacagcggtg

SEQ ID NO: 414000 - DNA, 140 bp, Artificial Sequence
  Synthetic
caccgctgtcccaaaaggtctcgtatggtctctcgcaggttatgtttagagtggaatttagggtcactaggatattatcagtatttgaaagattttttcccagcattcttatttttccttcatatcagcagccagggcct

SEQ ID NO: 414001 - DNA, 140 bp, Artificial Sequence
  Synthetic
atacgccatgctgggtctccaagtagaacgaaacaagacagccgccactcccaggacagcttattgcacatataatgtctctgaatgggaaagtgcattaaaacaaatagctgaaagatacgtacttgggagtcggccat

SEQ ID NO: 414002 - DNA, 140 bp, Artificial Sequence
  Synthetic
atggccgactcccaagtacgtatctttcagctatttgttttaatgcactttcccattcagagacattatatgtgcaataagctgtcctgggagtggcggctgtcttgtttcgttctacttggagacccagcatggcgtat

SEQ ID NO: 414003 - DNA, 140 bp, Artificial Sequence
  Synthetic
aggccctggctgctgatatgtataatgtctctgaatgggaaagtgcattaaaacaaatagctgaaagatatttagaacttataaatcagacagacaatgttgctgtgatcttcgatagaagaccttttgggacagcggtg

SEQ ID NO: 414004 - DNA, 140 bp, Artificial Sequence
  Synthetic
caccgctgtcccaaaaggtcttctatcgaagatcacagcaacattgtctgtctgatttataagttctaaatatctttcagctatttgttttaatgcactttcccattcagagacattatacatatcagcagccagggcct

SEQ ID NO: 414005 - DNA, 140 bp, Artificial Sequence
  Synthetic
atacgccatgctgggtctccgaattcttttattgtaacacaagtgagatgtttaattacacctttaactgtaccccgaccaaatgtaatgaaagtagttacaatagtacaggtagttacacgtacttgggagtcggccat

SEQ ID NO: 414006 - DNA, 140 bp, Artificial Sequence
  Synthetic
atggccgactcccaagtacgtgtaactacctgtactattgtaactactttcattacatttggtcggggtacagttaaaggtgtaattaaacatctcacttgtgttacaataaaagaattcggagacccagcatggcgtat

SEQ ID NO: 414007 - DNA, 140 bp, Artificial Sequence
  Synthetic
atacgccatgctgggtctcctggataaagggagagtcgggactctatgcaccacccattaaaggttacctaacctgcatatcaaacataactggaatgattctacaaagggacagtccaacgtacttgggagtcggccat

SEQ ID NO: 414008 - DNA, 140 bp, Artificial Sequence
  Synthetic
atggccgactcccaagtacgttggactgtccctttgtagaatcattccagttatgtttgatatgcaggttaggtaacctttaatgggtggtgcatagagtcccgactctccctttatccaggagacccagcatggcgtat

SEQ ID NO: 414009 - DNA, 140 bp, Artificial Sequence
  Synthetic
  misc_feature (102)..(102): n is a, c, g, or t
aggccctggctgctgatatgaacctgcatatcaaacataactggaatgattctacaaagggacagtccaaccaattacacctttaggccagtagggggaganatgaaagatatatggagagaccttttgggacagcggtg

SEQ ID NO: 414010 - DNA, 140 bp, Artificial Sequence
  Synthetic
  misc_feature (39)..(39): n is a, c, g, or t
caccgctgtcccaaaaggtctctccatatatctttcatntctccccctactggcctaaaggtgtaattggttggactgtccctttgtagaatcattccagttatgtttgatatgcaggttcatatcagcagccagggcct

SEQ ID NO: 414011 - DNA, 140 bp, Artificial Sequence
  Synthetic
atacgccatgctgggtctccgggtggcaagtggtcaaaaagtagtttcggggggtggtctactataagggaaagaatgagacgagccccagcccctccagcagcggaaggggtgggagcacgtacttgggagtcggccat

SEQ ID NO: 414012 - DNA, 140 bp, Artificial Sequence
  Synthetic
atggccgactcccaagtacgtgctcccaccccttccgctgctggaggggctggggctcgtctcattctttcccttatagtagaccaccccccgaaactactttttgaccacttgccacccggagacccagcatggcgtat

SEQ ID NO: 414013 - DNA, 140 bp, Artificial Sequence
  Synthetic
aggccctggctgctgatatgggaacttctgggacgcagcagtctcaggggactacagagagggtgggaagcccttaagtatctgggaaatcttgtgcagtattggggtctggagctaaaagaccttttgggacagcggtg

SEQ ID NO: 414014 - DNA, 140 bp, Artificial Sequence
  Synthetic
caccgctgtcccaaaaggtcttttagctccagaccccaatactgcacaagatttcccagatacttaagggcttcccaccctctctgtagtcccctgagactgctgcgtcccagaagttcccatatcagcagccagggcct

SEQ ID NO: 414015 - DNA, 140 bp, Artificial Sequence
  Synthetic
aggccctggctgctgatatgaggcccagcaacagttgctgaggttatctgtatggggtattagacaactccgagctcgcctgctagccttagaaacctttatacagaatcagcaactcctgaccttttgggacagcggtg

SEQ ID NO: 414016 - DNA, 140 bp, Artificial Sequence
  Synthetic
caccgctgtcccaaaaggtcaggagttgctgattctgtataaaggtttctaaggctagcaggcgagctcggagttgtctaataccccatacagataacctcagcaactgttgctgggcctcatatcagcagccagggcct

SEQ ID NO: 414017 - DNA, 140 bp, Artificial Sequence
  Synthetic
aggccctggctgctgatatgtagctatagaatataagaaaatacaaaaagaaagaaaaatagaaaagttacttgagagaataagagaaagagcagaagacagtggaaatgaaagtgaggggaccttttgggacagcggtg

SEQ ID NO: 414018 - DNA, 140 bp, Artificial Sequence
  Synthetic
caccgctgtcccaaaaggtcccctcactttcatttccactgtcttctgctctttctcttattctctcaagtaacttttctatttttctttctttttgtattttcttatattctatagctacatatcagcagccagggcct

SEQ ID NO: 414019 - DNA, 140 bp, Artificial Sequence
  Synthetic
aggccctggctgctgatatgagtcctctattttgtacatcaaaaggtagaggtaaaggacaccaaggaagctttagagaagctagaggaagaacaaaacaaaagtcagcaaaagacacaggaccttttgggacagcggtg

SEQ ID NO: 414020 - DNA, 140 bp, Artificial Sequence
  Synthetic
caccgctgtcccaaaaggtcctgtgtcttttgctgacttttgttttgttcttcctctagcttctctaaagcttccttggtgtcctttacctctaccttttgatgtacaaaatagaggactcatatcagcagccagggcct

SEQ ID NO: 414021 - DNA, 140 bp, Artificial Sequence
  Synthetic
atacgccatgctgggtctcctggagttagatgaatgggcctctctttggagttggcttgacataactaaatggttgtggtatataaaaatagctataatcatagtaggagcactaataggcgtacttgggagtcggccat

SEQ ID NO: 414022 - DNA, 140 bp, Artificial Sequence
  Synthetic
atggccgactcccaagtacgcctattagtgctcctactatgattatagctatttttatataccacaaccatttagttatgtcaagccaactccaaagagaggcccattcatctaactccaggagacccagcatggcgtat

SEQ ID NO: 414023 - DNA, 140 bp, Artificial Sequence
  Synthetic
atacgccatgctgggtctccgatatcaacccctctcgttacagaccctcaaccagcaccaaccggaagcagaaacgccaggaggaacaggaggagaaggtggaggcgaagacaggcacagcgtacttgggagtcggccat

SEQ ID NO: 414024 - DNA, 140 bp, Artificial Sequence
  Synthetic
atggccgactcccaagtacgctgtgcctgtcttcgcctccaccttctcctcctgttcctcctggcgtttctgcttccggttggtgctggttgagggtctgtaacgagaggggttgatatcggagacccagcatggcgtat

SEQ ID NO: 414025 - DNA, 140 bp, Artificial Sequence
  Synthetic
atacgccatgctgggtctccggacgataatcttgtggagttaccgcctcttgagcagcttagcatcagggatccggaacgtgaccagttacctgggacttggactggagatcctagggcacgtacttgggagtcggccat

SEQ ID NO: 414026 - DNA, 140 bp, Artificial Sequence
  Synthetic
atggccgactcccaagtacgtgccctaggatctccagtccaagtcccaggtaactggtcacgttccggatccctgatgctaagctgctcaagaggcggtaactccacaagattatcgtccggagacccagcatggcgtat

SEQ ID NO: 414027 - DNA, 140 bp, Artificial Sequence
  Synthetic
aggccctggctgctgatatgttgttggtccaaaatgcgaacccagattgtaagaccattttaaaagcattgggaccaggggctacactagaagaaatgatgacagcatgtcagggagtgggaccttttgggacagcggtg

SEQ ID NO: 414028 - DNA, 140 bp, Artificial Sequence
  Synthetic
caccgctgtcccaaaaggtcccactccctgacatgctgtcatcatttcttctagtgtagcccctggtcccaatgcttttaaaatggtcttacaatctgggttcgcattttggaccaacaacatatcagcagccagggcct

SEQ ID NO: 414029 - DNA, 140 bp, Artificial Sequence
  Synthetic
atacgccatgctgggtctccgtcagcagtaagagatagaatgagaagaaccagaacctccagaacctcccctaattctgaaccatgtgcacctggggtaggagaaatctccagacagttacgtacttgggagtcggccat

SEQ ID NO: 414030 - DNA, 140 bp, Artificial Sequence
  Synthetic
atggccgactcccaagtacgtaactgtctggagatttctcctaccccaggtgcacatggttcagaattaggggaggttctggaggttctggttcttctcattctatctcttactgctgacggagacccagcatggcgtat

SEQ ID NO: 414031 - DNA, 140 bp, Artificial Sequence
  Synthetic
aggccctggctgctgatatgtgctctggtgtgtacacaatggatttagaattaatgacacacagcaggcaatacaaaaattaaaggaagtaatgaacaaaaagtctgcgagtgccgctaagaccttttgggacagcggtg

SEQ ID NO: 414032 - DNA, 140 bp, Artificial Sequence
  Synthetic
caccgctgtcccaaaaggtcttagcggcactcgcagactttttgttcattacttcctttaatttttgtattgcctgctgtgtgtcattaattctaaatccattgtgtacacaccagagcacatatcagcagccagggcct

SEQ ID NO: 414033 - DNA, 140 bp, Artificial Sequence
  Synthetic
atacgccatgctgggtctccaaattgctctttcaatgcaaccacagaagtaagagataagaagcgcagagagtatgcgcttttttataggctagatatagtaccacttgatgggaataagcgtacttgggagtcggccat

SEQ ID NO: 414034 - DNA, 140 bp, Artificial Sequence
  Synthetic
atggccgactcccaagtacgcttattcccatcaagtggtactatatctagcctataaaaaagcgcatactctctgcgcttcttatctcttacttctgtggttgcattgaaagagcaatttggagacccagcatggcgtat

SEQ ID NO: 414035 - DNA, 140 bp, Artificial Sequence
  Synthetic
aggccctggctgctgatatgagcattaggaccaggggctacattagaagaaatgatgacagcatgtcagggagtgggaggacctggccacaaagcaagagtgttggctgaggcaatgagcgaccttttgggacagcggtg

SEQ ID NO: 414036 - DNA, 140 bp, Artificial Sequence
  Synthetic
caccgctgtcccaaaaggtcgctcattgcctcagccaacactcttgctttgtggccaggtcctcccactccctgacatgctgtcatcatttcttctaatgtagcccctggtcctaatgctcatatcagcagccagggcct

SEQ ID NO: 414037 - DNA, 140 bp, Artificial Sequence
  Synthetic
aggccctggctgctgatatgatgcacagggacaaatggtacatcaggctatctcccctagaactttaaatgcatgggtaaaggcagtagaagaaaaggcctttaaccccgaaatcattccgaccttttgggacagcggtg

SEQ ID NO: 414038 - DNA, 140 bp, Artificial Sequence
  Synthetic
caccgctgtcccaaaaggtcggaatgatttcggggttaaaggccttttcttctactgcctttacccatgcatttaaagttctaggggagatagcctgatgtaccatttgtccctgtgcatcatatcagcagccagggcct

SEQ ID NO: 414039 - DNA, 140 bp, Artificial Sequence
  Synthetic
aggccctggctgctgatatgacttatggaaatgggggactttgatccttgggttggtgataatttgtagtgcctcaaataacttgtgggtcacagtctattatggggtacctgtgtgggagaccttttgggacagcggtg

SEQ ID NO: 414040 - DNA, 140 bp, Artificial Sequence
  Synthetic
caccgctgtcccaaaaggtctcccacacaggtaccccataatagactgtgacccacaagttatttgaggcactacaaattatcaccaacccaaggatcaaagtcccccatttccataagtcatatcagcagccagggcct

SEQ ID NO: 414041 - DNA, 140 bp, Artificial Sequence
  Synthetic
aggccctggctgctgatatgagctatactttgataaattgtaacacctcagtcattacacaggcctgtccaaaggcatcctttgaaccaattcccatacattattgtaccccggctggttgaccttttgggacagcggtg

SEQ ID NO: 414042 - DNA, 140 bp, Artificial Sequence
  Synthetic
caccgctgtcccaaaaggtcaaccagccggggtacaataatgtatgggaattggttcaaaggatgcctttggacaggcctgtgtaatgactgaggtgttacaatttatcaaagtatagctcatatcagcagccagggcct

SEQ ID NO: 414043 - DNA, 140 bp, Artificial Sequence
  Synthetic
aggccctggctgctgatatggtaatcaatgaggaagcatcagattgggatagaactcacccaccagcagcagggccatatccagcagggcagataagggacccaactggcagtgacattggaccttttgggacagcggtg

SEQ ID NO: 414044 - DNA, 140 bp, Artificial Sequence
  Synthetic
caccgctgtcccaaaaggtccaatgtcactgccagttgggtcccttatctgccctgctggatatggccctgctgctggtgggtgagttctatcccaatctgatgcttcctcattgattaccatatcagcagccagggcct

SEQ ID NO: 414045 - DNA, 140 bp, Artificial Sequence
  Synthetic
aggccctggctgctgatatggaaaaatgacatggtagaacagatgcatgaggatataatcagtttatgggatgaaagcctaaagccatgtgtaaagctaacccctctctgtgttactttagaccttttgggacagcggtg

SEQ ID NO: 414046 - DNA, 140 bp, Artificial Sequence
  Synthetic
caccgctgtcccaaaaggtctaaagtaacacagagaggggttagctttacacatggctttaggctttcatcccataaactgattatatcctcatgcatctgttctaccatgtcatttttccatatcagcagccagggcct

SEQ ID NO: 414047 - DNA, 140 bp, Artificial Sequence
  Synthetic
atacgccatgctgggtctcccatcctcaggaggggatctagaaattgtaacacatagctttaattgtggaggagaatttttctattgcaatacatcaagactatttaataatacatttaacgtacttgggagtcggccat

SEQ ID NO: 414048 - DNA, 140 bp, Artificial Sequence
  Synthetic
atggccgactcccaagtacgttaaatgtattattaaatagtcttgatgtattgcaatagaaaaattctcctccacaattaaagctatgtgttacaatttctagatcccctcctgaggatgggagacccagcatggcgtat

SEQ ID NO: 414049 - DNA, 140 bp, Artificial Sequence
  Synthetic
aggccctggctgctgatatggaacagatgcaggaggatataatcagtttatgggatcaaagcctaaagccatgtgtaaaattaaccccactctgtgttactttaaattgcactgatttgagaccttttgggacagcggtg

SEQ ID NO: 414050 - DNA, 140 bp, Artificial Sequence
  Synthetic
caccgctgtcccaaaaggtctcaaatcagtgcaatttaaagtaacacagagtggggttaattttacacatggctttaggctttgatcccataaactgattatatcctcctgcatctgttccatatcagcagccagggcct

SEQ ID NO: 414051 - DNA, 140 bp, Artificial Sequence
  Synthetic
aggccctggctgctgatatgagcccagcaagatctgaaaggaggatatacatcagtattcatgcaaagagggcaaaacccagttaaaagagggcctgtaaaatgctttaactgtggaaaagaccttttgggacagcggtg

SEQ ID NO: 414052 - DNA, 140 bp, Artificial Sequence
  Synthetic
caccgctgtcccaaaaggtcttttccacagttaaagcattttacaggccctcttttaactgggttttgccctctttgcatgaatactgatgtatatcctcctttcagatcttgctgggctcatatcagcagccagggcct

SEQ ID NO: 414053 - DNA, 140 bp, Artificial Sequence
  Synthetic
aggccctggctgctgatatgagaatgttactagtaacagcactgataatagtagtatgacaaattgctctttcaatatcaccacaagcatgagagataagatgcagaaagaatatgcaatgaccttttgggacagcggtg

SEQ ID NO: 414054 - DNA, 140 bp, Artificial Sequence
  Synthetic
caccgctgtcccaaaaggtcattgcatattctttctgcatcttatctctcatgcttgtggtgatattgaaagagcaatttgtcatactactattatcagtgctgttactagtaacattctcatatcagcagccagggcct

SEQ ID NO: 414055 - DNA, 140 bp, Artificial Sequence
  Synthetic
aggccctggctgctgatatgatccgtttgcctccctcaaatccctctttgggacagaccagtagttacagcaagggttgggggccatctatgtgaagttttgctggacacaggggcagatgaccttttgggacagcggtg

SEQ ID NO: 414056 - DNA, 140 bp, Artificial Sequence
  Synthetic
caccgctgtcccaaaaggtcatctgcccctgtgtccagcaaaacttcacatagatggcccccaacccttgctgtaactactggtctgtcccaaagagggatttgagggaggcaaacggatcatatcagcagccagggcct

SEQ ID NO: 414057 - DNA, 140 bp, Artificial Sequence
  Synthetic
atacgccatgctgggtctccgatagggggtataggaggatttataaaagtaaaagaatacaataatgtgacagtagaaatagagggaaggaaagtgcagggagtagtattggtgggacctcgtacttgggagtcggccat

SEQ ID NO: 414058 - DNA, 140 bp, Artificial Sequence
  Synthetic
atggccgactcccaagtacgaggtcccaccaatactactccctgcactttccttccctctatttctactgtcacattattgtattcttttacttttataaatcctcctataccccctatcggagacccagcatggcgtat

SEQ ID NO: 414059 - DNA, 140 bp, Artificial Sequence
  Synthetic
aggccctggctgctgatatgtggaacaggaccatgcaataatgtcagcacagtacaatgtacacatggaattaagccagtggtatcaactcaactactgttaaatgggagtctagcagaagaccttttgggacagcggtg

SEQ ID NO: 414060 - DNA, 140 bp, Artificial Sequence
  Synthetic
caccgctgtcccaaaaggtcttctgctagactcccatttaacagtagttgagttgataccactggcttaattccatgtgtacattgtactgtgctgacattattgcatggtcctgttccacatatcagcagccagggcct

SEQ ID NO: 414061 - DNA, 140 bp, Artificial Sequence
  Synthetic
atacgccatgctgggtctcctggtgaaaattttagatccatttaggaaagacaacccagaattagaaatatgtcagtacgtggatgacttatatgtaggatcagatctacccttgacagacgtacttgggagtcggccat

SEQ ID NO: 414062 - DNA, 140 bp, Artificial Sequence
  Synthetic
atggccgactcccaagtacgtctgtcaagggtagatctgatcctacatataagtcatccacgtactgacatatttctaattctgggttgtctttcctaaatggatctaaaattttcaccaggagacccagcatggcgtat

SEQ ID NO: 414063 - DNA, 140 bp, Artificial Sequence
  Synthetic
atacgccatgctgggtctccgagcagcatctcaagacttagacacatatggagcacttacaagcagcaacttaggtcccgctaatgctgattgtgcctggctagaagcgcaagaggaaggcgtacttgggagtcggccat

SEQ ID NO: 414064 - DNA, 140 bp, Artificial Sequence
  Synthetic
atggccgactcccaagtacgccttcctcttgcgcttctagccaggcacaatcagcattagcgggacctaagttgctgcttgtaagtgctccatatgtgtctaagtcttgagatgctgctcggagacccagcatggcgtat

SEQ ID NO: 414065 - DNA, 140 bp, Artificial Sequence
  Synthetic
aggccctggctgctgatatggagagatgggtgcgagagcgtcagtattaagcgggggagaattagataaatgggaaaaaattcggttaaggccagggggaaagaaaaaatatagattaaagaccttttgggacagcggtg

SEQ ID NO: 414066 - DNA, 140 bp, Artificial Sequence
  Synthetic
caccgctgtcccaaaaggtctttaatctatattttttctttccccctggccttaaccgaattttttcccatttatctaattctcccccgcttaatactgacgctctcgcacccatctctccatatcagcagccagggcct

SEQ ID NO: 414067 - DNA, 140 bp, Artificial Sequence
  Synthetic
aggccctggctgctgatatgttgggaatcatggtgggcggactattggcaggccacctggattccagaatgggaatttgtcagcacacccccattgatcaagttatggtacagattagaagaccttttgggacagcggtg

SEQ ID NO: 414068 - DNA, 140 bp, Artificial Sequence
  Synthetic
caccgctgtcccaaaaggtcttctaatctgtaccataacttgatcaatgggggtgtgctgacaaattcccattctggaatccaggtggcctgccaatagtccgcccaccatgattcccaacatatcagcagccagggcct

SEQ ID NO: 414069 - DNA, 140 bp, Artificial Sequence
  Synthetic
aggccctggctgctgatatggtgtatcttacatgggttcctgctcataagggtataggaggaaatgaaaaaatagataaattagtaagcaaggacattagaagagtcctattcctagaaggaccttttgggacagcggtg

SEQ ID NO: 414070 - DNA, 140 bp, Artificial Sequence
  Synthetic
caccgctgtcccaaaaggtccttctaggaataggactcttctaatgtccttgcttactaatttatctattttttcatttcctcctatacccttatgagcaggaacccatgtaagatacaccatatcagcagccagggcct

SEQ ID NO: 414071 - DNA, 140 bp, Artificial Sequence
  Synthetic
atacgccatgctgggtctccaagtgaaaacatggaacagcctggtgaaatatcataagtacaggtctaggaaggccaaagaatggtattacagacaccattttgaacatagaaacccaagcgtacttgggagtcggccat

SEQ ID NO: 414072 - DNA, 140 bp, Artificial Sequence
  Synthetic
atggccgactcccaagtacgcttgggtttctatgttcaaaatggtgtctgtaataccattctttggccttcctagacctgtacttatgatatttcaccaggctgttccatgttttcacttggagacccagcatggcgtat

SEQ ID NO: 414073 - DNA, 140 bp, Artificial Sequence
  Synthetic
atacgccatgctgggtctccccacatattggggattgatgccaggggaaagagatgaacatttgggacatggggttagtatagaatggcagtacaagaagtataaaacacagattgaccccgtacttgggagtcggccat

SEQ ID NO: 414074 - DNA, 140 bp, Artificial Sequence
  Synthetic
atggccgactcccaagtacggggtcaatctgtgttttatacttcttgtactgccattctatactaaccccatgtcccaaatgttcatctctttcccctggcatcaatccccaatatgtggggagacccagcatggcgtat

SEQ ID NO: 414075 - DNA, 140 bp, Artificial Sequence
  Synthetic
aggccctggctgctgatatggacccaataacaatacaagaaaaagtatacaaataggaccaggacgagcattttatgcaacaggagatataataggagacatcagaaaggcacattgtaagaccttttgggacagcggtg

SEQ ID NO: 414076 - DNA, 140 bp, Artificial Sequence
  Synthetic
caccgctgtcccaaaaggtcttacaatgtgcctttctgatgtctcctattatatctcctgttgcataaaatgctcgtcctggtcctatttgtatactttttcttgtattgttattgggtccatatcagcagccagggcct

SEQ ID NO: 414077 - DNA, 140 bp, Artificial Sequence
  Synthetic
aggccctggctgctgatatgtcactttggattgtacaaatgttactagtggtacgggtaatagtactgcagaaatgaaaaattgctctttcaatgcatccacagaactaaaagataagaagaccttttgggacagcggtg

SEQ ID NO: 414078 - DNA, 140 bp, Artificial Sequence
  Synthetic
caccgctgtcccaaaaggtcttcttatcttttagttctgtggatgcattgaaagagcaatttttcatttctgcagtactattacccgtaccactagtaacatttgtacaatccaaagtgacatatcagcagccagggcct

SEQ ID NO: 414079 - DNA, 140 bp, Artificial Sequence
  Synthetic
aggccctggctgctgatatgctagagagccattcaatgaatgggcactagagctcctagaagaactaaaagcagaagcagtaagacacttccctagaccttggctacatgccttgggacagaccttttgggacagcggtg

SEQ ID NO: 414080 - DNA, 140 bp, Artificial Sequence
  Synthetic
caccgctgtcccaaaaggtctgtcccaaggcatgtagccaaggtctagggaagtgtcttactgcttctgcttttagttcttctaggagctctagtgcccattcattgaatggctctctagcatatcagcagccagggcct

SEQ ID NO: 414081 - DNA, 140 bp, Artificial Sequence
  Synthetic
aggccctggctgctgatatgtcaaatttaccaagagccatacaaaaatctgaaaacaggaaaatatgcaaaaagggggtctgcccacactaatgatgtaaaacaattaacagaagtagtggaccttttgggacagcggtg

SEQ ID NO: 414082 - DNA, 140 bp, Artificial Sequence
  Synthetic
caccgctgtcccaaaaggtccactacttctgttaattgttttacatcattagtgtgggcagaccccctttttgcatattttcctgttttcagatttttgtatggctcttggtaaatttgacatatcagcagccagggcct

SEQ ID NO: 414083 - DNA, 140 bp, Artificial Sequence
  Synthetic
atacgccatgctgggtctcctacaccttaatgaatctgtagaaattgagtgtacaagacccaataataacacaagaaaaagtgtgagaataggaccaggacaagcattctatacaacaggcgtacttgggagtcggccat

SEQ ID NO: 414084 - DNA, 140 bp, Artificial Sequence
  Synthetic
atggccgactcccaagtacgcctgttgtatagaatgcttgtcctggtcctattctcacactttttcttgtgttattattgggtcttgtacactcaatttctacagattcattaaggtgtaggagacccagcatggcgtat

SEQ ID NO: 414085 - DNA, 140 bp, Artificial Sequence
  Synthetic
atacgccatgctgggtctccgcttttgtaccagagcagtaagtaacgctaatgcagcataaggacctgataatagtaataatttctagtgctttgctatttctaaatgtactaatatggacgtacttgggagtcggccat

SEQ ID NO: 414086 - DNA, 140 bp, Artificial Sequence
  Synthetic
atggccgactcccaagtacgtccatattagtacatttagaaatagcaaagcactagaaattattactattatcaggtccttatgctgcattagcgttacttactgctctggtacaaaagcggagacccagcatggcgtat

SEQ ID NO: 414087 - DNA, 140 bp, Artificial Sequence
  Synthetic
aggccctggctgctgatatgaatagtaataatttctagtgctttgctatttctaaatgtactaatatggacctttgtacttaaacaatgtttagatcataagaaacaagacagaagggaagaccttttgggacagcggtg

SEQ ID NO: 414088 - DNA, 140 bp, Artificial Sequence
  Synthetic
caccgctgtcccaaaaggtcttcccttctgtcttgtttcttatgatctaaacattgtttaagtacaaaggtccatattagtacatttagaaatagcaaagcactagaaattattactattcatatcagcagccagggcct

SEQ ID NO: 414089 - DNA, 140 bp, Artificial Sequence
  Synthetic
aggccctggctgctgatatgcctaataaaacaataatatttaaccaatcctcaggaggggatctagaaattacaacacatagctttaattgtagaggagaatttttctattgcaatacatgaccttttgggacagcggtg

SEQ ID NO: 414090 - DNA, 140 bp, Artificial Sequence
  Synthetic
caccgctgtcccaaaaggtcatgtattgcaatagaaaaattctcctctacaattaaagctatgtgttgtaatttctagatcccctcctgaggattggttaaatattattgttttattaggcatatcagcagccagggcct

SEQ ID NO: 414091 - DNA, 140 bp, Artificial Sequence
  Synthetic
atacgccatgctgggtctcctgactatgaaagcaatggagaagaggaacaggaagttatggatctggtgcatagtcatgggttttataaccccatgtttgagctctaaccaacagctgtacgtacttgggagtcggccat

SEQ ID NO: 414092 - DNA, 140 bp, Artificial Sequence
  Synthetic
atggccgactcccaagtacgtacagctgttggttagagctcaaacatggggttataaaacccatgactatgcaccagatccataacttcctgttcctcttctccattgctttcatagtcaggagacccagcatggcgtat

SEQ ID NO: 414093 - DNA, 140 bp, Artificial Sequence
  Synthetic
aggccctggctgctgatatgatagtcatgggttttataaccccatgtttgagctctaaccaacagctgtatgcaacagtctatgctggagtgcctgtatgggaagatgcaagcccagtatgaccttttgggacagcggtg

SEQ ID NO: 414094 - DNA, 140 bp, Artificial Sequence
  Synthetic
caccgctgtcccaaaaggtcatactgggcttgcatcttcccatacaggcactccagcatagactgttgcatacagctgttggttagagctcaaacatggggttataaaacccatgactatcatatcagcagccagggcct

SEQ ID NO: 414095 - DNA, 140 bp, Artificial Sequence
  Synthetic
atacgccatgctgggtctcctgggcagcacaatcctgtgttcccacagatcctactccacaagagtacccattaaaaaatgtgacagataaatttgatatatggaaaaattatatggtagcgtacttgggagtcggccat

SEQ ID NO: 414096 - DNA, 140 bp, Artificial Sequence
  Synthetic
atggccgactcccaagtacgctaccatataatttttccatatatcaaatttatctgtcacattttttaatgggtactcttgtggagtaggatctgtgggaacacaggattgtgctgcccaggagacccagcatggcgtat

SEQ ID NO: 414097 - DNA, 140 bp, Artificial Sequence
  Synthetic
aggccctggctgctgatatgattaaaaaatgtgacagataaatttgatatatggaaaaattatatggtagaacaaatgcatgaggacattattgatttatgggaacaaagtttaaaacctgaccttttgggacagcggtg

SEQ ID NO: 414098 - DNA, 140 bp, Artificial Sequence
  Synthetic
caccgctgtcccaaaaggtcaggttttaaactttgttcccataaatcaataatgtcctcatgcatttgttctaccatataatttttccatatatcaaatttatctgtcacattttttaatcatatcagcagccagggcct

SEQ ID NO: 414099 - DNA, 140 bp, Artificial Sequence
  Synthetic
atacgccatgctgggtctcctaataataccagcaaaagcaatataacagagaacgatggtgaaacccctatgaaagtgtgtgaatttaatgtaaccacagttctcaaagagaaaaaagagcgtacttgggagtcggccat

SEQ ID NO: 414100 - DNA, 140 bp, Artificial Sequence
  Synthetic
atggccgactcccaagtacgctcttttttctctttgagaactgtggttacattaaattcacacactttcataggggtttcaccatcgttctctgttatattgcttttgctggtattattaggagacccagcatggcgtat

SEQ ID NO: 414101 - DNA, 140 bp, Artificial Sequence
  Synthetic
aggccctggctgctgatatgaatatgcacttttttataaacttgatgtagtaccaatagataatgataatacaagctatacgttgataaattgtaacacctcagtcattacacaggcctggaccttttgggacagcggtg

SEQ ID NO: 414102 - DNA, 140 bp, Artificial Sequence
  Synthetic
caccgctgtcccaaaaggtccaggcctgtgtaatgactgaggtgttacaatttatcaacgtatagcttgtattatcattatctattggtactacatcaagtttataaaaaagtgcatattcatatcagcagccagggcct

SEQ ID NO: 414103 - DNA, 140 bp, Artificial Sequence
  Synthetic
aggccctggctgctgatatgaaaagtatcacagcaattggagagcaatggctagtgattttaatctgccacccatagtagcaaaagaaatagtagctagctgtgataaatgtcagctaaagaccttttgggacagcggtg

SEQ ID NO: 414104 - DNA, 140 bp, Artificial Sequence
  Synthetic
caccgctgtcccaaaaggtctttagctgacatttatcacagctagctactatttcttttgctactatgggtggcagattaaaatcactagccattgctctccaattgctgtgatacttttcatatcagcagccagggcct

SEQ ID NO: 414105 - DNA, 140 bp, Artificial Sequence
  Synthetic
atacgccatgctgggtctcctaatggaacaggcacatgtagaaacattacagtagttacttgtacacatggcattaagccaacagtaagtactcatctaatattaaatggaacaatatctcgtacttgggagtcggccat

SEQ ID NO: 414106 - DNA, 140 bp, Artificial Sequence
  Synthetic
atggccgactcccaagtacgagatattgttccatttaatattagatgagtacttactgttggcttaatgccatgtgtacaagtaactactgtaatgtttctacatgtgcctgttccattaggagacccagcatggcgtat

SEQ ID NO: 414107 - DNA, 140 bp, Artificial Sequence
  Synthetic
aggccctggctgctgatatgttagatctgaaaatttcacggacaatgctaaaaccataatagtacagctgaatgaatctgtagaaattaattgtacaagacccaacaacaatacaagaaagaccttttgggacagcggtg

SEQ ID NO: 414108 - DNA, 140 bp, Artificial Sequence
  Synthetic
caccgctgtcccaaaaggtctttcttgtattgttgttgggtcttgtacaattaatttctacagattcattcagctgtactattatggttttagcattgtccgtgaaattttcagatctaacatatcagcagccagggcct

SEQ ID NO: 414109 - DNA, 140 bp, Artificial Sequence
  Synthetic
atacgccatgctgggtctcctatcttagtaactctaaatactactataaagatgacctgtgaaagaccaggggacaacgtgacagtaggacaggtgggcccaggtccaatggctgtgatccgtacttgggagtcggccat

SEQ ID NO: 414110 - DNA, 140 bp, Artificial Sequence
  Synthetic
atggccgactcccaagtacggatcacagccattggacctgggcccacctgtcctactgtcacgttgtcccctggtctttcacaggtcatctttatagtagtatttagagttactaagataggagacccagcatggcgtat

SEQ ID NO: 414111 - DNA, 140 bp, Artificial Sequence
  Synthetic
atacgccatgctgggtctccccctccagcagcagaaggggtgggagcagcgtctcaagacttagaaagacggggggcgattacaaacagcaatactagagataataatcctgacgtggcccgtacttgggagtcggccat

SEQ ID NO: 414112 - DNA, 140 bp, Artificial Sequence
  Synthetic
atggccgactcccaagtacgggccacgtcaggattattatctctagtattgctgtttgtaatcgccccccgtctttctaagtcttgagacgctgctcccaccccttctgctgctggagggggagacccagcatggcgtat

SEQ ID NO: 414113 - DNA, 140 bp, Artificial Sequence
  Synthetic
aggccctggctgctgatatgcgacaggctcggaagaatcgaagaagaaggtggagagcaagacagagacagatccattcgattagtgaacggattcttagcacttgtctgggacgatctggaccttttgggacagcggtg

SEQ ID NO: 414114 - DNA, 140 bp, Artificial Sequence
  Synthetic
caccgctgtcccaaaaggtccagatcgtcccagacaagtgctaagaatccgttcactaatcgaatggatctgtctctgtcttgctctccaccttcttcttcgattcttccgagcctgtcgcatatcagcagccagggcct

SEQ ID NO: 414115 - DNA, 140 bp, Artificial Sequence
  Synthetic
atacgccatgctgggtctccaaaggtatttagaacttgtaaacaatagtcagttagttacagtgcagttcaatagaagcactgatggtgatgcagagataaccactttacattttaactgcgtacttgggagtcggccat

SEQ ID NO: 414116 - DNA, 140 bp, Artificial Sequence
  Synthetic
atggccgactcccaagtacgcagttaaaatgtaaagtggttatctctgcatcaccatcagtgcttctattgaactgcactgtaactaactgactattgtttacaagttctaaatacctttggagacccagcatggcgtat

SEQ ID NO: 414117 - DNA, 140 bp, Artificial Sequence
  Synthetic
aggccctggctgctgatatgaatagaagcactgatggtgatgcagagataaccactttacattttaactgtcatggagagttcttttattgtaacacctctaagatgttttgttatacttgaccttttgggacagcggtg

SEQ ID NO: 414118 - DNA, 140 bp, Artificial Sequence
  Synthetic
caccgctgtcccaaaaggtcaagtataacaaaacatcttagaggtgttacaataaaagaactctccatgacagttaaaatgtaaagtggttatctctgcatcaccatcagtgcttctattcatatcagcagccagggcct

SEQ ID NO: 414119 - DNA, 140 bp, Artificial Sequence
  Synthetic
atacgccatgctgggtctccggcgactggtgagtacgccaaatttttgactagcagaggctagaaggagagagatgggtgcgagagcgtcagtattaagcgggggaaaattagatgcatgcgtacttgggagtcggccat

SEQ ID NO: 414120 - DNA, 140 bp, Artificial Sequence
  Synthetic
atggccgactcccaagtacgcatgcatctaattttcccccgcttaatactgacgctctcgcacccatctctctccttctagcctctgctagtcaaaaatttggcgtactcaccagtcgccggagacccagcatggcgtat

SEQ ID NO: 414121 - DNA, 140 bp, Artificial Sequence
  Synthetic
atacgccatgctgggtctccattaatagtactagtaatagtacgagtgagataccttgcaggttgagacaggtggtaagatcatggatggggggacagtcaggactctatgctcctcccacgtacttgggagtcggccat

SEQ ID NO: 414122 - DNA, 140 bp, Artificial Sequence
  Synthetic
atggccgactcccaagtacgtgggaggagcatagagtcctgactgtccccccatccatgatcttaccacctgtctcaacctgcaaggtatctcactcgtactattactagtactattaatggagacccagcatggcgtat

SEQ ID NO: 414123 - DNA, 140 bp, Artificial Sequence
  Synthetic
aggccctggctgctgatatgggtggtaagatcatggatggggggacagtcaggactctatgctcctcccatcaaaggtaatctaacatgtatatcaaacataactggaatgattctacaagaccttttgggacagcggtg

SEQ ID NO: 414124 - DNA, 140 bp, Artificial Sequence
  Synthetic
caccgctgtcccaaaaggtcttgtagaatcattccagttatgtttgatatacatgttagattacctttgatgggaggagcatagagtcctgactgtccccccatccatgatcttaccacccatatcagcagccagggcct

SEQ ID NO: 414125 - DNA, 140 bp, Artificial Sequence
  Synthetic
aggccctggctgctgatatgggcctgctgtaagagaaagaataagacgagctgagccagcagcagagggagtaggagcagcgtctcaagacttagataaatatggagcacttacaagcaggaccttttgggacagcggtg

SEQ ID NO: 414126 - DNA, 140 bp, Artificial Sequence
  Synthetic
caccgctgtcccaaaaggtcctgcttgtaagtgctccatatttatctaagtcttgagacgctgctcctactccctctgctgctggctcagctcgtcttattctttctcttacagcaggcccatatcagcagccagggcct

SEQ ID NO: 414127 - DNA, 140 bp, Artificial Sequence
  Synthetic
aggccctggctgctgatatgaataatggaacagctacaaccaacccttaagacaggatcagaagaaattaaatcattatataacacagtagcaaccctctattgtgtgcatcaaaggatagaccttttgggacagcggtg

SEQ ID NO: 414128 - DNA, 140 bp, Artificial Sequence
  Synthetic
caccgctgtcccaaaaggtctatcctttgatgcacacaatagagggttgctactgtgttatataatgatttaatttcttctgatcctgtcttaagggttggttgtagctgttccattattcatatcagcagccagggcct

SEQ ID NO: 414129 - DNA, 140 bp, Artificial Sequence
  Synthetic
atacgccatgctgggtctccaaaccttaatacagaatcagcaactcctaaacctatggggctgtaagggaaggctaatctgctacacctcagttcagtggaacaagacatgggtaaacaacgtacttgggagtcggccat

SEQ ID NO: 414130 - DNA, 140 bp, Artificial Sequence
  Synthetic
atggccgactcccaagtacgttgtttacccatgtcttgttccactgaactgaggtgtagcagattagccttcccttacagccccataggtttaggagttgctgattctgtattaaggtttggagacccagcatggcgtat

SEQ ID NO: 414131 - DNA, 140 bp, Artificial Sequence
  Synthetic
aggccctggctgctgatatgcctctcgttccagacccacagccatcaccgatcggaagcagaaacgccaggaagaacaggagaaggaggtggagaagaaggcaggtccagattgacagccgaccttttgggacagcggtg

SEQ ID NO: 414132 - DNA, 140 bp, Artificial Sequence
  Synthetic
caccgctgtcccaaaaggtcggctgtcaatctggacctgccttcttctccacctccttctcctgttcttcctggcgtttctgcttccgatcggtgatggctgtgggtctggaacgagaggcatatcagcagccagggcct

SEQ ID NO: 414133 - DNA, 140 bp, Artificial Sequence
  Synthetic
atacgccatgctgggtctcctgtgtggagttaccatctcttgagcatcttagcatcggggattcagaaggcgatcagccatctgagacttggactgtggatcctaggagagaagataattcgtacttgggagtcggccat

SEQ ID NO: 414134 - DNA, 140 bp, Artificial Sequence
  Synthetic
atggccgactcccaagtacgaattatcttctctcctaggatccacagtccaagtctcagatggctgatcgccttctgaatccccgatgctaagatgctcaagagatggtaactccacacaggagacccagcatggcgtat

SEQ ID NO: 414135 - DNA, 140 bp, Artificial Sequence
  Synthetic
aggccctggctgctgatatgcagatagggttatagaagtagtacaaagaatttgtagagctattctccacatacctagaagaataagacagggcttggaaagggctttgctataagatgggaccttttgggacagcggtg

SEQ ID NO: 414136 - DNA, 140 bp, Artificial Sequence
  Synthetic
caccgctgtcccaaaaggtcccatcttatagcaaagccctttccaagccctgtcttattcttctaggtatgtggagaatagctctacaaattctttgtactacttctataaccctatctgcatatcagcagccagggcct

SEQ ID NO: 414137 - DNA, 140 bp, Artificial Sequence
  Synthetic
aggccctggctgctgatatgttactagaaagagtagattatagattaggagtaggagcactgataatagcattagtcatagcaatagttgtgtggatcatagcatatatagaatataggagaccttttgggacagcggtg

SEQ ID NO: 414138 - DNA, 140 bp, Artificial Sequence
  Synthetic
caccgctgtcccaaaaggtctcctatattctatatatgctatgatccacacaactattgctatgactaatgctattatcagtgctcctactcctaatctataatctactctttctagtaacatatcagcagccagggcct

SEQ ID NO: 414139 - DNA, 140 bp, Artificial Sequence
  Synthetic
atacgccatgctgggtctccattggacagacggcataatcttagggatacaaagaataggaagaggaattctcaacatcccaacaagaattagacagggcttggagagaagtttactgtacgtacttgggagtcggccat

SEQ ID NO: 414140 - DNA, 140 bp, Artificial Sequence
  Synthetic
atggccgactcccaagtacgtacagtaaacttctctccaagccctgtctaattcttgttgggatgttgagaattcctcttcctattctttgtatccctaagattatgccgtctgtccaatggagacccagcatggcgtat

SEQ ID NO: 414141 - DNA, 140 bp, Artificial Sequence
  Synthetic
aggccctggctgctgatatgctcaacatcccaacaagaattagacagggcttggagagaagtttactgtaacatgggaaacgtgttggggaaagataaatttggaggatggccagcagtagaccttttgggacagcggtg

SEQ ID NO: 414142 - DNA, 140 bp, Artificial Sequence
  Synthetic
caccgctgtcccaaaaggtctactgctggccatcctccaaatttatctttccccaacacgtttcccatgttacagtaaacttctctccaagccctgtctaattcttgttgggatgttgagcatatcagcagccagggcct

SEQ ID NO: 414143 - DNA, 140 bp, Artificial Sequence
  Synthetic
atacgccatgctgggtctccagctggagtaggagcagtctccagggcaatagcagagaaaggaggaataccaaattcttatactcctcaaaacaatgaggcccttgcattcctagacagtcgtacttgggagtcggccat

SEQ ID NO: 414144 - DNA, 140 bp, Artificial Sequence
  Synthetic
atggccgactcccaagtacgactgtctaggaatgcaagggcctcattgttttgaggagtataagaatttggtattcctcctttctctgctattgccctggagactgctcctactccagctggagacccagcatggcgtat

SEQ ID NO: 414145 - DNA, 140 bp, Artificial Sequence
  Synthetic
atacgccatgctgggtctcccatcaagaggaagaggtaggcttcccagtaagacctcaagtgcccctgaggccaatgacctttaaaggagcgcatgacctcagcgtctttttaaaagaaacgtacttgggagtcggccat

SEQ ID NO: 414146 - DNA, 140 bp, Artificial Sequence
  Synthetic
atggccgactcccaagtacgtttcttttaaaaagacgctgaggtcatgcgctcctttaaaggtcattggcctcaggggcacttgaggtcttactgggaagcctacctcttcctcttgatgggagacccagcatggcgtat

SEQ ID NO: 414147 - DNA, 140 bp, Artificial Sequence
  Synthetic
aggccctggctgctgatatgcctccgacgcaacgggctcggcttagcggagtgcacccgctgagaggcgagaggaactcacagagggtgagtaaatttgctggcggtggccagacctagggaccttttgggacagcggtg

SEQ ID NO: 414148 - DNA, 140 bp, Artificial Sequence
  Synthetic
caccgctgtcccaaaaggtccctaggtctggccaccgccagcaaatttactcaccctctgtgagttcctctcgcctctcagcgggtgcactccgctaagccgagcccgttgcgtcggaggcatatcagcagccagggcct

SEQ ID NO: 414149 - DNA, 140 bp, Artificial Sequence
  Synthetic
atacgccatgctgggtctccccaaagtggtaatgatacctgcaataataacatgtgtgcagaaatgaaaaattgctctttcaatacaaccacagaattaagagataagaaccgcaaagagcgtacttgggagtcggccat

SEQ ID NO: 414150 - DNA, 140 bp, Artificial Sequence
  Synthetic
atggccgactcccaagtacgctctttgcggttcttatctcttaattctgtggttgtattgaaagagcaatttttcatttctgcacacatgttattattgcaggtatcattaccactttggggagacccagcatggcgtat

SEQ ID NO: 414151 - DNA, 140 bp, Artificial Sequence
  Synthetic
aggccctggctgctgatatgtagagctatctacaacatacctagaagaataagacagggctttgaagcagctttgctataaaatggggggcaagtggtcaaaaagcagcatagttggatggaccttttgggacagcggtg

SEQ ID NO: 414152 - DNA, 140 bp, Artificial Sequence
  Synthetic
caccgctgtcccaaaaggtccatccaactatgctgctttttgaccacttgccccccattttatagcaaagctgcttcaaagccctgtcttattcttctaggtatgttgtagatagctctacatatcagcagccagggcct

SEQ ID NO: 414153 - DNA, 140 bp, Artificial Sequence
  Synthetic
aggccctggctgctgatatgatttaaagttgaagatacgcagcaggcaatacaaaagttaaaggaagtaatggggaaaaggaagcctgtagatactgctaaggaagacacaaactcaagggaccttttgggacagcggtg

SEQ ID NO: 414154 - DNA, 140 bp, Artificial Sequence
  Synthetic
caccgctgtcccaaaaggtcccttgagtttgtgtcttccttagcagtatctacaggcttccttttccccattacttcctttaacttttgtattgcctgctgcgtatcttcaactttaaatcatatcagcagccagggcct

SEQ ID NO: 414155 - DNA, 140 bp, Artificial Sequence
  Synthetic
aggccctggctgctgatatgcaaaacaataatagtacatcttaatgaatctgtagaaattgtgtgtacaagacccaacaataatacaagaaaaagtataaggataggaccaggacaaacagaccttttgggacagcggtg

SEQ ID NO: 414156 - DNA, 140 bp, Artificial Sequence
  Synthetic
caccgctgtcccaaaaggtctgtttgtcctggtcctatccttatactttttcttgtattattgttgggtcttgtacacacaatttctacagattcattaagatgtactattattgttttgcatatcagcagccagggcct

SEQ ID NO: 414157 - DNA, 140 bp, Artificial Sequence
  Synthetic
atacgccatgctgggtctccatttagagactatgtagatcggttctacaaaacattaagagctgagcaagcaactcaagaagtaaaaaattggatgacagaaaccctgcttgttcaaaatcgtacttgggagtcggccat

SEQ ID NO: 414158 - DNA, 140 bp, Artificial Sequence
  Synthetic
atggccgactcccaagtacgattttgaacaagcagggtttctgtcatccaattttttacttcttgagttgcttgctcagctcttaatgttttgtagaaccgatctacatagtctctaaatggagacccagcatggcgtat

SEQ ID NO: 414159 - DNA, 140 bp, Artificial Sequence
  Synthetic
atacgccatgctgggtctcctagtgaggaaagggaaatgaagaagtgctctttcaatgtcaccacagtcataagagataggcctaagaaagaagaggcacttttttatagacttgatttacgtacttgggagtcggccat

SEQ ID NO: 414160 - DNA, 140 bp, Artificial Sequence
  Synthetic
atggccgactcccaagtacgtaaatcaagtctataaaaaagtgcctcttctttcttaggcctatctcttatgactgtggtgacattgaaagagcacttcttcatttccctttcctcactaggagacccagcatggcgtat

SEQ ID NO: 414161 - DNA, 140 bp, Artificial Sequence
  Synthetic
aggccctggctgctgatatgtgcattaggaatcattcaagcacaaccagataagagtgaatcagagttagtcaatcaaataatagagcaattaataaaaaaggaaaaggtctacctgtcagaccttttgggacagcggtg

SEQ ID NO: 414162 - DNA, 140 bp, Artificial Sequence
  Synthetic
caccgctgtcccaaaaggtctgacaggtagaccttttccttttttattaattgctctattatttgattgactaactctgattcactcttatctggttgtgcttgaatgattcctaatgcacatatcagcagccagggcct

SEQ ID NO: 414163 - DNA, 140 bp, Artificial Sequence
  Synthetic
aggccctggctgctgatatgagcaggaacaaaatgaaaaagatttattagcattggacaagtggcaaagtctgtggagttggtttgacataacaaattggctatggtatataaaaatattgaccttttgggacagcggtg

SEQ ID NO: 414164 - DNA, 140 bp, Artificial Sequence
  Synthetic
caccgctgtcccaaaaggtcaatatttttatataccatagccaatttgttatgtcaaaccaactccacagactttgccacttgtccaatgctaataaatctttttcattttgttcctgctcatatcagcagccagggcct

SEQ ID NO: 414165 - DNA, 140 bp, Artificial Sequence
  Synthetic
aggccctggctgctgatatgatgtgaagttttactggatacaggggcagatgatacagtactaaacaacatacaattggaaggaaaatggacaccaaaaatgatagggggtataggaggcgaccttttgggacagcggtg

SEQ ID NO: 414166 - DNA, 140 bp, Artificial Sequence
  Synthetic
caccgctgtcccaaaaggtcgcctcctataccccctatcatttttggtgtccattttccttccaattgtatgttgtttagtactgtatcatctgcccctgtatccagtaaaacttcacatcatatcagcagccagggcct

SEQ ID NO: 414167 - DNA, 140 bp, Artificial Sequence
  Synthetic
atacgccatgctgggtctcccaataatctttaatcaatcctcaggaggggacccagaagttgtaaggcacacttttaattgtggggggaatttttctactgtgattcaacaccactgtttcgtacttgggagtcggccat

SEQ ID NO: 414168 - DNA, 140 bp, Artificial Sequence
  Synthetic
atggccgactcccaagtacgaaacagtggtgttgaatcacagtagaaaaattccccccacaattaaaagtgtgccttacaacttctgggtcccctcctgaggattgattaaagattattgggagacccagcatggcgtat

SEQ ID NO: 414169 - DNA, 140 bp, Artificial Sequence
  Synthetic
  misc_feature (44)..(44): n is a, c, g, or t
atacgccatgctgggtctccaaaggatcgccagccatattccanagttccatgacaaaaattctagatccatttaggaaaaagaacccagaaatagaaatttatcagtacatggatgactcgtacttgggagtcggccat

SEQ ID NO: 414170 - DNA, 140 bp, Artificial Sequence
  Synthetic
  misc_feature (97)..(97): n is a, c, g, or t
atggccgactcccaagtacgagtcatccatgtactgataaatttctatttctgggttctttttcctaaatggatctagaatttttgtcatggaactntggaatatggctggcgatcctttggagacccagcatggcgtat

SEQ ID NO: 414171 - DNA, 140 bp, Artificial Sequence
  Synthetic
aggccctggctgctgatatggctggaagcgcaagaggaggaaggagacgtaggctttccagtcagacctcaggtgcccttaagaccaatgacttatagggggcgttcgatctcggcttctgaccttttgggacagcggtg

SEQ ID NO: 414172 - DNA, 140 bp, Artificial Sequence
  Synthetic
caccgctgtcccaaaaggtcagaagccgagatcgaacgccccctataagtcattggtcttaagggcacctgaggtctgactggaaagcctacgtctccttcctcctcttgcgcttccagccatatcagcagccagggcct

SEQ ID NO: 414173 - DNA, 140 bp, Artificial Sequence
  Synthetic
atacgccatgctgggtctccaataagaaaacagaaaaaagtagaaagattaattgataggataagagaaagagcagaagacagtggaaatgagagtgaaggggatagagaggaattggcacgtacttgggagtcggccat

SEQ ID NO: 414174 - DNA, 140 bp, Artificial Sequence
  Synthetic
atggccgactcccaagtacgtgccaattcctctctatccccttcactctcatttccactgtcttctgctctttctcttatcctatcaattaatctttctacttttttctgttttcttattggagacccagcatggcgtat

SEQ ID NO: 414175 - DNA, 140 bp, Artificial Sequence
  Synthetic
  misc_feature (79)..(79): n is a, c, g, or t
  misc_feature (109)..(109): n is a, c, g, or t
atacgccatgctgggtctccagtcattgacagaggtggtacctttaagtaaagaggcagaactagaattagaagaaaanagggaaaagctaaaagaaccagtacatggngtatactatcacgtacttgggagtcggccat

SEQ ID NO: 414176 - DNA, 140 bp, Artificial Sequence
  Synthetic
  misc_feature (32)..(32): n is a, c, g, or t
  misc_feature (62)..(62): n is a, c, g, or t
atggccgactcccaagtacgtgatagtatacnccatgtactggttcttttagcttttccctnttttcttctaattctagttctgcctctttacttaaaggtaccacctctgtcaatgactggagacccagcatggcgtat

SEQ ID NO: 414177 - DNA, 140 bp, Artificial Sequence
  Synthetic
aggccctggctgctgatatgataaattgtaatgtctcaaccattaaacaggcttgtccaaaggtggattttgacccaatccccatacattattgtgctccagctggttttgcgattttaagaccttttgggacagcggtg

SEQ ID NO: 414178 - DNA, 140 bp, Artificial Sequence
  Synthetic
caccgctgtcccaaaaggtcttaaaatcgcaaaaccagctggagcacaataatgtatggggattgggtcaaaatccacctttggacaagcctgtttaatggttgagacattacaatttatcatatcagcagccagggcct

SEQ ID NO: 414179 - DNA, 140 bp, Artificial Sequence
  Synthetic
aggccctggctgctgatatgctgctcataagggcatagggggaaatgaaaaaatagataaattagtaagcaaagatattagaagagtcctattcctagaaggaatagaccaggcacaagagaccttttgggacagcggtg

SEQ ID NO: 414180 - DNA, 140 bp, Artificial Sequence
  Synthetic
caccgctgtcccaaaaggtctcttgtgcctggtctattccttctaggaataggactcttctaatatctttgcttactaatttatctattttttcatttccccctatgcccttatgagcagcatatcagcagccagggcct

SEQ ID NO: 414181 - DNA, 140 bp, Artificial Sequence
  Synthetic
atacgccatgctgggtctccctaacaatgatattcaaaatgacaccttgagggaagagccaggggcaataaaaaactgttctttcaatatgaccacagtaataaaagataagcagccgaacgtacttgggagtcggccat

SEQ ID NO: 414182 - DNA, 140 bp, Artificial Sequence
  Synthetic
atggccgactcccaagtacgttcggctgcttatcttttattactgtggtcatattgaaagaacagttttttattgcccctggctcttccctcaaggtgtcattttgaatatcattgttagggagacccagcatggcgtat

SEQ ID NO: 414183 - DNA, 140 bp, Artificial Sequence
  Synthetic
aggccctggctgctgatatgagtacaagaggtataaaacacagattgaccctgaaacagcagacaggatgatacatctgtattatttcacctgttttacagagtcagcaatcaggaaagcgaccttttgggacagcggtg

SEQ ID NO: 414184 - DNA, 140 bp, Artificial Sequence
  Synthetic
caccgctgtcccaaaaggtcgctttcctgattgctgactctgtaaaacaggtgaaataatacagatgtatcatcctgtctgctgtttcagggtcaatctgtgttttatacctcttgtactcatatcagcagccagggcct

SEQ ID NO: 414185 - DNA, 140 bp, Artificial Sequence
  Synthetic
atacgccatgctgggtctccaccaataatagtagttgttgggaagaaataaaagaagaagtaaaaaactgctctttcaatgtcactacaagcataagagataaggtgcagaaagaatatgcgtacttgggagtcggccat

SEQ ID NO: 414186 - DNA, 140 bp, Artificial Sequence
  Synthetic
atggccgactcccaagtacgcatattctttctgcaccttatctcttatgcttgtagtgacattgaaagagcagttttttacttcttcttttatttcttcccaacaactactattattggtggagacccagcatggcgtat

SEQ ID NO: 414187 - DNA, 140 bp, Artificial Sequence
  Synthetic
aggccctggctgctgatatggtacaatgtacacatggaattaagccagtggtatcaactcaactgctgttaaatggtagcctagcagaaggggggataataattagatctgaaaatctgagaccttttgggacagcggtg

SEQ ID NO: 414188 - DNA, 140 bp, Artificial Sequence
  Synthetic
caccgctgtcccaaaaggtctcagattttcagatctaattattatccccccttctgctaggctaccatttaacagcagttgagttgataccactggcttaattccatgtgtacattgtaccatatcagcagccagggcct

SEQ ID NO: 414189 - DNA, 140 bp, Artificial Sequence
  Synthetic
aggccctggctgctgatatgagcatgacaaaaatcttagagccctttagagcaaaaaatccagaaatagtcatctatcaatatatggatgacttgtatgtaggatctgacttagaaataggaccttttgggacagcggtg

SEQ ID NO: 414190 - DNA, 140 bp, Artificial Sequence
  Synthetic
caccgctgtcccaaaaggtcctatttctaagtcagatcctacatacaagtcatccatatattgatagatgactatttctggattttttgctctaaagggctctaagatttttgtcatgctcatatcagcagccagggcct

SEQ ID NO: 414191 - DNA, 140 bp, Artificial Sequence
  Synthetic
aggccctggctgctgatatgatgggcactagagctcctggaagaactgaaagcagaagcagtgagacatttccctaggaattggttacaagacctgggacaattcatttatgagacttatgaccttttgggacagcggtg

SEQ ID NO: 414192 - DNA, 140 bp, Artificial Sequence
  Synthetic
caccgctgtcccaaaaggtcataagtctcataaatgaattgtcccaggtcttgtaaccaattcctagggaaatgtctcactgcttctgctttcagttcttccaggagctctagtgcccatcatatcagcagccagggcct

SEQ ID NO: 414193 - DNA, 140 bp, Artificial Sequence
  Synthetic
aggccctggctgctgatatgagcaagggtttgggaatctcccatggcaggaagaagcgacgaagaccagcagctgctgcaagccgtccagataataaagatcctgtaccagagcagtaaggaccttttgggacagcggtg

SEQ ID NO: 414194 - DNA, 140 bp, Artificial Sequence
  Synthetic
caccgctgtcccaaaaggtccttactgctctggtacaggatctttattatctggacggcttgcagcagctgctggtcttcgtcgcttcttcctgccatgggagattcccaaacccttgctcatatcagcagccagggcct

SEQ ID NO: 414195 - DNA, 140 bp, Artificial Sequence
  Synthetic
  misc_feature (33)..(33): n is a, c, g, or t
atacgccatgctgggtctcccttataaatgtanttgtatggatgtttaatcttagaaaatatctagaacaaaagaaacaagagagaagggaaagagaagtaattaataggttaagaagaacgtacttgggagtcggccat

SEQ ID NO: 414196 - DNA, 140 bp, Artificial Sequence
  Synthetic
  misc_feature (108)..(108): n is a, c, g, or t
atggccgactcccaagtacgttcttcttaacctattaattacttctctttcccttctctcttgtttcttttgttctagatattttctaagattaaacatccatacaantacatttataagggagacccagcatggcgtat

SEQ ID NO: 414197 - DNA, 140 bp, Artificial Sequence
  Synthetic
atacgccatgctgggtctcccaggaagttatggagcttgtacatagtcatggctttgataaccccatgtttgagctctagccagttgtatgcaacagtctatgctggggtgcctgtatggcgtacttgggagtcggccat

SEQ ID NO: 414198 - DNA, 140 bp, Artificial Sequence
  Synthetic
atggccgactcccaagtacgccatacaggcaccccagcatagactgttgcatacaactggctagagctcaaacatggggttatcaaagccatgactatgtacaagctccataacttcctgggagacccagcatggcgtat

SEQ ID NO: 414199 - DNA, 140 bp, Artificial Sequence
  Synthetic
aggccctggctgctgatatgtgagctctagccagttgtatgcaacagtctatgctggggtgcctgtatgggaagaagcaaacccaatactattctgtgcttccgatgctaacttaacaaggaccttttgggacagcggtg

SEQ ID NO: 414200 - DNA, 140 bp, Artificial Sequence
  Synthetic
caccgctgtcccaaaaggtccttgttaagttagcatcggaagcacagaatagtattgggtttgcttcttcccatacaggcaccccagcatagactgttgcatacaactggctagagctcacatatcagcagccagggcct

SEQ ID NO: 414201 - DNA, 140 bp, Artificial Sequence
  Synthetic
atacgccatgctgggtctccccactccacatgaatatccattatccaatgtgacagataacttcaatatatgggaaaattacatggtggaccagatgcatgatgatatcactgatttgtgcgtacttgggagtcggccat

SEQ ID NO: 414202 - DNA, 140 bp, Artificial Sequence
  Synthetic
atggccgactcccaagtacgcacaaatcagtgatatcatcatgcatctggtccaccatgtaattttcccatatattgaagttatctgtcacattggataatggatattcatgtggagtggggagacccagcatggcgtat

SEQ ID NO: 414203 - DNA, 140 bp, Artificial Sequence
  Synthetic
aggccctggctgctgatatgtgggaaaattacatggtggaccagatgcatgatgatatcactgatttgtggaagcagagtttaaagccatgtgttgaattgactttcctgtgtgtacaaagaccttttgggacagcggtg

SEQ ID NO: 414204 - DNA, 140 bp, Artificial Sequence
  Synthetic
caccgctgtcccaaaaggtctttgtacacacaggaaagtcaattcaacacatggctttaaactctgcttccacaaatcagtgatatcatcatgcatctggtccaccatgtaattttcccacatatcagcagccagggcct

SEQ ID NO: 414205 - DNA, 140 bp, Artificial Sequence
  Synthetic
aggccctggctgctgatatgcacctgcagagagcttcgggttcggagaggagctagccccctccccgaagcaagggcagaacgagaaggacttaatctccctcaaatcactctttggcaggaccttttgggacagcggtg

SEQ ID NO: 414206 - DNA, 140 bp, Artificial Sequence
  Synthetic
caccgctgtcccaaaaggtcctgccaaagagtgatttgagggagattaagtccttctcgttctgcccttgcttcggggagggggctagctcctctccgaacccgaagctctctgcaggtgcatatcagcagccagggcct

SEQ ID NO: 414207 - DNA, 140 bp, Artificial Sequence
  Synthetic
aggccctggctgctgatatgcaacagctcctagggatttggggatgctctggaaaactcatttgcaccactactgtgccttggaatactagttggagtaataaatctctggatgaaatttgaccttttgggacagcggtg

SEQ ID NO: 414208 - DNA, 140 bp, Artificial Sequence
  Synthetic
caccgctgtcccaaaaggtcaaatttcatccagagatttattactccaactagtattccaaggcacagtagtggtgcaaatgagttttccagagcatccccaaatccctaggagctgttgcatatcagcagccagggcct

SEQ ID NO: 414209 - DNA, 140 bp, Artificial Sequence
  Synthetic
aggccctggctgctgatatgaaatttgcacttaaccctggccttttagagacatcagaaggctgtaaacagataatgaaacagctacaaccagctcttcagacaggaacagaggaacttagaccttttgggacagcggtg

SEQ ID NO: 414210 - DNA, 140 bp, Artificial Sequence
  Synthetic
caccgctgtcccaaaaggtctaagttcctctgttcctgtctgaagagctggttgtagctgtttcattatctgtttacagccttctgatgtctctaaaaggccagggttaagtgcaaatttcatatcagcagccagggcct

SEQ ID NO: 414211 - DNA, 140 bp, Artificial Sequence
  Synthetic
atacgccatgctgggtctccaactccacaaccatcaagcaagcctgtccaaaagtaacttttgaacctattccaatacactactgtgctccagcaggctatgccatctttaagtgtaacacgtacttgggagtcggccat

SEQ ID NO: 414212 - DNA, 140 bp, Artificial Sequence
  Synthetic
atggccgactcccaagtacgtgttacacttaaagatggcatagcctgctggagcacagtagtgtattggaataggttcaaaagttacttttggacaggcttgcttgatggttgtggagttggagacccagcatggcgtat

SEQ ID NO: 414213 - DNA, 140 bp, Artificial Sequence
  Synthetic
aggccctggctgctgatatggacactctctaaaggaaaaataagaattatgggaaaaaatatttcagacagtgggcaaagtatcctagtgactctaaattctactataaacataacctgtgaccttttgggacagcggtg

SEQ ID NO: 414214 - DNA, 140 bp, Artificial Sequence
  Synthetic
caccgctgtcccaaaaggtcacaggttatgtttatagtagaatttagagtcactaggatactttgcccactgtctgaaatattttttcccataattcttatttttcctttagagagtgtccatatcagcagccagggcct

SEQ ID NO: 414215 - DNA, 140 bp, Artificial Sequence
  Synthetic
atacgccatgctgggtctccttggtacagtatgtcagtagaaaacaacataacatcaagggaagcttattgcacatataatgtcagtaaatgggcaacagccctaaagcaaacagctgagcgtacttgggagtcggccat

SEQ ID NO: 414216 - DNA, 140 bp, Artificial Sequence
  Synthetic
atggccgactcccaagtacgctcagctgtttgctttagggctgttgcccatttactgacattatatgtgcaataagcttcccttgatgttatgttgttttctactgacatactgtaccaaggagacccagcatggcgtat

SEQ ID NO: 414217 - DNA, 140 bp, Artificial Sequence
  Synthetic
aggccctggctgctgatatggcacatataatgtcagtaaatgggcaacagccctaaagcaaacagctgagaggtatctagaacttgtaaacaatacacaggctagcataacattcaatcagaccttttgggacagcggtg

SEQ ID NO: 414218 - DNA, 140 bp, Artificial Sequence
  Synthetic
caccgctgtcccaaaaggtctgattgaatgttatgctagcctgtgtattgtttacaagttctagatacctctcagctgtttgctttagggctgttgcccatttactgacattatatgtgccatatcagcagccagggcct

SEQ ID NO: 414219 - DNA, 140 bp, Artificial Sequence
  Synthetic
atacgccatgctgggtctccgagaattcttttattgtaacacaacggggttgtttaattatacctttctgtgtgaaaactccatctgtaacttcacccataacaatacttcagaggagcgcgtacttgggagtcggccat

SEQ ID NO: 414220 - DNA, 140 bp, Artificial Sequence
  Synthetic
atggccgactcccaagtacgcgctcctctgaagtattgttatgggtgaagttacagatggagttttcacacagaaaggtataattaaacaaccccgttgtgttacaataaaagaattctcggagacccagcatggcgtat

SEQ ID NO: 414221 - DNA, 140 bp, Artificial Sequence
  Synthetic
atacgccatgctgggtctcccaatctaacttgtagaattagacaggtggtaaggtcatggatgaagacagggtcgggactctatgcacctcccatcgaaggtaacctaacatgtaggtcacgtacttgggagtcggccat

SEQ ID NO: 414222 - DNA, 140 bp, Artificial Sequence
  Synthetic
atggccgactcccaagtacgtgacctacatgttaggttaccttcgatgggaggtgcatagagtcccgaccctgtcttcatccatgaccttaccacctgtctaattctacaagttagattgggagacccagcatggcgtat

SEQ ID NO: 414223 - DNA, 140 bp, Artificial Sequence
  Synthetic
  misc_feature (72)..(72): n is a, c, g, or t
atacgccatgctgggtctccagtaaaatggaacacaacatggggaagcaatattcctaatattactaatctngaggaaatttggggcaaactaacctggcaggaatgggatcagcaggtacgtacttgggagtcggccat

SEQ ID NO: 414224 - DNA, 140 bp, Artificial Sequence
  Synthetic
  misc_feature (69)..(69): n is a, c, g, or t
atggccgactcccaagtacgtacctgctgatcccattcctgccaggttagtttgccccaaatttcctcnagattagtaatattaggaatattgcttccccatgttgtgttccattttactggagacccagcatggcgtat

SEQ ID NO: 414225 - DNA, 140 bp, Artificial Sequence
  Synthetic
aggccctggctgctgatatgcttgccactgttgtacacggacctcaggacaataatcttgtggagttaccacctcttgagcaacttagcatcagggatccagaggttgatcagccatctggaccttttgggacagcggtg

SEQ ID NO: 414226 - DNA, 140 bp, Artificial Sequence
  Synthetic
caccgctgtcccaaaaggtccagatggctgatcaacctctggatccctgatgctaagttgctcaagaggtggtaactccacaagattattgtcctgaggtccgtgtacaacagtggcaagcatatcagcagccagggcct

SEQ ID NO: 414227 - DNA, 140 bp, Artificial Sequence
  Synthetic
atacgccatgctgggtctccggacttggactgtggatcctagggcagaagataattgaagcttgtagaattggtagagctgtaatacaatactggctacaagaattgcagaatagtgctacgtacttgggagtcggccat

SEQ ID NO: 414228 - DNA, 140 bp, Artificial Sequence
  Synthetic
atggccgactcccaagtacgtagcactattctgcaattcttgtagccagtattgtattacagctctaccaattctacaagcttcaattatcttctgccctaggatccacagtccaagtccggagacccagcatggcgtat

SEQ ID NO: 414229 - DNA, 140 bp, Artificial Sequence
  Synthetic
atacgccatgctgggtctccatcattttaggactacaacgcataggaagaggaattcttaacatcccaacaagaattaggcagggcctagaattaggtttattgtaacatgggaaacgcacgtacttgggagtcggccat

SEQ ID NO: 414230 - DNA, 140 bp, Artificial Sequence
  Synthetic
atggccgactcccaagtacgtgcgtttcccatgttacaataaacctaattctaggccctgcctaattcttgttgggatgttaagaattcctcttcctatgcgttgtagtcctaaaatgatggagacccagcatggcgtat

SEQ ID NO: 414231 - DNA, 140 bp, Artificial Sequence
  Synthetic
  misc_feature (73)..(73): n is a, c, g, or t
aggccctggctgctgatatgaagaattaggcagggcctagaattaggtttattgtaacatgggaaacgcattnaagaaaagtagctttgtgggatggccagcagtaagagaaagaatgaggaccttttgggacagcggtg

SEQ ID NO: 414232 - DNA, 140 bp, Artificial Sequence
  Synthetic
  misc_feature (68)..(68): n is a, c, g, or t
caccgctgtcccaaaaggtcctcattctttctcttactgctggccatcccacaaagctacttttcttnaatgcgtttcccatgttacaataaacctaattctaggccctgcctaattcttcatatcagcagccagggcct

SEQ ID NO: 414233 - DNA, 140 bp, Artificial Sequence
  Synthetic
atacgccatgctgggtctcctctccagagaattagcagctagaggagggataccaggctcatatactcctcaaaataatgcagcccttgcattcctagaaagccaccgagaagaagaagacgtacttgggagtcggccat

SEQ ID NO: 414234 - DNA, 140 bp, Artificial Sequence
  Synthetic
atggccgactcccaagtacgtcttcttcttctcggtggctttctaggaatgcaagggctgcattattttgaggagtatatgagcctggtatccctcctctagctgctaattctctggagaggagacccagcatggcgtat

SEQ ID NO: 414235 - DNA, 140 bp, Artificial Sequence
  Synthetic
aggccctggctgctgatatggaagaagtaggtttcccagttaaacctcaggtgcctttaaaaccaatgacctataaaggagcatttgacctcagcttctttttaaaagaaaagggaggacgaccttttgggacagcggtg

SEQ ID NO: 414236 - DNA, 140 bp, Artificial Sequence
  Synthetic
caccgctgtcccaaaaggtcgtcctcccttttcttttaaaaagaagctgaggtcaaatgctcctttataggtcattggttttaaaggcacctgaggtttaactgggaaacctacttcttccatatcagcagccagggcct

SEQ ID NO: 414237 - DNA, 140 bp, Artificial Sequence
  Synthetic
atacgccatgctgggtctccgtggcgcccgaacagggaccggaagagaaagtgaaaccagggaagaaaacctccgacgcaacgggctcggcttagcggagtgcacccgctaagaggcgagcgtacttgggagtcggccat

SEQ ID NO: 414238 - DNA, 140 bp, Artificial Sequence
  Synthetic
atggccgactcccaagtacgctcgcctcttagcgggtgcactccgctaagccgagcccgttgcgtcggaggttttcttccctggtttcactttctcttccggtccctgttcgggcgccacggagacccagcatggcgtat

SEQ ID NO: 414239 - DNA, 140 bp, Artificial Sequence
  Synthetic
aggccctggctgctgatatgcaaaaatgataggaggaattggaggttttatcaaagtaagacagtatgatcaaatacctatagaaatttgtggaaaaaaggctataggtacagtattagtgaccttttgggacagcggtg

SEQ ID NO: 414240 - DNA, 140 bp, Artificial Sequence
  Synthetic
caccgctgtcccaaaaggtcactaatactgtacctatagccttttttccacaaatttctataggtatttgatcatactgtcttactttgataaaacctccaattcctcctatcatttttgcatatcagcagccagggcct

SEQ ID NO: 414241 - DNA, 140 bp, Artificial Sequence
  Synthetic
aggccctggctgctgatatgacaggaagcaaattggatgcatgggaacaaattaggttaaagccaggatctaaaaagaaatataggctaaaacatttagtatgggcaagcagggagctgggaccttttgggacagcggtg

SEQ ID NO: 414242 - DNA, 140 bp, Artificial Sequence
  Synthetic
caccgctgtcccaaaaggtcccagctccctgcttgcccatactaaatgttttagcctatatttctttttagatcctggctttaacctaatttgttcccatgcatccaatttgcttcctgtcatatcagcagccagggcct

SEQ ID NO: 414243 - DNA, 140 bp, Artificial Sequence
  Synthetic
atacgccatgctgggtctccaaactgttacaacagttagagccagctcttaagacagggtcagaaagcctgcagtcactctggaacacaatagcagtgctctggtgtgttcacaacagatcgtacttgggagtcggccat

SEQ ID NO: 414244 - DNA, 140 bp, Artificial Sequence
  Synthetic
atggccgactcccaagtacgatctgttgtgaacacaccagagcactgctattgtgttccagagtgactgcaggctttctgaccctgtcttaagagctggctctaactgttgtaacagtttggagacccagcatggcgtat

SEQ ID NO: 414245 - DNA, 140 bp, Artificial Sequence
  Synthetic
aggccctggctgctgatatggcagtcactctggaacacaatagcagtgctctggtgtgttcacaacagatataaaattgaagatacacagcaggcaatacaaaggctaagagaagaaaaggaccttttgggacagcggtg

SEQ ID NO: 414246 - DNA, 140 bp, Artificial Sequence
  Synthetic
caccgctgtcccaaaaggtccttttcttctcttagcctttgtattgcctgctgtgtatcttcaattttatatctgttgtgaacacaccagagcactgctattgtgttccagagtgactgccatatcagcagccagggcct

SEQ ID NO: 414247 - DNA, 140 bp, Artificial Sequence
  Synthetic
atacgccatgctgggtctccagaataaggaatataaggataggaccaggacgagcattccatacaaatggcgtaataggagacataagaaaagcatattgtaacattagtaataatcattcgtacttgggagtcggccat

SEQ ID NO: 414248 - DNA, 140 bp, Artificial Sequence
  Synthetic
atggccgactcccaagtacgaatgattattactaatgttacaatatgcttttcttatgtctcctattacgccatttgtatggaatgctcgtcctggtcctatccttatattccttattctggagacccagcatggcgtat

SEQ ID NO: 414249 - DNA, 140 bp, Artificial Sequence
  Synthetic
  misc_feature (27)..(27): n is a, c, g, or t
aggccctggctgctgatatggacgggncaaaattaccctataatacaaaatgcacagggacaaatggtacatcaggccctctcccccagaactttaaatgcatgggtaaaggcagtagaagaccttttgggacagcggtg

SEQ ID NO: 414250 - DNA, 140 bp, Artificial Sequence
  Synthetic
  misc_feature (114)..(114): n is a, c, g, or t
caccgctgtcccaaaaggtcttctactgcctttacccatgcatttaaagttctgggggagagggcctgatgtaccatttgtccctgtgcattttgtattatagggtaattttgncccgtccatatcagcagccagggcct

SEQ ID NO: 414251 - DNA, 140 bp, Artificial Sequence
  Synthetic
  misc_feature (47)..(47): n is a, c, g, or t
atacgccatgctgggtctccgccagagtgttagcagaagcaatggcntcagcccagcaagatataaaaggaggatacacagcagtattcatgcaaagagggcaaaacccaaataggagagcgtacttgggagtcggccat

SEQ ID NO: 414252 - DNA, 140 bp, Artificial Sequence
  Synthetic
  misc_feature (94)..(94): n is a, c, g, or t
atggccgactcccaagtacgctctcctatttgggttttgccctctttgcatgaatactgctgtgtatcctccttttatatcttgctgggctgangccattgcttctgctaacactctggcggagacccagcatggcgtat

SEQ ID NO: 414253 - DNA, 140 bp, Artificial Sequence
  Synthetic
aggccctggctgctgatatgttaagagtgaagctgttagacattttcctaggatatggcttcatggcttaggacaacatatctatgaaacttatggggatacttgggcaggagtggaagcgaccttttgggacagcggtg

SEQ ID NO: 414254 - DNA, 140 bp, Artificial Sequence
  Synthetic
caccgctgtcccaaaaggtcgcttccactcctgcccaagtatccccataagtttcatagatatgttgtcctaagccatgaagccatatcctaggaaaatgtctaacagcttcactcttaacatatcagcagccagggcct

SEQ ID NO: 414255 - DNA, 140 bp, Artificial Sequence
  Synthetic
aggccctggctgctgatatgatctatgtgaagttttgctggatacaggggcagatgacacagtattaaataacatacaattggaaggaaaatggaaaccaaaaatgataggaggaatagggaccttttgggacagcggtg

SEQ ID NO: 414256 - DNA, 140 bp, Artificial Sequence
  Synthetic
caccgctgtcccaaaaggtccctattcctcctatcatttttggtttccattttccttccaattgtatgttatttaatactgtgtcatctgcccctgtatccagcaaaacttcacatagatcatatcagcagccagggcct

SEQ ID NO: 414257 - DNA, 140 bp, Artificial Sequence
  Synthetic
atacgccatgctgggtctccactaatgcaaccaacaattgcactaaaggagtcaatagcactgtggacaactgtgaagacataaaaaactgctctttcaatgtaaccacagagatacaggcgtacttgggagtcggccat

SEQ ID NO: 414258 - DNA, 140 bp, Artificial Sequence
  Synthetic
atggccgactcccaagtacgcctgtatctctgtggttacattgaaagagcagttttttatgtcttcacagttgtccacagtgctattgactcctttagtgcaattgttggttgcattagtggagacccagcatggcgtat

SEQ ID NO: 414259 - DNA, 140 bp, Artificial Sequence
  Synthetic
aggccctggctgctgatatgaagccccatagccccagtaccagtaaaactaaaaccaggaatggatggaccaaaagtaaaacaatggcccctatctaaagaaaaaatagaagccttaacagaccttttgggacagcggtg

SEQ ID NO: 414260 - DNA, 140 bp, Artificial Sequence
  Synthetic
caccgctgtcccaaaaggtctgttaaggcttctattttttctttagataggggccattgttttacttttggtccatccattcctggttttagttttactggtactggggctatggggcttcatatcagcagccagggcct

SEQ ID NO: 414261 - DNA, 140 bp, Artificial Sequence
  Synthetic
aggccctggctgctgatatgagtattcatagaatataggaaaatattaagacaaagaaaaatagacaggttaattgatagaataagagaaagagcagaagacagtggcaatgaaagtgaagaccttttgggacagcggtg

SEQ ID NO: 414262 - DNA, 140 bp, Artificial Sequence
  Synthetic
caccgctgtcccaaaaggtcttcactttcattgccactgtcttctgctctttctcttattctatcaattaacctgtctatttttctttgtcttaatattttcctatattctatgaatactcatatcagcagccagggcct

SEQ ID NO: 414263 - DNA, 140 bp, Artificial Sequence
  Synthetic
aggccctggctgctgatatgttcaaccacccacaggaggggacctagaaattacaacacatagttttaattgtagaggagaatttttctattgcaatacatcagaactgtttaatagtaggaccttttgggacagcggtg

SEQ ID NO: 414264 - DNA, 140 bp, Artificial Sequence
  Synthetic
caccgctgtcccaaaaggtcctactattaaacagttctgatgtattgcaatagaaaaattctcctctacaattaaaactatgtgttgtaatttctaggtcccctcctgtgggtggttgaacatatcagcagccagggcct

SEQ ID NO: 414265 - DNA, 140 bp, Artificial Sequence
  Synthetic
aggccctggctgctgatatgattaatagtagcattaataatagcaatagttgtgtggactatagtatatatagaatataggaaactggtaaggcaaagaaaaataaataggttatataaagaccttttgggacagcggtg

SEQ ID NO: 414266 - DNA, 140 bp, Artificial Sequence
  Synthetic
caccgctgtcccaaaaggtctttatataacctatttatttttctttgccttaccagtttcctatattctatatatactatagtccacacaactattgctattattaatgctactattaatcatatcagcagccagggcct

SEQ ID NO: 414267 - DNA, 140 bp, Artificial Sequence
  Synthetic
aggccctggctgctgatatgtagaatataggaaactggtaaggcaaagaaaaataaataggttatataaaagaataagagaaagagcagaagacagtggcaatgagagtgagggggatgcgaccttttgggacagcggtg

SEQ ID NO: 414268 - DNA, 140 bp, Artificial Sequence
  Synthetic
caccgctgtcccaaaaggtcgcatccccctcactctcattgccactgtcttctgctctttctcttattcttttatataacctatttatttttctttgccttaccagtttcctatattctacatatcagcagccagggcct

SEQ ID NO: 414269 - DNA, 140 bp, Artificial Sequence
  Synthetic
aggccctggctgctgatatggatctagcaatttctcgaacaatgctaaaatcataatagtacagctgaatgaatctgtagtaattaattgtacaagacccaacaacaatacaagaaaaaggaccttttgggacagcggtg

SEQ ID NO: 414270 - DNA, 140 bp, Artificial Sequence
  Synthetic
caccgctgtcccaaaaggtcctttttcttgtattgttgttgggtcttgtacaattaattactacagattcattcagctgtactattatgattttagcattgttcgagaaattgctagatccatatcagcagccagggcct

SEQ ID NO: 414271 - DNA, 140 bp, Artificial Sequence
  Synthetic
atacgccatgctgggtctcctcttagtggtcttcaagacagcgccctgaaggaagagccaggggcaatacaaaactgttcttttaatatgaccacagaaataagagataagcagctgaaccgtacttgggagtcggccat

SEQ ID NO: 414272 - DNA, 140 bp, Artificial Sequence
  Synthetic
atggccgactcccaagtacggttcagctgcttatctcttatttctgtggtcatattaaaagaacagttttgtattgcccctggctcttccttcagggcgctgtcttgaagaccactaagaggagacccagcatggcgtat

SEQ ID NO: 414273 - DNA, 140 bp, Artificial Sequence
  Synthetic
aggccctggctgctgatatgacatgtggcaggaagtaggaaaagcaatgtatgcccctcccatcagaggactaattagatgttcatcaaatattacagggctactattaacaagagatgggaccttttgggacagcggtg

SEQ ID NO: 414274 - DNA, 140 bp, Artificial Sequence
  Synthetic
caccgctgtcccaaaaggtcccatctcttgttaatagtagccctgtaatatttgatgaacatctaattagtcctctgatgggaggggcatacattgcttttcctacttcctgccacatgtcatatcagcagccagggcct

SEQ ID NO: 414275 - DNA, 140 bp, Artificial Sequence
  Synthetic
aggccctggctgctgatatgaatagtacaccttaataaagctgtatacattaattgtacaagacccaacaacaataccagaaaaagcatacaaatgggaccaggacgagcattttacacagaccttttgggacagcggtg

SEQ ID NO: 414276 - DNA, 140 bp, Artificial Sequence
  Synthetic
caccgctgtcccaaaaggtctgtgtaaaatgctcgtcctggtcccatttgtatgctttttctggtattgttgttgggtcttgtacaattaatgtatacagctttattaaggtgtactattcatatcagcagccagggcct

SEQ ID NO: 414277 - DNA, 140 bp, Artificial Sequence
  Synthetic
atacgccatgctgggtctccaccacaatggaatgaaacgctaagaggggtgaaggtagcattagagtctcatttccctaataaaacaatagaatttagcccatccgcaggaggggacctacgtacttgggagtcggccat

SEQ ID NO: 414278 - DNA, 140 bp, Artificial Sequence
  Synthetic
atggccgactcccaagtacgtaggtcccctcctgcggatgggctaaattctattgttttattagggaaatgagactctaatgctaccttcacccctcttagcgtttcattccattgtggtggagacccagcatggcgtat

SEQ ID NO: 414279 - DNA, 140 bp, Artificial Sequence
  Synthetic
atacgccatgctgggtctccgaagttacaatgcataattttaattgtagaggagaatttttctactgcgatacatcaagactgtttaatttgacactgtttgatagaacagtagtcaatgcgtacttgggagtcggccat

SEQ ID NO: 414280 - DNA, 140 bp, Artificial Sequence
  Synthetic
atggccgactcccaagtacgcattgactactgttctatcaaacagtgtcaaattaaacagtcttgatgtatcgcagtagaaaaattctcctctacaattaaaattatgcattgtaacttcggagacccagcatggcgtat

SEQ ID NO: 414281 - DNA, 140 bp, Artificial Sequence
  Synthetic
aggccctggctgctgatatgctctggaaaactcatttgcaccactactgtgccttggaatgctagttggagtaataaatctctggataagatttggaataacatgacctggatggagtgggaccttttgggacagcggtg

SEQ ID NO: 414282 - DNA, 140 bp, Artificial Sequence
  Synthetic
caccgctgtcccaaaaggtcccactccatccaggtcatgttattccaaatcttatccagagatttattactccaactagcattccaaggcacagtagtggtgcaaatgagttttccagagcatatcagcagccagggcct

SEQ ID NO: 414283 - DNA, 140 bp, Artificial Sequence
  Synthetic
atacgccatgctgggtctccatgaaagctgcatgttggtgggccaacataaaacatgagtttggaataccatataacccacaaagtcaaggagtagtagaagccatgaataaggaattaacgtacttgggagtcggccat

SEQ ID NO: 414284 - DNA, 140 bp, Artificial Sequence
  Synthetic
atggccgactcccaagtacgttaattccttattcatggcttctactactccttgactttgtgggttatatggtattccaaactcatgttttatgttggcccaccaacatgcagctttcatggagacccagcatggcgtat

SEQ ID NO: 414285 - DNA, 140 bp, Artificial Sequence
  Synthetic
atacgccatgctgggtctccgaagtaaaaaattgctctttcactaccaccacagaaataaaagataagcataagcaagtgcgtgcactcttttatagatctgatgtagaaccccttaccacgtacttgggagtcggccat

SEQ ID NO: 414286 - DNA, 140 bp, Artificial Sequence
  Synthetic
atggccgactcccaagtacgtggtaaggggttctacatcagatctataaaagagtgcacgcacttgcttatgcttatcttttatttctgtggtggtagtgaaagagcaattttttacttcggagacccagcatggcgtat

SEQ ID NO: 414287 - DNA, 140 bp, Artificial Sequence
  Synthetic
aggccctggctgctgatatgtctcctgcagtattggagtcaggaactaaagaatagtgctgttagcttgctcaatgccacagctatagcagtagctgaggggacagataggattatagaagaccttttgggacagcggtg

SEQ ID NO: 414288 - DNA, 140 bp, Artificial Sequence
  Synthetic
caccgctgtcccaaaaggtcttctataatcctatctgtcccctcagctactgctatagctgtggcattgagcaagctaacagcactattctttagttcctgactccaatactgcaggagacatatcagcagccagggcct

SEQ ID NO: 414289 - DNA, 140 bp, Artificial Sequence
  Synthetic
  misc_feature (96)..(96): n is a, c, g, or t
aggccctggctgctgatatgtattacagacatcattatgaatctagaaatccaagagtcagttcaggtgtatatattccagtagggctagcttgtntagtagtgaccacatattggggatgaccttttgggacagcggtg

SEQ ID NO: 414290 - DNA, 140 bp, Artificial Sequence
  Synthetic
  misc_feature (45)..(45): n is a, c, g, or t
caccgctgtcccaaaaggtcatccccaatatgtggtcactactanacaagctagccctactggaatatatacacctgaactgactcttggatttctagattcataatgatgtctgtaatacatatcagcagccagggcct

SEQ ID NO: 414291 - DNA, 140 bp, Artificial Sequence
  Synthetic
aggccctggctgctgatatggtagtacaaagagcttatagagctatcctccacatacctacaagaataagacagggcttggaaagggctttgctataaaatgggtggcaagtggtcaaaagaccttttgggacagcggtg

SEQ ID NO: 414292 - DNA, 140 bp, Artificial Sequence
  Synthetic
caccgctgtcccaaaaggtcttttgaccacttgccacccattttatagcaaagccctttccaagccctgtcttattcttgtaggtatgtggaggatagctctataagctctttgtactaccatatcagcagccagggcct

SEQ ID NO: 414293 - DNA, 140 bp, Artificial Sequence
  Synthetic
aggccctggctgctgatatgtaatagtacaccttaatgaatctgtagaaattgtgtgtacaagacctggcaataatacaagacaaagtataaggataggaccaggacaagcattctatacgaccttttgggacagcggtg

SEQ ID NO: 414294 - DNA, 140 bp, Artificial Sequence
  Synthetic
caccgctgtcccaaaaggtcgtatagaatgcttgtcctggtcctatccttatactttgtcttgtattattgccaggtcttgtacacacaatttctacagattcattaaggtgtactattacatatcagcagccagggcct

SEQ ID NO: 414295 - DNA, 140 bp, Artificial Sequence
  Synthetic
atacgccatgctgggtctccggaacctgtgcctcttcagctaccgccacttgagagacttcatattaattgcagcgaggattgtggacaggggactgaagagggggtgggaagctctcaacgtacttgggagtcggccat

SEQ ID NO: 414296 - DNA, 140 bp, Artificial Sequence
  Synthetic
atggccgactcccaagtacgttgagagcttcccaccccctcttcagtcccctgtccacaatcctcgctgcaattaatatgaagtctctcaagtggcggtagctgaagaggcacaggttccggagacccagcatggcgtat

SEQ ID NO: 414297 - DNA, 140 bp, Artificial Sequence
  Synthetic
atacgccatgctgggtctcctaccctaacaaaacaatagaatttgcaccagcctcaggaggggatctagaaattacaacacatagttttaattgtagaggagaatttttctattgcaacacgtacttgggagtcggccat

SEQ ID NO: 414298 - DNA, 140 bp, Artificial Sequence
  Synthetic
atggccgactcccaagtacgtgttgcaatagaaaaattctcctctacaattaaaactatgtgttgtaatttctagatcccctcctgaggctggtgcaaattctattgttttgttagggtaggagacccagcatggcgtat

SEQ ID NO: 414299 - DNA, 140 bp, Artificial Sequence
  Synthetic
atacgccatgctgggtctcctgtaataagtgctattgcaaaagctgctgctatcattgctatgtttgtttcacaagaaagggtttgggaatctcctatggcaggaagaagcgacgacgatcgtacttgggagtcggccat

SEQ ID NO: 414300 - DNA, 140 bp, Artificial Sequence
  Synthetic
atggccgactcccaagtacgatcgtcgtcgcttcttcctgccataggagattcccaaaccctttcttgtgaaacaaacatagcaatgatagcagcagcttttgcaatagcacttattacaggagacccagcatggcgtat

SEQ ID NO: 414301 - DNA, 140 bp, Artificial Sequence
  Synthetic
atacgccatgctgggtctcccagctgctgcaggccattcggataataaagatcttgtaccagagcagtaagtaacgctaatgcattatagggacttatcaacattaataattgttagtgccgtacttgggagtcggccat

SEQ ID NO: 414302 - DNA, 140 bp, Artificial Sequence
  Synthetic
atggccgactcccaagtacggcactaacaattattaatgttgataagtccctataatgcattagcgttacttactgctctggtacaagatctttattatccgaatggcctgcagcagctgggagacccagcatggcgtat

SEQ ID NO: 414303 - DNA, 140 bp, Artificial Sequence
  Synthetic
atacgccatgctgggtctccgtggcgcccgaacagggacttgaagcgaaagtagaaccagagaagatctctcgacgcaggactcggcttgctgaaggtgcacacggcaagaggcgagagccgtacttgggagtcggccat

SEQ ID NO: 414304 - DNA, 140 bp, Artificial Sequence
  Synthetic
atggccgactcccaagtacggctctcgcctcttgccgtgtgcaccttcagcaagccgagtcctgcgtcgagagatcttctctggttctactttcgcttcaagtccctgttcgggcgccacggagacccagcatggcgtat

SEQ ID NO: 414305 - DNA, 140 bp, Artificial Sequence
  Synthetic
aggccctggctgctgatatgagaagaataagagaaattaaggatgatagtgactatgaaagtaatggagaagaagaacaagaagttatggatcttgtacatagtcatgggtttgataaccgaccttttgggacagcggtg

SEQ ID NO: 414306 - DNA, 140 bp, Artificial Sequence
  Synthetic
caccgctgtcccaaaaggtcggttatcaaacccatgactatgtacaagatccataacttcttgttcttcttctccattactttcatagtcactatcatccttaatttctcttattcttctcatatcagcagccagggcct

SEQ ID NO: 414307 - DNA, 140 bp, Artificial Sequence
  Synthetic
aggccctggctgctgatatgacagaccccactccacatgaatatccattaaaaaatgtgacagatagatttgatatatggaaaaattacatggtggaacagatgcaggaagacattactagaccttttgggacagcggtg

SEQ ID NO: 414308 - DNA, 140 bp, Artificial Sequence
  Synthetic
caccgctgtcccaaaaggtctagtaatgtcttcctgcatctgttccaccatgtaatttttccatatatcaaatctatctgtcacattttttaatggatattcatgtggagtggggtctgtcatatcagcagccagggcct

SEQ ID NO: 414309 - DNA, 140 bp, Artificial Sequence
  Synthetic
atacgccatgctgggtctccgtacaaatgaactgtacagacacaaactcaacagccaacgcatctaaaacagaaacagaagtccacatgaaacagtgtgagtttaatgtaaccacagttgcgtacttgggagtcggccat

SEQ ID NO: 414310 - DNA, 140 bp, Artificial Sequence
  Synthetic
atggccgactcccaagtacgcaactgtggttacattaaactcacactgtttcatgtggacttctgtttctgttttagatgcgttggctgttgagtttgtgtctgtacagttcatttgtacggagacccagcatggcgtat

SEQ ID NO: 414311 - DNA, 140 bp, Artificial Sequence
  Synthetic
aggccctggctgctgatatgagaaacagaagtccacatgaaacagtgtgagtttaatgtaaccacagttgtcaaagacaagaaagagaaaaaacaggctctattttatgtaacagatttggaccttttgggacagcggtg

SEQ ID NO: 414312 - DNA, 140 bp, Artificial Sequence
  Synthetic
caccgctgtcccaaaaggtccaaatctgttacataaaatagagcctgttttttctctttcttgtctttgacaactgtggttacattaaactcacactgtttcatgtggacttctgtttctcatatcagcagccagggcct

SEQ ID NO: 414313 - DNA, 140 bp, Artificial Sequence
  Synthetic
atacgccatgctgggtctcctacattaattaattgtaactctactacaatcacacaagcctgtccaaaggtatcttttgagcccattccaatacattattgtgctccagcaggatatgctcgtacttgggagtcggccat

SEQ ID NO: 414314 - DNA, 140 bp, Artificial Sequence
  Synthetic
atggccgactcccaagtacgagcatatcctgctggagcacaataatgtattggaatgggctcaaaagatacctttggacaggcttgtgtgattgtagtagagttacaattaattaatgtaggagacccagcatggcgtat

SEQ ID NO: 414315 - DNA, 140 bp, Artificial Sequence
  Synthetic
aggccctggctgctgatatgcattacagtagttacttgtacacatggtatcaagccaacaataagtactcaactaatactaaatggaacactctctaaaggagatataagaattatgggagaccttttgggacagcggtg

SEQ ID NO: 414316 - DNA, 140 bp, Artificial Sequence
  Synthetic
caccgctgtcccaaaaggtctcccataattcttatatctcctttagagagtgttccatttagtattagttgagtacttattgttggcttgataccatgtgtacaagtaactactgtaatgcatatcagcagccagggcct

SEQ ID NO: 414317 - DNA, 140 bp, Artificial Sequence
  Synthetic
atacgccatgctgggtctcctgtaagtatgacctgtgagagaccatacaatctatcagtacaacagataaggataggcccaatgtcctggtacagcgtgggcatagggagagacaatgcacgtacttgggagtcggccat

SEQ ID NO: 414318 - DNA, 140 bp, Artificial Sequence
  Synthetic
atggccgactcccaagtacgtgcattgtctctccctatgcccacgctgtaccaggacattgggcctatccttatctgttgtactgatagattgtatggtctctcacaggtcatacttacaggagacccagcatggcgtat

SEQ ID NO: 414319 - DNA, 140 bp, Artificial Sequence
  Synthetic
aggccctggctgctgatatgggataggcccaatgtcctggtacagcgtgggcatagggagagacaatgcaaccgacccaaggagagccttttgcagttttaataccactgactgggtaaagaccttttgggacagcggtg

SEQ ID NO: 414320 - DNA, 140 bp, Artificial Sequence
  Synthetic
caccgctgtcccaaaaggtctttacccagtcagtggtattaaaactgcaaaaggctctccttgggtcggttgcattgtctctccctatgcccacgctgtaccaggacattgggcctatcccatatcagcagccagggcct

SEQ ID NO: 414321 - DNA, 140 bp, Artificial Sequence
  Synthetic
atacgccatgctgggtctccaaaacaaaatccagaaatagttatttttcaatacatggttgatttgtatgtaggatctgccttagaaatggggaggcatagagcaaaaatagaggaattacgtacttgggagtcggccat

SEQ ID NO: 414322 - DNA, 140 bp, Artificial Sequence
  Synthetic
atggccgactcccaagtacgtaattcctctatttttgctctatgcctccccatttctaaggcagatcctacatacaaatcaaccatgtattgaaaaataactatttctggattttgttttggagacccagcatggcgtat

SEQ ID NO: 414323 - DNA, 140 bp, Artificial Sequence
  Synthetic
  misc_feature (28)..(28): n is a, c, g, or t
atacgccatgctgggtctccagacaganaatattagcataattttcagtaacagtgctggtggagatctagaggtagcctttttgcattttaactgtcatggagagttcttttattgtaacgtacttgggagtcggccat

SEQ ID NO: 414324 - DNA, 140 bp, Artificial Sequence
  Synthetic
  misc_feature (113)..(113): n is a, c, g, or t
atggccgactcccaagtacgttacaataaaagaactctccatgacagttaaaatgcaaaaaggctacctctagatctccaccagcactgttactgaaaattatgctaatattntctgtctggagacccagcatggcgtat

SEQ ID NO: 414325 - DNA, 140 bp, Artificial Sequence
  Synthetic
aggccctggctgctgatatggaggtagcctttttgcattttaactgtcatggagagttcttttattgtaacacatctgggatatttaattataactttacatgcttaggaaccacctgcagaccttttgggacagcggtg

SEQ ID NO: 414326 - DNA, 140 bp, Artificial Sequence
  Synthetic
caccgctgtcccaaaaggtctgcaggtggttcctaagcatgtaaagttataattaaatatcccagatgtgttacaataaaagaactctccatgacagttaaaatgcaaaaaggctacctccatatcagcagccagggcct

SEQ ID NO: 414327 - DNA, 140 bp, Artificial Sequence
  Synthetic
atacgccatgctgggtctccccttgcaaattgaaacaggtggtaaggtcatggataaagggagggtcaggactctatgcccctcccatcaaaggtaacctaacatgtaggtcaaacataacgtacttgggagtcggccat

SEQ ID NO: 414328 - DNA, 140 bp, Artificial Sequence
  Synthetic
atggccgactcccaagtacgttatgtttgacctacatgttaggttacctttgatgggaggggcatagagtcctgaccctccctttatccatgaccttaccacctgtttcaatttgcaaggggagacccagcatggcgtat

SEQ ID NO: 414329 - DNA, 140 bp, Artificial Sequence
  Synthetic
atacgccatgctgggtctccgacacgacatttagaccagtagggggagatatggaagatatatggagaactcaattgttcaactataaagtagtaagggtaaaaccttttagtgtagcaccgtacttgggagtcggccat

SEQ ID NO: 414330 - DNA, 140 bp, Artificial Sequence
  Synthetic
atggccgactcccaagtacggtgctacactaaaaggttttacccttactactttatagttgaacaattgagttctccatatatcttccatatctccccctactggtctaaatgtcgtgtcggagacccagcatggcgtat

SEQ ID NO: 414331 - DNA, 140 bp, Artificial Sequence
  Synthetic
atacgccatgctgggtctccacctatggggctgtaaaggaaacctaatctgctacacatcagtaaaatggaatgatacatggaaaggaagtaataatattagcatggagaaaatttgggacgtacttgggagtcggccat

SEQ ID NO: 414332 - DNA, 140 bp, Artificial Sequence
  Synthetic
atggccgactcccaagtacgtcccaaattttctccatgctaatattattacttcctttccatgtatcattccattttactgatgtgtagcagattaggtttcctttacagccccataggtggagacccagcatggcgtat

SEQ ID NO: 414333 - DNA, 140 bp, Artificial Sequence
  Synthetic
  misc_feature (21)..(21): n is a, c, g, or t
aggccctggctgctgatatgngcggaagtaggaacgccaggaggaacaggagaaggaggtggagaaggaggcaggcccaggtggataccattgcagcaaggattcttgcaactgttgtacgaccttttgggacagcggtg

SEQ ID NO: 414334 - DNA, 140 bp, Artificial Sequence
  Synthetic
  misc_feature (120)..(120): n is a, c, g, or t
caccgctgtcccaaaaggtcgtacaacagttgcaagaatccttgctgcaatggtatccacctgggcctgcctccttctccacctccttctcctgttcctcctggcgttcctacttccgcncatatcagcagccagggcct

SEQ ID NO: 414335 - DNA, 140 bp, Artificial Sequence
  Synthetic
atacgccatgctgggtctccagcatcagggactcagagtgtgaccagccatctgagaattggactgtggatcctaggacagagaataattgatgcttgcaaactttgtaacgctgtaatacgtacttgggagtcggccat

SEQ ID NO: 414336 - DNA, 140 bp, Artificial Sequence
  Synthetic
atggccgactcccaagtacgtattacagcgttacaaagtttgcaagcatcaattattctctgtcctaggatccacagtccaattctcagatggctggtcacactctgagtccctgatgctggagacccagcatggcgtat

SEQ ID NO: 414337 - DNA, 140 bp, Artificial Sequence
  Synthetic
  misc_feature (82)..(82): n is a, c, g, or t
aggccctggctgctgatatgtcctaggacagagaataattgatgcttgcaaactttgtaacgctgtaatacaatactggctncaagaattgaagaatagtgctacaaatctactagatacgaccttttgggacagcggtg

SEQ ID NO: 414338 - DNA, 140 bp, Artificial Sequence
  Synthetic
  misc_feature (59)..(59): n is a, c, g, or t
caccgctgtcccaaaaggtcgtatctagtagatttgtagcactattcttcaattcttgnagccagtattgtattacagcgttacaaagtttgcaagcatcaattattctctgtcctaggacatatcagcagccagggcct

SEQ ID NO: 414339 - DNA, 140 bp, Artificial Sequence
  Synthetic
atacgccatgctgggtctccagaactgttaatgctaataatgctagtgttatcaatgaaatacaaaattgctctttcaatgcaaccacagaaataaaagataagaaacagaaaatgtatgcgtacttgggagtcggccat

SEQ ID NO: 414340 - DNA, 140 bp, Artificial Sequence
  Synthetic
atggccgactcccaagtacgcatacattttctgtttcttatcttttatttctgtggttgcattgaaagagcaattttgtatttcattgataacactagcattattagcattaacagttctggagacccagcatggcgtat

SEQ ID NO: 414341 - DNA, 140 bp, Artificial Sequence
  Synthetic
aggccctggctgctgatatggaagaagtaggtttcccagtaaggcctcaagtacctttaaggccaatgacctttaaaggagcattcgacctcggcttctttttaaaagaaaagggaggacgaccttttgggacagcggtg

SEQ ID NO: 414342 - DNA, 140 bp, Artificial Sequence
  Synthetic
caccgctgtcccaaaaggtcgtcctcccttttcttttaaaaagaagccgaggtcgaatgctcctttaaaggtcattggccttaaaggtacttgaggccttactgggaaacctacttcttccatatcagcagccagggcct

SEQ ID NO: 414343 - DNA, 140 bp, Artificial Sequence
  Synthetic
aggccctggctgctgatatgtgacagggagcaaattggatgcatgggaacaaattaagttaaagccaggatgtaaaaagaaatatagactaaaacatttagtatgggcaagcagggagctgaccttttgggacagcggtg

SEQ ID NO: 414344 - DNA, 140 bp, Artificial Sequence
  Synthetic
caccgctgtcccaaaaggtcagctccctgcttgcccatactaaatgttttagtctatatttctttttacatcctggctttaacttaatttgttcccatgcatccaatttgctccctgtcacatatcagcagccagggcct

SEQ ID NO: 414345 - DNA, 140 bp, Artificial Sequence
  Synthetic
aggccctggctgctgatatgcagacgggtcaaaattaccctgtagtacaaaatgcgcagggacaaatggtacatcaggccctctcccccaggactttaaatgcatgggtaaaggcagtaggaccttttgggacagcggtg

SEQ ID NO: 414346 - DNA, 140 bp, Artificial Sequence
  Synthetic
caccgctgtcccaaaaggtcctactgcctttacccatgcatttaaagtcctgggggagagggcctgatgtaccatttgtccctgcgcattttgtactacagggtaattttgacccgtctgcatatcagcagccagggcct

SEQ ID NO: 414347 - DNA, 140 bp, Artificial Sequence
  Synthetic
  misc_feature (23)..(23): n is a, c, g, or t
  misc_feature (44)..(44): n is a, c, g, or t
atacgccatgctgggtctccganggagctacctcctatgatatnaatactatgttaaatgccataggaggacatcaaggggccttacaagtactaaaggaagtaatcaatgaagaagcagcgtacttgggagtcggccat

SEQ ID NO: 414348 - DNA, 140 bp, Artificial Sequence
  Synthetic
  misc_feature (97)..(97): n is a, c, g, or t
  misc_feature (118)..(118): n is a, c, g, or t
atggccgactcccaagtacgctgcttcttcattgattacttcctttagtacttgtaaggccccttgatgtcctcctatggcatttaacatagtattnatatcataggaggtagctccntcggagacccagcatggcgtat

SEQ ID NO: 414349 - DNA, 140 bp, Artificial Sequence
  Synthetic
atacgccatgctgggtctcccaggaacagaaagaggactcaaacgaactctatccgtttgcctccctcaaatccctctttgggacagaccagtagtcacagcaaaggtcgggggccatctcgtacttgggagtcggccat

SEQ ID NO: 414350 - DNA, 140 bp, Artificial Sequence
  Synthetic
atggccgactcccaagtacgagatggcccccgacctttgctgtgactactggtctgtcccaaagagggatttgagggaggcaaacggatagagttcgtttgagtcctctttctgttcctgggagacccagcatggcgtat

SEQ ID NO: 414351 - DNA, 140 bp, Artificial Sequence
  Synthetic
aggccctggctgctgatatgctgctctttcaatataaccacagagataaaggataaaaagaagcaagaatacgcgcttttctataaacttgatatagtgccaattaatgataagaatattgaccttttgggacagcggtg

SEQ ID NO: 414352 - DNA, 140 bp, Artificial Sequence
  Synthetic
caccgctgtcccaaaaggtcaatattcttatcattaattggcactatatcaagtttatagaaaagcgcgtattcttgcttctttttatcctttatctctgtggttatattgaaagagcagcatatcagcagccagggcct

SEQ ID NO: 414353 - DNA, 140 bp, Artificial Sequence
  Synthetic
atacgccatgctgggtctccgcttagcagaaaaggaaataatgattagatctgaaaacctcacaaacaatgccaaagtcataatagtgcagcttaataaaagtatagcaattaattgtaccgtacttgggagtcggccat

SEQ ID NO: 414354 - DNA, 140 bp, Artificial Sequence
  Synthetic
atggccgactcccaagtacggtacaattaattgctatacttttattaagctgcactattatgactttggcattgtttgtgaggttttcagatctaatcattatttccttttctgctaagcggagacccagcatggcgtat

SEQ ID NO: 414355 - DNA, 140 bp, Artificial Sequence
  Synthetic
aggccctggctgctgatatgtcatagcaatagttgtgtggactatagtaggcatagaatataagaaattgctaaagcaaaggaaaatagacaggttaattgagagaataagagaaagagcgaccttttgggacagcggtg

SEQ ID NO: 414356 - DNA, 140 bp, Artificial Sequence
  Synthetic
caccgctgtcccaaaaggtcgctctttctcttattctctcaattaacctgtctattttcctttgctttagcaatttcttatattctatgcctactatagtccacacaactattgctatgacatatcagcagccagggcct

SEQ ID NO: 414357 - DNA, 140 bp, Artificial Sequence
  Synthetic
atacgccatgctgggtctccagacccagatttcagaaaatatactgctttcactattcctagtgtgaacaatgagaccccaggagtaagataccagtacaatgtcctcccacaaggatggcgtacttgggagtcggccat

SEQ ID NO: 414358 - DNA, 140 bp, Artificial Sequence
  Synthetic
atggccgactcccaagtacgccatccttgtgggaggacattgtactggtatcttactcctggggtctcattgttcacactaggaatagtgaaagcagtatattttctgaaatctgggtctggagacccagcatggcgtat

SEQ ID NO: 414359 - DNA, 140 bp, Artificial Sequence
  Synthetic
aggccctggctgctgatatgtaggcagggatactcaccattatcgttccagacccgcctcccagcccagaggggacccgacaggcccgaaggaatcgaagaagaaggtggagagagagacgaccttttgggacagcggtg

SEQ ID NO: 414360 - DNA, 140 bp, Artificial Sequence
  Synthetic
caccgctgtcccaaaaggtcgtctctctctccaccttcttcttcgattccttcgggcctgtcgggtcccctctgggctgggaggcgggtctggaacgataatggtgagtatccctgcctacatatcagcagccagggcct

SEQ ID NO: 414361 - DNA, 140 bp, Artificial Sequence
  Synthetic
atacgccatgctgggtctccgtagcagttctctattgggtacataaaaacatacaggtatcagacaccaaggaagccttagacaagatagaggaggaacaaaacaaaagccagcaaaggacgtacttgggagtcggccat

SEQ ID NO: 414362 - DNA, 140 bp, Artificial Sequence
  Synthetic
atggccgactcccaagtacgtcctttgctggcttttgttttgttcctcctctatcttgtctaaggcttccttggtgtctgatacctgtatgtttttatgtacccaatagagaactgctacggagacccagcatggcgtat

SEQ ID NO: 414363 - DNA, 140 bp, Artificial Sequence
  Synthetic
atacgccatgctgggtctccactcaaaacagcctgaaggaagaggtaggggcagtaaaaaactgttctttcaatatgaccacagaagtaagagataagcagaagcgagtacaagcactttcgtacttgggagtcggccat

SEQ ID NO: 414364 - DNA, 140 bp, Artificial Sequence
  Synthetic
atggccgactcccaagtacgaaagtgcttgtactcgcttctgcttatctcttacttctgtggtcatattgaaagaacagttttttactgcccctacctcttccttcaggctgttttgagtggagacccagcatggcgtat

SEQ ID NO: 414365 - DNA, 140 bp, Artificial Sequence
  Synthetic
aggccctggctgctgatatgagtcattaacagaggtagtacctttaagtaaagaggcagagctagaattagaagaaaacagggaaaggctaaaagaaccagtgcatggggtatactatcagaccttttgggacagcggtg

SEQ ID NO: 414366 - DNA, 140 bp, Artificial Sequence
  Synthetic
caccgctgtcccaaaaggtctgatagtataccccatgcactggttcttttagcctttccctgttttcttctaattctagctctgcctctttacttaaaggtactacctctgttaatgactcatatcagcagccagggcct

SEQ ID NO: 414367 - DNA, 140 bp, Artificial Sequence
  Synthetic
aggccctggctgctgatatgtatacatttaggaccaggacaagcattttatgcaacaggagaaataataggagacatcagaaaggcacattgtaacattagtggaacacaatggaataaagaccttttgggacagcggtg

SEQ ID NO: 414368 - DNA, 140 bp, Artificial Sequence
  Synthetic
caccgctgtcccaaaaggtctttattccattgtgttccactaatgttacaatgtgcctttctgatgtctcctattatttctcctgttgcataaaatgcttgtcctggtcctaaatgtatacatatcagcagccagggcct

SEQ ID NO: 414369 - DNA, 140 bp, Artificial Sequence
  Synthetic
aggccctggctgctgatatgaacatatagtatgggcaagcagggagctagaacgattcgcagttaatcctggcctgttagaaacatcagaaggctgtagacaaatactgggacagctacagaccttttgggacagcggtg

SEQ ID NO: 414370 - DNA, 140 bp, Artificial Sequence
  Synthetic
caccgctgtcccaaaaggtctgtagctgtcccagtatttgtctacagccttctgatgtttctaacaggccaggattaactgcgaatcgttctagctccctgcttgcccatactatatgttcatatcagcagccagggcct

SEQ ID NO: 414371 - DNA, 140 bp, Artificial Sequence
  Synthetic
aggccctggctgctgatatgacaaattataaacatgtggcaggaagtaggacgagcaatgtatgccgctcccattgcaggaaacattacctgtaactcaaatattacaggtttactattggaccttttgggacagcggtg

SEQ ID NO: 414372 - DNA, 140 bp, Artificial Sequence
  Synthetic
caccgctgtcccaaaaggtccaatagtaaacctgtaatatttgagttacaggtaatgtttcctgcaatgggagcggcatacattgctcgtcctacttcctgccacatgtttataatttgtcatatcagcagccagggcct

SEQ ID NO: 414373 - DNA, 140 bp, Artificial Sequence
  Synthetic
aggccctggctgctgatatgttgtgtggaccatagtattcatagaatataggaaaatattaagacaaagaaaaatagataggataattgagagaataagagaaagagcagaagacagtgggaccttttgggacagcggtg

SEQ ID NO: 414374 - DNA, 140 bp, Artificial Sequence
  Synthetic
caccgctgtcccaaaaggtcccactgtcttctgctctttctcttattctctcaattatcctatctatttttctttgtcttaatattttcctatattctatgaatactatggtccacacaacatatcagcagccagggcct

SEQ ID NO: 414375 - DNA, 140 bp, Artificial Sequence
  Synthetic
atacgccatgctgggtctccatagtacaaagaggatttagagcttttctgcacatacctagaaggataagacaaggctttgaaagggcgctgctataaaatggggaacaaatggtcaaaacgtacttgggagtcggccat

SEQ ID NO: 414376 - DNA, 140 bp, Artificial Sequence
  Synthetic
atggccgactcccaagtacgttttgaccatttgttccccattttatagcagcgccctttcaaagccttgtcttatccttctaggtatgtgcagaaaagctctaaatcctctttgtactatggagacccagcatggcgtat

SEQ ID NO: 414377 - DNA, 140 bp, Artificial Sequence
  Synthetic
aggccctggctgctgatatgagttgaccccactctgtgtcactttagagtgtactactgttaaggttgggaataatactgataatgccaaaaattgctctttcaatacaaccacagaaatgaccttttgggacagcggtg

SEQ ID NO: 414378 - DNA, 140 bp, Artificial Sequence
  Synthetic
caccgctgtcccaaaaggtcatttctgtggttgtattgaaagagcaatttttggcattatcagtattattcccaaccttaacagtagtacactctaaagtgacacagagtggggtcaactcatatcagcagccagggcct

SEQ ID NO: 414379 - DNA, 140 bp, Artificial Sequence
  Synthetic
aggccctggctgctgatatgaggacaaacattctttgcaaatgaaataataggagacataagaaaggcacattgtaacattagtaaggctaattggaccaaaactataaaacgggtaaaggaccttttgggacagcggtg

SEQ ID NO: 414380 - DNA, 140 bp, Artificial Sequence
  Synthetic
caccgctgtcccaaaaggtcctttacccgttttatagttttggtccaattagccttactaatgttacaatgtgcctttcttatgtctcctattatttcatttgcaaagaatgtttgtcctcatatcagcagccagggcct

SEQ ID NO: 414381 - DNA, 140 bp, Artificial Sequence
  Synthetic
aggccctggctgctgatatgaacaggagaaataataggagatataagacaagcacattgtaacattactagagagaaatggaataacactttacaaaagatagctgaaaaattaagagaagaccttttgggacagcggtg

SEQ ID NO: 414382 - DNA, 140 bp, Artificial Sequence
  Synthetic
caccgctgtcccaaaaggtcttctcttaatttttcagctatcttttgtaaagtgttattccatttctctctagtaatgttacaatgtgcttgtcttatatctcctattatttctcctgttcatatcagcagccagggcct

SEQ ID NO: 414383 - DNA, 140 bp, Artificial Sequence
  Synthetic
aggccctggctgctgatatgtgtgggtcacagtctattatggggtgcctgtgtggaaagaagcatccaccaccctattttgtgcatcagatgctaaagcagttgacacagaggtacataagaccttttgggacagcggtg

SEQ ID NO: 414384 - DNA, 140 bp, Artificial Sequence
  Synthetic
caccgctgtcccaaaaggtcttatgtacctctgtgtcaactgctttagcatctgatgcacaaaatagggtggtggatgcttctttccacacaggcaccccataatagactgtgacccacacatatcagcagccagggcct

SEQ ID NO: 414385 - DNA, 140 bp, Artificial Sequence
  Synthetic
atacgccatgctgggtctccggacttgaagcgaaagtagaaccagagaagatctctcgacgcggggactcggcttgctgaagtgcaacacggcaagaggcgagagcggcgactggtgagtcgtacttgggagtcggccat

SEQ ID NO: 414386 - DNA, 140 bp, Artificial Sequence
  Synthetic
atggccgactcccaagtacgactcaccagtcgccgctctcgcctcttgccgtgttgcacttcagcaagccgagtccccgcgtcgagagatcttctctggttctactttcgcttcaagtccggagacccagcatggcgtat

SEQ ID NO: 414387 - DNA, 140 bp, Artificial Sequence
  Synthetic
atacgccatgctgggtctccgggcaagcagggagctagaacgatttgcacttgatcctggccttctagaaacatcagaaggctgtcaaaaaataataagacagctacaaccatcccttcacgtacttgggagtcggccat

SEQ ID NO: 414388 - DNA, 140 bp, Artificial Sequence
  Synthetic
atggccgactcccaagtacgtgaagggatggttgtagctgtcttattattttttgacagccttctgatgtttctagaaggccaggatcaagtgcaaatcgttctagctccctgcttgcccggagacccagcatggcgtat

SEQ ID NO: 414389 - DNA, 140 bp, Artificial Sequence
  Synthetic
aggccctggctgctgatatggaaaaatctgtggaattggtttgacataacaaaatggctgtggtatataaaaatattcatcatgatagtaggaggcttgataggtttgagaataatttttgaccttttgggacagcggtg

SEQ ID NO: 414390 - DNA, 140 bp, Artificial Sequence
  Synthetic
caccgctgtcccaaaaggtcaaaaattattctcaaacctatcaagcctcctactatcatgatgaatatttttatataccacagccattttgttatgtcaaaccaattccacagatttttccatatcagcagccagggcct

SEQ ID NO: 414391 - DNA, 140 bp, Artificial Sequence
  Synthetic
atacgccatgctgggtctccaccccaatccacatgaatatccattgcacaatgtgacagatagatttgatatatgggaaaattacatggtggaacagatgcaagaggacattactgatttcgtacttgggagtcggccat

SEQ ID NO: 414392 - DNA, 140 bp, Artificial Sequence
  Synthetic
atggccgactcccaagtacgaaatcagtaatgtcctcttgcatctgttccaccatgtaattttcccatatatcaaatctatctgtcacattgtgcaatggatattcatgtggattggggtggagacccagcatggcgtat

SEQ ID NO: 414393 - DNA, 140 bp, Artificial Sequence
  Synthetic
atacgccatgctgggtctccggaaaactcatttgcaccactaatgtgccttggaataatagttggagtaatagaaacttgagtaagatttgggataacatgacctggatgcaatgggaaacgtacttgggagtcggccat

SEQ ID NO: 414394 - DNA, 140 bp, Artificial Sequence
  Synthetic
atggccgactcccaagtacgtttcccattgcatccaggtcatgttatcccaaatcttactcaagtttctattactccaactattattccaaggcacattagtggtgcaaatgagttttccggagacccagcatggcgtat

SEQ ID NO: 414395 - DNA, 140 bp, Artificial Sequence
  Synthetic
atacgccatgctgggtctccaaatggaatgtaatgacataaatacaacaaacaccaacacaacaacacacaacccatcaccagacatgaaacagtgtaattttaatgtaaccacagttatcgtacttgggagtcggccat

SEQ ID NO: 414396 - DNA, 140 bp, Artificial Sequence
  Synthetic
atggccgactcccaagtacgataactgtggttacattaaaattacactgtttcatgtctggtgatgggttgtgtgttgttgtgttggtgtttgttgtatttatgtcattacattccatttggagacccagcatggcgtat

SEQ ID NO: 414397 - DNA, 140 bp, Artificial Sequence
  Synthetic
aggccctggctgctgatatgaacccatcaccagacatgaaacagtgtaattttaatgtaaccacagttatcaaagacaaaaaagagaaaaaacaggctctattttatgtatcagatttgagaccttttgggacagcggtg

SEQ ID NO: 414398 - DNA, 140 bp, Artificial Sequence
  Synthetic
caccgctgtcccaaaaggtctcaaatctgatacataaaatagagcctgttttttctcttttttgtctttgataactgtggttacattaaaattacactgtttcatgtctggtgatgggttcatatcagcagccagggcct

SEQ ID NO: 414399 - DNA, 140 bp, Artificial Sequence
  Synthetic
atacgccatgctgggtctccagtgtaacaatatagaatttaatggaacaggcacatgcaacaacatttcagtagttacttgtacacatggcatcaagccaacaataagtactcaactaatcgtacttgggagtcggccat

SEQ ID NO: 414400 - DNA, 140 bp, Artificial Sequence
  Synthetic
atggccgactcccaagtacgattagttgagtacttattgttggcttgatgccatgtgtacaagtaactactgaaatgttgttgcatgtgcctgttccattaaattctatattgttacactggagacccagcatggcgtat

SEQ ID NO: 414401 - DNA, 140 bp, Artificial Sequence
  Synthetic
aggccctggctgctgatatggtagttacttgtacacatggcatcaagccaacaataagtactcaactaatactaaatgggacactctccaaagggaaaataagaattatgggaaaagatagaccttttgggacagcggtg

SEQ ID NO: 414402 - DNA, 140 bp, Artificial Sequence
  Synthetic
caccgctgtcccaaaaggtctatcttttcccataattcttattttccctttggagagtgtcccatttagtattagttgagtacttattgttggcttgatgccatgtgtacaagtaactaccatatcagcagccagggcct

SEQ ID NO: 414403 - DNA, 140 bp, Artificial Sequence
  Synthetic
aggccctggctgctgatatggttttaattgtggcaaagaaggacacatagccagaaattgcagggcccctagaaaaaagggctgttggaaatgtggaagagaaggacaccaaatgaaagagaccttttgggacagcggtg

SEQ ID NO: 414404 - DNA, 140 bp, Artificial Sequence
  Synthetic
caccgctgtcccaaaaggtctctttcatttggtgtccttctcttccacatttccaacagcccttttttctaggggccctgcaatttctggctatgtgtccttctttgccacaattaaaaccatatcagcagccagggcct

SEQ ID NO: 414405 - DNA, 140 bp, Artificial Sequence
  Synthetic
atacgccatgctgggtctccataacctgtgagagaccattcaatctgacggtagaacagatgaagataggcccaatggcctggtacagcatagatatagggagaggaaacacaagcgacccgtacttgggagtcggccat

SEQ ID NO: 414406 - DNA, 140 bp, Artificial Sequence
  Synthetic
atggccgactcccaagtacgggtcgcttgtgtttcctctccctatatctatgctgtaccaggccattgggcctatcttcatctgttctaccgtcagattgaatggtctctcacaggttatggagacccagcatggcgtat

SEQ ID NO: 414407 - DNA, 140 bp, Artificial Sequence
  Synthetic
aggccctggctgctgatatgcccaatggcctggtacagcatagatatagggagaggaaacacaagcgacccaagaagagctttttgcaaatttgaagaaaccaaatggaaagaagccttagaccttttgggacagcggtg

SEQ ID NO: 414408 - DNA, 140 bp, Artificial Sequence
  Synthetic
caccgctgtcccaaaaggtctaaggcttctttccatttggtttcttcaaatttgcaaaaagctcttcttgggtcgcttgtgtttcctctccctatatctatgctgtaccaggccattgggcatatcagcagccagggcct

SEQ ID NO: 414409 - DNA, 140 bp, Artificial Sequence
  Synthetic
atacgccatgctgggtctcctgttagcgtgatcttcaatagaagcaatgatggagatccagagatagcctttttgcattttaactgccatggagagttcttttattgtaacacatcggggcgtacttgggagtcggccat

SEQ ID NO: 414410 - DNA, 140 bp, Artificial Sequence
  Synthetic
atggccgactcccaagtacgccccgatgtgttacaataaaagaactctccatggcagttaaaatgcaaaaaggctatctctggatctccatcattgcttctattgaagatcacgctaacaggagacccagcatggcgtat

SEQ ID NO: 414411 - DNA, 140 bp, Artificial Sequence
  Synthetic
aggccctggctgctgatatgttttgcattttaactgccatggagagttcttttattgtaacacatcggggatgtttaattatacctttacatgtaacaaaaccaactgcactaacaataggaccttttgggacagcggtg

SEQ ID NO: 414412 - DNA, 140 bp, Artificial Sequence
  Synthetic
caccgctgtcccaaaaggtcctattgttagtgcagttggttttgttacatgtaaaggtataattaaacatccccgatgtgttacaataaaagaactctccatggcagttaaaatgcaaaacatatcagcagccagggcct

SEQ ID NO: 414413 - DNA, 140 bp, Artificial Sequence
  Synthetic
atacgccatgctgggtctcctgaggtcatggatacagggggggtcaggactctatgcccctcccatcaaaggtaccctaacatgtatgtcaaacataactgggatgattctagaaatggacgtacttgggagtcggccat

SEQ ID NO: 414414 - DNA, 140 bp, Artificial Sequence
  Synthetic
atggccgactcccaagtacgtccatttctagaatcatcccagttatgtttgacatacatgttagggtacctttgatgggaggggcatagagtcctgaccccccctgtatccatgacctcaggagacccagcatggcgtat

SEQ ID NO: 414415 - DNA, 140 bp, Artificial Sequence
  Synthetic
atacgccatgctgggtctccttaatgctacattcagaccaatagggggagatatgaaagatatatggagaactcaattattcaactataaggtggtaagggtgaaaccttttagtgtagccgtacttgggagtcggccat

SEQ ID NO: 414416 - DNA, 140 bp, Artificial Sequence
  Synthetic
atggccgactcccaagtacggctacactaaaaggtttcacccttaccaccttatagttgaataattgagttctccatatatctttcatatctccccctattggtctgaatgtagcattaaggagacccagcatggcgtat

SEQ ID NO: 414417 - DNA, 140 bp, Artificial Sequence
  Synthetic
aggccctggctgctgatatgcaactccgagctcgcctgctagccttagaaacctttatacagaatcagcaactcctaaacctatggggctgtaaaggaaatctaatctgctacacatcaggaccttttgggacagcggtg

SEQ ID NO: 414418 - DNA, 140 bp, Artificial Sequence
  Synthetic
caccgctgtcccaaaaggtcctgatgtgtagcagattagatttcctttacagccccataggtttaggagttgctgattctgtataaaggtttctaaggctagcaggcgagctcggagttgcatatcagcagccagggcct

SEQ ID NO: 414419 - DNA, 140 bp, Artificial Sequence
  Synthetic
atacgccatgctgggtctccgtagggtggcctgctgtaagagaaagaataagacaaactggagctagggcagcagaaggagtaggagcagcttctcaagacttagatagacatggagcaccgtacttgggagtcggccat

SEQ ID NO: 414420 - DNA, 140 bp, Artificial Sequence
  Synthetic
atggccgactcccaagtacggtgctccatgtctatctaagtcttgagaagctgctcctactccttctgctgccctagctccagtttgtcttattctttctcttacagcaggccaccctacggagacccagcatggcgtat

SEQ ID NO: 414421 - DNA, 140 bp, Artificial Sequence
  Synthetic
atacgccatgctgggtctcccactttagggagaggacaagacatgacaaactgctctttcaaggtaaccacagaaagaagggataggaagaagaaagaatatgcacttttctatagagttcgtacttgggagtcggccat

SEQ ID NO: 414422 - DNA, 140 bp, Artificial Sequence
  Synthetic
atggccgactcccaagtacgaactctatagaaaagtgcatattctttcttcttcctatcccttctttctgtggttaccttgaaagagcagtttgtcatgtcttgtcctctccctaaagtgggagacccagcatggcgtat

SEQ ID NO: 414423 - DNA, 140 bp, Artificial Sequence
  Synthetic
atacgccatgctgggtctcccaccatatatgaagaaatacaaaaggcacaagtacagcaggaacacaatgagaaaaagttactagagctaagtgaatgggcttctatttggaattggtttcgtacttgggagtcggccat

SEQ ID NO: 414424 - DNA, 140 bp, Artificial Sequence
  Synthetic
atggccgactcccaagtacgaaaccaattccaaatagaagcccattcacttagctctagtaactttttctcattgtgttcctgctgtacttgtgccttttgtatttcttcatatatggtgggagacccagcatggcgtat

SEQ ID NO: 414425 - DNA, 140 bp, Artificial Sequence
  Synthetic
atacgccatgctgggtctcccataaatgacatgaaaaattgctctttcaatataaccacagaaataagaggtaaaaagaagaatgaatatgcacttttttatagacttgatatagtaccacgtacttgggagtcggccat

SEQ ID NO: 414426 - DNA, 140 bp, Artificial Sequence
  Synthetic
atggccgactcccaagtacgtggtactatatcaagtctataaaaaagtgcatattcattcttctttttacctcttatttctgtggttatattgaaagagcaatttttcatgtcatttatgggagacccagcatggcgtat

SEQ ID NO: 414427 - DNA, 140 bp, Artificial Sequence
  Synthetic
atacgccatgctgggtctccttagcatcagggacccagagagtgatcagccatctgggaattggactgtggatcctagggcagaagataattgatggttgcaaactttgtaaagctgtaacgtacttgggagtcggccat

SEQ ID NO: 414428 - DNA, 140 bp, Artificial Sequence
  Synthetic
atggccgactcccaagtacgttacagctttacaaagtttgcaaccatcaattatcttctgccctaggatccacagtccaattcccagatggctgatcactctctgggtccctgatgctaaggagacccagcatggcgtat

SEQ ID NO: 414429 - DNA, 140 bp, Artificial Sequence
  Synthetic
aggccctggctgctgatatgtttacccagggattaaagtaaggcaactttgtaaactccttaggggggccaaagcactaacagacatagtaccactaactgaagaagcagaattagaattgaccttttgggacagcggtg

SEQ ID NO: 414430 - DNA, 140 bp, Artificial Sequence
  Synthetic
caccgctgtcccaaaaggtcaattctaattctgcttcttcagttagtggtactatgtctgttagtgctttggcccccctaaggagtttacaaagttgccttactttaatccctgggtaaacatatcagcagccagggcct

SEQ ID NO: 414431 - DNA, 140 bp, Artificial Sequence
  Synthetic
atacgccatgctgggtctccaccattgcagtggcagtaggcaagtggactgacgacataatcttagggatacaaaggataggaagaggaatacttaacatcccaagaagaattagacaggcgtacttgggagtcggccat

SEQ ID NO: 414432 - DNA, 140 bp, Artificial Sequence
  Synthetic
atggccgactcccaagtacgcctgtctaattcttcttgggatgttaagtattcctcttcctatcctttgtatccctaagattatgtcgtcagtccacttgcctactgccactgcaatggtggagacccagcatggcgtat

SEQ ID NO: 414433 - DNA, 140 bp, Artificial Sequence
  Synthetic
  misc_feature (72)..(72): n is a, c, g, or t
aggccctggctgctgatatgacaaaggataggaagaggaatacttaacatcccaagaagaattagacagggnttagaaagaagcttattgtaacatgggaaacgttttggggaaaagcaagaccttttgggacagcggtg

SEQ ID NO: 414434 - DNA, 140 bp, Artificial Sequence
  Synthetic
  misc_feature (69)..(69): n is a, c, g, or t
caccgctgtcccaaaaggtcttgcttttccccaaaacgtttcccatgttacaataagcttctttctaanccctgtctaattcttcttgggatgttaagtattcctcttcctatcctttgtcatatcagcagccagggcct

SEQ ID NO: 414435 - DNA, 140 bp, Artificial Sequence
  Synthetic
aggccctggctgctgatatgaaaaagtgtgcgtataggaccagggcaaacatactatgcaccaggtgatataataggggatataagacaagcacattgtaatgtcagtagaagagattgggaccttttgggacagcggtg

SEQ ID NO: 414436 - DNA, 140 bp, Artificial Sequence
  Synthetic
caccgctgtcccaaaaggtcccaatctcttctactgacattacaatgtgcttgtcttatatcccctattatatcacctggtgcatagtatgtttgccctggtcctatacgcacactttttcatatcagcagccagggcct

SEQ ID NO: 414437 - DNA, 140 bp, Artificial Sequence
  Synthetic
aggccctggctgctgatatgtttaaagttggagatacgcagcaggcaatacaaaaattaagggaagtcatggggaacaggaagtctgcaagtgccgctaaggaagacacaagtgcaaaacgaccttttgggacagcggtg

SEQ ID NO: 414438 - DNA, 140 bp, Artificial Sequence
  Synthetic
caccgctgtcccaaaaggtcgttttgcacttgtgtcttccttagcggcacttgcagacttcctgttccccatgacttcccttaatttttgtattgcctgctgcgtatctccaactttaaacatatcagcagccagggcct

SEQ ID NO: 414439 - DNA, 140 bp, Artificial Sequence
  Synthetic
atacgccatgctgggtctccgtggcgcccgaacagggacgcgaaaacgaaagtgagaccagaggagctctctcgacgcaggactcggcttgctgaaagcgcgcacagcaagaggcgagagcgtacttgggagtcggccat

SEQ ID NO: 414440 - DNA, 140 bp, Artificial Sequence
  Synthetic
atggccgactcccaagtacgctctcgcctcttgctgtgcgcgctttcagcaagccgagtcctgcgtcgagagagctcctctggtctcactttcgttttcgcgtccctgttcgggcgccacggagacccagcatggcgtat

SEQ ID NO: 414441 - DNA, 140 bp, Artificial Sequence
  Synthetic
aggccctggctgctgatatgaaggagctattccctatgatattaatactatgctaaatgccataggaggacatcaaggggctttacaagtgctaaaggaagtaatcaatgaggaagcagcgaccttttgggacagcggtg

SEQ ID NO: 414442 - DNA, 140 bp, Artificial Sequence
  Synthetic
caccgctgtcccaaaaggtcgctgcttcctcattgattacttcctttagcacttgtaaagccccttgatgtcctcctatggcatttagcatagtattaatatcatagggaatagctccttcatatcagcagccagggcct

SEQ ID NO: 414443 - DNA, 140 bp, Artificial Sequence
  Synthetic
aggccctggctgctgatatgtgtagaggagaatttttctattgcaatacatcaaaactgtttaatagcagttataatggtaccagttataggggtacagaaagtaatagttcaatcatcagaccttttgggacagcggtg

SEQ ID NO: 414444 - DNA, 140 bp, Artificial Sequence
  Synthetic
caccgctgtcccaaaaggtctgatgattgaactattactttctgtacccctataactggtaccattataactgctattaaacagttttgatgtattgcaatagaaaaattctcctctacacatatcagcagccagggcct

SEQ ID NO: 414445 - DNA, 140 bp, Artificial Sequence
  Synthetic
aggccctggctgctgatatgtagtgagtatagattaataaattgtaatacctccaccataacacaagcctgtccaaaggtctcttttgatccaattcctatacattattgtgctccagctgaccttttgggacagcggtg

SEQ ID NO: 414446 - DNA, 140 bp, Artificial Sequence
  Synthetic
caccgctgtcccaaaaggtcagctggagcacaataatgtataggaattggatcaaaagagacctttggacaggcttgtgttatggtggaggtattacaatttattaatctatactcactacatatcagcagccagggcct

SEQ ID NO: 414447 - DNA, 140 bp, Artificial Sequence
  Synthetic
aggccctggctgctgatatgcggagacagcgacgaagacctcctcaaggcgatcaggctcatcaagttcctctatcaaagcagtaagtaacatatgtgatgcaacctgtagtgatagcaagaccttttgggacagcggtg

SEQ ID NO: 414448 - DNA, 140 bp, Artificial Sequence
  Synthetic
caccgctgtcccaaaaggtcttgctatcactacaggttgcatcacatatgttacttactgctttgatagaggaacttgatgagcctgatcgccttgaggaggtcttcgtcgctgtctccgcatatcagcagccagggcct

SEQ ID NO: 414449 - DNA, 140 bp, Artificial Sequence
  Synthetic
atacgccatgctgggtctcctgtactaaggtagactgtgagaccagaaattgcactactactaatggcactgtaaacaactctgcagatataaaaaactgctctttcaatataaccacagcgtacttgggagtcggccat

SEQ ID NO: 414450 - DNA, 140 bp, Artificial Sequence
  Synthetic
atggccgactcccaagtacgctgtggttatattgaaagagcagttttttatatctgcagagttgtttacagtgccattagtagtagtgcaatttctggtctcacagtctaccttagtacaggagacccagcatggcgtat

SEQ ID NO: 414451 - DNA, 140 bp, Artificial Sequence
  Synthetic
atacgccatgctgggtctccttgcaataaaatgggaagcaagtggtcaaaatgcagtatagttggatggcctgaggtaggagaaagaataagaagaactgcgccagcagcagagggagtacgtacttgggagtcggccat

SEQ ID NO: 414452 - DNA, 140 bp, Artificial Sequence
  Synthetic
atggccgactcccaagtacgtactccctctgctgctggcgcagttcttcttattctttctcctacctcaggccatccaactatactgcattttgaccacttgcttcccattttattgcaaggagacccagcatggcgtat

SEQ ID NO: 414453 - DNA, 140 bp, Artificial Sequence
  Synthetic
atacgccatgctgggtctccaggaacaaaagggggacacaaccgaactctatccttttgcttccctcaaatccctctttgggacagaccagtagtcatagcaagggtggaaggccatctacgtacttgggagtcggccat

SEQ ID NO: 414454 - DNA, 140 bp, Artificial Sequence
  Synthetic
atggccgactcccaagtacgtagatggccttccacccttgctatgactactggtctgtcccaaagagggatttgagggaagcaaaaggatagagttcggttgtgtcccccttttgttcctggagacccagcatggcgtat

SEQ ID NO: 414455 - DNA, 140 bp, Artificial Sequence
  Synthetic
aggccctggctgctgatatgtaacatttggaccaggacaagcattctatgcaacaggtgacataataggaaatataagagaagcattttgtgtggttaatagaacagcctggaatgagacgaccttttgggacagcggtg

SEQ ID NO: 414456 - DNA, 140 bp, Artificial Sequence
  Synthetic
caccgctgtcccaaaaggtcgtctcattccaggctgttctattaaccacacaaaatgcttctcttatatttcctattatgtcacctgttgcatagaatgcttgtcctggtccaaatgttacatatcagcagccagggcct

SEQ ID NO: 414457 - DNA, 140 bp, Artificial Sequence
  Synthetic
aggccctggctgctgatatgagaaagagcagaagacagtggcaatgagagtgagggggatgcagaggaattggcagcacttggggaaatggggccttttattcctggggatattaataatgaccttttgggacagcggtg

SEQ ID NO: 414458 - DNA, 140 bp, Artificial Sequence
  Synthetic
caccgctgtcccaaaaggtcattattaatatccccaggaataaaaggccccatttccccaagtgctgccaattcctctgcatccccctcactctcattgccactgtcttctgctctttctcatatcagcagccagggcct

SEQ ID NO: 414459 - DNA, 140 bp, Artificial Sequence
  Synthetic
atacgccatgctgggtctcctaaaacagattgtaagaatgtggcagagagtaggacaagcaatgtatgcccctcccatcgcaggaagcattacatgtgtatcaaacattacaggactaatcgtacttgggagtcggccat

SEQ ID NO: 414460 - DNA, 140 bp, Artificial Sequence
  Synthetic
atggccgactcccaagtacgattagtcctgtaatgtttgatacacatgtaatgcttcctgcgatgggaggggcatacattgcttgtcctactctctgccacattcttacaatctgttttaggagacccagcatggcgtat

SEQ ID NO: 414461 - DNA, 140 bp, Artificial Sequence
  Synthetic
aggccctggctgctgatatgctatgtaggatcagatttacctctgacagaacatagaaaaagggttgaattgcttagagaacacttatatcagtggggattcactacccctgataaaaaggaccttttgggacagcggtg

SEQ ID NO: 414462 - DNA, 140 bp, Artificial Sequence
  Synthetic
caccgctgtcccaaaaggtcctttttatcaggggtagtgaatccccactgatataagtgttctctaagcaattcaaccctttttctatgttctgtcagaggtaaatctgatcctacatagcatatcagcagccagggcct

SEQ ID NO: 414463 - DNA, 140 bp, Artificial Sequence
  Synthetic
aggccctggctgctgatatgcttccctcagatcactctttggcaacgacccctcgtcacaataaagataggggggcaactaaaggaagctctattagatacaggagcagatgatacagtagaccttttgggacagcggtg

SEQ ID NO: 414464 - DNA, 140 bp, Artificial Sequence
  Synthetic
caccgctgtcccaaaaggtctactgtatcatctgctcctgtatctaatagagcttcctttagttgcccccctatctttattgtgacgaggggtcgttgccaaagagtgatctgagggaagcatatcagcagccagggcct

SEQ ID NO: 414465 - DNA, 140 bp, Artificial Sequence
  Synthetic
atacgccatgctgggtctcctaaatgatatacaaaaactaataggaaagttaaattgggcaagtcaaatctatcaaggaattagagtaaaagaattgtgtaagttaattagaggcaccaacgtacttgggagtcggccat

SEQ ID NO: 414466 - DNA, 140 bp, Artificial Sequence
  Synthetic
atggccgactcccaagtacgttggtgcctctaattaacttacacaattcttttactctaattccttgatagatttgacttgcccaatttaactttcctattagtttttgtatatcatttaggagacccagcatggcgtat

SEQ ID NO: 414467 - DNA, 140 bp, Artificial Sequence
  Synthetic
atacgccatgctgggtctccgaagccttagacagaatagaggaggaacaaagaaaaggtcagggaaaaacacagcaggcagaagcagctaaggctgacggaaaggtcagtcaaaattatccgtacttgggagtcggccat

SEQ ID NO: 414468 - DNA, 140 bp, Artificial Sequence
  Synthetic
atggccgactcccaagtacggataattttgactgacctttccgtcagccttagctgcttctgcctgctgtgtttttccctgaccttttctttgttcctcctctattctgtctaaggcttcggagacccagcatggcgtat

SEQ ID NO: 414469 - DNA, 140 bp, Artificial Sequence
  Synthetic
atacgccatgctgggtctccccattgatcaaattatggtaccagttagaaagtgaacctattataggggcagaaacctattatgtagatggagcagctaatagagatacaaaactaggaacgtacttgggagtcggccat

SEQ ID NO: 414470 - DNA, 140 bp, Artificial Sequence
  Synthetic
atggccgactcccaagtacgttcctagttttgtatctctattagctgctccatctacataataggtttctgcccctataataggttcactttctaactggtaccataatttgatcaatggggagacccagcatggcgtat

SEQ ID NO: 414471 - DNA, 140 bp, Artificial Sequence
  Synthetic
atacgccatgctgggtctccagaaacctattatgtagatggagcagctaatagagatacaaaactaggaaaggcaggatatgttacagaacaagggaaacagaaaataataaaattagagcgtacttgggagtcggccat

SEQ ID NO: 414472 - DNA, 140 bp, Artificial Sequence
  Synthetic
atggccgactcccaagtacgctctaattttattattttctgtttcccttgttctgtaacatatcctgcctttcctagttttgtatctctattagctgctccatctacataataggtttctggagacccagcatggcgtat

SEQ ID NO: 414473 - DNA, 140 bp, Artificial Sequence
  Synthetic
aggccctggctgctgatatgaggcaggatatgttacagaacaagggaaacagaaaataataaaattagaggagaccaccaatcaaaaggctgaattaatggcagtattattagccttacagaccttttgggacagcggtg

SEQ ID NO: 414474 - DNA, 140 bp, Artificial Sequence
  Synthetic
caccgctgtcccaaaaggtctgtaaggctaataatactgccattaattcagccttttgattggtggtctcctctaattttattattttctgtttcccttgttctgtaacatatcctgcctcatatcagcagccagggcct

SEQ ID NO: 414475 - DNA, 140 bp, Artificial Sequence
  Synthetic
aggccctggctgctgatatggatcatgaaaaatatcatagcaattggagagcattagctagtgactttggactaccaccagtggtggccaaggaaatcattgctagctgtcctaaatgtcgaccttttgggacagcggtg

SEQ ID NO: 414476 - DNA, 140 bp, Artificial Sequence
  Synthetic
caccgctgtcccaaaaggtcgacatttaggacagctagcaatgatttccttggccaccactggtggtagtccaaagtcactagctaatgctctccaattgctatgatatttttcatgatccatatcagcagccagggcct

SEQ ID NO: 414477 - DNA, 140 bp, Artificial Sequence
  Synthetic
aggccctggctgctgatatgactaccaccagtggtggccaaggaaatcattgctagctgtcctaaatgtcatataagaggagaagcaatgcatggtcaggtagactgcagtccagaagtagaccttttgggacagcggtg

SEQ ID NO: 414478 - DNA, 140 bp, Artificial Sequence
  Synthetic
caccgctgtcccaaaaggtctacttctggactgcagtctacctgaccatgcattgcttctcctcttatatgacatttaggacagctagcaatgatttccttggccaccactggtggtagtcatatcagcagccagggcct

SEQ ID NO: 414479 - DNA, 140 bp, Artificial Sequence
  Synthetic
atacgccatgctgggtctcctagtggtaatactacccacattgataacataaaggaacaagtagtaaattgctctttcaatacaaccacagaaataagagataaaaaacagaatgtgtatcgtacttgggagtcggccat

SEQ ID NO: 414480 - DNA, 140 bp, Artificial Sequence
  Synthetic
atggccgactcccaagtacgatacacattctgttttttatctcttatttctgtggttgtattgaaagagcaatttactacttgttcctttatgttatcaatgtgggtagtattaccactaggagacccagcatggcgtat

SEQ ID NO: 414481 - DNA, 140 bp, Artificial Sequence
  Synthetic
atacgccatgctgggtctccctggtgaaataccataagtacaggtctaggaaggccaaggactggtactacagacatcattatgaatctagaaatccaagaatcagttcaagtgtatatacgtacttgggagtcggccat

SEQ ID NO: 414482 - DNA, 140 bp, Artificial Sequence
  Synthetic
atggccgactcccaagtacgtatatacacttgaactgattcttggatttctagattcataatgatgtctgtagtaccagtccttggccttcctagacctgtacttatggtatttcaccagggagacccagcatggcgtat

SEQ ID NO: 414483 - DNA, 140 bp, Artificial Sequence
  Synthetic
aggccctggctgctgatatgcaataaaatttgcaccacactcaggaggggacctagaaattacaacacatagttttaattgtagaggagaatttttctactgcaatacaacaaaactgttgaccttttgggacagcggtg

SEQ ID NO: 414484 - DNA, 140 bp, Artificial Sequence
  Synthetic
caccgctgtcccaaaaggtcaacagttttgttgtattgcagtagaaaaattctcctctacaattaaaactatgtgttgtaatttctaggtcccctcctgagtgtggtgcaaattttattgcatatcagcagccagggcct

SEQ ID NO: 414485 - DNA, 140 bp, Artificial Sequence
  Synthetic
aggccctggctgctgatatgccaggagaaagagaggaacatatgggacatggggttagtatagaatggcagtacaaaaagtatacaacacagattgaccctgaaacagcagacaggatgagaccttttgggacagcggtg

SEQ ID NO: 414486 - DNA, 140 bp, Artificial Sequence
  Synthetic
caccgctgtcccaaaaggtctcatcctgtctgctgtttcagggtcaatctgtgttgtatactttttgtactgccattctatactaaccccatgtcccatatgttcctctctttctcctggcatatcagcagccagggcct

SEQ ID NO: 414487 - DNA, 140 bp, Artificial Sequence
  Synthetic
atacgccatgctgggtctccagcagaaggggtgggagcagtgtctcgagacttagacagacggggagcaattacaagcagcaatactagaactactaatcctgacttggcctggctggaacgtacttgggagtcggccat

SEQ ID NO: 414488 - DNA, 140 bp, Artificial Sequence
  Synthetic
atggccgactcccaagtacgttccagccaggccaagtcaggattagtagttctagtattgctgcttgtaattgctccccgtctgtctaagtctcgagacactgctcccaccccttctgctggagacccagcatggcgtat

SEQ ID NO: 414489 - DNA, 140 bp, Artificial Sequence
  Synthetic
aggccctggctgctgatatggagatgcccccttggcatcaacctggaagtcagcccccgaatccttgtaataattgctattgcaaaaaatgctgctatcattgctatgtttgtttcacaagaccttttgggacagcggtg

SEQ ID NO: 414490 - DNA, 140 bp, Artificial Sequence
  Synthetic
caccgctgtcccaaaaggtcttgtgaaacaaacatagcaatgatagcagcattttttgcaatagcaattattacaaggattcgggggctgacttccaggttgatgccaagggggcatctccatatcagcagccagggcct

SEQ ID NO: 414491 - DNA, 140 bp, Artificial Sequence
  Synthetic
atacgccatgctgggtctccaaggggtcagtcaaaattaccctatagtacagaatcttcagggacaaatggtacatcaggctatatcacctagaactttaaatgcatgggtaaaggtgatcgtacttgggagtcggccat

SEQ ID NO: 414492 - DNA, 140 bp, Artificial Sequence
  Synthetic
atggccgactcccaagtacgatcacctttacccatgcatttaaagttctaggtgatatagcctgatgtaccatttgtccctgaagattctgtactatagggtaattttgactgaccccttggagacccagcatggcgtat

SEQ ID NO: 414493 - DNA, 140 bp, Artificial Sequence
  Synthetic
aggccctggctgctgatatgagtaacgccaatgcttcatagggatctgctattactaataattattagtgctttgctgcttacaaatataattctatggatgtttgttcttagaaaatatgaccttttgggacagcggtg

SEQ ID NO: 414494 - DNA, 140 bp, Artificial Sequence
  Synthetic
caccgctgtcccaaaaggtcatattttctaagaacaaacatccatagaattatatttgtaagcagcaaagcactaataattattagtaatagcagatccctatgaagcattggcgttactcatatcagcagccagggcct

SEQ ID NO: 414495 - DNA, 140 bp, Artificial Sequence
  Synthetic
  misc_feature (26)..(26): n is a, c, g, or t
aggccctggctgctgatatgaagaanaataagagaaattagagatgatagtgactatgaaagtaatgaagaagaagaacaagaagttagggatcatcttgtgcatacttttggctttgctgaccttttgggacagcggtg

SEQ ID NO: 414496 - DNA, 140 bp, Artificial Sequence
  Synthetic
  misc_feature (115)..(115): n is a, c, g, or t
caccgctgtcccaaaaggtcagcaaagccaaaagtatgcacaagatgatccctaacttcttgttcttcttcttcattactttcatagtcactatcatctctaatttctcttattnttcttcatatcagcagccagggcct

SEQ ID NO: 414497 - DNA, 140 bp, Artificial Sequence
  Synthetic
aggccctggctgctgatatgaacctaacaagcactgagcagcataatatttgggcatcacaagcctgtgttcccacagaccccactccacatgaatatccattacacaatgtgacagatagaccttttgggacagcggtg

SEQ ID NO: 414498 - DNA, 140 bp, Artificial Sequence
  Synthetic
caccgctgtcccaaaaggtctatctgtcacattgtgtaatggatattcatgtggagtggggtctgtgggaacacaggcttgtgatgcccaaatattatgctgctcagtgcttgttaggttcatatcagcagccagggcct

SEQ ID NO: 414499 - DNA, 140 bp, Artificial Sequence
  Synthetic
atacgccatgctgggtctccaatttaatatatggaaaaattacatggtagaccaaatgcaggaagacattattagcttatgggaacagagtttaaaaccttgtgttcaaatgactttcatcgtacttgggagtcggccat

SEQ ID NO: 414500 - DNA, 140 bp, Artificial Sequence
  Synthetic
atggccgactcccaagtacgatgaaagtcatttgaacacaaggttttaaactctgttcccataagctaataatgtcttcctgcatttggtctaccatgtaatttttccatatattaaattggagacccagcatggcgtat

SEQ ID NO: 414501 - DNA, 140 bp, Artificial Sequence
  Synthetic
aggccctggctgctgatatgattagcttatgggaacagagtttaaaaccttgtgttcaaatgactttcatgtgtatacaaatgaattgtacagactttaaaacaaacgacccctctacctgaccttttgggacagcggtg

SEQ ID NO: 414502 - DNA, 140 bp, Artificial Sequence
  Synthetic
caccgctgtcccaaaaggtcaggtagaggggtcgtttgttttaaagtctgtacaattcatttgtatacacatgaaagtcatttgaacacaaggttttaaactctgttcccataagctaatcatatcagcagccagggcct

SEQ ID NO: 414503 - DNA, 140 bp, Artificial Sequence
  Synthetic
aggccctggctgctgatatgtacaagaataagacagggttttgaagcagctttgctataagatggggggcaagttgtcaagaagtctagcacgtggatggcctgctgtaagagaaagaatgaccttttgggacagcggtg

SEQ ID NO: 414504 - DNA, 140 bp, Artificial Sequence
  Synthetic
caccgctgtcccaaaaggtcattctttctcttacagcaggccatccacgtgctagacttcttgacaacttgccccccatcttatagcaaagctgcttcaaaaccctgtcttattcttgtacatatcagcagccagggcct

SEQ ID NO: 414505 - DNA, 140 bp, Artificial Sequence
  Synthetic
atacgccatgctgggtctccgagtttaatgtaaccacagttctcaaagacaaaaaggagaaaaaacaggctctattctatatatcagatttggttaaagtgaatgatagcgaaacaagtacgtacttgggagtcggccat

SEQ ID NO: 414506 - DNA, 140 bp, Artificial Sequence
  Synthetic
atggccgactcccaagtacgtacttgtttcgctatcattcactttaaccaaatctgatatatagaatagagcctgttttttctcctttttgtctttgagaactgtggttacattaaactcggagacccagcatggcgtat

SEQ ID NO: 414507 - DNA, 140 bp, Artificial Sequence
  Synthetic
atacgccatgctgggtctcctatacattaattaattgtaactccacaaccatcaagcaagcctgtccaaaggtatcttttgagccaattccaatacactattgtgctccagcaggatttgcgtacttgggagtcggccat

SEQ ID NO: 414508 - DNA, 140 bp, Artificial Sequence
  Synthetic
atggccgactcccaagtacgcaaatcctgctggagcacaatagtgtattggaattggctcaaaagatacctttggacaggcttgcttgatggttgtggagttacaattaattaatgtataggagacccagcatggcgtat

SEQ ID NO: 414509 - DNA, 140 bp, Artificial Sequence
  Synthetic
aggccctggctgctgatatgaacattacagtagttacttgtacacatggcatcaagccaacagtaagtactcagctaatattaaatggaacactttcgaaaggaaagataagactgatgggaccttttgggacagcggtg

SEQ ID NO: 414510 - DNA, 140 bp, Artificial Sequence
  Synthetic
caccgctgtcccaaaaggtcccatcagtcttatctttcctttcgaaagtgttccatttaatattagctgagtacttactgttggcttgatgccatgtgtacaagtaactactgtaatgttcatatcagcagccagggcct

SEQ ID NO: 414511 - DNA, 140 bp, Artificial Sequence
  Synthetic
atacgccatgctgggtctccactataagcatgacctgccagagaccaggaaatacaacagtacaggagataaaaataggtccaatgtcctggtacagcatgagcacagaaggcaaccctgcgtacttgggagtcggccat

SEQ ID NO: 414512 - DNA, 140 bp, Artificial Sequence
  Synthetic
atggccgactcccaagtacgcagggttgccttctgtgctcatgctgtaccaggacattggacctatttttatctcctgtactgttgtatttcctggtctctggcaggtcatgcttatagtggagacccagcatggcgtat

SEQ ID NO: 414513 - DNA, 140 bp, Artificial Sequence
  Synthetic
aggccctggctgctgatatgaaaaataggtccaatgtcctggtacagcatgagcacagaaggcaaccctgagtcaagaagggcttattgtgagtataataccactaattgggtagaggccgaccttttgggacagcggtg

SEQ ID NO: 414514 - DNA, 140 bp, Artificial Sequence
  Synthetic
caccgctgtcccaaaaggtcggcctctacccaattagtggtattatactcacaataagcccttcttgactcagggttgccttctgtgctcatgctgtaccaggacattggacctatttttcatatcagcagccagggcct

SEQ ID NO: 414515 - DNA, 140 bp, Artificial Sequence
  Synthetic
atacgccatgctgggtctccatactaatagtactaatagtggttgggaaaagatggaagaagaaataagaaactgctctttcaatgtcaccacaaacataggaagtaagaggcaaaaagacgtacttgggagtcggccat

SEQ ID NO: 414516 - DNA, 140 bp, Artificial Sequence
  Synthetic
atggccgactcccaagtacgtctttttgcctcttacttcctatgtttgtggtgacattgaaagagcagtttcttatttcttcttccatcttttcccaaccactattagtactattagtatggagacccagcatggcgtat

SEQ ID NO: 414517 - DNA, 140 bp, Artificial Sequence
  Synthetic
atacgccatgctgggtctcctataagtatgatattcaagaacagtactggaggagatctagaggtaacccaattgcattttaattgtcatggagagttcttttactgtaacacatctcagcgtacttgggagtcggccat

SEQ ID NO: 414518 - DNA, 140 bp, Artificial Sequence
  Synthetic
atggccgactcccaagtacgctgagatgtgttacagtaaaagaactctccatgacaattaaaatgcaattgggttacctctagatctcctccagtactgttcttgaatatcatacttataggagacccagcatggcgtat

SEQ ID NO: 414519 - DNA, 140 bp, Artificial Sequence
  Synthetic
atacgccatgctgggtctccattcaatagcactaataacactcagataccttgcaggttgaagcaggtagtaaggtcatggataaaaggagaatcaggactctatgcacctcccatccaacgtacttgggagtcggccat

SEQ ID NO: 414520 - DNA, 140 bp, Artificial Sequence
  Synthetic
atggccgactcccaagtacgttggatgggaggtgcatagagtcctgattctccttttatccatgaccttactacctgcttcaacctgcaaggtatctgagtgttattagtgctattgaatggagacccagcatggcgtat

SEQ ID NO: 414521 - DNA, 140 bp, Artificial Sequence
  Synthetic
aggccctggctgctgatatgacatgcagggcctattgcaccaggccagatgagagaaccaaggggaagtgacatagcaggaactactagtacccttcaggaacaaatagcatggatgacagaccttttgggacagcggtg

SEQ ID NO: 414522 - DNA, 140 bp, Artificial Sequence
  Synthetic
caccgctgtcccaaaaggtctgtcatccatgctatttgttcctgaagggtactagtagttcctgctatgtcacttccccttggttctctcatctggcctggtgcaataggccctgcatgtcatatcagcagccagggcct

SEQ ID NO: 414523 - DNA, 140 bp, Artificial Sequence
  Synthetic
atacgccatgctgggtctcccatctaggaccgggggggacaatatatgcaacaggaggcataataggaaatataagacaagcacattgtaacattagtggagcagaatgggaaaacacttcgtacttgggagtcggccat

SEQ ID NO: 414524 - DNA, 140 bp, Artificial Sequence
  Synthetic
atggccgactcccaagtacgaagtgttttcccattctgctccactaatgttacaatgtgcttgtcttatatttcctattatgcctcctgttgcatatattgtcccccccggtcctagatgggagacccagcatggcgtat

SEQ ID NO: 414525 - DNA, 140 bp, Artificial Sequence
  Synthetic
aggccctggctgctgatatgaatccagacatagttatctaccaatacatggatgatttgtatgtagggtctgacttagaaatagggcagcatagaacaaaaatagaggagttaagagaacgaccttttgggacagcggtg

SEQ ID NO: 414526 - DNA, 140 bp, Artificial Sequence
  Synthetic
caccgctgtcccaaaaggtcgttctcttaactcctctatttttgttctatgctgccctatttctaagtcagaccctacatacaaatcatccatgtattggtagataactatgtctggattcatatcagcagccagggcct

SEQ ID NO: 414527 - DNA, 140 bp, Artificial Sequence
  Synthetic
aggccctggctgctgatatggcctttaatcaatcctcaggaggggatccagaaattataatgcacagttttaattgtggaggggaatttttctactgtaatacaacacagctgtttaatagaccttttgggacagcggtg

SEQ ID NO: 414528 - DNA, 140 bp, Artificial Sequence
  Synthetic
caccgctgtcccaaaaggtctattaaacagctgtgttgtattacagtagaaaaattcccctccacaattaaaactgtgcattataatttctggatcccctcctgaggattgattaaaggccatatcagcagccagggcct

SEQ ID NO: 414529 - DNA, 140 bp, Artificial Sequence
  Synthetic
aggccctggctgctgatatggtggcaggaagtaggaaaagcaatgtatgcccctcccatcagcggacaaattagatgttcatcaaatattacagggctgctattaacaagagatggtggtgaccttttgggacagcggtg

SEQ ID NO: 414530 - DNA, 140 bp, Artificial Sequence
  Synthetic
caccgctgtcccaaaaggtcaccaccatctcttgttaatagcagccctgtaatatttgatgaacatctaatttgtccgctgatgggaggggcatacattgcttttcctacttcctgccaccatatcagcagccagggcct

SEQ ID NO: 414531 - DNA, 140 bp, Artificial Sequence
  Synthetic
atacgccatgctgggtctcccttgccactgttgtacacggacctgaggacaataatcttgtggagttaccacctcttgagcaacttagcatcagggatccagaaggtgatcagccatctgcgtacttgggagtcggccat

SEQ ID NO: 414532 - DNA, 140 bp, Artificial Sequence
  Synthetic
atggccgactcccaagtacgcagatggctgatcaccttctggatccctgatgctaagttgctcaagaggtggtaactccacaagattattgtcctcaggtccgtgtacaacagtggcaagggagacccagcatggcgtat

SEQ ID NO: 414533 - DNA, 140 bp, Artificial Sequence
  Synthetic
atacgccatgctgggtctccagacttggactgtggactctagggcagaagataattagtgcttgcagaatttgtgcagctgtaacacaatactggctacaagaattgcagaatagtgttacgtacttgggagtcggccat

SEQ ID NO: 414534 - DNA, 140 bp, Artificial Sequence
  Synthetic
atggccgactcccaagtacgtaacactattctgcaattcttgtagccagtattgtgttacagctgcacaaattctgcaagcactaattatcttctgccctagagtccacagtccaagtctggagacccagcatggcgtat

SEQ ID NO: 414535 - DNA, 140 bp, Artificial Sequence
  Synthetic
atacgccatgctgggtctccgagaattagacaggggtttgaacgaagcttgttataacatgggaaacgcattgaggaaaagcaaatttgagggatggccagcagtaagagaaagaatgagcgtacttgggagtcggccat

SEQ ID NO: 414536 - DNA, 140 bp, Artificial Sequence
  Synthetic
atggccgactcccaagtacgctcattctttctcttactgctggccatccctcaaatttgcttttcctcaatgcgtttcccatgttataacaagcttcgttcaaacccctgtctaattctcggagacccagcatggcgtat

SEQ ID NO: 414537 - DNA, 140 bp, Artificial Sequence
  Synthetic
aggccctggctgctgatatgtaggtttaagaatagtttttgctgtactttctatagtaaatagagttaggcagggatattcaccattatcgtttcagacccacctcccaaccccgagggggaccttttgggacagcggtg

SEQ ID NO: 414538 - DNA, 140 bp, Artificial Sequence
  Synthetic
caccgctgtcccaaaaggtccccctcggggttgggaggtgggtctgaaacgataatggtgaatatccctgcctaactctatttactatagaaagtacagcaaaaactattcttaaacctacatatcagcagccagggcct

SEQ ID NO: 414539 - DNA, 140 bp, Artificial Sequence
  Synthetic
atacgccatgctgggtctccaaaaacttcccctgaacctaaagattgtgcacctggagtaggacaaatctccaaggaattagcagctagaggaggaataccaagttcttatactcctcagcgtacttgggagtcggccat

SEQ ID NO: 414540 - DNA, 140 bp, Artificial Sequence
  Synthetic
atggccgactcccaagtacgctgaggagtataagaacttggtattcctcctctagctgctaattccttggagatttgtcctactccaggtgcacaatctttaggttcaggggaagtttttggagacccagcatggcgtat

SEQ ID NO: 414541 - DNA, 140 bp, Artificial Sequence
  Synthetic
aggccctggctgctgatatgataaaacaataaaatttgcaccacactcaggaggggacctagaaattacaacacatagctttaattgtggaggagaatttttctattgcaatacatcaaagaccttttgggacagcggtg

SEQ ID NO: 414542 - DNA, 140 bp, Artificial Sequence
  Synthetic
caccgctgtcccaaaaggtctttgatgtattgcaatagaaaaattctcctccacaattaaagctatgtgttgtaatttctaggtcccctcctgagtgtggtgcaaattttattgttttatcatatcagcagccagggcct

SEQ ID NO: 414543 - DNA, 140 bp, Artificial Sequence
  Synthetic
atacgccatgctgggtctccctaaaaagaaatataggctaaaacatttagtatgggcaagcagggagctggacagattcgcatgtaatcctgagctactagaaactgcagagggcaatgacgtacttgggagtcggccat

SEQ ID NO: 414544 - DNA, 140 bp, Artificial Sequence
  Synthetic
atggccgactcccaagtacgtcattgccctctgcagtttctagtagctcaggattacatgcgaatctgtccagctccctgcttgcccatactaaatgttttagcctatatttctttttagggagacccagcatggcgtat

SEQ ID NO: 414545 - DNA, 140 bp, Artificial Sequence
  Synthetic
aggccctggctgctgatatgagaaaaggcctttaaccctgaaatcattcctatgttcatggcattgtcagagggagctattccctatgatattaatactatgctaaatgccataggaggagaccttttgggacagcggtg

SEQ ID NO: 414546 - DNA, 140 bp, Artificial Sequence
  Synthetic
caccgctgtcccaaaaggtctcctcctatggcatttagcatagtattaatatcatagggaatagctccctctgacaatgccatgaacataggaatgatttcagggttaaaggccttttctcatatcagcagccagggcct

SEQ ID NO: 414547 - DNA, 140 bp, Artificial Sequence
  Synthetic
aggccctggctgctgatatgagggagctattccctatgatattaatactatgctaaatgccataggaggacatcaaggggctttacaagtgctaaaggaagtaatcaatgaggaagcatcgaccttttgggacagcggtg

SEQ ID NO: 414548 - DNA, 140 bp, Artificial Sequence
  Synthetic
caccgctgtcccaaaaggtcgatgcttcctcattgattacttcctttagcacttgtaaagccccttgatgtcctcctatggcatttagcatagtattaatatcatagggaatagctccctcatatcagcagccagggcct

SEQ ID NO: 414549 - DNA, 140 bp, Artificial Sequence
  Synthetic
atacgccatgctgggtctccggcaggtagacaggatgaggattaacacatggaaaagtttagtaaaataccatatgcatgtttcaaagaaagccaaaagatggttttatagacatcacttcgtacttgggagtcggccat

SEQ ID NO: 414550 - DNA, 140 bp, Artificial Sequence
  Synthetic
atggccgactcccaagtacgaagtgatgtctataaaaccatcttttggctttctttgaaacatgcatatggtattttactaaacttttccatgtgttaatcctcatcctgtctacctgccggagacccagcatggcgtat

SEQ ID NO: 414551 - DNA, 140 bp, Artificial Sequence
  Synthetic
atacgccatgctgggtctccgaggatacacatcagtattcatgcaaagagggcaaaacccaattaggaaagggcctataaaatgtttcaactgtggaaaagagggacatatagcaaaaaacgtacttgggagtcggccat

SEQ ID NO: 414552 - DNA, 140 bp, Artificial Sequence
  Synthetic
atggccgactcccaagtacgttttttgctatatgtccctcttttccacagttgaaacattttataggccctttcctaattgggttttgccctctttgcatgaatactgatgtgtatcctcggagacccagcatggcgtat

SEQ ID NO: 414553 - DNA, 140 bp, Artificial Sequence
  Synthetic
  misc_feature (24)..(24): n is a, c, g, or t
  misc_feature (34)..(34): n is a, c, g, or t
  misc_feature (52)..(52): n is a, c, g, or t
  misc_feature (65)..(65): n is a, c, g, or t
  misc_feature (89)..(89): n is a, c, g, or t
  misc_feature (94)..(94): n is a, c, g, or t
atacgccatgctgggtctcctcantatgaccacngacttacaggataaacanaagaaagaatacncgcttttctataaacttgatatantgccnattagtgataatagtaataataataccgtacttgggagtcggccat

SEQ ID NO: 414554 - DNA, 140 bp, Artificial Sequence
  Synthetic
  misc_feature (47)..(47): n is a, c, g, or t
  misc_feature (52)..(52): n is a, c, g, or t
  misc_feature (76)..(76): n is a, c, g, or t
  misc_feature (89)..(89): n is a, c, g, or t
  misc_feature (107)..(107): n is a, c, g, or t
  misc_feature (117)..(117): n is a, c, g, or t
atggccgactcccaagtacggtattattattactattatcactaatnggcantatatcaagtttatagaaaagcgngtattctttcttntgtttatcctgtaagtcngtggtcatantgaggagacccagcatggcgtat

SEQ ID NO: 414555 - DNA, 140 bp, Artificial Sequence
  Synthetic
aggccctggctgctgatatgtttaggaaccaaagaaaaactgttaaatgtttcaattgtggcaaagaagggcacatagccaaaaattgcagggcccctaggaaaaagggctgttggaaatgaccttttgggacagcggtg

SEQ ID NO: 414556 - DNA, 140 bp, Artificial Sequence
  Synthetic
caccgctgtcccaaaaggtcatttccaacagccctttttcctaggggccctgcaatttttggctatgtgcccttctttgccacaattgaaacatttaacagtttttctttggttcctaaacatatcagcagccagggcct

SEQ ID NO: 414557 - DNA, 140 bp, Artificial Sequence
  Synthetic
  misc_feature (29)..(29): n is a, c, g, or t
atacgccatgctgggtctccgaaggagtntaggaattggaccaggacgagcgttctatacaacaggtgatataataggagatataagacaagcacactgtatagttaatggaacaaaatgcgtacttgggagtcggccat

SEQ ID NO: 414558 - DNA, 140 bp, Artificial Sequence
  Synthetic
  misc_feature (112)..(112): n is a, c, g, or t
atggccgactcccaagtacgcattttgttccattaactatacagtgtgcttgtcttatatctcctattatatcacctgttgtatagaacgctcgtcctggtccaattcctanactccttcggagacccagcatggcgtat

SEQ ID NO: 414559 - DNA, 140 bp, Artificial Sequence
  Synthetic
aggccctggctgctgatatggcaggaagaagcggagacagcgacacagaactcctcaaagcagtcaaatacatcaagatcctgtaccaaagcagtaagtattgttaagtagtgtatgtaagaccttttgggacagcggtg

SEQ ID NO: 414560 - DNA, 140 bp, Artificial Sequence
  Synthetic
caccgctgtcccaaaaggtcttacatacactacttaacaatacttactgctttggtacaggatcttgatgtatttgactgctttgaggagttctgtgtcgctgtctccgcttcttcctgccatatcagcagccagggcct

SEQ ID NO: 414561 - DNA, 140 bp, Artificial Sequence
  Synthetic
aggccctggctgctgatatgaaggaagaaccaggggcaatacaaaactgttctttcaatatgaccacagaagtagaagataagaagcagaaagtacatgcgcttttttatagacttgatagaccttttgggacagcggtg

SEQ ID NO: 414562 - DNA, 140 bp, Artificial Sequence
  Synthetic
caccgctgtcccaaaaggtctatcaagtctataaaaaagcgcatgtactttctgcttcttatcttctacttctgtggtcatattgaaagaacagttttgtattgcccctggttcttccttcatatcagcagccagggcct

SEQ ID NO: 414563 - DNA, 140 bp, Artificial Sequence
  Synthetic
aggccctggctgctgatatgcatcaaaaggagcctccctttctgtggatggggtatgagctccatccagacaaatggacagtacagcccatccaattgcctaacaaggaagtgtggacaggaccttttgggacagcggtg

SEQ ID NO: 414564 - DNA, 140 bp, Artificial Sequence
  Synthetic
caccgctgtcccaaaaggtcctgtccacacttccttgttaggcaattggatgggctgtactgtccatttgtctggatggagctcataccccatccacagaaagggaggctccttttgatgcatatcagcagccagggcct

SEQ ID NO: 414565 - DNA, 140 bp, Artificial Sequence
  Synthetic
atacgccatgctgggtctccaggaaaacagagagaagctaaaagaaccagtgcatggtgtatactatcaacctgacaaagacttatgggttaatattcagaagcaaggagaagggcaatgcgtacttgggagtcggccat

SEQ ID NO: 414566 - DNA, 140 bp, Artificial Sequence
  Synthetic
atggccgactcccaagtacgcattgcccttctccttgcttctgaatattaacccataagtctttgtcaggttgatagtatacaccatgcactggttcttttagcttctctctgttttcctggagacccagcatggcgtat

SEQ ID NO: 414567 - DNA, 140 bp, Artificial Sequence
  Synthetic
aggccctggctgctgatatggcactagcagcattaataacaccaaaaaagataaagccacctttgcctagtgttacgaaactgacagaggatagatggaacaagccccagaagaccaagggaccttttgggacagcggtg

SEQ ID NO: 414568 - DNA, 140 bp, Artificial Sequence
  Synthetic
caccgctgtcccaaaaggtcccttggtcttctggggcttgttccatctatcctctgtcagtttcgtaacactaggcaaaggtggctttatcttttttggtgttattaatgctgctagtgccatatcagcagccagggcct

SEQ ID NO: 414569 - DNA, 140 bp, Artificial Sequence
  Synthetic
atacgccatgctgggtctccggcactatcactctcccatgtcgaataaaacaatttgtaaacatgtggcaggaagtaggacgagcaatgtatgccgctcccattgcaggaaacattacctcgtacttgggagtcggccat

SEQ ID NO: 414570 - DNA, 140 bp, Artificial Sequence
  Synthetic
atggccgactcccaagtacgaggtaatgtttcctgcaatgggagcggcatacattgctcgtcctacttcctgccacatgtttacaaattgttttattcgacatgggagagtgatagtgccggagacccagcatggcgtat

SEQ ID NO: 414571 - DNA, 140 bp, Artificial Sequence
  Synthetic
aggccctggctgctgatatgagagcttttctgcacatacctagaaggataagacaaggctttgaaagggcgctgctataaaatgggaaacaaatggtcaaaaagtgtatctgaatggcctgaccttttgggacagcggtg

SEQ ID NO: 414572 - DNA, 140 bp, Artificial Sequence
  Synthetic
caccgctgtcccaaaaggtcaggccattcagatacactttttgaccatttgtttcccattttatagcagcgccctttcaaagccttgtcttatccttctaggtatgtgcagaaaagctctcatatcagcagccagggcct

SEQ ID NO: 414573 - DNA, 140 bp, Artificial Sequence
  Synthetic
atacgccatgctgggtctcctagatagagaaatgagaaattgctctttcaataccaccacagaactaagagataagaaacagaaaacatatgcactcttttatagatctgatatagtgcccgtacttgggagtcggccat

SEQ ID NO: 414574 - DNA, 140 bp, Artificial Sequence
  Synthetic
atggccgactcccaagtacgggcactatatcagatctataaaagagtgcatatgttttctgtttcttatctcttagttctgtggtggtattgaaagagcaatttctcatttctctatctaggagacccagcatggcgtat

SEQ ID NO: 414575 - DNA, 140 bp, Artificial Sequence
  Synthetic
atacgccatgctgggtctccttcagaggtgggctttccagtcagaccacaggtacctttaagaccaatgacctataaggctgcttttgatctcagcttctttttaaaagaaaaggggggacgtacttgggagtcggccat

SEQ ID NO: 414576 - DNA, 140 bp, Artificial Sequence
  Synthetic
atggccgactcccaagtacgtccccccttttcttttaaaaagaagctgagatcaaaagcagccttataggtcattggtcttaaaggtacctgtggtctgactggaaagcccacctctgaaggagacccagcatggcgtat

SEQ ID NO: 414577 - DNA, 140 bp, Artificial Sequence
  Synthetic
  misc_feature (38)..(38): n is a, c, g, or t
  misc_feature (67)..(67): n is a, c, g, or t
  misc_feature (105)..(105): n is a, c, g, or t
  misc_feature (115)..(115): n is a, c, g, or t
atacgccatgctgggtctccaggtgacttttgatccanttcccatacactattgtgctccacctggntttgcaattctaaaatgtaaggatgaagagttcaatgnaacagggccntgtagcgtacttgggagtcggccat

SEQ ID NO: 414578 - DNA, 140 bp, Artificial Sequence
  Synthetic
  misc_feature (26)..(26): n is a, c, g, or t
  misc_feature (36)..(36): n is a, c, g, or t
  misc_feature (74)..(74): n is a, c, g, or t
  misc_feature (103)..(103): n is a, c, g, or t
atggccgactcccaagtacgctacanggccctgttncattgaactcttcatccttacattttagaattgcaaanccaggtggagcacaatagtgtatgggaantggatcaaaagtcacctggagacccagcatggcgtat

SEQ ID NO: 414579 - DNA, 140 bp, Artificial Sequence
  Synthetic
aggccctggctgctgatatggtagctaactggacagatagggttatagaaatagtacaaagaacttgtagggcttttctcaacatacctagaaggataagacaaggctttgaaagggcgcgaccttttgggacagcggtg

SEQ ID NO: 414580 - DNA, 140 bp, Artificial Sequence
  Synthetic
caccgctgtcccaaaaggtcgcgccctttcaaagccttgtcttatccttctaggtatgttgagaaaagccctacaagttctttgtactatttctataaccctatctgtccagttagctaccatatcagcagccagggcct

SEQ ID NO: 414581 - DNA, 140 bp, Artificial Sequence
  Synthetic
atacgccatgctgggtctccaaaacgataaactttacaacaccctcaggaggggacctagaagttataacacatatgtttaattgtagaggagaatttttctactgcaatacaagcggaccgtacttgggagtcggccat

SEQ ID NO: 414582 - DNA, 140 bp, Artificial Sequence
  Synthetic
atggccgactcccaagtacggtccgcttgtattgcagtagaaaaattctcctctacaattaaacatatgtgttataacttctaggtcccctcctgagggtgttgtaaagtttatcgttttggagacccagcatggcgtat

SEQ ID NO: 414583 - DNA, 140 bp, Artificial Sequence
  Synthetic
atacgccatgctgggtctccgcagaagcaggaaacttaacaaactgcactttcaatataaccacagaaataagagataagaggaaggcagaatatgctcttttctatagacttgacgtggcgtacttgggagtcggccat

SEQ ID NO: 414584 - DNA, 140 bp, Artificial Sequence
  Synthetic
atggccgactcccaagtacgccacgtcaagtctatagaaaagagcatattctgccttcctcttatctcttatttctgtggttatattgaaagtgcagtttgttaagtttcctgcttctgcggagacccagcatggcgtat

SEQ ID NO: 414585 - DNA, 140 bp, Artificial Sequence
  Synthetic
aggccctggctgctgatatgtactgatagtatggcaagtagacagacagaaagtgaaagtgtggaacagcctggtgaaataccataagtacaggtctaggaagaccaaggactggtattagaccttttgggacagcggtg

SEQ ID NO: 414586 - DNA, 140 bp, Artificial Sequence
  Synthetic
caccgctgtcccaaaaggtctaataccagtccttggtcttcctagacctgtacttatggtatttcaccaggctgttccacactttcactttctgtctgtctacttgccatactatcagtacatatcagcagccagggcct

SEQ ID NO: 414587 - DNA, 140 bp, Artificial Sequence
  Synthetic
atacgccatgctgggtctcctacatctgcactattttacctgttttacagaatcagcaatcaggaaagccatcctagggcaaagagtactgaccaagtgtgaataccctgcaggacatagcgtacttgggagtcggccat

SEQ ID NO: 414588 - DNA, 140 bp, Artificial Sequence
  Synthetic
atggccgactcccaagtacgctatgtcctgcagggtattcacacttggtcagtactctttgccctaggatggctttcctgattgctgattctgtaaaacaggtaaaatagtgcagatgtaggagacccagcatggcgtat

SEQ ID NO: 414589 - DNA, 140 bp, Artificial Sequence
  Synthetic
aggccctggctgctgatatggaaaaaattcggttaaggccggggggaaagaaaaaatatagactgaaacatttagtatgggcaagcagggagctagaacgatttgcacttaatcctggccgaccttttgggacagcggtg

SEQ ID NO: 414590 - DNA, 140 bp, Artificial Sequence
  Synthetic
caccgctgtcccaaaaggtcggccaggattaagtgcaaatcgttctagctccctgcttgcccatactaaatgtttcagtctatattttttctttccccccggccttaaccgaattttttccatatcagcagccagggcct

SEQ ID NO: 414591 - DNA, 140 bp, Artificial Sequence
  Synthetic
atacgccatgctgggtctccaagaacaagaagttaggggtcatcttgtgcatagttttgggtttgataatcccatgtttgagctctaatctgtatgcaacagtctatgctggggtacctgcgtacttgggagtcggccat

SEQ ID NO: 414592 - DNA, 140 bp, Artificial Sequence
  Synthetic
atggccgactcccaagtacgcaggtaccccagcatagactgttgcatacagattagagctcaaacatgggattatcaaacccaaaactatgcacaagatgacccctaacttcttgttcttggagacccagcatggcgtat

SEQ ID NO: 414593 - DNA, 140 bp, Artificial Sequence
  Synthetic
aggccctggctgctgatatggttctcaaagacaaaaaggagaaaagacaggctttattctatgtatcagacttggctagagtggatgatagcgaaacaagtggcagtaacacaacaagtggaccttttgggacagcggtg

SEQ ID NO: 414594 - DNA, 140 bp, Artificial Sequence
  Synthetic
caccgctgtcccaaaaggtccacttgttgtgttactgccacttgtttcgctatcatccactctagccaagtctgatacatagaataaagcctgtcttttctcctttttgtctttgagaaccatatcagcagccagggcct

SEQ ID NO: 414595 - DNA, 140 bp, Artificial Sequence
  Synthetic
atacgccatgctgggtctcccaaacgatagctcaataaaccctataagcacagagaaccctaacagcatagagaaccctatgaaaaattgtgagtttaatgtaactacagttctcaaagacgtacttgggagtcggccat

SEQ ID NO: 414596 - DNA, 140 bp, Artificial Sequence
  Synthetic
atggccgactcccaagtacgtctttgagaactgtagttacattaaactcacaatttttcatagggttctctatgctgttagggttctctgtgcttatagggtttattgagctatcgtttgggagacccagcatggcgtat

SEQ ID NO: 414597 - DNA, 140 bp, Artificial Sequence
  Synthetic
atacgccatgctgggtctccactttcggaaggaaagataagaataatagcaaaaaatatttcagctactggcaacaatatcatagtgaccttaaatactactataaacatgacctgccagcgtacttgggagtcggccat

SEQ ID NO: 414598 - DNA, 140 bp, Artificial Sequence
  Synthetic
atggccgactcccaagtacgctggcaggtcatgtttatagtagtatttaaggtcactatgatattgttgccagtagctgaaatattttttgctattattcttatctttccttccgaaagtggagacccagcatggcgtat

SEQ ID NO: 414599 - DNA, 140 bp, Artificial Sequence
  Synthetic
atacgccatgctgggtctccgtatagcatggaactaaagaaagacacaaacacatccaaatcaagaatagcttattgtgagtataataccaagaagtgggaagaggccttaagacagacacgtacttgggagtcggccat

SEQ ID NO: 414600 - DNA, 140 bp, Artificial Sequence
  Synthetic
atggccgactcccaagtacgtgtctgtcttaaggcctcttcccacttcttggtattatactcacaataagctattcttgatttggatgtgtttgtgtctttctttagttccatgctatacggagacccagcatggcgtat

SEQ ID NO: 414601 - DNA, 140 bp, Artificial Sequence
  Synthetic
atacgccatgctgggtctccattcaattacaatactggaggagatccagagataacccagttgcattttaattgtcatggagagttcttttactgcaacacatctcagatgtttaattatcgtacttgggagtcggccat

SEQ ID NO: 414602 - DNA, 140 bp, Artificial Sequence
  Synthetic
atggccgactcccaagtacgataattaaacatctgagatgtgttgcagtaaaagaactctccatgacaattaaaatgcaactgggttatctctggatctcctccagtattgtaattgaatggagacccagcatggcgtat

SEQ ID NO: 414603 - DNA, 140 bp, Artificial Sequence
  Synthetic
atacgccatgctgggtctccttatacctttagccaaaataccactagcactaagataccttgcagattgaggcaggtagtaaggtcatggatgaggggaggatcgggaccctatgcacctcgtacttgggagtcggccat

SEQ ID NO: 414604 - DNA, 140 bp, Artificial Sequence
  Synthetic
atggccgactcccaagtacgaggtgcatagggtcccgatcctcccctcatccatgaccttactacctgcctcaatctgcaaggtatcttagtgctagtggtattttggctaaaggtataaggagacccagcatggcgtat

SEQ ID NO: 414605 - DNA, 140 bp, Artificial Sequence
  Synthetic
aggccctggctgctgatatgggcaggtagtaaggtcatggatgaggggaggatcgggaccctatgcacctcccatccgaggtaacttaacatgtggatcaaacataactggaatgattctgaccttttgggacagcggtg

SEQ ID NO: 414606 - DNA, 140 bp, Artificial Sequence
  Synthetic
caccgctgtcccaaaaggtcagaatcattccagttatgtttgatccacatgttaagttacctcggatgggaggtgcatagggtcccgatcctcccctcatccatgaccttactacctgcccatatcagcagccagggcct

SEQ ID NO: 414607 - DNA, 140 bp, Artificial Sequence
  Synthetic
aggccctggctgctgatatgcaacagggggaaatatgaaagatatatggagaactgaattgctcagatacaaagtagtaaggataaaaccttttagtgtggcacctacaaaaattacaaggaccttttgggacagcggtg

SEQ ID NO: 414608 - DNA, 140 bp, Artificial Sequence
  Synthetic
caccgctgtcccaaaaggtccttgtaatttttgtaggtgccacactaaaaggttttatccttactactttgtatctgagcaattcagttctccatatatctttcatatttccccctgttgcatatcagcagccagggcct

SEQ ID NO: 414609 - DNA, 140 bp, Artificial Sequence
  Synthetic
aggccctggctgctgatatgttgcttcataacaaaaggcttaggcatatcctatggcaggaagaagcggagacagcgacgaagagctcctcaggacaataaggatcatcaagtttctctagaccttttgggacagcggtg

SEQ ID NO: 414610 - DNA, 140 bp, Artificial Sequence
  Synthetic
caccgctgtcccaaaaggtctagagaaacttgatgatccttattgtcctgaggagctcttcgtcgctgtctccgcttcttcctgccataggatatgcctaagccttttgttatgaagcaacatatcagcagccagggcct

SEQ ID NO: 414611 - DNA, 140 bp, Artificial Sequence
  Synthetic
aggccctggctgctgatatgcagaatttgtgcagctgtaatacaatactggcttcaagaattgcagaatagtgctacaaatctagtagatactattgcagtagcagtagctaattggactgaccttttgggacagcggtg

SEQ ID NO: 414612 - DNA, 140 bp, Artificial Sequence
  Synthetic
caccgctgtcccaaaaggtcagtccaattagctactgctactgcaatagtatctactagatttgtagcactattctgcaattcttgaagccagtattgtattacagctgcacaaattctgcatatcagcagccagggcct

SEQ ID NO: 414613 - DNA, 140 bp, Artificial Sequence
  Synthetic
atacgccatgctgggtctccaagacccaacaataatataagaaagagtgtaagaataggaccaggacaagcattctatgcaacaggagacataataggagacataagagaggcatattgtcgtacttgggagtcggccat

SEQ ID NO: 414614 - DNA, 140 bp, Artificial Sequence
  Synthetic
atggccgactcccaagtacgacaatatgcctctcttatgtctcctattatgtctcctgttgcatagaatgcttgtcctggtcctattcttacactctttcttatattattgttgggtcttggagacccagcatggcgtat

SEQ ID NO: 414615 - DNA, 140 bp, Artificial Sequence
  Synthetic
aggccctggctgctgatatgaatgagaagggcttcccctaaacctgaagattgtgcacctggagtaggagaagtctccagggaattagcatctagaggaggaataccaagttcctatactgaccttttgggacagcggtg

SEQ ID NO: 414616 - DNA, 140 bp, Artificial Sequence
  Synthetic
caccgctgtcccaaaaggtcagtataggaacttggtattcctcctctagatgctaattccctggagacttctcctactccaggtgcacaatcttcaggtttaggggaagcccttctcattcatatcagcagccagggcct

SEQ ID NO: 414617 - DNA, 140 bp, Artificial Sequence
  Synthetic
atacgccatgctgggtctccctgtgttagtttaaagtgcactgatttgaagaatgatactaataccaatagtagtagcgggagaatgataatggagaaaggagagataaaaaactgctctcgtacttgggagtcggccat

SEQ ID NO: 414618 - DNA, 140 bp, Artificial Sequence
  Synthetic
atggccgactcccaagtacgagagcagttttttatctctcctttctccattatcattctcccgctactactattggtattagtatcattcttcaaatcagtgcactttaaactaacacagggagacccagcatggcgtat

SEQ ID NO: 414619 - DNA, 140 bp, Artificial Sequence
  Synthetic
aggccctggctgctgatatggacaatatatctataacacttatggggatacttgggaaggagttgaagccataataagaatactgcaacaactactgtttatccatttcagaattgggtggaccttttgggacagcggtg

SEQ ID NO: 414620 - DNA, 140 bp, Artificial Sequence
  Synthetic
caccgctgtcccaaaaggtccacccaattctgaaatggataaacagtagttgttgcagtattcttattatggcttcaactccttcccaagtatccccataagtgttatagatatattgtccatatcagcagccagggcct

SEQ ID NO: 414621 - DNA, 140 bp, Artificial Sequence
  Synthetic
atacgccatgctgggtctccaaacaccgacgaggaactccttcaggtggcaaggatcatcaaaatcctgtaccaaagcagtgagtagtgacaattaagtatatgtaatgcactcgctagacgtacttgggagtcggccat

SEQ ID NO: 414622 - DNA, 140 bp, Artificial Sequence
  Synthetic
atggccgactcccaagtacgtctagcgagtgcattacatatacttaattgtcactactcactgctttggtacaggattttgatgatccttgccacctgaaggagttcctcgtcggtgtttggagacccagcatggcgtat

SEQ ID NO: 414623 - DNA, 140 bp, Artificial Sequence
  Synthetic
atacgccatgctgggtctccgcagaccaactgatccatatatattattttgattgtttttcagaatctgccataaggaaagccatattaggacataaaattagccctaggtgtaactatccgtacttgggagtcggccat

SEQ ID NO: 414624 - DNA, 140 bp, Artificial Sequence
  Synthetic
atggccgactcccaagtacggatagttacacctagggctaattttatgtcctaatatggctttccttatggcagattctgaaaaacaatcaaaataatatatatggatcagttggtctgcggagacccagcatggcgtat

SEQ ID NO: 414625 - DNA, 140 bp, Artificial Sequence
  Synthetic
atacgccatgctgggtctccaaataattgcactaaagaaggcaataacactgtggacaactgtgcagacataaaaaactgctctttcaatataaccacagagatacgggataaaaagaagcgtacttgggagtcggccat

SEQ ID NO: 414626 - DNA, 140 bp, Artificial Sequence
  Synthetic
atggccgactcccaagtacgcttctttttatcccgtatctctgtggttatattgaaagagcagttttttatgtctgcacagttgtccacagtgttattgccttctttagtgcaattatttggagacccagcatggcgtat

SEQ ID NO: 414627 - DNA, 140 bp, Artificial Sequence
  Synthetic
atacgccatgctgggtctccacaagaacataacagagataacatttagcccacccacaggaggggacctagaaattacaacacatagttttaattgtagaggagaatttttctattgtaacgtacttgggagtcggccat

SEQ ID NO: 414628 - DNA, 140 bp, Artificial Sequence
  Synthetic
atggccgactcccaagtacgttacaatagaaaaattctcctctacaattaaaactatgtgttgtaatttctaggtcccctcctgtgggtgggctaaatgttatctctgttatgttcttgtggagacccagcatggcgtat

SEQ ID NO: 414629 - DNA, 140 bp, Artificial Sequence
  Synthetic
atacgccatgctgggtctcctggatacaatgggagagggaaattaacaattacacacaacaaatatacaacctaattgaagaatcgcagaaccagcaggaaaagaatgaacaagacttatcgtacttgggagtcggccat

SEQ ID NO: 414630 - DNA, 140 bp, Artificial Sequence
  Synthetic
atggccgactcccaagtacgataagtcttgttcattcttttcctgctggttctgcgattcttcaattaggttgtatatttgttgtgtgtaattgttaatttccctctcccattgtatccaggagacccagcatggcgtat

SEQ ID NO: 414631 - DNA, 140 bp, Artificial Sequence
  Synthetic
atacgccatgctgggtctcctgctgcttataaatataattttatggatgtttattcttagaaaatatttagaacaaaagagacaagacagaagggaaagagaaatacttgaaaggttaagcgtacttgggagtcggccat

SEQ ID NO: 414632 - DNA, 140 bp, Artificial Sequence
  Synthetic
atggccgactcccaagtacgcttaacctttcaagtatttctctttcccttctgtcttgtctcttttgttctaaatattttctaagaataaacatccataaaattatatttataagcagcaggagacccagcatggcgtat

SEQ ID NO: 414633 - DNA, 140 bp, Artificial Sequence
  Synthetic
aggccctggctgctgatatggaacaaaagagacaagacagaagggaaagagaaatacttgaaaggttaagaagaataagagaaattaaagatgatagtgactatgaaagcaatgaagaaggaccttttgggacagcggtg

SEQ ID NO: 414634 - DNA, 140 bp, Artificial Sequence
  Synthetic
caccgctgtcccaaaaggtccttcttcattgctttcatagtcactatcatctttaatttctcttattcttcttaacctttcaagtatttctctttcccttctgtcttgtctcttttgttccatatcagcagccagggcct

SEQ ID NO: 414635 - DNA, 140 bp, Artificial Sequence
  Synthetic
aggccctggctgctgatatgtaaatgagactggaaacatgaaggaagaaatgaaaaactgctctttcaatgcaaccacagaaataagagataagaaaaataaagtgtatgcacttttttagaccttttgggacagcggtg

SEQ ID NO: 414636 - DNA, 140 bp, Artificial Sequence
  Synthetic
caccgctgtcccaaaaggtctaaaaaagtgcatacactttatttttcttatctcttatttctgtggttgcattgaaagagcagtttttcatttcttccttcatgtttccagtctcatttacatatcagcagccagggcct

SEQ ID NO: 414637 - DNA, 140 bp, Artificial Sequence
  Synthetic
atacgccatgctgggtctccgggacagcttcgagaaccctgtgaaagaatgtgagtttaatgtaaccacggttctcaaagacaaaaaggagaaaagacaggctttattctatgtatcagacgtacttgggagtcggccat

SEQ ID NO: 414638 - DNA, 140 bp, Artificial Sequence
  Synthetic
atggccgactcccaagtacgtctgatacatagaataaagcctgtcttttctcctttttgtctttgagaaccgtggttacattaaactcacattctttcacagggttctcgaagctgtcccggagacccagcatggcgtat

SEQ ID NO: 414639 - DNA, 140 bp, Artificial Sequence
  Synthetic
atacgccatgctgggtctccctactaatctaaataatagtagtttagaggaaggagaaataaaaaactgctctttcaaggtcaccacaaacataagagataagttacagaaaacatatgccgtacttgggagtcggccat

SEQ ID NO: 414640 - DNA, 140 bp, Artificial Sequence
  Synthetic
atggccgactcccaagtacggcatatgttttctgtaacttatctcttatgtttgtggtgaccttgaaagagcagttttttatttctccttcctctaaactactattatttagattagtagggagacccagcatggcgtat

SEQ ID NO: 414641 - DNA, 140 bp, Artificial Sequence
  Synthetic
aggccctggctgctgatatgatccgtgagattagtgaacggattcttagctcttgtctgggacgacctgaggaacctgtgcctcttcagctaccgccacttgagagacttcatattaattgaccttttgggacagcggtg

SEQ ID NO: 414642 - DNA, 140 bp, Artificial Sequence
  Synthetic
caccgctgtcccaaaaggtcaattaatatgaagtctctcaagtggcggtagctgaagaggcacaggttcctcaggtcgtcccagacaagagctaagaatccgttcactaatctcacggatcatatcagcagccagggcct

SEQ ID NO: 414643 - DNA, 140 bp, Artificial Sequence
  Synthetic
atacgccatgctgggtctccgatattcaattacagtagtactggaggagatccagagataacccagctgcattttaattgtcatggagagttcttttactgcaacacatctcagatgtttcgtacttgggagtcggccat

SEQ ID NO: 414644 - DNA, 140 bp, Artificial Sequence
  Synthetic
atggccgactcccaagtacgaaacatctgagatgtgttgcagtaaaagaactctccatgacaattaaaatgcagctgggttatctctggatctcctccagtactactgtaattgaatatcggagacccagcatggcgtat

SEQ ID NO: 414645 - DNA, 140 bp, Artificial Sequence
  Synthetic
aggccctggctgctgatatggcacctcccatccgaggtaacttaacatgtggatcaaaaataactggaatgattctagaaatggatgagccatggaaagggaaccagaacagcacagacggaccttttgggacagcggtg

SEQ ID NO: 414646 - DNA, 140 bp, Artificial Sequence
  Synthetic
caccgctgtcccaaaaggtccgtctgtgctgttctggttccctttccatggctcatccatttctagaatcattccagttatttttgatccacatgttaagttacctcggatgggaggtgccatatcagcagccagggcct

SEQ ID NO: 414647 - DNA, 140 bp, Artificial Sequence
  Synthetic
atacgccatgctgggtctcccaagggcagaaggagaaggacttaatctccctcaaatcactctttggcagcgacccctagtcacagtaagaatagggggacagctaatagaagccctattcgtacttgggagtcggccat

SEQ ID NO: 414648 - DNA, 140 bp, Artificial Sequence
  Synthetic
atggccgactcccaagtacgaatagggcttctattagctgtccccctattcttactgtgactaggggtcgctgccaaagagtgatttgagggagattaagtccttctccttctgcccttgggagacccagcatggcgtat

SEQ ID NO: 414649 - DNA, 140 bp, Artificial Sequence
  Synthetic
atacgccatgctgggtctccggttggcgcccgaacagggacttgaagagtgagagtcttctgaaactcggctgagtgagggcagtaagggcggcaggaacaaaccacgacggagtgctcccgtacttgggagtcggccat

SEQ ID NO: 414650 - DNA, 140 bp, Artificial Sequence
  Synthetic
atggccgactcccaagtacgggagcactccgtcgtggtttgttcctgccgcccttactgccctcactcagccgagtttcagaagactctcactcttcaagtccctgttcgggcgccaaccggagacccagcatggcgtat

SEQ ID NO: 414651 - DNA, 140 bp, Artificial Sequence
  Synthetic
aggccctggctgctgatatgctgagtgagggcagtaagggcggcaggaacaaaccacgacggagtgctcctgtaaaggcgcaggctggtaccaagcagcgtgaggagcgggagtgagagggaccttttgggacagcggtg

SEQ ID NO: 414652 - DNA, 140 bp, Artificial Sequence
  Synthetic
caccgctgtcccaaaaggtccctctcactcccgctcctcacgctgcttggtaccagcctgcgcctttacaggagcactccgtcgtggtttgttcctgccgcccttactgccctcactcagcatatcagcagccagggcct

SEQ ID NO: 414653 - DNA, 140 bp, Artificial Sequence
  Synthetic
atacgccatgctgggtctcctgtaaaggcgcaggctggtaccaagcagcgtgaggagcgggagtgagaggtctccggttgcaggtaagtgcaacaaaaaatagaaccaaagggttgtctgcgtacttgggagtcggccat

SEQ ID NO: 414654 - DNA, 140 bp, Artificial Sequence
  Synthetic
atggccgactcccaagtacgcagacaaccctttggttctattttttgttgcacttacctgcaaccggagacctctcactcccgctcctcacgctgcttggtaccagcctgcgcctttacaggagacccagcatggcgtat

SEQ ID NO: 414655 - DNA, 140 bp, Artificial Sequence
  Synthetic
atacgccatgctgggtctcccgtcttgtcagggaagaaagtagatgaattagaaaaagttaggttacggcccaacggaaagaaaaaatacatgttaaaacatgttgtgtgggcagcgaaccgtacttgggagtcggccat

SEQ ID NO: 414656 - DNA, 140 bp, Artificial Sequence
  Synthetic
atggccgactcccaagtacggttcgctgcccacacaacatgttttaacatgtattttttctttccgttgggccgtaacctaactttttctaattcatctactttcttccctgacaagacgggagacccagcatggcgtat

SEQ ID NO: 414657 - DNA, 140 bp, Artificial Sequence
  Synthetic
aggccctggctgctgatatgccaacggaaagaaaaaatacatgttaaaacatgttgtgtgggcagcgaacgaattggacagatttggattagcagaaagcctgttggaggccaaagaagggaccttttgggacagcggtg

SEQ ID NO: 414658 - DNA, 140 bp, Artificial Sequence
  Synthetic
caccgctgtcccaaaaggtcccttctttggcctccaacaggctttctgctaatccaaatctgtccaattcgttcgctgcccacacaacatgttttaacatgtattttttctttccgttggcatatcagcagccagggcct

SEQ ID NO: 414659 - DNA, 140 bp, Artificial Sequence
  Synthetic
atacgccatgctgggtctccaaaatttaaagagcctttataatactgtctgcgtcatttggtgtttgcacgcagaagagaaagtgaaacatactgaggaagcaaagcagatagtacagagcgtacttgggagtcggccat

SEQ ID NO: 414660 - DNA, 140 bp, Artificial Sequence
  Synthetic
atggccgactcccaagtacgctctgtactatctgctttgcttcctcagtatgtttcactttctcttctgcgtgcaaacaccaaatgacgcagacagtattataaaggctctttaaattttggagacccagcatggcgtat

SEQ ID NO: 414661 - DNA, 140 bp, Artificial Sequence
  Synthetic
aggccctggctgctgatatggcagaagagaaagtgaaacatactgaggaagcaaagcagatagtacagagacatctagcggtggaaactgaaactgcagaaaaaatgccagccacaagtagaccttttgggacagcggtg

SEQ ID NO: 414662 - DNA, 140 bp, Artificial Sequence
  Synthetic
caccgctgtcccaaaaggtctacttgtggctggcattttttctgcagtttcagtttccaccgctagatgtctctgtactatctgctttgcttcctcagtatgtttcactttctcttctgccatatcagcagccagggcct

SEQ ID NO: 414663 - DNA, 140 bp, Artificial Sequence
  Synthetic
atacgccatgctgggtctccataggtggcaattatgcccacctacctctaagtcctagaacactcaatgcctgggtaaaactggtagaggagaaaaaatttggagcagaagtagtgccagcgtacttgggagtcggccat

SEQ ID NO: 414664 - DNA, 140 bp, Artificial Sequence
  Synthetic
atggccgactcccaagtacgctggcactacttctgctccaaattttttctcctctaccagttttacccaggcattgagtgttctaggacttagaggtaggtgggcataattgccacctatggagacccagcatggcgtat

SEQ ID NO: 414665 - DNA, 140 bp, Artificial Sequence
  Synthetic
aggccctggctgctgatatgctgggtaaaactggtagaggagaaaaaatttggagcagaagtagtgccaggatttcaggcactctcagagggctgcacgccctatgatattaatcaaatggaccttttgggacagcggtg

SEQ ID NO: 414666 - DNA, 140 bp, Artificial Sequence
  Synthetic
caccgctgtcccaaaaggtccatttgattaatatcatagggcgtgcagccctctgagagtgcctgaaatcctggcactacttctgctccaaattttttctcctctaccagttttacccagcatatcagcagccagggcct

SEQ ID NO: 414667 - DNA, 140 bp, Artificial Sequence
  Synthetic
atacgccatgctgggtctccaattaatgatgaagcagcagattgggacacacagcacccaaaccaaggcccaccaccagcagggcaacttagagagccaagaggttctgatattgcaggacgtacttgggagtcggccat

SEQ ID NO: 414668 - DNA, 140 bp, Artificial Sequence
  Synthetic
atggccgactcccaagtacgtcctgcaatatcagaacctcttggctctctaagttgccctgctggtggtgggccttggtttgggtgctgtgtgtcccaatctgctgcttcatcattaattggagacccagcatggcgtat

SEQ ID NO: 414669 - DNA, 140 bp, Artificial Sequence
  Synthetic
aggccctggctgctgatatgcaccaccagcagggcaacttagagagccaagaggttctgatattgcaggaacaactagcacagtggaagagcagatacagtggatgtacaggccgcaaaagaccttttgggacagcggtg

SEQ ID NO: 414670 - DNA, 140 bp, Artificial Sequence
  Synthetic
caccgctgtcccaaaaggtcttttgcggcctgtacatccactgtatctgctcttccactgtgctagttgttcctgcaatatcagaacctcttggctctctaagttgccctgctggtggtgcatatcagcagccagggcct

SEQ ID NO: 414671 - DNA, 140 bp, Artificial Sequence
  Synthetic
atacgccatgctgggtctccaaaaatgtgttagaatgtacaatccaactaatatcttagatataaagcaagggccaaaggagccatttcaaagttatgtagatagattctacaaaagtttcgtacttgggagtcggccat

SEQ ID NO: 414672 - DNA, 140 bp, Artificial Sequence
  Synthetic
atggccgactcccaagtacgaaacttttgtagaatctatctacataactttgaaatggctcctttggcccttgctttatatctaagatattagttggattgtacattctaacacatttttggagacccagcatggcgtat

SEQ ID NO: 414673 - DNA, 140 bp, Artificial Sequence
  Synthetic
aggccctggctgctgatatggggccaaaggagccatttcaaagttatgtagatagattctacaaaagtttgagagcagaacaaacagatccagcagtgaaaaattggatgactcagacgcgaccttttgggacagcggtg

SEQ ID NO: 414674 - DNA, 140 bp, Artificial Sequence
  Synthetic
caccgctgtcccaaaaggtcgcgtctgagtcatccaatttttcactgctggatctgtttgttctgctctcaaacttttgtagaatctatctacataactttgaaatggctcctttggccccatatcagcagccagggcct

SEQ ID NO: 414675 - DNA, 140 bp, Artificial Sequence
  Synthetic
atacgccatgctgggtctccggtatgaatcctaccttagaagagatgctaacagcctgtcaaggaataggaggaccaggacaaaaagctaggctgatggcagaagccttaaaagaggcctcgtacttgggagtcggccat

SEQ ID NO: 414676 - DNA, 140 bp, Artificial Sequence
  Synthetic
atggccgactcccaagtacgaggcctcttttaaggcttctgccatcagcctagctttttgtcctggtcctcctattccttgacaggctgttagcatctcttctaaggtaggattcataccggagacccagcatggcgtat

SEQ ID NO: 414677 - DNA, 140 bp, Artificial Sequence
  Synthetic
aggccctggctgctgatatgaggaccaggacaaaaagctaggctgatggcagaagccttaaaagaggccttacaacctatgcctataccctttgcagcagtccaacagagaggcggcccagaccttttgggacagcggtg

SEQ ID NO: 414678 - DNA, 140 bp, Artificial Sequence
  Synthetic
caccgctgtcccaaaaggtctgggccgcctctctgttggactgctgcaaagggtataggcataggttgtaaggcctcttttaaggcttctgccatcagcctagctttttgtcctggtcctcatatcagcagccagggcct

SEQ ID NO: 414679 - DNA, 140 bp, Artificial Sequence
  Synthetic
atacgccatgctgggtctccgcagtgtaaagcccctagaagacagggatgctggaaatgtgaaaagccaggacacaacatggctagctgcccagaaaccaaggtgggttttttagggcttcgtacttgggagtcggccat

SEQ ID NO: 414680 - DNA, 140 bp, Artificial Sequence
  Synthetic
atggccgactcccaagtacgaagccctaaaaaacccaccttggtttctgggcagctagccatgttgtgtcctggcttttcacatttccagcatccctgtcttctaggggctttacactgcggagacccagcatggcgtat

SEQ ID NO: 414681 - DNA, 140 bp, Artificial Sequence
  Synthetic
aggccctggctgctgatatggacacaacatggctagctgcccagaaaccaaggtgggttttttagggcttggcccttgggaaaaaaagcctcgcaacttccccatggcccaagtcccgcagaccttttgggacagcggtg

SEQ ID NO: 414682 - DNA, 140 bp, Artificial Sequence
  Synthetic
caccgctgtcccaaaaggtctgcgggacttgggccatggggaagttgcgaggctttttttcccaagggccaagccctaaaaaacccaccttggtttctgggcagctagccatgttgtgtccatatcagcagccagggcct

SEQ ID NO: 414683 - DNA, 140 bp, Artificial Sequence
  Synthetic
atacgccatgctgggtctccccccgacagcccctccagcggacccagcagtggatctgctaaagagctacatgcaacagggcaagaaacaaaaggagaacagagagagaccatacaaggacgtacttgggagtcggccat

SEQ ID NO: 414684 - DNA, 140 bp, Artificial Sequence
  Synthetic
atggccgactcccaagtacgtccttgtatggtctctctctgttctccttttgtttcttgccctgttgcatgtagctctttagcagatccactgctgggtccgctggaggggctgtcggggggagacccagcatggcgtat

SEQ ID NO: 414685 - DNA, 140 bp, Artificial Sequence
  Synthetic
aggccctggctgctgatatgatgcaacagggcaagaaacaaaaggagaacagagagagaccatacaaggaggtgacggaggatttgctgcacctcaattctctctttggaaacgaccaatgaccttttgggacagcggtg

SEQ ID NO: 414686 - DNA, 140 bp, Artificial Sequence
  Synthetic
caccgctgtcccaaaaggtcattggtcgtttccaaagagagaattgaggtgcagcaaatcctccgtcacctccttgtatggtctctctctgttctccttttgtttcttgccctgttgcatcatatcagcagccagggcct

SEQ ID NO: 414687 - DNA, 140 bp, Artificial Sequence
  Synthetic
atacgccatgctgggtctccgggctgatgattcaatagtagcagggattaaattagaaccatattatactccaaaaactgtaggggaaatagaagggttcattaatacaaaaaaatttcacgtacttgggagtcggccat

SEQ ID NO: 414688 - DNA, 140 bp, Artificial Sequence
  Synthetic
atggccgactcccaagtacgtgaaatttttttgtattaatgaacccttctatttcccctacagtttttggagtataatatggttctaatttaatccctgctactattgaatcatcagcccggagacccagcatggcgtat

SEQ ID NO: 414689 - DNA, 140 bp, Artificial Sequence
  Synthetic
aggccctggctgctgatatgccaaaaactgtaggggaaatagaagggttcattaatacaaaaaaatttcacaatgtaaacataaaagtattgggcaaaacaattagaggtaccataatgagaccttttgggacagcggtg

SEQ ID NO: 414690 - DNA, 140 bp, Artificial Sequence
  Synthetic
caccgctgtcccaaaaggtctcattatggtacctctaattgttttgcccaatacttttatgtttacattgtgaaatttttttgtattaatgaacccttctatttcccctacagtttttggcatatcagcagccagggcct

SEQ ID NO: 414691 - DNA, 140 bp, Artificial Sequence
  Synthetic
atacgccatgctgggtctccggcatgtctctaaactttccaataggaaaagaagcactagtcattgggggactaaaaccaggcaaggatggaccaaaattaagacagtggcctttatctacgtacttgggagtcggccat

SEQ ID NO: 414692 - DNA, 140 bp, Artificial Sequence
  Synthetic
atggccgactcccaagtacgtagataaaggccactgtcttaattttggtccatccttgcctggttttagtcccccaatgactagtgcttcttttcctattggaaagtttagagacatgccggagacccagcatggcgtat

SEQ ID NO: 414693 - DNA, 140 bp, Artificial Sequence
  Synthetic
aggccctggctgctgatatgactaaaaccaggcaaggatggaccaaaattaagacagtggcctttatctaaggaaaaattagaagcattaaaagagatatgtgagaaaatggaaaaggaggaccttttgggacagcggtg

SEQ ID NO: 414694 - DNA, 140 bp, Artificial Sequence
  Synthetic
caccgctgtcccaaaaggtcctccttttccattttctcacatatctcttttaatgcttctaatttttccttagataaaggccactgtcttaattttggtccatccttgcctggttttagtcatatcagcagccagggcct

SEQ ID NO: 414695 - DNA, 140 bp, Artificial Sequence
  Synthetic
atacgccatgctgggtctcctgccataaagaagaaggacaaaaacaaatggagaatgttaatagactttagagagttaaacagagtaactcaagattttagtgaagtccagttaggtatacgtacttgggagtcggccat

SEQ ID NO: 414696 - DNA, 140 bp, Artificial Sequence
  Synthetic
atggccgactcccaagtacgtatacctaactggacttcactaaaatcttgagttactctgtttaactctctaaagtctattaacattctccatttgtttttgtccttcttctttatggcaggagacccagcatggcgtat

SEQ ID NO: 414697 - DNA, 140 bp, Artificial Sequence
  Synthetic
aggccctggctgctgatatggagagttaaacagagtaactcaagattttagtgaagtccagttaggtataccccacccagcaggactagctgagaaaaagaggataacagttctagatgtgaccttttgggacagcggtg

SEQ ID NO: 414698 - DNA, 140 bp, Artificial Sequence
  Synthetic
caccgctgtcccaaaaggtcacatctagaactgttatcctctttttctcagctagtcctgctgggtggggtatacctaactggacttcactaaaatcttgagttactctgtttaactctccatatcagcagccagggcct

SEQ ID NO: 414699 - DNA, 140 bp, Artificial Sequence
  Synthetic
atacgccatgctgggtctccctgcttttactttaccatccattaataatgcagagccaggaaaaagatacatctacaaggtgttgcctcaaggctggaaaggatcaccaacaatttttcacgtacttgggagtcggccat

SEQ ID NO: 414700 - DNA, 140 bp, Artificial Sequence
  Synthetic
atggccgactcccaagtacgtgaaaaattgttggtgatcctttccagccttgaggcaacaccttgtagatgtatctttttcctggctctgcattattaatggatggtaaagtaaaagcagggagacccagcatggcgtat

SEQ ID NO: 414701 - DNA, 140 bp, Artificial Sequence
  Synthetic
aggccctggctgctgatatgatctacaaggtgttgcctcaaggctggaaaggatcaccaacaatttttcagtatacaatgaggaacctactggagccatttagaaaggcaaatgaagatggaccttttgggacagcggtg

SEQ ID NO: 414702 - DNA, 140 bp, Artificial Sequence
  Synthetic
caccgctgtcccaaaaggtccatcttcatttgcctttctaaatggctccagtaggttcctcattgtatactgaaaaattgttggtgatcctttccagccttgaggcaacaccttgtagatcatatcagcagccagggcct

SEQ ID NO: 414703 - DNA, 140 bp, Artificial Sequence
  Synthetic
atacgccatgctgggtctccgatttagagcatgatcagttagtttcacagctcaaggagctactgaataagacaggatttagcaccccagacgaaaaatttcagaaagacccaccacacacgtacttgggagtcggccat

SEQ ID NO: 414704 - DNA, 140 bp, Artificial Sequence
  Synthetic
atggccgactcccaagtacgtgtgtggtgggtctttctgaaatttttcgtctggggtgctaaatcctgtcttattcagtagctccttgagctgtgaaactaactgatcatgctctaaatcggagacccagcatggcgtat

SEQ ID NO: 414705 - DNA, 140 bp, Artificial Sequence
  Synthetic
aggccctggctgctgatatggacaggatttagcaccccagacgaaaaatttcagaaagacccaccacacaaatggatgggctatgaactatggcctaaaaagtggaaattgcagaaaattgaccttttgggacagcggtg

SEQ ID NO: 414706 - DNA, 140 bp, Artificial Sequence
  Synthetic
caccgctgtcccaaaaggtcaattttctgcaatttccactttttaggccatagttcatagcccatccatttgtgtggtgggtctttctgaaatttttcgtctggggtgctaaatcctgtccatatcagcagccagggcct

SEQ ID NO: 414707 - DNA, 140 bp, Artificial Sequence
  Synthetic
atacgccatgctgggtctccaggagtactaaattgggcagcacaagtttatccaggaataaagacaaaacatctttgtaaattaattaaggggaaaatgacactcacagaagaggtacagcgtacttgggagtcggccat

SEQ ID NO: 414708 - DNA, 140 bp, Artificial Sequence
  Synthetic
atggccgactcccaagtacgctgtacctcttctgtgagtgtcattttccccttaattaatttacaaagatgttttgtctttattcctggataaacttgtgctgcccaatttagtactcctggagacccagcatggcgtat

SEQ ID NO: 414709 - DNA, 140 bp, Artificial Sequence
  Synthetic
aggccctggctgctgatatgatctttgtaaattaattaaggggaaaatgacactcacagaagaggtacagtggacagaaatggcagaagcagaatttgcagagaataagattattttgaggaccttttgggacagcggtg

SEQ ID NO: 414710 - DNA, 140 bp, Artificial Sequence
  Synthetic
caccgctgtcccaaaaggtcctcaaaataatcttattctctgcaaattctgcttctgccatttctgtccactgtacctcttctgtgagtgtcattttccccttaattaatttacaaagatcatatcagcagccagggcct

SEQ ID NO: 414711 - DNA, 140 bp, Artificial Sequence
  Synthetic
atacgccatgctgggtctcccagtgcttaaaaatcaagataatcaatggacctacaagatccatcagggtgacaggacattaaaagtaggaaaatttgccaaggtaaagaatactcataccgtacttgggagtcggccat

SEQ ID NO: 414712 - DNA, 140 bp, Artificial Sequence
  Synthetic
atggccgactcccaagtacggtatgagtattctttaccttggcaaattttcctacttttaatgtcctgtcaccctgatggatcttgtaggtccattgattatcttgatttttaagcactgggagacccagcatggcgtat

SEQ ID NO: 414713 - DNA, 140 bp, Artificial Sequence
  Synthetic
aggccctggctgctgatatggacaggacattaaaagtaggaaaatttgccaaggtaaagaatactcatacaaatggagttcgcctgctagcacatgtggtacagaagataggaaaagaaggaccttttgggacagcggtg

SEQ ID NO: 414714 - DNA, 140 bp, Artificial Sequence
  Synthetic
caccgctgtcccaaaaggtccttcttttcctatcttctgtaccacatgtgctagcaggcgaactccatttgtatgagtattctttaccttggcaaattttcctacttttaatgtcctgtccatatcagcagccagggcct

SEQ ID NO: 414715 - DNA, 140 bp, Artificial Sequence
  Synthetic
atacgccatgctgggtctccgaggtctgggaacaatggtggactgactattggcaggtcacctgggtcctagactgggattttgtatccacaccacccctggtgagactggcatataatccgtacttgggagtcggccat

SEQ ID NO: 414716 - DNA, 140 bp, Artificial Sequence
  Synthetic
atggccgactcccaagtacggattatatgccagtctcaccaggggtggtgtggatacaaaatcccagtctaggacccaggtgacctgccaatagtcagtccaccattgttcccagacctcggagacccagcatggcgtat

SEQ ID NO: 414717 - DNA, 140 bp, Artificial Sequence
  Synthetic
aggccctggctgctgatatgagactgggattttgtatccacaccacccctggtgagactggcatataatctagtaaaagaaccattactagaagagacatattatacagatggctcttgtgaccttttgggacagcggtg

SEQ ID NO: 414718 - DNA, 140 bp, Artificial Sequence
  Synthetic
caccgctgtcccaaaaggtcacaagagccatctgtataatatgtctcttctagtaatggttcttttactagattatatgccagtctcaccaggggtggtgtggatacaaaatcccagtctcatatcagcagccagggcct

SEQ ID NO: 414719 - DNA, 140 bp, Artificial Sequence
  Synthetic
atacgccatgctgggtctccagacagagtaaaacctttagaacagaccaccaaccaacaagcagaattagaagcctttgctatggccttagaagattcaggaccaaaagtaaacattgtgcgtacttgggagtcggccat

SEQ ID NO: 414720 - DNA, 140 bp, Artificial Sequence
  Synthetic
atggccgactcccaagtacgcacaatgtttacttttggtcctgaatcttctaaggccatagcaaaggcttctaattctgcttgttggttggtggtctgttctaaaggttttactctgtctggagacccagcatggcgtat

SEQ ID NO: 414721 - DNA, 140 bp, Artificial Sequence
  Synthetic
aggccctggctgctgatatgaagcctttgctatggccttagaagattcaggaccaaaagtaaacattgtgacagattcacaatatataatgggaataatagcaggacagccaacagaaacgaccttttgggacagcggtg

SEQ ID NO: 414722 - DNA, 140 bp, Artificial Sequence
  Synthetic
caccgctgtcccaaaaggtcgtttctgttggctgtcctgctattattcccattatatattgtgaatctgtcacaatgtttacttttggtcctgaatcttctaaggccatagcaaaggcttcatatcagcagccagggcct

SEQ ID NO: 414723 - DNA, 140 bp, Artificial Sequence
  Synthetic
atacgccatgctgggtctcccagtgtatgttggctgggtacctgctcataagggtattggtggcaatcaagaagtagatcatttggtgagtcagggaattaggcaagtactgtttctagacgtacttgggagtcggccat

SEQ ID NO: 414724 - DNA, 140 bp, Artificial Sequence
  Synthetic
atggccgactcccaagtacgtctagaaacagtacttgcctaattccctgactcaccaaatgatctacttcttgattgccaccaatacccttatgagcaggtacccagccaacatacactgggagacccagcatggcgtat

SEQ ID NO: 414725 - DNA, 140 bp, Artificial Sequence
  Synthetic
aggccctggctgctgatatggaagtagatcatttggtgagtcagggaattaggcaagtactgtttctagaaaaaatagaaccagctcaggaagaacatgagaaataccatagcaatgttagaccttttgggacagcggtg

SEQ ID NO: 414726 - DNA, 140 bp, Artificial Sequence
  Synthetic
caccgctgtcccaaaaggtctaacattgctatggtatttctcatgttcttcctgagctggttctattttttctagaaacagtacttgcctaattccctgactcaccaaatgatctacttccatatcagcagccagggcct

SEQ ID NO: 414727 - DNA, 140 bp, Artificial Sequence
  Synthetic
atacgccatgctgggtctccgtaaatacttgtcatgtttgccagcagaaaggagaagccatgcatggacaggtaaatacagaagtagggacatggcaaatggactgtacccacttagaggcgtacttgggagtcggccat

SEQ ID NO: 414728 - DNA, 140 bp, Artificial Sequence
  Synthetic
atggccgactcccaagtacgcctctaagtgggtacagtccatttgccatgtccctacttctgtatttacctgtccatgcatggcttctcctttctgctggcaaacatgacaagtatttacggagacccagcatggcgtat

SEQ ID NO: 414729 - DNA, 140 bp, Artificial Sequence
  Synthetic
aggccctggctgctgatatgggtaaatacagaagtagggacatggcaaatggactgtacccacttagagggaaaagttgtcatcgtggcagtacatgtggccagtggctttatagaagcagaccttttgggacagcggtg

SEQ ID NO: 414730 - DNA, 140 bp, Artificial Sequence
  Synthetic
caccgctgtcccaaaaggtctgcttctataaagccactggccacatgtactgccacgatgacaacttttccctctaagtgggtacagtccatttgccatgtccctacttctgtatttacccatatcagcagccagggcct

SEQ ID NO: 414731 - DNA, 140 bp, Artificial Sequence
  Synthetic
atacgccatgctgggtctccgctagcaggaaggtggcctatcactcatttgcacacagataatggtgccaacttcacttcacaggaagtaaagatggtagcatggtgggtaggtatagagcgtacttgggagtcggccat

SEQ ID NO: 414732 - DNA, 140 bp, Artificial Sequence
  Synthetic
atggccgactcccaagtacgctctatacctacccaccatgctaccatctttacttcctgtgaagtgaagttggcaccattatctgtgtgcaaatgagtgataggccaccttcctgctagcggagacccagcatggcgtat

SEQ ID NO: 414733 - DNA, 140 bp, Artificial Sequence
  Synthetic
aggccctggctgctgatatgacttcacttcacaggaagtaaagatggtagcatggtgggtaggtatagagcatacctttggagtaccctataacccgcaaagccaaggagtggtagaagcgaccttttgggacagcggtg

SEQ ID NO: 414734 - DNA, 140 bp, Artificial Sequence
  Synthetic
caccgctgtcccaaaaggtcgcttctaccactccttggctttgcgggttatagggtactccaaaggtatgctctatacctacccaccatgctaccatctttacttcctgtgaagtgaagtcatatcagcagccagggcct

SEQ ID NO: 414735 - DNA, 140 bp, Artificial Sequence
  Synthetic
atacgccatgctgggtctccatacaatggagaccatagtcctaatggcagctcactgcatgaattttaaaagaaggggaggaataggggatatgactcctgcagaaagaatcattaacatcgtacttgggagtcggccat

SEQ ID NO: 414736 - DNA, 140 bp, Artificial Sequence
  Synthetic
atggccgactcccaagtacgatgttaatgattctttctgcaggagtcatatcccctattcctccccttcttttaaaattcatgcagtgagctgccattaggactatggtctccattgtatggagacccagcatggcgtat

SEQ ID NO: 414737 - DNA, 140 bp, Artificial Sequence
  Synthetic
aggccctggctgctgatatgagaaggggaggaataggggatatgactcctgcagaaagaatcattaacatgatatccacagaacaagaaatacaattcctccaatcaaaaaattcaaaatgaccttttgggacagcggtg

SEQ ID NO: 414738 - DNA, 140 bp, Artificial Sequence
  Synthetic
caccgctgtcccaaaaggtcattttgaattttttgattggaggaattgtatttcttgttctgtggatatcatgttaatgattctttctgcaggagtcatatcccctattcctccccttctcatatcagcagccagggcct

SEQ ID NO: 414739 - DNA, 140 bp, Artificial Sequence
  Synthetic
atacgccatgctgggtctccggcccagcagacttactgtggaagggagaaggagcggtccttattaaggtagggacagacattaaggtaatacccaggagaaaagcaaagatcatcagagcgtacttgggagtcggccat

SEQ ID NO: 414740 - DNA, 140 bp, Artificial Sequence
  Synthetic
atggccgactcccaagtacgctctgatgatctttgcttttctcctgggtattaccttaatgtctgtccctaccttaataaggaccgctccttctcccttccacagtaagtctgctgggccggagacccagcatggcgtat

SEQ ID NO: 414741 - DNA, 140 bp, Artificial Sequence
  Synthetic
aggccctggctgctgatatgagggacagacattaaggtaatacccaggagaaaagcaaagatcatcagagattatggaggaggaaaagaattggatagtagttccaacttggagggtgccgaccttttgggacagcggtg

SEQ ID NO: 414742 - DNA, 140 bp, Artificial Sequence
  Synthetic
caccgctgtcccaaaaggtcggcaccctccaagttggaactactatccaattcttttcctcctccataatctctgatgatctttgcttttctcctgggtattaccttaatgtctgtccctcatatcagcagccagggcct

SEQ ID NO: 414743 - DNA, 140 bp, Artificial Sequence
  Synthetic
atacgccatgctgggtctccaaaagagctacagaaagtgtgttatgtgccccatcacaaggtaggatgggcttggtggacttgcagcagggtaatatttcctctaaaaaaaggatcacatcgtacttgggagtcggccat

SEQ ID NO: 414744 - DNA, 140 bp, Artificial Sequence
  Synthetic
atggccgactcccaagtacgatgtgatcctttttttagaggaaatattaccctgctgcaagtccaccaagcccatcctaccttgtgatggggcacataacacactttctgtagctcttttggagacccagcatggcgtat

SEQ ID NO: 414745 - DNA, 140 bp, Artificial Sequence
  Synthetic
aggccctggctgctgatatgcttggtggacttgcagcagggtaatatttcctctaaaaaaaggatcacatttggaggtgcaagcctattggaatttgacaccagagaagggatggctatcgaccttttgggacagcggtg

SEQ ID NO: 414746 - DNA, 140 bp, Artificial Sequence
  Synthetic
caccgctgtcccaaaaggtcgatagccatcccttctctggtgtcaaattccaataggcttgcacctccaaatgtgatcctttttttagaggaaatattaccctgctgcaagtccaccaagcatatcagcagccagggcct

SEQ ID NO: 414747 - DNA, 140 bp, Artificial Sequence
  Synthetic
atacgccatgctgggtctcctaacacctgattgcgcagaccaattactgcatgggagttatttctcttgctttacagcgggtgaagtgaggagagccatcagaggagaacagttattgtccgtacttgggagtcggccat

SEQ ID NO: 414748 - DNA, 140 bp, Artificial Sequence
  Synthetic
atggccgactcccaagtacggacaataactgttctcctctgatggctctcctcacttcacccgctgtaaagcaagagaaataactcccatgcagtaattggtctgcgcaatcaggtgttaggagacccagcatggcgtat

SEQ ID NO: 414749 - DNA, 140 bp, Artificial Sequence
  Synthetic
aggccctggctgctgatatgtttacagcgggtgaagtgaggagagccatcagaggagaacagttattgtcctgctgcaactttccatcggctcatagacagcaggtaccatctttacaatgaccttttgggacagcggtg

SEQ ID NO: 414750 - DNA, 140 bp, Artificial Sequence
  Synthetic
caccgctgtcccaaaaggtcattgtaaagatggtacctgctgtctatgagccgatggaaagttgcagcaggacaataactgttctcctctgatggctctcctcacttcacccgctgtaaacatatcagcagccagggcct

SEQ ID NO: 414751 - DNA, 140 bp, Artificial Sequence
  Synthetic
atacgccatgctgggtctccaccaggaaattcagaagaagaaactgtaggagaggctttcagttggctagaaagaactgtgagagatatcaacagggcagcagtgcaacatcttcccaggcgtacttgggagtcggccat

SEQ ID NO: 414752 - DNA, 140 bp, Artificial Sequence
  Synthetic
atggccgactcccaagtacgcctgggaagatgttgcactgctgccctgttgatatctctcacagttctttctagccaactgaaagcctctcctacagtttcttcttctgaatttcctggtggagacccagcatggcgtat

SEQ ID NO: 414753 - DNA, 140 bp, Artificial Sequence
  Synthetic
aggccctggctgctgatatgaaagaactgtgagagatatcaacagggcagcagtgcaacatcttcccagggaacttattttccaggtctggcaaaggtcctggcaatactggcgtgatgagaccttttgggacagcggtg

SEQ ID NO: 414754 - DNA, 140 bp, Artificial Sequence
  Synthetic
caccgctgtcccaaaaggtctcatcacgccagtattgccaggacctttgccagacctggaaaataagttccctgggaagatgttgcactgctgccctgttgatatctctcacagttctttcatatcagcagccagggcct

SEQ ID NO: 414755 - DNA, 140 bp, Artificial Sequence
  Synthetic
atacgccatgctgggtctccagaaagctttatttatgcattgcaaaaagggatgtcaatgcttgggggaaggccatggaccaggaggatggagatcagggcctcctcctcctcccccacccgtacttgggagtcggccat

SEQ ID NO: 414756 - DNA, 140 bp, Artificial Sequence
  Synthetic
atggccgactcccaagtacgggtgggggaggaggaggaggccctgatctccatcctcctggtccatggccttcccccaagcattgacatccctttttgcaatgcataaataaagctttctggagacccagcatggcgtat

SEQ ID NO: 414757 - DNA, 140 bp, Artificial Sequence
  Synthetic
aggccctggctgctgatatgggccatggaccaggaggatggagatcagggcctcctcctcctcccccaccaggattgatctaatggcagaaatacctccagaggacggggccccacaaaggaccttttgggacagcggtg

SEQ ID NO: 414758 - DNA, 140 bp, Artificial Sequence
  Synthetic
caccgctgtcccaaaaggtcctttgtggggccccgtcctctggaggtatttctgccattagatcaatcctggtgggggaggaggaggaggccctgatctccatcctcctggtccatggcccatatcagcagccagggcct

SEQ ID NO: 414759 - DNA, 140 bp, Artificial Sequence
  Synthetic
atacgccatgctgggtctccaagctgtaaggcattttgatcctcgcttgctaactgcgcttggtaactatatctataataggcatggagatacccttgaaggagcaggagagctcattaacgtacttgggagtcggccat

SEQ ID NO: 414760 - DNA, 140 bp, Artificial Sequence
  Synthetic
atggccgactcccaagtacgttaatgagctctcctgctccttcaagggtatctccatgcctattatagatatagttaccaagcgcagttagcaagcgaggatcaaaatgccttacagcttggagacccagcatggcgtat

SEQ ID NO: 414761 - DNA, 140 bp, Artificial Sequence
  Synthetic
aggccctggctgctgatatgatctataataggcatggagatacccttgaaggagcaggagagctcattaaaatcctgcaaagagcaatcttcctccacttcagagggggatgtcggcactgaccttttgggacagcggtg

SEQ ID NO: 414762 - DNA, 140 bp, Artificial Sequence
  Synthetic
caccgctgtcccaaaaggtcagtgccgacatccccctctgaagtggaggaagattgctctttgcaggattttaatgagctctcctgctccttcaagggtatctccatgcctattatagatcatatcagcagccagggcct

SEQ ID NO: 414763 - DNA, 140 bp, Artificial Sequence
  Synthetic
atacgccatgctgggtctcctcttgaggcgtgctctaataaatgctattgtaaaaaatgttgctatcattgccagctatgttttcttaaaaagggccttgggatatgttatgagcaaccccgtacttgggagtcggccat

SEQ ID NO: 414764 - DNA, 140 bp, Artificial Sequence
  Synthetic
atggccgactcccaagtacggggttgctcataacatatcccaaggccctttttaagaaaacatagctggcaatgatagcaacattttttacaatagcatttattagagcacgcctcaagaggagacccagcatggcgtat

SEQ ID NO: 414765 - DNA, 140 bp, Artificial Sequence
  Synthetic
aggccctggctgctgatatggccagctatgttttcttaaaaagggccttgggatatgttatgagcaacccagaagaaggagtccaaagaaggttaaggcttattcatctgctccatcaaagaccttttgggacagcggtg

SEQ ID NO: 414766 - DNA, 140 bp, Artificial Sequence
  Synthetic
caccgctgtcccaaaaggtctttgatggagcagatgaataagccttaaccttctttggactccttcttctgggttgctcataacatatcccaaggccctttttaagaaaacatagctggccatatcagcagccagggcct

SEQ ID NO: 414767 - DNA, 140 bp, Artificial Sequence
  Synthetic
atacgccatgctgggtctcctttaaatgcatgcgtgatatactgtactcagtatgtcactgtcttttatggcatacctgcatggaggaacgcgacaattcccctcttttgtgcaaccaaccgtacttgggagtcggccat

SEQ ID NO: 414768 - DNA, 140 bp, Artificial Sequence
  Synthetic
atggccgactcccaagtacggttggttgcacaaaagaggggaattgtcgcgttcctccatgcaggtatgccataaaagacagtgacatactgagtacagtatatcacgcatgcatttaaaggagacccagcatggcgtat

SEQ ID NO: 414769 - DNA, 140 bp, Artificial Sequence
  Synthetic
aggccctggctgctgatatggcatacctgcatggaggaacgcgacaattcccctcttttgtgcaaccaacaatagagatacatggggaaccacacagtgccttcctgataatggtgattagaccttttgggacagcggtg

SEQ ID NO: 414770 - DNA, 140 bp, Artificial Sequence
  Synthetic
caccgctgtcccaaaaggtctaatcaccattatcaggaaggcactgtgtggttccccatgtatctctattgttggttgcacaaaagaggggaattgtcgcgttcctccatgcaggtatgccatatcagcagccagggcct

SEQ ID NO: 414771 - DNA, 140 bp, Artificial Sequence
  Synthetic
atacgccatgctgggtctcccagtaacagagcaagcagtggaagatgtctggagtctttttgagacatctataaaaccatgtgtaaagttgacacccctttgtatagcaatgagatgtagcgtacttgggagtcggccat

SEQ ID NO: 414772 - DNA, 140 bp, Artificial Sequence
  Synthetic
atggccgactcccaagtacgctacatctcattgctatacaaaggggtgtcaactttacacatggttttatagatgtctcaaaaagactccagacatcttccactgcttgctctgttactgggagacccagcatggcgtat

SEQ ID NO: 414773 - DNA, 140 bp, Artificial Sequence
  Synthetic
aggccctggctgctgatatgataaaaccatgtgtaaagttgacacccctttgtatagcaatgagatgtagtaaaactgaaacaaatagatggggattaacaggaacagcagcaacaacaagaccttttgggacagcggtg

SEQ ID NO: 414774 - DNA, 140 bp, Artificial Sequence
  Synthetic
caccgctgtcccaaaaggtcttgttgttgctgctgttcctgttaatccccatctatttgtttcagttttactacatctcattgctatacaaaggggtgtcaactttacacatggttttatcatatcagcagccagggcct

SEQ ID NO: 414775 - DNA, 140 bp, Artificial Sequence
  Synthetic
atacgccatgctgggtctcctgtatacgaaataatagctgctcaggattagaacaagaaccattggtgagttgtagatttaatatgacaggcttaaaaagggataagaaacaagagtatacgtacttgggagtcggccat

SEQ ID NO: 414776 - DNA, 140 bp, Artificial Sequence
  Synthetic
atggccgactcccaagtacgtatactcttgtttcttatccctttttaagcctgtcatattaaatctacaactcaccaatggttcttgttctaatcctgagcagctattatttcgtatacaggagacccagcatggcgtat

SEQ ID NO: 414777 - DNA, 140 bp, Artificial Sequence
  Synthetic
aggccctggctgctgatatgttgtagatttaatatgacaggcttaaaaagggataagaaacaagagtataaagaaacatggtattctcatgacatagtttgtgaacagaatactagtgaagaccttttgggacagcggtg

SEQ ID NO: 414778 - DNA, 140 bp, Artificial Sequence
  Synthetic
caccgctgtcccaaaaggtcttcactagtattctgttcacaaactatgtcatgagaataccatgtttctttatactcttgtttcttatccctttttaagcctgtcatattaaatctacaacatatcagcagccagggcct

SEQ ID NO: 414779 - DNA, 140 bp, Artificial Sequence
  Synthetic
atacgccatgctgggtctccgtcttgtgacaaacattattgggatgccataagatttaggtattgtgcaccgccaggctatgctctgttaagatgtaatgatactaattactcaggatttcgtacttgggagtcggccat

SEQ ID NO: 414780 - DNA, 140 bp, Artificial Sequence
  Synthetic
atggccgactcccaagtacgaaatcctgagtaattagtatcattacatcttaacagagcatagcctggcggtgcacaatacctaaatcttatggcatcccaataatgtttgtcacaagacggagacccagcatggcgtat

SEQ ID NO: 414781 - DNA, 140 bp, Artificial Sequence
  Synthetic
aggccctggctgctgatatgcgccaggctatgctctgttaagatgtaatgatactaattactcaggatttatgcctaattgctctaaagtagtagtctctacatgcacaagaatgagggggaccttttgggacagcggtg

SEQ ID NO: 414782 - DNA, 140 bp, Artificial Sequence
  Synthetic
caccgctgtcccaaaaggtccccctcattcttgtgcatgtagagactactactttagagcaattaggcataaatcctgagtaattagtatcattacatcttaacagagcatagcctggcgcatatcagcagccagggcct

SEQ ID NO: 414783 - DNA, 140 bp, Artificial Sequence
  Synthetic
atacgccatgctgggtctccgaacttatatatactggcatggtagagacaatagaacaataattagcttaaataagtattataatttaacaatgtactgtagaaggccagggaataagaccgtacttgggagtcggccat

SEQ ID NO: 414784 - DNA, 140 bp, Artificial Sequence
  Synthetic
atggccgactcccaagtacggtcttattccctggccttctacagtacattgttaaattataatacttatttaagctaattattgttctattgtctctaccatgccagtatatataagttcggagacccagcatggcgtat

SEQ ID NO: 414785 - DNA, 140 bp, Artificial Sequence
  Synthetic
aggccctggctgctgatatgaataagtattataatttaacaatgtactgtagaaggccagggaataagacagtcttaccagtaaccattatgtcaggactagtgttccattctcaagctagaccttttgggacagcggtg

SEQ ID NO: 414786 - DNA, 140 bp, Artificial Sequence
  Synthetic
caccgctgtcccaaaaggtctagcttgagaatggaacactagtcctgacataatggttactggtaagactgtcttattccctggccttctacagtacattgttaaattataatacttattcatatcagcagccagggcct

SEQ ID NO: 414787 - DNA, 140 bp, Artificial Sequence
  Synthetic
atacgccatgctgggtctccggggcaatccaggaggtgaaggagaccattgccaaccatcccaggtatcatggtaccaagaatattagtcagataaatctggcagaaccagcaggaggtgcgtacttgggagtcggccat

SEQ ID NO: 414788 - DNA, 140 bp, Artificial Sequence
  Synthetic
atggccgactcccaagtacgcacctcctgctggttctgccagatttatctgactaatattcttggtaccatgatacctgggatggttggcaatggtctccttcacctcctggattgccccggagacccagcatggcgtat

SEQ ID NO: 414789 - DNA, 140 bp, Artificial Sequence
  Synthetic
aggccctggctgctgatatgtggtaccaagaatattagtcagataaatctggcagaaccagcaggaggtgattcagaggtaaaatttatgtggactaactgcagaggagaattcctctacgaccttttgggacagcggtg

SEQ ID NO: 414790 - DNA, 140 bp, Artificial Sequence
  Synthetic
caccgctgtcccaaaaggtcgtagaggaattctcctctgcagttagtccacataaattttacctctgaatcacctcctgctggttctgccagatttatctgactaatattcttggtaccacatatcagcagccagggcct

SEQ ID NO: 414791 - DNA, 140 bp, Artificial Sequence
  Synthetic
atacgccatgctgggtctccacaaacgtcaagggagagacataaaaggaactatgtgccttgccatattaggcaggtaattaacacatggcataaagtagggagaaatgtgtatttgcctcgtacttgggagtcggccat

SEQ ID NO: 414792 - DNA, 140 bp, Artificial Sequence
  Synthetic
atggccgactcccaagtacgaggcaaatacacatttctccctactttatgccatgtgttaattacctgcctaatatggcaaggcacatagttccttttatgtctctcccttgacgtttgtggagacccagcatggcgtat

SEQ ID NO: 414793 - DNA, 140 bp, Artificial Sequence
  Synthetic
aggccctggctgctgatatgggcaggtaattaacacatggcataaagtagggagaaatgtgtatttgcctccaagagaaggagatctcacctgcaattctacagtaactagcatgattgcgaccttttgggacagcggtg

SEQ ID NO: 414794 - DNA, 140 bp, Artificial Sequence
  Synthetic
caccgctgtcccaaaaggtcgcaatcatgctagttactgtagaattgcaggtgagatctccttctcttggaggcaaatacacatttctccctactttatgccatgtgttaattacctgcccatatcagcagccagggcct

SEQ ID NO: 414795 - DNA, 140 bp, Artificial Sequence
  Synthetic
atacgccatgctgggtctccaagtggcagaactgtatagattagagttgggggattataaattggtagaaataagaccaattggctttgctcccacaccagtgaaaagatattcctcagtcgtacttgggagtcggccat

SEQ ID NO: 414796 - DNA, 140 bp, Artificial Sequence
  Synthetic
atggccgactcccaagtacgactgaggaatatcttttcactggtgtgggagcaaagccaattggtcttatttctaccaatttataatcccccaactctaatctatacagttctgccacttggagacccagcatggcgtat

SEQ ID NO: 414797 - DNA, 140 bp, Artificial Sequence
  Synthetic
aggccctggctgctgatatgataagaccaattggctttgctcccacaccagtgaaaagatattcctcagtgacaccgaggaataaaaggggagtatttgtgcttgggttcttgggttttcgaccttttgggacagcggtg

SEQ ID NO: 414798 - DNA, 140 bp, Artificial Sequence
  Synthetic
caccgctgtcccaaaaggtcgaaaacccaagaacccaagcacaaatactccccttttattcctcggtgtcactgaggaatatcttttcactggtgtgggagcaaagccaattggtcttatcatatcagcagccagggcct

SEQ ID NO: 414799 - DNA, 140 bp, Artificial Sequence
  Synthetic
atacgccatgctgggtctcccagtcccggactttactggctgggatagtgcagcaacagcaacagctgttggacgtggtcaaaagacaacaagaaatgttgcggctgaccgtctggggaacgtacttgggagtcggccat

SEQ ID NO: 414800 - DNA, 140 bp, Artificial Sequence
  Synthetic
atggccgactcccaagtacgttccccagacggtcagccgcaacatttcttgttgtcttttgaccacgtccaacagctgttgctgttgctgcactatcccagccagtaaagtccgggactgggagacccagcatggcgtat

SEQ ID NO: 414801 - DNA, 140 bp, Artificial Sequence
  Synthetic
aggccctggctgctgatatgggacgtggtcaaaagacaacaagaaatgttgcggctgaccgtctggggaactaaaaacctccagactagagtcactgccatcgagaaatacctaaaggatgaccttttgggacagcggtg

SEQ ID NO: 414802 - DNA, 140 bp, Artificial Sequence
  Synthetic
caccgctgtcccaaaaggtcatcctttaggtatttctcgatggcagtgactctagtctggaggtttttagttccccagacggtcagccgcaacatttcttgttgtcttttgaccacgtcccatatcagcagccagggcct

SEQ ID NO: 414803 - DNA, 140 bp, Artificial Sequence
  Synthetic
atacgccatgctgggtctcctactgtgccatggataaacgacacattaacacctaattgggataatatgacgtggcaagaatgggaggaaaaggtgaactacttggaagaaaatatcacacgtacttgggagtcggccat

SEQ ID NO: 414804 - DNA, 140 bp, Artificial Sequence
  Synthetic
atggccgactcccaagtacgtgtgatattttcttccaagtagttcaccttttcctcccattcttgccacgtcatattatcccaattaggtgttaatgtgtcgtttatccatggcacagtaggagacccagcatggcgtat

SEQ ID NO: 414805 - DNA, 140 bp, Artificial Sequence
  Synthetic
aggccctggctgctgatatgcgtggcaagaatgggaggaaaaggtgaactacttggaagaaaatatcacacagctattagaagcagctcaaatacaacaagagaaaaacatgtatgaattgaccttttgggacagcggtg

SEQ ID NO: 414806 - DNA, 140 bp, Artificial Sequence
  Synthetic
caccgctgtcccaaaaggtcaattcatacatgtttttctcttgttgtatttgagctgcttctaatagctgtgtgatattttcttccaagtagttcaccttttcctcccattcttgccacgcatatcagcagccagggcct

SEQ ID NO: 414807 - DNA, 140 bp, Artificial Sequence
  Synthetic
atacgccatgctgggtctcccatgggttaaatatgtatacttaggactgtatgtagtagcaggaataataatacttagaatagtgatatatgtagtacagctgttaggtagtcttaggaacgtacttgggagtcggccat

SEQ ID NO: 414808 - DNA, 140 bp, Artificial Sequence
  Synthetic
atggccgactcccaagtacgttcctaagactacctaacagctgtactacatatatcactattctaagtattattattcctgctactacatacagtcctaagtatacatatttaacccatgggagacccagcatggcgtat

SEQ ID NO: 414809 - DNA, 140 bp, Artificial Sequence
  Synthetic
aggccctggctgctgatatgatacttagaatagtgatatatgtagtacagctgttaggtagtcttaggaaaggttataggccagttttctcttcccacccctcttatgttgaacagatccgaccttttgggacagcggtg

SEQ ID NO: 414810 - DNA, 140 bp, Artificial Sequence
  Synthetic
caccgctgtcccaaaaggtcggatctgttcaacataagaggggtgggaagagaaaactggcctataacctttcctaagactacctaacagctgtactacatatatcactattctaagtatcatatcagcagccagggcct

SEQ ID NO: 414811 - DNA, 140 bp, Artificial Sequence
  Synthetic
atacgccatgctgggtctccgctggagacagcggtggctacagatcttggccttggcagataagatatatacatttcctgatccaccaactgattcgcctgttgacttggctatacagcacgtacttgggagtcggccat

SEQ ID NO: 414812 - DNA, 140 bp, Artificial Sequence
  Synthetic
atggccgactcccaagtacgtgctgtatagccaagtcaacaggcgaatcagttggtggatcaggaaatgtatatatcttatctgccaaggccaagatctgtagccaccgctgtctccagcggagacccagcatggcgtat

SEQ ID NO: 414813 - DNA, 140 bp, Artificial Sequence
  Synthetic
aggccctggctgctgatatgacatttcctgatccaccaactgattcgcctgttgacttggctatacagcagctgcagggacttgctatccaggatttgccagagcctccagccgttgttcgaccttttgggacagcggtg

SEQ ID NO: 414814 - DNA, 140 bp, Artificial Sequence
  Synthetic
caccgctgtcccaaaaggtcgaacaacggctggaggctctggcaaatcctggatagcaagtccctgcagctgctgtatagccaagtcaacaggcgaatcagttggtggatcaggaaatgtcatatcagcagccagggcct

SEQ ID NO: 414815 - DNA, 140 bp, Artificial Sequence
  Synthetic
atacgccatgctgggtctccgtggcagtatttcaaagaagcattccaagcgttcgggaaagctgcgcgagagactcttagccgcacggggagagaactatgggagactctggggcgggttcgtacttgggagtcggccat

SEQ ID NO: 414816 - DNA, 140 bp, Artificial Sequence
  Synthetic
atggccgactcccaagtacgaacccgccccagagtctcccatagttctctccccgtgcggctaagagtctctcgcgcagctttcccgaacgcttggaatgcttctttgaaatactgccacggagacccagcatggcgtat

SEQ ID NO: 414817 - DNA, 140 bp, Artificial Sequence
  Synthetic
aggccctggctgctgatatgagactcttagccgcacggggagagaactatgggagactctggggcgggttggaagatggcttcgagctataccaaggaggatcaggcaaggatttgagctgaccttttgggacagcggtg

SEQ ID NO: 414818 - DNA, 140 bp, Artificial Sequence
  Synthetic
caccgctgtcccaaaaggtcagctcaaatccttgcctgatcctccttggtatagctcgaagccatcttccaacccgccccagagtctcccatagttctctccccgtgcggctaagagtctcatatcagcagccagggcct

SEQ ID NO: 414819 - DNA, 140 bp, Artificial Sequence
  Synthetic
atacgccatgctgggtctccaatacaccttggagaaccccagcaacagggaaagataaattacaatataagcaacaaaacatggatgatgtagatgaagaagataatgatttagtaggagcgtacttgggagtcggccat

SEQ ID NO: 414820 - DNA, 140 bp, Artificial Sequence
  Synthetic
atggccgactcccaagtacgctcctactaaatcattatcttcttcatctacatcatccatgttttgttgcttatattgtaatttatctttccctgttgctggggttctccaaggtgtattggagacccagcatggcgtat

SEQ ID NO: 414821 - DNA, 140 bp, Artificial Sequence
  Synthetic
aggccctggctgctgatatggatttagtaggagtagcagtaagaccaagagtagcactgagaacaatgacttacaaattggcagtagatatgtcacattttataaaagaaaaagggggacgaccttttgggacagcggtg

SEQ ID NO: 414822 - DNA, 140 bp, Artificial Sequence
  Synthetic
caccgctgtcccaaaaggtcgtccccctttttcttttataaaatgtgacatatctactgccaatttgtaagtcattgttctcagtgctactcttggtcttactgctactcctactaaatccatatcagcagccagggcct

SEQ ID NO: 414823 - DNA, 140 bp, Artificial Sequence
  Synthetic
atacgccatgctgggtctccggttggcgcccgaacagggacttgaagaggactgagaagccctggaacacggctgagtgaaggcagtaagggcggcaggaacaaaccacgacggagtgctcgtacttgggagtcggccat

SEQ ID NO: 414824 - DNA, 140 bp, Artificial Sequence
  Synthetic
atggccgactcccaagtacgagcactccgtcgtggtttgttcctgccgcccttactgccttcactcagccgtgttccagggcttctcagtcctcttcaagtccctgttcgggcgccaaccggagacccagcatggcgtat

SEQ ID NO: 414825 - DNA, 140 bp, Artificial Sequence
  Synthetic
aggccctggctgctgatatgggctgagtgaaggcagtaagggcggcaggaacaaaccacgacggagtgctcctagaaaggcgcgggccgaggtaccaaggcggcgtgtggagcgggagtggaccttttgggacagcggtg

SEQ ID NO: 414826 - DNA, 140 bp, Artificial Sequence
  Synthetic
caccgctgtcccaaaaggtccactcccgctccacacgccgccttggtacctcggcccgcgcctttctaggagcactccgtcgtggtttgttcctgccgcccttactgccttcactcagcccatatcagcagccagggcct

SEQ ID NO: 414827 - DNA, 140 bp, Artificial Sequence
  Synthetic
atacgccatgctgggtctcccctagaaaggcgcgggccgaggtaccaaggcggcgtgtggagcgggagtgaaagaggcctccgggtgaaggtaagtacctacaccaaaaactgtagccagcgtacttgggagtcggccat

SEQ ID NO: 414828 - DNA, 140 bp, Artificial Sequence
  Synthetic
atggccgactcccaagtacgctggctacagtttttggtgtaggtacttaccttcacccggaggcctctttcactcccgctccacacgccgccttggtacctcggcccgcgcctttctaggggagacccagcatggcgtat

SEQ ID NO: 414829 - DNA, 140 bp, Artificial Sequence
  Synthetic
atacgccatgctgggtctccgcgcgagaaactccgtcttgcgagggaaaaaagcagatgaattagagaaaattaggttacggcccggcggaaagaaaaagtacaagttaaaacatattgtcgtacttgggagtcggccat

SEQ ID NO: 414830 - DNA, 140 bp, Artificial Sequence
  Synthetic
atggccgactcccaagtacgacaatatgttttaacttgtactttttctttccgccgggccgtaacctaattttctctaattcatctgcttttttccctcgcaagacggagtttctcgcgcggagacccagcatggcgtat

SEQ ID NO: 414831 - DNA, 140 bp, Artificial Sequence
  Synthetic
aggccctggctgctgatatgattaggttacggcccggcggaaagaaaaagtacaagttaaaacatattgtgtgggcagcgaacgaattggacagattcggattagcagagagcctgttgggaccttttgggacagcggtg

SEQ ID NO: 414832 - DNA, 140 bp, Artificial Sequence
  Synthetic
caccgctgtcccaaaaggtcccaacaggctctctgctaatccgaatctgtccaattcgttcgctgcccacacaatatgttttaacttgtactttttctttccgccgggccgtaacctaatcatatcagcagccagggcct

SEQ ID NO: 414833 - DNA, 140 bp, Artificial Sequence
  Synthetic
atacgccatgctgggtctccccaacagggtcagaaaatttaaaaagcctttttaatacagtctgcgtcatttggtgcttgcacgcagaagagaaagtgaaagatactgaagaagcaaaaacgtacttgggagtcggccat

SEQ ID NO: 414834 - DNA, 140 bp, Artificial Sequence
  Synthetic
atggccgactcccaagtacgtttttgcttcttcagtatctttcactttctcttctgcgtgcaagcaccaaatgacgcagactgtattaaaaaggctttttaaattttctgaccctgttggggagacccagcatggcgtat

SEQ ID NO: 414835 - DNA, 140 bp, Artificial Sequence
  Synthetic
atacgccatgctgggtctccccagaaacaagtagaccaacagcaccacctagtgggaaaggaggaaacttccccgtacaacaagtaggcggcaactatgtccatgtgccgctgagccccccgtacttgggagtcggccat

SEQ ID NO: 414836 - DNA, 140 bp, Artificial Sequence
  Synthetic
atggccgactcccaagtacggggggctcagcggcacatggacatagttgccgcctacttgttgtacggggaagtttcctcctttcccactaggtggtgctgttggtctacttgtttctggggagacccagcatggcgtat

SEQ ID NO: 414837 - DNA, 140 bp, Artificial Sequence
  Synthetic
atacgccatgctgggtctccgaagtagtgccaggatttcaggcactctcagaaggctgcacgccctatgatatcaatcaaatgcttaattgtgtgggcgatcaccaagcagctatgcaaacgtacttgggagtcggccat

SEQ ID NO: 414838 - DNA, 140 bp, Artificial Sequence
  Synthetic
atggccgactcccaagtacgtttgcatagctgcttggtgatcgcccacacaattaagcatttgattgatatcatagggcgtgcagccttctgagagtgcctgaaatcctggcactacttcggagacccagcatggcgtat

SEQ ID NO: 414839 - DNA, 140 bp, Artificial Sequence
  Synthetic
aggccctggctgctgatatgtatcaatcaaatgcttaattgtgtgggcgatcaccaagcagctatgcaaataatcagagaaattatcaatgaggaagcagcagaatgggatgcacagcacgaccttttgggacagcggtg

SEQ ID NO: 414840 - DNA, 140 bp, Artificial Sequence
  Synthetic
caccgctgtcccaaaaggtcgtgctgtgcatcccattctgctgcttcctcattgataatttctctgattatttgcatagctgcttggtgatcgcccacacaattaagcatttgattgatacatatcagcagccagggcct

SEQ ID NO: 414841 - DNA, 140 bp, Artificial Sequence
  Synthetic
atacgccatgctgggtctcctgacatagcaggaacaacaagcacagtagaagaacagctccagtggatgtataggcagccaaatcccgtgccggtagggaacatctacaggagatggatccgtacttgggagtcggccat

SEQ ID NO: 414842 - DNA, 140 bp, Artificial Sequence
  Synthetic
atggccgactcccaagtacggatccatctcctgtagatgttccctaccggcacgggatttggctgcctatacatccactggagctgttcttctactgtgcttgttgttcctgctatgtcaggagacccagcatggcgtat

SEQ ID NO: 414843 - DNA, 140 bp, Artificial Sequence
  Synthetic
atacgccatgctgggtctccagacataaaacagggaccaaaggaaccgttccagagctatgtagacaggttctataaaagcttgagggcagaacaaacagacccggcagtgaagaactggcgtacttgggagtcggccat

SEQ ID NO: 414844 - DNA, 140 bp, Artificial Sequence
  Synthetic
atggccgactcccaagtacgccagttcttcactgccgggtctgtttgttctgccctcaagcttttatagaacctgtctacatagctctggaacggttcctttggtccctgttttatgtctggagacccagcatggcgtat

SEQ ID NO: 414845 - DNA, 140 bp, Artificial Sequence
  Synthetic
aggccctggctgctgatatgtctataaaagcttgagggcagaacaaacagacccggcagtgaagaactggatgacccaaacgctgctaatacagaatgctaacccagactgcaagttagtgaccttttgggacagcggtg

SEQ ID NO: 414846 - DNA, 140 bp, Artificial Sequence
  Synthetic
caccgctgtcccaaaaggtcactaacttgcagtctgggttagcattctgtattagcagcgtttgggtcatccagttcttcactgccgggtctgtttgttctgccctcaagcttttatagacatatcagcagccagggcct

SEQ ID NO: 414847 - DNA, 140 bp, Artificial Sequence
  Synthetic
atacgccatgctgggtctccgtcagggagtaggtggaccaggccaaaaagccagactaatggccgaagccctgaaggaggctttgacaccagcccctatcccatttgcagcagcccaacacgtacttgggagtcggccat

SEQ ID NO: 414848 - DNA, 140 bp, Artificial Sequence
  Synthetic
atggccgactcccaagtacgtgttgggctgctgcaaatgggataggggctggtgtcaaagcctccttcagggcttcggccattagtctggctttttggcctggtccacctactccctgacggagacccagcatggcgtat

SEQ ID NO: 414849 - DNA, 140 bp, Artificial Sequence
  Synthetic
atacgccatgctgggtctccgacagtgccgagcacccagaaggcagggctgctggaaatgtggcaagcaaggacacatcatgtcaaattgcccagaaagacaggcaggttttttagggatcgtacttgggagtcggccat

SEQ ID NO: 414850 - DNA, 140 bp, Artificial Sequence
  Synthetic
atggccgactcccaagtacgatccctaaaaaacctgcctgtctttctgggcaatttgacatgatgtgtccttgcttgccacatttccagcagccctgccttctgggtgctcggcactgtcggagacccagcatggcgtat

SEQ ID NO: 414851 - DNA, 140 bp, Artificial Sequence
  Synthetic
atacgccatgctgggtctccaagtccacggggaaagaagcctcgcaacttccccgtggcccaagctcctcagggactgataccaacagcacccccagcagatccagcaatggacctgttgcgtacttgggagtcggccat

SEQ ID NO: 414852 - DNA, 140 bp, Artificial Sequence
  Synthetic
atggccgactcccaagtacgcaacaggtccattgctggatctgctgggggtgctgttggtatcagtccctgaggagcttgggccacggggaagttgcgaggcttctttccccgtggacttggagacccagcatggcgtat

SEQ ID NO: 414853 - DNA, 140 bp, Artificial Sequence
  Synthetic
atacgccatgctgggtctccatacaaagaggtgacagaggacttactgcacctcgagcaaggagagacacctcacagagaggcgacaaaggacttgctgcacctcaattctctctttggacgtacttgggagtcggccat

SEQ ID NO: 414854 - DNA, 140 bp, Artificial Sequence
  Synthetic
atggccgactcccaagtacgtccaaagagagaattgaggtgcagcaagtcctttgtcgcctctctgtgaggtgtctctccttgctcgaggtgcagtaagtcctctgtcacctctttgtatggagacccagcatggcgtat

SEQ ID NO: 414855 - DNA, 140 bp, Artificial Sequence
  Synthetic
atacgccatgctgggtctccttagacacaggggctgatgattcaatagtagcaggaatagagttagggaacaattacactccaaaaatagtagggggaataggaggattcataaataccacgtacttgggagtcggccat

SEQ ID NO: 414856 - DNA, 140 bp, Artificial Sequence
  Synthetic
atggccgactcccaagtacgtggtatttatgaatcctcctattccccctactatttttggagtgtaattgttccctaactctattcctgctactattgaatcatcagcccctgtgtctaaggagacccagcatggcgtat

SEQ ID NO: 414857 - DNA, 140 bp, Artificial Sequence
  Synthetic
atacgccatgctgggtctccaccataatgacaggagataccccaatcaacatctttggcagaaatatcctggcggccttaggcatgtcattaaatttaccaatcgccaagatagaaccaacgtacttgggagtcggccat

SEQ ID NO: 414858 - DNA, 140 bp, Artificial Sequence
  Synthetic
atggccgactcccaagtacgttggttctatcttggcgattggtaaatttaatgacatgcctaaggccgccaggatatttctgccaaagatgttgattggggtatctcctgtcattatggtggagacccagcatggcgtat

SEQ ID NO: 414859 - DNA, 140 bp, Artificial Sequence
  Synthetic
atacgccatgctgggtctcccccctaacaaaagaaaaaatagaggcgctaaaagagatctgtgaaaaaatggagaaagagggccaactagaagaagcacctccaactaatccttataatacgtacttgggagtcggccat

SEQ ID NO: 414860 - DNA, 140 bp, Artificial Sequence
  Synthetic
atggccgactcccaagtacgtattataaggattagttggaggtgcttcttctagttggccctctttctccattttttcacagatctcttttagcgcctctattttttcttttgttaggggggagacccagcatggcgtat

SEQ ID NO: 414861 - DNA, 140 bp, Artificial Sequence
  Synthetic
aggccctggctgctgatatggctaggaattccacacccggcagggttagccaaaaagaaaaggatcactgtactagatgtaggggatgcctatttttccataccactgtatgaagattttgaccttttgggacagcggtg

SEQ ID NO: 414862 - DNA, 140 bp, Artificial Sequence
  Synthetic
caccgctgtcccaaaaggtcaaaatcttcatacagtggtatggaaaaataggcatcccctacatctagtacagtgatccttttctttttggctaaccctgccgggtgtggaattcctagccatatcagcagccagggcct

SEQ ID NO: 414863 - DNA, 140 bp, Artificial Sequence
  Synthetic
atacgccatgctgggtctccaaaaagatatatatataaagtcttgccacaaggatggaagggatcaccagcaatttttcaacacacaatgaggcaagtcttagaacccttcagaaaagcacgtacttgggagtcggccat

SEQ ID NO: 414864 - DNA, 140 bp, Artificial Sequence
  Synthetic
atggccgactcccaagtacgtgcttttctgaagggttctaagacttgcctcattgtgtgttgaaaaattgctggtgatcccttccatccttgtggcaagactttatatatatatctttttggagacccagcatggcgtat

SEQ ID NO: 414865 - DNA, 140 bp, Artificial Sequence
  Synthetic
aggccctggctgctgatatgcaatttttcaacacacaatgaggcaagtcttagaacccttcagaaaagcaaacccagatgtcattatcatccaatacatggatgatattttaatagctaggaccttttgggacagcggtg

SEQ ID NO: 414866 - DNA, 140 bp, Artificial Sequence
  Synthetic
caccgctgtcccaaaaggtcctagctattaaaatatcatccatgtattggatgataatgacatctgggtttgcttttctgaagggttctaagacttgcctcattgtgtgttgaaaaattgcatatcagcagccagggcct

SEQ ID NO: 414867 - DNA, 140 bp, Artificial Sequence
  Synthetic
atacgccatgctgggtctccttctgaatggcctagggttctctaccccagatgaaaagttccaaaaagaccctccatttcaatggatgggctatgaactatggccaactaaatggaagctcgtacttgggagtcggccat

SEQ ID NO: 414868 - DNA, 140 bp, Artificial Sequence
  Synthetic
atggccgactcccaagtacgagcttccatttagttggccatagttcatagcccatccattgaaatggagggtctttttggaacttttcatctggggtagagaaccctaggccattcagaaggagacccagcatggcgtat

SEQ ID NO: 414869 - DNA, 140 bp, Artificial Sequence
  Synthetic
atacgccatgctgggtctccacagaaaatacaactgccccagaaagaagtatggacagtcaatgacattcaaaagctagtgggagtcttaaattgggcagcacaaatctatccaggaatacgtacttgggagtcggccat

SEQ ID NO: 414870 - DNA, 140 bp, Artificial Sequence
  Synthetic
atggccgactcccaagtacgtattcctggatagatttgtgctgcccaatttaagactcccactagcttttgaatgtcattgactgtccatacttctttctggggcagttgtattttctgtggagacccagcatggcgtat

SEQ ID NO: 414871 - DNA, 140 bp, Artificial Sequence
  Synthetic
atacgccatgctgggtctccagaagtacagtggacagagttagcagaagcagagctagaagaaaacaaaattatcttaagccaggaacaagaagggtgctattaccaagaagaaaaagaacgtacttgggagtcggccat

SEQ ID NO: 414872 - DNA, 140 bp, Artificial Sequence
  Synthetic
atggccgactcccaagtacgttctttttcttcttggtaatagcacccttcttgttcctggcttaagataattttgttttcttctagctctgcttctgctaactctgtccactgtacttctggagacccagcatggcgtat

SEQ ID NO: 414873 - DNA, 140 bp, Artificial Sequence
  Synthetic
aggccctggctgctgatatgatacccataccaatggggtcagattactagcacaggtagttcagaaaataggaaaagaagcactagtcatctggggacggataccaaaattccacctaccgaccttttgggacagcggtg

SEQ ID NO: 414874 - DNA, 140 bp, Artificial Sequence
  Synthetic
caccgctgtcccaaaaggtcggtaggtggaattttggtatccgtccccagatgactagtgcttcttttcctattttctgaactacctgtgctagtaatctgaccccattggtatgggtatcatatcagcagccagggcct

SEQ ID NO: 414875 - DNA, 140 bp, Artificial Sequence
  Synthetic
atacgccatgctgggtctccggtggaaagagagacctgggagcagtggtgggataactactggcaagtaacatggatcccagagtgggactttgtatctaccccgccactggtcaggctacgtacttgggagtcggccat

SEQ ID NO: 414876 - DNA, 140 bp, Artificial Sequence
  Synthetic
atggccgactcccaagtacgtagcctgaccagtggcggggtagatacaaagtcccactctgggatccatgttacttgccagtagttatcccaccactgctcccaggtctctctttccaccggagacccagcatggcgtat

SEQ ID NO: 414877 - DNA, 140 bp, Artificial Sequence
  Synthetic
aggccctggctgctgatatgcatggatcccagagtgggactttgtatctaccccgccactggtcaggctaacattcaacctggtaggagatcctataccagatgcagagaccttctacacgaccttttgggacagcggtg

SEQ ID NO: 414878 - DNA, 140 bp, Artificial Sequence
  Synthetic
caccgctgtcccaaaaggtcgtgtagaaggtctctgcatctggtataggatctcctaccaggttgaatgttagcctgaccagtggcggggtagatacaaagtcccactctgggatccatgcatatcagcagccagggcct

SEQ ID NO: 414879 - DNA, 140 bp, Artificial Sequence
  Synthetic
atacgccatgctgggtctccacattcaacctggtaggagatcctataccagatgcagagaccttctacacagatggatcatgcaataggcagtcaaaagaaggaaaagcaggatatgtaacgtacttgggagtcggccat

SEQ ID NO: 414880 - DNA, 140 bp, Artificial Sequence
  Synthetic
atggccgactcccaagtacgttacatatcctgcttttccttcttttgactgcctattgcatgatccatctgtgtagaaggtctctgcatctggtataggatctcctaccaggttgaatgtggagacccagcatggcgtat

SEQ ID NO: 414881 - DNA, 140 bp, Artificial Sequence
  Synthetic
atacgccatgctgggtctcccaagcagaattagaagcctttgcaatggcgctggcagactcaggtacaaaggttaatatcatagtagactcacaatatgtaatgggaatagtggcaagcccgtacttgggagtcggccat

SEQ ID NO: 414882 - DNA, 140 bp, Artificial Sequence
  Synthetic
atggccgactcccaagtacgggcttgccactattcccattacatattgtgagtctactatgatattaacctttgtacctgagtctgccagcgccattgcaaaggcttctaattctgcttgggagacccagcatggcgtat

SEQ ID NO: 414883 - DNA, 140 bp, Artificial Sequence
  Synthetic
aggccctggctgctgatatgggttaatatcatagtagactcacaatatgtaatgggaatagtggcaagccaaccaacagaatcagaaagtagaatagtaaaccaaatcattgaggacatggaccttttgggacagcggtg

SEQ ID NO: 414884 - DNA, 140 bp, Artificial Sequence
  Synthetic
caccgctgtcccaaaaggtccatgtcctcaatgatttggtttactattctactttctgattctgttggttggcttgccactattcccattacatattgtgagtctactatgatattaacccatatcagcagccagggcct

SEQ ID NO: 414885 - DNA, 140 bp, Artificial Sequence
  Synthetic
atacgccatgctgggtctccaggaggaaaccaggaagtagaccatttagtgagtcagggaattagacagatattattcatagaaaagatagagcctgctcaagaagaacatgaaaaatatcgtacttgggagtcggccat

SEQ ID NO: 414886 - DNA, 140 bp, Artificial Sequence
  Synthetic
atggccgactcccaagtacgatatttttcatgttcttcttgagcaggctctatcttttctatgaataatatctgtctaattccctgactcactaaatggtctacttcctggtttcctcctggagacccagcatggcgtat

SEQ ID NO: 414887 - DNA, 140 bp, Artificial Sequence
  Synthetic
atacgccatgctgggtctccggcaagacagatagtaaacacatgtccccaatgtcaacaaaagggagaggccatacatgggcaagtgaatgcagaaataggtgtctggcaaatggattgccgtacttgggagtcggccat

SEQ ID NO: 414888 - DNA, 140 bp, Artificial Sequence
  Synthetic
atggccgactcccaagtacggcaatccatttgccagacacctatttctgcattcacttgcccatgtatggcctctcccttttgttgacattggggacatgtgtttactatctgtcttgccggagacccagcatggcgtat

SEQ ID NO: 414889 - DNA, 140 bp, Artificial Sequence
  Synthetic
aggccctggctgctgatatgtcttcctattaaaactggccagtaggtggccaataacacacttgcacacagacaatggctccaacttcacttcacaggaagtgaagatggtggcatggtggaccttttgggacagcggtg

SEQ ID NO: 414890 - DNA, 140 bp, Artificial Sequence
  Synthetic
caccgctgtcccaaaaggtccaccatgccaccatcttcacttcctgtgaagtgaagttggagccattgtctgtgtgcaagtgtgttattggccacctactggccagttttaataggaagacatatcagcagccagggcct

SEQ ID NO: 414891 - DNA, 140 bp, Artificial Sequence
  Synthetic
atacgccatgctgggtctccgagtagtagaagcaatgaaccatcacctaaagaaccagataagtagaattagagaacaggcaaacacagtagaaacaatagtactaatggcagttcattgcgtacttgggagtcggccat

SEQ ID NO: 414892 - DNA, 140 bp, Artificial Sequence
  Synthetic
atggccgactcccaagtacgcaatgaactgccattagtactattgtttctactgtgtttgcctgttctctaattctacttatctggttctttaggtgatggttcattgcttctactactcggagacccagcatggcgtat

SEQ ID NO: 414893 - DNA, 140 bp, Artificial Sequence
  Synthetic
aggccctggctgctgatatgagagaacaggcaaacacagtagaaacaatagtactaatggcagttcattgcatgaattttaaaagaaggggaggaataggggatatgaccccagcagaaagaccttttgggacagcggtg

SEQ ID NO: 414894 - DNA, 140 bp, Artificial Sequence
  Synthetic
caccgctgtcccaaaaggtctttctgctggggtcatatcccctattcctccccttcttttaaaattcatgcaatgaactgccattagtactattgtttctactgtgtttgcctgttctctcatatcagcagccagggcct

SEQ ID NO: 414895 - DNA, 140 bp, Artificial Sequence
  Synthetic
atacgccatgctgggtctccaaaaattcaaattttaaaaatttccaggtctattacagggaaggcagagaccagctgtggaaaggacctggagagctactgtggaagggagaaggagcagcgtacttgggagtcggccat

SEQ ID NO: 414896 - DNA, 140 bp, Artificial Sequence
  Synthetic
atggccgactcccaagtacgctgctccttctcccttccacagtagctctccaggtcctttccacagctggtctctgccttccctgtaatagacctggaaatttttaaaatttgaatttttggagacccagcatggcgtat

SEQ ID NO: 414897 - DNA, 140 bp, Artificial Sequence
  Synthetic
atacgccatgctgggtctcctcatagtcaaggtagggacagacataaaagtaataccaagaaggaaggccaagattatcagagactatggaggaagacaagaactggatagtagtccccacgtacttgggagtcggccat

SEQ ID NO: 414898 - DNA, 140 bp, Artificial Sequence
  Synthetic
atggccgactcccaagtacgtggggactactatccagttcttgtcttcctccatagtctctgataatcttggccttccttcttggtattacttttatgtctgtccctaccttgactatgaggagacccagcatggcgtat

SEQ ID NO: 414899 - DNA, 140 bp, Artificial Sequence
  Synthetic
atacgccatgctgggtctccctaaaatacagaacaaaagacctagaggaggtgcgctatgttccccaccacaaggtgggatgggcatggtggacttgcagcagggtaatattccctctaacgtacttgggagtcggccat

SEQ ID NO: 414900 - DNA, 140 bp, Artificial Sequence
  Synthetic
atggccgactcccaagtacgttagagggaatattaccctgctgcaagtccaccatgcccatcccaccttgtggtggggaacatagcgcacctcctctaggtcttttgttctgtattttagggagacccagcatggcgtat

SEQ ID NO: 414901 - DNA, 140 bp, Artificial Sequence
  Synthetic
aggccctggctgctgatatgcaaggtgggatgggcatggtggacttgcagcagggtaatattccctctaaaaggacatagtcatctagagatacaggcatattggaacctaacaccagaagaccttttgggacagcggtg

SEQ ID NO: 414902 - DNA, 140 bp, Artificial Sequence
  Synthetic
caccgctgtcccaaaaggtcttctggtgttaggttccaatatgcctgtatctctagatgactatgtccttttagagggaatattaccctgctgcaagtccaccatgcccatcccaccttgcatatcagcagccagggcct

SEQ ID NO: 414903 - DNA, 140 bp, Artificial Sequence
  Synthetic
aggccctggctgctgatatgcttatttctcttgctttacggcaggtgaagtaagaagagccatcagaggggaaaagttattgtcctgctgcaactatccccaagctcataaagtacaggtgaccttttgggacagcggtg

SEQ ID NO: 414904 - DNA, 140 bp, Artificial Sequence
  Synthetic
caccgctgtcccaaaaggtcacctgtactttatgagcttggggatagttgcagcaggacaataacttttcccctctgatggctcttcttacttcacctgccgtaaagcaagagaaataagcatatcagcagccagggcct

SEQ ID NO: 414905 - DNA, 140 bp, Artificial Sequence
  Synthetic
atacgccatgctgggtctccgaaaagttattgtcctgctgcaactatccccaagctcataaagtacaggtaccatcactccaatacctagccctagtggtagtgcaacaaaatgacagaccgtacttgggagtcggccat

SEQ ID NO: 414906 - DNA, 140 bp, Artificial Sequence
  Synthetic
atggccgactcccaagtacggtctgtcattttgttgcactaccactagggctaggtattggagtgatggtacctgtactttatgagcttggggatagttgcagcaggacaataacttttcggagacccagcatggcgtat

SEQ ID NO: 414907 - DNA, 140 bp, Artificial Sequence
  Synthetic
atacgccatgctgggtctccggccttcgagtggctagacaggactatagaagccttgaacagagaggcagtgaaccatctgccccgagagctcattttccaggtgtggcaaaggtcctggcgtacttgggagtcggccat

SEQ ID NO: 414908 - DNA, 140 bp, Artificial Sequence
  Synthetic
atggccgactcccaagtacgccaggacctttgccacacctggaaaatgagctctcggggcagatggttcactgcctctctgttcaaggcttctatagtcctgtctagccactcgaaggccggagacccagcatggcgtat

SEQ ID NO: 414909 - DNA, 140 bp, Artificial Sequence
  Synthetic
aggccctggctgctgatatgtgaaccatctgccccgagagctcattttccaggtgtggcaaaggtcctggagatactggcatgatgagcaagggatgtcaccaagctacacaaagtataggaccttttgggacagcggtg

SEQ ID NO: 414910 - DNA, 140 bp, Artificial Sequence
  Synthetic
caccgctgtcccaaaaggtcctatactttgtgtagcttggtgacatcccttgctcatcatgccagtatctccaggacctttgccacacctggaaaatgagctctcggggcagatggttcacatatcagcagccagggcct

SEQ ID NO: 414911 - DNA, 140 bp, Artificial Sequence
  Synthetic
atacgccatgctgggtctccgcacttgcctgggggagggacatgggccgggaggatggagaccaggacctccccctcctccccctccaggtctagtctaatgactgaagtaccaacagagcgtacttgggagtcggccat

SEQ ID NO: 414912 - DNA, 140 bp, Artificial Sequence
  Synthetic
atggccgactcccaagtacgctctgttggtacttcagtcattagactagacctggagggggaggagggggaggtcctggtctccatcctcccggcccatgtccctcccccaggcaagtgcggagacccagcatggcgtat

SEQ ID NO: 414913 - DNA, 140 bp, Artificial Sequence
  Synthetic
aggccctggctgctgatatgccccctcctccccctccaggtctagtctaatgactgaagtaccaacagagtttcccccagaagatgggaccccgcagagggaactagggggtgactgggtgaccttttgggacagcggtg

SEQ ID NO: 414914 - DNA, 140 bp, Artificial Sequence
  Synthetic
caccgctgtcccaaaaggtcacccagtcaccccctagttccctctgcggggtcccatcttctgggggaaactctgttggtacttcagtcattagactagacctggagggggaggagggggcatatcagcagccagggcct

SEQ ID NO: 414915 - DNA, 140 bp, Artificial Sequence
  Synthetic
atacgccatgctgggtctcccccgcccgctaattgctcttggcaactatatctatactagacatggagacacccttgaaggagcaagaaagctcattgatatcttacagcgagccctcttcgtacttgggagtcggccat

SEQ ID NO: 414916 - DNA, 140 bp, Artificial Sequence
  Synthetic
atggccgactcccaagtacgaagagggctcgctgtaagatatcaatgagctttcttgctccttcaagggtgtctccatgtctagtatagatatagttgccaagagcaattagcgggcgggggagacccagcatggcgtat

SEQ ID NO: 414917 - DNA, 140 bp, Artificial Sequence
  Synthetic
aggccctggctgctgatatgacccttgaaggagcaagaaagctcattgatatcttacagcgagccctcttcctgcacttcaaggcaggatgcagccgatcaaaggttaatcagacaaggggaccttttgggacagcggtg

SEQ ID NO: 414918 - DNA, 140 bp, Artificial Sequence
  Synthetic
caccgctgtcccaaaaggtccccttgtctgattaacctttgatcggctgcatcctgccttgaagtgcaggaagagggctcgctgtaagatatcaatgagctttcttgctccttcaagggtcatatcagcagccagggcct

SEQ ID NO: 414919 - DNA, 140 bp, Artificial Sequence
  Synthetic
atacgccatgctgggtctccatgttattgtaagcagtgctgttaccattgccagctgtgctttttaaacaaggggctcgggatatggtatgaccgaaagggcagacggagaagaactcctcgtacttgggagtcggccat

SEQ ID NO: 414920 - DNA, 140 bp, Artificial Sequence
  Synthetic
atggccgactcccaagtacgaggagttcttctccgtctgccctttcggtcataccatatcccgagccccttgtttaaaaagcacagctggcaatggtaacagcactgcttacaataacatggagacccagcatggcgtat

SEQ ID NO: 414921 - DNA, 140 bp, Artificial Sequence
  Synthetic
atacgccatgctgggtctccaagaaaattaaggctcatccgtcttctgcatcagacaagtgagtaaaatgtgtggtaagattttattaattgttgccagcttgctagctagtgcttgcttcgtacttgggagtcggccat

SEQ ID NO: 414922 - DNA, 140 bp, Artificial Sequence
  Synthetic
atggccgactcccaagtacgaagcaagcactagctagcaagctggcaacaattaataaaatcttaccacacattttactcacttgtctgatgcagaagacggatgagccttaattttcttggagacccagcatggcgtat

SEQ ID NO: 414923 - DNA, 140 bp, Artificial Sequence
  Synthetic
aggccctggctgctgatatgtgtggtaagattttattaattgttgccagcttgctagctagtgcttgcttagtgcattgcaaaaaacaacaatatgtgactgttttctatggcgtgcccggaccttttgggacagcggtg

SEQ ID NO: 414924 - DNA, 140 bp, Artificial Sequence
  Synthetic
caccgctgtcccaaaaggtccgggcacgccatagaaaacagtcacatattgttgttttttgcaatgcactaagcaagcactagctagcaagctggcaacaattaataaaatcttaccacacatatcagcagccagggcct

SEQ ID NO: 414925 - DNA, 140 bp, Artificial Sequence
  Synthetic
atacgccatgctgggtctccacttggggaaccatacagtgcttaccagacaataatgattatcaggaaatagccttgaatgtgacagaggctttcgacgcatgggataatacagtaacagcgtacttgggagtcggccat

SEQ ID NO: 414926 - DNA, 140 bp, Artificial Sequence
  Synthetic
atggccgactcccaagtacgctgttactgtattatcccatgcgtcgaaagcctctgtcacattcaaggctatttcctgataatcattattgtctggtaagcactgtatggttccccaagtggagacccagcatggcgtat

SEQ ID NO: 414927 - DNA, 140 bp, Artificial Sequence
  Synthetic
aggccctggctgctgatatgagccttgaatgtgacagaggctttcgacgcatgggataatacagtaacagaacaggcaatagaagatgtctggagtctatttgagacatcaataaaaccagaccttttgggacagcggtg

SEQ ID NO: 414928 - DNA, 140 bp, Artificial Sequence
  Synthetic
caccgctgtcccaaaaggtctggttttattgatgtctcaaatagactccagacatcttctattgcctgttctgttactgtattatcccatgcgtcgaaagcctctgtcacattcaaggctcatatcagcagccagggcct

SEQ ID NO: 414929 - DNA, 140 bp, Artificial Sequence
  Synthetic
atacgccatgctgggtctcccaacccaaccacaccagcaggcacaacaaagtccttcccaaccccaggagagaacaaaaccataaatgaaaatgatacatgcatacgcgaaaacaactgtcgtacttgggagtcggccat

SEQ ID NO: 414930 - DNA, 140 bp, Artificial Sequence
  Synthetic
atggccgactcccaagtacgacagttgttttcgcgtatgcatgtatcattttcatttatggttttgttctctcctggggttgggaaggactttgttgtgcctgctggtgtggttgggttgggagacccagcatggcgtat

SEQ ID NO: 414931 - DNA, 140 bp, Artificial Sequence
  Synthetic
aggccctggctgctgatatgagaacaaaaccataaatgaaaatgatacatgcatacgcgaaaacaactgtacaggattgggggaggaagagatggtcaactgtcagttcaatatgacagggaccttttgggacagcggtg

SEQ ID NO: 414932 - DNA, 140 bp, Artificial Sequence
  Synthetic
caccgctgtcccaaaaggtccctgtcatattgaactgacagttgaccatctcttcctcccccaatcctgtacagttgttttcgcgtatgcatgtatcattttcatttatggttttgttctcatatcagcagccagggcct

SEQ ID NO: 414933 - DNA, 140 bp, Artificial Sequence
  Synthetic
atacgccatgctgggtctccatgtagtttgtgaaccaaataatcagaccgcagatgggaaagaaaaatgttacatgaaccattgcaacacatcagtcatcaaagaatcatgtgataagcacgtacttgggagtcggccat

SEQ ID NO: 414934 - DNA, 140 bp, Artificial Sequence
  Synthetic
atggccgactcccaagtacgtgcttatcacatgattctttgatgactgatgtgttgcaatggttcatgtaacatttttctttcccatctgcggtctgattatttggttcacaaactacatggagacccagcatggcgtat

SEQ ID NO: 414935 - DNA, 140 bp, Artificial Sequence
  Synthetic
aggccctggctgctgatatgtacatgaaccattgcaacacatcagtcatcaaagaatcatgtgataagcactattgggatactataagatttagatattgtgcaccaccgggttatgcccgaccttttgggacagcggtg

SEQ ID NO: 414936 - DNA, 140 bp, Artificial Sequence
  Synthetic
caccgctgtcccaaaaggtcgggcataacccggtggtgcacaatatctaaatcttatagtatcccaatagtgcttatcacatgattctttgatgactgatgtgttgcaatggttcatgtacatatcagcagccagggcct

SEQ ID NO: 414937 - DNA, 140 bp, Artificial Sequence
  Synthetic
atacgccatgctgggtctccaaggtagtagtttcttcatgcacaaggatgatggagacgcaaacctccacttggtttggctttaatggcaccagggcagagaacagaacatatatctattcgtacttgggagtcggccat

SEQ ID NO: 414938 - DNA, 140 bp, Artificial Sequence
  Synthetic
atggccgactcccaagtacgaatagatatatgttctgttctctgccctggtgccattaaagccaaaccaagtggaggtttgcgtctccatcatccttgtgcatgaagaaactactaccttggagacccagcatggcgtat

SEQ ID NO: 414939 - DNA, 140 bp, Artificial Sequence
  Synthetic
aggccctggctgctgatatgttggtttggctttaatggcaccagggcagagaacagaacatatatctattggcatggcagggataataggactatcatcagcttaaacaagtattataatgaccttttgggacagcggtg

SEQ ID NO: 414940 - DNA, 140 bp, Artificial Sequence
  Synthetic
caccgctgtcccaaaaggtcattataatacttgtttaagctgatgatagtcctattatccctgccatgccaatagatatatgttctgttctctgccctggtgccattaaagccaaaccaacatatcagcagccagggcct

SEQ ID NO: 414941 - DNA, 140 bp, Artificial Sequence
  Synthetic
atacgccatgctgggtctccactcctttcaggggcaaggtttcactcccagccagtaattaatacaaaacctaagcaagcatggtgctggttcaaaggcgagtggaaaaaggccttggagcgtacttgggagtcggccat

SEQ ID NO: 414942 - DNA, 140 bp, Artificial Sequence
  Synthetic
atggccgactcccaagtacgctccaaggcctttttccactcgcctttgaaccagcaccatgcttgcttaggttttgtattaattactggctgggagtgaaaccttgcccctgaaaggagtggagacccagcatggcgtat

SEQ ID NO: 414943 - DNA, 140 bp, Artificial Sequence
  Synthetic
aggccctggctgctgatatgctaagcaagcatggtgctggttcaaaggcgagtggaaaaaggccttggaggaggtgaaagaaacccttaaagaacatcccaggtatagaggacccaatgagaccttttgggacagcggtg

SEQ ID NO: 414944 - DNA, 140 bp, Artificial Sequence
  Synthetic
caccgctgtcccaaaaggtctcattgggtcctctatacctgggatgttctttaagggtttctttcacctcctccaaggcctttttccactcgcctttgaaccagcaccatgcttgcttagcatatcagcagccagggcct

SEQ ID NO: 414945 - DNA, 140 bp, Artificial Sequence
  Synthetic
atacgccatgctgggtctcctgaaatacatgtggactaactgcagaggagaatttctctactgcaacatggattggttcctcaattgggtaggagaaagtaaaggtaaagtgcgcaattacgtacttgggagtcggccat

SEQ ID NO: 414946 - DNA, 140 bp, Artificial Sequence
  Synthetic
atggccgactcccaagtacgtaattgcgcactttacctttactttctcctacccaattgaggaaccaatccatgttgcagtagagaaattctcctctgcagttagtccacatgtatttcaggagacccagcatggcgtat

SEQ ID NO: 414947 - DNA, 140 bp, Artificial Sequence
  Synthetic
aggccctggctgctgatatggattggttcctcaattgggtaggagaaagtaaaggtaaagtgcgcaattatgtgccgtgccatataagtcaaataattagaacctggcacaaggtagggagaccttttgggacagcggtg

SEQ ID NO: 414948 - DNA, 140 bp, Artificial Sequence
  Synthetic
caccgctgtcccaaaaggtctccctaccttgtgccaggttctaattatttgacttatatggcacggcacataattgcgcactttacctttactttctcctacccaattgaggaaccaatccatatcagcagccagggcct

SEQ ID NO: 414949 - DNA, 140 bp, Artificial Sequence
  Synthetic
atacgccatgctgggtctccgtgaccagcataattgccaacattgacatgggtaaaaactcaacaaatattacctttagtgcagaggtggcagaactataccgattagaattgggagattcgtacttgggagtcggccat

SEQ ID NO: 414950 - DNA, 140 bp, Artificial Sequence
  Synthetic
atggccgactcccaagtacgaatctcccaattctaatcggtatagttctgccacctctgcactaaaggtaatatttgttgagtttttacccatgtcaatgttggcaattatgctggtcacggagacccagcatggcgtat

SEQ ID NO: 414951 - DNA, 140 bp, Artificial Sequence
  Synthetic
aggccctggctgctgatatgtacctttagtgcagaggtggcagaactataccgattagaattgggagattataaattagtagaagtgacaccaattggttttgcacctacatcacaaaaagaccttttgggacagcggtg

SEQ ID NO: 414952 - DNA, 140 bp, Artificial Sequence
  Synthetic
caccgctgtcccaaaaggtctttttgtgatgtaggtgcaaaaccaattggtgtcacttctactaatttataatctcccaattctaatcggtatagttctgccacctctgcactaaaggtacatatcagcagccagggcct

SEQ ID NO: 414953 - DNA, 140 bp, Artificial Sequence
  Synthetic
atacgccatgctgggtctccgttcttgggttttctcacaacagcaggagctgcaatgggcgcggcgtccttgacgctgtcggctcagtctcggactttattggctgggatagtgcagcaacgtacttgggagtcggccat

SEQ ID NO: 414954 - DNA, 140 bp, Artificial Sequence
  Synthetic
atggccgactcccaagtacgttgctgcactatcccagccaataaagtccgagactgagccgacagcgtcaaggacgccgcgcccattgcagctcctgctgttgtgagaaaacccaagaacggagacccagcatggcgtat

SEQ ID NO: 414955 - DNA, 140 bp, Artificial Sequence
  Synthetic
aggccctggctgctgatatgtgacgctgtcggctcagtctcggactttattggctgggatagtgcagcaacagcaacagctgttagacgtggtcaagagacaacaagaaatgttgcgactgaccttttgggacagcggtg

SEQ ID NO: 414956 - DNA, 140 bp, Artificial Sequence
  Synthetic
caccgctgtcccaaaaggtcagtcgcaacatttcttgttgtctcttgaccacgtctaacagctgttgctgttgctgcactatcccagccaataaagtccgagactgagccgacagcgtcacatatcagcagccagggcct

SEQ ID NO: 414957 - DNA, 140 bp, Artificial Sequence
  Synthetic
atacgccatgctgggtctccaatacttaaaggaccaggcgcaactaaattcatgggggtgcgcgtttaggcaagtctgccacactactgtaccatgggtaaatgacagcttgtcacctgacgtacttgggagtcggccat

SEQ ID NO: 414958 - DNA, 140 bp, Artificial Sequence
  Synthetic
atggccgactcccaagtacgtcaggtgacaagctgtcatttacccatggtacagtagtgtggcagacttgcctaaacgcgcacccccatgaatttagttgcgcctggtcctttaagtattggagacccagcatggcgtat

SEQ ID NO: 414959 - DNA, 140 bp, Artificial Sequence
  Synthetic
aggccctggctgctgatatgcaagtctgccacactactgtaccatgggtaaatgacagcttgtcacctgattgggataacatgacatggcaacaatgggaacaccaaatcagtttcctaggaccttttgggacagcggtg

SEQ ID NO: 414960 - DNA, 140 bp, Artificial Sequence
  Synthetic
caccgctgtcccaaaaggtcctaggaaactgatttggtgttcccattgttgccatgtcatgttatcccaatcaggtgacaagctgtcatttacccatggtacagtagtgtggcagacttgcatatcagcagccagggcct

SEQ ID NO: 414961 - DNA, 140 bp, Artificial Sequence
  Synthetic
atacgccatgctgggtctccaacatgtatgaattacaaaaattaaatagctgggatgtttttggcaactggtttgatttaacctcctggatcagatatattcagtatggagtttttatagcgtacttgggagtcggccat

SEQ ID NO: 414962 - DNA, 140 bp, Artificial Sequence
  Synthetic
atggccgactcccaagtacgctataaaaactccatactgaatatatctgatccaggaggttaaatcaaaccagttgccaaaaacatcccagctatttaatttttgtaattcatacatgttggagacccagcatggcgtat

SEQ ID NO: 414963 - DNA, 140 bp, Artificial Sequence
  Synthetic
atacgccatgctgggtctcctaatagcagtaatagctcttagaatagtaatatatatagtacagatgttaagtagatttagaaggggctataggcctgttttctcttccccccccggttacgtacttgggagtcggccat

SEQ ID NO: 414964 - DNA, 140 bp, Artificial Sequence
  Synthetic
atggccgactcccaagtacgtaaccggggggggaagagaaaacaggcctatagccccttctaaatctacttaacatctgtactatatatattactattctaagagctattactgctattaggagacccagcatggcgtat

SEQ ID NO: 414965 - DNA, 140 bp, Artificial Sequence
  Synthetic
atacgccatgctgggtctcccttccaacagatccatatccacaaggactgggaacagccagacagagaaggaacagaagaagacgttggagacaacgttggagacagcttgtggccttggcgtacttgggagtcggccat

SEQ ID NO: 414966 - DNA, 140 bp, Artificial Sequence
  Synthetic
atggccgactcccaagtacgccaaggccacaagctgtctccaacgttgtctccaacgtcttcttctgttccttctctgtctggctgttcccagtccttgtggatatggatctgttggaagggagacccagcatggcgtat

SEQ ID NO: 414967 - DNA, 140 bp, Artificial Sequence
  Synthetic
aggccctggctgctgatatggaacagaagaagacgttggagacaacgttggagacagcttgtggccttggccgataagatatattcatttcctgatccgccagctgattcgcctcttgacgaccttttgggacagcggtg

SEQ ID NO: 414968 - DNA, 140 bp, Artificial Sequence
  Synthetic
caccgctgtcccaaaaggtcgtcaagaggcgaatcagctggcggatcaggaaatgaatatatcttatcggccaaggccacaagctgtctccaacgttgtctccaacgtcttcttctgttccatatcagcagccagggcct

SEQ ID NO: 414969 - DNA, 140 bp, Artificial Sequence
  Synthetic
atacgccatgctgggtctcctccaactgatcagagactggctgagagttaaaacagcacacctgcaatatgggtgcgagtggatccaagaagcgttccaagctttcgcaaggactgcgagcgtacttgggagtcggccat

SEQ ID NO: 414970 - DNA, 140 bp, Artificial Sequence
  Synthetic
atggccgactcccaagtacgctcgcagtccttgcgaaagcttggaacgcttcttggatccactcgcacccatattgcaggtgtgctgttttaactctcagccagtctctgatcagttggaggagacccagcatggcgtat

SEQ ID NO: 414971 - DNA, 140 bp, Artificial Sequence
  Synthetic
atacgccatgctgggtctcctcgggaggggaatacttgcagtcccaagaaggatcagacagggggcagagatcgccctcctgtgaggggcagcggtatcagcagggagagtacatgaatacgtacttgggagtcggccat

SEQ ID NO: 414972 - DNA, 140 bp, Artificial Sequence
  Synthetic
atggccgactcccaagtacgtattcatgtactctccctgctgataccgctgcccctcacaggagggcgatctctgccccctgtctgatccttcttgggactgcaagtattcccctcccgaggagacccagcatggcgtat

SEQ ID NO: 414973 - DNA, 140 bp, Artificial Sequence
  Synthetic
atacgccatgctgggtctcccagaatatggatgatgtagatgcagatgatgatgatctagtagggtttcctgttacaagtagagtaccaatgagaacaatgacctataaattggcagtagcgtacttgggagtcggccat

SEQ ID NO: 414974 - DNA, 140 bp, Artificial Sequence
  Synthetic
atggccgactcccaagtacgctactgccaatttataggtcattgttctcattggtactctacttgtaacaggaaaccctactagatcatcatcatctgcatctacatcatccatattctgggagacccagcatggcgtat

SEQ ID NO: 414975 - DNA, 140 bp, Artificial Sequence
  Synthetic
aggccctggctgctgatatggatctagtagggtttcctgttacaagtagagtaccaatgagaacaatgacctataaattggcagtagacatgtcacattttataaaagaaaaagggggacgaccttttgggacagcggtg

SEQ ID NO: 414976 - DNA, 140 bp, Artificial Sequence
  Synthetic
caccgctgtcccaaaaggtcgtccccctttttcttttataaaatgtgacatgtctactgccaatttataggtcattgttctcattggtactctacttgtaacaggaaaccctactagatccatatcagcagccagggcct

SEQ ID NO: 414977 - DNA, 140 bp, Artificial Sequence
  Synthetic
atacgccatgctgggtctcccccctaacaaaagaaaaaatagaggcactaaaagaaatctgtgaaaaaatggaaaaggagggccaactagaagaagcacctccaactaatccttataatacgtacttgggagtcggccat

SEQ ID NO: 414978 - DNA, 140 bp, Artificial Sequence
  Synthetic
atggccgactcccaagtacgtattataaggattagttggaggtgcttcttctagttggccctccttttccattttttcacagatttcttttagtgcctctattttttcttttgttaggggggagacccagcatggcgtat

SEQ ID NO: 414979 - DNA, 140 bp, Artificial Sequence
  Synthetic
atacgccatgctgggtctccatagactttagagaactaaacagggtgactcaagatttcacagaaattcagctaggaattccacacccggcagggttagccaaaaagaaaaggatcactgcgtacttgggagtcggccat

SEQ ID NO: 414980 - DNA, 140 bp, Artificial Sequence
  Synthetic
atggccgactcccaagtacgcagtgatccttttctttttggctaaccctgccgggtgtggaattcctagctgaatttctgtgaaatcttgagtcaccctgtttagttctctaaagtctatggagacccagcatggcgtat

SEQ ID NO: 414981 - DNA, 140 bp, Artificial Sequence
  Synthetic
atacgccatgctgggtctccttctgaatggcctagggttctctaccccagatgaaaagttccaaaaagaccctccgtttcaatggatgggctatgaactatggccaaataaatggaagctcgtacttgggagtcggccat

SEQ ID NO: 414982 - DNA, 140 bp, Artificial Sequence
  Synthetic
atggccgactcccaagtacgagcttccatttatttggccatagttcatagcccatccattgaaacggagggtctttttggaacttttcatctggggtagagaaccctaggccattcagaaggagacccagcatggcgtat

SEQ ID NO: 414983 - DNA, 140 bp, Artificial Sequence
  Synthetic
atacgccatgctgggtctccacagaaaatacaattgcctcagaaagaagtatggacagtcaatgacattcaaaagctagtgggagtcttaaattgggcagcacaaatctatccaggaatacgtacttgggagtcggccat

SEQ ID NO: 414984 - DNA, 140 bp, Artificial Sequence
  Synthetic
atggccgactcccaagtacgtattcctggatagatttgtgctgcccaatttaagactcccactagcttttgaatgtcattgactgtccatacttctttctgaggcaattgtattttctgtggagacccagcatggcgtat

SEQ ID NO: 414985 - DNA, 140 bp, Artificial Sequence
  Synthetic
atacgccatgctgggtctccacattcaacctggtaggagatcctataccagatgcagaaaccttctacacagatggatcatgcaacaggcagtcaaaagaaggaaaagcaggatatgtgacgtacttgggagtcggccat

SEQ ID NO: 414986 - DNA, 140 bp, Artificial Sequence
  Synthetic
atggccgactcccaagtacgtcacatatcctgcttttccttcttttgactgcctgttgcatgatccatctgtgtagaaggtttctgcatctggtataggatctcctaccaggttgaatgtggagacccagcatggcgtat

SEQ ID NO: 414987 - DNA, 140 bp, Artificial Sequence
  Synthetic
atacgccatgctgggtctccagcaagacagatagtaaacacatgtccccaatgtcaacaaaaaggagaggccatacatgggcaagtaaatgcagaaataggtgtctggcaaatggattgccgtacttgggagtcggccat

SEQ ID NO: 414988 - DNA, 140 bp, Artificial Sequence
  Synthetic
atggccgactcccaagtacggcaatccatttgccagacacctatttctgcatttacttgcccatgtatggcctctcctttttgttgacattggggacatgtgtttactatctgtcttgctggagacccagcatggcgtat

SEQ ID NO: 414989 - DNA, 140 bp, Artificial Sequence
  Synthetic
atacgccatgctgggtctccctgaaatatagaacaaaagatctagagaaggtgcgctatgttccccatcacaaggtgggatgggcatggtggacttgcagcagggtaatattccctctagcgtacttgggagtcggccat

SEQ ID NO: 414990 - DNA, 140 bp, Artificial Sequence
  Synthetic
atggccgactcccaagtacgctagagggaatattaccctgctgcaagtccaccatgcccatcccaccttgtgatggggaacatagcgcaccttctctagatcttttgttctatatttcagggagacccagcatggcgtat

SEQ ID NO: 414991 - DNA, 140 bp, Artificial Sequence
  Synthetic
aggccctggctgctgatatgcaaggtgggatgggcatggtggacttgcagcagggtaatattccctctagaaggaaaaagtcatctagagatacaggcatattggaacctaacaccagaggaccttttgggacagcggtg

SEQ ID NO: 414992 - DNA, 140 bp, Artificial Sequence
  Synthetic
caccgctgtcccaaaaggtcctctggtgttaggttccaatatgcctgtatctctagatgactttttccttctagagggaatattaccctgctgcaagtccaccatgcccatcccaccttgcatatcagcagccagggcct

SEQ ID NO: 414993 - DNA, 140 bp, Artificial Sequence
  Synthetic
atacgccatgctgggtctccgttctggacagatgttaccccagactatgcagacatcctaatacatagcacttatttctcttgctttacggcaggtgaagtaagaagagccatcagagggcgtacttgggagtcggccat

SEQ ID NO: 414994 - DNA, 140 bp, Artificial Sequence
  Synthetic
atggccgactcccaagtacgccctctgatggctcttcttacttcacctgccgtaaagcaagagaaataagtgctatgtattaggatgtctgcatagtctggggtaacatctgtccagaacggagacccagcatggcgtat

SEQ ID NO: 414995 - DNA, 140 bp, Artificial Sequence
  Synthetic
atacgccatgctgggtctccgaaaagttattgtcctgctgcaactatccccaagctcataaagtacaggtaccatcactccaatacctagccttagtggtagtgcaacaaaatggcagaccgtacttgggagtcggccat

SEQ ID NO: 414996 - DNA, 140 bp, Artificial Sequence
  Synthetic
atggccgactcccaagtacggtctgccattttgttgcactaccactaaggctaggtattggagtgatggtacctgtactttatgagcttggggatagttgcagcaggacaataacttttcggagacccagcatggcgtat

SEQ ID NO: 414997 - DNA, 140 bp, Artificial Sequence
  Synthetic
atacgccatgctgggtctccgcacttgcctgggggagggacacgggccgggaggatggagaccaggacctccccctcctccccctccaggtctagtctaatgactgaagcaccaacagagcgtacttgggagtcggccat

SEQ ID NO: 414998 - DNA, 140 bp, Artificial Sequence
  Synthetic
atggccgactcccaagtacgctctgttggtgcttcagtcattagactagacctggagggggaggagggggaggtcctggtctccatcctcccggcccgtgtccctcccccaggcaagtgcggagacccagcatggcgtat

SEQ ID NO: 414999 - DNA, 140 bp, Artificial Sequence
  Synthetic
aggccctggctgctgatatgccccctcctccccctccaggtctagtctaatgactgaagcaccaacagagtttcccccagaagatgggaccccgcagagggaactagggggtgactggatgaccttttgggacagcggtg

SEQ ID NO: 415000 - DNA, 140 bp, Artificial Sequence
  Synthetic
caccgctgtcccaaaaggtcatccagtcaccccctagttccctctgcggggtcccatcttctgggggaaactctgttggtgcttcagtcattagactagacctggagggggaggagggggcatatcagcagccagggcct

SEQ ID NO: 415001 - DNA, 140 bp, Artificial Sequence
  Synthetic
atacgccatgctgggtctcccccgcccgctaatcgctcttggcaactatatctatgctagacatggagacacgcttgaaggcgcaagaaagctcgttgatatcttacagcgagtcctcttcgtacttgggagtcggccat

SEQ ID NO: 415002 - DNA, 140 bp, Artificial Sequence
  Synthetic
atggccgactcccaagtacgaagaggactcgctgtaagatatcaacgagctttcttgcgccttcaagcgtgtctccatgtctagcatagatatagttgccaagagcgattagcgggcgggggagacccagcatggcgtat

SEQ ID NO: 415003 - DNA, 140 bp, Artificial Sequence
  Synthetic
aggccctggctgctgatatgacgcttgaaggcgcaagaaagctcgttgatatcttacagcgagtcctcttcctgcacttcaaagcaggatgcagccgaccaaaggttaatcagacaaggggaccttttgggacagcggtg

SEQ ID NO: 415004 - DNA, 140 bp, Artificial Sequence
  Synthetic
caccgctgtcccaaaaggtccccttgtctgattaacctttggtcggctgcatcctgctttgaagtgcaggaagaggactcgctgtaagatatcaacgagctttcttgcgccttcaagcgtcatatcagcagccagggcct

SEQ ID NO: 415005 - DNA, 140 bp, Artificial Sequence
  Synthetic
aggccctggctgctgatatgtgtggtaagattttattaattgttgccagcttgctagctagtgcttgcttagtatattgcaaaaaacaacaatatgtgactgttttctatggcgtgcccggaccttttgggacagcggtg

SEQ ID NO: 415006 - DNA, 140 bp, Artificial Sequence
  Synthetic
caccgctgtcccaaaaggtccgggcacgccatagaaaacagtcacatattgttgttttttgcaatatactaagcaagcactagctagcaagctggcaacaattaataaaatcttaccacacatatcagcagccagggcct

SEQ ID NO: 415007 - DNA, 140 bp, Artificial Sequence
  Synthetic
aggccctggctgctgatatgggctgagtgaaggcagtaagggcggcaggaacaaaccacgacggagtgctcctagaaaggcgcgggccgaggtaccaaaggcggcgtgtggagcgggagtgaccttttgggacagcggtg

SEQ ID NO: 415008 - DNA, 140 bp, Artificial Sequence
  Synthetic
caccgctgtcccaaaaggtcactcccgctccacacgccgcctttggtacctcggcccgcgcctttctaggagcactccgtcgtggtttgttcctgccgcccttactgccttcactcagcccatatcagcagccagggcct

SEQ ID NO: 415009 - DNA, 140 bp, Artificial Sequence
  Synthetic
atacgccatgctgggtctccgaaaaggcttgttatcctacctttagacaggtagaagattgtgggagatgggcgcgagaaactccgtcttgagagggaaaaaagcagacgaattagaaaacgtacttgggagtcggccat

SEQ ID NO: 415010 - DNA, 140 bp, Artificial Sequence
  Synthetic
atggccgactcccaagtacgttttctaattcgtctgcttttttccctctcaagacggagtttctcgcgcccatctcccacaatcttctacctgtctaaaggtaggataacaagccttttcggagacccagcatggcgtat

SEQ ID NO: 415011 - DNA, 140 bp, Artificial Sequence
  Synthetic
aggccctggctgctgatatgggcgcgagaaactccgtcttgagagggaaaaaagcagacgaattagaaaaagttaggttacggcccggcggaaagaaaaagtacaggttaaaacatattggaccttttgggacagcggtg

SEQ ID NO: 415012 - DNA, 140 bp, Artificial Sequence
  Synthetic
caccgctgtcccaaaaggtccaatatgttttaacctgtactttttctttccgccgggccgtaacctaactttttctaattcgtctgcttttttccctctcaagacggagtttctcgcgcccatatcagcagccagggcct

SEQ ID NO: 415013 - DNA, 140 bp, Artificial Sequence
  Synthetic
atacgccatgctgggtctccgagtcaaaagaaggttgccaaaagattctcagagttttagatccattagtaccaacagggtcagaaaatttaaaaagcctttttaataccgtctgcgtcacgtacttgggagtcggccat

SEQ ID NO: 415014 - DNA, 140 bp, Artificial Sequence
  Synthetic
atggccgactcccaagtacgtgacgcagacggtattaaaaaggctttttaaattttctgaccctgttggtactaatggatctaaaactctgagaatcttttggcaaccttcttttgactcggagacccagcatggcgtat

SEQ ID NO: 415015 - DNA, 140 bp, Artificial Sequence
  Synthetic
aggccctggctgctgatatgaccaacagggtcagaaaatttaaaaagcctttttaataccgtctgcgtcatttggtgcttgcacgcagaagagaaagtgaaagatactgaggaagcaaaggaccttttgggacagcggtg

SEQ ID NO: 415016 - DNA, 140 bp, Artificial Sequence
  Synthetic
caccgctgtcccaaaaggtcctttgcttcctcagtatctttcactttctcttctgcgtgcaagcaccaaatgacgcagacggtattaaaaaggctttttaaattttctgaccctgttggtcatatcagcagccagggcct

SEQ ID NO: 415017 - DNA, 140 bp, Artificial Sequence
  Synthetic
atacgccatgctgggtctccgccaaatacaagtagaccaacagcaccacctagtgggaaaagaggaaactaccccgtgcaacaagcgggtggcaactatgtccatgtgccactgagcccccgtacttgggagtcggccat

SEQ ID NO: 415018 - DNA, 140 bp, Artificial Sequence
  Synthetic
atggccgactcccaagtacgggggctcagtggcacatggacatagttgccacccgcttgttgcacggggtagtttcctcttttcccactaggtggtgctgttggtctacttgtatttggcggagacccagcatggcgtat

SEQ ID NO: 415019 - DNA, 140 bp, Artificial Sequence
  Synthetic
aggccctggctgctgatatgatattaatcaaatgcttaattgtgtgggcgatcaccaagcagctatgcaaataatcagagagattattaatgaagaagcagcagactgggattcgcagcagaccttttgggacagcggtg

SEQ ID NO: 415020 - DNA, 140 bp, Artificial Sequence
  Synthetic
caccgctgtcccaaaaggtctgctgcgaatcccagtctgctgcttcttcattaataatctctctgattatttgcatagctgcttggtgatcgcccacacaattaagcatttgattaatatcatatcagcagccagggcct

SEQ ID NO: 415021 - DNA, 140 bp, Artificial Sequence
  Synthetic
atacgccatgctgggtctccctgacatagcaggaacaacaagcacagtagatgaacagatccagtggatgtataggccacaaaatcccgtaccggtagggaacatctacagaagatggatcgtacttgggagtcggccat

SEQ ID NO: 415022 - DNA, 140 bp, Artificial Sequence
  Synthetic
atggccgactcccaagtacgatccatcttctgtagatgttccctaccggtacgggattttgtggcctatacatccactggatctgttcatctactgtgcttgttgttcctgctatgtcagggagacccagcatggcgtat

SEQ ID NO: 415023 - DNA, 140 bp, Artificial Sequence
  Synthetic
aggccctggctgctgatatgtataggccacaaaatcccgtaccggtagggaacatctacagaagatggatccaaatagggctgcaaaagtgtgtcagaaagtacaacccaactaacatctgaccttttgggacagcggtg

SEQ ID NO: 415024 - DNA, 140 bp, Artificial Sequence
  Synthetic
caccgctgtcccaaaaggtcagatgttagttgggttgtactttctgacacacttttgcagccctatttggatccatcttctgtagatgttccctaccggtacgggattttgtggcctatacatatcagcagccagggcct

SEQ ID NO: 415025 - DNA, 140 bp, Artificial Sequence
  Synthetic
atacgccatgctgggtctccttctacaaaagcttgagggcagaacaaacagacccagcagtaaaaaattggatgacccaaacgctgctaatacagaatgccaacccagactgcaagttagcgtacttgggagtcggccat

SEQ ID NO: 415026 - DNA, 140 bp, Artificial Sequence
  Synthetic
atggccgactcccaagtacgctaacttgcagtctgggttggcattctgtattagcagcgtttgggtcatccaattttttactgctgggtctgtttgttctgccctcaagcttttgtagaaggagacccagcatggcgtat

SEQ ID NO: 415027 - DNA, 140 bp, Artificial Sequence
  Synthetic
aggccctggctgctgatatggatgacccaaacgctgctaatacagaatgccaacccagactgcaagttagtactaaaaggactggggatgaatcccaccctagaagagatgctaaccgccgaccttttgggacagcggtg

SEQ ID NO: 415028 - DNA, 140 bp, Artificial Sequence
  Synthetic
caccgctgtcccaaaaggtcggcggttagcatctcttctagggtgggattcatccccagtccttttagtactaacttgcagtctgggttggcattctgtattagcagcgtttgggtcatccatatcagcagccagggcct

SEQ ID NO: 415029 - DNA, 140 bp, Artificial Sequence
  Synthetic
atacgccatgctgggtctcccctaaaagaggctatgggaccaagccctatcccatttgcagcagcccaacaaagaaaggcaattaggtattggaactgtggaaaggagggacactcggcacgtacttgggagtcggccat

SEQ ID NO: 415030 - DNA, 140 bp, Artificial Sequence
  Synthetic
atggccgactcccaagtacgtgccgagtgtccctcctttccacagttccaatacctaattgcctttctttgttgggctgctgcaaatgggatagggcttggtcccatagcctcttttaggggagacccagcatggcgtat

SEQ ID NO: 415031 - DNA, 140 bp, Artificial Sequence
  Synthetic
aggccctggctgctgatatgaaagaaaggcaattaggtattggaactgtggaaaggagggacactcggcaagacagtgccgagcacctagaagacagggctgctggaagtgtggcaagccgaccttttgggacagcggtg

SEQ ID NO: 415032 - DNA, 140 bp, Artificial Sequence
  Synthetic
caccgctgtcccaaaaggtcggcttgccacacttccagcagccctgtcttctaggtgctcggcactgtcttgccgagtgtccctcctttccacagttccaatacctaattgcctttctttcatatcagcagccagggcct

SEQ ID NO: 415033 - DNA, 140 bp, Artificial Sequence
  Synthetic
atacgccatgctgggtctcctgggcccacggggaaagaagcctcgcaacttccccgtgacccaagcccctcaggggctgataccaacagcacctccggcagatccagcagcggaactgttcgtacttgggagtcggccat

SEQ ID NO: 415034 - DNA, 140 bp, Artificial Sequence
  Synthetic
atggccgactcccaagtacgaacagttccgctgctggatctgccggaggtgctgttggtatcagcccctgaggggcttgggtcacggggaagttgcgaggcttctttccccgtgggcccaggagacccagcatggcgtat

SEQ ID NO: 415035 - DNA, 140 bp, Artificial Sequence
  Synthetic
aggccctggctgctgatatgcaggggctgataccaacagcacctccggcagatccagcagcggaactgttggagagatatatgcagcaagggagaaagcagagggagcagagggagagacgaccttttgggacagcggtg

SEQ ID NO: 415036 - DNA, 140 bp, Artificial Sequence
  Synthetic
caccgctgtcccaaaaggtcgtctctccctctgctccctctgctttctcccttgctgcatatatctctccaacagttccgctgctggatctgccggaggtgctgttggtatcagcccctgcatatcagcagccagggcct

SEQ ID NO: 415037 - DNA, 140 bp, Artificial Sequence
  Synthetic
atacgccatgctgggtctcccctcacagagaggagacagaggacttgctgcacctcaattctctctttggaaaagaccagtagtcacagcgtacatcgaggatcagccggtagaagtcttcgtacttgggagtcggccat

SEQ ID NO: 415038 - DNA, 140 bp, Artificial Sequence
  Synthetic
atggccgactcccaagtacgaagacttctaccggctgatcctcgatgtacgctgtgactactggtcttttccaaagagagaattgaggtgcagcaagtcctctgtctcctctctgtgaggggagacccagcatggcgtat

SEQ ID NO: 415039 - DNA, 140 bp, Artificial Sequence
  Synthetic
aggccctggctgctgatatgaaaagaccagtagtcacagcgtacatcgaggatcagccggtagaagtcttactagacacaggggctgatgactcaatagtagcaggaatagaattagggggaccttttgggacagcggtg

SEQ ID NO: 415040 - DNA, 140 bp, Artificial Sequence
  Synthetic
caccgctgtcccaaaaggtccccctaattctattcctgctactattgagtcatcagcccctgtgtctagtaagacttctaccggctgatcctcgatgtacgctgtgactactggtcttttcatatcagcagccagggcct

SEQ ID NO: 415041 - DNA, 140 bp, Artificial Sequence
  Synthetic
atacgccatgctgggtctccaaagaatacaaaaatgtagaaataaaagtactaaataaaagagtaagagccaccataatgacaggagataccccaatcaacatctttggcagaaatattccgtacttgggagtcggccat

SEQ ID NO: 415042 - DNA, 140 bp, Artificial Sequence
  Synthetic
atggccgactcccaagtacggaatatttctgccaaagatgttgattggggtatctcctgtcattatggtggctcttactcttttatttagtacttttatttctacatttttgtattctttggagacccagcatggcgtat

SEQ ID NO: 415043 - DNA, 140 bp, Artificial Sequence
  Synthetic
aggccctggctgctgatatgcaccataatgacaggagataccccaatcaacatctttggcagaaatattctgacagccttaggcatgtcattaaatttaccagttgccaagatagagccagaccttttgggacagcggtg

SEQ ID NO: 415044 - DNA, 140 bp, Artificial Sequence
  Synthetic
caccgctgtcccaaaaggtctggctctatcttggcaactggtaaatttaatgacatgcctaaggctgtcagaatatttctgccaaagatgttgattggggtatctcctgtcattatggtgcatatcagcagccagggcct

SEQ ID NO: 415045 - DNA, 140 bp, Artificial Sequence
  Synthetic
atacgccatgctgggtctccgcccctaacaaaagagaaaatagaagcactaaaagagatctgtgaaaaaatggaaaaagagggccagctagaagaggcacctccaactaatccttataatcgtacttgggagtcggccat

SEQ ID NO: 415046 - DNA, 140 bp, Artificial Sequence
  Synthetic
atggccgactcccaagtacgattataaggattagttggaggtgcctcttctagctggccctctttttccattttttcacagatctcttttagtgcttctattttctcttttgttaggggcggagacccagcatggcgtat

SEQ ID NO: 415047 - DNA, 140 bp, Artificial Sequence
  Synthetic
aggccctggctgctgatatgtggaaaaagagggccagctagaagaggcacctccaactaatccttataatacccccacatttgcaattaagaaaaaggacaagaacaaatggaggatgctgaccttttgggacagcggtg

SEQ ID NO: 415048 - DNA, 140 bp, Artificial Sequence
  Synthetic
caccgctgtcccaaaaggtcagcatcctccatttgttcttgtcctttttcttaattgcaaatgtgggggtattataaggattagttggaggtgcctcttctagctggccctctttttccacatatcagcagccagggcct

SEQ ID NO: 415049 - DNA, 140 bp, Artificial Sequence
  Synthetic
atacgccatgctgggtctccagctaggaattccacacccggcaggactagccaaaaagaaaaggatctctatattagatgtaggggatgcctatttttccataccactacatgaagatttcgtacttgggagtcggccat

SEQ ID NO: 415050 - DNA, 140 bp, Artificial Sequence
  Synthetic
atggccgactcccaagtacgaaatcttcatgtagtggtatggaaaaataggcatcccctacatctaatatagagatccttttctttttggctagtcctgccgggtgtggaattcctagctggagacccagcatggcgtat

SEQ ID NO: 415051 - DNA, 140 bp, Artificial Sequence
  Synthetic
aggccctggctgctgatatgatattagatgtaggggatgcctatttttccataccactacatgaagattttaggcagtatactgcatttaccctaccagcagtaaacaatatggaaccaggaccttttgggacagcggtg

SEQ ID NO: 415052 - DNA, 140 bp, Artificial Sequence
  Synthetic
caccgctgtcccaaaaggtcctggttccatattgtttactgctggtagggtaaatgcagtatactgcctaaaatcttcatgtagtggtatggaaaaataggcatcccctacatctaatatcatatcagcagccagggcct

SEQ ID NO: 415053 - DNA, 140 bp, Artificial Sequence
  Synthetic
atacgccatgctgggtctccgcaatttttcaatacacaatgaggcaagtcttagaacctttcagaaaagcaaacccagatgtcattctcatccagtacatggatgatatcttaatagctacgtacttgggagtcggccat

SEQ ID NO: 415054 - DNA, 140 bp, Artificial Sequence
  Synthetic
atggccgactcccaagtacgtagctattaagatatcatccatgtactggatgagaatgacatctgggtttgcttttctgaaaggttctaagacttgcctcattgtgtattgaaaaattgcggagacccagcatggcgtat

SEQ ID NO: 415055 - DNA, 140 bp, Artificial Sequence
  Synthetic
aggccctggctgctgatatgaaacccagatgtcattctcatccagtacatggatgatatcttaatagctagtgacaggacaggtttagagcatgacaaagtggtcctgcagctaaaagaagaccttttgggacagcggtg

SEQ ID NO: 415056 - DNA, 140 bp, Artificial Sequence
  Synthetic
caccgctgtcccaaaaggtcttcttttagctgcaggaccactttgtcatgctctaaacctgtcctgtcactagctattaagatatcatccatgtactggatgagaatgacatctgggtttcatatcagcagccagggcct

SEQ ID NO: 415057 - DNA, 140 bp, Artificial Sequence
  Synthetic
atacgccatgctgggtctccccctccatttcaatggatgggctgtgaactatggccaactaaatggaagctgcagaaactacaactgccccagaaagacatatggacagtcaatgacatccgtacttgggagtcggccat

SEQ ID NO: 415058 - DNA, 140 bp, Artificial Sequence
  Synthetic
atggccgactcccaagtacggatgtcattgactgtccatatgtctttctggggcagttgtagtttctgcagcttccatttagttggccatagttcacagcccatccattgaaatggagggggagacccagcatggcgtat

SEQ ID NO: 415059 - DNA, 140 bp, Artificial Sequence
  Synthetic
aggccctggctgctgatatgtgcagaaactacaactgccccagaaagacatatggacagtcaatgacatccaaaagctagtgggagtcttaaattgggcggcacaaatctattcaggaatgaccttttgggacagcggtg

SEQ ID NO: 415060 - DNA, 140 bp, Artificial Sequence
  Synthetic
caccgctgtcccaaaaggtcattcctgaatagatttgtgccgcccaatttaagactcccactagcttttggatgtcattgactgtccatatgtctttctggggcagttgtagtttctgcacatatcagcagccagggcct

SEQ ID NO: 415061 - DNA, 140 bp, Artificial Sequence
  Synthetic
atacgccatgctgggtctccaagaagtgcagtggacagaactagcagaagcagagctagaagaaaacaaaattatcttgagccaggaacaagaaggatattattaccaagaagaaaaagacgtacttgggagtcggccat

SEQ ID NO: 415062 - DNA, 140 bp, Artificial Sequence
  Synthetic
atggccgactcccaagtacgtctttttcttcttggtaataatatccttcttgttcctggctcaagataattttgttttcttctagctctgcttctgctagttctgtccactgcacttcttggagacccagcatggcgtat

SEQ ID NO: 415063 - DNA, 140 bp, Artificial Sequence
  Synthetic
aggccctggctgctgatatgattatcttgagccaggaacaagaaggatattattaccaagaagaaaaagaattagaggcaacaatccaaaaaagccaaggacatcaatggacatacaaaagaccttttgggacagcggtg

SEQ ID NO: 415064 - DNA, 140 bp, Artificial Sequence
  Synthetic
caccgctgtcccaaaaggtcttttgtatgtccattgatgtccttggcttttttggattgttgcctctaattctttttcttcttggtaataatatccttcttgttcctggctcaagataatcatatcagcagccagggcct

SEQ ID NO: 415065 - DNA, 140 bp, Artificial Sequence
  Synthetic
atacgccatgctgggtctccaatacccataccaatggggtcagattactagcacaggtagttcagaaaataggaaaagaggcactagtcatttggggacggataccaaaatttcacctgccgtacttgggagtcggccat

SEQ ID NO: 415066 - DNA, 140 bp, Artificial Sequence
  Synthetic
atggccgactcccaagtacggcaggtgaaattttggtatccgtccccaaatgactagtgcctcttttcctattttctgaactacctgtgctagtaatctgaccccattggtatgggtattggagacccagcatggcgtat

SEQ ID NO: 415067 - DNA, 140 bp, Artificial Sequence
  Synthetic
aggccctggctgctgatatgaggaaaagaggcactagtcatttggggacggataccaaaatttcacctgccagtggagagagagacctgggagcagtggtgggataactactggcaagtggaccttttgggacagcggtg

SEQ ID NO: 415068 - DNA, 140 bp, Artificial Sequence
  Synthetic
caccgctgtcccaaaaggtccacttgccagtagttatcccaccactgctcccaggtctctctctccactggcaggtgaaattttggtatccgtccccaaatgactagtgcctcttttcctcatatcagcagccagggcct

SEQ ID NO: 415069 - DNA, 140 bp, Artificial Sequence
  Synthetic
atacgccatgctgggtctccaacatttaacctagtaggagatcctataccaggcgcagagaccttctacacagatggatcatgcaatagacagtcaaaagagggaaaagcaggatatgtacgtacttgggagtcggccat

SEQ ID NO: 415070 - DNA, 140 bp, Artificial Sequence
  Synthetic
atggccgactcccaagtacgtacatatcctgcttttccctcttttgactgtctattgcatgatccatctgtgtagaaggtctctgcgcctggtataggatctcctactaggttaaatgttggagacccagcatggcgtat

SEQ ID NO: 415071 - DNA, 140 bp, Artificial Sequence
  Synthetic
aggccctggctgctgatatgcagatggatcatgcaatagacagtcaaaagagggaaaagcaggatatgtaacagatagaggaaaagacaaagtaaaagtattagaacaaactaccaatcagaccttttgggacagcggtg

SEQ ID NO: 415072 - DNA, 140 bp, Artificial Sequence
  Synthetic
caccgctgtcccaaaaggtctgattggtagtttgttctaatacttttactttgtcttttcctctatctgttacatatcctgcttttccctcttttgactgtctattgcatgatccatctgcatatcagcagccagggcct

SEQ ID NO: 415073 - DNA, 140 bp, Artificial Sequence
  Synthetic
atacgccatgctgggtctccaggttaatatcatagtagattcacagtatgtaatggggatagtagcaggccagccaacagagtcagaaaatagaatagtgaaccagatcatagaagaaatcgtacttgggagtcggccat

SEQ ID NO: 415074 - DNA, 140 bp, Artificial Sequence
  Synthetic
atggccgactcccaagtacgatttcttctatgatctggttcactattctattttctgactctgttggctggcctgctactatccccattacatactgtgaatctactatgatattaacctggagacccagcatggcgtat

SEQ ID NO: 415075 - DNA, 140 bp, Artificial Sequence
  Synthetic
aggccctggctgctgatatgcagccaacagagtcagaaaatagaatagtgaaccagatcatagaagaaatgataaagaaggaagcagtctatgttgcatgggtcccagcccataaaggcagaccttttgggacagcggtg

SEQ ID NO: 415076 - DNA, 140 bp, Artificial Sequence
  Synthetic
caccgctgtcccaaaaggtctgcctttatgggctgggacccatgcaacatagactgcttccttctttatcatttcttctatgatctggttcactattctattttctgactctgttggctgcatatcagcagccagggcct

SEQ ID NO: 415077 - DNA, 140 bp, Artificial Sequence
  Synthetic
atacgccatgctgggtctccgtattattcctggaaaagatagagcccgctcaagaggaacatgaaaaatatcatagcattataaaagaactaacccataaatttggaataccccttctagcgtacttgggagtcggccat

SEQ ID NO: 415078 - DNA, 140 bp, Artificial Sequence
  Synthetic
atggccgactcccaagtacgctagaaggggtattccaaatttatgggttagttcttttataatgctatgatatttttcatgttcctcttgagcgggctctatcttttccaggaataatacggagacccagcatggcgtat

SEQ ID NO: 415079 - DNA, 140 bp, Artificial Sequence
  Synthetic
atacgccatgctgggtctcctagcaagacagatagtaaactcatgtgcccaatgccaacagaaaggagaagccatacatgggcaagtaaatgcagaaataggcgtttggcaaatggactacgtacttgggagtcggccat

SEQ ID NO: 415080 - DNA, 140 bp, Artificial Sequence
  Synthetic
atggccgactcccaagtacgtagtccatttgccaaacgcctatttctgcatttacttgcccatgtatggcttctcctttctgttggcattgggcacatgagtttactatctgtcttgctaggagacccagcatggcgtat

SEQ ID NO: 415081 - DNA, 140 bp, Artificial Sequence
  Synthetic
atacgccatgctgggtctccgggtaggtatagaacaatcctttggagtaccttacaacccacaaagccagggagtagtagaagcaatgaatcaccacctaaagaatcagataagtagaatcgtacttgggagtcggccat

SEQ ID NO: 415082 - DNA, 140 bp, Artificial Sequence
  Synthetic
atggccgactcccaagtacgattctacttatctgattctttaggtggtgattcattgcttctactactccctggctttgtgggttgtaaggtactccaaaggattgttctatacctacccggagacccagcatggcgtat

SEQ ID NO: 415083 - DNA, 140 bp, Artificial Sequence
  Synthetic
atacgccatgctgggtctccgcatgaattttaaaagaaggggaggaataggggatatgaccccagcagaaagactaatcaacatgattaccacagaacaagaaatacaattcctccaaagcgtacttgggagtcggccat

SEQ ID NO: 415084 - DNA, 140 bp, Artificial Sequence
  Synthetic
atggccgactcccaagtacgctttggaggaattgtatttcttgttctgtggtaatcatgttgattagtctttctgctggggtcatatcccctattcctccccttcttttaaaattcatgcggagacccagcatggcgtat

SEQ ID NO: 415085 - DNA, 140 bp, Artificial Sequence
  Synthetic
aggccctggctgctgatatgagactaatcaacatgattaccacagaacaagaaatacaattcctccaaagaaaaaattcaaattttaaaaatttccaggtctattacagagaaggcagaggaccttttgggacagcggtg

SEQ ID NO: 415086 - DNA, 140 bp, Artificial Sequence
  Synthetic
caccgctgtcccaaaaggtcctctgccttctctgtaatagacctggaaatttttaaaatttgaattttttctttggaggaattgtatttcttgttctgtggtaatcatgttgattagtctcatatcagcagccagggcct

SEQ ID NO: 415087 - DNA, 140 bp, Artificial Sequence
  Synthetic
atacgccatgctgggtctccgtcatagtcaaggtagggacagacataaaagtagtaccaagaaggaaggccaagattatcagggactatggaggaagacaggaactggatagtagtcccccgtacttgggagtcggccat

SEQ ID NO: 415088 - DNA, 140 bp, Artificial Sequence
  Synthetic
atggccgactcccaagtacgggggactactatccagttcctgtcttcctccatagtccctgataatcttggccttccttcttggtactacttttatgtctgtccctaccttgactatgacggagacccagcatggcgtat

SEQ ID NO: 415089 - DNA, 140 bp, Artificial Sequence
  Synthetic
aggccctggctgctgatatgcaagattatcagggactatggaggaagacaggaactggatagtagtccccacctggagggtgccagggaggatggagaaatggcatgcccttgtcaagtagaccttttgggacagcggtg

SEQ ID NO: 415090 - DNA, 140 bp, Artificial Sequence
  Synthetic
caccgctgtcccaaaaggtctacttgacaagggcatgccatttctccatcctccctggcaccctccaggtggggactactatccagttcctgtcttcctccatagtccctgataatcttgcatatcagcagccagggcct

SEQ ID NO: 415091 - DNA, 140 bp, Artificial Sequence
  Synthetic
atacgccatgctgggtctccacaaggtgggatgggcatggtggacttgcagcagggtaatattcccactacaaggaaaaagtcatctagaaatacaggcatattggaacctaacaccagacgtacttgggagtcggccat

SEQ ID NO: 415092 - DNA, 140 bp, Artificial Sequence
  Synthetic
atggccgactcccaagtacgtctggtgttaggttccaatatgcctgtatttctagatgactttttccttgtagtgggaatattaccctgctgcaagtccaccatgcccatcccaccttgtggagacccagcatggcgtat

SEQ ID NO: 415093 - DNA, 140 bp, Artificial Sequence
  Synthetic
aggccctggctgctgatatgggaaaagttattgtcctgctgcaactatccccaagctcataaagcacaggtaccatcacttcaatacctagccctagtagtagtacaacaaaatgacagagaccttttgggacagcggtg

SEQ ID NO: 415094 - DNA, 140 bp, Artificial Sequence
  Synthetic
caccgctgtcccaaaaggtctctgtcattttgttgtactactactagggctaggtattgaagtgatggtacctgtgctttatgagcttggggatagttgcagcaggacaataacttttcccatatcagcagccagggcct

SEQ ID NO: 415095 - DNA, 140 bp, Artificial Sequence
  Synthetic
atacgccatgctgggtctccaggccttcgagtggctagagaggaccatagaagccttaaacagggaggcagtgaaccatctgccccgagagctcattttccaggtgtggcaaaggtcctgcgtacttgggagtcggccat

SEQ ID NO: 415096 - DNA, 140 bp, Artificial Sequence
  Synthetic
atggccgactcccaagtacgcaggacctttgccacacctggaaaatgagctctcggggcagatggttcactgcctccctgtttaaggcttctatggtcctctctagccactcgaaggcctggagacccagcatggcgtat

SEQ ID NO: 415097 - DNA, 140 bp, Artificial Sequence
  Synthetic
aggccctggctgctgatatggtgaaccatctgccccgagagctcattttccaggtgtggcaaaggtcctggagatattggcatgatgaacaagggatgtcagcaagctacacaaagtatagaccttttgggacagcggtg

SEQ ID NO: 415098 - DNA, 140 bp, Artificial Sequence
  Synthetic
caccgctgtcccaaaaggtctatactttgtgtagcttgctgacatcccttgttcatcatgccaatatctccaggacctttgccacacctggaaaatgagctctcggggcagatggttcaccatatcagcagccagggcct

SEQ ID NO: 415099 - DNA, 140 bp, Artificial Sequence
  Synthetic
atacgccatgctgggtctcctgcacttgctggggggaggacatgggccgggaaggattggaagaccaaggacctccccctcctccccctccaggtctagtctaatgactgaagcaccaaccgtacttgggagtcggccat

SEQ ID NO: 415100 - DNA, 140 bp, Artificial Sequence
  Synthetic
atggccgactcccaagtacggttggtgcttcagtcattagactagacctggagggggaggagggggaggtccttggtcttccaatccttcccggcccatgtcctccccccagcaagtgcaggagacccagcatggcgtat

SEQ ID NO: 415101 - DNA, 140 bp, Artificial Sequence
  Synthetic
aggccctggctgctgatatgacctccccctcctccccctccaggtctagtctaatgactgaagcaccaacagagtttcccccagaagatgggaccccacggagggacttagggagtgactgaccttttgggacagcggtg

SEQ ID NO: 415102 - DNA, 140 bp, Artificial Sequence
  Synthetic
caccgctgtcccaaaaggtcagtcactccctaagtccctccgtggggtcccatcttctgggggaaactctgttggtgcttcagtcattagactagacctggagggggaggagggggaggtcatatcagcagccagggcct

SEQ ID NO: 415103 - DNA, 140 bp, Artificial Sequence
  Synthetic
atacgccatgctgggtctccgatccccgcttgctaattgctcttggctactatatccataatagacatggagacacccttgaaggcgccagagagctcattaaaaccctacaacgagccccgtacttgggagtcggccat

SEQ ID NO: 415104 - DNA, 140 bp, Artificial Sequence
  Synthetic
atggccgactcccaagtacggggctcgttgtagggttttaatgagctctctggcgccttcaagggtgtctccatgtctattatggatatagtagccaagagcaattagcaagcggggatcggagacccagcatggcgtat

SEQ ID NO: 415105 - DNA, 140 bp, Artificial Sequence
  Synthetic
aggccctggctgctgatatgagacacccttgaaggcgccagagagctcattaaaaccctacaacgagccctcttcgtgcacttcagagcgggatgtaaccgctcaagaattggctaaacagaccttttgggacagcggtg

SEQ ID NO: 415106 - DNA, 140 bp, Artificial Sequence
  Synthetic
caccgctgtcccaaaaggtctgtttagccaattcttgagcggttacatcccgctctgaagtgcacgaagagggctcgttgtagggttttaatgagctctctggcgccttcaagggtgtctcatatcagcagccagggcct

SEQ ID NO: 415107 - DNA, 140 bp, Artificial Sequence
  Synthetic
atacgccatgctgggtctccacaaatgctattgtaagcgatgcagtttccattgccagctgtgtttctcgaaaaaggggctcggaatatcatatgagcgaaagggcagacgaagaaggaccgtacttgggagtcggccat

SEQ ID NO: 415108 - DNA, 140 bp, Artificial Sequence
  Synthetic
atggccgactcccaagtacggtccttcttcgtctgccctttcgctcatatgatattccgagcccctttttcgagaaacacagctggcaatggaaactgcatcgcttacaatagcatttgtggagacccagcatggcgtat

SEQ ID NO: 415109 - DNA, 140 bp, Artificial Sequence
  Synthetic
aggccctggctgctgatatgaaaaaggggctcggaatatcatatgagcgaaagggcagacgaagaaggactccaaggaaaactaagactccttcgccttctgcaccagacaagtgagtatgaccttttgggacagcggtg

SEQ ID NO: 415110 - DNA, 140 bp, Artificial Sequence
  Synthetic
caccgctgtcccaaaaggtcatactcacttgtctggtgcagaaggcgaaggagtcttagttttccttggagtccttcttcgtctgccctttcgctcatatgatattccgagcccctttttcatatcagcagccagggcct

SEQ ID NO: 415111 - DNA, 140 bp, Artificial Sequence
  Synthetic
atacgccatgctgggtctccgcttagtatattgtagccagtatgtgactgttttctatggcatacccgcgtggaaaaatgcatctattcccttattttgtgcaactaaaaatagagacaccgtacttgggagtcggccat

SEQ ID NO: 415112 - DNA, 140 bp, Artificial Sequence
  Synthetic
atggccgactcccaagtacggtgtctctatttttagttgcacaaaataagggaatagatgcatttttccacgcgggtatgccatagaaaacagtcacatactggctacaatatactaagcggagacccagcatggcgtat

SEQ ID NO: 415113 - DNA, 140 bp, Artificial Sequence
  Synthetic
aggccctggctgctgatatgtggaaaaatgcatctattcccttattttgtgcaactaaaaatagagacacttgggggaccatacagtgcttgccagacaatgatgattatcaggaaataagaccttttgggacagcggtg

SEQ ID NO: 415114 - DNA, 140 bp, Artificial Sequence
  Synthetic
caccgctgtcccaaaaggtcttatttcctgataatcatcattgtctggcaagcactgtatggtcccccaagtgtctctatttttagttgcacaaaataagggaatagatgcatttttccacatatcagcagccagggcct

SEQ ID NO: 415115 - DNA, 140 bp, Artificial Sequence
  Synthetic
atacgccatgctgggtctcccaagcagtagaagatgtctggcatctatttgagacatcaataaaaccatgtgtcaagctaacacctctatgtgtggcaatgaattgtagcagggttcaagcgtacttgggagtcggccat

SEQ ID NO: 415116 - DNA, 140 bp, Artificial Sequence
  Synthetic
atggccgactcccaagtacgcttgaaccctgctacaattcattgccacacatagaggtgttagcttgacacatggttttattgatgtctcaaatagatgccagacatcttctactgcttgggagacccagcatggcgtat

SEQ ID NO: 415117 - DNA, 140 bp, Artificial Sequence
  Synthetic
aggccctggctgctgatatgtgtcaagctaacacctctatgtgtggcaatgaattgtagcagggttcaagggaataccacgaccccgaatcccaggacctcgagttccacaacctcgagagaccttttgggacagcggtg

SEQ ID NO: 415118 - DNA, 140 bp, Artificial Sequence
  Synthetic
caccgctgtcccaaaaggtctctcgaggttgtggaactcgaggtcctgggattcggggtcgtggtattcccttgaaccctgctacaattcattgccacacatagaggtgttagcttgacacatatcagcagccagggcct

SEQ ID NO: 415119 - DNA, 140 bp, Artificial Sequence
  Synthetic
atacgccatgctgggtctccaaacaacacatgcgcaggattagggtatgaggagatgatgcaatgtgagttcaatatgaaggggttagaacaagataagaaaaggaggtataaggacacacgtacttgggagtcggccat

SEQ ID NO: 415120 - DNA, 140 bp, Artificial Sequence
  Synthetic
atggccgactcccaagtacgtgtgtccttatacctccttttcttatcttgttctaaccccttcatattgaactcacattgcatcatctcctcataccctaatcctgcgcatgtgttgtttggagacccagcatggcgtat

SEQ ID NO: 415121 - DNA, 140 bp, Artificial Sequence
  Synthetic
atacgccatgctgggtctcccatgagacattgcaacacatcaatcatcaaagagtcatgtgataagcactattgggatgctatgaggtttagatactgtgcaccaccgggctttgccctacgtacttgggagtcggccat

SEQ ID NO: 415122 - DNA, 140 bp, Artificial Sequence
  Synthetic
atggccgactcccaagtacgtagggcaaagcccggtggtgcacagtatctaaacctcatagcatcccaatagtgcttatcacatgactctttgatgattgatgtgttgcaatgtctcatgggagacccagcatggcgtat

SEQ ID NO: 415123 - DNA, 140 bp, Artificial Sequence
  Synthetic
aggccctggctgctgatatgattgggatgctatgaggtttagatactgtgcaccaccgggctttgccctattaagatgtaatgataccaactattcaggctttgaacctaagtgcactaagaccttttgggacagcggtg

SEQ ID NO: 415124 - DNA, 140 bp, Artificial Sequence
  Synthetic
caccgctgtcccaaaaggtcttagtgcacttaggttcaaagcctgaatagttggtatcattacatcttaatagggcaaagcccggtggtgcacagtatctaaacctcatagcatcccaatcatatcagcagccagggcct

SEQ ID NO: 415125 - DNA, 140 bp, Artificial Sequence
  Synthetic
atacgccatgctgggtctccggtttggctttaatggcactagagcagaaaatagaacatatatctattggcatggcagagataataggactatcattagcttaaacaagtattataatctcgtacttgggagtcggccat

SEQ ID NO: 415126 - DNA, 140 bp, Artificial Sequence
  Synthetic
atggccgactcccaagtacgagattataatacttgtttaagctaatgatagtcctattatctctgccatgccaatagatatatgttctattttctgctctagtgccattaaagccaaaccggagacccagcatggcgtat

SEQ ID NO: 415127 - DNA, 140 bp, Artificial Sequence
  Synthetic
aggccctggctgctgatatgcatggcagagataataggactatcattagcttaaacaagtattataatctcacaatgcgttgtaagagaccaggaaataagacagttttaccaataacacgaccttttgggacagcggtg

SEQ ID NO: 415128 - DNA, 140 bp, Artificial Sequence
  Synthetic
caccgctgtcccaaaaggtcgtgttattggtaaaactgtcttatttcctggtctcttacaacgcattgtgagattataatacttgtttaagctaatgatagtcctattatctctgccatgcatatcagcagccagggcct

SEQ ID NO: 415129 - DNA, 140 bp, Artificial Sequence
  Synthetic
atacgccatgctgggtctcccaggcatggtgccggtttggaggcagatggagggaagccatgcaggaggtgaagcaaacccttgtacaacatcccagatacaaaggaatcaatgatacagcgtacttgggagtcggccat

SEQ ID NO: 415130 - DNA, 140 bp, Artificial Sequence
  Synthetic
atggccgactcccaagtacgctgtatcattgattcctttgtatctgggatgttgtacaagggtttgcttcacctcctgcatggcttccctccatctgcctccaaaccggcaccatgcctgggagacccagcatggcgtat

SEQ ID NO: 415131 - DNA, 140 bp, Artificial Sequence
  Synthetic
aggccctggctgctgatatggaagcaaacccttgtacaacatcccagatacaaaggaatcaatgatacagggaaaattaactttacgaaaccgggagcaggctcagacccggaagtggcagaccttttgggacagcggtg

SEQ ID NO: 415132 - DNA, 140 bp, Artificial Sequence
  Synthetic
caccgctgtcccaaaaggtctgccacttccgggtctgagcctgctcccggtttcgtaaagttaattttccctgtatcattgattcctttgtatctgggatgttgtacaagggtttgcttccatatcagcagccagggcct

SEQ ID NO: 415133 - DNA, 140 bp, Artificial Sequence
  Synthetic
atacgccatgctgggtctccgttcctcaattgggtagaagacaagaaccaaacacggcgcaactattgccatataaagcagataattaatacctggcataaagtagggaaaaatgtatatcgtacttgggagtcggccat

SEQ ID NO: 415134 - DNA, 140 bp, Artificial Sequence
  Synthetic
atggccgactcccaagtacgatatacatttttccctactttatgccaggtattaattatctgctttatatggcaatagttgcgccgtgtttggttcttgtcttctacccaattgaggaacggagacccagcatggcgtat

SEQ ID NO: 415135 - DNA, 140 bp, Artificial Sequence
  Synthetic
aggccctggctgctgatatgatataaagcagataattaatacctggcataaagtagggaaaaatgtatatttgcctcctagggaaggggagttggcctgtgaatcaacagtaaccagcatgaccttttgggacagcggtg

SEQ ID NO: 415136 - DNA, 140 bp, Artificial Sequence
  Synthetic
caccgctgtcccaaaaggtcatgctggttactgttgattcacaggccaactccccttccctaggaggcaaatatacatttttccctactttatgccaggtattaattatctgctttatatcatatcagcagccagggcct

SEQ ID NO: 415137 - DNA, 140 bp, Artificial Sequence
  Synthetic
atacgccatgctgggtctccttagtgcagaagtggcagaactgtaccgattagaactgggagactacaaattaatagaaataacaccaattggcttcgcacctacagatcagagaaggtacgtacttgggagtcggccat

SEQ ID NO: 415138 - DNA, 140 bp, Artificial Sequence
  Synthetic
atggccgactcccaagtacgtaccttctctgatctgtaggtgcgaagccaattggtgttatttctattaatttgtagtctcccagttctaatcggtacagttctgccacttctgcactaaggagacccagcatggcgtat

SEQ ID NO: 415139 - DNA, 140 bp, Artificial Sequence
  Synthetic
atacgccatgctgggtctccctcctcaactccagtgaggaacaaaagaggtgtgttcgtgctagggttcttgggttttctcgcgacagcaggttctgcaatgggcgcgcggtccctgacgcgtacttgggagtcggccat

SEQ ID NO: 415140 - DNA, 140 bp, Artificial Sequence
  Synthetic
atggccgactcccaagtacgcgtcagggaccgcgcgcccattgcagaacctgctgtcgcgagaaaacccaagaaccctagcacgaacacacctcttttgttcctcactggagttgaggagggagacccagcatggcgtat

SEQ ID NO: 415141 - DNA, 140 bp, Artificial Sequence
  Synthetic
aggccctggctgctgatatgacagctgttggacgtagtcaagagacaacaagaaatgttgcgactgaccgtctggggaacgaaaaacctccaggcaagagtcactgctatcgagaagtacgaccttttgggacagcggtg

SEQ ID NO: 415142 - DNA, 140 bp, Artificial Sequence
  Synthetic
caccgctgtcccaaaaggtcgtacttctcgatagcagtgactcttgcctggaggtttttcgttccccagacggtcagtcgcaacatttcttgttgtctcttgactacgtccaacagctgtcatatcagcagccagggcct

SEQ ID NO: 415143 - DNA, 140 bp, Artificial Sequence
  Synthetic
atacgccatgctgggtctccctgccacactactgtaccgtgggtaaatgactctttatcgcctgactggaaaaatatgacatggcaggagtgggagaaacaagtccgctacctagaggcacgtacttgggagtcggccat

SEQ ID NO: 415144 - DNA, 140 bp, Artificial Sequence
  Synthetic
atggccgactcccaagtacgtgcctctaggtagcggacttgtttctcccactcctgccatgtcatatttttccagtcaggcgataaagagtcatttacccacggtacagtagtgtggcagggagacccagcatggcgtat

SEQ ID NO: 415145 - DNA, 140 bp, Artificial Sequence
  Synthetic
aggccctggctgctgatatgaaaatatgacatggcaggagtgggagaaacaagtccgctacctagaggcaaatatcagtcaaagtttagaagaagcccaaattcaacaagaaaagaatatgaccttttgggacagcggtg

SEQ ID NO: 415146 - DNA, 140 bp, Artificial Sequence
  Synthetic
caccgctgtcccaaaaggtcatattcttttcttgttgaatttgggcttcttctaaactttgactgatatttgcctctaggtagcggacttgtttctcccactcctgccatgtcatattttcatatcagcagccagggcct

SEQ ID NO: 415147 - DNA, 140 bp, Artificial Sequence
  Synthetic
atacgccatgctgggtctccacttaacctcctgggtcaagtatattcaatatggagtgcatatagtagtgggaataatagctttaagaatagcaatctatgtagtgcaattgttaagtagcgtacttgggagtcggccat

SEQ ID NO: 415148 - DNA, 140 bp, Artificial Sequence
  Synthetic
atggccgactcccaagtacgctacttaacaattgcactacatagattgctattcttaaagctattattcccactactatatgcactccatattgaatatacttgacccaggaggttaagtggagacccagcatggcgtat

SEQ ID NO: 415149 - DNA, 140 bp, Artificial Sequence
  Synthetic
aggccctggctgctgatatgggaataatagctttaagaatagcaatctatgtagtgcaattgttaagtagatttagaaagggctataggcctgttttctcttccccccccggttatctccgaccttttgggacagcggtg

SEQ ID NO: 415150 - DNA, 140 bp, Artificial Sequence
  Synthetic
caccgctgtcccaaaaggtcggagataaccggggggggaagagaaaacaggcctatagccctttctaaatctacttaacaattgcactacatagattgctattcttaaagctattattcccatatcagcagccagggcct

SEQ ID NO: 415151 - DNA, 140 bp, Artificial Sequence
  Synthetic
atacgccatgctgggtctccgaagaagacgtcggaggcgacagtggttacgacttgtggccttggccaataaactatgtgcagttcctgatccacctactgactcgcctcttgatcgggccgtacttgggagtcggccat

SEQ ID NO: 415152 - DNA, 140 bp, Artificial Sequence
  Synthetic
atggccgactcccaagtacggcccgatcaagaggcgagtcagtaggtggatcaggaactgcacatagtttattggccaaggccacaagtcgtaaccactgtcgcctccgacgtcttcttcggagacccagcatggcgtat

SEQ ID NO: 415153 - DNA, 140 bp, Artificial Sequence
  Synthetic
aggccctggctgctgatatgaaactatgtgcagttcctgatccacctactgactcgcctcttgatcgggctatacaacatctgcagagacttactatccaagaactccccgacccgccgagaccttttgggacagcggtg

SEQ ID NO: 415154 - DNA, 140 bp, Artificial Sequence
  Synthetic
caccgctgtcccaaaaggtctcggcgggtcggggagttcttggatagtaagtctctgcagatgttgtatagcccgatcaagaggcgagtcagtaggtggatcaggaactgcacatagtttcatatcagcagccagggcct

SEQ ID NO: 415155 - DNA, 140 bp, Artificial Sequence
  Synthetic
atacgccatgctgggtctccggcccaactgcaatatgggtgcgagtggatccaagaagctttccaagcattcgcgaggactacgagagagactcttgcgggcgcgtggggatggttatggcgtacttgggagtcggccat

SEQ ID NO: 415156 - DNA, 140 bp, Artificial Sequence
  Synthetic
atggccgactcccaagtacgccataaccatccccacgcgcccgcaagagtctctctcgtagtcctcgcgaatgcttggaaagcttcttggatccactcgcacccatattgcagttgggccggagacccagcatggcgtat

SEQ ID NO: 415157 - DNA, 140 bp, Artificial Sequence
  Synthetic
aggccctggctgctgatatgtcgcgaggactacgagagagactcttgcgggcgcgtggggatggttatgggaagcagcgcgacgcatcgggaggggaatactcgcagttccaagaagaatgaccttttgggacagcggtg

SEQ ID NO: 415158 - DNA, 140 bp, Artificial Sequence
  Synthetic
caccgctgtcccaaaaggtcattcttcttggaactgcgagtattcccctcccgatgcgtcgcgctgcttcccataaccatccccacgcgcccgcaagagtctctctcgtagtcctcgcgacatatcagcagccagggcct

SEQ ID NO: 415159 - DNA, 140 bp, Artificial Sequence
  Synthetic
atacgccatgctgggtctccggagagtacatgaacagcccatggagaaacccagcaacagaaagacagaaagatttgtataggcagcaaaatatggatgatgtagattctgatgatgatgcgtacttgggagtcggccat

SEQ ID NO: 415160 - DNA, 140 bp, Artificial Sequence
  Synthetic
atggccgactcccaagtacgcatcatcatcagaatctacatcatccatattttgctgcctatacaaatctttctgtctttctgttgctgggtttctccatgggctgttcatgtactctccggagacccagcatggcgtat

SEQ ID NO: 415161 - DNA, 140 bp, Artificial Sequence
  Synthetic
aggccctggctgctgatatggacctaataggagttcctgttacaccaagagtaccacggagagaaatgacctataaattggcaatagatatgtcacattttataaaagaaaaagggggacgaccttttgggacagcggtg

SEQ ID NO: 415162 - DNA, 140 bp, Artificial Sequence
  Synthetic
caccgctgtcccaaaaggtcgtccccctttttcttttataaaatgtgacatatctattgccaatttataggtcatttctctccgtggtactcttggtgtaacaggaactcctattaggtccatatcagcagccagggcct

SEQ ID NO: 415163 - DNA, 140 bp, Artificial Sequence
  Synthetic
atacgccatgctgggtctccggttggcgcccaacagggacttgaaagggactgagaagccctggaacacggctagtgaaggtagtaaggcggcaggaacaaaccacgacggagtgctcctcgtacttgggagtcggccat

SEQ ID NO: 415164 - DNA, 140 bp, Artificial Sequence
  Synthetic
atggccgactcccaagtacgaggagcactccgtcgtggtttgttcctgccgccttactaccttcactagccgtgttccagggcttctcagtccctttcaagtccctgttgggcgccaaccggagacccagcatggcgtat

SEQ ID NO: 415165 - DNA, 140 bp, Artificial Sequence
  Synthetic
aggccctggctgctgatatggctagtgaaggtagtaaggcggcaggaacaaaccacgacggagtgctcctagaaaagcgcgggccgaggtaccaaaggcggcgtgtggagcgggagtgaagaccttttgggacagcggtg

SEQ ID NO: 415166 - DNA, 140 bp, Artificial Sequence
  Synthetic
caccgctgtcccaaaaggtcttcactcccgctccacacgccgcctttggtacctcggcccgcgcttttctaggagcactccgtcgtggtttgttcctgccgccttactaccttcactagccatatcagcagccagggcct

SEQ ID NO: 415167 - DNA, 140 bp, Artificial Sequence
  Synthetic
atacgccatgctgggtctccagaaaagcgcgggccgaggtaccaaaggcggcgtgtggagcgggagtgaaagaggcctccgggtgaaggtaagtgcctacaccgaaaaccgtagccagaacgtacttgggagtcggccat

SEQ ID NO: 415168 - DNA, 140 bp, Artificial Sequence
  Synthetic
atggccgactcccaagtacgttctggctacggttttcggtgtaggcacttaccttcacccggaggcctctttcactcccgctccacacgccgcctttggtacctcggcccgcgcttttctggagacccagcatggcgtat

SEQ ID NO: 415169 - DNA, 140 bp, Artificial Sequence
  Synthetic
atacgccatgctgggtctcccgcgagaaactccgtcttgagagggaaaaaagcagatgaattagaaaagattaggttacggcccagcggaaagaaaaagtacaggctaaaacatattgtgcgtacttgggagtcggccat

SEQ ID NO: 415170 - DNA, 140 bp, Artificial Sequence
  Synthetic
atggccgactcccaagtacgcacaatatgttttagcctgtactttttctttccgctgggccgtaacctaatcttttctaattcatctgcttttttccctctcaagacggagtttctcgcgggagacccagcatggcgtat

SEQ ID NO: 415171 - DNA, 140 bp, Artificial Sequence
  Synthetic
aggccctggctgctgatatgttaggttacggcccagcggaaagaaaaagtacaggctaaaacatattgtgtgggcagcgaacgaattggacaaattcggattggcagagagcctgttggagaccttttgggacagcggtg

SEQ ID NO: 415172 - DNA, 140 bp, Artificial Sequence
  Synthetic
caccgctgtcccaaaaggtctccaacaggctctctgccaatccgaatttgtccaattcgttcgctgcccacacaatatgttttagcctgtactttttctttccgctgggccgtaacctaacatatcagcagccagggcct

SEQ ID NO: 415173 - DNA, 140 bp, Artificial Sequence
  Synthetic
aggccctggctgctgatatgtggtgcttgcacgcagaagagaaagtgaaagatactgaagaagcaaaaaaactagtacagagacatctaggggcagaaacaggaactgcagaaaaaatgcgaccttttgggacagcggtg

SEQ ID NO: 415174 - DNA, 140 bp, Artificial Sequence
  Synthetic
caccgctgtcccaaaaggtcgcattttttctgcagttcctgtttctgcccctagatgtctctgtactagtttttttgcttcttcagtatctttcactttctcttctgcgtgcaagcaccacatatcagcagccagggcct

SEQ ID NO: 415175 - DNA, 140 bp, Artificial Sequence
  Synthetic
atacgccatgctgggtctcccctgtacaacagacaggcggtggcaactatatccacgtgccactgagcccccgaactctaaatgcttgggtaaaattagtagaggacaagaagttcggggcgtacttgggagtcggccat

SEQ ID NO: 415176 - DNA, 140 bp, Artificial Sequence
  Synthetic
atggccgactcccaagtacgccccgaacttcttgtcctctactaattttacccaagcatttagagttcgggggctcagtggcacgtggatatagttgccaccgcctgtctgttgtacaggggagacccagcatggcgtat

SEQ ID NO: 415177 - DNA, 140 bp, Artificial Sequence
  Synthetic
aggccctggctgctgatatgccgaactctaaatgcttgggtaaaattagtagaggacaagaagttcggggcagaagtagtgccaggatttcaagcactctcagaaggctgcacgccctatgaccttttgggacagcggtg

SEQ ID NO: 415178 - DNA, 140 bp, Artificial Sequence
  Synthetic
caccgctgtcccaaaaggtcatagggcgtgcagccttctgagagtgcttgaaatcctggcactacttctgccccgaacttcttgtcctctactaattttacccaagcatttagagttcggcatatcagcagccagggcct

SEQ ID NO: 415179 - DNA, 140 bp, Artificial Sequence
  Synthetic
atacgccatgctgggtctccaataatcagagagattatcaatgacgaagcagcagattgggatgcacagcacccaataccaggccccttaccagcagggcagcttagagacccaagggggcgtacttgggagtcggccat

SEQ ID NO: 415180 - DNA, 140 bp, Artificial Sequence
  Synthetic
atggccgactcccaagtacgcccccttgggtctctaagctgccctgctggtaaggggcctggtattgggtgctgtgcatcccaatctgctgcttcgtcattgataatctctctgattattggagacccagcatggcgtat

SEQ ID NO: 415181 - DNA, 140 bp, Artificial Sequence
  Synthetic
aggccctggctgctgatatgacccaataccaggccccttaccagcagggcagcttagagacccaagggggtctgacatagcaggaacaacaagcacagtagaagaacagatccagtggatgaccttttgggacagcggtg

SEQ ID NO: 415182 - DNA, 140 bp, Artificial Sequence
  Synthetic
caccgctgtcccaaaaggtcatccactggatctgttcttctactgtgcttgttgttcctgctatgtcagacccccttgggtctctaagctgccctgctggtaaggggcctggtattgggtcatatcagcagccagggcct

SEQ ID NO: 415183 - DNA, 140 bp, Artificial Sequence
  Synthetic
atacgccatgctgggtctcctccagatagggctacagaagtgtgtcaggatgtacaacccaactaacatcttagacgtaaagcagggaccaaaggaaccgttccagagctatgtggacagcgtacttgggagtcggccat

SEQ ID NO: 415184 - DNA, 140 bp, Artificial Sequence
  Synthetic
atggccgactcccaagtacgctgtccacatagctctggaacggttcctttggtccctgctttacgtctaagatgttagttgggttgtacatcctgacacacttctgtagccctatctggaggagacccagcatggcgtat

SEQ ID NO: 415185 - DNA, 140 bp, Artificial Sequence
  Synthetic
aggccctggctgctgatatgttagacgtaaagcagggaccaaaggaaccgttccagagctatgtggacaggttctataaaagcttgagggcagaacaaacagatccggcagtaaagaactgaccttttgggacagcggtg

SEQ ID NO: 415186 - DNA, 140 bp, Artificial Sequence
  Synthetic
caccgctgtcccaaaaggtcagttctttactgccggatctgtttgttctgccctcaagcttttatagaacctgtccacatagctctggaacggttcctttggtccctgctttacgtctaacatatcagcagccagggcct

SEQ ID NO: 415187 - DNA, 140 bp, Artificial Sequence
  Synthetic
atacgccatgctgggtctccgtactaaaaggactggggatgaatcccaccctagaagagatgctgactgcctgtcagggggtaggtggaccaggccaaaaagccagactaatggccgaagcgtacttgggagtcggccat

SEQ ID NO: 415188 - DNA, 140 bp, Artificial Sequence
  Synthetic
atggccgactcccaagtacgcttcggccattagtctggctttttggcctggtccacctaccccctgacaggcagtcagcatctcttctagggtgggattcatccccagtccttttagtacggagacccagcatggcgtat

SEQ ID NO: 415189 - DNA, 140 bp, Artificial Sequence
  Synthetic
aggccctggctgctgatatgctgtcagggggtaggtggaccaggccaaaaagccagactaatggccgaagccctgaaggaggctttgacaccaccccctatcccatttgcagcagcccaagaccttttgggacagcggtg

SEQ ID NO: 415190 - DNA, 140 bp, Artificial Sequence
  Synthetic
caccgctgtcccaaaaggtcttgggctgctgcaaatgggatagggggtggtgtcaaagcctccttcagggcttcggccattagtctggctttttggcctggtccacctaccccctgacagcatatcagcagccagggcct

SEQ ID NO: 415191 - DNA, 140 bp, Artificial Sequence
  Synthetic
atacgccatgctgggtctccgagacagtgccgagcgcctagaagacagggctgctggaaatgtggcaagacaggacacgtcatggcaaaatgcccagaaagacaggcaggttttttagggcgtacttgggagtcggccat

SEQ ID NO: 415192 - DNA, 140 bp, Artificial Sequence
  Synthetic
atggccgactcccaagtacgccctaaaaaacctgcctgtctttctgggcattttgccatgacgtgtcctgtcttgccacatttccagcagccctgtcttctaggcgctcggcactgtctcggagacccagcatggcgtat

SEQ ID NO: 415193 - DNA, 140 bp, Artificial Sequence
  Synthetic
aggccctggctgctgatatgcaggacacgtcatggcaaaatgcccagaaagacaggcaggttttttagggatgggtccatggggaaagaagccccgcaacttccccgtggcccaagctccgaccttttgggacagcggtg

SEQ ID NO: 415194 - DNA, 140 bp, Artificial Sequence
  Synthetic
caccgctgtcccaaaaggtcggagcttgggccacggggaagttgcggggcttctttccccatggacccatccctaaaaaacctgcctgtctttctgggcattttgccatgacgtgtcctgcatatcagcagccagggcct

SEQ ID NO: 415195 - DNA, 140 bp, Artificial Sequence
  Synthetic
atacgccatgctgggtctcctggaaagatatatgcagcaggggagagagcagagggagcagagggagagaccatacaaagaggtgacggaagacttactgcacctcgagcagggaaaagccgtacttgggagtcggccat

SEQ ID NO: 415196 - DNA, 140 bp, Artificial Sequence
  Synthetic
atggccgactcccaagtacggcttttccctgctcgaggtgcagtaagtcttccgtcacctctttgtatggtctctccctctgctccctctgctctctcccctgctgcatatatctttccaggagacccagcatggcgtat

SEQ ID NO: 415197 - DNA, 140 bp, Artificial Sequence
  Synthetic
aggccctggctgctgatatgccatacaaagaggtgacggaagacttactgcacctcgagcagggaaaagcacctcacagagaggcgacagaggacttgctgcacctcaattctctctttggaccttttgggacagcggtg

SEQ ID NO: 415198 - DNA, 140 bp, Artificial Sequence
  Synthetic
caccgctgtcccaaaaggtccaaagagagaattgaggtgcagcaagtcctctgtcgcctctctgtgaggtgcttttccctgctcgaggtgcagtaagtcttccgtcacctctttgtatggcatatcagcagccagggcct

SEQ ID NO: 415199 - DNA, 140 bp, Artificial Sequence
  Synthetic
atacgccatgctgggtctcctattagacacaggggctgatgactcaatagtggcaggaatacagttaggggacaattacgttccaaaaatagtggggggaatagggggattcataaacaccgtacttgggagtcggccat

SEQ ID NO: 415200 - DNA, 140 bp, Artificial Sequence
  Synthetic
atggccgactcccaagtacggtgtttatgaatccccctattccccccactatttttggaacgtaattgtcccctaactgtattcctgccactattgagtcatcagcccctgtgtctaataggagacccagcatggcgtat

SEQ ID NO: 415201 - DNA, 140 bp, Artificial Sequence
  Synthetic
aggccctggctgctgatatggacaattacgttccaaaaatagtggggggaatagggggattcataaacaccaaagagattaaaaatatagaaataaaagtactaaataaaagagtaagaggaccttttgggacagcggtg

SEQ ID NO: 415202 - DNA, 140 bp, Artificial Sequence
  Synthetic
caccgctgtcccaaaaggtcctcttactcttttatttagtacttttatttctatatttttaatctctttggtgtttatgaatccccctattccccccactatttttggaacgtaattgtccatatcagcagccagggcct

SEQ ID NO: 415203 - DNA, 140 bp, Artificial Sequence
  Synthetic
atacgccatgctgggtctccctgacagccttaggcatgtcattaaatttaccaatcgccaagatagaaccaataaaagtaacgttgaagccagggaaagatggaccaagactgagacaatcgtacttgggagtcggccat

SEQ ID NO: 415204 - DNA, 140 bp, Artificial Sequence
  Synthetic
atggccgactcccaagtacgattgtctcagtcttggtccatctttccctggcttcaacgttacttttattggttctatcttggcgattggtaaatttaatgacatgcctaaggctgtcagggagacccagcatggcgtat

SEQ ID NO: 415205 - DNA, 140 bp, Artificial Sequence
  Synthetic
atacgccatgctgggtctccggcccctaacaaaagagaaaatagaagcactaagagagatctgcgaaaaaatggaaaaggagggccaactagaagaggcacctccaactaatccttataacgtacttgggagtcggccat

SEQ ID NO: 415206 - DNA, 140 bp, Artificial Sequence
  Synthetic
atggccgactcccaagtacgttataaggattagttggaggtgcctcttctagttggccctccttttccattttttcgcagatctctcttagtgcttctattttctcttttgttaggggccggagacccagcatggcgtat

SEQ ID NO: 415207 - DNA, 140 bp, Artificial Sequence
  Synthetic
aggccctggctgctgatatgcagctaggaattccacacccggcaggattagccaaaaagaaaaggatcactgtactagatgtaggggatgcctacttttccataccgctacatgaagattgaccttttgggacagcggtg

SEQ ID NO: 415208 - DNA, 140 bp, Artificial Sequence
  Synthetic
caccgctgtcccaaaaggtcaatcttcatgtagcggtatggaaaagtaggcatcccctacatctagtacagtgatccttttctttttggctaatcctgccgggtgtggaattcctagctgcatatcagcagccagggcct

SEQ ID NO: 415209 - DNA, 140 bp, Artificial Sequence
  Synthetic
atacgccatgctgggtctccggaaaaagatatatatataaggtcttaccacaaggatggaagggatcaccagcaatttttcaacacacaatgaggcaagtcttagaacctttcagaaaagcgtacttgggagtcggccat

SEQ ID NO: 415210 - DNA, 140 bp, Artificial Sequence
  Synthetic
atggccgactcccaagtacgcttttctgaaaggttctaagacttgcctcattgtgtgttgaaaaattgctggtgatcccttccatccttgtggtaagaccttatatatatatctttttccggagacccagcatggcgtat

SEQ ID NO: 415211 - DNA, 140 bp, Artificial Sequence
  Synthetic
aggccctggctgctgatatgagcaatttttcaacacacaatgaggcaagtcttagaacctttcagaaaagcaaacccagatgtcattctcatccaatacatggatgatattttaatagctgaccttttgggacagcggtg

SEQ ID NO: 415212 - DNA, 140 bp, Artificial Sequence
  Synthetic
caccgctgtcccaaaaggtcagctattaaaatatcatccatgtattggatgagaatgacatctgggtttgcttttctgaaaggttctaagacttgcctcattgtgtgttgaaaaattgctcatatcagcagccagggcct

SEQ ID NO: 415213 - DNA, 140 bp, Artificial Sequence
  Synthetic
atacgccatgctgggtctccacttctgaatggcctagggttctctaccccagatgagaagttccaaaaagaccctccgcttcaatggatgggctatgaactatggccaactaaatggaagcgtacttgggagtcggccat

SEQ ID NO: 415214 - DNA, 140 bp, Artificial Sequence
  Synthetic
atggccgactcccaagtacgcttccatttagttggccatagttcatagcccatccattgaagcggagggtctttttggaacttctcatctggggtagagaaccctaggccattcagaagtggagacccagcatggcgtat

SEQ ID NO: 415215 - DNA, 140 bp, Artificial Sequence
  Synthetic
aggccctggctgctgatatgaccctccgcttcaatggatgggctatgaactatggccaactaaatggaagctgcagaaattacaactgccccagaaagaaatatggacagtcaacgacatgaccttttgggacagcggtg

SEQ ID NO: 415216 - DNA, 140 bp, Artificial Sequence
  Synthetic
caccgctgtcccaaaaggtcatgtcgttgactgtccatatttctttctggggcagttgtaatttctgcagcttccatttagttggccatagttcatagcccatccattgaagcggagggtcatatcagcagccagggcct

SEQ ID NO: 415217 - DNA, 140 bp, Artificial Sequence
  Synthetic
atacgccatgctgggtctcctaaaaaccaaacatttgtgtaggctaatcaaaggaaaaatgacactcacagaagaagtgcagtggacagagttagcagaagcagagctagaagaaaacaacgtacttgggagtcggccat

SEQ ID NO: 415218 - DNA, 140 bp, Artificial Sequence
  Synthetic
atggccgactcccaagtacgttgttttcttctagctctgcttctgctaactctgtccactgcacttcttctgtgagtgtcatttttcctttgattagcctacacaaatgtttggtttttaggagacccagcatggcgtat

SEQ ID NO: 415219 - DNA, 140 bp, Artificial Sequence
  Synthetic
aggccctggctgctgatatggaagaagtgcagtggacagagttagcagaagcagagctagaagaaaacaaaattatcttaagccaggaacaagaaggatactattaccaagaagaaaaaggaccttttgggacagcggtg

SEQ ID NO: 415220 - DNA, 140 bp, Artificial Sequence
  Synthetic
caccgctgtcccaaaaggtcctttttcttcttggtaatagtatccttcttgttcctggcttaagataattttgttttcttctagctctgcttctgctaactctgtccactgcacttcttccatatcagcagccagggcct

SEQ ID NO: 415221 - DNA, 140 bp, Artificial Sequence
  Synthetic
atacgccatgctgggtctccatacaccaggaagagaaaatcctaaaagtagggaaatatgcaaagataaaaaatacccataccaatggggtcagattactagcacaggtagttcagaaaacgtacttgggagtcggccat

SEQ ID NO: 415222 - DNA, 140 bp, Artificial Sequence
  Synthetic
atggccgactcccaagtacgttttctgaactacctgtgctagtaatctgaccccattggtatgggtattttttatctttgcatatttccctacttttaggattttctcttcctggtgtatggagacccagcatggcgtat

SEQ ID NO: 415223 - DNA, 140 bp, Artificial Sequence
  Synthetic
atacgccatgctgggtctccgacatggatcccagagtgggacttcgtatctaccccaccactagtcaggttaacatttaacctagtaggagatcctataccaggcgcagagaccttctaccgtacttgggagtcggccat

SEQ ID NO: 415224 - DNA, 140 bp, Artificial Sequence
  Synthetic
atggccgactcccaagtacggtagaaggtctctgcgcctggtataggatctcctactaggttaaatgttaacctgactagtggtggggtagatacgaagtcccactctgggatccatgtcggagacccagcatggcgtat

SEQ ID NO: 415225 - DNA, 140 bp, Artificial Sequence
  Synthetic
aggccctggctgctgatatgtaacatttaacctagtaggagatcctataccaggcgcagagaccttctacacagatggatcatgcaatagacagtcaaaggaaggaaaagcacgatatgtgaccttttgggacagcggtg

SEQ ID NO: 415226 - DNA, 140 bp, Artificial Sequence
  Synthetic
caccgctgtcccaaaaggtcacatatcgtgcttttccttcctttgactgtctattgcatgatccatctgtgtagaaggtctctgcgcctggtataggatctcctactaggttaaatgttacatatcagcagccagggcct

SEQ ID NO: 415227 - DNA, 140 bp, Artificial Sequence
  Synthetic
atacgccatgctgggtctccagcaagcagaattagaagcctttgcgatgacactgacagactcgggtccaaaagttaatatcatagtagactcacagtatgtaatgggaatagtagtaggcgtacttgggagtcggccat

SEQ ID NO: 415228 - DNA, 140 bp, Artificial Sequence
  Synthetic
atggccgactcccaagtacgcctactactattcccattacatactgtgagtctactatgatattaacttttggacccgagtctgtcagtgtcatcgcaaaggcttctaattctgcttgctggagacccagcatggcgtat

SEQ ID NO: 415229 - DNA, 140 bp, Artificial Sequence
  Synthetic
aggccctggctgctgatatgaaagttaatatcatagtagactcacagtatgtaatgggaatagtagtaggccaaccaacagagtcagaaagtagaatagtaaaccaaatcattgaggacagaccttttgggacagcggtg

SEQ ID NO: 415230 - DNA, 140 bp, Artificial Sequence
  Synthetic
caccgctgtcccaaaaggtctgtcctcaatgatttggtttactattctactttctgactctgttggttggcctactactattcccattacatactgtgagtctactatgatattaactttcatatcagcagccagggcct

SEQ ID NO: 415231 - DNA, 140 bp, Artificial Sequence
  Synthetic
atacgccatgctgggtctccataggaggaaaccaggaagtagaccatttagtaagtcagggcatcagacaagtattgttcctagaaaggatagagcccgcccaagaagaacatgaaaaatcgtacttgggagtcggccat

SEQ ID NO: 415232 - DNA, 140 bp, Artificial Sequence
  Synthetic
atggccgactcccaagtacgatttttcatgttcttcttgggcgggctctatcctttctaggaacaatacttgtctgatgccctgacttactaaatggtctacttcctggtttcctcctatggagacccagcatggcgtat

SEQ ID NO: 415233 - DNA, 140 bp, Artificial Sequence
  Synthetic
atacgccatgctgggtctccatcatagcaatatgaaagaactaacccataaatttggaataccccaactagtagcaagacagatagtaaacacatgtgcccaatgccaacagaaaggagacgtacttgggagtcggccat

SEQ ID NO: 415234 - DNA, 140 bp, Artificial Sequence
  Synthetic
atggccgactcccaagtacgtctcctttctgttggcattgggcacatgtgtttactatctgtcttgctactagttggggtattccaaatttatgggttagttctttcatattgctatgatggagacccagcatggcgtat

SEQ ID NO: 415235 - DNA, 140 bp, Artificial Sequence
  Synthetic
atacgccatgctgggtctccgcacacacttagaaggaaagatcattatagtagcagtacatgttgcaagtggattcatagaagcagaagttatcccacaggaatcaggaaggcagacagccgtacttgggagtcggccat

SEQ ID NO: 415236 - DNA, 140 bp, Artificial Sequence
  Synthetic
atggccgactcccaagtacggctgtctgccttcctgattcctgtgggataacttctgcttctatgaatccacttgcaacatgtactgctactataatgatctttccttctaagtgtgtgcggagacccagcatggcgtat

SEQ ID NO: 415237 - DNA, 140 bp, Artificial Sequence
  Synthetic
aggccctggctgctgatatgtggataggtatagagcaatcctttggagtaccttacaacccacaaagccagggagtagtagaagcaatgaatcaccacttaaagaatcagataagtagaagaccttttgggacagcggtg

SEQ ID NO: 415238 - DNA, 140 bp, Artificial Sequence
  Synthetic
caccgctgtcccaaaaggtcttctacttatctgattctttaagtggtgattcattgcttctactactccctggctttgtgggttgtaaggtactccaaaggattgctctatacctatccacatatcagcagccagggcct

SEQ ID NO: 415239 - DNA, 140 bp, Artificial Sequence
  Synthetic
atacgccatgctgggtctccagtcatagtcaaggtaggggcagacataaaagtaataccaagaaggaaggccaagattatcagagactatggaggaaggcaagaactggatagttcccaccgtacttgggagtcggccat

SEQ ID NO: 415240 - DNA, 140 bp, Artificial Sequence
  Synthetic
atggccgactcccaagtacggtgggaactatccagttcttgccttcctccatagtctctgataatcttggccttccttcttggtattacttttatgtctgcccctaccttgactatgactggagacccagcatggcgtat

SEQ ID NO: 415241 - DNA, 140 bp, Artificial Sequence
  Synthetic
aggccctggctgctgatatgccaagattatcagagactatggaggaaggcaagaactggatagttcccacctggagggtgccagggaggaggatggagaggtggcatagtcttgtcaagtgaccttttgggacagcggtg

SEQ ID NO: 415242 - DNA, 140 bp, Artificial Sequence
  Synthetic
caccgctgtcccaaaaggtcacttgacaagactatgccacctctccatcctcctccctggcaccctccaggtgggaactatccagttcttgccttcctccatagtctctgataatcttggcatatcagcagccagggcct

SEQ ID NO: 415243 - DNA, 140 bp, Artificial Sequence
  Synthetic
atacgccatgctgggtctcccacaaggtgggatgggcgtggtggacttgcagcagggtaatattccctctaaaaggagaaagtcatctagagatacaggcatattggaacctaacgccagcgtacttgggagtcggccat

SEQ ID NO: 415244 - DNA, 140 bp, Artificial Sequence
  Synthetic
atggccgactcccaagtacgctggcgttaggttccaatatgcctgtatctctagatgactttctccttttagagggaatattaccctgctgcaagtccaccacgcccatcccaccttgtgggagacccagcatggcgtat

SEQ ID NO: 415245 - DNA, 140 bp, Artificial Sequence
  Synthetic
atacgccatgctgggtctccgtgcacttgcctggggggaggacatggaccgggaggatggagatcaggacctccccctcctccccctccaggtctagtctaatgactgaagcaccaacagcgtacttgggagtcggccat

SEQ ID NO: 415246 - DNA, 140 bp, Artificial Sequence
  Synthetic
atggccgactcccaagtacgctgttggtgcttcagtcattagactagacctggagggggaggagggggaggtcctgatctccatcctcccggtccatgtcctccccccaggcaagtgcacggagacccagcatggcgtat

SEQ ID NO: 415247 - DNA, 140 bp, Artificial Sequence
  Synthetic
aggccctggctgctgatatgctccccctcctccccctccaggtctagtctaatgactgaagcaccaacagagtttcccccagaagatgggaccccacggagggaactagggggtgactgggaccttttgggacagcggtg

SEQ ID NO: 415248 - DNA, 140 bp, Artificial Sequence
  Synthetic
caccgctgtcccaaaaggtcccagtcaccccctagttccctccgtggggtcccatcttctgggggaaactctgttggtgcttcagtcattagactagacctggagggggaggagggggagcatatcagcagccagggcct

SEQ ID NO: 415249 - DNA, 140 bp, Artificial Sequence
  Synthetic
atacgccatgctgggtctcctccccgcttgctaatcgctcttggcaactatatccatagtagacatggagacacacctgaaggcgccagagagctcattagaatcctacaacgagccctccgtacttgggagtcggccat

SEQ ID NO: 415250 - DNA, 140 bp, Artificial Sequence
  Synthetic
atggccgactcccaagtacggagggctcgttgtaggattctaatgagctctctggcgccttcaggtgtgtctccatgtctactatggatatagttgccaagagcgattagcaagcggggaggagacccagcatggcgtat

SEQ ID NO: 415251 - DNA, 140 bp, Artificial Sequence
  Synthetic
aggccctggctgctgatatgacacacctgaaggcgccagagagctcattagaatcctacaacgagccctcttcgtgcacctcagagcagggtgtaaccgctcaagaattagccaaacaaggaccttttgggacagcggtg

SEQ ID NO: 415252 - DNA, 140 bp, Artificial Sequence
  Synthetic
caccgctgtcccaaaaggtccttgtttggctaattcttgagcggttacaccctgctctgaggtgcacgaagagggctcgttgtaggattctaatgagctctctggcgccttcaggtgtgtcatatcagcagccagggcct

SEQ ID NO: 415253 - DNA, 140 bp, Artificial Sequence
  Synthetic
atacgccatgctgggtctcctcatgctattgtaagcagtgcagcttccattgccagctgtgtttcttgaaaaaagggctcgggatatggtatgcacgaaaaagcagacggagaagaactccgtacttgggagtcggccat

SEQ ID NO: 415254 - DNA, 140 bp, Artificial Sequence
  Synthetic
atggccgactcccaagtacggagttcttctccgtctgctttttcgtgcataccatatcccgagcccttttttcaagaaacacagctggcaatggaagctgcactgcttacaatagcatgaggagacccagcatggcgtat

SEQ ID NO: 415255 - DNA, 140 bp, Artificial Sequence
  Synthetic
aggccctggctgctgatatgaaaagggctcgggatatggtatgcacgaaaaagcagacggagaagaactccaagaaagactaagactcattcgtcttctgcatcagacaagtgagtaagagaccttttgggacagcggtg

SEQ ID NO: 415256 - DNA, 140 bp, Artificial Sequence
  Synthetic
caccgctgtcccaaaaggtctcttactcacttgtctgatgcagaagacgaatgagtcttagtctttcttggagttcttctccgtctgctttttcgtgcataccatatcccgagcccttttcatatcagcagccagggcct

SEQ ID NO: 415257 - DNA, 140 bp, Artificial Sequence
  Synthetic
atacgccatgctgggtctccttagtatattgcacccaatatgtgactgttttctatggcgtgcccgtgtggagaaatgcatccattcccctcttttgtgcaactaaaaacagagatacttcgtacttgggagtcggccat

SEQ ID NO: 415258 - DNA, 140 bp, Artificial Sequence
  Synthetic
atggccgactcccaagtacgaagtatctctgtttttagttgcacaaaagaggggaatggatgcatttctccacacgggcacgccatagaaaacagtcacatattgggtgcaatatactaaggagacccagcatggcgtat

SEQ ID NO: 415259 - DNA, 140 bp, Artificial Sequence
  Synthetic
aggccctggctgctgatatggagaaatgcatccattcccctcttttgtgcaactaaaaacagagatacttggggaaccatacagtgcaagccagacaatgatgattatcaagaaataaccgaccttttgggacagcggtg

SEQ ID NO: 415260 - DNA, 140 bp, Artificial Sequence
  Synthetic
caccgctgtcccaaaaggtcggttatttcttgataatcatcattgtctggcttgcactgtatggttccccaagtatctctgtttttagttgcacaaaagaggggaatggatgcatttctccatatcagcagccagggcct

SEQ ID NO: 415261 - DNA, 140 bp, Artificial Sequence
  Synthetic
atacgccatgctgggtctccagcagtagaagatgtctggagtctatttgagacatcaataaaaccatgcgtcaaactaacacctctatgtgtagcaatgagttgtaacagcaccactaaccgtacttgggagtcggccat

SEQ ID NO: 415262 - DNA, 140 bp, Artificial Sequence
  Synthetic
atggccgactcccaagtacggttagtggtgctgttacaactcattgctacacatagaggtgttagtttgacgcatggttttattgatgtctcaaatagactccagacatcttctactgctggagacccagcatggcgtat

SEQ ID NO: 415263 - DNA, 140 bp, Artificial Sequence
  Synthetic
aggccctggctgctgatatgtcaaactaacacctctatgtgtagcaatgagttgtaacagcaccactaacaacacaaccacaacagggagcacaacagggatgtcagagataaatgaaacgaccttttgggacagcggtg

SEQ ID NO: 415264 - DNA, 140 bp, Artificial Sequence
  Synthetic
caccgctgtcccaaaaggtcgtttcatttatctctgacatccctgttgtgctccctgttgtggttgtgttgttagtggtgctgttacaactcattgctacacatagaggtgttagtttgacatatcagcagccagggcct

SEQ ID NO: 415265 - DNA, 140 bp, Artificial Sequence
  Synthetic
atacgccatgctgggtctcctcaattgtcagttctatatgacaggattagagagagataagaaaaaacagtataatgaaacatggtactcaaaagatgtagtttgtgaatcaaataataccgtacttgggagtcggccat

SEQ ID NO: 415266 - DNA, 140 bp, Artificial Sequence
  Synthetic
atggccgactcccaagtacggtattatttgattcacaaactacatcttttgagtaccatgtttcattatactgttttttcttatctctctctaatcctgtcatatagaactgacaattgaggagacccagcatggcgtat

SEQ ID NO: 415267 - DNA, 140 bp, Artificial Sequence
  Synthetic
aggccctggctgctgatatgtataatgaaacatggtactcaaaagatgtagtttgtgaatcaaataataccaaagatgggaaaaacagatgttacatgaaccattgcaacacatcagtcagaccttttgggacagcggtg

SEQ ID NO: 415268 - DNA, 140 bp, Artificial Sequence
  Synthetic
caccgctgtcccaaaaggtctgactgatgtgttgcaatggttcatgtaacatctgtttttcccatctttggtattatttgattcacaaactacatcttttgagtaccatgtttcattatacatatcagcagccagggcct

SEQ ID NO: 415269 - DNA, 140 bp, Artificial Sequence
  Synthetic
atacgccatgctgggtctcctgtgcaccaccgggttatgccctactaagatgcaatgataccaattattcaggcttcgagccaaagtgttctaaagtagtagcttctacatgcacaaggacgtacttgggagtcggccat

SEQ ID NO: 415270 - DNA, 140 bp, Artificial Sequence
  Synthetic
atggccgactcccaagtacgtccttgtgcatgtagaagctactactttagaacactttggctcgaagcctgaataattggtatcattgcatcttagtagggcataacccggtggtgcacaggagacccagcatggcgtat

SEQ ID NO: 415271 - DNA, 140 bp, Artificial Sequence
  Synthetic
atacgccatgctgggtctcctgatggaaacgcaaacctccacttggtttggctttaatggcactagggcagagaatagaacatatatctattggcatggcagagataataggactatcatcgtacttgggagtcggccat

SEQ ID NO: 415272 - DNA, 140 bp, Artificial Sequence
  Synthetic
atggccgactcccaagtacgatgatagtcctattatctctgccatgccaatagatatatgttctattctctgccctagtgccattaaagccaaaccaagtggaggtttgcgtttccatcaggagacccagcatggcgtat

SEQ ID NO: 415273 - DNA, 140 bp, Artificial Sequence
  Synthetic
aggccctggctgctgatatgacaagacagttgtaccaataacactcatgtcagggttagtgtttcactcccagccaatcaatacaagacctaggcaagcatggtgctggttcaaaggcaagaccttttgggacagcggtg

SEQ ID NO: 415274 - DNA, 140 bp, Artificial Sequence
  Synthetic
caccgctgtcccaaaaggtcttgcctttgaaccagcaccatgcttgcctaggtcttgtattgattggctgggagtgaaacactaaccctgacatgagtgttattggtacaactgtcttgtcatatcagcagccagggcct

SEQ ID NO: 415275 - DNA, 140 bp, Artificial Sequence
  Synthetic
aggccctggctgctgatatgcagccaatcaatacaagacctaggcaagcatggtgctggttcaaaggcaagtggagggaagccatgcaggaggtaaagcaaacccttataaaacatcccagaccttttgggacagcggtg

SEQ ID NO: 415276 - DNA, 140 bp, Artificial Sequence
  Synthetic
caccgctgtcccaaaaggtctgggatgttttataagggtttgctttacctcctgcatggcttccctccacttgcctttgaaccagcaccatgcttgcctaggtcttgtattgattggctgcatatcagcagccagggcct

SEQ ID NO: 415277 - DNA, 140 bp, Artificial Sequence
  Synthetic
atacgccatgctgggtctccagaggctcagacccagaagtggcatacatgtggactaactgcagaggagaatttctctactgcaacatgacttggttcctcaattgggtagaaaacagaccgtacttgggagtcggccat

SEQ ID NO: 415278 - DNA, 140 bp, Artificial Sequence
  Synthetic
atggccgactcccaagtacggtctgttttctacccaattgaggaaccaagtcatgttgcagtagagaaattctcctctgcagttagtccacatgtatgccacttctgggtctgagcctctggagacccagcatggcgtat

SEQ ID NO: 415279 - DNA, 140 bp, Artificial Sequence
  Synthetic
aggccctggctgctgatatgatttctctactgcaacatgacttggttcctcaattgggtagaaaacagaccgaatcagacacagcacaattatgcgccgtgccatataaggcaaataattgaccttttgggacagcggtg

SEQ ID NO: 415280 - DNA, 140 bp, Artificial Sequence
  Synthetic
caccgctgtcccaaaaggtcaattatttgccttatatggcacggcgcataattgtgctgtgtctgattcggtctgttttctacccaattgaggaaccaagtcatgttgcagtagagaaatcatatcagcagccagggcct

SEQ ID NO: 415281 - DNA, 140 bp, Artificial Sequence
  Synthetic
atacgccatgctgggtctccacagttgacctgcaactcaacagtgaccagcataattgctaacattgacgtaaatagtaaccagacaaatattacctttagtgcagaggtggcagaactacgtacttgggagtcggccat

SEQ ID NO: 415282 - DNA, 140 bp, Artificial Sequence
  Synthetic
atggccgactcccaagtacgtagttctgccacctctgcactaaaggtaatatttgtctggttactatttacgtcaatgttagcaattatgctggtcactgttgagttgcaggtcaactgtggagacccagcatggcgtat

SEQ ID NO: 415283 - DNA, 140 bp, Artificial Sequence
  Synthetic
atacgccatgctgggtctcccttcgcacctacgagagagaaaagatattcctcggctccagtgaggaacaaaagaggtgtgtttgtgctagggttcttgggttttctcgcgacagcaggtcgtacttgggagtcggccat

SEQ ID NO: 415284 - DNA, 140 bp, Artificial Sequence
  Synthetic
atggccgactcccaagtacgacctgctgtcgcgagaaaacccaagaaccctagcacaaacacacctcttttgttcctcactggagccgaggaatatcttttctctctcgtaggtgcgaagggagacccagcatggcgtat

SEQ ID NO: 415285 - DNA, 140 bp, Artificial Sequence
  Synthetic
atacgccatgctgggtctccactggccgggatagtgcagcaacagcaacagctgttggacgtagtcaagagacaacaagaaatgttgcgactgaccgtctggggaacgaaaaatctccagcgtacttgggagtcggccat

SEQ ID NO: 415286 - DNA, 140 bp, Artificial Sequence
  Synthetic
atggccgactcccaagtacgctggagatttttcgttccccagacggtcagtcgcaacatttcttgttgtctcttgactacgtccaacagctgttgctgttgctgcactatcccggccagtggagacccagcatggcgtat

SEQ ID NO: 415287 - DNA, 140 bp, Artificial Sequence
  Synthetic
aggccctggctgctgatatggacaacaagaaatgttgcgactgaccgtctggggaacgaaaaatctccaggcaagagtcactgctatcgagaagtacttaaaggaccaggcacagttaaagaccttttgggacagcggtg

SEQ ID NO: 415288 - DNA, 140 bp, Artificial Sequence
  Synthetic
caccgctgtcccaaaaggtctttaactgtgcctggtcctttaagtacttctcgatagcagtgactcttgcctggagatttttcgttccccagacggtcagtcgcaacatttcttgttgtccatatcagcagccagggcct

SEQ ID NO: 415289 - DNA, 140 bp, Artificial Sequence
  Synthetic
atacgccatgctgggtctcctaaatgattctttatcgcctgactggaacaatatgacatggcaggaatgggaaaaacaagtccgctacctagaggcaaatatcagtcaaagtttagaacacgtacttgggagtcggccat

SEQ ID NO: 415290 - DNA, 140 bp, Artificial Sequence
  Synthetic
atggccgactcccaagtacgtgttctaaactttgactgatatttgcctctaggtagcggacttgtttttcccattcctgccatgtcatattgttccagtcaggcgataaagaatcatttaggagacccagcatggcgtat

SEQ ID NO: 415291 - DNA, 140 bp, Artificial Sequence
  Synthetic
aggccctggctgctgatatggaaaaacaagtccgctacctagaggcaaatatcagtcaaagtttagaacaggcacaaattcaacaagaaaagaatatgtatgaattacaaaagctaaatagaccttttgggacagcggtg

SEQ ID NO: 415292 - DNA, 140 bp, Artificial Sequence
  Synthetic
caccgctgtcccaaaaggtctatttagcttttgtaattcatacatattcttttcttgttgaatttgtgcctgttctaaactttgactgatatttgcctctaggtagcggacttgtttttccatatcagcagccagggcct

SEQ ID NO: 415293 - DNA, 140 bp, Artificial Sequence
  Synthetic
atacgccatgctgggtctccattcaatatggagtttatatagtagtaggagtgatagttttaagaatagcaatatatatagtgcaattgttaagtagacttagaaagggctataggcctgcgtacttgggagtcggccat

SEQ ID NO: 415294 - DNA, 140 bp, Artificial Sequence
  Synthetic
atggccgactcccaagtacgcaggcctatagccctttctaagtctacttaacaattgcactatatatattgctattcttaaaactatcactcctactactatataaactccatattgaatggagacccagcatggcgtat

SEQ ID NO: 415295 - DNA, 140 bp, Artificial Sequence
  Synthetic
aggccctggctgctgatatgaatatatatagtgcaattgttaagtagacttagaaagggctataggcctgttttctcttcccctcccggttatctccaacagatccatatccacacggacgaccttttgggacagcggtg

SEQ ID NO: 415296 - DNA, 140 bp, Artificial Sequence
  Synthetic
caccgctgtcccaaaaggtcgtccgtgtggatatggatctgttggagataaccgggaggggaagagaaaacaggcctatagccctttctaagtctacttaacaattgcactatatatattcatatcagcagccagggcct

SEQ ID NO: 415297 - DNA, 140 bp, Artificial Sequence
  Synthetic
atacgccatgctgggtctcctggttacgacttgtagccttggccgataaactatatacatttcctgatccacctactgactcgcctcttgaccgggctatacaagatctgcagagacttacgtacttgggagtcggccat

SEQ ID NO: 415298 - DNA, 140 bp, Artificial Sequence
  Synthetic
atggccgactcccaagtacgtaagtctctgcagatcttgtatagcccggtcaagaggcgagtcagtaggtggatcaggaaatgtatatagtttatcggccaaggctacaagtcgtaaccaggagacccagcatggcgtat

SEQ ID NO: 415299 - DNA, 140 bp, Artificial Sequence
  Synthetic
aggccctggctgctgatatgacctactgactcgcctcttgaccgggctatacaagatctgcagagacttactatccacgaactccccgacccaccgactgatctcccagaatctaacagcgaccttttgggacagcggtg

SEQ ID NO: 415300 - DNA, 140 bp, Artificial Sequence
  Synthetic
caccgctgtcccaaaaggtcgctgttagattctgggagatcagtcggtgggtcggggagttcgtggatagtaagtctctgcagatcttgtatagcccggtcaagaggcgagtcagtaggtcatatcagcagccagggcct

SEQ ID NO: 415301 - DNA, 140 bp, Artificial Sequence
  Synthetic
atacgccatgctgggtctccagtggatccaagaagcattccaagcattcgcaaagactacgagagagactcttgcgagcgcatggggggggttatgtgcagcagtgcaacgcgtcgggagcgtacttgggagtcggccat

SEQ ID NO: 415302 - DNA, 140 bp, Artificial Sequence
  Synthetic
atggccgactcccaagtacgctcccgacgcgttgcactgctgcacataaccccccccatgcgctcgcaagagtctctctcgtagtctttgcgaatgcttggaatgcttcttggatccactggagacccagcatggcgtat

SEQ ID NO: 415303 - DNA, 140 bp, Artificial Sequence
  Synthetic
aggccctggctgctgatatgcttgcgagcgcatggggggggttatgtgcagcagtgcaacgcgtcgggaggggaatactcgcagtcccaagaaggatcaggcaaggggcagaaatcgcccgaccttttgggacagcggtg

SEQ ID NO: 415304 - DNA, 140 bp, Artificial Sequence
  Synthetic
caccgctgtcccaaaaggtcgggcgatttctgccccttgcctgatccttcttgggactgcgagtattcccctcccgacgcgttgcactgctgcacataaccccccccatgcgctcgcaagcatatcagcagccagggcct

SEQ ID NO: 415305 - DNA, 140 bp, Artificial Sequence
  Synthetic
atacgccatgctgggtctccgagaaccccggcaatagaaggacagaaaaagttatacaagcagcaaaatatggatgatatagattctagtgatgatgacctagtgggagttcctgttacacgtacttgggagtcggccat

SEQ ID NO: 415306 - DNA, 140 bp, Artificial Sequence
  Synthetic
atggccgactcccaagtacgtgtaacaggaactcccactaggtcatcatcactagaatctatatcatccatattttgctgcttgtataactttttctgtccttctattgccggggttctcggagacccagcatggcgtat

SEQ ID NO: 415307 - DNA, 140 bp, Artificial Sequence
  Synthetic
aggccctggctgctgatatgtggatgatatagattctagtgatgatgacctagtgggagttcctgttacaccaagagtaccactaagagcaatgacctataaattggcagtagatatgtcgaccttttgggacagcggtg

SEQ ID NO: 415308 - DNA, 140 bp, Artificial Sequence
  Synthetic
caccgctgtcccaaaaggtcgacatatctactgccaatttataggtcattgctcttagtggtactcttggtgtaacaggaactcccactaggtcatcatcactagaatctatatcatccacatatcagcagccagggcct

SEQ ID NO: 415309 - DNA, 140 bp, Artificial Sequence
  Synthetic
atacgccatgctgggtctccggttggcgcccgaacagggacttgaagaaggctgagaagccctggaacacggctgagtgaaggcagtaagggcggcaggaacaaaccacgacggagtgctcgtacttgggagtcggccat

SEQ ID NO: 415310 - DNA, 140 bp, Artificial Sequence
  Synthetic
atggccgactcccaagtacgagcactccgtcgtggtttgttcctgccgcccttactgccttcactcagccgtgttccagggcttctcagccttcttcaagtccctgttcgggcgccaaccggagacccagcatggcgtat

SEQ ID NO: 415311 - DNA, 140 bp, Artificial Sequence
  Synthetic
aggccctggctgctgatatgggctgagtgaaggcagtaagggcggcaggaacaaaccacgacggagtgctcctagaaaagcgcgggccaaggtaccaaaggcggcgtgtggagcgggagtgaccttttgggacagcggtg

SEQ ID NO: 415312 - DNA, 140 bp, Artificial Sequence
  Synthetic
caccgctgtcccaaaaggtcactcccgctccacacgccgcctttggtaccttggcccgcgcttttctaggagcactccgtcgtggtttgttcctgccgcccttactgccttcactcagcccatatcagcagccagggcct

SEQ ID NO: 415313 - DNA, 140 bp, Artificial Sequence
  Synthetic
atacgccatgctgggtctcccctagaaaagcgcgggccaaggtaccaaaggcggcgtgtggagcgggagtgaaagaggcctccgggtgaaggtaagtacctcaccaaaaactgtagccagcgtacttgggagtcggccat

SEQ ID NO: 415314 - DNA, 140 bp, Artificial Sequence
  Synthetic
atggccgactcccaagtacgctggctacagtttttggtgaggtacttaccttcacccggaggcctctttcactcccgctccacacgccgcctttggtaccttggcccgcgcttttctaggggagacccagcatggcgtat

SEQ ID NO: 415315 - DNA, 140 bp, Artificial Sequence
  Synthetic
atacgccatgctgggtctccggcgcgaagaactccgtcctgagagggaaaaaagctgatgaattagaaagaattaggttacggcccggcggaaagaaaaaatacagagtaaaacatgttgcgtacttgggagtcggccat

SEQ ID NO: 415316 - DNA, 140 bp, Artificial Sequence
  Synthetic
atggccgactcccaagtacgcaacatgttttactctgtattttttctttccgccgggccgtaacctaattctttctaattcatcagcttttttccctctcaggacggagttcttcgcgccggagacccagcatggcgtat

SEQ ID NO: 415317 - DNA, 140 bp, Artificial Sequence
  Synthetic
atacgccatgctgggtctccgaatcaaaagagggttgccaaaaaattcttacagttttagatccattagtgccgacaggttcagaaaatttaaaaagcctttttaatactgtctgcgtcacgtacttgggagtcggccat

SEQ ID NO: 415318 - DNA, 140 bp, Artificial Sequence
  Synthetic
atggccgactcccaagtacgtgacgcagacagtattaaaaaggctttttaaattttctgaacctgtcggcactaatggatctaaaactgtaagaattttttggcaaccctcttttgattcggagacccagcatggcgtat

SEQ ID NO: 415319 - DNA, 140 bp, Artificial Sequence
  Synthetic
atacgccatgctgggtctccgccaaatacaagtagaccaacagcaccccctagcgagggagggggaaactttcccgtacaacgcataggcggcaactacacccacgtgccgctgagcccccgtacttgggagtcggccat

SEQ ID NO: 415320 - DNA, 140 bp, Artificial Sequence
  Synthetic
atggccgactcccaagtacgggggctcagcggcacgtgggtgtagttgccgcctatgcgttgtacgggaaagtttccccctccctcgctagggggtgctgttggtctacttgtatttggcggagacccagcatggcgtat

SEQ ID NO: 415321 - DNA, 140 bp, Artificial Sequence
  Synthetic
atacgccatgctgggtctccagaagtagtgccaggatttcaggcgctctcagaaggctgcacgccctatgatattaatcaaatgcttaattgtgtgggcgaccatcaagcagccatgcaacgtacttgggagtcggccat

SEQ ID NO: 415322 - DNA, 140 bp, Artificial Sequence
  Synthetic
atggccgactcccaagtacgttgcatggctgcttgatggtcgcccacacaattaagcatttgattaatatcatagggcgtgcagccttctgagagcgcctgaaatcctggcactacttctggagacccagcatggcgtat

SEQ ID NO: 415323 - DNA, 140 bp, Artificial Sequence
  Synthetic
aggccctggctgctgatatgatattaatcaaatgcttaattgtgtgggcgaccatcaagcagccatgcaaataatcagggaaattattaatgaagaagcagcagattgggatgtgcaacagaccttttgggacagcggtg

SEQ ID NO: 415324 - DNA, 140 bp, Artificial Sequence
  Synthetic
caccgctgtcccaaaaggtctgttgcacatcccaatctgctgcttcttcattaataatttccctgattatttgcatggctgcttgatggtcgcccacacaattaagcatttgattaatatcatatcagcagccagggcct

SEQ ID NO: 415325 - DNA, 140 bp, Artificial Sequence
  Synthetic
atacgccatgctgggtctccctgacatagcaggaacaacaagcacagtagaagaacagatcgagtggatgtttagagcacaaaatcctgtaccagtgggaaacatctatagaagatggatcgtacttgggagtcggccat

SEQ ID NO: 415326 - DNA, 140 bp, Artificial Sequence
  Synthetic
atggccgactcccaagtacgatccatcttctatagatgtttcccactggtacaggattttgtgctctaaacatccactcgatctgttcttctactgtgcttgttgttcctgctatgtcagggagacccagcatggcgtat

SEQ ID NO: 415327 - DNA, 140 bp, Artificial Sequence
  Synthetic
aggccctggctgctgatatgtttagagcacaaaatcctgtaccagtgggaaacatctatagaagatggatccagatagggctgcaaaagtgtgtcaggatgtacaatccgaccaacatccgaccttttgggacagcggtg

SEQ ID NO: 415328 - DNA, 140 bp, Artificial Sequence
  Synthetic
caccgctgtcccaaaaggtcggatgttggtcggattgtacatcctgacacacttttgcagccctatctggatccatcttctatagatgtttcccactggtacaggattttgtgctctaaacatatcagcagccagggcct

SEQ ID NO: 415329 - DNA, 140 bp, Artificial Sequence
  Synthetic
atacgccatgctgggtctccttctacaagagcttgagagcagaacagacagatccagcagtaaagaattggatgacccaaacattactgatacaaaatgccaacccagattgtaaaataacgtacttgggagtcggccat

SEQ ID NO: 415330 - DNA, 140 bp, Artificial Sequence
  Synthetic
atggccgactcccaagtacgttattttacaatctgggttggcattttgtatcagtaatgtttgggtcatccaattctttactgctggatctgtctgttctgctctcaagctcttgtagaaggagacccagcatggcgtat

SEQ ID NO: 415331 - DNA, 140 bp, Artificial Sequence
  Synthetic
aggccctggctgctgatatggatgacccaaacattactgatacaaaatgccaacccagattgtaaaataatactaaaaggactagggatgaatccaaccttagaaggaatgctaaccgccgaccttttgggacagcggtg

SEQ ID NO: 415332 - DNA, 140 bp, Artificial Sequence
  Synthetic
caccgctgtcccaaaaggtcggcggttagcattccttctaaggttggattcatccctagtccttttagtattattttacaatctgggttggcattttgtatcagtaatgtttgggtcatccatatcagcagccagggcct

SEQ ID NO: 415333 - DNA, 140 bp, Artificial Sequence
  Synthetic
atacgccatgctgggtctcccttaaaggaggccatgggaccaacccctatcccattcgtagcagcccagcagagaaagacaattaggtgctggaattgtggaaaggaaggacactcagcacgtacttgggagtcggccat

SEQ ID NO: 415334 - DNA, 140 bp, Artificial Sequence
  Synthetic
atggccgactcccaagtacgtgctgagtgtccttcctttccacaattccagcacctaattgtctttctctgctgggctgctacgaatgggataggggttggtcccatggcctcctttaagggagacccagcatggcgtat

SEQ ID NO: 415335 - DNA, 140 bp, Artificial Sequence
  Synthetic
aggccctggctgctgatatgagagaaagacaattaggtgctggaattgtggaaaggaaggacactcagcaagacagtgccgagcacctagaaaacagggctgttggaagtgtggcaagccgaccttttgggacagcggtg

SEQ ID NO: 415336 - DNA, 140 bp, Artificial Sequence
  Synthetic
caccgctgtcccaaaaggtcggcttgccacacttccaacagccctgttttctaggtgctcggcactgtcttgctgagtgtccttcctttccacaattccagcacctaattgtctttctctcatatcagcagccagggcct

SEQ ID NO: 415337 - DNA, 140 bp, Artificial Sequence
  Synthetic
atacgccatgctgggtctcctgggcccccggggaaagaagccccgcaacttccccgtggcccaaatcccgcaggggctaacaccaacagcacccccaatggatccagcagtggacctattcgtacttgggagtcggccat

SEQ ID NO: 415338 - DNA, 140 bp, Artificial Sequence
  Synthetic
atggccgactcccaagtacgaataggtccactgctggatccattgggggtgctgttggtgttagcccctgcgggatttgggccacggggaagttgcggggcttctttccccgggggcccaggagacccagcatggcgtat

SEQ ID NO: 415339 - DNA, 140 bp, Artificial Sequence
  Synthetic
aggccctggctgctgatatgcaggggctaacaccaacagcacccccaatggatccagcagtggacctattggagaaatatatgcagcaagggagaaagcagagggagcagagagagagacgaccttttgggacagcggtg

SEQ ID NO: 415340 - DNA, 140 bp, Artificial Sequence
  Synthetic
caccgctgtcccaaaaggtcgtctctctctctgctccctctgctttctcccttgctgcatatatttctccaataggtccactgctggatccattgggggtgctgttggtgttagcccctgcatatcagcagccagggcct

SEQ ID NO: 415341 - DNA, 140 bp, Artificial Sequence
  Synthetic
atacgccatgctgggtctccccctgcggggaaacgacagaagacttgctgcacctcaattctctctttggaaaagacctgtagtcacagcatacatcgagggtcagccagtagaagttttcgtacttgggagtcggccat

SEQ ID NO: 415342 - DNA, 140 bp, Artificial Sequence
  Synthetic
atggccgactcccaagtacgaaaacttctactggctgaccctcgatgtatgctgtgactacaggtcttttccaaagagagaattgaggtgcagcaagtcttctgtcgtttccccgcagggggagacccagcatggcgtat

SEQ ID NO: 415343 - DNA, 140 bp, Artificial Sequence
  Synthetic
aggccctggctgctgatatgaaaagacctgtagtcacagcatacatcgagggtcagccagtagaagttttgctagacacaggggctgacgactcaatagtagcaggaatagagttaggaagaccttttgggacagcggtg

SEQ ID NO: 415344 - DNA, 140 bp, Artificial Sequence
  Synthetic
caccgctgtcccaaaaggtcttcctaactctattcctgctactattgagtcgtcagcccctgtgtctagcaaaacttctactggctgaccctcgatgtatgctgtgactacaggtcttttcatatcagcagccagggcct

SEQ ID NO: 415345 - DNA, 140 bp, Artificial Sequence
  Synthetic
atacgccatgctgggtctccaaagaatataaaaatgtagaaatagaagtcctaggtaaaaaggtaagggccaccataatgacaggtgataccccaatcaacatttttggcagaaacatttcgtacttgggagtcggccat

SEQ ID NO: 415346 - DNA, 140 bp, Artificial Sequence
  Synthetic
atggccgactcccaagtacgaaatgtttctgccaaaaatgttgattggggtatcacctgtcattatggtggcccttacctttttacctaggacttctatttctacatttttatattctttggagacccagcatggcgtat

SEQ ID NO: 415347 - DNA, 140 bp, Artificial Sequence
  Synthetic
aggccctggctgctgatatgcaccataatgacaggtgataccccaatcaacatttttggcagaaacattttgacagccttaggcatgtctttaaacctaccagtcgccaagatagaaccagaccttttgggacagcggtg

SEQ ID NO: 415348 - DNA, 140 bp, Artificial Sequence
  Synthetic
caccgctgtcccaaaaggtctggttctatcttggcgactggtaggtttaaagacatgcctaaggctgtcaaaatgtttctgccaaaaatgttgattggggtatcacctgtcattatggtgcatatcagcagccagggcct

SEQ ID NO: 415349 - DNA, 140 bp, Artificial Sequence
  Synthetic
atacgccatgctgggtctccgcccttaacaaaagaaaaaatagaggcattaaaggaaatctgtgaaaagatggaaagagagggccagctagaggaagcacctccaactaatccttataatcgtacttgggagtcggccat

SEQ ID NO: 415350 - DNA, 140 bp, Artificial Sequence
  Synthetic
atggccgactcccaagtacgattataaggattagttggaggtgcttcctctagctggccctctctttccatcttttcacagatttcctttaatgcctctattttttcttttgttaagggcggagacccagcatggcgtat

SEQ ID NO: 415351 - DNA, 140 bp, Artificial Sequence
  Synthetic
aggccctggctgctgatatgtggaaagagagggccagctagaggaagcacctccaactaatccttataatacccccacatttgcaatcagaaaaaaggacaagaataaatggaggatgctgaccttttgggacagcggtg

SEQ ID NO: 415352 - DNA, 140 bp, Artificial Sequence
  Synthetic
caccgctgtcccaaaaggtcagcatcctccatttattcttgtccttttttctgattgcaaatgtgggggtattataaggattagttggaggtgcttcctctagctggccctctctttccacatatcagcagccagggcct

SEQ ID NO: 415353 - DNA, 140 bp, Artificial Sequence
  Synthetic
atacgccatgctgggtctccagctaggaattccacacccggcaggattggccaagaaaagaagaatcactgtactagatgtaggggatgcttacttttccataccactgcatgaggacttcgtacttgggagtcggccat

SEQ ID NO: 415354 - DNA, 140 bp, Artificial Sequence
  Synthetic
atggccgactcccaagtacgaagtcctcatgcagtggtatggaaaagtaagcatcccctacatctagtacagtgattcttcttttcttggccaatcctgccgggtgtggaattcctagctggagacccagcatggcgtat

SEQ ID NO: 415355 - DNA, 140 bp, Artificial Sequence
  Synthetic
aggccctggctgctgatatggtactagatgtaggggatgcttacttttccataccactgcatgaggactttagacagtacactgcatttaccttgccgtcagtaaacaatgcagaaccaggaccttttgggacagcggtg

SEQ ID NO: 415356 - DNA, 140 bp, Artificial Sequence
  Synthetic
caccgctgtcccaaaaggtcctggttctgcattgtttactgacggcaaggtaaatgcagtgtactgtctaaagtcctcatgcagtggtatggaaaagtaagcatcccctacatctagtaccatatcagcagccagggcct

SEQ ID NO: 415357 - DNA, 140 bp, Artificial Sequence
  Synthetic
atacgccatgctgggtctccgcaatttttcaatacacaatgaggaagatcttagagccattcagaaaggcaaaccaggatgtcattatcattcaatacatggatgatatcctaatagctacgtacttgggagtcggccat

SEQ ID NO: 415358 - DNA, 140 bp, Artificial Sequence
  Synthetic
atggccgactcccaagtacgtagctattaggatatcatccatgtattgaatgataatgacatcctggtttgcctttctgaatggctctaagatcttcctcattgtgtattgaaaaattgcggagacccagcatggcgtat

SEQ ID NO: 415359 - DNA, 140 bp, Artificial Sequence
  Synthetic
aggccctggctgctgatatgaaaccaggatgtcattatcattcaatacatggatgatatcctaatagctagcgacaggtcagatccagaacatgacaaagtagtcctacagctaaaggaagaccttttgggacagcggtg

SEQ ID NO: 415360 - DNA, 140 bp, Artificial Sequence
  Synthetic
caccgctgtcccaaaaggtcttcctttagctgtaggactactttgtcatgttctggatctgacctgtcgctagctattaggatatcatccatgtattgaatgataatgacatcctggtttcatatcagcagccagggcct

SEQ ID NO: 415361 - DNA, 140 bp, Artificial Sequence
  Synthetic
atacgccatgctgggtctcctcctccatactactggatgggctatgaattatggccaactaaatggaagttgcagaaaatacagttgccccagaaggaggtatggacagtcaatgacatccgtacttgggagtcggccat

SEQ ID NO: 415362 - DNA, 140 bp, Artificial Sequence
  Synthetic
atggccgactcccaagtacggatgtcattgactgtccatacctccttctggggcaactgtattttctgcaacttccatttagttggccataattcatagcccatccagtagtatggaggaggagacccagcatggcgtat

SEQ ID NO: 415363 - DNA, 140 bp, Artificial Sequence
  Synthetic
aggccctggctgctgatatgtgcagaaaatacagttgccccagaaggaggtatggacagtcaatgacatccaaaagctagtgggcgtcctaaattgggcggcacaaatttacccaggaatgaccttttgggacagcggtg

SEQ ID NO: 415364 - DNA, 140 bp, Artificial Sequence
  Synthetic
caccgctgtcccaaaaggtcattcctgggtaaatttgtgccgcccaatttaggacgcccactagcttttggatgtcattgactgtccatacctccttctggggcaactgtattttctgcacatatcagcagccagggcct

SEQ ID NO: 415365 - DNA, 140 bp, Artificial Sequence
  Synthetic
atacgccatgctgggtctccaagaagtgcagtggacagagttagcagaagcggagctagaagaaaacagaatcatattaagccaggaacaagagggacactattacaaagaggaaaaagacgtacttgggagtcggccat

SEQ ID NO: 415366 - DNA, 140 bp, Artificial Sequence
  Synthetic
atggccgactcccaagtacgtctttttcctctttgtaatagtgtccctcttgttcctggcttaatatgattctgttttcttctagctccgcttctgctaactctgtccactgcacttcttggagacccagcatggcgtat

SEQ ID NO: 415367 - DNA, 140 bp, Artificial Sequence
  Synthetic
aggccctggctgctgatatgatcatattaagccaggaacaagagggacactattacaaagaggaaaaagaactagaggcaacagtccaaaaagaccaagacaatcagtggacgtacaagggaccttttgggacagcggtg

SEQ ID NO: 415368 - DNA, 140 bp, Artificial Sequence
  Synthetic
caccgctgtcccaaaaggtcccttgtacgtccactgattgtcttggtctttttggactgttgcctctagttctttttcctctttgtaatagtgtccctcttgttcctggcttaatatgatcatatcagcagccagggcct

SEQ ID NO: 415369 - DNA, 140 bp, Artificial Sequence
  Synthetic
atacgccatgctgggtctccaatgcccataccaacggggtcagattactagcacaggtagttcagaaaataggaaaggaagcactagtcatctgggggcgaataccaaaatttcacctaccgtacttgggagtcggccat

SEQ ID NO: 415370 - DNA, 140 bp, Artificial Sequence
  Synthetic
atggccgactcccaagtacggtaggtgaaattttggtattcgcccccagatgactagtgcttcctttcctattttctgaactacctgtgctagtaatctgaccccgttggtatgggcattggagacccagcatggcgtat

SEQ ID NO: 415371 - DNA, 140 bp, Artificial Sequence
  Synthetic
aggccctggctgctgatatgaggaaaggaagcactagtcatctgggggcgaataccaaaatttcacctaccagtagaaagagaaacctgggaacagtggtgggatgattactggcaggtggaccttttgggacagcggtg

SEQ ID NO: 415372 - DNA, 140 bp, Artificial Sequence
  Synthetic
caccgctgtcccaaaaggtccacctgccagtaatcatcccaccactgttcccaggtttctctttctactggtaggtgaaattttggtattcgcccccagatgactagtgcttcctttcctcatatcagcagccagggcct

SEQ ID NO: 415373 - DNA, 140 bp, Artificial Sequence
  Synthetic
atacgccatgctgggtctccagcatttaacctagtaaaagatcccataccaggcgcagagaccatctacacagacggatcctgcaataagcagtcaaaagaaggaaaagcaggatatgtacgtacttgggagtcggccat

SEQ ID NO: 415374 - DNA, 140 bp, Artificial Sequence
  Synthetic
atggccgactcccaagtacgtacatatcctgcttttccttcttttgactgcttattgcaggatccgtctgtgtagatggtctctgcgcctggtatgggatcttttactaggttaaatgctggagacccagcatggcgtat

SEQ ID NO: 415375 - DNA, 140 bp, Artificial Sequence
  Synthetic
aggccctggctgctgatatgcagacggatcctgcaataagcagtcaaaagaaggaaaagcaggatatgtaacagatagagggagagacagggtaaaggtactagagcaaactaccaatcagaccttttgggacagcggtg

SEQ ID NO: 415376 - DNA, 140 bp, Artificial Sequence
  Synthetic
caccgctgtcccaaaaggtctgattggtagtttgctctagtacctttaccctgtctctccctctatctgttacatatcctgcttttccttcttttgactgcttattgcaggatccgtctgcatatcagcagccagggcct

SEQ ID NO: 415377 - DNA, 140 bp, Artificial Sequence
  Synthetic
atacgccatgctgggtctccaagtcaatattatagtagactcacagtatgtaatgggaatagtggcaggccaaccaacagagtcagaaaatagactagtaaatcagatcatagaagaaatcgtacttgggagtcggccat

SEQ ID NO: 415378 - DNA, 140 bp, Artificial Sequence
  Synthetic
atggccgactcccaagtacgatttcttctatgatctgatttactagtctattttctgactctgttggttggcctgccactattcccattacatactgtgagtctactataatattgacttggagacccagcatggcgtat

SEQ ID NO: 415379 - DNA, 140 bp, Artificial Sequence
  Synthetic
aggccctggctgctgatatgcaaccaacagagtcagaaaatagactagtaaatcagatcatagaagaaatgataaaaaaggaagcaatctatgttgcatgggtcccagcccacaaaggcagaccttttgggacagcggtg

SEQ ID NO: 415380 - DNA, 140 bp, Artificial Sequence
  Synthetic
caccgctgtcccaaaaggtctgcctttgtgggctgggacccatgcaacatagattgcttccttttttatcatttcttctatgatctgatttactagtctattttctgactctgttggttgcatatcagcagccagggcct

SEQ ID NO: 415381 - DNA, 140 bp, Artificial Sequence
  Synthetic
atacgccatgctgggtctccgtattgttcctagaaaaaatagagcccgctcaagaagaacatgaaaaatatcataacaatgtgaaagaactatcccacaaatttggattacccaaactagcgtacttgggagtcggccat

SEQ ID NO: 415382 - DNA, 140 bp, Artificial Sequence
  Synthetic
atggccgactcccaagtacgctagtttgggtaatccaaatttgtgggatagttctttcacattgttatgatatttttcatgttcttcttgagcgggctctattttttctaggaacaatacggagacccagcatggcgtat

SEQ ID NO: 415383 - DNA, 140 bp, Artificial Sequence
  Synthetic
aggccctggctgctgatatgtcataacaatgtgaaagaactatcccacaaatttggattacccaaactagtggcaagacaaatagtaaacacatgtgcccaatgtcaacagaaaggggaggaccttttgggacagcggtg

SEQ ID NO: 415384 - DNA, 140 bp, Artificial Sequence
  Synthetic
caccgctgtcccaaaaggtcctcccctttctgttgacattgggcacatgtgtttactatttgtcttgccactagtttgggtaatccaaatttgtgggatagttctttcacattgttatgacatatcagcagccagggcct

SEQ ID NO: 415385 - DNA, 140 bp, Artificial Sequence
  Synthetic
atacgccatgctgggtctcccacacatttagaaggaaaagtcatcatagtggcagtacatgttgcaagtggatttatagaggcagaagtcatcccacaagaatcaggaaggcaaacagcacgtacttgggagtcggccat

SEQ ID NO: 415386 - DNA, 140 bp, Artificial Sequence
  Synthetic
atggccgactcccaagtacgtgctgtttgccttcctgattcttgtgggatgacttctgcctctataaatccacttgcaacatgtactgccactatgatgacttttccttctaaatgtgtgggagacccagcatggcgtat

SEQ ID NO: 415387 - DNA, 140 bp, Artificial Sequence
  Synthetic
atacgccatgctgggtctccagataatggagctaacttcacttcacaagaagtgaagatggtagcatggtgggtaggtatagagcaatcctttggagtaccttacaatccacaaagccagcgtacttgggagtcggccat

SEQ ID NO: 415388 - DNA, 140 bp, Artificial Sequence
  Synthetic
atggccgactcccaagtacgctggctttgtggattgtaaggtactccaaaggattgctctatacctacccaccatgctaccatcttcacttcttgtgaagtgaagttagctccattatctggagacccagcatggcgtat

SEQ ID NO: 415389 - DNA, 140 bp, Artificial Sequence
  Synthetic
atacgccatgctgggtctcccagagagcaggcaaatacagtagaaacaatagtattaatggcagttcattgcatgaattttaaaagaaggggaggaataggggatatgaccccatcagagcgtacttgggagtcggccat

SEQ ID NO: 415390 - DNA, 140 bp, Artificial Sequence
  Synthetic
atggccgactcccaagtacgctctgatggggtcatatcccctattcctccccttcttttaaaattcatgcaatgaactgccattaatactattgtttctactgtatttgcctgctctctgggagacccagcatggcgtat

SEQ ID NO: 415391 - DNA, 140 bp, Artificial Sequence
  Synthetic
aggccctggctgctgatatggcatgaattttaaaagaaggggaggaataggggatatgaccccatcagagagactaatcaacatgatcaccgcagaacaagagatacaattcctccaagcgaccttttgggacagcggtg

SEQ ID NO: 415392 - DNA, 140 bp, Artificial Sequence
  Synthetic
caccgctgtcccaaaaggtcgcttggaggaattgtatctcttgttctgcggtgatcatgttgattagtctctctgatggggtcatatcccctattcctccccttcttttaaaattcatgccatatcagcagccagggcct

SEQ ID NO: 415393 - DNA, 140 bp, Artificial Sequence
  Synthetic
atacgccatgctgggtctccatcagttgtggaaaggacctggggaactactgtggaagggtgacggagcggtcatagtcaaggtaggaacagacataaaaataataccaagaaggaaggccgtacttgggagtcggccat

SEQ ID NO: 415394 - DNA, 140 bp, Artificial Sequence
  Synthetic
atggccgactcccaagtacggccttccttcttggtattatttttatgtctgttcctaccttgactatgaccgctccgtcacccttccacagtagttccccaggtcctttccacaactgatggagacccagcatggcgtat

SEQ ID NO: 415395 - DNA, 140 bp, Artificial Sequence
  Synthetic
aggccctggctgctgatatggtcatagtcaaggtaggaacagacataaaaataataccaagaaggaaggccaagatcatcagggactatggaggaaggcaagaggtggatagtggtccccgaccttttgggacagcggtg

SEQ ID NO: 415396 - DNA, 140 bp, Artificial Sequence
  Synthetic
caccgctgtcccaaaaggtcggggaccactatccacctcttgccttcctccatagtccctgatgatcttggccttccttcttggtattatttttatgtctgttcctaccttgactatgaccatatcagcagccagggcct

SEQ ID NO: 415397 - DNA, 140 bp, Artificial Sequence
  Synthetic
atacgccatgctgggtctcctctaaaatacaaaacaaaagatctggaaagggtgtgctatgtcccccaccataaggtggggtgggcatggtggacttgcagcagggtaatattcccattacgtacttgggagtcggccat

SEQ ID NO: 415398 - DNA, 140 bp, Artificial Sequence
  Synthetic
atggccgactcccaagtacgtaatgggaatattaccctgctgcaagtccaccatgcccaccccaccttatggtgggggacatagcacaccctttccagatcttttgttttgtattttagaggagacccagcatggcgtat

SEQ ID NO: 415399 - DNA, 140 bp, Artificial Sequence
  Synthetic
aggccctggctgctgatatgataaggtggggtgggcatggtggacttgcagcagggtaatattcccattaaacaacaatagcaacctagagatacaggcatattggaatctaacaccagagaccttttgggacagcggtg

SEQ ID NO: 415400 - DNA, 140 bp, Artificial Sequence
  Synthetic
caccgctgtcccaaaaggtctctggtgttagattccaatatgcctgtatctctaggttgctattgttgtttaatgggaatattaccctgctgcaagtccaccatgcccaccccaccttatcatatcagcagccagggcct

SEQ ID NO: 415401 - DNA, 140 bp, Artificial Sequence
  Synthetic
atacgccatgctgggtctccaattctggacagatgttaccccagactatgcagactccctaatacatggcacttatttcgcttgctttacagcaggtgaagtaagaagagccatcagaggcgtacttgggagtcggccat

SEQ ID NO: 415402 - DNA, 140 bp, Artificial Sequence
  Synthetic
atggccgactcccaagtacgcctctgatggctcttcttacttcacctgctgtaaagcaagcgaaataagtgccatgtattagggagtctgcatagtctggggtaacatctgtccagaattggagacccagcatggcgtat

SEQ ID NO: 415403 - DNA, 140 bp, Artificial Sequence
  Synthetic
aggccctggctgctgatatgacttatttcgcttgctttacagcaggtgaagtaagaagagccatcagaggggaaaaagtattgtcctgctgcaattatccccaggcccataagacccagggaccttttgggacagcggtg

SEQ ID NO: 415404 - DNA, 140 bp, Artificial Sequence
  Synthetic
caccgctgtcccaaaaggtccctgggtcttatgggcctggggataattgcagcaggacaatactttttcccctctgatggctcttcttacttcacctgctgtaaagcaagcgaaataagtcatatcagcagccagggcct

SEQ ID NO: 415405 - DNA, 140 bp, Artificial Sequence
  Synthetic
atacgccatgctgggtctcctcccagagagacagtaccaccaggaaacagcggcgaagagactatcggagaggccttcgcttggctagagaggacggtagaagccataaacagagaggcacgtacttgggagtcggccat

SEQ ID NO: 415406 - DNA, 140 bp, Artificial Sequence
  Synthetic
atggccgactcccaagtacgtgcctctctgtttatggcttctaccgtcctctctagccaagcgaaggcctctccgatagtctcttcgccgctgtttcctggtggtactgtctctctgggaggagacccagcatggcgtat

SEQ ID NO: 415407 - DNA, 140 bp, Artificial Sequence
  Synthetic
aggccctggctgctgatatgaggccttcgcttggctagagaggacggtagaagccataaacagagaggcagtgaatcacctgcccagggagctcattttccaggtgtggcaaaggtcctggaccttttgggacagcggtg

SEQ ID NO: 415408 - DNA, 140 bp, Artificial Sequence
  Synthetic
caccgctgtcccaaaaggtccaggacctttgccacacctggaaaatgagctccctgggcaggtgattcactgcctctctgtttatggcttctaccgtcctctctagccaagcgaaggcctcatatcagcagccagggcct

SEQ ID NO: 415409 - DNA, 140 bp, Artificial Sequence
  Synthetic
atacgccatgctgggtctccgatacttatgcttgatgcagaaagcaatgttcatacatgctagaagagggtgcacttgcctgggaggagggcacgggggaggagggtggagatcaggacccgtacttgggagtcggccat

SEQ ID NO: 415410 - DNA, 140 bp, Artificial Sequence
  Synthetic
atggccgactcccaagtacgggtcctgatctccaccctcctcccccgtgccctcctcccaggcaagtgcaccctcttctagcatgtatgaacattgctttctgcatcaagcataagtatcggagacccagcatggcgtat

SEQ ID NO: 415411 - DNA, 140 bp, Artificial Sequence
  Synthetic
aggccctggctgctgatatgtgcacttgcctgggaggagggcacgggggaggagggtggagatcaggacctctccctcctccccctccaggttgggtttaaatgactgaagcaccaacaggaccttttgggacagcggtg

SEQ ID NO: 415412 - DNA, 140 bp, Artificial Sequence
  Synthetic
caccgctgtcccaaaaggtcctgttggtgcttcagtcatttaaacccaacctggagggggaggagggagaggtcctgatctccaccctcctcccccgtgccctcctcccaggcaagtgcacatatcagcagccagggcct

SEQ ID NO: 415413 - DNA, 140 bp, Artificial Sequence
  Synthetic
atacgccatgctgggtctccgtaatagaaatcctaagagaaataaaagaagaagctttaaggcattttgacccccgcttgctgactgctcttggcagatatatctacactagatatggagcgtacttgggagtcggccat

SEQ ID NO: 415414 - DNA, 140 bp, Artificial Sequence
  Synthetic
atggccgactcccaagtacgctccatatctagtgtagatatatctgccaagagcagtcagcaagcgggggtcaaaatgccttaaagcttcttcttttatttctcttaggatttctattacggagacccagcatggcgtat

SEQ ID NO: 415415 - DNA, 140 bp, Artificial Sequence
  Synthetic
aggccctggctgctgatatgcccccgcttgctgactgctcttggcagatatatctacactagatatggagacacccctgaaggtgccagagagctcattagagtcttgcaacgagcccttgaccttttgggacagcggtg

SEQ ID NO: 415416 - DNA, 140 bp, Artificial Sequence
  Synthetic
caccgctgtcccaaaaggtcaagggctcgttgcaagactctaatgagctctctggcaccttcaggggtgtctccatatctagtgtagatatatctgccaagagcagtcagcaagcgggggcatatcagcagccagggcct

SEQ ID NO: 415417 - DNA, 140 bp, Artificial Sequence
  Synthetic
atacgccatgctgggtctccaggaggaaatcctctctcagctattccaacccctagaagcatgcgataactcgtgctattgtaagaaatgctgcttccactgcgagttgtgttttttacacgtacttgggagtcggccat

SEQ ID NO: 415418 - DNA, 140 bp, Artificial Sequence
  Synthetic
atggccgactcccaagtacgtgtaaaaaacacaactcgcagtggaagcagcatttcttacaatagcacgagttatcgcatgcttctaggggttggaatagctgagagaggatttcctcctggagacccagcatggcgtat

SEQ ID NO: 415419 - DNA, 140 bp, Artificial Sequence
  Synthetic
aggccctggctgctgatatgtcgtgctattgtaagaaatgctgcttccactgcgagttgtgttttttacaaaagggactcgggatatgttatgaccgaaagggcaggcgaagaaggacccgaccttttgggacagcggtg

SEQ ID NO: 415420 - DNA, 140 bp, Artificial Sequence
  Synthetic
caccgctgtcccaaaaggtcgggtccttcttcgcctgccctttcggtcataacatatcccgagtcccttttgtaaaaaacacaactcgcagtggaagcagcatttcttacaatagcacgacatatcagcagccagggcct

SEQ ID NO: 415421 - DNA, 140 bp, Artificial Sequence
  Synthetic
atacgccatgctgggtctcccacgtgaaagggcccagctgcttgttgtcattttgctaactagtacttgcttaatatattgcaaacaacaatatgtaactgttttctatggcatacccgccgtacttgggagtcggccat

SEQ ID NO: 415422 - DNA, 140 bp, Artificial Sequence
  Synthetic
atggccgactcccaagtacggcgggtatgccatagaaaacagttacatattgttgtttgcaatatattaagcaagtactagttagcaaaatgacaacaagcagctgggccctttcacgtgggagacccagcatggcgtat

SEQ ID NO: 415423 - DNA, 140 bp, Artificial Sequence
  Synthetic
aggccctggctgctgatatgttaatatattgcaaacaacaatatgtaactgttttctatggcatacccgcgtggaagaatgcatccatccctctcttttgtgcaaccaaaaatagagatagaccttttgggacagcggtg

SEQ ID NO: 415424 - DNA, 140 bp, Artificial Sequence
  Synthetic
caccgctgtcccaaaaggtctatctctatttttggttgcacaaaagagagggatggatgcattcttccacgcgggtatgccatagaaaacagttacatattgttgtttgcaatatattaacatatcagcagccagggcct

SEQ ID NO: 415425 - DNA, 140 bp, Artificial Sequence
  Synthetic
atacgccatgctgggtctccgctttaaatgtgacagaggctttcgatgcatgggacaatacagtgacagaacaagcagtagaagatgtctggaatctattcgagacatcaacaaaaccatcgtacttgggagtcggccat

SEQ ID NO: 415426 - DNA, 140 bp, Artificial Sequence
  Synthetic
atggccgactcccaagtacgatggttttgttgatgtctcgaatagattccagacatcttctactgcttgttctgtcactgtattgtcccatgcatcgaaagcctctgtcacatttaaagcggagacccagcatggcgtat

SEQ ID NO: 415427 - DNA, 140 bp, Artificial Sequence
  Synthetic
aggccctggctgctgatatgacaagcagtagaagatgtctggaatctattcgagacatcaacaaaaccatgtgtcaaattaacacccttatgtgtagcaatggagtgcaagaacagagaggaccttttgggacagcggtg

SEQ ID NO: 415428 - DNA, 140 bp, Artificial Sequence
  Synthetic
caccgctgtcccaaaaggtcctctctgttcttgcactccattgctacacataagggtgttaatttgacacatggttttgttgatgtctcgaatagattccagacatcttctactgcttgtcatatcagcagccagggcct

SEQ ID NO: 415429 - DNA, 140 bp, Artificial Sequence
  Synthetic
atacgccatgctgggtctccgacaactgagataagtgagaacacttcatgcgtacgcggagacaactgctcaggattaagagaggaggagatagtcatatgtcagttcaatatgacaggacgtacttgggagtcggccat

SEQ ID NO: 415430 - DNA, 140 bp, Artificial Sequence
  Synthetic
atggccgactcccaagtacgtcctgtcatattgaactgacatatgactatctcctcctctcttaatcctgagcagttgtctccgcgtacgcatgaagtgttctcacttatctcagttgtcggagacccagcatggcgtat

SEQ ID NO: 415431 - DNA, 140 bp, Artificial Sequence
  Synthetic
aggccctggctgctgatatgcaggattaagagaggaggagatagtcatatgtcagttcaatatgacaggattaataagagataagccaaaaaggtataatgaaacatggtactcaagcgagaccttttgggacagcggtg

SEQ ID NO: 415432 - DNA, 140 bp, Artificial Sequence
  Synthetic
caccgctgtcccaaaaggtctcgcttgagtaccatgtttcattatacctttttggcttatctcttattaatcctgtcatattgaactgacatatgactatctcctcctctcttaatcctgcatatcagcagccagggcct

SEQ ID NO: 415433 - DNA, 140 bp, Artificial Sequence
  Synthetic
atacgccatgctgggtctcccaggccagcacatgcgcacgtggtacatgagagattcatgtgataagcattattgggatgatatgaggtttagatattgcgcaccaccgggttatgccttcgtacttgggagtcggccat

SEQ ID NO: 415434 - DNA, 140 bp, Artificial Sequence
  Synthetic
atggccgactcccaagtacgaaggcataacccggtggtgcgcaatatctaaacctcatatcatcccaataatgcttatcacatgaatctctcatgtaccacgtgcgcatgtgctggcctgggagacccagcatggcgtat

SEQ ID NO: 415435 - DNA, 140 bp, Artificial Sequence
  Synthetic
aggccctggctgctgatatgtattgggatgatatgaggtttagatattgcgcaccaccgggttatgccttgctaagatgtaatgataccaattactcaggctttgagcccaattgtactagaccttttgggacagcggtg

SEQ ID NO: 415436 - DNA, 140 bp, Artificial Sequence
  Synthetic
caccgctgtcccaaaaggtctagtacaattgggctcaaagcctgagtaattggtatcattacatcttagcaaggcataacccggtggtgcgcaatatctaaacctcatatcatcccaatacatatcagcagccagggcct

SEQ ID NO: 415437 - DNA, 140 bp, Artificial Sequence
  Synthetic
atacgccatgctgggtctcctggtttggctttaatggcactagagcagaaaatagaacatatatctattggcatagtagagataacagaactataatcagcttaaacaaacattataatccgtacttgggagtcggccat

SEQ ID NO: 415438 - DNA, 140 bp, Artificial Sequence
  Synthetic
atggccgactcccaagtacggattataatgtttgtttaagctgattatagttctgttatctctactatgccaatagatatatgttctattttctgctctagtgccattaaagccaaaccaggagacccagcatggcgtat

SEQ ID NO: 415439 - DNA, 140 bp, Artificial Sequence
  Synthetic
aggccctggctgctgatatggcatagtagagataacagaactataatcagcttaaacaaacattataatctctctatatattgtaagagaccaggaaataaaacagtagtacctataacagaccttttgggacagcggtg

SEQ ID NO: 415440 - DNA, 140 bp, Artificial Sequence
  Synthetic
caccgctgtcccaaaaggtctgttataggtactactgttttatttcctggtctcttacaatatatagagagattataatgtttgtttaagctgattatagttctgttatctctactatgccatatcagcagccagggcct

SEQ ID NO: 415441 - DNA, 140 bp, Artificial Sequence
  Synthetic
atacgccatgctgggtctccacaagcatggtgctggttcaaaggcagatggaaggaagccatgcaggaggtgaagcaaaccattgcagaacaccccaggtataggggaaccaatattacacgtacttgggagtcggccat

SEQ ID NO: 415442 - DNA, 140 bp, Artificial Sequence
  Synthetic
atggccgactcccaagtacgtgtaatattggttcccctatacctggggtgttctgcaatggtttgcttcacctcctgcatggcttccttccatctgcctttgaaccagcaccatgcttgtggagacccagcatggcgtat

SEQ ID NO: 415443 - DNA, 140 bp, Artificial Sequence
  Synthetic
aggccctggctgctgatatgtgaagcaaaccattgcagaacaccccaggtataggggaaccaatattacagaaaaaattaaatttacagcaccgggaaaaggttcagacccggaagtggcgaccttttgggacagcggtg

SEQ ID NO: 415444 - DNA, 140 bp, Artificial Sequence
  Synthetic
caccgctgtcccaaaaggtcgccacttccgggtctgaaccttttcccggtgctgtaaatttaattttttctgtaatattggttcccctatacctggggtgttctgcaatggtttgcttcacatatcagcagccagggcct

SEQ ID NO: 415445 - DNA, 140 bp, Artificial Sequence
  Synthetic
atacgccatgctgggtctccggttcctcaattggatagagaacagaacaaatgaaacaaagcacaattatgtgccatgccatataaagcagataattaacacttggcataaagcagggagcgtacttgggagtcggccat

SEQ ID NO: 415446 - DNA, 140 bp, Artificial Sequence
  Synthetic
atggccgactcccaagtacgctccctgctttatgccaagtgttaattatctgctttatatggcatggcacataattgtgctttgtttcatttgttctgttctctatccaattgaggaaccggagacccagcatggcgtat

SEQ ID NO: 415447 - DNA, 140 bp, Artificial Sequence
  Synthetic
aggccctggctgctgatatggtgccatgccatataaagcagataattaacacttggcataaagcagggagacatgtatatttgcctcccagggaaggcgagttgacctgtgactcaactggaccttttgggacagcggtg

SEQ ID NO: 415448 - DNA, 140 bp, Artificial Sequence
  Synthetic
caccgctgtcccaaaaggtccagttgagtcacaggtcaactcgccttccctgggaggcaaatatacatgtctccctgctttatgccaagtgttaattatctgctttatatggcatggcaccatatcagcagccagggcct

SEQ ID NO: 415449 - DNA, 140 bp, Artificial Sequence
  Synthetic
atacgccatgctgggtctccagtgcaggggtggcagacctataccgattagaattgggggattacaaattagtagaaataacaccaattggcttcgcacctacaccagaaaaacgatactcgtacttgggagtcggccat

SEQ ID NO: 415450 - DNA, 140 bp, Artificial Sequence
  Synthetic
atggccgactcccaagtacgagtatcgtttttctggtgtaggtgcgaagccaattggtgttatttctactaatttgtaatcccccaattctaatcggtataggtctgccacccctgcactggagacccagcatggcgtat

SEQ ID NO: 415451 - DNA, 140 bp, Artificial Sequence
  Synthetic
aggccctggctgctgatatgagtagaaataacaccaattggcttcgcacctacaccagaaaaacgatactcctttgcctccaggagacaaacaagaggtgtgttcgtgctagggttcttggaccttttgggacagcggtg

SEQ ID NO: 415452 - DNA, 140 bp, Artificial Sequence
  Synthetic
caccgctgtcccaaaaggtccaagaaccctagcacgaacacacctcttgtttgtctcctggaggcaaaggagtatcgtttttctggtgtaggtgcgaagccaattggtgttatttctactcatatcagcagccagggcct

SEQ ID NO: 415453 - DNA, 140 bp, Artificial Sequence
  Synthetic
aggccctggctgctgatatgagctgttggacgtggtcaagaggcaacaagaaatgttgcgactgaccgtctggggaacgaaaaatctccaggcaagagtcactgctatagagaaatacctgaccttttgggacagcggtg

SEQ ID NO: 415454 - DNA, 140 bp, Artificial Sequence
  Synthetic
caccgctgtcccaaaaggtcaggtatttctctatagcagtgactcttgcctggagatttttcgttccccagacggtcagtcgcaacatttcttgttgcctcttgaccacgtccaacagctcatatcagcagccagggcct

SEQ ID NO: 415455 - DNA, 140 bp, Artificial Sequence
  Synthetic
atacgccatgctgggtctccaaaggcccaggcgcagctagattcatggggatgtgcgtttagacaagtctgccacactactgtaccatgggaaaatgataccttagtacctaattggaaacgtacttgggagtcggccat

SEQ ID NO: 415456 - DNA, 140 bp, Artificial Sequence
  Synthetic
atggccgactcccaagtacgtttccaattaggtactaaggtatcattttcccatggtacagtagtgtggcagacttgtctaaacgcacatccccatgaatctagctgcgcctgggcctttggagacccagcatggcgtat

SEQ ID NO: 415457 - DNA, 140 bp, Artificial Sequence
  Synthetic
aggccctggctgctgatatggccacactactgtaccatgggaaaatgataccttagtacctaattggaaaaatatgacgtgcaaagaatgggaacaaaaggtccgccacctggaggcaaagaccttttgggacagcggtg

SEQ ID NO: 415458 - DNA, 140 bp, Artificial Sequence
  Synthetic
caccgctgtcccaaaaggtctttgcctccaggtggcggaccttttgttcccattctttgcacgtcatatttttccaattaggtactaaggtatcattttcccatggtacagtagtgtggccatatcagcagccagggcct

SEQ ID NO: 415459 - DNA, 140 bp, Artificial Sequence
  Synthetic
atacgccatgctgggtctccatgaactacaaaaattaaatagctgggatatttttggcaactggtttgacttaacctcctggatcaagtatattcaatatggagtttacatagtagtaggcgtacttgggagtcggccat

SEQ ID NO: 415460 - DNA, 140 bp, Artificial Sequence
  Synthetic
atggccgactcccaagtacgcctactactatgtaaactccatattgaatatacttgatccaggaggttaagtcaaaccagttgccaaaaatatcccagctatttaatttttgtagttcatggagacccagcatggcgtat

SEQ ID NO: 415461 - DNA, 140 bp, Artificial Sequence
  Synthetic
aggccctggctgctgatatgttaacctcctggatcaagtatattcaatatggagtttacatagtagtaggaataatagctttaagagtagtaatatatgtagtacagttactatgtagctgaccttttgggacagcggtg

SEQ ID NO: 415462 - DNA, 140 bp, Artificial Sequence
  Synthetic
caccgctgtcccaaaaggtcagctacatagtaactgtactacatatattactactcttaaagctattattcctactactatgtaaactccatattgaatatacttgatccaggaggttaacatatcagcagccagggcct

SEQ ID NO: 415463 - DNA, 140 bp, Artificial Sequence
  Synthetic
atacgccatgctgggtctcccagatccatatccacaaggaccaggaacagccagacagagaaggaacagaagaagacgttggagacaacggtggatacagatcttggccctggccgatagcgtacttgggagtcggccat

SEQ ID NO: 415464 - DNA, 140 bp, Artificial Sequence
  Synthetic
atggccgactcccaagtacgctatcggccagggccaagatctgtatccaccgttgtctccaacgtcttcttctgttccttctctgtctggctgttcctggtccttgtggatatggatctgggagacccagcatggcgtat

SEQ ID NO: 415465 - DNA, 140 bp, Artificial Sequence
  Synthetic
aggccctggctgctgatatgagaagacgttggagacaacggtggatacagatcttggccctggccgatagcatatatacatttcctgatcctcctgctgattcgcctgttgaccagactagaccttttgggacagcggtg

SEQ ID NO: 415466 - DNA, 140 bp, Artificial Sequence
  Synthetic
caccgctgtcccaaaaggtctagtctggtcaacaggcgaatcagcaggaggatcaggaaatgtatatatgctatcggccagggccaagatctgtatccaccgttgtctccaacgtcttctcatatcagcagccagggcct

SEQ ID NO: 415467 - DNA, 140 bp, Artificial Sequence
  Synthetic
atacgccatgctgggtctcccatcctccagaatctcagagactggctgaggcttagaacagccttcctgcaatatgggtgcgagtggatccaagaagcattccaggccgccgcgaggactcgtacttgggagtcggccat

SEQ ID NO: 415468 - DNA, 140 bp, Artificial Sequence
  Synthetic
atggccgactcccaagtacgagtcctcgcggcggcctggaatgcttcttggatccactcgcacccatattgcaggaaggctgttctaagcctcagccagtctctgagattctggaggatgggagacccagcatggcgtat

SEQ ID NO: 415469 - DNA, 140 bp, Artificial Sequence
  Synthetic
aggccctggctgctgatatgaatatgggtgcgagtggatccaagaagcattccaggccgccgcgaggactacgggagagactcttgcgagcgcgtgcaggagcttgtgggggacgttgcggaccttttgggacagcggtg

SEQ ID NO: 415470 - DNA, 140 bp, Artificial Sequence
  Synthetic
caccgctgtcccaaaaggtccgcaacgtcccccacaagctcctgcacgcgctcgcaagagtctctcccgtagtcctcgcggcggcctggaatgcttcttggatccactcgcacccatattcatatcagcagccagggcct

SEQ ID NO: 415471 - DNA, 140 bp, Artificial Sequence
  Synthetic
atacgccatgctgggtctcccagagctcgccctcctgtgagggacggcagaatcaccagggagagtacgcggaccgcccatggaggaatcccatcaacggagagaccgaacgattggtatcgtacttgggagtcggccat

SEQ ID NO: 415472 - DNA, 140 bp, Artificial Sequence
  Synthetic
atggccgactcccaagtacgataccaatcgttcggtctctccgttgatgggattcctccatgggcggtccgcgtactctccctggtgattctgccgtccctcacaggagggcgagctctgggagacccagcatggcgtat

SEQ ID NO: 415473 - DNA, 140 bp, Artificial Sequence
  Synthetic
atacgccatgctgggtctccgacctagtaggagtccctgtcacatcaaggacacaactgagggaaatgacctataaatttgcaatagacatgtctcatttaataaaagataaggggggaccgtacttgggagtcggccat

SEQ ID NO: 415474 - DNA, 140 bp, Artificial Sequence
  Synthetic
atggccgactcccaagtacggtccccccttatcttttattaaatgagacatgtctattgcaaatttataggtcatttccctcagttgtgtccttgatgtgacagggactcctactaggtcggagacccagcatggcgtat

SEQ ID NO: 415475 - DNA, 140 bp, Artificial Sequence
  Synthetic
atacgccatgctgggtctccggttggcgcccgaacagggacttgaaggagactgagaagtcttggaacacggctgagtgaaggcagtaagggcggcaggaacaaaccacgacggagtgctcgtacttgggagtcggccat

SEQ ID NO: 415476 - DNA, 140 bp, Artificial Sequence
  Synthetic
atggccgactcccaagtacgagcactccgtcgtggtttgttcctgccgcccttactgccttcactcagccgtgttccaagacttctcagtctccttcaagtccctgttcgggcgccaaccggagacccagcatggcgtat

SEQ ID NO: 415477 - DNA, 140 bp, Artificial Sequence
  Synthetic
atacgccatgctgggtctcccctagaaaggcgcgggccgaggtaccaaggcggcgtgtggagcgggagtcaagaggcctccgggtgaaggtaagtacctacaccaaaaactgtagccagacgtacttgggagtcggccat

SEQ ID NO: 415478 - DNA, 140 bp, Artificial Sequence
  Synthetic
atggccgactcccaagtacgtctggctacagtttttggtgtaggtacttaccttcacccggaggcctcttgactcccgctccacacgccgccttggtacctcggcccgcgcctttctaggggagacccagcatggcgtat

SEQ ID NO: 415479 - DNA, 140 bp, Artificial Sequence
  Synthetic
atacgccatgctgggtctccgcgcgaagagctccgtcctgagagggaaaaaagctgatgaattagaaagaattaggttacggcccggcggaaagaaaaaatacagactaaaacatgttgtcgtacttgggagtcggccat

SEQ ID NO: 415480 - DNA, 140 bp, Artificial Sequence
  Synthetic
atggccgactcccaagtacgacaacatgttttagtctgtattttttctttccgccgggccgtaacctaattctttctaattcatcagcttttttccctctcaggacggagctcttcgcgcggagacccagcatggcgtat

SEQ ID NO: 415481 - DNA, 140 bp, Artificial Sequence
  Synthetic
aggccctggctgctgatatgccgacaggttcagaaaatttaaaaagcctttttaatactgtctgcgtcatttggtgcatacacgcagaagagaaagtgaaagatactgaagaagcaaaaagaccttttgggacagcggtg

SEQ ID NO: 415482 - DNA, 140 bp, Artificial Sequence
  Synthetic
caccgctgtcccaaaaggtctttttgcttcttcagtatctttcactttctcttctgcgtgtatgcaccaaatgacgcagacagtattaaaaaggctttttaaattttctgaacctgtcggcatatcagcagccagggcct

SEQ ID NO: 415483 - DNA, 140 bp, Artificial Sequence
  Synthetic
atacgccatgctgggtctccttggtgcatacacgcagaagagaaagtgaaagatactgaagaagcaaaaaagatagtacagagacatctagtggcagaaactggaactgcagagaaaatgcgtacttgggagtcggccat

SEQ ID NO: 415484 - DNA, 140 bp, Artificial Sequence
  Synthetic
atggccgactcccaagtacgcattttctctgcagttccagtttctgccactagatgtctctgtactatcttttttgcttcttcagtatctttcactttctcttctgcgtgtatgcaccaaggagacccagcatggcgtat

SEQ ID NO: 415485 - DNA, 140 bp, Artificial Sequence
  Synthetic
atacgccatgctgggtctccccccgtacaacacataggcggcaattatacccatgtgccgctgagtcccagaactctaaatgcctgggtaaaattagtagaggaaaagaagttcggggcacgtacttgggagtcggccat

SEQ ID NO: 415486 - DNA, 140 bp, Artificial Sequence
  Synthetic
atggccgactcccaagtacgtgccccgaacttcttttcctctactaattttacccaggcatttagagttctgggactcagcggcacatgggtataattgccgcctatgtgttgtacggggggagacccagcatggcgtat

SEQ ID NO: 415487 - DNA, 140 bp, Artificial Sequence
  Synthetic
aggccctggctgctgatatggaactctaaatgcctgggtaaaattagtagaggaaaagaagttcggggcagaagtagtgccaagatttcaggcactctcagaaggctgcacgccctatgagaccttttgggacagcggtg

SEQ ID NO: 415488 - DNA, 140 bp, Artificial Sequence
  Synthetic
caccgctgtcccaaaaggtctcatagggcgtgcagccttctgagagtgcctgaaatcttggcactacttctgccccgaacttcttttcctctactaattttacccaggcatttagagttccatatcagcagccagggcct

SEQ ID NO: 415489 - DNA, 140 bp, Artificial Sequence
  Synthetic
atacgccatgctgggtctcctaatcagggagattattaatgaagaagcagcagattgggatgcgcaacatccaataccaggccccttaccagcaggacagcttagagagccaagaggatccgtacttgggagtcggccat

SEQ ID NO: 415490 - DNA, 140 bp, Artificial Sequence
  Synthetic
atggccgactcccaagtacggatcctcttggctctctaagctgtcctgctggtaaggggcctggtattggatgttgcgcatcccaatctgctgcttcttcattaataatctccctgattaggagacccagcatggcgtat

SEQ ID NO: 415491 - DNA, 140 bp, Artificial Sequence
  Synthetic
aggccctggctgctgatatgccaataccaggccccttaccagcaggacagcttagagagccaagaggatctgacatagcagggacaacaagcacagtagaggaacagatccagtggatgtgaccttttgggacagcggtg

SEQ ID NO: 415492 - DNA, 140 bp, Artificial Sequence
  Synthetic
caccgctgtcccaaaaggtcacatccactggatctgttcctctactgtgcttgttgtccctgctatgtcagatcctcttggctctctaagctgtcctgctggtaaggggcctggtattggcatatcagcagccagggcct

SEQ ID NO: 415493 - DNA, 140 bp, Artificial Sequence
  Synthetic
atacgccatgctgggtctcccagataggactgcagaagtgtgtcaggatgtacaatccgactaacatcctagacataaaacagggaccaaaagaaccgtttcaaagctatgtagatagatcgtacttgggagtcggccat

SEQ ID NO: 415494 - DNA, 140 bp, Artificial Sequence
  Synthetic
atggccgactcccaagtacgatctatctacatagctttgaaacggttcttttggtccctgttttatgtctaggatgttagtcggattgtacatcctgacacacttctgcagtcctatctgggagacccagcatggcgtat

SEQ ID NO: 415495 - DNA, 140 bp, Artificial Sequence
  Synthetic
aggccctggctgctgatatgagacataaaacagggaccaaaagaaccgtttcaaagctatgtagatagattctacaagagcttgagagcagaacagacagacccagcagtaaagaattgggaccttttgggacagcggtg

SEQ ID NO: 415496 - DNA, 140 bp, Artificial Sequence
  Synthetic
caccgctgtcccaaaaggtcccaattctttactgctgggtctgtctgttctgctctcaagctcttgtagaatctatctacatagctttgaaacggttcttttggtccctgttttatgtctcatatcagcagccagggcct

SEQ ID NO: 415497 - DNA, 140 bp, Artificial Sequence
  Synthetic
atacgccatgctgggtctccactaaaaggactaggaatgaatcctaccttagaagaaatgctaaccgcctgtcaaggggtaggtgggccaggccagaaagctagattaatggcagaagcccgtacttgggagtcggccat

SEQ ID NO: 415498 - DNA, 140 bp, Artificial Sequence
  Synthetic
atggccgactcccaagtacgggcttctgccattaatctagctttctggcctggcccacctaccccttgacaggcggttagcatttcttctaaggtaggattcattcctagtccttttagtggagacccagcatggcgtat

SEQ ID NO: 415499 - DNA, 140 bp, Artificial Sequence
  Synthetic
aggccctggctgctgatatggtcaaggggtaggtgggccaggccagaaagctagattaatggcagaagccttaaaggaggccctggcaccaccacctatcccattcgcagcagcccagcagaccttttgggacagcggtg

SEQ ID NO: 415500 - DNA, 140 bp, Artificial Sequence
  Synthetic
caccgctgtcccaaaaggtctgctgggctgctgcgaatgggataggtggtggtgccagggcctcctttaaggcttctgccattaatctagctttctggcctggcccacctaccccttgaccatatcagcagccagggcct

SEQ ID NO: 415501 - DNA, 140 bp, Artificial Sequence
  Synthetic
atacgccatgctgggtctccgacaatgccgagcacctaggagacagggctgttggaagtgtggcaagacaggacatgtcatggcaaactgcccagaaagacaggcgggttttttagggatcgtacttgggagtcggccat

SEQ ID NO: 415502 - DNA, 140 bp, Artificial Sequence
  Synthetic
atggccgactcccaagtacgatccctaaaaaacccgcctgtctttctgggcagtttgccatgacatgtcctgtcttgccacacttccaacagccctgtctcctaggtgctcggcattgtcggagacccagcatggcgtat

SEQ ID NO: 415503 - DNA, 140 bp, Artificial Sequence
  Synthetic
aggccctggctgctgatatgggacatgtcatggcaaactgcccagaaagacaggcgggttttttagggataagcccccggggaaagaagcctcgcaacttccccgtggcccaagttccacgaccttttgggacagcggtg

SEQ ID NO: 415504 - DNA, 140 bp, Artificial Sequence
  Synthetic
caccgctgtcccaaaaggtcgtggaacttgggccacggggaagttgcgaggcttctttccccgggggcttatccctaaaaaacccgcctgtctttctgggcagtttgccatgacatgtcccatatcagcagccagggcct

SEQ ID NO: 415505 - DNA, 140 bp, Artificial Sequence
  Synthetic
atacgccatgctgggtctccgagaaatatatgcagcaagggagaaagcagagggagcagagagagagaccatacaaggaggtgacagaggacctactgcacctcgagcagggaggggcaccgtacttgggagtcggccat

SEQ ID NO: 415506 - DNA, 140 bp, Artificial Sequence
  Synthetic
atggccgactcccaagtacggtgcccctccctgctcgaggtgcagtaggtcctctgtcacctccttgtatggtctctctctctgctccctctgctttctcccttgctgcatatatttctcggagacccagcatggcgtat

SEQ ID NO: 415507 - DNA, 140 bp, Artificial Sequence
  Synthetic
atacgccatgctgggtctccaaagaccagtagtcacagcatacattgagggtcagccagtagaagttttactagacacaggggctgacgactcaatagtagcaggaatagaattaggaagcgtacttgggagtcggccat

SEQ ID NO: 415508 - DNA, 140 bp, Artificial Sequence
  Synthetic
atggccgactcccaagtacgcttcctaattctattcctgctactattgagtcgtcagcccctgtgtctagtaaaacttctactggctgaccctcaatgtatgctgtgactactggtctttggagacccagcatggcgtat

SEQ ID NO: 415509 - DNA, 140 bp, Artificial Sequence
  Synthetic
aggccctggctgctgatatgaccataatgacaggtgataccccaatcaacatttttggcagaaacattttgacagtcttaggcatgtcattaaatctacccgtcgccaagatagaaccaagaccttttgggacagcggtg

SEQ ID NO: 415510 - DNA, 140 bp, Artificial Sequence
  Synthetic
caccgctgtcccaaaaggtcttggttctatcttggcgacgggtagatttaatgacatgcctaagactgtcaaaatgtttctgccaaaaatgttgattggggtatcacctgtcattatggtcatatcagcagccagggcct

SEQ ID NO: 415511 - DNA, 140 bp, Artificial Sequence
  Synthetic
atacgccatgctgggtctcccccctaaccaaagaaaaaatagaagcattaaaagagatctgtgaaaaaatggaaaaggagggacagctagaggaagcacctccaactaacccttataatacgtacttgggagtcggccat

SEQ ID NO: 415512 - DNA, 140 bp, Artificial Sequence
  Synthetic
atggccgactcccaagtacgtattataagggttagttggaggtgcttcctctagctgtccctccttttccattttttcacagatctcttttaatgcttctattttttctttggttaggggggagacccagcatggcgtat

SEQ ID NO: 415513 - DNA, 140 bp, Artificial Sequence
  Synthetic
aggccctggctgctgatatgggaaaaggagggacagctagaggaagcacctccaactaacccttataatacccccacatttgcaatcaagaaaaaggacaagaataaatggaggatgctagaccttttgggacagcggtg

SEQ ID NO: 415514 - DNA, 140 bp, Artificial Sequence
  Synthetic
caccgctgtcccaaaaggtctagcatcctccatttattcttgtcctttttcttgattgcaaatgtgggggtattataagggttagttggaggtgcttcctctagctgtccctccttttcccatatcagcagccagggcct

SEQ ID NO: 415515 - DNA, 140 bp, Artificial Sequence
  Synthetic
atacgccatgctgggtctccgttaggaatcccacacccagcaggattggccaagaagagaagaatcactgtactagatgtaggggatgcttacttttccataccactgcatgaagactttcgtacttgggagtcggccat

SEQ ID NO: 415516 - DNA, 140 bp, Artificial Sequence
  Synthetic
atggccgactcccaagtacgaaagtcttcatgcagtggtatggaaaagtaagcatcccctacatctagtacagtgattcttctcttcttggccaatcctgctgggtgtgggattcctaacggagacccagcatggcgtat

SEQ ID NO: 415517 - DNA, 140 bp, Artificial Sequence
  Synthetic
aggccctggctgctgatatgtactagatgtaggggatgcttacttttccataccactgcatgaagactttagacagtatactgcatttactttgccatcagtgaacaatgcagaaccagggaccttttgggacagcggtg

SEQ ID NO: 415518 - DNA, 140 bp, Artificial Sequence
  Synthetic
caccgctgtcccaaaaggtccctggttctgcattgttcactgatggcaaagtaaatgcagtatactgtctaaagtcttcatgcagtggtatggaaaagtaagcatcccctacatctagtacatatcagcagccagggcct

SEQ ID NO: 415519 - DNA, 140 bp, Artificial Sequence
  Synthetic
atacgccatgctgggtctcccaatttttcaatacacaatgaggcagatcttagagccattcagaaaagcaaaccaggatgtcattatcattcagtacatggatgatatcttaatagctagcgtacttgggagtcggccat

SEQ ID NO: 415520 - DNA, 140 bp, Artificial Sequence
  Synthetic
atggccgactcccaagtacgctagctattaagatatcatccatgtactgaatgataatgacatcctggtttgcttttctgaatggctctaagatctgcctcattgtgtattgaaaaattgggagacccagcatggcgtat

SEQ ID NO: 415521 - DNA, 140 bp, Artificial Sequence
  Synthetic
aggccctggctgctgatatgaaccaggatgtcattatcattcagtacatggatgatatcttaatagctagtgacaggacagatctagaacatgacagagtagtcctacagctaaaggaacgaccttttgggacagcggtg

SEQ ID NO: 415522 - DNA, 140 bp, Artificial Sequence
  Synthetic
caccgctgtcccaaaaggtcgttcctttagctgtaggactactctgtcatgttctagatctgtcctgtcactagctattaagatatcatccatgtactgaatgataatgacatcctggttcatatcagcagccagggcct

SEQ ID NO: 415523 - DNA, 140 bp, Artificial Sequence
  Synthetic
atacgccatgctgggtctcccctccataccaatggatgggttatgaactatggccaactaaatggaagttgcagaaaatacagttgccccaaaaggaggtatggacagtcaatgacatcccgtacttgggagtcggccat

SEQ ID NO: 415524 - DNA, 140 bp, Artificial Sequence
  Synthetic
atggccgactcccaagtacgggatgtcattgactgtccatacctccttttggggcaactgtattttctgcaacttccatttagttggccatagttcataacccatccattggtatggaggggagacccagcatggcgtat

SEQ ID NO: 415525 - DNA, 140 bp, Artificial Sequence
  Synthetic
aggccctggctgctgatatggcagaaaatacagttgccccaaaaggaggtatggacagtcaatgacatccaaaagctggtgggtgtcctaaattgggcagcacaaatctacccaaggatagaccttttgggacagcggtg

SEQ ID NO: 415526 - DNA, 140 bp, Artificial Sequence
  Synthetic
caccgctgtcccaaaaggtctatccttgggtagatttgtgctgcccaatttaggacacccaccagcttttggatgtcattgactgtccatacctccttttggggcaactgtattttctgccatatcagcagccagggcct

SEQ ID NO: 415527 - DNA, 140 bp, Artificial Sequence
  Synthetic
atacgccatgctgggtctccagaagtacaatggacagagttagcagaagcggagctagaagaaaacagaatcatcttaagccaggaacaagagggacactattaccaagaggaaaaggagcgtacttgggagtcggccat

SEQ ID NO: 415528 - DNA, 140 bp, Artificial Sequence
  Synthetic
atggccgactcccaagtacgctccttttcctcttggtaatagtgtccctcttgttcctggcttaagatgattctgttttcttctagctccgcttctgctaactctgtccattgtacttctggagacccagcatggcgtat

SEQ ID NO: 415529 - DNA, 140 bp, Artificial Sequence
  Synthetic
aggccctggctgctgatatgtcatcttaagccaggaacaagagggacactattaccaagaggaaaaggagctagaagccacagtccaaaaagaccaagacaatcagtggacatataaagtgaccttttgggacagcggtg

SEQ ID NO: 415530 - DNA, 140 bp, Artificial Sequence
  Synthetic
caccgctgtcccaaaaggtcactttatatgtccactgattgtcttggtctttttggactgtggcttctagctccttttcctcttggtaatagtgtccctcttgttcctggcttaagatgacatatcagcagccagggcct

SEQ ID NO: 415531 - DNA, 140 bp, Artificial Sequence
  Synthetic
atacgccatgctgggtctccatgcccataccaatggggtcagattgctagcacaggtagttcagaagataggaaaagaagcactagtcatctggggacgaataccaaaatttcacctacccgtacttgggagtcggccat

SEQ ID NO: 415532 - DNA, 140 bp, Artificial Sequence
  Synthetic
atggccgactcccaagtacgggtaggtgaaattttggtattcgtccccagatgactagtgcttcttttcctatcttctgaactacctgtgctagcaatctgaccccattggtatgggcatggagacccagcatggcgtat

SEQ ID NO: 415533 - DNA, 140 bp, Artificial Sequence
  Synthetic
aggccctggctgctgatatgggaaaagaagcactagtcatctggggacgaataccaaaatttcacctaccagtagagagagaaacttgggagcagtggtgggatgactactggcaggtaagaccttttgggacagcggtg

SEQ ID NO: 415534 - DNA, 140 bp, Artificial Sequence
  Synthetic
caccgctgtcccaaaaggtcttacctgccagtagtcatcccaccactgctcccaagtttctctctctactggtaggtgaaattttggtattcgtccccagatgactagtgcttcttttcccatatcagcagccagggcct

SEQ ID NO: 415535 - DNA, 140 bp, Artificial Sequence
  Synthetic
atacgccatgctgggtctccgcatttaacctagtaaaagatcccataccaggcacagaaaccttctacacagatggatcctgcaataggcagtcaaaagaaggaaaggcaggatatgtaacgtacttgggagtcggccat

SEQ ID NO: 415536 - DNA, 140 bp, Artificial Sequence
  Synthetic
atggccgactcccaagtacgttacatatcctgcctttccttcttttgactgcctattgcaggatccatctgtgtagaaggtttctgtgcctggtatgggatcttttactaggttaaatgcggagacccagcatggcgtat

SEQ ID NO: 415537 - DNA, 140 bp, Artificial Sequence
  Synthetic
aggccctggctgctgatatgagatggatcctgcaataggcagtcaaaagaaggaaaggcaggatatgtaacagacagagggagagacaaggtaaaggtactagagcaaactaccaatcaggaccttttgggacagcggtg

SEQ ID NO: 415538 - DNA, 140 bp, Artificial Sequence
  Synthetic
caccgctgtcccaaaaggtcctgattggtagtttgctctagtacctttaccttgtctctccctctgtctgttacatatcctgcctttccttcttttgactgcctattgcaggatccatctcatatcagcagccagggcct

SEQ ID NO: 415539 - DNA, 140 bp, Artificial Sequence
  Synthetic
atacgccatgctgggtctccagccaatattatagtggattcacaatatgtaatgggaatagtggcaggccaaccaacagagtcagaaaataagatagtgaatcagatcatagaagaaatgcgtacttgggagtcggccat

SEQ ID NO: 415540 - DNA, 140 bp, Artificial Sequence
  Synthetic
atggccgactcccaagtacgcatttcttctatgatctgattcactatcttattttctgactctgttggttggcctgccactattcccattacatattgtgaatccactataatattggctggagacccagcatggcgtat

SEQ ID NO: 415541 - DNA, 140 bp, Artificial Sequence
  Synthetic
aggccctggctgctgatatgaaccaacagagtcagaaaataagatagtgaatcagatcatagaagaaatgataaaaaaggaagccatctatgttgcatgggtcccagcccacaaaggcatgaccttttgggacagcggtg

SEQ ID NO: 415542 - DNA, 140 bp, Artificial Sequence
  Synthetic
caccgctgtcccaaaaggtcatgcctttgtgggctgggacccatgcaacatagatggcttccttttttatcatttcttctatgatctgattcactatcttattttctgactctgttggttcatatcagcagccagggcct

SEQ ID NO: 415543 - DNA, 140 bp, Artificial Sequence
  Synthetic
atacgccatgctgggtctcctattgttcctagaaaaaatagagcccgctcaagaagagcatgaaaaatatcatagcaatgtaaaagaactatcccataaatttagattacccaaactagtcgtacttgggagtcggccat

SEQ ID NO: 415544 - DNA, 140 bp, Artificial Sequence
  Synthetic
atggccgactcccaagtacgactagtttgggtaatctaaatttatgggatagttcttttacattgctatgatatttttcatgctcttcttgagcgggctctattttttctaggaacaataggagacccagcatggcgtat

SEQ ID NO: 415545 - DNA, 140 bp, Artificial Sequence
  Synthetic
aggccctggctgctgatatgcatagcaatgtaaaagaactatcccataaatttagattacccaaactagtggcaagacagatagtaaacacatgtgcccaatgtcaacagaaaggagagggaccttttgggacagcggtg

SEQ ID NO: 415546 - DNA, 140 bp, Artificial Sequence
  Synthetic
caccgctgtcccaaaaggtccctctcctttctgttgacattgggcacatgtgtttactatctgtcttgccactagtttgggtaatctaaatttatgggatagttcttttacattgctatgcatatcagcagccagggcct

SEQ ID NO: 415547 - DNA, 140 bp, Artificial Sequence
  Synthetic
atacgccatgctgggtctccacacatttagaaggaaaagtcattatagtagcagtgcatgttgcaagtggatttatagaggcagaagtcatcccacaggaaacaggaaggcaaacagcaccgtacttgggagtcggccat

SEQ ID NO: 415548 - DNA, 140 bp, Artificial Sequence
  Synthetic
atggccgactcccaagtacggtgctgtttgccttcctgtttcctgtgggatgacttctgcctctataaatccacttgcaacatgcactgctactataatgacttttccttctaaatgtgtggagacccagcatggcgtat

SEQ ID NO: 415549 - DNA, 140 bp, Artificial Sequence
  Synthetic
atacgccatgctgggtctccgataatggtgctaacttcacttcacaggaagtaaagatggtggcatggtggataggtatagagcaatcctttggagtaccttacaatccacaaagccaggcgtacttgggagtcggccat

SEQ ID NO: 415550 - DNA, 140 bp, Artificial Sequence
  Synthetic
atggccgactcccaagtacgcctggctttgtggattgtaaggtactccaaaggattgctctatacctatccaccatgccaccatctttacttcctgtgaagtgaagttagcaccattatcggagacccagcatggcgtat

SEQ ID NO: 415551 - DNA, 140 bp, Artificial Sequence
  Synthetic
atacgccatgctgggtctccgactaatcaatatgatcaccacagaacaagaaatacaattcctccaagccaaaaattcaaaattaaaaaattttcgggtctatttcagagaaggcagagacgtacttgggagtcggccat

SEQ ID NO: 415552 - DNA, 140 bp, Artificial Sequence
  Synthetic
atggccgactcccaagtacgtctctgccttctctgaaatagacccgaaaattttttaattttgaatttttggcttggaggaattgtatttcttgttctgtggtgatcatattgattagtcggagacccagcatggcgtat

SEQ ID NO: 415553 - DNA, 140 bp, Artificial Sequence
  Synthetic
aggccctggctgctgatatgaaaaattcaaaattaaaaaattttcgggtctatttcagagaaggcagagatcagttgtggaaaggacctggggaactactgtggaagggagacggagcaggaccttttgggacagcggtg

SEQ ID NO: 415554 - DNA, 140 bp, Artificial Sequence
  Synthetic
caccgctgtcccaaaaggtcctgctccgtctcccttccacagtagttccccaggtcctttccacaactgatctctgccttctctgaaatagacccgaaaattttttaattttgaatttttcatatcagcagccagggcct

SEQ ID NO: 415555 - DNA, 140 bp, Artificial Sequence
  Synthetic
atacgccatgctgggtctccaagattatcagggactatggaggaagacaagagatggatagtggtccccacttggaaggtaccagggaggatggagaagtggcatagccttgtcaagtatcgtacttgggagtcggccat

SEQ ID NO: 415556 - DNA, 140 bp, Artificial Sequence
  Synthetic
atggccgactcccaagtacgatacttgacaaggctatgccacttctccatcctccctggtaccttccaagtggggaccactatccatctcttgtcttcctccatagtccctgataatcttggagacccagcatggcgtat

SEQ ID NO: 415557 - DNA, 140 bp, Artificial Sequence
  Synthetic
aggccctggctgctgatatgcttggaaggtaccagggaggatggagaagtggcatagccttgtcaagtatctaaaatacaaaacaaaagatctagaaaaggtgtgctatgtcccccaccagaccttttgggacagcggtg

SEQ ID NO: 415558 - DNA, 140 bp, Artificial Sequence
  Synthetic
caccgctgtcccaaaaggtctggtgggggacatagcacaccttttctagatcttttgttttgtattttagatacttgacaaggctatgccacttctccatcctccctggtaccttccaagcatatcagcagccagggcct

SEQ ID NO: 415559 - DNA, 140 bp, Artificial Sequence
  Synthetic
atacgccatgctgggtctccaagacaatagtcacatagagatacaggcatattggaatctaacaccagaagaaggatggctttcctcttatgcagtaaggataacctggtacacagagaacgtacttgggagtcggccat

SEQ ID NO: 415560 - DNA, 140 bp, Artificial Sequence
  Synthetic
atggccgactcccaagtacgttctctgtgtaccaggttatccttactgcataagaggaaagccatccttcttctggtgttagattccaatatgcctgtatctctatgtgactattgtcttggagacccagcatggcgtat

SEQ ID NO: 415561 - DNA, 140 bp, Artificial Sequence
  Synthetic
aggccctggctgctgatatggaaggatggctttcctcttatgcagtaaggataacctggtacacagagaatttctggacagatgttaccccagactgtacagactccctaatacatagcagaccttttgggacagcggtg

SEQ ID NO: 415562 - DNA, 140 bp, Artificial Sequence
  Synthetic
caccgctgtcccaaaaggtctgctatgtattagggagtctgtacagtctggggtaacatctgtccagaaattctctgtgtaccaggttatccttactgcataagaggaaagccatccttccatatcagcagccagggcct

SEQ ID NO: 415563 - DNA, 140 bp, Artificial Sequence
  Synthetic
atacgccatgctgggtctccgaaaagatattgtcctgctgcaattatccccaggcccatagaacccaggtaccgacacttcaatttttggccttagtagtagtgcaacaaaatgacagatcgtacttgggagtcggccat

SEQ ID NO: 415564 - DNA, 140 bp, Artificial Sequence
  Synthetic
atggccgactcccaagtacgatctgtcattttgttgcactactactaaggccaaaaattgaagtgtcggtacctgggttctatgggcctggggataattgcagcaggacaatatcttttcggagacccagcatggcgtat

SEQ ID NO: 415565 - DNA, 140 bp, Artificial Sequence
  Synthetic
aggccctggctgctgatatgaccgacacttcaatttttggccttagtagtagtgcaacaaaatgacagatcccagagagacggtaccaccaggaaacagcggcgaagagactatcggagagaccttttgggacagcggtg

SEQ ID NO: 415566 - DNA, 140 bp, Artificial Sequence
  Synthetic
caccgctgtcccaaaaggtctctccgatagtctcttcgccgctgtttcctggtggtaccgtctctctgggatctgtcattttgttgcactactactaaggccaaaaattgaagtgtcggtcatatcagcagccagggcct

SEQ ID NO: 415567 - DNA, 140 bp, Artificial Sequence
  Synthetic
atacgccatgctgggtctcctgaatcacctgcccagggaactcattttccaggtctggcagaggtcctggggatactggcatgatgaacaagggatgtcagcaagttacacaaaatatagcgtacttgggagtcggccat

SEQ ID NO: 415568 - DNA, 140 bp, Artificial Sequence
  Synthetic
atggccgactcccaagtacgctatattttgtgtaacttgctgacatcccttgttcatcatgccagtatccccaggacctctgccagacctggaaaatgagttccctgggcaggtgattcaggagacccagcatggcgtat

SEQ ID NO: 415569 - DNA, 140 bp, Artificial Sequence
  Synthetic
aggccctggctgctgatatgggatactggcatgatgaacaagggatgtcagcaagttacacaaaatatagatacctgtgcttgatgcagaaagcaatattcatacatgttagaagagggtgaccttttgggacagcggtg

SEQ ID NO: 415570 - DNA, 140 bp, Artificial Sequence
  Synthetic
caccgctgtcccaaaaggtcaccctcttctaacatgtatgaatattgctttctgcatcaagcacaggtatctatattttgtgtaacttgctgacatcccttgttcatcatgccagtatcccatatcagcagccagggcct

SEQ ID NO: 415571 - DNA, 140 bp, Artificial Sequence
  Synthetic
atacgccatgctgggtctccccccctcctccccctccaggtctagtctaatgactgaagcaccaacagagctccccccggaagacgggaccccaccgagggagccaggggatgagtgggtcgtacttgggagtcggccat

SEQ ID NO: 415572 - DNA, 140 bp, Artificial Sequence
  Synthetic
atggccgactcccaagtacgacccactcatcccctggctccctcggtggggtcccgtcttccggggggagctctgttggtgcttcagtcattagactagacctggagggggaggagggggggagacccagcatggcgtat

SEQ ID NO: 415573 - DNA, 140 bp, Artificial Sequence
  Synthetic
aggccctggctgctgatatgctccccccggaagacgggaccccaccgagggagccaggggatgagtgggtaatagaaatcctaagagaaataaaagaagaagctttaaggcattttgaccgaccttttgggacagcggtg

SEQ ID NO: 415574 - DNA, 140 bp, Artificial Sequence
  Synthetic
caccgctgtcccaaaaggtcggtcaaaatgccttaaagcttcttcttttatttctcttaggatttctattacccactcatcccctggctccctcggtggggtcccgtcttccggggggagcatatcagcagccagggcct

SEQ ID NO: 415575 - DNA, 140 bp, Artificial Sequence
  Synthetic
atacgccatgctgggtctccacccttgaaggcgccagagagctcattagagtcttgcaacgagccctttttacacacttcagagcaggatgtggccactcaaggatcggccaaccaagggcgtacttgggagtcggccat

SEQ ID NO: 415576 - DNA, 140 bp, Artificial Sequence
  Synthetic
atggccgactcccaagtacgcccttggttggccgatccttgagtggccacatcctgctctgaagtgtgtaaaaagggctcgttgcaagactctaatgagctctctggcgccttcaagggtggagacccagcatggcgtat

SEQ ID NO: 415577 - DNA, 140 bp, Artificial Sequence
  Synthetic
aggccctggctgctgatatgtacacacttcagagcaggatgtggccactcaaggatcggccaaccaaggggaggaaatcctctctcaactataccgacccctagaagcatgcgctagcacgaccttttgggacagcggtg

SEQ ID NO: 415578 - DNA, 140 bp, Artificial Sequence
  Synthetic
caccgctgtcccaaaaggtcgtgctagcgcatgcttctaggggtcggtatagttgagagaggatttcctccccttggttggccgatccttgagtggccacatcctgctctgaagtgtgtacatatcagcagccagggcct

SEQ ID NO: 415579 - DNA, 140 bp, Artificial Sequence
  Synthetic
atacgccatgctgggtctccaggggctcgggatatgttatgaacgaaagggcagacgaagaaggactccaaagaaaactaagactcatccgactcttacatcagacaagtgagtatggcgcgtacttgggagtcggccat

SEQ ID NO: 415580 - DNA, 140 bp, Artificial Sequence
  Synthetic
atggccgactcccaagtacgcgccatactcacttgtctgatgtaagagtcggatgagtcttagttttctttggagtccttcttcgtctgccctttcgttcataacatatcccgagcccctggagacccagcatggcgtat

SEQ ID NO: 415581 - DNA, 140 bp, Artificial Sequence
  Synthetic
aggccctggctgctgatatgaagaaaactaagactcatccgactcttacatcagacaagtgagtatggcgcatgaagggactcagctacttattgcctttttattaactagtgcttgcttgaccttttgggacagcggtg

SEQ ID NO: 415582 - DNA, 140 bp, Artificial Sequence
  Synthetic
caccgctgtcccaaaaggtcaagcaagcactagttaataaaaaggcaataagtagctgagtcccttcatgcgccatactcacttgtctgatgtaagagtcggatgagtcttagttttcttcatatcagcagccagggcct

SEQ ID NO: 415583 - DNA, 140 bp, Artificial Sequence
  Synthetic
atacgccatgctgggtctccagaatgcatccattcccctcttttgtgcaaccagaaatagggatacttggggaaccatacagtgcttaccagacaatgatgactatcaggaaatagttttcgtacttgggagtcggccat

SEQ ID NO: 415584 - DNA, 140 bp, Artificial Sequence
  Synthetic
atggccgactcccaagtacgaaaactatttcctgatagtcatcattgtctggtaagcactgtatggttccccaagtatccctatttctggttgcacaaaagaggggaatggatgcattctggagacccagcatggcgtat

SEQ ID NO: 415585 - DNA, 140 bp, Artificial Sequence
  Synthetic
aggccctggctgctgatatgggaaccatacagtgcttaccagacaatgatgactatcaggaaatagttttgaatgtggcagaggctttcgatgcatgggacaatacagtaacagaacaaggaccttttgggacagcggtg

SEQ ID NO: 415586 - DNA, 140 bp, Artificial Sequence
  Synthetic
caccgctgtcccaaaaggtccttgttctgttactgtattgtcccatgcatcgaaagcctctgccacattcaaaactatttcctgatagtcatcattgtctggtaagcactgtatggttcccatatcagcagccagggcct

SEQ ID NO: 415587 - DNA, 140 bp, Artificial Sequence
  Synthetic
atacgccatgctgggtctccaaattaacacccttatgtgtaacaatgagatgcaacacaagtacaaccacaaccacaaccgcacccacaagcacaagtgcagggagcacagccacacccacgtacttgggagtcggccat

SEQ ID NO: 415588 - DNA, 140 bp, Artificial Sequence
  Synthetic
atggccgactcccaagtacgtgggtgtggctgtgctccctgcacttgtgcttgtgggtgcggttgtggttgtggttgtacttgtgttgcatctcattgttacacataagggtgttaatttggagacccagcatggcgtat

SEQ ID NO: 415589 - DNA, 140 bp, Artificial Sequence
  Synthetic
aggccctggctgctgatatgaaccacaaccgcacccacaagcacaagtgcagggagcacagccacacccaaacccataatggtaaatgagaacacttcatgcatgcacgcaaacaactgcgaccttttgggacagcggtg

SEQ ID NO: 415590 - DNA, 140 bp, Artificial Sequence
  Synthetic
caccgctgtcccaaaaggtcgcagttgtttgcgtgcatgcatgaagtgttctcatttaccattatgggtttgggtgtggctgtgctccctgcacttgtgcttgtgggtgcggttgtggttcatatcagcagccagggcct

SEQ ID NO: 415591 - DNA, 140 bp, Artificial Sequence
  Synthetic
atacgccatgctgggtctccattagtgagagataaaccaaagacatataatgaaacatggtactcacgtgatgtggattgtgaaccagatagcaccacaaactcgagaaagtgttacatgcgtacttgggagtcggccat

SEQ ID NO: 415592 - DNA, 140 bp, Artificial Sequence
  Synthetic
atggccgactcccaagtacgcatgtaacactttctcgagtttgtggtgctatctggttcacaatccacatcacgtgagtaccatgtttcattatatgtctttggtttatctctcactaatggagacccagcatggcgtat

SEQ ID NO: 415593 - DNA, 140 bp, Artificial Sequence
  Synthetic
aggccctggctgctgatatgatgtggattgtgaaccagatagcaccacaaactcgagaaagtgttacatgaaccattgcaacacatcagtcatcacagagtcatgtgataagcactattggaccttttgggacagcggtg

SEQ ID NO: 415594 - DNA, 140 bp, Artificial Sequence
  Synthetic
caccgctgtcccaaaaggtccaatagtgcttatcacatgactctgtgatgactgatgtgttgcaatggttcatgtaacactttctcgagtttgtggtgctatctggttcacaatccacatcatatcagcagccagggcct

SEQ ID NO: 415595 - DNA, 140 bp, Artificial Sequence
  Synthetic
atacgccatgctgggtctccgatgcaatgataccaattactcaggctttgcacccaattgttctaaagtagtagcttccacttgcaccaggatgatggaaacgcaaacttctacatggttcgtacttgggagtcggccat

SEQ ID NO: 415596 - DNA, 140 bp, Artificial Sequence
  Synthetic
atggccgactcccaagtacgaaccatgtagaagtttgcgtttccatcatcctggtgcaagtggaagctactactttagaacaattgggtgcaaagcctgagtaattggtatcattgcatcggagacccagcatggcgtat

SEQ ID NO: 415597 - DNA, 140 bp, Artificial Sequence
  Synthetic
aggccctggctgctgatatggtagcttccacttgcaccaggatgatggaaacgcaaacttctacatggtttggctttaatggcactagagcagaaaatagaacatacctttattggcatagaccttttgggacagcggtg

SEQ ID NO: 415598 - DNA, 140 bp, Artificial Sequence
  Synthetic
caccgctgtcccaaaaggtctatgccaataaaggtatgttctattttctgctctagtgccattaaagccaaaccatgtagaagtttgcgtttccatcatcctggtgcaagtggaagctaccatatcagcagccagggcct

SEQ ID NO: 415599 - DNA, 140 bp, Artificial Sequence
  Synthetic
atacgccatgctgggtctccatacattgtaagaggccaggaaataaaacagtaacaccaataacacttatgtcaggatataagtttcattcccggccagtaatcaatacaagacctaaaccgtacttgggagtcggccat

SEQ ID NO: 415600 - DNA, 140 bp, Artificial Sequence
  Synthetic
atggccgactcccaagtacggtttaggtcttgtattgattactggccgggaatgaaacttatatcctgacataagtgttattggtgttactgttttatttcctggcctcttacaatgtatggagacccagcatggcgtat

SEQ ID NO: 415601 - DNA, 140 bp, Artificial Sequence
  Synthetic
aggccctggctgctgatatggtcaggatataagtttcattcccggccagtaatcaatacaagacctaaacaagcatggtgctggttcaaaggccggtggaaggacgccatgcaggaggtagaccttttgggacagcggtg

SEQ ID NO: 415602 - DNA, 140 bp, Artificial Sequence
  Synthetic
caccgctgtcccaaaaggtctacctcctgcatggcgtccttccaccggcctttgaaccagcaccatgcttgtttaggtcttgtattgattactggccgggaatgaaacttatatcctgaccatatcagcagccagggcct

SEQ ID NO: 415603 - DNA, 140 bp, Artificial Sequence
  Synthetic
atacgccatgctgggtctcccattacctttgcagcaccgggaaaaggctcagacccggaagtagaatacatgtggactaactgcaggggagaatttctctactgcgacatgacttggttccgtacttgggagtcggccat

SEQ ID NO: 415604 - DNA, 140 bp, Artificial Sequence
  Synthetic
atggccgactcccaagtacggaaccaagtcatgtcgcagtagagaaattctcccctgcagttagtccacatgtattctacttccgggtctgagccttttcccggtgctgcaaaggtaatgggagacccagcatggcgtat

SEQ ID NO: 415605 - DNA, 140 bp, Artificial Sequence
  Synthetic
aggccctggctgctgatatgtgtggactaactgcaggggagaatttctctactgcgacatgacttggttccttgattggatagagaacagacctacgaggaaggcatggcgcaattatgtgaccttttgggacagcggtg

SEQ ID NO: 415606 - DNA, 140 bp, Artificial Sequence
  Synthetic
caccgctgtcccaaaaggtcacataattgcgccatgccttcctcgtaggtctgttctctatccaatcaaggaaccaagtcatgtcgcagtagagaaattctcccctgcagttagtccacacatatcagcagccagggcct

SEQ ID NO: 415607 - DNA, 140 bp, Artificial Sequence
  Synthetic
atacgccatgctgggtctccatgtgtatttgcctcccagggaaggggagttgacctgcaactcaactgtgaccagcataattgctaacattgatgtaaacgaaatagataaacggacaaacgtacttgggagtcggccat

SEQ ID NO: 415608 - DNA, 140 bp, Artificial Sequence
  Synthetic
atggccgactcccaagtacgtttgtccgtttatctatttcgtttacatcaatgttagcaattatgctggtcacagttgagttgcaggtcaactccccttccctgggaggcaaatacacatggagacccagcatggcgtat

SEQ ID NO: 415609 - DNA, 140 bp, Artificial Sequence
  Synthetic
atacgccatgctgggtctccattataaattggtagaagtaacaccaattggcttcgcacctacatcagaaaaacggtactcctctggccaccgggagacatacaagaggtgtgctcgtgccgtacttgggagtcggccat

SEQ ID NO: 415610 - DNA, 140 bp, Artificial Sequence
  Synthetic
atggccgactcccaagtacggcacgagcacacctcttgtatgtctcccggtggccagaggagtaccgtttttctgatgtaggtgcgaagccaattggtgttacttctaccaatttataatggagacccagcatggcgtat

SEQ ID NO: 415611 - DNA, 140 bp, Artificial Sequence
  Synthetic
atacgccatgctgggtctcctccttgacgctgtccgctcagccccggactttactggccgggatagtgcagcaacagcaacagctgttggacgtggtcaagagacaacaagaaatgttgccgtacttgggagtcggccat

SEQ ID NO: 415612 - DNA, 140 bp, Artificial Sequence
  Synthetic
atggccgactcccaagtacggcaacatttcttgttgtctcttgaccacgtccaacagctgttgctgttgctgcactatcccggccagtaaagtccggggctgagcggacagcgtcaaggaggagacccagcatggcgtat

SEQ ID NO: 415613 - DNA, 140 bp, Artificial Sequence
  Synthetic
atacgccatgctgggtctcctagacaagtctgccacactactgtaccatgggtaaatgattccttgacacctgattggaaaaatatgacatggtaagaatgggaacaaaaagtccgctaccgtacttgggagtcggccat

SEQ ID NO: 415614 - DNA, 140 bp, Artificial Sequence
  Synthetic
atggccgactcccaagtacggtagcggactttttgttcccattcttaccatgtcatatttttccaatcaggtgtcaaggaatcatttacccatggtacagtagtgtggcagacttgtctaggagacccagcatggcgtat

SEQ ID NO: 415615 - DNA, 140 bp, Artificial Sequence
  Synthetic
aggccctggctgctgatatgctgattggaaaaatatgacatggtaagaatgggaacaaaaagtccgctacctggaggcaaatatcagtcaaagtttagaacaggcacaaatccaacaggagaccttttgggacagcggtg

SEQ ID NO: 415616 - DNA, 140 bp, Artificial Sequence
  Synthetic
caccgctgtcccaaaaggtctcctgttggatttgtgcctgttctaaactttgactgatatttgcctccaggtagcggactttttgttcccattcttaccatgtcatatttttccaatcagcatatcagcagccagggcct

SEQ ID NO: 415617 - DNA, 140 bp, Artificial Sequence
  Synthetic
atacgccatgctgggtctccactggtttgacttaacctcctggatcaagtatattcagtatggagtttgcatagtagtaggaataatagttttaagaatagtaatatatgtagtacaaatcgtacttgggagtcggccat

SEQ ID NO: 415618 - DNA, 140 bp, Artificial Sequence
  Synthetic
atggccgactcccaagtacgatttgtactacatatattactattcttaaaactattattcctactactatgcaaactccatactgaatatacttgatccaggaggttaagtcaaaccagtggagacccagcatggcgtat

SEQ ID NO: 415619 - DNA, 140 bp, Artificial Sequence
  Synthetic
aggccctggctgctgatatgatagtagtaggaataatagttttaagaatagtaatatatgtagtacaaatgttaagtagacttagaaagggctataggcctgttttctcctccccccccggaccttttgggacagcggtg

SEQ ID NO: 415620 - DNA, 140 bp, Artificial Sequence
  Synthetic
caccgctgtcccaaaaggtccggggggggaggagaaaacaggcctatagccctttctaagtctacttaacatttgtactacatatattactattcttaaaactattattcctactactatcatatcagcagccagggcct

SEQ ID NO: 415621 - DNA, 140 bp, Artificial Sequence
  Synthetic
atacgccatgctgggtctccgaaggaatagaagaagacgttggagacaacggtggttacagatcttgaccctggccgatagcatatatacatttcctgatccacctgctaattcgcctgtcgtacttgggagtcggccat

SEQ ID NO: 415622 - DNA, 140 bp, Artificial Sequence
  Synthetic
atggccgactcccaagtacgacaggcgaattagcaggtggatcaggaaatgtatatatgctatcggccagggtcaagatctgtaaccaccgttgtctccaacgtcttcttctattccttcggagacccagcatggcgtat

SEQ ID NO: 415623 - DNA, 140 bp, Artificial Sequence
  Synthetic
aggccctggctgctgatatgctggccgatagcatatatacatttcctgatccacctgctaattcgcctgttgaccagactatacaacagctgcaaggacttactatccaggagcttcctggaccttttgggacagcggtg

SEQ ID NO: 415624 - DNA, 140 bp, Artificial Sequence
  Synthetic
caccgctgtcccaaaaggtccaggaagctcctggatagtaagtccttgcagctgttgtatagtctggtcaacaggcgaattagcaggtggatcaggaaatgtatatatgctatcggccagcatatcagcagccagggcct

SEQ ID NO: 415625 - DNA, 140 bp, Artificial Sequence
  Synthetic
atacgccatgctgggtctccagccttcctgcaatatgggtgcgagtggatccaagaagcattccaagccttcgcgaggactgcgggaaagactcttgcgagcgcaggcagaaacttgtgtcgtacttgggagtcggccat

SEQ ID NO: 415626 - DNA, 140 bp, Artificial Sequence
  Synthetic
atggccgactcccaagtacgacacaagtttctgcctgcgctcgcaagagtctttcccgcagtcctcgcgaaggcttggaatgcttcttggatccactcgcacccatattgcaggaaggctggagacccagcatggcgtat

SEQ ID NO: 415627 - DNA, 140 bp, Artificial Sequence
  Synthetic
aggccctggctgctgatatgtcgcgaggactgcgggaaagactcttgcgagcgcaggcagaaacttgtgtgggacagtggaaagaattgggaggggaatactcgcaatcccaagaaggatgaccttttgggacagcggtg

SEQ ID NO: 415628 - DNA, 140 bp, Artificial Sequence
  Synthetic
caccgctgtcccaaaaggtcatccttcttgggattgcgagtattcccctcccaattctttccactgtcccacacaagtttctgcctgcgctcgcaagagtctttcccgcagtcctcgcgacatatcagcagccagggcct

SEQ ID NO: 415629 - DNA, 140 bp, Artificial Sequence
  Synthetic
atacgccatgctgggtctccggggacttcatgaatactccatggagaaccccagcaacagaaaaagggaaagacttatacaggcaacaaaatatggatgatgtagattcagatgatgatgcgtacttgggagtcggccat

SEQ ID NO: 415630 - DNA, 140 bp, Artificial Sequence
  Synthetic
atggccgactcccaagtacgcatcatcatctgaatctacatcatccatattttgttgcctgtataagtctttccctttttctgttgctggggttctccatggagtattcatgaagtccccggagacccagcatggcgtat

SEQ ID NO: 415631 - DNA, 140 bp, Artificial Sequence
  Synthetic
aggccctggctgctgatatggacctagtaggagtttctgtcacaccaagggtaccactaagaacaatgacatatagaatggcaatagacatgtcacatttaataaaagaaaaggggggacgaccttttgggacagcggtg

SEQ ID NO: 415632 - DNA, 140 bp, Artificial Sequence
  Synthetic
caccgctgtcccaaaaggtcgtccccccttttcttttattaaatgtgacatgtctattgccattctatatgtcattgttcttagtggtacccttggtgtgacagaaactcctactaggtccatatcagcagccagggcct

SEQ ID NO: 415633 - DNA, 140 bp, Artificial Sequence
  Synthetic
atacgccatgctgggtctccgattggcgcccgaacaggacttgaaggagactggaacacggctgagtgaaggcagtaagggcggcaggaacaaaccacgacggagtgctcctagaaaggccgtacttgggagtcggccat

SEQ ID NO: 415634 - DNA, 140 bp, Artificial Sequence
  Synthetic
atggccgactcccaagtacggcctttctaggagcactccgtcgtggtttgttcctgccgcccttactgccttcactcagccgtgttccagtctccttcaagtcctgttcgggcgccaatcggagacccagcatggcgtat

SEQ ID NO: 415635 - DNA, 140 bp, Artificial Sequence
  Synthetic
aggccctggctgctgatatgggcagtaagggcggcaggaacaaaccacgacggagtgctcctagaaaggcgcgggccgaggtaccaaaggcggcgtgtggagcgggagtaaagaggcctcgaccttttgggacagcggtg

SEQ ID NO: 415636 - DNA, 140 bp, Artificial Sequence
  Synthetic
caccgctgtcccaaaaggtcgaggcctctttactcccgctccacacgccgcctttggtacctcggcccgcgcctttctaggagcactccgtcgtggtttgttcctgccgcccttactgcccatatcagcagccagggcct

SEQ ID NO: 415637 - DNA, 140 bp, Artificial Sequence
  Synthetic
atacgccatgctgggtctccttatcctacctttagacaggtagaagattgtgggagatgggcgcgagaagctccgtcttgagagggaaaaaagtagatgaattagaaaaaattaggttaccgtacttgggagtcggccat

SEQ ID NO: 415638 - DNA, 140 bp, Artificial Sequence
  Synthetic
atggccgactcccaagtacggtaacctaattttttctaattcatctacttttttccctctcaagacggagcttctcgcgcccatctcccacaatcttctacctgtctaaaggtaggataaggagacccagcatggcgtat

SEQ ID NO: 415639 - DNA, 140 bp, Artificial Sequence
  Synthetic
aggccctggctgctgatatgctccgtcttgagagggaaaaaagtagatgaattagaaaaaattaggttacggcccggcgggaagaaaaaatatagactaaagcatattgtgtgggcagcggaccttttgggacagcggtg

SEQ ID NO: 415640 - DNA, 140 bp, Artificial Sequence
  Synthetic
caccgctgtcccaaaaggtccgctgcccacacaatatgctttagtctatattttttcttcccgccgggccgtaacctaattttttctaattcatctacttttttccctctcaagacggagcatatcagcagccagggcct

SEQ ID NO: 415641 - DNA, 140 bp, Artificial Sequence
  Synthetic
atacgccatgctgggtctccaggttgccaaaaaattattacagttttagatccattagtgccaacaggatcagaaaatttaaaaagcctttttaatactgtctgcgtcatttggtgcttgcgtacttgggagtcggccat

SEQ ID NO: 415642 - DNA, 140 bp, Artificial Sequence
  Synthetic
atggccgactcccaagtacgcaagcaccaaatgacgcagacagtattaaaaaggctttttaaattttctgatcctgttggcactaatggatctaaaactgtaataattttttggcaacctggagacccagcatggcgtat

SEQ ID NO: 415643 - DNA, 140 bp, Artificial Sequence
  Synthetic
aggccctggctgctgatatgcagaaaatttaaaaagcctttttaatactgtctgcgtcatttggtgcttgcacgcagaagagaaagtgaaagatactgaaggagcaaaacaaatagtacagaccttttgggacagcggtg

SEQ ID NO: 415644 - DNA, 140 bp, Artificial Sequence
  Synthetic
caccgctgtcccaaaaggtctgtactatttgttttgctccttcagtatctttcactttctcttctgcgtgcaagcaccaaatgacgcagacagtattaaaaaggctttttaaattttctgcatatcagcagccagggcct

SEQ ID NO: 415645 - DNA, 140 bp, Artificial Sequence
  Synthetic
atacgccatgctgggtctccgtagaccagcagcaccacctagcgggagagggggaaattaccccgtgcaacaaatagctggcaactattcccatgtgccgttgagcccccgaaccctaaacgtacttgggagtcggccat

SEQ ID NO: 415646 - DNA, 140 bp, Artificial Sequence
  Synthetic
atggccgactcccaagtacgtttagggttcgggggctcaacggcacatgggaatagttgccagctatttgttgcacggggtaatttccccctctcccgctaggtggtgctgctggtctacggagacccagcatggcgtat

SEQ ID NO: 415647 - DNA, 140 bp, Artificial Sequence
  Synthetic
aggccctggctgctgatatgcaaatagctggcaactattcccatgtgccgttgagcccccgaaccctaaatgcttgggtaaagttagtggaagaaaagaagttcggggcagaagtagtgcgaccttttgggacagcggtg

SEQ ID NO: 415648 - DNA, 140 bp, Artificial Sequence
  Synthetic
caccgctgtcccaaaaggtcgcactacttctgccccgaacttcttttcttccactaactttacccaagcatttagggttcgggggctcaacggcacatgggaatagttgccagctatttgcatatcagcagccagggcct

SEQ ID NO: 415649 - DNA, 140 bp, Artificial Sequence
  Synthetic
atacgccatgctgggtctccatgcttaattgtgtgggcgaccatcaagcagctatgcaaataatcagagagattattaatgaagaagcagcagattgggatgtgcaacacccaataccagcgtacttgggagtcggccat

SEQ ID NO: 415650 - DNA, 140 bp, Artificial Sequence
  Synthetic
atggccgactcccaagtacgctggtattgggtgttgcacatcccaatctgctgcttcttcattaataatctctctgattatttgcatagctgcttgatggtcgcccacacaattaagcatggagacccagcatggcgtat

SEQ ID NO: 415651 - DNA, 140 bp, Artificial Sequence
  Synthetic
aggccctggctgctgatatggattattaatgaagaagcagcagattgggatgtgcaacacccaataccaggccccttgccagcggggcagcttagagaaccaagagggtctgatatagcagaccttttgggacagcggtg

SEQ ID NO: 415652 - DNA, 140 bp, Artificial Sequence
  Synthetic
caccgctgtcccaaaaggtctgctatatcagaccctcttggttctctaagctgccccgctggcaaggggcctggtattgggtgttgcacatcccaatctgctgcttcttcattaataatccatatcagcagccagggcct

SEQ ID NO: 415653 - DNA, 140 bp, Artificial Sequence
  Synthetic
atacgccatgctgggtctccaaatcctataccagtagggaacatctataggagatggatccagataggactgcagaagtgcgtcaggatgtacaatccaaccaacatcctagacgtaaaacgtacttgggagtcggccat

SEQ ID NO: 415654 - DNA, 140 bp, Artificial Sequence
  Synthetic
atggccgactcccaagtacgttttacgtctaggatgttggttggattgtacatcctgacgcacttctgcagtcctatctggatccatctcctatagatgttccctactggtataggatttggagacccagcatggcgtat

SEQ ID NO: 415655 - DNA, 140 bp, Artificial Sequence
  Synthetic
aggccctggctgctgatatgtgcagaagtgcgtcaggatgtacaatccaaccaacatcctagacgtaaaacagggaccaaaggagccgttccaaagctatgtagatagattctacaaaaggaccttttgggacagcggtg

SEQ ID NO: 415656 - DNA, 140 bp, Artificial Sequence
  Synthetic
caccgctgtcccaaaaggtccttttgtagaatctatctacatagctttggaacggctcctttggtccctgttttacgtctaggatgttggttggattgtacatcctgacgcacttctgcacatatcagcagccagggcct

SEQ ID NO: 415657 - DNA, 140 bp, Artificial Sequence
  Synthetic
atacgccatgctgggtctcccactgctggtacagaatgccaacccagactgtaaattagtactaaaaggactggggatgaatcctaccttagaggagatgctgaccgcctgtcagggaatcgtacttgggagtcggccat

SEQ ID NO: 415658 - DNA, 140 bp, Artificial Sequence
  Synthetic
atggccgactcccaagtacgattccctgacaggcggtcagcatctcctctaaggtaggattcatccccagtccttttagtactaatttacagtctgggttggcattctgtaccagcagtgggagacccagcatggcgtat

SEQ ID NO: 415659 - DNA, 140 bp, Artificial Sequence
  Synthetic
aggccctggctgctgatatgctggggatgaatcctaccttagaggagatgctgaccgcctgtcagggaataggaggaccaggccagaaagccagattaatggcagaagccttaaaggagggaccttttgggacagcggtg

SEQ ID NO: 415660 - DNA, 140 bp, Artificial Sequence
  Synthetic
caccgctgtcccaaaaggtccctcctttaaggcttctgccattaatctggctttctggcctggtcctcctattccctgacaggcggtcagcatctcctctaaggtaggattcatccccagcatatcagcagccagggcct

SEQ ID NO: 415661 - DNA, 140 bp, Artificial Sequence
  Synthetic
atacgccatgctgggtctccattaagtgctggaattgtggaaaggatgggcactcggcaagacaatgccgagcacctagaagacagggctgctggaaatgtggcaaatcaggacatgtcacgtacttgggagtcggccat

SEQ ID NO: 415662 - DNA, 140 bp, Artificial Sequence
  Synthetic
atggccgactcccaagtacgtgacatgtcctgatttgccacatttccagcagccctgtcttctaggtgctcggcattgtcttgccgagtgcccatcctttccacaattccagcacttaatggagacccagcatggcgtat

SEQ ID NO: 415663 - DNA, 140 bp, Artificial Sequence
  Synthetic
aggccctggctgctgatatgagcacctagaagacagggctgctggaaatgtggcaaatcaggacatgtcatggcaaactgcccagaaagacaggctggttttttagggattggcccatgggaccttttgggacagcggtg

SEQ ID NO: 415664 - DNA, 140 bp, Artificial Sequence
  Synthetic
caccgctgtcccaaaaggtcccatgggccaatccctaaaaaaccagcctgtctttctgggcagtttgccatgacatgtcctgatttgccacatttccagcagccctgtcttctaggtgctcatatcagcagccagggcct

SEQ ID NO: 415665 - DNA, 140 bp, Artificial Sequence
  Synthetic
atacgccatgctgggtctccaccaacagcacccccagcagacccagcagcagacctgctagagaagtacttgcagcaagggaggaagcagaaagagcagaaaatgagaccatacaaggagcgtacttgggagtcggccat

SEQ ID NO: 415666 - DNA, 140 bp, Artificial Sequence
  Synthetic
atggccgactcccaagtacgctccttgtatggtctcattttctgctctttctgcttcctcccttgctgcaagtacttctctagcaggtctgctgctgggtctgctgggggtgctgttggtggagacccagcatggcgtat

SEQ ID NO: 415667 - DNA, 140 bp, Artificial Sequence
  Synthetic
aggccctggctgctgatatgtgcagcaagggaggaagcagaaagagcagaaaatgagaccatacaaggaggtgacagaggacttactgcacctcgaacaaggagagacaccacacaaagagaccttttgggacagcggtg

SEQ ID NO: 415668 - DNA, 140 bp, Artificial Sequence
  Synthetic
caccgctgtcccaaaaggtctctttgtgtggtgtctctccttgttcgaggtgcagtaagtcctctgtcacctccttgtatggtctcattttctgctctttctgcttcctcccttgctgcacatatcagcagccagggcct

SEQ ID NO: 415669 - DNA, 140 bp, Artificial Sequence
  Synthetic
atacgccatgctgggtctccagtcacagcatatgttgagggtcagccagtagaagtcttactagacacaggggctgacgactcaatagtagcaggaatagagttggggagcaattatagtcgtacttgggagtcggccat

SEQ ID NO: 415670 - DNA, 140 bp, Artificial Sequence
  Synthetic
atggccgactcccaagtacgactataattgctccccaactctattcctgctactattgagtcgtcagcccctgtgtctagtaagacttctactggctgaccctcaacatatgctgtgactggagacccagcatggcgtat

SEQ ID NO: 415671 - DNA, 140 bp, Artificial Sequence
  Synthetic
aggccctggctgctgatatggggctgacgactcaatagtagcaggaatagagttggggagcaattatagtccaaaaatagtagggggaatagggggattcataaacaccaaggaatataagaccttttgggacagcggtg

SEQ ID NO: 415672 - DNA, 140 bp, Artificial Sequence
  Synthetic
caccgctgtcccaaaaggtcttatattccttggtgtttatgaatccccctattccccctactatttttggactataattgctccccaactctattcctgctactattgagtcgtcagccccatatcagcagccagggcct

SEQ ID NO: 415673 - DNA, 140 bp, Artificial Sequence
  Synthetic
atacgccatgctgggtctcccaggtgataccccaatcaacatttttggcagaaacattctgacagccttaggcatgtcattaaatctaccagtcgccaaggtagacccgataaaagtaatcgtacttgggagtcggccat

SEQ ID NO: 415674 - DNA, 140 bp, Artificial Sequence
  Synthetic
atggccgactcccaagtacgattacttttatcgggtctaccttggcgactggtagatttaatgacatgcctaaggctgtcagaatgtttctgccaaaaatgttgattggggtatcacctgggagacccagcatggcgtat

SEQ ID NO: 415675 - DNA, 140 bp, Artificial Sequence
  Synthetic
aggccctggctgctgatatgggcatgtcattaaatctaccagtcgccaaggtagacccgataaaagtaatactgaaaccaggaaaagatggaccaaaagtaagacaatggcctctaacaagaccttttgggacagcggtg

SEQ ID NO: 415676 - DNA, 140 bp, Artificial Sequence
  Synthetic
caccgctgtcccaaaaggtcttgttagaggccattgtcttacttttggtccatcttttcctggtttcagtattacttttatcgggtctaccttggcgactggtagatttaatgacatgcccatatcagcagccagggcct

SEQ ID NO: 415677 - DNA, 140 bp, Artificial Sequence
  Synthetic
atacgccatgctgggtctccggccagctagaggaagctcccccaactaatccttataatacccccacatttgcaattaagaaaaaggacaaaaacaaatggagaatgctaatagattttacgtacttgggagtcggccat

SEQ ID NO: 415678 - DNA, 140 bp, Artificial Sequence
  Synthetic
atggccgactcccaagtacgtaaaatctattagcattctccatttgtttttgtcctttttcttaattgcaaatgtgggggtattataaggattagttgggggagcttcctctagctggccggagacccagcatggcgtat

SEQ ID NO: 415679 - DNA, 140 bp, Artificial Sequence
  Synthetic
aggccctggctgctgatatgtgcaattaagaaaaaggacaaaaacaaatggagaatgctaatagattttagagaactaaataaggtaactcaagagttcacagaaattcagttaggaattgaccttttgggacagcggtg

SEQ ID NO: 415680 - DNA, 140 bp, Artificial Sequence
  Synthetic
caccgctgtcccaaaaggtcaattcctaactgaatttctgtgaactcttgagttaccttatttagttctctaaaatctattagcattctccatttgtttttgtcctttttcttaattgcacatatcagcagccagggcct

SEQ ID NO: 415681 - DNA, 140 bp, Artificial Sequence
  Synthetic
atacgccatgctgggtctccaggggatgcctacttttccataccactacatgaggactttagacaatatactgcatttactctaccaacagtgaacaatgcagaaccaggaaagagatatcgtacttgggagtcggccat

SEQ ID NO: 415682 - DNA, 140 bp, Artificial Sequence
  Synthetic
atggccgactcccaagtacgatatctctttcctggttctgcattgttcactgttggtagagtaaatgcagtatattgtctaaagtcctcatgtagtggtatggaaaagtaggcatcccctggagacccagcatggcgtat

SEQ ID NO: 415683 - DNA, 140 bp, Artificial Sequence
  Synthetic
aggccctggctgctgatatgctgcatttactctaccaacagtgaacaatgcagaaccaggaaagagatatatatataaagtcctaccacagggatggaaaggatcgccagcaatttttcagaccttttgggacagcggtg

SEQ ID NO: 415684 - DNA, 140 bp, Artificial Sequence
  Synthetic
caccgctgtcccaaaaggtctgaaaaattgctggcgatcctttccatccctgtggtaggactttatatatatatctctttcctggttctgcattgttcactgttggtagagtaaatgcagcatatcagcagccagggcct

SEQ ID NO: 415685 - DNA, 140 bp, Artificial Sequence
  Synthetic
atacgccatgctgggtctcctcattctcgtccaatatatggatgatatcttaatagctagcgacaggacagacttagagcatgacagaacggtcctgcagttaaaagaacttttaaatggcgtacttgggagtcggccat

SEQ ID NO: 415686 - DNA, 140 bp, Artificial Sequence
  Synthetic
atggccgactcccaagtacgccatttaaaagttcttttaactgcaggaccgttctgtcatgctctaagtctgtcctgtcgctagctattaagatatcatccatatattggacgagaatgaggagacccagcatggcgtat

SEQ ID NO: 415687 - DNA, 140 bp, Artificial Sequence
  Synthetic
aggccctggctgctgatatggacttagagcatgacagaacggtcctgcagttaaaagaacttttaaatggcctaggattctccaccccagatgagaagttccaaaaagaccccccatacagaccttttgggacagcggtg

SEQ ID NO: 415688 - DNA, 140 bp, Artificial Sequence
  Synthetic
caccgctgtcccaaaaggtctgtatggggggtctttttggaacttctcatctggggtggagaatcctaggccatttaaaagttcttttaactgcaggaccgttctgtcatgctctaagtccatatcagcagccagggcct

SEQ ID NO: 415689 - DNA, 140 bp, Artificial Sequence
  Synthetic
atacgccatgctgggtctcccaattgccccaaaaagaagtatggacagtcaatgacatccaaaagctagtaggtgtcctaaattgggcagcacaaatctacccagggataaagaccaaaccgtacttgggagtcggccat

SEQ ID NO: 415690 - DNA, 140 bp, Artificial Sequence
  Synthetic
atggccgactcccaagtacggtttggtctttatccctgggtagatttgtgctgcccaatttaggacacctactagcttttggatgtcattgactgtccatacttctttttggggcaattgggagacccagcatggcgtat

SEQ ID NO: 415691 - DNA, 140 bp, Artificial Sequence
  Synthetic
aggccctggctgctgatatgaggtgtcctaaattgggcagcacaaatctacccagggataaagaccaaacacttatgtaggctaattagaggaaaaatgacactcacggaagaagtacaggaccttttgggacagcggtg

SEQ ID NO: 415692 - DNA, 140 bp, Artificial Sequence
  Synthetic
caccgctgtcccaaaaggtcctgtacttcttccgtgagtgtcatttttcctctaattagcctacataagtgtttggtctttatccctgggtagatttgtgctgcccaatttaggacacctcatatcagcagccagggcct

SEQ ID NO: 415693 - DNA, 140 bp, Artificial Sequence
  Synthetic
atacgccatgctgggtctccccaggaacaggagggatgctattaccaagaagaaaaggaattagaagcaacagtccaaaaggatcaagacaatcagtggacatataaaatacaccaaggacgtacttgggagtcggccat

SEQ ID NO: 415694 - DNA, 140 bp, Artificial Sequence
  Synthetic
atggccgactcccaagtacgtccttggtgtattttatatgtccactgattgtcttgatccttttggactgttgcttctaattccttttcttcttggtaatagcatccctcctgttcctggggagacccagcatggcgtat

SEQ ID NO: 415695 - DNA, 140 bp, Artificial Sequence
  Synthetic
aggccctggctgctgatatgcagtccaaaaggatcaagacaatcagtggacatataaaatacaccaaggagagaaaatcctaaaagtaggaaaatatgcaaagataaaaaatacccatacgaccttttgggacagcggtg

SEQ ID NO: 415696 - DNA, 140 bp, Artificial Sequence
  Synthetic
caccgctgtcccaaaaggtcgtatgggtattttttatctttgcatattttcctacttttaggattttctctccttggtgtattttatatgtccactgattgtcttgatccttttggactgcatatcagcagccagggcct

SEQ ID NO: 415697 - DNA, 140 bp, Artificial Sequence
  Synthetic
atacgccatgctgggtctcccactagtcatttggggacgaataccaaaatttcacctaccagtagaaagagaaacctgggagcagtggtgggataactattggcaagtgacatggatccccgtacttgggagtcggccat

SEQ ID NO: 415698 - DNA, 140 bp, Artificial Sequence
  Synthetic
atggccgactcccaagtacggggatccatgtcacttgccaatagttatcccaccactgctcccaggtttctctttctactggtaggtgaaattttggtattcgtccccaaatgactagtgggagacccagcatggcgtat

SEQ ID NO: 415699 - DNA, 140 bp, Artificial Sequence
  Synthetic
aggccctggctgctgatatggaaacctgggagcagtggtgggataactattggcaagtgacatggatcccagactgggacttcgtatctactccaccactggtcaggttagcatttaaccgaccttttgggacagcggtg

SEQ ID NO: 415700 - DNA, 140 bp, Artificial Sequence
  Synthetic
caccgctgtcccaaaaggtcggttaaatgctaacctgaccagtggtggagtagatacgaagtcccagtctgggatccatgtcacttgccaatagttatcccaccactgctcccaggtttccatatcagcagccagggcct

SEQ ID NO: 415701 - DNA, 140 bp, Artificial Sequence
  Synthetic
atacgccatgctgggtctcctgtaataggcaatcaaaagagggaaaagcaggatatataacagatagagggagagacaaggtaaggatattggagcaaactaccaatcagcaagcagaatcgtacttgggagtcggccat

SEQ ID NO: 415702 - DNA, 140 bp, Artificial Sequence
  Synthetic
atggccgactcccaagtacgattctgcttgctgattggtagtttgctccaatatccttaccttgtctctccctctatctgttatatatcctgcttttccctcttttgattgcctattacaggagacccagcatggcgtat

SEQ ID NO: 415703 - DNA, 140 bp, Artificial Sequence
  Synthetic
aggccctggctgctgatatggagagacaaggtaaggatattggagcaaactaccaatcagcaagcagaattagaagccttcgcaatggcattaacagactcaggtccaaaagccaatattgaccttttgggacagcggtg

SEQ ID NO: 415704 - DNA, 140 bp, Artificial Sequence
  Synthetic
caccgctgtcccaaaaggtcaatattggcttttggacctgagtctgttaatgccattgcgaaggcttctaattctgcttgctgattggtagtttgctccaatatccttaccttgtctctccatatcagcagccagggcct

SEQ ID NO: 415705 - DNA, 140 bp, Artificial Sequence
  Synthetic
atacgccatgctgggtctccatcagagagtaaactagtaaaccaaatcatagaagaaatgataaaaaaggaaacactctatgttgcatgggtcccagcccacaaaggcataggaggaaatcgtacttgggagtcggccat

SEQ ID NO: 415706 - DNA, 140 bp, Artificial Sequence
  Synthetic
atggccgactcccaagtacgatttcctcctatgcctttgtgggctgggacccatgcaacatagagtgtttccttttttatcatttcttctatgatttggtttactagtttactctctgatggagacccagcatggcgtat

SEQ ID NO: 415707 - DNA, 140 bp, Artificial Sequence
  Synthetic
aggccctggctgctgatatgaaacactctatgttgcatgggtcccagcccacaaaggcataggaggaaatcaggaagtagatcatttagtaagtcagggcattagacaagtattattcctgaccttttgggacagcggtg

SEQ ID NO: 415708 - DNA, 140 bp, Artificial Sequence
  Synthetic
caccgctgtcccaaaaggtcaggaataatacttgtctaatgccctgacttactaaatgatctacttcctgatttcctcctatgcctttgtgggctgggacccatgcaacatagagtgtttcatatcagcagccagggcct

SEQ ID NO: 415709 - DNA, 140 bp, Artificial Sequence
  Synthetic
atacgccatgctgggtctcctaaaagaattatcccataaatttggactgcccaaactagtggcaagacaaatagtaaacacatgtgcccaatgtcaacagaaaggggaagctatacatggcgtacttgggagtcggccat

SEQ ID NO: 415710 - DNA, 140 bp, Artificial Sequence
  Synthetic
atggccgactcccaagtacgccatgtatagcttcccctttctgttgacattgggcacatgtgtttactatttgtcttgccactagtttgggcagtccaaatttatgggataattcttttaggagacccagcatggcgtat

SEQ ID NO: 415711 - DNA, 140 bp, Artificial Sequence
  Synthetic
aggccctggctgctgatatgatagtaaacacatgtgcccaatgtcaacagaaaggggaagctatacatgggcaagtagatgcagaactgggcacttggcaaatggactgcacacacttaggaccttttgggacagcggtg

SEQ ID NO: 415712 - DNA, 140 bp, Artificial Sequence
  Synthetic
caccgctgtcccaaaaggtcctaagtgtgtgcagtccatttgccaagtgcccagttctgcatctacttgcccatgtatagcttcccctttctgttgacattgggcacatgtgtttactatcatatcagcagccagggcct

SEQ ID NO: 415713 - DNA, 140 bp, Artificial Sequence
  Synthetic
atacgccatgctgggtctccgcagaagttatcccacaggaaacgggaaggcaaacagcactcttcctattaaaactggccagtaggtggccaataacacacctgcacacagataatggtgcgtacttgggagtcggccat

SEQ ID NO: 415714 - DNA, 140 bp, Artificial Sequence
  Synthetic
atggccgactcccaagtacgcaccattatctgtgtgcaggtgtgttattggccacctactggccagttttaataggaagagtgctgtttgccttcccgtttcctgtgggataacttctgcggagacccagcatggcgtat

SEQ ID NO: 415715 - DNA, 140 bp, Artificial Sequence
  Synthetic
aggccctggctgctgatatgaaaactggccagtaggtggccaataacacacctgcacacagataatggtgccaacttcacctcacaggaagtaaagatggtagcgtggtggacaggtatagaccttttgggacagcggtg

SEQ ID NO: 415716 - DNA, 140 bp, Artificial Sequence
  Synthetic
caccgctgtcccaaaaggtctatacctgtccaccacgctaccatctttacttcctgtgaggtgaagttggcaccattatctgtgtgcaggtgtgttattggccacctactggccagttttcatatcagcagccagggcct

SEQ ID NO: 415717 - DNA, 140 bp, Artificial Sequence
  Synthetic
atacgccatgctgggtctccagcaatgaatcaccacttaaaaaaccagataagcagaattagagagcaggcaaatacaatggaaacaatagtattaatggcagttcattgcatgaattttcgtacttgggagtcggccat

SEQ ID NO: 415718 - DNA, 140 bp, Artificial Sequence
  Synthetic
atggccgactcccaagtacgaaaattcatgcaatgaactgccattaatactattgtttccattgtatttgcctgctctctaattctgcttatctggttttttaagtggtgattcattgctggagacccagcatggcgtat

SEQ ID NO: 415719 - DNA, 140 bp, Artificial Sequence
  Synthetic
aggccctggctgctgatatgcaaatacaatggaaacaatagtattaatggcagttcattgcatgaattttaaaagaaggggaggaataggggatatgaccccagcagaaagactaatcaagaccttttgggacagcggtg

SEQ ID NO: 415720 - DNA, 140 bp, Artificial Sequence
  Synthetic
caccgctgtcccaaaaggtcttgattagtctttctgctggggtcatatcccctattcctccccttcttttaaaattcatgcaatgaactgccattaatactattgtttccattgtatttgcatatcagcagccagggcct

SEQ ID NO: 415721 - DNA, 140 bp, Artificial Sequence
  Synthetic
atacgccatgctgggtctccaattaaaaaatttccgggtctatttcagagaaggcagagatcagctgtggaaaggacctggggaactactgtggaagggagatggagcagtcatagtcaacgtacttgggagtcggccat

SEQ ID NO: 415722 - DNA, 140 bp, Artificial Sequence
  Synthetic
atggccgactcccaagtacgttgactatgactgctccatctcccttccacagtagttccccaggtcctttccacagctgatctctgccttctctgaaatagacccggaaattttttaattggagacccagcatggcgtat

SEQ ID NO: 415723 - DNA, 140 bp, Artificial Sequence
  Synthetic
aggccctggctgctgatatgaaaggacctggggaactactgtggaagggagatggagcagtcatagtcaaggtagggacagacataaaaatagtgccaagaaggaaagctaagatcatcagaccttttgggacagcggtg

SEQ ID NO: 415724 - DNA, 140 bp, Artificial Sequence
  Synthetic
caccgctgtcccaaaaggtctgatgatcttagctttccttcttggcactatttttatgtctgtccctaccttgactatgactgctccatctcccttccacagtagttccccaggtcctttcatatcagcagccagggcct

SEQ ID NO: 415725 - DNA, 140 bp, Artificial Sequence
  Synthetic
atacgccatgctgggtctccaccagggaggatggagaagtggcatagccttgtcaagtatctaaaacacagaacaaaagatctggaaggggtgtgctatgttccccaccataaggtgggacgtacttgggagtcggccat

SEQ ID NO: 415726 - DNA, 140 bp, Artificial Sequence
  Synthetic
atggccgactcccaagtacgtcccaccttatggtggggaacatagcacaccccttccagatcttttgttctgtgttttagatacttgacaaggctatgccacttctccatcctccctggtggagacccagcatggcgtat

SEQ ID NO: 415727 - DNA, 140 bp, Artificial Sequence
  Synthetic
aggccctggctgctgatatggaacaaaagatctggaaggggtgtgctatgttccccaccataaggtgggatgggcatggtggacttgcagcagggtaatattcccattacaaggaaataggaccttttgggacagcggtg

SEQ ID NO: 415728 - DNA, 140 bp, Artificial Sequence
  Synthetic
caccgctgtcccaaaaggtcctatttccttgtaatgggaatattaccctgctgcaagtccaccatgcccatcccaccttatggtggggaacatagcacaccccttccagatcttttgttccatatcagcagccagggcct

SEQ ID NO: 415729 - DNA, 140 bp, Artificial Sequence
  Synthetic
atacgccatgctgggtctcctctcctcttatgcagtaagaataacctggtatacagagaggttctggacagatgttaccccagactgtgcagactccctaatacatagcacttatttctccgtacttgggagtcggccat

SEQ ID NO: 415730 - DNA, 140 bp, Artificial Sequence
  Synthetic
atggccgactcccaagtacggagaaataagtgctatgtattagggagtctgcacagtctggggtaacatctgtccagaacctctctgtataccaggttattcttactgcataagaggagaggagacccagcatggcgtat

SEQ ID NO: 415731 - DNA, 140 bp, Artificial Sequence
  Synthetic
aggccctggctgctgatatggatgttaccccagactgtgcagactccctaatacatagcacttatttctcttgttttacggcgggtgaagtaagaagagccatcagaggggaaaagttacgaccttttgggacagcggtg

SEQ ID NO: 415732 - DNA, 140 bp, Artificial Sequence
  Synthetic
caccgctgtcccaaaaggtcgtaacttttcccctctgatggctcttcttacttcacccgccgtaaaacaagagaaataagtgctatgtattagggagtctgcacagtctggggtaacatccatatcagcagccagggcct

SEQ ID NO: 415733 - DNA, 140 bp, Artificial Sequence
  Synthetic
atacgccatgctgggtctcccaatttctggccttagtagtagtgcaacaaaatggcagaccccagaaaaacagtaccaccaggaaacggtggcgaagtaactattggagaggctttcgctcgtacttgggagtcggccat

SEQ ID NO: 415734 - DNA, 140 bp, Artificial Sequence
  Synthetic
atggccgactcccaagtacgagcgaaagcctctccaatagttacttcgccaccgtttcctggtggtactgtttttctggggtctgccattttgttgcactactactaaggccagaaattgggagacccagcatggcgtat

SEQ ID NO: 415735 - DNA, 140 bp, Artificial Sequence
  Synthetic
aggccctggctgctgatatgcagtaccaccaggaaacggtggcgaagtaactattggagaggctttcgcttggctagaaaggatggtagaggccataaacagagaggcagtgaaccacctgaccttttgggacagcggtg

SEQ ID NO: 415736 - DNA, 140 bp, Artificial Sequence
  Synthetic
caccgctgtcccaaaaggtcaggtggttcactgcctctctgtttatggcctctaccatcctttctagccaagcgaaagcctctccaatagttacttcgccaccgtttcctggtggtactgcatatcagcagccagggcct

SEQ ID NO: 415737 - DNA, 140 bp, Artificial Sequence
  Synthetic
atacgccatgctgggtctccatgatgacctagggatgtcacaaagttacacaaagtatagatatttgcgcttaatgcagtatgctatgttcatacatgttaagaaagggtgcacttgcctcgtacttgggagtcggccat

SEQ ID NO: 415738 - DNA, 140 bp, Artificial Sequence
  Synthetic
atggccgactcccaagtacgaggcaagtgcaccctttcttaacatgtatgaacatagcatactgcattaagcgcaaatatctatactttgtgtaactttgtgacatccctaggtcatcatggagacccagcatggcgtat

SEQ ID NO: 415739 - DNA, 140 bp, Artificial Sequence
  Synthetic
aggccctggctgctgatatgttaatgcagtatgctatgttcatacatgttaagaaagggtgcacttgcctggggggaggacatgggccgggagggtggagaccaggacctccccctcctcgaccttttgggacagcggtg

SEQ ID NO: 415740 - DNA, 140 bp, Artificial Sequence
  Synthetic
caccgctgtcccaaaaggtcgaggagggggaggtcctggtctccaccctcccggcccatgtcctccccccaggcaagtgcaccctttcttaacatgtatgaacatagcatactgcattaacatatcagcagccagggcct

SEQ ID NO: 415741 - DNA, 140 bp, Artificial Sequence
  Synthetic
atacgccatgctgggtctccatgaaaccccaccgagggggccaggggatgagtgggtaataggaatcctgagagaattaagagaagaagctttaaagcattttgaccctcgcttgctaaccgtacttgggagtcggccat

SEQ ID NO: 415742 - DNA, 140 bp, Artificial Sequence
  Synthetic
atggccgactcccaagtacggttagcaagcgagggtcaaaatgctttaaagcttcttctcttaattctctcaggattcctattacccactcatcccctggccccctcggtggggtttcatggagacccagcatggcgtat

SEQ ID NO: 415743 - DNA, 140 bp, Artificial Sequence
  Synthetic
aggccctggctgctgatatgagagaattaagagaagaagctttaaagcattttgaccctcgcttgctaactactcttggcaactatatctgtgctagacatggagacaccctcgaaagcggaccttttgggacagcggtg

SEQ ID NO: 415744 - DNA, 140 bp, Artificial Sequence
  Synthetic
caccgctgtcccaaaaggtccgctttcgagggtgtctccatgtctagcacagatatagttgccaagagtagttagcaagcgagggtcaaaatgctttaaagcttcttctcttaattctctcatatcagcagccagggcct

SEQ ID NO: 415745 - DNA, 140 bp, Artificial Sequence
  Synthetic
atacgccatgctgggtctccgcaggatgtaaaatctcaagaattggccaaacaaggggagagactcctttctcagctataccaacccctagaggcatgcaataacccatgttattgtaagcgtacttgggagtcggccat

SEQ ID NO: 415746 - DNA, 140 bp, Artificial Sequence
  Synthetic
atggccgactcccaagtacgcttacaataacatgggttattgcatgcctctaggggttggtatagctgagaaaggagtctctccccttgtttggccaattcttgagattttacatcctgcggagacccagcatggcgtat

SEQ ID NO: 415747 - DNA, 140 bp, Artificial Sequence
  Synthetic
aggccctggctgctgatatgctcagctataccaacccctagaggcatgcaataacccatgttattgtaagaaatgttgttaccattgccagctatgttttttaaaaaagggactcgggatgaccttttgggacagcggtg

SEQ ID NO: 415748 - DNA, 140 bp, Artificial Sequence
  Synthetic
caccgctgtcccaaaaggtcatcccgagtcccttttttaaaaaacatagctggcaatggtaacaacatttcttacaataacatgggttattgcatgcctctaggggttggtatagctgagcatatcagcagccagggcct

SEQ ID NO: 415749 - DNA, 140 bp, Artificial Sequence
  Synthetic
atacgccatgctgggtctccctcattcgtcttctgcatcagacaagtgagtataatggatagtagaaatcagctaattgttgccattttactaactagtgcttgcttaatatattgcgcccgtacttgggagtcggccat

SEQ ID NO: 415750 - DNA, 140 bp, Artificial Sequence
  Synthetic
atggccgactcccaagtacgggcgcaatatattaagcaagcactagttagtaaaatggcaacaattagctgatttctactatccattatactcacttgtctgatgcagaagacgaatgagggagacccagcatggcgtat

SEQ ID NO: 415751 - DNA, 140 bp, Artificial Sequence
  Synthetic
aggccctggctgctgatatgagctaattgttgccattttactaactagtgcttgcttaatatattgcgcccaatatgtgactgttttctatggcatacccgcgtggaagaatgcatccatgaccttttgggacagcggtg

SEQ ID NO: 415752 - DNA, 140 bp, Artificial Sequence
  Synthetic
caccgctgtcccaaaaggtcatggatgcattcttccacgcgggtatgccatagaaaacagtcacatattgggcgcaatatattaagcaagcactagttagtaaaatggcaacaattagctcatatcagcagccagggcct

SEQ ID NO: 415753 - DNA, 140 bp, Artificial Sequence
  Synthetic
atacgccatgctgggtctccgcttgccagacaatgatgattatcaggaaatacctttaaatgtgacagaggcttttgacgcatggaacaatacagtaacagaacaagcagtagaagatgtcgtacttgggagtcggccat

SEQ ID NO: 415754 - DNA, 140 bp, Artificial Sequence
  Synthetic
atggccgactcccaagtacgacatcttctactgcttgttctgttactgtattgttccatgcgtcaaaagcctctgtcacatttaaaggtatttcctgataatcatcattgtctggcaagcggagacccagcatggcgtat

SEQ ID NO: 415755 - DNA, 140 bp, Artificial Sequence
  Synthetic
aggccctggctgctgatatggcttttgacgcatggaacaatacagtaacagaacaagcagtagaagatgtctggaatctatttgagacatcagtaaaaccatgtgtcaaattaacaccctgaccttttgggacagcggtg

SEQ ID NO: 415756 - DNA, 140 bp, Artificial Sequence
  Synthetic
caccgctgtcccaaaaggtcagggtgttaatttgacacatggttttactgatgtctcaaatagattccagacatcttctactgcttgttctgttactgtattgttccatgcgtcaaaagccatatcagcagccagggcct

SEQ ID NO: 415757 - DNA, 140 bp, Artificial Sequence
  Synthetic
atacgccatgctgggtctccacaagtgaggggagcacagtcccagagatattaaacgaaactacttcatgcataaccaacaacagctgctcagatttagggagtgaagaggtagtcgattcgtacttgggagtcggccat

SEQ ID NO: 415758 - DNA, 140 bp, Artificial Sequence
  Synthetic
atggccgactcccaagtacgaatcgactacctcttcactccctaaatctgagcagctgttgttggttatgcatgaagtagtttcgtttaatatctctgggactgtgctcccctcacttgtggagacccagcatggcgtat

SEQ ID NO: 415759 - DNA, 140 bp, Artificial Sequence
  Synthetic
aggccctggctgctgatatgcataaccaacaacagctgctcagatttagggagtgaagaggtagtcgattgtcggttcaatatgacaggactacaactagataagccacagcaatatagtgaccttttgggacagcggtg

SEQ ID NO: 415760 - DNA, 140 bp, Artificial Sequence
  Synthetic
caccgctgtcccaaaaggtcactatattgctgtggcttatctagttgtagtcctgtcatattgaaccgacaatcgactacctcttcactccctaaatctgagcagctgttgttggttatgcatatcagcagccagggcct

SEQ ID NO: 415761 - DNA, 140 bp, Artificial Sequence
  Synthetic
atacgccatgctgggtctccccgcaaatgttacatgaaccattgcaacacatcagtcatcacagagtcatgtgataagcactattgggatgctatgaggtttagatactgtgcaccaccgcgtacttgggagtcggccat

SEQ ID NO: 415762 - DNA, 140 bp, Artificial Sequence
  Synthetic
atggccgactcccaagtacgcggtggtgcacagtatctaaacctcatagcatcccaatagtgcttatcacatgactctgtgatgactgatgtgttgcaatggttcatgtaacatttgcggggagacccagcatggcgtat

SEQ ID NO: 415763 - DNA, 140 bp, Artificial Sequence
  Synthetic
aggccctggctgctgatatggtgataagcactattgggatgctatgaggtttagatactgtgcaccaccgggtttatgcttgctaagatgcaatgataccaattattcaggctttgagccgaccttttgggacagcggtg

SEQ ID NO: 415764 - DNA, 140 bp, Artificial Sequence
  Synthetic
caccgctgtcccaaaaggtcggctcaaagcctgaataattggtatcattgcatcttagcaagcataaacccggtggtgcacagtatctaaacctcatagcatcccaatagtgcttatcaccatatcagcagccagggcct

SEQ ID NO: 415765 - DNA, 140 bp, Artificial Sequence
  Synthetic
atacgccatgctgggtctccaaacttctacttggtttggctttaatggcactagggcagaaaatagaacatatatctattggcatggtagagataataggactattatcagcttaaataccgtacttgggagtcggccat

SEQ ID NO: 415766 - DNA, 140 bp, Artificial Sequence
  Synthetic
atggccgactcccaagtacggtatttaagctgataatagtcctattatctctaccatgccaatagatatatgttctattttctgccctagtgccattaaagccaaaccaagtagaagtttggagacccagcatggcgtat

SEQ ID NO: 415767 - DNA, 140 bp, Artificial Sequence
  Synthetic
aggccctggctgctgatatgtatatctattggcatggtagagataataggactattatcagcttaaatacacattataatctcacaatgcattgtaagaggccaggaaataagtcagtttgaccttttgggacagcggtg

SEQ ID NO: 415768 - DNA, 140 bp, Artificial Sequence
  Synthetic
caccgctgtcccaaaaggtcaaactgacttatttcctggcctcttacaatgcattgtgagattataatgtgtatttaagctgataatagtcctattatctctaccatgccaatagatatacatatcagcagccagggcct

SEQ ID NO: 415769 - DNA, 140 bp, Artificial Sequence
  Synthetic
atacgccatgctgggtctccaatgaaagacccaagcaggcatggtgctggttcggaggtgattggaagaaagccatgcaggaggtgaaacaaacccttgtgaaacatcccaggtatagagcgtacttgggagtcggccat

SEQ ID NO: 415770 - DNA, 140 bp, Artificial Sequence
  Synthetic
atggccgactcccaagtacgctctatacctgggatgtttcacaagggtttgtttcacctcctgcatggctttcttccaatcacctccgaaccagcaccatgcctgcttgggtctttcattggagacccagcatggcgtat

SEQ ID NO: 415771 - DNA, 140 bp, Artificial Sequence
  Synthetic
aggccctggctgctgatatgagccatgcaggaggtgaaacaaacccttgtgaaacatcccaggtatagaggaaccaacgacacacagaaaattaactttacacaaccaggaaaaggttcagaccttttgggacagcggtg

SEQ ID NO: 415772 - DNA, 140 bp, Artificial Sequence
  Synthetic
caccgctgtcccaaaaggtctgaaccttttcctggttgtgtaaagttaattttctgtgtgtcgttggttcctctatacctgggatgtttcacaagggtttgtttcacctcctgcatggctcatatcagcagccagggcct

SEQ ID NO: 415773 - DNA, 140 bp, Artificial Sequence
  Synthetic
atacgccatgctgggtctccctgcaacatgactcggttcctcaattggatagaaaacagggcacacccacagcgcaattatgcaccgtgccatataaggcaaataattaatacctggcatcgtacttgggagtcggccat

SEQ ID NO: 415774 - DNA, 140 bp, Artificial Sequence
  Synthetic
atggccgactcccaagtacgatgccaggtattaattatttgccttatatggcacggtgcataattgcgctgtgggtgtgccctgttttctatccaattgaggaaccgagtcatgttgcagggagacccagcatggcgtat

SEQ ID NO: 415775 - DNA, 140 bp, Artificial Sequence
  Synthetic
aggccctggctgctgatatgagcgcaattatgcaccgtgccatataaggcaaataattaatacctggcatagagtaggccaaaatatatatttgcctcctagggaaggggaattggtctggaccttttgggacagcggtg

SEQ ID NO: 415776 - DNA, 140 bp, Artificial Sequence
  Synthetic
caccgctgtcccaaaaggtccagaccaattccccttccctaggaggcaaatatatattttggcctactctatgccaggtattaattatttgccttatatggcacggtgcataattgcgctcatatcagcagccagggcct

SEQ ID NO: 415777 - DNA, 140 bp, Artificial Sequence
  Synthetic
atacgccatgctgggtctccagacaagcattacctttagtgcagaggtggcagaactataccgattggaattgggagattacaaattagtagaaataacaccaattggcttcgcacctaccgtacttgggagtcggccat

SEQ ID NO: 415778 - DNA, 140 bp, Artificial Sequence
  Synthetic
atggccgactcccaagtacggtaggtgcgaagccaattggtgttatttctactaatttgtaatctcccaattccaatcggtatagttctgccacctctgcactaaaggtaatgcttgtctggagacccagcatggcgtat

SEQ ID NO: 415779 - DNA, 140 bp, Artificial Sequence
  Synthetic
aggccctggctgctgatatgttgggagattacaaattagtagaaataacaccaattggcttcgcacctacatcagaaaaaaggtattcctctgctccacagaggaataaaagaggtgtgtgaccttttgggacagcggtg

SEQ ID NO: 415780 - DNA, 140 bp, Artificial Sequence
  Synthetic
caccgctgtcccaaaaggtcacacacctcttttattcctctgtggagcagaggaataccttttttctgatgtaggtgcgaagccaattggtgttatttctactaatttgtaatctcccaacatatcagcagccagggcct

SEQ ID NO: 415781 - DNA, 140 bp, Artificial Sequence
  Synthetic
atacgccatgctgggtctccgcggcgtccttgacgctgtcggctcatcccggactttactgggctgggatagtgcagcaacagcaacagctgttggacgtggtcaagagacaacaagaaacgtacttgggagtcggccat

SEQ ID NO: 415782 - DNA, 140 bp, Artificial Sequence
  Synthetic
atggccgactcccaagtacgtttcttgttgtctcttgaccacgtccaacagctgttgctgttgctgcactatcccagcccagtaaagtccgggatgagccgacagcgtcaaggacgccgcggagacccagcatggcgtat

SEQ ID NO: 415783 - DNA, 140 bp, Artificial Sequence
  Synthetic
aggccctggctgctgatatgagtgcagcaacagcaacagctgttggacgtggtcaagagacaacaagaaatgttgcgactgaccgtctggggaacaaaaaatctccagacaagagtcactgaccttttgggacagcggtg

SEQ ID NO: 415784 - DNA, 140 bp, Artificial Sequence
  Synthetic
caccgctgtcccaaaaggtcagtgactcttgtctggagattttttgttccccagacggtcagtcgcaacatttcttgttgtctcttgaccacgtccaacagctgttgctgttgctgcactcatatcagcagccagggcct

SEQ ID NO: 415785 - DNA, 140 bp, Artificial Sequence
  Synthetic
atacgccatgctgggtctcctgcatttagacaagtctgctacaccactgtactatgggaaaataacagcatagtacctgattggaacaacatgacgtggcaggaatgggaacaacaaacccgtacttgggagtcggccat

SEQ ID NO: 415786 - DNA, 140 bp, Artificial Sequence
  Synthetic
atggccgactcccaagtacgggtttgttgttcccattcctgccacgtcatgttgttccaatcaggtactatgctgttattttcccatagtacagtggtgtagcagacttgtctaaatgcaggagacccagcatggcgtat

SEQ ID NO: 415787 - DNA, 140 bp, Artificial Sequence
  Synthetic
aggccctggctgctgatatgtagtacctgattggaacaacatgacgtggcaggaatgggaacaacaaacccgcgacctagaggcaaatatcagtagatcgttagagcaggcacaaatccagaccttttgggacagcggtg

SEQ ID NO: 415788 - DNA, 140 bp, Artificial Sequence
  Synthetic
caccgctgtcccaaaaggtctggatttgtgcctgctctaacgatctactgatatttgcctctaggtcgcgggtttgttgttcccattcctgccacgtcatgttgttccaatcaggtactacatatcagcagccagggcct

SEQ ID NO: 415789 - DNA, 140 bp, Artificial Sequence
  Synthetic
atacgccatgctgggtctccttggcaactggtttgatttaacctcctggattaagtatattcagtatggagtttatgtaataataggaataatagctttaagaatagtaatatatgtagtcgtacttgggagtcggccat

SEQ ID NO: 415790 - DNA, 140 bp, Artificial Sequence
  Synthetic
atggccgactcccaagtacgactacatatattactattcttaaagctattattcctattattacataaactccatactgaatatacttaatccaggaggttaaatcaaaccagttgccaaggagacccagcatggcgtat

SEQ ID NO: 415791 - DNA, 140 bp, Artificial Sequence
  Synthetic
aggccctggctgctgatatggtttatgtaataataggaataatagctttaagaatagtaatatatgtagtacaattactaagtagacttagaaagggctataggcctgttttctcttcccgaccttttgggacagcggtg

SEQ ID NO: 415792 - DNA, 140 bp, Artificial Sequence
  Synthetic
caccgctgtcccaaaaggtcgggaagagaaaacaggcctatagccctttctaagtctacttagtaattgtactacatatattactattcttaaagctattattcctattattacataaaccatatcagcagccagggcct

SEQ ID NO: 415793 - DNA, 140 bp, Artificial Sequence
  Synthetic
atacgccatgctgggtctccgacagagaagaaacagacgaagacgccggaaacagcattggagacagctcgtggccttggccaatagcatatatacatttcctgatccgccagctgattccgtacttgggagtcggccat

SEQ ID NO: 415794 - DNA, 140 bp, Artificial Sequence
  Synthetic
atggccgactcccaagtacggaatcagctggcggatcaggaaatgtatatatgctattggccaaggccacgagctgtctccaatgctgtttccggcgtcttcgtctgtttcttctctgtcggagacccagcatggcgtat

SEQ ID NO: 415795 - DNA, 140 bp, Artificial Sequence
  Synthetic
aggccctggctgctgatatggtggccttggccaatagcatatatacatttcctgatccgccagctgattcgcctcttgaccgggctatacagcgtctgcaaggacttactatccaggagcgaccttttgggacagcggtg

SEQ ID NO: 415796 - DNA, 140 bp, Artificial Sequence
  Synthetic
caccgctgtcccaaaaggtcgctcctggatagtaagtccttgcagacgctgtatagcccggtcaagaggcgaatcagctggcggatcaggaaatgtatatatgctattggccaaggccaccatatcagcagccagggcct

SEQ ID NO: 415797 - DNA, 140 bp, Artificial Sequence
  Synthetic
atacgccatgctgggtctccaatcagggactggctgagacttacaatagcctacctgcaatatgggtgcgagtggatccaagaagtgctccaggtccttgcaaggactacgagagagactcgtacttgggagtcggccat

SEQ ID NO: 415798 - DNA, 140 bp, Artificial Sequence
  Synthetic
atggccgactcccaagtacgagtctctctcgtagtccttgcaaggacctggagcacttcttggatccactcgcacccatattgcaggtaggctattgtaagtctcagccagtccctgattggagacccagcatggcgtat

SEQ ID NO: 415799 - DNA, 140 bp, Artificial Sequence
  Synthetic
aggccctggctgctgatatgagtggatccaagaagtgctccaggtccttgcaaggactacgagagagactcttgcgagcgcgtggagagacttgtggggggcaatgggacggatcggcaggaccttttgggacagcggtg

SEQ ID NO: 415800 - DNA, 140 bp, Artificial Sequence
  Synthetic
caccgctgtcccaaaaggtcctgccgatccgtcccattgccccccacaagtctctccacgcgctcgcaagagtctctctcgtagtccttgcaaggacctggagcacttcttggatccactcatatcagcagccagggcct

SEQ ID NO: 415801 - DNA, 140 bp, Artificial Sequence
  Synthetic
atacgccatgctgggtctcctcctgtgaggggcagcggtatcaacagggagactttatgaacaccccatggagaactccagcagcaggaagggagggaacattgtacaagcaacaaaatacgtacttgggagtcggccat

SEQ ID NO: 415802 - DNA, 140 bp, Artificial Sequence
  Synthetic
atggccgactcccaagtacgtattttgttgcttgtacaatgttccctcccttcctgctgctggagttctccatggggtgttcataaagtctccctgttgataccgctgcccctcacaggaggagacccagcatggcgtat

SEQ ID NO: 415803 - DNA, 140 bp, Artificial Sequence
  Synthetic
atacgccatgctgggtctcctggatgatgtagatgcagataatgataacctaataggggtccctgtcacaccaagagtaccattaagggcaatgacatataagttggcagtagatatatccgtacttgggagtcggccat

SEQ ID NO: 415804 - DNA, 140 bp, Artificial Sequence
  Synthetic
atggccgactcccaagtacggatatatctactgccaacttatatgtcattgcccttaatggtactcttggtgtgacagggacccctattaggttatcattatctgcatctacatcatccaggagacccagcatggcgtat

SEQ ID NO: 415805 - DNA, 140 bp, Artificial Sequence
  Synthetic
atacgccatgctgggtctccggttggcgcccgaacagggacttgaggaagactgagaagccttggaacacggctgagtgaaggcagtaagggcggcaggaacaaaccacgacggagtgctcgtacttgggagtcggccat

SEQ ID NO: 415806 - DNA, 140 bp, Artificial Sequence
  Synthetic
atggccgactcccaagtacgagcactccgtcgtggtttgttcctgccgcccttactgccttcactcagccgtgttccaaggcttctcagtcttcctcaagtccctgttcgggcgccaaccggagacccagcatggcgtat

SEQ ID NO: 415807 - DNA, 140 bp, Artificial Sequence
  Synthetic
aggccctggctgctgatatgggctgagtgaaggcagtaagggcggcaggaacaaaccacgacggagtgctcctagaaaggcgcaggccaaggtaccaaaggcggcgtgtggagcgggagtgaccttttgggacagcggtg

SEQ ID NO: 415808 - DNA, 140 bp, Artificial Sequence
  Synthetic
caccgctgtcccaaaaggtcactcccgctccacacgccgcctttggtaccttggcctgcgcctttctaggagcactccgtcgtggtttgttcctgccgcccttactgccttcactcagcccatatcagcagccagggcct

SEQ ID NO: 415809 - DNA, 140 bp, Artificial Sequence
  Synthetic
atacgccatgctgggtctcccctagaaaggcgcaggccaaggtaccaaaggcggcgtgtggagcgggagtcaagaggcctccgggtgaaggtaagtacctacaccaaaaactgtagccggcgtacttgggagtcggccat

SEQ ID NO: 415810 - DNA, 140 bp, Artificial Sequence
  Synthetic
atggccgactcccaagtacgccggctacagtttttggtgtaggtacttaccttcacccggaggcctcttgactcccgctccacacgccgcctttggtaccttggcctgcgcctttctaggggagacccagcatggcgtat

SEQ ID NO: 415811 - DNA, 140 bp, Artificial Sequence
  Synthetic
atacgccatgctgggtctccgcgcgaaaaactccgtcttgagagggaaaaaggcagatgaattagaaaaaattaggttacggcccggcgggaagaaaaaatacagattaaaacatattgtcgtacttgggagtcggccat

SEQ ID NO: 415812 - DNA, 140 bp, Artificial Sequence
  Synthetic
atggccgactcccaagtacgacaatatgttttaatctgtattttttcttcccgccgggccgtaacctaattttttctaattcatctgcctttttccctctcaagacggagtttttcgcgcggagacccagcatggcgtat

SEQ ID NO: 415813 - DNA, 140 bp, Artificial Sequence
  Synthetic
aggccctggctgctgatatgattaggttacggcccggcgggaagaaaaaatacagattaaaacatattgtgtgggcagcgaatgaattggacagattcggattaacagagagcctgttgggaccttttgggacagcggtg

SEQ ID NO: 415814 - DNA, 140 bp, Artificial Sequence
  Synthetic
caccgctgtcccaaaaggtcccaacaggctctctgttaatccgaatctgtccaattcattcgctgcccacacaatatgttttaatctgtattttttcttcccgccgggccgtaacctaatcatatcagcagccagggcct

SEQ ID NO: 415815 - DNA, 140 bp, Artificial Sequence
  Synthetic
atacgccatgctgggtctccccaacagggtcagaaaatttaaaaagcctttataatactacctgcgtcatttggtgcttgcacgcagaagagaaagtgaaagatactgaagaagcaaaaacgtacttgggagtcggccat

SEQ ID NO: 415816 - DNA, 140 bp, Artificial Sequence
  Synthetic
atggccgactcccaagtacgtttttgcttcttcagtatctttcactttctcttctgcgtgcaagcaccaaatgacgcaggtagtattataaaggctttttaaattttctgaccctgttggggagacccagcatggcgtat

SEQ ID NO: 415817 - DNA, 140 bp, Artificial Sequence
  Synthetic
aggccctggctgctgatatgttggtgcttgcacgcagaagagaaagtgaaagatactgaagaagcaaaaagaatagtagggagacatctagtggcagaaacagaaactgcagagaaaatggaccttttgggacagcggtg

SEQ ID NO: 415818 - DNA, 140 bp, Artificial Sequence
  Synthetic
caccgctgtcccaaaaggtccattttctctgcagtttctgtttctgccactagatgtctccctactattctttttgcttcttcagtatctttcactttctcttctgcgtgcaagcaccaacatatcagcagccagggcct

SEQ ID NO: 415819 - DNA, 140 bp, Artificial Sequence
  Synthetic
atacgccatgctgggtctccccccgtgcaacaaataggcggcaactatgtccatctgccgctgagtccccgaaccctaaatgcttgggtaaagttagtagaggagaaaaagttcggggcacgtacttgggagtcggccat

SEQ ID NO: 415820 - DNA, 140 bp, Artificial Sequence
  Synthetic
atggccgactcccaagtacgtgccccgaactttttctcctctactaactttacccaagcatttagggttcggggactcagcggcagatggacatagttgccgcctatttgttgcacggggggagacccagcatggcgtat

SEQ ID NO: 415821 - DNA, 140 bp, Artificial Sequence
  Synthetic
aggccctggctgctgatatggaaccctaaatgcttgggtaaagttagtagaggagaaaaagttcggggcagaagtagtgccgggatttcaggcactctcagaaggctgcacgccctatgagaccttttgggacagcggtg

SEQ ID NO: 415822 - DNA, 140 bp, Artificial Sequence
  Synthetic
caccgctgtcccaaaaggtctcatagggcgtgcagccttctgagagtgcctgaaatcccggcactacttctgccccgaactttttctcctctactaactttacccaagcatttagggttccatatcagcagccagggcct

SEQ ID NO: 415823 - DNA, 140 bp, Artificial Sequence
  Synthetic
atacgccatgctgggtctcctaatcagagaaattattaatgaagaagcagcagactgggatgtacaacatccaataccaggccccttaccagcggggcagctcagagatccacgaggatccgtacttgggagtcggccat

SEQ ID NO: 415824 - DNA, 140 bp, Artificial Sequence
  Synthetic
atggccgactcccaagtacggatcctcgtggatctctgagctgccccgctggtaaggggcctggtattggatgttgtacatcccagtctgctgcttcttcattaataatttctctgattaggagacccagcatggcgtat

SEQ ID NO: 415825 - DNA, 140 bp, Artificial Sequence
  Synthetic
aggccctggctgctgatatgccaataccaggccccttaccagcggggcagctcagagatccacgaggatctgacatagcagggacaacaagcacagtagaggaacagatcgaatggatgtgaccttttgggacagcggtg

SEQ ID NO: 415826 - DNA, 140 bp, Artificial Sequence
  Synthetic
caccgctgtcccaaaaggtcacatccattcgatctgttcctctactgtgcttgttgtccctgctatgtcagatcctcgtggatctctgagctgccccgctggtaaggggcctggtattggcatatcagcagccagggcct

SEQ ID NO: 415827 - DNA, 140 bp, Artificial Sequence
  Synthetic
atacgccatgctgggtctcccagataggactgcagaagtgtgtcagaatgtacaatccaaccaacattctagacataaaacaaggaccaaaagagtcgttccaaagctatgtggatagatcgtacttgggagtcggccat

SEQ ID NO: 415828 - DNA, 140 bp, Artificial Sequence
  Synthetic
atggccgactcccaagtacgatctatccacatagctttggaacgactcttttggtccttgttttatgtctagaatgttggttggattgtacattctgacacacttctgcagtcctatctgggagacccagcatggcgtat

SEQ ID NO: 415829 - DNA, 140 bp, Artificial Sequence
  Synthetic
aggccctggctgctgatatgagacataaaacaaggaccaaaagagtcgttccaaagctatgtggatagattctacaaaagcttaagggcagaacagacagatgcagcagtgaagaattgggaccttttgggacagcggtg

SEQ ID NO: 415830 - DNA, 140 bp, Artificial Sequence
  Synthetic
caccgctgtcccaaaaggtcccaattcttcactgctgcatctgtctgttctgcccttaagcttttgtagaatctatccacatagctttggaacgactcttttggtccttgttttatgtctcatatcagcagccagggcct

SEQ ID NO: 415831 - DNA, 140 bp, Artificial Sequence
  Synthetic
atacgccatgctgggtctccaaagggactagggatgaatcctaccttagaagagatgctaaccgcctgtcaagggataggtggaccaggccagaaggccagactaatggcagaagccttacgtacttgggagtcggccat

SEQ ID NO: 415832 - DNA, 140 bp, Artificial Sequence
  Synthetic
atggccgactcccaagtacgtaaggcttctgccattagtctggccttctggcctggtccacctatcccttgacaggcggttagcatctcttctaaggtaggattcatccctagtccctttggagacccagcatggcgtat

SEQ ID NO: 415833 - DNA, 140 bp, Artificial Sequence
  Synthetic
aggccctggctgctgatatgaagggataggtggaccaggccagaaggccagactaatggcagaagccttaaaagaggccatgcgaccagcccctatcccatttgcagcagcccaacagaagaccttttgggacagcggtg

SEQ ID NO: 415834 - DNA, 140 bp, Artificial Sequence
  Synthetic
caccgctgtcccaaaaggtcttctgttgggctgctgcaaatgggataggggctggtcgcatggcctcttttaaggcttctgccattagtctggccttctggcctggtccacctatcccttcatatcagcagccagggcct

SEQ ID NO: 415835 - DNA, 140 bp, Artificial Sequence
  Synthetic
atacgccatgctgggtctccaatgccgagcgcctagaagacagggctgctggaaatgtggcaagtcaggacacatcatggcaaactgcccagatagacaggctggttttttagggcttggcgtacttgggagtcggccat

SEQ ID NO: 415836 - DNA, 140 bp, Artificial Sequence
  Synthetic
atggccgactcccaagtacgccaagccctaaaaaaccagcctgtctatctgggcagtttgccatgatgtgtcctgacttgccacatttccagcagccctgtcttctaggcgctcggcattggagacccagcatggcgtat

SEQ ID NO: 415837 - DNA, 140 bp, Artificial Sequence
  Synthetic
aggccctggctgctgatatgcacatcatggcaaactgcccagatagacaggctggttttttagggcttggaccatggggaaagaagccccgcaacttccccgtggtcccaagttcgcagggaccttttgggacagcggtg

SEQ ID NO: 415838 - DNA, 140 bp, Artificial Sequence
  Synthetic
caccgctgtcccaaaaggtccctgcgaacttgggaccacggggaagttgcggggcttctttccccatggtccaagccctaaaaaaccagcctgtctatctgggcagtttgccatgatgtgcatatcagcagccagggcct

SEQ ID NO: 415839 - DNA, 140 bp, Artificial Sequence
  Synthetic
atacgccatgctgggtctccaagtacatgcagcaagggagaaaacagagagagcagagacaaagaccatacaaagaagtgacagaggacttgctgcatctcgagcaaggagagacaccaccgtacttgggagtcggccat

SEQ ID NO: 415840 - DNA, 140 bp, Artificial Sequence
  Synthetic
atggccgactcccaagtacggtggtgtctctccttgctcgagatgcagcaagtcctctgtcacttctttgtatggtctttgtctctgctctctctgttttctcccttgctgcatgtacttggagacccagcatggcgtat

SEQ ID NO: 415841 - DNA, 140 bp, Artificial Sequence
  Synthetic
aggccctggctgctgatatgcaaagaagtgacagaggacttgctgcatctcgagcaaggagagacaccacacagagagacgacagaggacttgctgcacctcaattctctctttggaaacgaccttttgggacagcggtg

SEQ ID NO: 415842 - DNA, 140 bp, Artificial Sequence
  Synthetic
caccgctgtcccaaaaggtcgtttccaaagagagaattgaggtgcagcaagtcctctgtcgtctctctgtgtggtgtctctccttgctcgagatgcagcaagtcctctgtcacttctttgcatatcagcagccagggcct

SEQ ID NO: 415843 - DNA, 140 bp, Artificial Sequence
  Synthetic
atacgccatgctgggtctccgacacaggggctgacgactcaatagtagcaggaatagagttagggagcaattatagtccaaaaatagtagggggaataggaggattcataaataccaaagcgtacttgggagtcggccat

SEQ ID NO: 415844 - DNA, 140 bp, Artificial Sequence
  Synthetic
atggccgactcccaagtacgctttggtatttatgaatcctcctattccccctactatttttggactataattgctccctaactctattcctgctactattgagtcgtcagcccctgtgtcggagacccagcatggcgtat

SEQ ID NO: 415845 - DNA, 140 bp, Artificial Sequence
  Synthetic
aggccctggctgctgatatgttatagtccaaaaatagtagggggaataggaggattcataaataccaaagaatataaagatgtagaaataagagtgctaaataaaaaggtaagagccaccgaccttttgggacagcggtg

SEQ ID NO: 415846 - DNA, 140 bp, Artificial Sequence
  Synthetic
caccgctgtcccaaaaggtcggtggctcttacctttttatttagcactcttatttctacatctttatattctttggtatttatgaatcctcctattccccctactatttttggactataacatatcagcagccagggcct

SEQ ID NO: 415847 - DNA, 140 bp, Artificial Sequence
  Synthetic
atacgccatgctgggtctccagccttgggcatgtcattaaatttaccagtcgccaaaatagaaccagtaaaagtaacattaaagccaggaaaagatgggccaaaacaaagacaatggccccgtacttgggagtcggccat

SEQ ID NO: 415848 - DNA, 140 bp, Artificial Sequence
  Synthetic
atggccgactcccaagtacggggccattgtctttgttttggcccatcttttcctggctttaatgttacttttactggttctattttggcgactggtaaatttaatgacatgcccaaggctggagacccagcatggcgtat

SEQ ID NO: 415849 - DNA, 140 bp, Artificial Sequence
  Synthetic
aggccctggctgctgatatgaagtaacattaaagccaggaaaagatgggccaaaacaaagacaatggcccttaacaagagaaaaaatagaagcactaagagaaatctgtgaaaaaatggagaccttttgggacagcggtg

SEQ ID NO: 415850 - DNA, 140 bp, Artificial Sequence
  Synthetic
caccgctgtcccaaaaggtctccattttttcacagatttctcttagtgcttctattttttctcttgttaagggccattgtctttgttttggcccatcttttcctggctttaatgttacttcatatcagcagccagggcct

SEQ ID NO: 415851 - DNA, 140 bp, Artificial Sequence
  Synthetic
atacgccatgctgggtctccctacatttgcaattaagaaaaaggacaaaaacaaatggaggatgctgatagattttagagaactaaacaaggtaactcaagatttcacagaggttcagttcgtacttgggagtcggccat

SEQ ID NO: 415852 - DNA, 140 bp, Artificial Sequence
  Synthetic
atggccgactcccaagtacgaactgaacctctgtgaaatcttgagttaccttgtttagttctctaaaatctatcagcatcctccatttgtttttgtcctttttcttaattgcaaatgtagggagacccagcatggcgtat

SEQ ID NO: 415853 - DNA, 140 bp, Artificial Sequence
  Synthetic
aggccctggctgctgatatggattttagagaactaaacaaggtaactcaagatttcacagaggttcagttaggaattccacacccagcaggattagccaagaaaagaagaattactgtgtgaccttttgggacagcggtg

SEQ ID NO: 415854 - DNA, 140 bp, Artificial Sequence
  Synthetic
caccgctgtcccaaaaggtcacacagtaattcttcttttcttggctaatcctgctgggtgtggaattcctaactgaacctctgtgaaatcttgagttaccttgtttagttctctaaaatccatatcagcagccagggcct

SEQ ID NO: 415855 - DNA, 140 bp, Artificial Sequence
  Synthetic
atacgccatgctgggtctcccagtatactgcatttactctgccatcagtaaacaatgcagaaccaggaaaaagatatatatacaaagtcttaccacagggatggaaggggtcaccagcaacgtacttgggagtcggccat

SEQ ID NO: 415856 - DNA, 140 bp, Artificial Sequence
  Synthetic
atggccgactcccaagtacgttgctggtgaccccttccatccctgtggtaagactttgtatatatatctttttcctggttctgcattgtttactgatggcagagtaaatgcagtatactgggagacccagcatggcgtat

SEQ ID NO: 415857 - DNA, 140 bp, Artificial Sequence
  Synthetic
aggccctggctgctgatatgaagatatatatacaaagtcttaccacagggatggaaggggtcaccagcaatttttcaatacacaatgaggcaagtcttagaaccattcagaaaagcaaacgaccttttgggacagcggtg

SEQ ID NO: 415858 - DNA, 140 bp, Artificial Sequence
  Synthetic
caccgctgtcccaaaaggtcgtttgcttttctgaatggttctaagacttgcctcattgtgtattgaaaaattgctggtgaccccttccatccctgtggtaagactttgtatatatatcttcatatcagcagccagggcct

SEQ ID NO: 415859 - DNA, 140 bp, Artificial Sequence
  Synthetic
atacgccatgctgggtctcccaggacagatttggaacatgacaaagtagtcctacagctaaaggaacttctaaatggcctgggattttccaccccagacgaaaagttccaaaaggaccctcgtacttgggagtcggccat

SEQ ID NO: 415860 - DNA, 140 bp, Artificial Sequence
  Synthetic
atggccgactcccaagtacgagggtccttttggaacttttcgtctggggtggaaaatcccaggccatttagaagttcctttagctgtaggactactttgtcatgttccaaatctgtcctgggagacccagcatggcgtat

SEQ ID NO: 415861 - DNA, 140 bp, Artificial Sequence
  Synthetic
aggccctggctgctgatatgtaaatggcctgggattttccaccccagacgaaaagttccaaaaggaccctccataccaatggatgggctatgaactgtggccaaccaaatggaaattgcagaccttttgggacagcggtg

SEQ ID NO: 415862 - DNA, 140 bp, Artificial Sequence
  Synthetic
caccgctgtcccaaaaggtctgcaatttccatttggttggccacagttcatagcccatccattggtatggagggtccttttggaacttttcgtctggggtggaaaatcccaggccatttacatatcagcagccagggcct

SEQ ID NO: 415863 - DNA, 140 bp, Artificial Sequence
  Synthetic
atacgccatgctgggtctccaactagtgggtgtcctaaactgggcggcacaaatctacccaggaataaagaccaaacacttatgtaagctaattagaggaaagatgacacccacggaagacgtacttgggagtcggccat

SEQ ID NO: 415864 - DNA, 140 bp, Artificial Sequence
  Synthetic
atggccgactcccaagtacgtcttccgtgggtgtcatctttcctctaattagcttacataagtgtttggtctttattcctgggtagatttgtgccgcccagtttaggacacccactagttggagacccagcatggcgtat

SEQ ID NO: 415865 - DNA, 140 bp, Artificial Sequence
  Synthetic
aggccctggctgctgatatgaccaaacacttatgtaagctaattagaggaaagatgacacccacggaagaagtacagtggacagaattagcagaagcagagctggaggaaaacaaaattagaccttttgggacagcggtg

SEQ ID NO: 415866 - DNA, 140 bp, Artificial Sequence
  Synthetic
caccgctgtcccaaaaggtctaattttgttttcctccagctctgcttctgctaattctgtccactgtacttcttccgtgggtgtcatctttcctctaattagcttacataagtgtttggtcatatcagcagccagggcct

SEQ ID NO: 415867 - DNA, 140 bp, Artificial Sequence
  Synthetic
atacgccatgctgggtctccgaagcaacagttcaaaaggatcaagacaatcagtggacatataaagtacaccagggagaaaaaattctaaaagtaggaaaatatgcaaagataaaaaatacgtacttgggagtcggccat

SEQ ID NO: 415868 - DNA, 140 bp, Artificial Sequence
  Synthetic
atggccgactcccaagtacgtattttttatctttgcatattttcctacttttagaattttttctccctggtgtactttatatgtccactgattgtcttgatccttttgaactgttgcttcggagacccagcatggcgtat

SEQ ID NO: 415869 - DNA, 140 bp, Artificial Sequence
  Synthetic
aggccctggctgctgatatgccagggagaaaaaattctaaaagtaggaaaatatgcaaagataaaaaatacccataccaacggggtcaggttgttggcacaggtagttcagaaaataggagaccttttgggacagcggtg

SEQ ID NO: 415870 - DNA, 140 bp, Artificial Sequence
  Synthetic
caccgctgtcccaaaaggtctcctattttctgaactacctgtgccaacaacctgaccccgttggtatgggtattttttatctttgcatattttcctacttttagaattttttctccctggcatatcagcagccagggcct

SEQ ID NO: 415871 - DNA, 140 bp, Artificial Sequence
  Synthetic
atacgccatgctgggtctccagaaagagagacctgggaacagtggtgggataactattggcaagtgacatggatcccagactgggacttcgtatccaccccaccgttggtcaggttagcacgtacttgggagtcggccat

SEQ ID NO: 415872 - DNA, 140 bp, Artificial Sequence
  Synthetic
atggccgactcccaagtacgtgctaacctgaccaacggtggggtggatacgaagtcccagtctgggatccatgtcacttgccaatagttatcccaccactgttcccaggtctctctttctggagacccagcatggcgtat

SEQ ID NO: 415873 - DNA, 140 bp, Artificial Sequence
  Synthetic
aggccctggctgctgatatgggatcccagactgggacttcgtatccaccccaccgttggtcaggttagcatttaacctggtaaaagatcctataccaggcgcagagaccttctacacggagaccttttgggacagcggtg

SEQ ID NO: 415874 - DNA, 140 bp, Artificial Sequence
  Synthetic
caccgctgtcccaaaaggtctccgtgtagaaggtctctgcgcctggtataggatcttttaccaggttaaatgctaacctgaccaacggtggggtggatacgaagtcccagtctgggatcccatatcagcagccagggcct

SEQ ID NO: 415875 - DNA, 140 bp, Artificial Sequence
  Synthetic
atacgccatgctgggtctccatagaggaaaagacaaagtaaggatattagagcaaactaccaaccaacaagcagaattagaagcctttgcaatggcagtaacagactcaggtccaaaagtcgtacttgggagtcggccat

SEQ ID NO: 415876 - DNA, 140 bp, Artificial Sequence
  Synthetic
atggccgactcccaagtacgacttttggacctgagtctgttactgccattgcaaaggcttctaattctgcttgttggttggtagtttgctctaatatccttactttgtcttttcctctatggagacccagcatggcgtat

SEQ ID NO: 415877 - DNA, 140 bp, Artificial Sequence
  Synthetic
aggccctggctgctgatatggcagaattagaagcctttgcaatggcagtaacagactcaggtccaaaagtcaatattgtagtagactcacagtatgtaatgggaatagtaacaggccaacgaccttttgggacagcggtg

SEQ ID NO: 415878 - DNA, 140 bp, Artificial Sequence
  Synthetic
caccgctgtcccaaaaggtcgttggcctgttactattcccattacatactgtgagtctactacaatattgacttttggacctgagtctgttactgccattgcaaaggcttctaattctgccatatcagcagccagggcct

SEQ ID NO: 415879 - DNA, 140 bp, Artificial Sequence
  Synthetic
atacgccatgctgggtctccaaaaaggaagcaatctatgttgcatgggtcccggcccacaaaggcataggaggaaatcaagaaattgaccacttagtaagtcagggcatcagacaagtatcgtacttgggagtcggccat

SEQ ID NO: 415880 - DNA, 140 bp, Artificial Sequence
  Synthetic
atggccgactcccaagtacgatacttgtctgatgccctgacttactaagtggtcaatttcttgatttcctcctatgcctttgtgggccgggacccatgcaacatagattgcttcctttttggagacccagcatggcgtat

SEQ ID NO: 415881 - DNA, 140 bp, Artificial Sequence
  Synthetic
aggccctggctgctgatatgaggaaatcaagaaattgaccacttagtaagtcagggcatcagacaagtattattcctagagagaatagagcccgctcaggaagaacatggaaaatatcatgaccttttgggacagcggtg

SEQ ID NO: 415882 - DNA, 140 bp, Artificial Sequence
  Synthetic
caccgctgtcccaaaaggtcatgatattttccatgttcttcctgagcgggctctattctctctaggaataatacttgtctgatgccctgacttactaagtggtcaatttcttgatttcctcatatcagcagccagggcct

SEQ ID NO: 415883 - DNA, 140 bp, Artificial Sequence
  Synthetic
atacgccatgctgggtctccaagacaaatagtaaacacatgtgcccagtgccaacaaaaaggggaagctatacatgggcaagtaaatgcagaactaggcacctggcaaatggactgcacacgtacttgggagtcggccat

SEQ ID NO: 415884 - DNA, 140 bp, Artificial Sequence
  Synthetic
atggccgactcccaagtacgtgtgcagtccatttgccaggtgcctagttctgcatttacttgcccatgtatagcttcccctttttgttggcactgggcacatgtgtttactatttgtcttggagacccagcatggcgtat

SEQ ID NO: 415885 - DNA, 140 bp, Artificial Sequence
  Synthetic
aggccctggctgctgatatgtacatgggcaagtaaatgcagaactaggcacctggcaaatggactgcacacacttagaaggaaaaatcattatagtagcagtacatgttgcaagtggattgaccttttgggacagcggtg

SEQ ID NO: 415886 - DNA, 140 bp, Artificial Sequence
  Synthetic
caccgctgtcccaaaaggtcaatccacttgcaacatgtactgctactataatgatttttccttctaagtgtgtgcagtccatttgccaggtgcctagttctgcatttacttgcccatgtacatatcagcagccagggcct

SEQ ID NO: 415887 - DNA, 140 bp, Artificial Sequence
  Synthetic
atacgccatgctgggtctcctcctattaaaactggccagtaggtggccaataacacacttgcacacagataatggtgccaacttcacttcacaggaggtaaagatggtagcatggtgggtcgtacttgggagtcggccat

SEQ ID NO: 415888 - DNA, 140 bp, Artificial Sequence
  Synthetic
atggccgactcccaagtacgacccaccatgctaccatctttacctcctgtgaagtgaagttggcaccattatctgtgtgcaagtgtgttattggccacctactggccagttttaataggaggagacccagcatggcgtat

SEQ ID NO: 415889 - DNA, 140 bp, Artificial Sequence
  Synthetic
aggccctggctgctgatatgaatggtgccaacttcacttcacaggaggtaaagatggtagcatggtgggtaggcatagaacaatcctttggagtaccttacaatccacaaagccagggaggaccttttgggacagcggtg

SEQ ID NO: 415890 - DNA, 140 bp, Artificial Sequence
  Synthetic
caccgctgtcccaaaaggtcctccctggctttgtggattgtaaggtactccaaaggattgttctatgcctacccaccatgctaccatctttacctcctgtgaagtgaagttggcaccattcatatcagcagccagggcct

SEQ ID NO: 415891 - DNA, 140 bp, Artificial Sequence
  Synthetic
atacgccatgctgggtctccgagcaggcaaatacaatggaaacaatagtactaatggcagttcattgcatgaattttaaaagaaggggaggaataggggatatgaccccagtagaaagaccgtacttgggagtcggccat

SEQ ID NO: 415892 - DNA, 140 bp, Artificial Sequence
  Synthetic
atggccgactcccaagtacggtctttctactggggtcatatcccctattcctccccttcttttaaaattcatgcaatgaactgccattagtactattgtttccattgtatttgcctgctcggagacccagcatggcgtat

SEQ ID NO: 415893 - DNA, 140 bp, Artificial Sequence
  Synthetic
aggccctggctgctgatatggaattttaaaagaaggggaggaataggggatatgaccccagtagaaagactagtcaatatgatcaccacagaacaagaaatacaattcctccaagcaaaagaccttttgggacagcggtg

SEQ ID NO: 415894 - DNA, 140 bp, Artificial Sequence
  Synthetic
caccgctgtcccaaaaggtcttttgcttggaggaattgtatttcttgttctgtggtgatcatattgactagtctttctactggggtcatatcccctattcctccccttcttttaaaattccatatcagcagccagggcct

SEQ ID NO: 415895 - DNA, 140 bp, Artificial Sequence
  Synthetic
atacgccatgctgggtctccactgtggcaaggacctggggagctactgtggaaaggggacggagcagtcatagtcaaggtagggacagatataaaagtaataccaagaagaaaggccaagcgtacttgggagtcggccat

SEQ ID NO: 415896 - DNA, 140 bp, Artificial Sequence
  Synthetic
atggccgactcccaagtacgcttggcctttcttcttggtattacttttatatctgtccctaccttgactatgactgctccgtcccctttccacagtagctccccaggtccttgccacagtggagacccagcatggcgtat

SEQ ID NO: 415897 - DNA, 140 bp, Artificial Sequence
  Synthetic
aggccctggctgctgatatgtagtcaaggtagggacagatataaaagtaataccaagaagaaaggccaagatcatcagagactatggaccaaggcaagagatggatagcggttcccacctgaccttttgggacagcggtg

SEQ ID NO: 415898 - DNA, 140 bp, Artificial Sequence
  Synthetic
caccgctgtcccaaaaggtcaggtgggaaccgctatccatctcttgccttggtccatagtctctgatgatcttggcctttcttcttggtattacttttatatctgtccctaccttgactacatatcagcagccagggcct

SEQ ID NO: 415899 - DNA, 140 bp, Artificial Sequence
  Synthetic
atacgccatgctgggtctccaaatacagaacaaaagatctagaacaggtgcgctatgttccccaccataaggtggggtgggcatggtggacttgcagcagggtaatattcccattaaaagcgtacttgggagtcggccat

SEQ ID NO: 415900 - DNA, 140 bp, Artificial Sequence
  Synthetic
atggccgactcccaagtacgcttttaatgggaatattaccctgctgcaagtccaccatgcccaccccaccttatggtggggaacatagcgcacctgttctagatcttttgttctgtatttggagacccagcatggcgtat

SEQ ID NO: 415901 - DNA, 140 bp, Artificial Sequence
  Synthetic
aggccctggctgctgatatgggtggggtgggcatggtggacttgcagcagggtaatattcccattaaaaggaaacagtcatctagagatacaggcatattggaacctaacaccagaaaaagaccttttgggacagcggtg

SEQ ID NO: 415902 - DNA, 140 bp, Artificial Sequence
  Synthetic
caccgctgtcccaaaaggtctttttctggtgttaggttccaatatgcctgtatctctagatgactgtttccttttaatgggaatattaccctgctgcaagtccaccatgcccaccccacccatatcagcagccagggcct

SEQ ID NO: 415903 - DNA, 140 bp, Artificial Sequence
  Synthetic
atacgccatgctgggtctccctggacagatgttaccccagactgtgcagacaccctaatacacagcacttatttctcttgctttacggcaggtgaagtaagaagagccatcaggggagaacgtacttgggagtcggccat

SEQ ID NO: 415904 - DNA, 140 bp, Artificial Sequence
  Synthetic
atggccgactcccaagtacgttctcccctgatggctcttcttacttcacctgccgtaaagcaagagaaataagtgctgtgtattagggtgtctgcacagtctggggtaacatctgtccagggagacccagcatggcgtat

SEQ ID NO: 415905 - DNA, 140 bp, Artificial Sequence
  Synthetic
aggccctggctgctgatatgatttctcttgctttacggcaggtgaagtaagaagagccatcaggggagaaaagtcattgtcctgctgcaattatccccaagcccataagtccaaggtaccgaccttttgggacagcggtg

SEQ ID NO: 415906 - DNA, 140 bp, Artificial Sequence
  Synthetic
caccgctgtcccaaaaggtcggtaccttggacttatgggcttggggataattgcagcaggacaatgacttttctcccctgatggctcttcttacttcacctgccgtaaagcaagagaaatcatatcagcagccagggcct

SEQ ID NO: 415907 - DNA, 140 bp, Artificial Sequence
  Synthetic
atacgccatgctgggtctccagagagacaataccaccaggaaacagtggcgaagaaactatcgaagaggccttcgattggctagacaggacggtagaagccataaacagagaggcagtgacgtacttgggagtcggccat

SEQ ID NO: 415908 - DNA, 140 bp, Artificial Sequence
  Synthetic
atggccgactcccaagtacgtcactgcctctctgtttatggcttctaccgtcctgtctagccaatcgaaggcctcttcgatagtttcttcgccactgtttcctggtggtattgtctctctggagacccagcatggcgtat

SEQ ID NO: 415909 - DNA, 140 bp, Artificial Sequence
  Synthetic
aggccctggctgctgatatgcttcgattggctagacaggacggtagaagccataaacagagaggcagtgaaccacctgcccagggagcttattttccaggtgtggcaaaggtcctggagagaccttttgggacagcggtg

SEQ ID NO: 415910 - DNA, 140 bp, Artificial Sequence
  Synthetic
caccgctgtcccaaaaggtctctccaggacctttgccacacctggaaaataagctccctgggcaggtggttcactgcctctctgtttatggcttctaccgtcctgtctagccaatcgaagcatatcagcagccagggcct

SEQ ID NO: 415911 - DNA, 140 bp, Artificial Sequence
  Synthetic
atacgccatgctgggtctcctttgtgcttaatgcagaaagctgtgttcatgcatttcaagaaagggtgcacttgccggggggaaggacatgggccaggagggtggagatcaggacctccccgtacttgggagtcggccat

SEQ ID NO: 415912 - DNA, 140 bp, Artificial Sequence
  Synthetic
atggccgactcccaagtacggggaggtcctgatctccaccctcctggcccatgtccttccccccggcaagtgcaccctttcttgaaatgcatgaacacagctttctgcattaagcacaaaggagacccagcatggcgtat

SEQ ID NO: 415913 - DNA, 140 bp, Artificial Sequence
  Synthetic
aggccctggctgctgatatgcttgccggggggaaggacatgggccaggagggtggagatcaggacctccccctcctcctcccccaggtttagtctaatgactgaagcaccagcagagtttgaccttttgggacagcggtg

SEQ ID NO: 415914 - DNA, 140 bp, Artificial Sequence
  Synthetic
caccgctgtcccaaaaggtcaaactctgctggtgcttcagtcattagactaaacctgggggaggaggagggggaggtcctgatctccaccctcctggcccatgtccttccccccggcaagcatatcagcagccagggcct

SEQ ID NO: 415915 - DNA, 140 bp, Artificial Sequence
  Synthetic
atacgccatgctgggtctccagaaattctgagagaaataaaggaagaagctttaaagcattttgaccctcgcttgctaactgctcttggctactatatctatactagacatggagacacccgtacttgggagtcggccat

SEQ ID NO: 415916 - DNA, 140 bp, Artificial Sequence
  Synthetic
atggccgactcccaagtacgggtgtctccatgtctagtatagatatagtagccaagagcagttagcaagcgagggtcaaaatgctttaaagcttcttcctttatttctctcagaatttctggagacccagcatggcgtat

SEQ ID NO: 415917 - DNA, 140 bp, Artificial Sequence
  Synthetic
aggccctggctgctgatatggcttgctaactgctcttggctactatatctatactagacatggagacacccttgaaggcgccagagagctcattagggtcctacaacgagccctcttcacgaccttttgggacagcggtg

SEQ ID NO: 415918 - DNA, 140 bp, Artificial Sequence
  Synthetic
caccgctgtcccaaaaggtcgtgaagagggctcgttgtaggaccctaatgagctctctggcgccttcaagggtgtctccatgtctagtatagatatagtagccaagagcagttagcaagccatatcagcagccagggcct

SEQ ID NO: 415919 - DNA, 140 bp, Artificial Sequence
  Synthetic
atacgccatgctgggtctccgaaatcctctctcagctataccgacccctagaaacatgcaataacaaatgcttttgtaaggggtgctgcttccattgccagctgtgttttttaaacaaggcgtacttgggagtcggccat

SEQ ID NO: 415920 - DNA, 140 bp, Artificial Sequence
  Synthetic
atggccgactcccaagtacgccttgtttaaaaaacacagctggcaatggaagcagcaccccttacaaaagcatttgttattgcatgtttctaggggtcggtatagctgagagaggatttcggagacccagcatggcgtat

SEQ ID NO: 415921 - DNA, 140 bp, Artificial Sequence
  Synthetic
aggccctggctgctgatatgcttttgtaaggggtgctgcttccattgccagctgtgttttttaaacaaggggctcgggatatgttatgaccgaaagggcagacgaagaaggagtccgaaggaccttttgggacagcggtg

SEQ ID NO: 415922 - DNA, 140 bp, Artificial Sequence
  Synthetic
caccgctgtcccaaaaggtccttcggactccttcttcgtctgccctttcggtcataacatatcccgagccccttgtttaaaaaacacagctggcaatggaagcagcaccccttacaaaagcatatcagcagccagggcct

SEQ ID NO: 415923 - DNA, 140 bp, Artificial Sequence
  Synthetic
atacgccatgctgggtctccggtaaaattcagctgcttgttgcctttctgctaactagtgcttgcttaatatattgcaccaaatatgtgactgttttctatggagtacccgtgtggaaaacgtacttgggagtcggccat

SEQ ID NO: 415924 - DNA, 140 bp, Artificial Sequence
  Synthetic
atggccgactcccaagtacgttttccacacgggtactccatagaaaacagtcacatatttggtgcaatatattaagcaagcactagttagcagaaaggcaacaagcagctgaattttaccggagacccagcatggcgtat

SEQ ID NO: 415925 - DNA, 140 bp, Artificial Sequence
  Synthetic
aggccctggctgctgatatgatattgcaccaaatatgtgactgttttctatggagtacccgtgtggaaaaatgcatccattcccctcttttgtgcaactaaaaatagagatacttggggagaccttttgggacagcggtg

SEQ ID NO: 415926 - DNA, 140 bp, Artificial Sequence
  Synthetic
caccgctgtcccaaaaggtctccccaagtatctctatttttagttgcacaaaagaggggaatggatgcatttttccacacgggtactccatagaaaacagtcacatatttggtgcaatatcatatcagcagccagggcct

SEQ ID NO: 415927 - DNA, 140 bp, Artificial Sequence
  Synthetic
atacgccatgctgggtctcctgtaacagaggcttttgacgcatgggataatatagtaacagaacaagcagtagaagatgtctggaatctatttgagacatcaataaaaccatgtgtcaaacgtacttgggagtcggccat

SEQ ID NO: 415928 - DNA, 140 bp, Artificial Sequence
  Synthetic
atggccgactcccaagtacgtttgacacatggttttattgatgtctcaaatagattccagacatcttctactgcttgttctgttactatattatcccatgcgtcaaaagcctctgttacaggagacccagcatggcgtat

SEQ ID NO: 415929 - DNA, 140 bp, Artificial Sequence
  Synthetic
aggccctggctgctgatatgtagaagatgtctggaatctatttgagacatcaataaaaccatgtgtcaaattaacgcctttatgtgtaacaatgaactgtaacgcaagtacagagagcgcgaccttttgggacagcggtg

SEQ ID NO: 415930 - DNA, 140 bp, Artificial Sequence
  Synthetic
caccgctgtcccaaaaggtcgcgctctctgtacttgcgttacagttcattgttacacataaaggcgttaatttgacacatggttttattgatgtctcaaatagattccagacatcttctacatatcagcagccagggcct

SEQ ID NO: 415931 - DNA, 140 bp, Artificial Sequence
  Synthetic
atacgccatgctgggtctcccatgcatacaattgaacaattgctcaggactgagggaggaagacatggtcgagtgtcagttcaatatgacaggactagagttagataagaaaaaacagtacgtacttgggagtcggccat

SEQ ID NO: 415932 - DNA, 140 bp, Artificial Sequence
  Synthetic
atggccgactcccaagtacgtactgttttttcttatctaactctagtcctgtcatattgaactgacactcgaccatgtcttcctccctcagtcctgagcaattgttcaattgtatgcatgggagacccagcatggcgtat

SEQ ID NO: 415933 - DNA, 140 bp, Artificial Sequence
  Synthetic
aggccctggctgctgatatggagtgtcagttcaatatgacaggactagagttagataagaaaaaacagtatagtgaaacctggtactcaaaagatgtggtttgtgaatcagataacagcagaccttttgggacagcggtg

SEQ ID NO: 415934 - DNA, 140 bp, Artificial Sequence
  Synthetic
caccgctgtcccaaaaggtctgctgttatctgattcacaaaccacatcttttgagtaccaggtttcactatactgttttttcttatctaactctagtcctgtcatattgaactgacactccatatcagcagccagggcct

SEQ ID NO: 415935 - DNA, 140 bp, Artificial Sequence
  Synthetic
atacgccatgctgggtctccgagtcatgtgacaagcactattgggatgctatgagatttagatactgtgcaccaccgggttttgtcttgctaaggtgcaatgataccaattactcaggctcgtacttgggagtcggccat

SEQ ID NO: 415936 - DNA, 140 bp, Artificial Sequence
  Synthetic
atggccgactcccaagtacgagcctgagtaattggtatcattgcaccttagcaagacaaaacccggtggtgcacagtatctaaatctcatagcatcccaatagtgcttgtcacatgactcggagacccagcatggcgtat

SEQ ID NO: 415937 - DNA, 140 bp, Artificial Sequence
  Synthetic
aggccctggctgctgatatgaccaccgggttttgtcttgctaaggtgcaatgataccaattactcaggctttgagcccaattgctctaaagtagtagcttctacatgtacaagaatgatggaccttttgggacagcggtg

SEQ ID NO: 415938 - DNA, 140 bp, Artificial Sequence
  Synthetic
caccgctgtcccaaaaggtccatcattcttgtacatgtagaagctactactttagagcaattgggctcaaagcctgagtaattggtatcattgcaccttagcaagacaaaacccggtggtcatatcagcagccagggcct

SEQ ID NO: 415939 - DNA, 140 bp, Artificial Sequence
  Synthetic
atacgccatgctgggtctcctagaacatatatctattggcatggtagggataacagaactattatcagcttaaacaaatattataatctcaccatactttgtaggagaccagaaaataaacgtacttgggagtcggccat

SEQ ID NO: 415940 - DNA, 140 bp, Artificial Sequence
  Synthetic
atggccgactcccaagtacgtttattttctggtctcctacaaagtatggtgagattataatatttgtttaagctgataatagttctgttatccctaccatgccaatagatatatgttctaggagacccagcatggcgtat

SEQ ID NO: 415941 - DNA, 140 bp, Artificial Sequence
  Synthetic
aggccctggctgctgatatgtaaacaaatattataatctcaccatactttgtaggagaccagaaaataaaacagttgtaccaataacactcatgtcaggccgcagatttcactcccagaagaccttttgggacagcggtg

SEQ ID NO: 415942 - DNA, 140 bp, Artificial Sequence
  Synthetic
caccgctgtcccaaaaggtcttctgggagtgaaatctgcggcctgacatgagtgttattggtacaactgttttattttctggtctcctacaaagtatggtgagattataatatttgtttacatatcagcagccagggcct

SEQ ID NO: 415943 - DNA, 140 bp, Artificial Sequence
  Synthetic
atacgccatgctgggtctccggagggaagccatgcaggaggtgaaacaaacccttgtaaaacatcccaggtataaaggaaccaatgacacaaataaaattaactttacagcaccagaaaacgtacttgggagtcggccat

SEQ ID NO: 415944 - DNA, 140 bp, Artificial Sequence
  Synthetic
atggccgactcccaagtacgttttctggtgctgtaaagttaattttatttgtgtcattggttcctttatacctgggatgttttacaagggtttgtttcacctcctgcatggcttccctccggagacccagcatggcgtat

SEQ ID NO: 415945 - DNA, 140 bp, Artificial Sequence
  Synthetic
aggccctggctgctgatatgtataaaggaaccaatgacacaaataaaattaactttacagcaccagaaaaagactcagacccagaagtagcatatatgtggactaactgcagaggagaatgaccttttgggacagcggtg

SEQ ID NO: 415946 - DNA, 140 bp, Artificial Sequence
  Synthetic
caccgctgtcccaaaaggtcattctcctctgcagttagtccacatatatgctacttctgggtctgagtctttttctggtgctgtaaagttaattttatttgtgtcattggttcctttatacatatcagcagccagggcct

SEQ ID NO: 415947 - DNA, 140 bp, Artificial Sequence
  Synthetic
atacgccatgctgggtctccggtcaacagcataactatgtgccgtgccatatagagcaaataattaatacctggcataaggtagggaaaaatgtatatttgcctcctagggaaggagagtcgtacttgggagtcggccat

SEQ ID NO: 415948 - DNA, 140 bp, Artificial Sequence
  Synthetic
atggccgactcccaagtacgactctccttccctaggaggcaaatatacatttttccctaccttatgccaggtattaattatttgctctatatggcacggcacatagttatgctgttgaccggagacccagcatggcgtat

SEQ ID NO: 415949 - DNA, 140 bp, Artificial Sequence
  Synthetic
aggccctggctgctgatatgctggcataaggtagggaaaaatgtatatttgcctcctagggaaggagagttgtcctgcgaatcaacagtgaccagtatcattgctaacattgatgttgatgaccttttgggacagcggtg

SEQ ID NO: 415950 - DNA, 140 bp, Artificial Sequence
  Synthetic
caccgctgtcccaaaaggtcatcaacatcaatgttagcaatgatactggtcactgttgattcgcaggacaactctccttccctaggaggcaaatatacatttttccctaccttatgccagcatatcagcagccagggcct

SEQ ID NO: 415951 - DNA, 140 bp, Artificial Sequence
  Synthetic
atacgccatgctgggtctccccgattggaattgggggattataaattagtagaagtaacaccaattggcttcgcccctacagcagaaaaaagatactcctctgctccagggagacataagcgtacttgggagtcggccat

SEQ ID NO: 415952 - DNA, 140 bp, Artificial Sequence
  Synthetic
atggccgactcccaagtacgcttatgtctccctggagcagaggagtatcttttttctgctgtaggggcgaagccaattggtgttacttctactaatttataatcccccaattccaatcggggagacccagcatggcgtat

SEQ ID NO: 415953 - DNA, 140 bp, Artificial Sequence
  Synthetic
aggccctggctgctgatatgtcgcccctacagcagaaaaaagatactcctctgctccagggagacataagagaggtgtgcttgtgctagggttcctaggttttctcacgacagcaggtgcgaccttttgggacagcggtg

SEQ ID NO: 415954 - DNA, 140 bp, Artificial Sequence
  Synthetic
caccgctgtcccaaaaggtcgcacctgctgtcgtgagaaaacctaggaaccctagcacaagcacacctctcttatgtctccctggagcagaggagtatcttttttctgctgtaggggcgacatatcagcagccagggcct

SEQ ID NO: 415955 - DNA, 140 bp, Artificial Sequence
  Synthetic
atacgccatgctgggtctcctccgtgggatagtgcagcaacagcaacagctgttggacgtggtcaagagacaacaagaaatgttgcgactgaccgtctggggaactaaaaacctccaggccgtacttgggagtcggccat

SEQ ID NO: 415956 - DNA, 140 bp, Artificial Sequence
  Synthetic
atggccgactcccaagtacggcctggaggtttttagttccccagacggtcagtcgcaacatttcttgttgtctcttgaccacgtccaacagctgttgctgttgctgcactatcccacggaggagacccagcatggcgtat

SEQ ID NO: 415957 - DNA, 140 bp, Artificial Sequence
  Synthetic
aggccctggctgctgatatgcaacaagaaatgttgcgactgaccgtctggggaactaaaaacctccaggcaagagtcactgctattgagaagtacctagcagaccaggcgcgactaaattgaccttttgggacagcggtg

SEQ ID NO: 415958 - DNA, 140 bp, Artificial Sequence
  Synthetic
caccgctgtcccaaaaggtcaatttagtcgcgcctggtctgctaggtacttctcaatagcagtgactcttgcctggaggtttttagttccccagacggtcagtcgcaacatttcttgttgcatatcagcagccagggcct

SEQ ID NO: 415959 - DNA, 140 bp, Artificial Sequence
  Synthetic
atacgccatgctgggtctccaatgacaccttaacacctgagtggaacaacatgacatggcaagaatgggaacacaaaatccgcttcctagaggcaaatatcagtgagagtttagaacaggcgtacttgggagtcggccat

SEQ ID NO: 415960 - DNA, 140 bp, Artificial Sequence
  Synthetic
atggccgactcccaagtacgcctgttctaaactctcactgatatttgcctctaggaagcggattttgtgttcccattcttgccatgtcatgttgttccactcaggtgttaaggtgtcattggagacccagcatggcgtat

SEQ ID NO: 415961 - DNA, 140 bp, Artificial Sequence
  Synthetic
aggccctggctgctgatatgacacaaaatccgcttcctagaggcaaatatcagtgagagtttagaacaggcacaaatccagcaagaaaagaatatgtatgagctgcaaaagctaaatagcgaccttttgggacagcggtg

SEQ ID NO: 415962 - DNA, 140 bp, Artificial Sequence
  Synthetic
caccgctgtcccaaaaggtcgctatttagcttttgcagctcatacatattcttttcttgctggatttgtgcctgttctaaactctcactgatatttgcctctaggaagcggattttgtgtcatatcagcagccagggcct

SEQ ID NO: 415963 - DNA, 140 bp, Artificial Sequence
  Synthetic
atacgccatgctgggtctcctcaatatggagtcatgatagtagtaggaatagtagctctcagaatagtaatatatgtagtacaaatgctaagtagacttagaaagggctataggcctgttcgtacttgggagtcggccat

SEQ ID NO: 415964 - DNA, 140 bp, Artificial Sequence
  Synthetic
atggccgactcccaagtacgaacaggcctatagccctttctaagtctacttagcatttgtactacatatattactattctgagagctactattcctactactatcatgactccatattgaggagacccagcatggcgtat

SEQ ID NO: 415965 - DNA, 140 bp, Artificial Sequence
  Synthetic
aggccctggctgctgatatgtatatgtagtacaaatgctaagtagacttagaaagggctataggcctgttttctcttccccccccggttatattcaacagatccatatccacaaggactggaccttttgggacagcggtg

SEQ ID NO: 415966 - DNA, 140 bp, Artificial Sequence
  Synthetic
caccgctgtcccaaaaggtccagtccttgtggatatggatctgttgaatataaccggggggggaagagaaaacaggcctatagccctttctaagtctacttagcatttgtactacatatacatatcagcagccagggcct

SEQ ID NO: 415967 - DNA, 140 bp, Artificial Sequence
  Synthetic
atacgccatgctgggtctccgaagcagatcctggccttggccgatagaatatatacatttcctgatccgcctgctgatccgcctcttgaccagactatacaacagctgcagggacttactcgtacttgggagtcggccat

SEQ ID NO: 415968 - DNA, 140 bp, Artificial Sequence
  Synthetic
atggccgactcccaagtacgagtaagtccctgcagctgttgtatagtctggtcaagaggcggatcagcaggcggatcaggaaatgtatatattctatcggccaaggccaggatctgcttcggagacccagcatggcgtat

SEQ ID NO: 415969 - DNA, 140 bp, Artificial Sequence
  Synthetic
aggccctggctgctgatatgctgctgatccgcctcttgaccagactatacaacagctgcagggacttactatccagactctacctgatcctccaaccactcagagactggctgagactcagaccttttgggacagcggtg

SEQ ID NO: 415970 - DNA, 140 bp, Artificial Sequence
  Synthetic
caccgctgtcccaaaaggtctgagtctcagccagtctctgagtggttggaggatcaggtagagtctggatagtaagtccctgcagctgttgtatagtctggtcaagaggcggatcagcagcatatcagcagccagggcct

SEQ ID NO: 415971 - DNA, 140 bp, Artificial Sequence
  Synthetic
atacgccatgctgggtctccgccctcgcgagggttacaagagagactcttacgagcgcggggaggagcttgtggggggctctgggacgaatcggaagggggatactcgcagttccacgaacgtacttgggagtcggccat

SEQ ID NO: 415972 - DNA, 140 bp, Artificial Sequence
  Synthetic
atggccgactcccaagtacgttcgtggaactgcgagtatcccccttccgattcgtcccagagccccccacaagctcctccccgcgctcgtaagagtctctcttgtaaccctcgcgagggcggagacccagcatggcgtat

SEQ ID NO: 415973 - DNA, 140 bp, Artificial Sequence
  Synthetic
aggccctggctgctgatatggtggggggctctgggacgaatcggaagggggatactcgcagttccacgaaggatcaggcagggagcagaaattgccctcctgtgagggacagagatatcagaccttttgggacagcggtg

SEQ ID NO: 415974 - DNA, 140 bp, Artificial Sequence
  Synthetic
caccgctgtcccaaaaggtctgatatctctgtccctcacaggagggcaatttctgctccctgcctgatccttcgtggaactgcgagtatcccccttccgattcgtcccagagccccccaccatatcagcagccagggcct

SEQ ID NO: 415975 - DNA, 140 bp, Artificial Sequence
  Synthetic
atacgccatgctgggtctccaaaaagaatcgtacaggcaacaaaatatggatgatgtagattcagatgatgatgacctagtaggggtctctgacacatcaagagtaccattgagagcaatcgtacttgggagtcggccat

SEQ ID NO: 415976 - DNA, 140 bp, Artificial Sequence
  Synthetic
atggccgactcccaagtacgattgctctcaatggtactcttgatgtgtcagagacccctactaggtcatcatcatctgaatctacatcatccatattttgttgcctgtacgattctttttggagacccagcatggcgtat

SEQ ID NO: 415977 - DNA, 140 bp, Artificial Sequence
  Synthetic
aggccctggctgctgatatggatgacctagtaggggtctctgacacatcaagagtaccattgagagcaatgacatatagaatggcagtagacatgtcagatttaataaaagataaggggggaccttttgggacagcggtg

SEQ ID NO: 415978 - DNA, 140 bp, Artificial Sequence
  Synthetic
caccgctgtcccaaaaggtccccccttatcttttattaaatctgacatgtctactgccattctatatgtcattgctctcaatggtactcttgatgtgtcagagacccctactaggtcatccatatcagcagccagggcct

SEQ ID NO: 415979 - DNA, 140 bp, Artificial Sequence
  Synthetic
atacgccatgctgggtctccggttggcgcccgaacagggacttgaagaagactgagaagtctaggaacacggctgagtgaaggcagtaagggcggcaggaacaaaccacgacggagtgctcgtacttgggagtcggccat

SEQ ID NO: 415980 - DNA, 140 bp, Artificial Sequence
  Synthetic
atggccgactcccaagtacgagcactccgtcgtggtttgttcctgccgcccttactgccttcactcagccgtgttcctagacttctcagtcttcttcaagtccctgttcgggcgccaaccggagacccagcatggcgtat

SEQ ID NO: 415981 - DNA, 140 bp, Artificial Sequence
  Synthetic
aggccctggctgctgatatgggctgagtgaaggcagtaagggcggcaggaacaaaccacgacggagtgctcctagaaaggcgcaggccaaggtaccaaaggccggcgtgtggagcgggaggaccttttgggacagcggtg

SEQ ID NO: 415982 - DNA, 140 bp, Artificial Sequence
  Synthetic
caccgctgtcccaaaaggtcctcccgctccacacgccggcctttggtaccttggcctgcgcctttctaggagcactccgtcgtggtttgttcctgccgcccttactgccttcactcagcccatatcagcagccagggcct

SEQ ID NO: 415983 - DNA, 140 bp, Artificial Sequence
  Synthetic
atacgccatgctgggtctcccctagaaaggcgcaggccaaggtaccaaaggccggcgtgtggagcgggagtgaagaggcctccgggtgaaggtaagtacctacaccaaaattgtagccgacgtacttgggagtcggccat

SEQ ID NO: 415984 - DNA, 140 bp, Artificial Sequence
  Synthetic
atggccgactcccaagtacgtcggctacaattttggtgtaggtacttaccttcacccggaggcctcttcactcccgctccacacgccggcctttggtaccttggcctgcgcctttctaggggagacccagcatggcgtat

SEQ ID NO: 415985 - DNA, 140 bp, Artificial Sequence
  Synthetic
atacgccatgctgggtctcccgcgagaaactccgtcttgagagggagaaaagcagacgaattagaaagaattaggttacggcccggcggaaagaaaaaatatcagctaaaacatattgtgcgtacttgggagtcggccat

SEQ ID NO: 415986 - DNA, 140 bp, Artificial Sequence
  Synthetic
atggccgactcccaagtacgcacaatatgttttagctgatattttttctttccgccgggccgtaacctaattctttctaattcgtctgcttttctccctctcaagacggagtttctcgcgggagacccagcatggcgtat

SEQ ID NO: 415987 - DNA, 140 bp, Artificial Sequence
  Synthetic
aggccctggctgctgatatgttaggttacggcccggcggaaagaaaaaatatcagctaaaacatattgtgtgggcagcgaatgaattggacagattcggattggcagaaagcctgttggagaccttttgggacagcggtg

SEQ ID NO: 415988 - DNA, 140 bp, Artificial Sequence
  Synthetic
caccgctgtcccaaaaggtctccaacaggctttctgccaatccgaatctgtccaattcattcgctgcccacacaatatgttttagctgatattttttctttccgccgggccgtaacctaacatatcagcagccagggcct

SEQ ID NO: 415989 - DNA, 140 bp, Artificial Sequence
  Synthetic
atacgccatgctgggtctcccaacaggatcagaaaatttaaaaagcctttttaatactgtctgcgtagtttggtgcgtgcacgcagaagagaaagtgaaagatactgaaggagcaaaacacgtacttgggagtcggccat

SEQ ID NO: 415990 - DNA, 140 bp, Artificial Sequence
  Synthetic
atggccgactcccaagtacgtgttttgctccttcagtatctttcactttctcttctgcgtgcacgcaccaaactacgcagacagtattaaaaaggctttttaaattttctgatcctgttgggagacccagcatggcgtat

SEQ ID NO: 415991 - DNA, 140 bp, Artificial Sequence
  Synthetic
atacgccatgctgggtctcccaagcacaagtagaccaacagcaccacctagtgaacaggggggaaacttccccgtacaacaagtagccggcaactacacccatgtgccgctgagcccccgcgtacttgggagtcggccat

SEQ ID NO: 415992 - DNA, 140 bp, Artificial Sequence
  Synthetic
atggccgactcccaagtacgcgggggctcagcggcacatgggtgtagttgccggctacttgttgtacggggaagtttcccccctgttcactaggtggtgctgttggtctacttgtgcttgggagacccagcatggcgtat

SEQ ID NO: 415993 - DNA, 140 bp, Artificial Sequence
  Synthetic
aggccctggctgctgatatgattaatcaaatgcttaattgtgtgggcgaccatcaagcagccatgcaaataatcagggagattatcaatgaagaagcagcagactgggatgttgcacatcgaccttttgggacagcggtg

SEQ ID NO: 415994 - DNA, 140 bp, Artificial Sequence
  Synthetic
caccgctgtcccaaaaggtcgatgtgcaacatcccagtctgctgcttcttcattgataatctccctgattatttgcatggctgcttgatggtcgcccacacaattaagcatttgattaatcatatcagcagccagggcct

SEQ ID NO: 415995 - DNA, 140 bp, Artificial Sequence
  Synthetic
atacgccatgctgggtctccgacatagcaggaacaacaagcacagtagaagaacagatccagtggatgttcaggccacggaatcctgtgccagtagggaacatctatagaagatggatcccgtacttgggagtcggccat

SEQ ID NO: 415996 - DNA, 140 bp, Artificial Sequence
  Synthetic
atggccgactcccaagtacgggatccatcttctatagatgttccctactggcacaggattccgtggcctgaacatccactggatctgttcttctactgtgcttgttgttcctgctatgtcggagacccagcatggcgtat

SEQ ID NO: 415997 - DNA, 140 bp, Artificial Sequence
  Synthetic
aggccctggctgctgatatgcaggccacggaatcctgtgccagtagggaacatctatagaagatggatccagatagggctacagaagtgtgtcaggatgtacaacccaaccaacatcctagaccttttgggacagcggtg

SEQ ID NO: 415998 - DNA, 140 bp, Artificial Sequence
  Synthetic
caccgctgtcccaaaaggtctaggatgttggttgggttgtacatcctgacacacttctgtagccctatctggatccatcttctatagatgttccctactggcacaggattccgtggcctgcatatcagcagccagggcct

SEQ ID NO: 415999 - DNA, 140 bp, Artificial Sequence
  Synthetic
atacgccatgctgggtctccctacaaaagcttaagggcagaacaaacagatccagcagtaaagaattggatgactcaaacactgctggtacagaatgccaacccagactgcaaattagtgcgtacttgggagtcggccat

SEQ ID NO: 416000 - DNA, 140 bp, Artificial Sequence
  Synthetic
atggccgactcccaagtacgcactaatttgcagtctgggttggcattctgtaccagcagtgtttgagtcatccaattctttactgctggatctgtttgttctgcccttaagcttttgtagggagacccagcatggcgtat

SEQ ID NO: 416001 - DNA, 140 bp, Artificial Sequence
  Synthetic
aggccctggctgctgatatgtgactcaaacactgctggtacagaatgccaacccagactgcaaattagtgctgaaaggattagggatgaatcctaccttagaagagatgctaaccgcctggaccttttgggacagcggtg

SEQ ID NO: 416002 - DNA, 140 bp, Artificial Sequence
  Synthetic
caccgctgtcccaaaaggtccaggcggttagcatctcttctaaggtaggattcatccctaatcctttcagcactaatttgcagtctgggttggcattctgtaccagcagtgtttgagtcacatatcagcagccagggcct

SEQ ID NO: 416003 - DNA, 140 bp, Artificial Sequence
  Synthetic
atacgccatgctgggtctcctaaaggaggccatgacaccagctcctatcccatttgcggcagcccaacaaagaaggacaattaagtgctggaattgtggaaaggaagggcactcggcaagcgtacttgggagtcggccat

SEQ ID NO: 416004 - DNA, 140 bp, Artificial Sequence
  Synthetic
atggccgactcccaagtacgcttgccgagtgcccttcctttccacaattccagcacttaattgtccttctttgttgggctgccgcaaatgggataggagctggtgtcatggcctcctttaggagacccagcatggcgtat

SEQ ID NO: 416005 - DNA, 140 bp, Artificial Sequence
  Synthetic
aggccctggctgctgatatgagaaggacaattaagtgctggaattgtggaaaggaagggcactcggcaagacaatgccgagcacccagaaaacagggctgctggaaatgtggcaagccaggaccttttgggacagcggtg

SEQ ID NO: 416006 - DNA, 140 bp, Artificial Sequence
  Synthetic
caccgctgtcccaaaaggtcctggcttgccacatttccagcagccctgttttctgggtgctcggcattgtcttgccgagtgcccttcctttccacaattccagcacttaattgtccttctcatatcagcagccagggcct

SEQ ID NO: 416007 - DNA, 140 bp, Artificial Sequence
  Synthetic
atacgccatgctgggtctccggcccatggggaaagaagcctcgcaacttccccgtaacccgagttccgcagggattaacaccaacagcacccccagcagagccagcagcggacctgctggcgtacttgggagtcggccat

SEQ ID NO: 416008 - DNA, 140 bp, Artificial Sequence
  Synthetic
atggccgactcccaagtacgccagcaggtccgctgctggctctgctgggggtgctgttggtgttaatccctgcggaactcgggttacggggaagttgcgaggcttctttccccatgggccggagacccagcatggcgtat

SEQ ID NO: 416009 - DNA, 140 bp, Artificial Sequence
  Synthetic
aggccctggctgctgatatggggattaacaccaacagcacccccagcagagccagcagcggacctgctggagcagtatatgcagcaggggagaaagcaaagagagcagagagagaggccagaccttttgggacagcggtg

SEQ ID NO: 416010 - DNA, 140 bp, Artificial Sequence
  Synthetic
caccgctgtcccaaaaggtctggcctctctctctgctctctttgctttctcccctgctgcatatactgctccagcaggtccgctgctggctctgctgggggtgctgttggtgttaatccccatatcagcagccagggcct

SEQ ID NO: 416011 - DNA, 140 bp, Artificial Sequence
  Synthetic
atacgccatgctgggtctccacacaaagaggtgacagaggacttgctgcacctcaattctctctttggaaaagaccagtagtcacagcctacattgagggccagccagtggaagttttaccgtacttgggagtcggccat

SEQ ID NO: 416012 - DNA, 140 bp, Artificial Sequence
  Synthetic
atggccgactcccaagtacggtaaaacttccactggctggccctcaatgtaggctgtgactactggtcttttccaaagagagaattgaggtgcagcaagtcctctgtcacctctttgtgtggagacccagcatggcgtat

SEQ ID NO: 416013 - DNA, 140 bp, Artificial Sequence
  Synthetic
aggccctggctgctgatatgaagaccagtagtcacagcctacattgagggccagccagtggaagttttactagacacaggggctgacgactcaatagtagcaggaatagagttagggagcgaccttttgggacagcggtg

SEQ ID NO: 416014 - DNA, 140 bp, Artificial Sequence
  Synthetic
caccgctgtcccaaaaggtcgctccctaactctattcctgctactattgagtcgtcagcccctgtgtctagtaaaacttccactggctggccctcaatgtaggctgtgactactggtcttcatatcagcagccagggcct

SEQ ID NO: 416015 - DNA, 140 bp, Artificial Sequence
  Synthetic
atacgccatgctgggtctccagaatatgaagatgtagaaataaaagtactaaataaaagagtaaaagccaccataatgacaggtgacaccccaatcaatatttttggcagaaacattttgcgtacttgggagtcggccat

SEQ ID NO: 416016 - DNA, 140 bp, Artificial Sequence
  Synthetic
atggccgactcccaagtacgcaaaatgtttctgccaaaaatattgattggggtgtcacctgtcattatggtggcttttactcttttatttagtacttttatttctacatcttcatattctggagacccagcatggcgtat

SEQ ID NO: 416017 - DNA, 140 bp, Artificial Sequence
  Synthetic
aggccctggctgctgatatgccataatgacaggtgacaccccaatcaatatttttggcagaaacattttgacagccttaggcatgtcattaaacctaccagttgccaagatagagccaatgaccttttgggacagcggtg

SEQ ID NO: 416018 - DNA, 140 bp, Artificial Sequence
  Synthetic
caccgctgtcccaaaaggtcattggctctatcttggcaactggtaggtttaatgacatgcctaaggctgtcaaaatgtttctgccaaaaatattgattggggtgtcacctgtcattatggcatatcagcagccagggcct

SEQ ID NO: 416019 - DNA, 140 bp, Artificial Sequence
  Synthetic
atacgccatgctgggtctccccttaacaaaagaaaaaatagaggcactaaaagaaatctgtgaaaaaacggaaagagaaggccaattagaggaggcacctccaactaacccttataataccgtacttgggagtcggccat

SEQ ID NO: 416020 - DNA, 140 bp, Artificial Sequence
  Synthetic
atggccgactcccaagtacggtattataagggttagttggaggtgcctcctctaattggccttctctttccgttttttcacagatttcttttagtgcctctattttttcttttgttaaggggagacccagcatggcgtat

SEQ ID NO: 416021 - DNA, 140 bp, Artificial Sequence
  Synthetic
aggccctggctgctgatatggaaagagaaggccaattagaggaggcacctccaactaacccttataatacccccacatttgcaataaagaagaaggacaaaaacaaatggagaatgctaagaccttttgggacagcggtg

SEQ ID NO: 416022 - DNA, 140 bp, Artificial Sequence
  Synthetic
caccgctgtcccaaaaggtcttagcattctccatttgtttttgtccttcttctttattgcaaatgtgggggtattataagggttagttggaggtgcctcctctaattggccttctctttccatatcagcagccagggcct

SEQ ID NO: 416023 - DNA, 140 bp, Artificial Sequence
  Synthetic
atacgccatgctgggtctccttagggattccacatccagcaggattagccaagaaaagaagaatcactgtgctggatgtaggggatgcttacttttccataccactgcatgagagctttacgtacttgggagtcggccat

SEQ ID NO: 416024 - DNA, 140 bp, Artificial Sequence
  Synthetic
atggccgactcccaagtacgtaaagctctcatgcagtggtatggaaaagtaagcatcccctacatccagcacagtgattcttcttttcttggctaatcctgctggatgtggaatccctaaggagacccagcatggcgtat

SEQ ID NO: 416025 - DNA, 140 bp, Artificial Sequence
  Synthetic
aggccctggctgctgatatggctggatgtaggggatgcttacttttccataccactgcatgagagctttagacagtatactgcatttactctaccatcagtaaacaatgcagaaccaggagaccttttgggacagcggtg

SEQ ID NO: 416026 - DNA, 140 bp, Artificial Sequence
  Synthetic
caccgctgtcccaaaaggtctcctggttctgcattgtttactgatggtagagtaaatgcagtatactgtctaaagctctcatgcagtggtatggaaaagtaagcatcccctacatccagccatatcagcagccagggcct

SEQ ID NO: 416027 - DNA, 140 bp, Artificial Sequence
  Synthetic
atacgccatgctgggtctccaatttttcaacacacaatgagacagatcttagagccattcagaaaggcaaaccaggatgtcattctcattcaatacatggatgatatcttaatagctagtcgtacttgggagtcggccat

SEQ ID NO: 416028 - DNA, 140 bp, Artificial Sequence
  Synthetic
atggccgactcccaagtacgactagctattaagatatcatccatgtattgaatgagaatgacatcctggtttgcctttctgaatggctctaagatctgtctcattgtgtgttgaaaaattggagacccagcatggcgtat

SEQ ID NO: 416029 - DNA, 140 bp, Artificial Sequence
  Synthetic
aggccctggctgctgatatgaccaggatgtcattctcattcaatacatggatgatatcttaatagctagtgacaggacagatttagaacatgacaaggtggtcctgcagttaaaggaactgaccttttgggacagcggtg

SEQ ID NO: 416030 - DNA, 140 bp, Artificial Sequence
  Synthetic
caccgctgtcccaaaaggtcagttcctttaactgcaggaccaccttgtcatgttctaaatctgtcctgtcactagctattaagatatcatccatgtattgaatgagaatgacatcctggtcatatcagcagccagggcct

SEQ ID NO: 416031 - DNA, 140 bp, Artificial Sequence
  Synthetic
atacgccatgctgggtctccctccatacaaatggatgggctatggactgtggccaactaaatggaagctgcaaaaaatacaattgccccagaaagaagtatggacagtcaatgacatccacgtacttgggagtcggccat

SEQ ID NO: 416032 - DNA, 140 bp, Artificial Sequence
  Synthetic
atggccgactcccaagtacgtggatgtcattgactgtccatacttctttctggggcaattgtattttttgcagcttccatttagttggccacagtccatagcccatccatttgtatggagggagacccagcatggcgtat

SEQ ID NO: 416033 - DNA, 140 bp, Artificial Sequence
  Synthetic
aggccctggctgctgatatgcaaaaaatacaattgccccagaaagaagtatggacagtcaatgacatccaaaaacatgtgggtgtcctaaattgggcagcacaaatctacccaggaataagaccttttgggacagcggtg

SEQ ID NO: 416034 - DNA, 140 bp, Artificial Sequence
  Synthetic
caccgctgtcccaaaaggtcttattcctgggtagatttgtgctgcccaatttaggacacccacatgtttttggatgtcattgactgtccatacttctttctggggcaattgtattttttgcatatcagcagccagggcct

SEQ ID NO: 416035 - DNA, 140 bp, Artificial Sequence
  Synthetic
atacgccatgctgggtctccggagtgcagtggacagaactagcagaagcagaactagaggagaacagaattatcttaagtcaggaacaagaggggcactattaccaagaagaaaaggagtcgtacttgggagtcggccat

SEQ ID NO: 416036 - DNA, 140 bp, Artificial Sequence
  Synthetic
atggccgactcccaagtacgactccttttcttcttggtaatagtgcccctcttgttcctgacttaagataattctgttctcctctagttctgcttctgctagttctgtccactgcactccggagacccagcatggcgtat

SEQ ID NO: 416037 - DNA, 140 bp, Artificial Sequence
  Synthetic
aggccctggctgctgatatgtatcttaagtcaggaacaagaggggcactattaccaagaagaaaaggagttagaagcaacagtccaaaaagatcaagacaatcaatggacatataaaatagaccttttgggacagcggtg

SEQ ID NO: 416038 - DNA, 140 bp, Artificial Sequence
  Synthetic
caccgctgtcccaaaaggtctattttatatgtccattgattgtcttgatctttttggactgttgcttctaactccttttcttcttggtaatagtgcccctcttgttcctgacttaagatacatatcagcagccagggcct

SEQ ID NO: 416039 - DNA, 140 bp, Artificial Sequence
  Synthetic
atacgccatgctgggtctcctacccataccaacggggtcagattgttagcacaggtagttcaaaaaataggaaaagaagcactggtcatttggggacgaataccaagatttcacctaccacgtacttgggagtcggccat

SEQ ID NO: 416040 - DNA, 140 bp, Artificial Sequence
  Synthetic
atggccgactcccaagtacgtggtaggtgaaatcttggtattcgtccccaaatgaccagtgcttcttttcctattttttgaactacctgtgctaacaatctgaccccgttggtatgggtaggagacccagcatggcgtat

SEQ ID NO: 416041 - DNA, 140 bp, Artificial Sequence
  Synthetic
aggccctggctgctgatatggaaaagaagcactggtcatttggggacgaataccaagatttcacctaccagtagaaagagaaacctgggaacagtggtgggatgactactggcaagtgacgaccttttgggacagcggtg

SEQ ID NO: 416042 - DNA, 140 bp, Artificial Sequence
  Synthetic
caccgctgtcccaaaaggtcgtcacttgccagtagtcatcccaccactgttcccaggtttctctttctactggtaggtgaaatcttggtattcgtccccaaatgaccagtgcttcttttccatatcagcagccagggcct

SEQ ID NO: 416043 - DNA, 140 bp, Artificial Sequence
  Synthetic
atacgccatgctgggtctcccatttaacctagtaaaagatcctatactaggcgcagagaccttctacacagacgggccctgtaataggcaatcaaaagaaggaaaagcaggatatataaccgtacttgggagtcggccat

SEQ ID NO: 416044 - DNA, 140 bp, Artificial Sequence
  Synthetic
atggccgactcccaagtacggttatatatcctgcttttccttcttttgattgcctattacagggcccgtctgtgtagaaggtctctgcgcctagtataggatcttttactaggttaaatgggagacccagcatggcgtat

SEQ ID NO: 416045 - DNA, 140 bp, Artificial Sequence
  Synthetic
aggccctggctgctgatatggacgggccctgtaataggcaatcaaaagaaggaaaagcaggatatataacagatagagggagagacaaggtgaaggtactagaacaaactaccaatcagcgaccttttgggacagcggtg

SEQ ID NO: 416046 - DNA, 140 bp, Artificial Sequence
  Synthetic
caccgctgtcccaaaaggtcgctgattggtagtttgttctagtaccttcaccttgtctctccctctatctgttatatatcctgcttttccttcttttgattgcctattacagggcccgtccatatcagcagccagggcct

SEQ ID NO: 416047 - DNA, 140 bp, Artificial Sequence
  Synthetic
atacgccatgctgggtctccgccaatattatagtagattcacagtatgtaatgggaatagtagcaggccagccaacagaatcagaaaatagaatagtaaatcaaatcatagaagaaatgacgtacttgggagtcggccat

SEQ ID NO: 416048 - DNA, 140 bp, Artificial Sequence
  Synthetic
atggccgactcccaagtacgtcatttcttctatgatttgatttactattctattttctgattctgttggctggcctgctactattcccattacatactgtgaatctactataatattggcggagacccagcatggcgtat

SEQ ID NO: 416049 - DNA, 140 bp, Artificial Sequence
  Synthetic
aggccctggctgctgatatggccaacagaatcagaaaatagaatagtaaatcaaatcatagaagaaatgataaaaaaggaagccatctatgttgcgtgggtcccagcccacaaaggcatagaccttttgggacagcggtg

SEQ ID NO: 416050 - DNA, 140 bp, Artificial Sequence
  Synthetic
caccgctgtcccaaaaggtctatgcctttgtgggctgggacccacgcaacatagatggcttccttttttatcatttcttctatgatttgatttactattctattttctgattctgttggccatatcagcagccagggcct

SEQ ID NO: 416051 - DNA, 140 bp, Artificial Sequence
  Synthetic
atacgccatgctgggtctccattgtttctagaaaaaatagagccagctcaggaagaacatgaaaagtatcatagcaatgtgaaagaactatcccataaatttggattacccaatctggtgcgtacttgggagtcggccat

SEQ ID NO: 416052 - DNA, 140 bp, Artificial Sequence
  Synthetic
atggccgactcccaagtacgcaccagattgggtaatccaaatttatgggatagttctttcacattgctatgatacttttcatgttcttcctgagctggctctattttttctagaaacaatggagacccagcatggcgtat

SEQ ID NO: 416053 - DNA, 140 bp, Artificial Sequence
  Synthetic
aggccctggctgctgatatgatagcaatgtgaaagaactatcccataaatttggattacccaatctggtggcaagacagatagtaaacacatgtgcccaatgtcagcagaagggagaggcgaccttttgggacagcggtg

SEQ ID NO: 416054 - DNA, 140 bp, Artificial Sequence
  Synthetic
caccgctgtcccaaaaggtcgcctctcccttctgctgacattgggcacatgtgtttactatctgtcttgccaccagattgggtaatccaaatttatgggatagttctttcacattgctatcatatcagcagccagggcct

SEQ ID NO: 416055 - DNA, 140 bp, Artificial Sequence
  Synthetic
atacgccatgctgggtctcccacacttagaaggaaaagtcatcataatagcagtgcatgttgccagtggattcatagaagcagaggtcatcccgcaggaatcaggaagacaaacagcactcgtacttgggagtcggccat

SEQ ID NO: 416056 - DNA, 140 bp, Artificial Sequence
  Synthetic
atggccgactcccaagtacgagtgctgtttgtcttcctgattcctgcgggatgacctctgcttctatgaatccactggcaacatgcactgctattatgatgacttttccttctaagtgtgggagacccagcatggcgtat

SEQ ID NO: 416057 - DNA, 140 bp, Artificial Sequence
  Synthetic
aggccctggctgctgatatgttcatagaagcagaggtcatcccgcaggaatcaggaagacaaacagcactcttcctattaaaactggctagtagatggccaataacacacttgcacacaggaccttttgggacagcggtg

SEQ ID NO: 416058 - DNA, 140 bp, Artificial Sequence
  Synthetic
caccgctgtcccaaaaggtcctgtgtgcaagtgtgttattggccatctactagccagttttaataggaagagtgctgtttgtcttcctgattcctgcgggatgacctctgcttctatgaacatatcagcagccagggcct

SEQ ID NO: 416059 - DNA, 140 bp, Artificial Sequence
  Synthetic
atacgccatgctgggtctccgttggtatagagcaatcctttggagtaccttacaatccacaaagccaaggagtagtagaagcaatgaatcaccacctaaaaaatcagataagcagaattacgtacttgggagtcggccat

SEQ ID NO: 416060 - DNA, 140 bp, Artificial Sequence
  Synthetic
atggccgactcccaagtacgtaattctgcttatctgattttttaggtggtgattcattgcttctactactccttggctttgtggattgtaaggtactccaaaggattgctctataccaacggagacccagcatggcgtat

SEQ ID NO: 416061 - DNA, 140 bp, Artificial Sequence
  Synthetic
aggccctggctgctgatatgagtagtagaagcaatgaatcaccacctaaaaaatcagataagcagaattagagagcaggcaaatacagtggaaacaatagtactaatggcagttcattgcgaccttttgggacagcggtg

SEQ ID NO: 416062 - DNA, 140 bp, Artificial Sequence
  Synthetic
caccgctgtcccaaaaggtcgcaatgaactgccattagtactattgtttccactgtatttgcctgctctctaattctgcttatctgattttttaggtggtgattcattgcttctactactcatatcagcagccagggcct

SEQ ID NO: 416063 - DNA, 140 bp, Artificial Sequence
  Synthetic
atacgccatgctgggtctccactcatcaatatgatctccacagaacaagaaatacaattcctccaaacaaaaaatttgaaatttaaaaatttcccggtctattacagggaaggcagagatcgtacttgggagtcggccat

SEQ ID NO: 416064 - DNA, 140 bp, Artificial Sequence
  Synthetic
atggccgactcccaagtacgatctctgccttccctgtaatagaccgggaaatttttaaatttcaaattttttgtttggaggaattgtatttcttgttctgtggagatcatattgatgagtggagacccagcatggcgtat

SEQ ID NO: 416065 - DNA, 140 bp, Artificial Sequence
  Synthetic
aggccctggctgctgatatgaaaatttgaaatttaaaaatttcccggtctattacagggaaggcagagatcagctgtggaaaggacctggggagctactgtggaaaggggacggagcagtgaccttttgggacagcggtg

SEQ ID NO: 416066 - DNA, 140 bp, Artificial Sequence
  Synthetic
caccgctgtcccaaaaggtcactgctccgtcccctttccacagtagctccccaggtcctttccacagctgatctctgccttccctgtaatagaccgggaaatttttaaatttcaaattttcatatcagcagccagggcct

SEQ ID NO: 416067 - DNA, 140 bp, Artificial Sequence
  Synthetic
atacgccatgctgggtctccagatcatcagagactatggaggaaggcaagagctggatagtggtccccacttggagggtgccagggaggatggagaagtggcatagccttgtcaagtacccgtacttgggagtcggccat

SEQ ID NO: 416068 - DNA, 140 bp, Artificial Sequence
  Synthetic
atggccgactcccaagtacgggtacttgacaaggctatgccacttctccatcctccctggcaccctccaagtggggaccactatccagctcttgccttcctccatagtctctgatgatctggagacccagcatggcgtat

SEQ ID NO: 416069 - DNA, 140 bp, Artificial Sequence
  Synthetic
aggccctggctgctgatatgttggagggtgccagggaggatggagaagtggcatagccttgtcaagtacctaaagtacagaacaaaagatctagaaaaggtgtgctatgttccccaccatgaccttttgggacagcggtg

SEQ ID NO: 416070 - DNA, 140 bp, Artificial Sequence
  Synthetic
caccgctgtcccaaaaggtcatggtggggaacatagcacaccttttctagatcttttgttctgtactttaggtacttgacaaggctatgccacttctccatcctccctggcaccctccaacatatcagcagccagggcct

SEQ ID NO: 416071 - DNA, 140 bp, Artificial Sequence
  Synthetic
atacgccatgctgggtctccaggaagaagtcatctagagatacaggcatattggaacctaacaccagaaaaaggatggctctcctcttatgcagtaagaataacttggtatacagaaaagcgtacttgggagtcggccat

SEQ ID NO: 416072 - DNA, 140 bp, Artificial Sequence
  Synthetic
atggccgactcccaagtacgcttttctgtataccaagttattcttactgcataagaggagagccatcctttttctggtgttaggttccaatatgcctgtatctctagatgacttcttcctggagacccagcatggcgtat

SEQ ID NO: 416073 - DNA, 140 bp, Artificial Sequence
  Synthetic
aggccctggctgctgatatgaaggatggctctcctcttatgcagtaagaataacttggtatacagaaaagttctggacagatgttaccccagactgtgcagactccctaatacatggcacgaccttttgggacagcggtg

SEQ ID NO: 416074 - DNA, 140 bp, Artificial Sequence
  Synthetic
caccgctgtcccaaaaggtcgtgccatgtattagggagtctgcacagtctggggtaacatctgtccagaacttttctgtataccaagttattcttactgcataagaggagagccatccttcatatcagcagccagggcct

SEQ ID NO: 416075 - DNA, 140 bp, Artificial Sequence
  Synthetic
atacgccatgctgggtctccaaaagttattgtcctgctgcaattatccccaggcccataagtcacaggtaccgtcactccaatttctggccttagtggtagtgcaacaaaatggcaaacccgtacttgggagtcggccat

SEQ ID NO: 416076 - DNA, 140 bp, Artificial Sequence
  Synthetic
atggccgactcccaagtacgggtttgccattttgttgcactaccactaaggccagaaattggagtgacggtacctgtgacttatgggcctggggataattgcagcaggacaataacttttggagacccagcatggcgtat

SEQ ID NO: 416077 - DNA, 140 bp, Artificial Sequence
  Synthetic
aggccctggctgctgatatgccgtcactccaatttctggccttagtggtagtgcaacaaaatggcaaaccccagagaaacagtaccaccaggaaacagtggcgaagagactatcggagaggaccttttgggacagcggtg

SEQ ID NO: 416078 - DNA, 140 bp, Artificial Sequence
  Synthetic
caccgctgtcccaaaaggtcctctccgatagtctcttcgccactgtttcctggtggtactgtttctctggggtttgccattttgttgcactaccactaaggccagaaattggagtgacggcatatcagcagccagggcct

SEQ ID NO: 416079 - DNA, 140 bp, Artificial Sequence
  Synthetic
atacgccatgctgggtctccgaatcacctgccccgggagctcattttccaggtgtggcaaaggtcctggagatactggcatgatgaacaaggaatgtcacaaagttacacaaaatatagacgtacttgggagtcggccat

SEQ ID NO: 416080 - DNA, 140 bp, Artificial Sequence
  Synthetic
atggccgactcccaagtacgtctatattttgtgtaactttgtgacattccttgttcatcatgccagtatctccaggacctttgccacacctggaaaatgagctcccggggcaggtgattcggagacccagcatggcgtat

SEQ ID NO: 416081 - DNA, 140 bp, Artificial Sequence
  Synthetic
aggccctggctgctgatatggatactggcatgatgaacaaggaatgtcacaaagttacacaaaatatagatacttgtgcttaatgcagaaagctatgtacacacatttcatgaaagggtggaccttttgggacagcggtg

SEQ ID NO: 416082 - DNA, 140 bp, Artificial Sequence
  Synthetic
caccgctgtcccaaaaggtccaccctttcatgaaatgtgtgtacatagctttctgcattaagcacaagtatctatattttgtgtaactttgtgacattccttgttcatcatgccagtatccatatcagcagccagggcct

SEQ ID NO: 416083 - DNA, 140 bp, Artificial Sequence
  Synthetic
atacgccatgctgggtctcccccctcctccccctccaggtctagtctaatgactgaagcaccaacagagtttcccccggccggaatgggaccccaccagggagccagggatgagtgggtacgtacttgggagtcggccat

SEQ ID NO: 416084 - DNA, 140 bp, Artificial Sequence
  Synthetic
atggccgactcccaagtacgtacccactcatccctggctccctggtggggtcccattccggccgggggaaactctgttggtgcttcagtcattagactagacctggagggggaggaggggggagacccagcatggcgtat

SEQ ID NO: 416085 - DNA, 140 bp, Artificial Sequence
  Synthetic
aggccctggctgctgatatgttcccccggccggaatgggaccccaccagggagccagggatgagtgggtaatagaagtcctgagagaaataaaagaagaagctttaaggcattttgacccgaccttttgggacagcggtg

SEQ ID NO: 416086 - DNA, 140 bp, Artificial Sequence
  Synthetic
caccgctgtcccaaaaggtcgggtcaaaatgccttaaagcttcttcttttatttctctcaggacttctattacccactcatccctggctccctggtggggtcccattccggccgggggaacatatcagcagccagggcct

SEQ ID NO: 416087 - DNA, 140 bp, Artificial Sequence
  Synthetic
atacgccatgctgggtctcccccttgaaagagccagggagctcattaatgccctacaacgagccctcttcatgcacttcagagcaggatgtggccgttcaagagttggccaaacaaggggcgtacttgggagtcggccat

SEQ ID NO: 416088 - DNA, 140 bp, Artificial Sequence
  Synthetic
atggccgactcccaagtacgccccttgtttggccaactcttgaacggccacatcctgctctgaagtgcatgaagagggctcgttgtagggcattaatgagctccctggctctttcaagggggagacccagcatggcgtat

SEQ ID NO: 416089 - DNA, 140 bp, Artificial Sequence
  Synthetic
aggccctggctgctgatatgatgcacttcagagcaggatgtggccgttcaagagttggccaaacaaggggaagaaatcctctctcagctataccgacccctagaaacatgcaataacacagaccttttgggacagcggtg

SEQ ID NO: 416090 - DNA, 140 bp, Artificial Sequence
  Synthetic
caccgctgtcccaaaaggtctgtgttattgcatgtttctaggggtcggtatagctgagagaggatttcttccccttgtttggccaactcttgaacggccacatcctgctctgaagtgcatcatatcagcagccagggcct

SEQ ID NO: 416091 - DNA, 140 bp, Artificial Sequence
  Synthetic
atacgccatgctgggtctccgggactcgggatatggtatgaccgaaagggcaggcgaagaagatctccaaagaaaattaaggctcattcgtcttctgcatcagacaagtgagtatgatgtcgtacttgggagtcggccat

SEQ ID NO: 416092 - DNA, 140 bp, Artificial Sequence
  Synthetic
atggccgactcccaagtacgacatcatactcacttgtctgatgcagaagacgaatgagccttaattttctttggagatcttcttcgcctgccctttcggtcataccatatcccgagtcccggagacccagcatggcgtat

SEQ ID NO: 416093 - DNA, 140 bp, Artificial Sequence
  Synthetic
aggccctggctgctgatatgagaaaattaaggctcattcgtcttctgcatcagacaagtgagtatgatgtctagtagaaatcagctgcttgttactatcttactagctagtgcttgcttagaccttttgggacagcggtg

SEQ ID NO: 416094 - DNA, 140 bp, Artificial Sequence
  Synthetic
caccgctgtcccaaaaggtctaagcaagcactagctagtaagatagtaacaagcagctgatttctactagacatcatactcacttgtctgatgcagaagacgaatgagccttaattttctcatatcagcagccagggcct

SEQ ID NO: 416095 - DNA, 140 bp, Artificial Sequence
  Synthetic
atacgccatgctgggtctccaaatgcatccattcccctcttttgtgcaaccaaaaatagagatacttggggaaccatacagtgcttaccagacaatgatgattatcaggaaatagctttgcgtacttgggagtcggccat

SEQ ID NO: 416096 - DNA, 140 bp, Artificial Sequence
  Synthetic
atggccgactcccaagtacgcaaagctatttcctgataatcatcattgtctggtaagcactgtatggttccccaagtatctctatttttggttgcacaaaagaggggaatggatgcatttggagacccagcatggcgtat

SEQ ID NO: 416097 - DNA, 140 bp, Artificial Sequence
  Synthetic
aggccctggctgctgatatggaaccatacagtgcttaccagacaatgatgattatcaggaaatagctttgaatgtgacagaggctttcgatgcatgggataatacagtaacagaacaagcgaccttttgggacagcggtg

SEQ ID NO: 416098 - DNA, 140 bp, Artificial Sequence
  Synthetic
caccgctgtcccaaaaggtcgcttgttctgttactgtattatcccatgcatcgaaagcctctgtcacattcaaagctatttcctgataatcatcattgtctggtaagcactgtatggttccatatcagcagccagggcct

SEQ ID NO: 416099 - DNA, 140 bp, Artificial Sequence
  Synthetic
atacgccatgctgggtctccagttaacacctttatgtatagcaatgaagtgtagcaacataagcacagagagcacaaccacatccccgagcccagggagcacactcaaacccctgataaacgtacttgggagtcggccat

SEQ ID NO: 416100 - DNA, 140 bp, Artificial Sequence
  Synthetic
atggccgactcccaagtacgtttatcaggggtttgagtgtgctccctgggctcggggatgtggttgtgctctctgtgcttatgttgctacacttcattgctatacataaaggtgttaactggagacccagcatggcgtat

SEQ ID NO: 416101 - DNA, 140 bp, Artificial Sequence
  Synthetic
aggccctggctgctgatatgagcacaaccacatccccgagcccagggagcacactcaaacccctgataaatgagagcgatccatgcataaaggcagacaactgccccaggggactagggggaccttttgggacagcggtg

SEQ ID NO: 416102 - DNA, 140 bp, Artificial Sequence
  Synthetic
caccgctgtcccaaaaggtccccctagtcccctggggcagttgtctgcctttatgcatggatcgctctcatttatcaggggtttgagtgtgctccctgggctcggggatgtggttgtgctcatatcagcagccagggcct

SEQ ID NO: 416103 - DNA, 140 bp, Artificial Sequence
  Synthetic
atacgccatgctgggtctccaagccaaaacagtataatgaaacatggtactcaaaagatgtggtttgtgaaccatttaacaccaccacaaaccagaccaggtgttacatgaaccattgcacgtacttgggagtcggccat

SEQ ID NO: 416104 - DNA, 140 bp, Artificial Sequence
  Synthetic
atggccgactcccaagtacgtgcaatggttcatgtaacacctggtctggtttgtggtggtgttaaatggttcacaaaccacatcttttgagtaccatgtttcattatactgttttggcttggagacccagcatggcgtat

SEQ ID NO: 416105 - DNA, 140 bp, Artificial Sequence
  Synthetic
aggccctggctgctgatatgaccatttaacaccaccacaaaccagaccaggtgttacatgaaccattgcaacacatcagtcatcacagagtcatgtgataagcactattgggatgctatagaccttttgggacagcggtg

SEQ ID NO: 416106 - DNA, 140 bp, Artificial Sequence
  Synthetic
caccgctgtcccaaaaggtctatagcatcccaatagtgcttatcacatgactctgtgatgactgatgtgttgcaatggttcatgtaacacctggtctggtttgtggtggtgttaaatggtcatatcagcagccagggcct

SEQ ID NO: 416107 - DNA, 140 bp, Artificial Sequence
  Synthetic
atacgccatgctgggtctcctatcaattattcaggctttgcacccaattgctctaaagtagtagctgctacatgcacaaggatgatggagacgcaaacttctacttggtttggctttaatcgtacttgggagtcggccat

SEQ ID NO: 416108 - DNA, 140 bp, Artificial Sequence
  Synthetic
atggccgactcccaagtacgattaaagccaaaccaagtagaagtttgcgtctccatcatccttgtgcatgtagcagctactactttagagcaattgggtgcaaagcctgaataattgataggagacccagcatggcgtat

SEQ ID NO: 416109 - DNA, 140 bp, Artificial Sequence
  Synthetic
aggccctggctgctgatatgcatgcacaaggatgatggagacgcaaacttctacttggtttggctttaatggcactagggcagaaaatagaacatatatctattggcatggtagagataagaccttttgggacagcggtg

SEQ ID NO: 416110 - DNA, 140 bp, Artificial Sequence
  Synthetic
caccgctgtcccaaaaggtcttatctctaccatgccaatagatatatgttctattttctgccctagtgccattaaagccaaaccaagtagaagtttgcgtctccatcatccttgtgcatgcatatcagcagccagggcct

SEQ ID NO: 416111 - DNA, 140 bp, Artificial Sequence
  Synthetic
atacgccatgctgggtctccagaggccaggaaataagacagttgtaccaataacacttatgtcagggttaatatttcactcccagccaatcaataaaagacccagacaagcatggtgctgcgtacttgggagtcggccat

SEQ ID NO: 416112 - DNA, 140 bp, Artificial Sequence
  Synthetic
atggccgactcccaagtacgcagcaccatgcttgtctgggtcttttattgattggctgggagtgaaatattaaccctgacataagtgttattggtacaactgtcttatttcctggcctctggagacccagcatggcgtat

SEQ ID NO: 416113 - DNA, 140 bp, Artificial Sequence
  Synthetic
aggccctggctgctgatatgatatttcactcccagccaatcaataaaagacccagacaagcatggtgctggttcaaaggcgaatggaggaaagccatgcaggaggtgaaggaaacccttggaccttttgggacagcggtg

SEQ ID NO: 416114 - DNA, 140 bp, Artificial Sequence
  Synthetic
caccgctgtcccaaaaggtccaagggtttccttcacctcctgcatggctttcctccattcgcctttgaaccagcaccatgcttgtctgggtcttttattgattggctgggagtgaaatatcatatcagcagccagggcct

SEQ ID NO: 416115 - DNA, 140 bp, Artificial Sequence
  Synthetic
atacgccatgctgggtctccacaaaaccaggaagaggctcagatgcagaagtggtatatatgtggactaactgcagaggagaatttctccattgcaacatgacttggttcctcaattgggcgtacttgggagtcggccat

SEQ ID NO: 416116 - DNA, 140 bp, Artificial Sequence
  Synthetic
atggccgactcccaagtacgcccaattgaggaaccaagtcatgttgcaatggagaaattctcctctgcagttagtccacatatataccacttctgcatctgagcctcttcctggttttgtggagacccagcatggcgtat

SEQ ID NO: 416117 - DNA, 140 bp, Artificial Sequence
  Synthetic
aggccctggctgctgatatgctgcagaggagaatttctccattgcaacatgacttggttcctcaattgggtggaaaacaaaacgggtcaggaacagcacaattatgcaccgtgccatatagaccttttgggacagcggtg

SEQ ID NO: 416118 - DNA, 140 bp, Artificial Sequence
  Synthetic
caccgctgtcccaaaaggtctatatggcacggtgcataattgtgctgttcctgacccgttttgttttccacccaattgaggaaccaagtcatgttgcaatggagaaattctcctctgcagcatatcagcagccagggcct

SEQ ID NO: 416119 - DNA, 140 bp, Artificial Sequence
  Synthetic
atacgccatgctgggtctcctcctagggaaggagagttgacctgcaactcaacagtaaccagcttgattgctaacattgacacggatggcaaccagacaaatattacctttagtgcagagcgtacttgggagtcggccat

SEQ ID NO: 416120 - DNA, 140 bp, Artificial Sequence
  Synthetic
atggccgactcccaagtacgctctgcactaaaggtaatatttgtctggttgccatccgtgtcaatgttagcaatcaagctggttactgttgagttgcaggtcaactctccttccctaggaggagacccagcatggcgtat

SEQ ID NO: 416121 - DNA, 140 bp, Artificial Sequence
  Synthetic
aggccctggctgctgatatgctaacattgacacggatggcaaccagacaaatattacctttagtgcagaggtggcagaactataccgattagaattgggggattataaattagtagagatgaccttttgggacagcggtg

SEQ ID NO: 416122 - DNA, 140 bp, Artificial Sequence
  Synthetic
caccgctgtcccaaaaggtcatctctactaatttataatcccccaattctaatcggtatagttctgccacctctgcactaaaggtaatatttgtctggttgccatccgtgtcaatgttagcatatcagcagccagggcct

SEQ ID NO: 416123 - DNA, 140 bp, Artificial Sequence
  Synthetic
atacgccatgctgggtctcccaaggaggaataaaagaggtgtgttcgtgctagggttcttaggttttctcgcgacagcaggttctgcaatgggcacggcagctttaacgctgtctgctcacgtacttgggagtcggccat

SEQ ID NO: 416124 - DNA, 140 bp, Artificial Sequence
  Synthetic
atggccgactcccaagtacgtgagcagacagcgttaaagctgccgtgcccattgcagaacctgctgtcgcgagaaaacctaagaaccctagcacgaacacacctcttttattcctccttgggagacccagcatggcgtat

SEQ ID NO: 416125 - DNA, 140 bp, Artificial Sequence
  Synthetic
aggccctggctgctgatatggcgacagcaggttctgcaatgggcacggcagctttaacgctgtctgctcagtctcggactttattggccgggatagtgcagcaacagcaacagctgttgggaccttttgggacagcggtg

SEQ ID NO: 416126 - DNA, 140 bp, Artificial Sequence
  Synthetic
caccgctgtcccaaaaggtcccaacagctgttgctgttgctgcactatcccggccaataaagtccgagactgagcagacagcgttaaagctgccgtgcccattgcagaacctgctgtcgccatatcagcagccagggcct

SEQ ID NO: 416127 - DNA, 140 bp, Artificial Sequence
  Synthetic
atacgccatgctgggtctccaaaaatctccaggcaagagtcactgctatcgagaaatacttaaaggaccaggcgcggctaaattcatggggatgtgcatttagacaagtctgccacactacgtacttgggagtcggccat

SEQ ID NO: 416128 - DNA, 140 bp, Artificial Sequence
  Synthetic
atggccgactcccaagtacgtagtgtggcagacttgtctaaatgcacatccccatgaatttagccgcgcctggtcctttaagtatttctcgatagcagtgactcttgcctggagatttttggagacccagcatggcgtat

SEQ ID NO: 416129 - DNA, 140 bp, Artificial Sequence
  Synthetic
aggccctggctgctgatatgggcgcggctaaattcatggggatgtgcatttagacaagtctgccacactactgtaccatgggtaaataactccttaaaacctgattgggacaacatgacggaccttttgggacagcggtg

SEQ ID NO: 416130 - DNA, 140 bp, Artificial Sequence
  Synthetic
caccgctgtcccaaaaggtccgtcatgttgtcccaatcaggttttaaggagttatttacccatggtacagtagtgtggcagacttgtctaaatgcacatccccatgaatttagccgcgcccatatcagcagccagggcct

SEQ ID NO: 416131 - DNA, 140 bp, Artificial Sequence
  Synthetic
atacgccatgctgggtctccacagttagaacgggcacaaattcagcaagaaaagaatacgtatgaactacaaaaattaaatagctgggatgtttttaccaactggcttgacttaaccgcccgtacttgggagtcggccat

SEQ ID NO: 416132 - DNA, 140 bp, Artificial Sequence
  Synthetic
atggccgactcccaagtacgggcggttaagtcaagccagttggtaaaaacatcccagctatttaatttttgtagttcatacgtattcttttcttgctgaatttgtgcccgttctaactgtggagacccagcatggcgtat

SEQ ID NO: 416133 - DNA, 140 bp, Artificial Sequence
  Synthetic
aggccctggctgctgatatgaaaaattaaatagctgggatgtttttaccaactggcttgacttaaccgcctgggtcaagtatattcaatatggagtttatataatagtaggaatagtagcgaccttttgggacagcggtg

SEQ ID NO: 416134 - DNA, 140 bp, Artificial Sequence
  Synthetic
caccgctgtcccaaaaggtcgctactattcctactattatataaactccatattgaatatacttgacccaggcggttaagtcaagccagttggtaaaaacatcccagctatttaatttttcatatcagcagccagggcct

SEQ ID NO: 416135 - DNA, 140 bp, Artificial Sequence
  Synthetic
atacgccatgctgggtctccgctataggcctgttttctcctcccctcccggttacatccaacagatccatatccacaaggaccaggaacagccaaccagaggagaaacagaagaagacgtcgtacttgggagtcggccat

SEQ ID NO: 416136 - DNA, 140 bp, Artificial Sequence
  Synthetic
atggccgactcccaagtacgacgtcttcttctgtttctcctctggttggctgttcctggtccttgtggatatggatctgttggatgtaaccgggaggggaggagaaaacaggcctatagcggagacccagcatggcgtat

SEQ ID NO: 416137 - DNA, 140 bp, Artificial Sequence
  Synthetic
aggccctggctgctgatatgatccacaaggaccaggaacagccaaccagaggagaaacagaagaagacgttggagacaacgttggggacagattgtggccctggccgatcgcatatttacgaccttttgggacagcggtg

SEQ ID NO: 416138 - DNA, 140 bp, Artificial Sequence
  Synthetic
caccgctgtcccaaaaggtcgtaaatatgcgatcggccagggccacaatctgtccccaacgttgtctccaacgtcttcttctgtttctcctctggttggctgttcctggtccttgtggatcatatcagcagccagggcct

SEQ ID NO: 416139 - DNA, 140 bp, Artificial Sequence
  Synthetic
atacgccatgctgggtctcctgcagggacttactatccaggatctccccgatcctccaaccgatcttccggagtcttcagagagcgctgacaacaatcagggactggctgagacttaaagcgtacttgggagtcggccat

SEQ ID NO: 416140 - DNA, 140 bp, Artificial Sequence
  Synthetic
atggccgactcccaagtacgctttaagtctcagccagtccctgattgttgtcagcgctctctgaagactccggaagatcggttggaggatcggggagatcctggatagtaagtccctgcaggagacccagcatggcgtat

SEQ ID NO: 416141 - DNA, 140 bp, Artificial Sequence
  Synthetic
aggccctggctgctgatatggagtcttcagagagcgctgacaacaatcagggactggctgagacttaaagcagcctacctgcagtatgggtgcgagtggatccaagaagcgttccgggccgaccttttgggacagcggtg

SEQ ID NO: 416142 - DNA, 140 bp, Artificial Sequence
  Synthetic
caccgctgtcccaaaaggtcggcccggaacgcttcttggatccactcgcacccatactgcaggtaggctgctttaagtctcagccagtccctgattgttgtcagcgctctctgaagactccatatcagcagccagggcct

SEQ ID NO: 416143 - DNA, 140 bp, Artificial Sequence
  Synthetic
atacgccatgctgggtctccgggggcagtgcagtgggtcgggaggaggatactcgcagtcccaaggaggatcaggcagggggcagaaattgccctcctgtgaaggacagcggtatcagcacgtacttgggagtcggccat

SEQ ID NO: 416144 - DNA, 140 bp, Artificial Sequence
  Synthetic
atggccgactcccaagtacgtgctgataccgctgtccttcacaggagggcaatttctgccccctgcctgatcctccttgggactgcgagtatcctcctcccgacccactgcactgcccccggagacccagcatggcgtat

SEQ ID NO: 416145 - DNA, 140 bp, Artificial Sequence
  Synthetic
atacgccatgctgggtctccaagaattgtacaagcaacagaatatggatgatgtagatttagatgatgatgatagcctagtaggggtctctgtcacaccaagagtacaattaagaacaatcgtacttgggagtcggccat

SEQ ID NO: 416146 - DNA, 140 bp, Artificial Sequence
  Synthetic
atggccgactcccaagtacgattgttcttaattgtactcttggtgtgacagagacccctactaggctatcatcatcatctaaatctacatcatccatattctgttgcttgtacaattcttggagacccagcatggcgtat

SEQ ID NO: 416147 - DNA, 140 bp, Artificial Sequence
  Synthetic
aggccctggctgctgatatggatagcctagtaggggtctctgtcacaccaagagtacaattaagaacaatgacatacaaattggcagtagatatgtcacatttaataaaagaaagggggggaccttttgggacagcggtg

SEQ ID NO: 416148 - DNA, 140 bp, Artificial Sequence
  Synthetic
caccgctgtcccaaaaggtccccccctttcttttattaaatgtgacatatctactgccaatttgtatgtcattgttcttaattgtactcttggtgtgacagagacccctactaggctatccatatcagcagccagggcct

SEQ ID NO: 416149 - DNA, 140 bp, Artificial Sequence
  Synthetic
atacgccatgctgggtctccggttggcgcccgaacagggacttgaagaagactgaaaagccttggaacacggctgagtgagggcagtaagggcggcaggaacaaaccacgacggagtgctcgtacttgggagtcggccat

SEQ ID NO: 416150 - DNA, 140 bp, Artificial Sequence
  Synthetic
atggccgactcccaagtacgagcactccgtcgtggtttgttcctgccgcccttactgccctcactcagccgtgttccaaggcttttcagtcttcttcaagtccctgttcgggcgccaaccggagacccagcatggcgtat

SEQ ID NO: 416151 - DNA, 140 bp, Artificial Sequence
  Synthetic
aggccctggctgctgatatgggctgagtgagggcagtaagggcggcaggaacaaaccacgacggagtgctccagtaaaggcgcaggccgaggtaccaaaggcggcgtgtggagcgggagtgaccttttgggacagcggtg

SEQ ID NO: 416152 - DNA, 140 bp, Artificial Sequence
  Synthetic
caccgctgtcccaaaaggtcactcccgctccacacgccgcctttggtacctcggcctgcgcctttactggagcactccgtcgtggtttgttcctgccgcccttactgccctcactcagcccatatcagcagccagggcct

SEQ ID NO: 416153 - DNA, 140 bp, Artificial Sequence
  Synthetic
atacgccatgctgggtctccgttaggttacggcccggcggaaagaaaaaatacaagttaaaacatattgtgtgggcagcgaatgaattggacagattcggattggcagagagcctgttggcgtacttgggagtcggccat

SEQ ID NO: 416154 - DNA, 140 bp, Artificial Sequence
  Synthetic
atggccgactcccaagtacgccaacaggctctctgccaatccgaatctgtccaattcattcgctgcccacacaatatgttttaacttgtattttttctttccgccgggccgtaacctaacggagacccagcatggcgtat

SEQ ID NO: 416155 - DNA, 140 bp, Artificial Sequence
  Synthetic
aggccctggctgctgatatgatggtgcatacacgcagaagagaaagtgaaagatactgaagaagcaaaaagaatagcactgagacatctagcggcagaaacaggaactgcagagaaaatggaccttttgggacagcggtg

SEQ ID NO: 416156 - DNA, 140 bp, Artificial Sequence
  Synthetic
caccgctgtcccaaaaggtccattttctctgcagttcctgtttctgccgctagatgtctcagtgctattctttttgcttcttcagtatctttcactttctcttctgcgtgtatgcaccatcatatcagcagccagggcct

SEQ ID NO: 416157 - DNA, 140 bp, Artificial Sequence
  Synthetic
atacgccatgctgggtctccccccgtgcaaagcataggcggcaactatactcatgtgccgctaagtccccgaactctaaatgcttgggtaaaattagtagaggaaaagaagttcggggcacgtacttgggagtcggccat

SEQ ID NO: 416158 - DNA, 140 bp, Artificial Sequence
  Synthetic
atggccgactcccaagtacgtgccccgaacttcttttcctctactaattttacccaagcatttagagttcggggacttagcggcacatgagtatagttgccgcctatgctttgcacggggggagacccagcatggcgtat

SEQ ID NO: 416159 - DNA, 140 bp, Artificial Sequence
  Synthetic
aggccctggctgctgatatggaactctaaatgcttgggtaaaattagtagaggaaaagaagttcggggcagaagtagtgccaggatttcaggcactctcagaaggctgcacgccctatgagaccttttgggacagcggtg

SEQ ID NO: 416160 - DNA, 140 bp, Artificial Sequence
  Synthetic
caccgctgtcccaaaaggtctcatagggcgtgcagccttctgagagtgcctgaaatcctggcactacttctgccccgaacttcttttcctctactaattttacccaagcatttagagttccatatcagcagccagggcct

SEQ ID NO: 416161 - DNA, 140 bp, Artificial Sequence
  Synthetic
atacgccatgctgggtctcctaatcagggagattattaatgaagaagcagcagactgggatgccaatcatccaataccaggccccttaccagcggggcagctcagagacccaagagggtccgtacttgggagtcggccat

SEQ ID NO: 416162 - DNA, 140 bp, Artificial Sequence
  Synthetic
atggccgactcccaagtacggaccctcttgggtctctgagctgccccgctggtaaggggcctggtattggatgattggcatcccagtctgctgcttcttcattaataatctccctgattaggagacccagcatggcgtat

SEQ ID NO: 416163 - DNA, 140 bp, Artificial Sequence
  Synthetic
aggccctggctgctgatatgccaataccaggccccttaccagcggggcagctcagagacccaagagggtctgacatagcaggaacaacaagcacagtagaagaacagatccaatggatgtgaccttttgggacagcggtg

SEQ ID NO: 416164 - DNA, 140 bp, Artificial Sequence
  Synthetic
caccgctgtcccaaaaggtcacatccattggatctgttcttctactgtgcttgttgttcctgctatgtcagaccctcttgggtctctgagctgccccgctggtaaggggcctggtattggcatatcagcagccagggcct

SEQ ID NO: 416165 - DNA, 140 bp, Artificial Sequence
  Synthetic
atacgccatgctgggtctcccagatagggctgcagaagtgtgtcaggatgtacaacccgaccaacatcctagacataaaacagggaccaaaggagtcattccaaagctatgtagatagatcgtacttgggagtcggccat

SEQ ID NO: 416166 - DNA, 140 bp, Artificial Sequence
  Synthetic
atggccgactcccaagtacgatctatctacatagctttggaatgactcctttggtccctgttttatgtctaggatgttggtcgggttgtacatcctgacacacttctgcagccctatctgggagacccagcatggcgtat

SEQ ID NO: 416167 - DNA, 140 bp, Artificial Sequence
  Synthetic
aggccctggctgctgatatgagacataaaacagggaccaaaggagtcattccaaagctatgtagatagattctacaaaagcttgagggcagaacaaacagatccagcagtaaaaaattgggaccttttgggacagcggtg

SEQ ID NO: 416168 - DNA, 140 bp, Artificial Sequence
  Synthetic
caccgctgtcccaaaaggtcccaattttttactgctggatctgtttgttctgccctcaagcttttgtagaatctatctacatagctttggaatgactcctttggtccctgttttatgtctcatatcagcagccagggcct

SEQ ID NO: 416169 - DNA, 140 bp, Artificial Sequence
  Synthetic
atacgccatgctgggtctccactaaagggattagggatgaatcctaccttagaagagatgctaactgcctgtcaaggagtaggtggaccaggccagaaagctagactaatggcagaagcccgtacttgggagtcggccat

SEQ ID NO: 416170 - DNA, 140 bp, Artificial Sequence
  Synthetic
atggccgactcccaagtacgggcttctgccattagtctagctttctggcctggtccacctactccttgacaggcagttagcatctcttctaaggtaggattcatccctaatccctttagtggagacccagcatggcgtat

SEQ ID NO: 416171 - DNA, 140 bp, Artificial Sequence
  Synthetic
aggccctggctgctgatatggtcaaggagtaggtggaccaggccagaaagctagactaatggcagaagccttaaaggaggccatgggaccaccccctatcccattcgcagcagcccagcagaccttttgggacagcggtg

SEQ ID NO: 416172 - DNA, 140 bp, Artificial Sequence
  Synthetic
caccgctgtcccaaaaggtctgctgggctgctgcgaatgggatagggggtggtcccatggcctcctttaaggcttctgccattagtctagctttctggcctggtccacctactccttgaccatatcagcagccagggcct

SEQ ID NO: 416173 - DNA, 140 bp, Artificial Sequence
  Synthetic
atacgccatgctgggtctccgacaatgccgagcacctagaaggcagggctgctggaagtgtggcaagccaggacacatcatgacaaattgccctgatagacaggcgggttttttagggatcgtacttgggagtcggccat

SEQ ID NO: 416174 - DNA, 140 bp, Artificial Sequence
  Synthetic
atggccgactcccaagtacgatccctaaaaaacccgcctgtctatcagggcaatttgtcatgatgtgtcctggcttgccacacttccagcagccctgccttctaggtgctcggcattgtcggagacccagcatggcgtat

SEQ ID NO: 416175 - DNA, 140 bp, Artificial Sequence
  Synthetic
aggccctggctgctgatatgggacacatcatgacaaattgccctgatagacaggcgggttttttagggattggcccctggggaaagaagccccgcaatttccccgtggcccaagttccacgaccttttgggacagcggtg

SEQ ID NO: 416176 - DNA, 140 bp, Artificial Sequence
  Synthetic
caccgctgtcccaaaaggtcgtggaacttgggccacggggaaattgcggggcttctttccccaggggccaatccctaaaaaacccgcctgtctatcagggcaatttgtcatgatgtgtcccatatcagcagccagggcct

SEQ ID NO: 416177 - DNA, 140 bp, Artificial Sequence
  Synthetic
atacgccatgctgggtctccgagaaatatatgcagcaagggaaaaggcagagggagcagagacagagaccatacaaagaggtgacagaggacttactgcacctcgaacaaggagaggccccgtacttgggagtcggccat

SEQ ID NO: 416178 - DNA, 140 bp, Artificial Sequence
  Synthetic
atggccgactcccaagtacggggcctctccttgttcgaggtgcagtaagtcctctgtcacctctttgtatggtctctgtctctgctccctctgccttttcccttgctgcatatatttctcggagacccagcatggcgtat

SEQ ID NO: 416179 - DNA, 140 bp, Artificial Sequence
  Synthetic
aggccctggctgctgatatgatacaaagaggtgacagaggacttactgcacctcgaacaaggagaggccccatgcagggagacaacagaggacttgctgcacctcaattctctctttggagaccttttgggacagcggtg

SEQ ID NO: 416180 - DNA, 140 bp, Artificial Sequence
  Synthetic
caccgctgtcccaaaaggtctccaaagagagaattgaggtgcagcaagtcctctgttgtctccctgcatggggcctctccttgttcgaggtgcagtaagtcctctgtcacctctttgtatcatatcagcagccagggcct

SEQ ID NO: 416181 - DNA, 140 bp, Artificial Sequence
  Synthetic
atacgccatgctgggtctccttagacacaggggctgatgactcaatagtagcaggaatagaattagggagcaattatagcccaaaaatagtggggggaataggaggattcataaataccacgtacttgggagtcggccat

SEQ ID NO: 416182 - DNA, 140 bp, Artificial Sequence
  Synthetic
atggccgactcccaagtacgtggtatttatgaatcctcctattccccccactatttttgggctataattgctccctaattctattcctgctactattgagtcatcagcccctgtgtctaaggagacccagcatggcgtat

SEQ ID NO: 416183 - DNA, 140 bp, Artificial Sequence
  Synthetic
aggccctggctgctgatatgcaattatagcccaaaaatagtggggggaataggaggattcataaataccaaagaatataaaaatgtggaaatagaagttctaggtaaaagggtaagggccgaccttttgggacagcggtg

SEQ ID NO: 416184 - DNA, 140 bp, Artificial Sequence
  Synthetic
caccgctgtcccaaaaggtcggcccttacccttttacctagaacttctatttccacatttttatattctttggtatttatgaatcctcctattccccccactatttttgggctataattgcatatcagcagccagggcct

SEQ ID NO: 416185 - DNA, 140 bp, Artificial Sequence
  Synthetic
atacgccatgctgggtctccgacagccttaggcatgtcattaaatctaccagtcgccaagatagaaccaataaaaataatgctaaagccaggaaaagatggaccaagattgagacaatggcgtacttgggagtcggccat

SEQ ID NO: 416186 - DNA, 140 bp, Artificial Sequence
  Synthetic
atggccgactcccaagtacgccattgtctcaatcttggtccatcttttcctggctttagcattatttttattggttctatcttggcgactggtagatttaatgacatgcctaaggctgtcggagacccagcatggcgtat

SEQ ID NO: 416187 - DNA, 140 bp, Artificial Sequence
  Synthetic
aggccctggctgctgatatgtaaaaataatgctaaagccaggaaaagatggaccaagattgagacaatggcccttgacaaaagaaaaaatagaagcactaaaagagatctgtgaaaaaatgaccttttgggacagcggtg

SEQ ID NO: 416188 - DNA, 140 bp, Artificial Sequence
  Synthetic
caccgctgtcccaaaaggtcattttttcacagatctcttttagtgcttctattttttcttttgtcaagggccattgtctcaatcttggtccatcttttcctggctttagcattatttttacatatcagcagccagggcct

SEQ ID NO: 416189 - DNA, 140 bp, Artificial Sequence
  Synthetic
atacgccatgctgggtctcccccccacatttgcaatcaggaaaaaggacaagaacaaatggaggatgctaatagattttagagagctaaacaaagtaacccaagatttcacagaaatccacgtacttgggagtcggccat

SEQ ID NO: 416190 - DNA, 140 bp, Artificial Sequence
  Synthetic
atggccgactcccaagtacgtggatttctgtgaaatcttgggttactttgtttagctctctaaaatctattagcatcctccatttgttcttgtcctttttcctgattgcaaatgtgggggggagacccagcatggcgtat

SEQ ID NO: 416191 - DNA, 140 bp, Artificial Sequence
  Synthetic
aggccctggctgctgatatgatagattttagagagctaaacaaagtaacccaagatttcacagaaatccagttaggaattccacacccagcaggattagccaaaaagagaagaattactggaccttttgggacagcggtg

SEQ ID NO: 416192 - DNA, 140 bp, Artificial Sequence
  Synthetic
caccgctgtcccaaaaggtccagtaattcttctctttttggctaatcctgctgggtgtggaattcctaactggatttctgtgaaatcttgggttactttgtttagctctctaaaatctatcatatcagcagccagggcct

SEQ ID NO: 416193 - DNA, 140 bp, Artificial Sequence
  Synthetic
atacgccatgctgggtctccagacagtacactgcatttactctaccatcagtgaacaatgcagaaccaggaaaaagatacatatataaagtcttaccgcaggggtggaaaggatcaccagcgtacttgggagtcggccat

SEQ ID NO: 416194 - DNA, 140 bp, Artificial Sequence
  Synthetic
atggccgactcccaagtacgctggtgatcctttccacccctgcggtaagactttatatatgtatctttttcctggttctgcattgttcactgatggtagagtaaatgcagtgtactgtctggagacccagcatggcgtat

SEQ ID NO: 416195 - DNA, 140 bp, Artificial Sequence
  Synthetic
aggccctggctgctgatatgaaaaagatacatatataaagtcttaccgcaggggtggaaaggatcaccagcaatttttcagtacacaatgaggcaggtcttagagccattcagaaaagcagaccttttgggacagcggtg

SEQ ID NO: 416196 - DNA, 140 bp, Artificial Sequence
  Synthetic
caccgctgtcccaaaaggtctgcttttctgaatggctctaagacctgcctcattgtgtactgaaaaattgctggtgatcctttccacccctgcggtaagactttatatatgtatctttttcatatcagcagccagggcct

SEQ ID NO: 416197 - DNA, 140 bp, Artificial Sequence
  Synthetic
atacgccatgctgggtctcctgacaggacagacttagaacatgacaaagtggttctgcagctaaaggaacttctaaataacctaggattctctaccccagatgagaagttccaaaaagaccgtacttgggagtcggccat

SEQ ID NO: 416198 - DNA, 140 bp, Artificial Sequence
  Synthetic
atggccgactcccaagtacggtctttttggaacttctcatctggggtagagaatcctaggttatttagaagttcctttagctgcagaaccactttgtcatgttctaagtctgtcctgtcaggagacccagcatggcgtat

SEQ ID NO: 416199 - DNA, 140 bp, Artificial Sequence
  Synthetic
aggccctggctgctgatatgttctaaataacctaggattctctaccccagatgagaagttccaaaaagaccctccataccgctggatgggctatgaactgtggccaactaaatggaagttgaccttttgggacagcggtg

SEQ ID NO: 416200 - DNA, 140 bp, Artificial Sequence
  Synthetic
caccgctgtcccaaaaggtcaacttccatttagttggccacagttcatagcccatccagcggtatggagggtctttttggaacttctcatctggggtagagaatcctaggttatttagaacatatcagcagccagggcct

SEQ ID NO: 416201 - DNA, 140 bp, Artificial Sequence
  Synthetic
atacgccatgctgggtctccaaaagctagtaggtgtcctaaattgggcagcacaaatctacccagggataaagaccaaacacttgtgtagattaattagaggaaaaatgacactcacagacgtacttgggagtcggccat

SEQ ID NO: 416202 - DNA, 140 bp, Artificial Sequence
  Synthetic
atggccgactcccaagtacgtctgtgagtgtcatttttcctctaattaatctacacaagtgtttggtctttatccctgggtagatttgtgctgcccaatttaggacacctactagcttttggagacccagcatggcgtat

SEQ ID NO: 416203 - DNA, 140 bp, Artificial Sequence
  Synthetic
aggccctggctgctgatatgaagaccaaacacttgtgtagattaattagaggaaaaatgacactcacagaagaggtacaatggacagaattagcagaagcagaactagaagaaaacagaagaccttttgggacagcggtg

SEQ ID NO: 416204 - DNA, 140 bp, Artificial Sequence
  Synthetic
caccgctgtcccaaaaggtcttctgttttcttctagttctgcttctgctaattctgtccattgtacctcttctgtgagtgtcatttttcctctaattaatctacacaagtgtttggtcttcatatcagcagccagggcct

SEQ ID NO: 416205 - DNA, 140 bp, Artificial Sequence
  Synthetic
atacgccatgctgggtctccttagaagcaacagttcaaaaggatcaagacaatcagtggacatataagatacaccaggaagaaaaaattctaaaagtaggaaaatatgcaaaaataaaaccgtacttgggagtcggccat

SEQ ID NO: 416206 - DNA, 140 bp, Artificial Sequence
  Synthetic
atggccgactcccaagtacggttttatttttgcatattttcctacttttagaattttttcttcctggtgtatcttatatgtccactgattgtcttgatccttttgaactgttgcttctaaggagacccagcatggcgtat

SEQ ID NO: 416207 - DNA, 140 bp, Artificial Sequence
  Synthetic
aggccctggctgctgatatgacaccaggaagaaaaaattctaaaagtaggaaaatatgcaaaaataaaacatacccataccaatggagtcaaattattagcacaggtagttcaaaaaatagaccttttgggacagcggtg

SEQ ID NO: 416208 - DNA, 140 bp, Artificial Sequence
  Synthetic
caccgctgtcccaaaaggtctattttttgaactacctgtgctaataatttgactccattggtatgggtatgttttatttttgcatattttcctacttttagaattttttcttcctggtgtcatatcagcagccagggcct

SEQ ID NO: 416209 - DNA, 140 bp, Artificial Sequence
  Synthetic
atacgccatgctgggtctccagtagagagagaggtctgggagcagtggtgggataactactggcaggtgacatggatcccagactgggacttcgtatctaccccaccactggtcagactacgtacttgggagtcggccat

SEQ ID NO: 416210 - DNA, 140 bp, Artificial Sequence
  Synthetic
atggccgactcccaagtacgtagtctgaccagtggtggggtagatacgaagtcccagtctgggatccatgtcacctgccagtagttatcccaccactgctcccagacctctctctctactggagacccagcatggcgtat

SEQ ID NO: 416211 - DNA, 140 bp, Artificial Sequence
  Synthetic
aggccctggctgctgatatgcatggatcccagactgggacttcgtatctaccccaccactggtcagactagcatttaacttagtaggggatcctataccaggcacagagaccttctacacgaccttttgggacagcggtg

SEQ ID NO: 416212 - DNA, 140 bp, Artificial Sequence
  Synthetic
caccgctgtcccaaaaggtcgtgtagaaggtctctgtgcctggtataggatcccctactaagttaaatgctagtctgaccagtggtggggtagatacgaagtcccagtctgggatccatgcatatcagcagccagggcct

SEQ ID NO: 416213 - DNA, 140 bp, Artificial Sequence
  Synthetic
atacgccatgctgggtctcccagatagaggaagagacaaggtaaaaatactagagcaaactaccaatcagcaagcagagttagaagcctttgcgatggcactaacagactcaggtccaaacgtacttgggagtcggccat

SEQ ID NO: 416214 - DNA, 140 bp, Artificial Sequence
  Synthetic
atggccgactcccaagtacgtttggacctgagtctgttagtgccatcgcaaaggcttctaactctgcttgctgattggtagtttgctctagtatttttaccttgtctcttcctctatctgggagacccagcatggcgtat

SEQ ID NO: 416215 - DNA, 140 bp, Artificial Sequence
  Synthetic
aggccctggctgctgatatgcaagcagagttagaagcctttgcgatggcactaacagactcaggtccaaaagctaatattatagtagactcacagtatgtaatgggaatagtggcaggccgaccttttgggacagcggtg

SEQ ID NO: 416216 - DNA, 140 bp, Artificial Sequence
  Synthetic
caccgctgtcccaaaaggtcggcctgccactattcccattacatactgtgagtctactataatattagcttttggacctgagtctgttagtgccatcgcaaaggcttctaactctgcttgcatatcagcagccagggcct

SEQ ID NO: 416217 - DNA, 140 bp, Artificial Sequence
  Synthetic
atacgccatgctgggtctccataaaaaaggaagcaatctatgttgcatgggtcccagcccataaaggcatagggggaaaccaggaagtagatcatttagtgagtcaaggcatcagacaagcgtacttgggagtcggccat

SEQ ID NO: 416218 - DNA, 140 bp, Artificial Sequence
  Synthetic
atggccgactcccaagtacgcttgtctgatgccttgactcactaaatgatctacttcctggtttccccctatgcctttatgggctgggacccatgcaacatagattgcttccttttttatggagacccagcatggcgtat

SEQ ID NO: 416219 - DNA, 140 bp, Artificial Sequence
  Synthetic
aggccctggctgctgatatgagggggaaaccaggaagtagatcatttagtgagtcaaggcatcagacaagtactgttcctagaaaagatagagcctgctcaggaagaacatgaaaaatatgaccttttgggacagcggtg

SEQ ID NO: 416220 - DNA, 140 bp, Artificial Sequence
  Synthetic
caccgctgtcccaaaaggtcatatttttcatgttcttcctgagcaggctctatcttttctaggaacagtacttgtctgatgccttgactcactaaatgatctacttcctggtttccccctcatatcagcagccagggcct

SEQ ID NO: 416221 - DNA, 140 bp, Artificial Sequence
  Synthetic
atacgccatgctgggtctccggcaagacaaatagtaaacacatgtgcccaatatcaacagaaaggggaggctatacatgggcaagtaaatgcagaagtgggcacctggcaaatggactgccgtacttgggagtcggccat

SEQ ID NO: 416222 - DNA, 140 bp, Artificial Sequence
  Synthetic
atggccgactcccaagtacggcagtccatttgccaggtgcccacttctgcatttacttgcccatgtatagcctcccctttctgttgatattgggcacatgtgtttactatttgtcttgccggagacccagcatggcgtat

SEQ ID NO: 416223 - DNA, 140 bp, Artificial Sequence
  Synthetic
aggccctggctgctgatatgctatacatgggcaagtaaatgcagaagtgggcacctggcaaatggactgcacacatctagagggaaaaatcatcatagtagcagtacatgttgcaagtgggaccttttgggacagcggtg

SEQ ID NO: 416224 - DNA, 140 bp, Artificial Sequence
  Synthetic
caccgctgtcccaaaaggtcccacttgcaacatgtactgctactatgatgatttttccctctagatgtgtgcagtccatttgccaggtgcccacttctgcatttacttgcccatgtatagcatatcagcagccagggcct

SEQ ID NO: 416225 - DNA, 140 bp, Artificial Sequence
  Synthetic
atacgccatgctgggtctcctcttcctattaaaattggctagcaggtggccaataacacacttacacacagataatggtgccaacttcacttcacaggaagtaaagatggtagcatggtgcgtacttgggagtcggccat

SEQ ID NO: 416226 - DNA, 140 bp, Artificial Sequence
  Synthetic
atggccgactcccaagtacgcaccatgctaccatctttacttcctgtgaagtgaagttggcaccattatctgtgtgtaagtgtgttattggccacctgctagccaattttaataggaagaggagacccagcatggcgtat

SEQ ID NO: 416227 - DNA, 140 bp, Artificial Sequence
  Synthetic
atacgccatgctgggtctccgagtagtagaagcaatgaatcaccacctaaaaaatcagataagtagaattagagaacaggcaaatacagtagaaacaatagtactaatggcagttcattgcgtacttgggagtcggccat

SEQ ID NO: 416228 - DNA, 140 bp, Artificial Sequence
  Synthetic
atggccgactcccaagtacgcaatgaactgccattagtactattgtttctactgtatttgcctgttctctaattctacttatctgattttttaggtggtgattcattgcttctactactcggagacccagcatggcgtat

SEQ ID NO: 416229 - DNA, 140 bp, Artificial Sequence
  Synthetic
atacgccatgctgggtctccaagatcatcagagactatggaggaaggcaagagctggatagcagttcccacctggagggtgccagggagaatggagaagtggcatagccttgtcaagtatcgtacttgggagtcggccat

SEQ ID NO: 416230 - DNA, 140 bp, Artificial Sequence
  Synthetic
atggccgactcccaagtacgatacttgacaaggctatgccacttctccattctccctggcaccctccaggtgggaactgctatccagctcttgccttcctccatagtctctgatgatcttggagacccagcatggcgtat

SEQ ID NO: 416231 - DNA, 140 bp, Artificial Sequence
  Synthetic
aggccctggctgctgatatgcctggagggtgccagggagaatggagaagtggcatagccttgtcaagtatctaaaatacaaaacaggagatctagaacaggtgtgctatgttccccaccagaccttttgggacagcggtg

SEQ ID NO: 416232 - DNA, 140 bp, Artificial Sequence
  Synthetic
caccgctgtcccaaaaggtctggtggggaacatagcacacctgttctagatctcctgttttgtattttagatacttgacaaggctatgccacttctccattctccctggcaccctccaggcatatcagcagccagggcct

SEQ ID NO: 416233 - DNA, 140 bp, Artificial Sequence
  Synthetic
atacgccatgctgggtctccgaggagacagtcgtctagagatacaggcatattggaacttaacaccagaaaaaggatggctctcctcttatgcagtaagaatgacttggtacacagaaaacgtacttgggagtcggccat

SEQ ID NO: 416234 - DNA, 140 bp, Artificial Sequence
  Synthetic
atggccgactcccaagtacgttttctgtgtaccaagtcattcttactgcataagaggagagccatcctttttctggtgttaagttccaatatgcctgtatctctagacgactgtctcctcggagacccagcatggcgtat

SEQ ID NO: 416235 - DNA, 140 bp, Artificial Sequence
  Synthetic
aggccctggctgctgatatgaaaggatggctctcctcttatgcagtaagaatgacttggtacacagaaaagttctggacagatgtcaccccagactgtgcagacaccctaatacatagtagaccttttgggacagcggtg

SEQ ID NO: 416236 - DNA, 140 bp, Artificial Sequence
  Synthetic
caccgctgtcccaaaaggtctactatgtattagggtgtctgcacagtctggggtgacatctgtccagaacttttctgtgtaccaagtcattcttactgcataagaggagagccatcctttcatatcagcagccagggcct

SEQ ID NO: 416237 - DNA, 140 bp, Artificial Sequence
  Synthetic
atacgccatgctgggtctccgaaaagttattgtcctgctgcaaatatccccgagcccatagatcccaggtaccatcacttcaatttctggccttagtggtagtgcaacaaaatgacagaccgtacttgggagtcggccat

SEQ ID NO: 416238 - DNA, 140 bp, Artificial Sequence
  Synthetic
atggccgactcccaagtacggtctgtcattttgttgcactaccactaaggccagaaattgaagtgatggtacctgggatctatgggctcggggatatttgcagcaggacaataacttttcggagacccagcatggcgtat

SEQ ID NO: 416239 - DNA, 140 bp, Artificial Sequence
  Synthetic
aggccctggctgctgatatgaccatcacttcaatttctggccttagtggtagtgcaacaaaatgacagaccccagagagaccgtaccaccaggaaacagtggcgaagagactatcgaagagaccttttgggacagcggtg

SEQ ID NO: 416240 - DNA, 140 bp, Artificial Sequence
  Synthetic
caccgctgtcccaaaaggtctcttcgatagtctcttcgccactgtttcctggtggtacggtctctctggggtctgtcattttgttgcactaccactaaggccagaaattgaagtgatggtcatatcagcagccagggcct

SEQ ID NO: 416241 - DNA, 140 bp, Artificial Sequence
  Synthetic
atacgccatgctgggtctcctgaatcacctgccccgggagcttattttccaggtgtggcaaaggtcctggagatactggcatgatgaacaagggatgtcacaaagttacaccaagtatagcgtacttgggagtcggccat

SEQ ID NO: 416242 - DNA, 140 bp, Artificial Sequence
  Synthetic
atggccgactcccaagtacgctatacttggtgtaactttgtgacatcccttgttcatcatgccagtatctccaggacctttgccacacctggaaaataagctcccggggcaggtgattcaggagacccagcatggcgtat

SEQ ID NO: 416243 - DNA, 140 bp, Artificial Sequence
  Synthetic
aggccctggctgctgatatgagatactggcatgatgaacaagggatgtcacaaagttacaccaagtatagatatttgtgcttaatgcagaaagcagtgttcatacattttaagagagggtgaccttttgggacagcggtg

SEQ ID NO: 416244 - DNA, 140 bp, Artificial Sequence
  Synthetic
caccgctgtcccaaaaggtcaccctctcttaaaatgtatgaacactgctttctgcattaagcacaaatatctatacttggtgtaactttgtgacatcccttgttcatcatgccagtatctcatatcagcagccagggcct

SEQ ID NO: 416245 - DNA, 140 bp, Artificial Sequence
  Synthetic
atacgccatgctgggtctccccccctcctccccctccagggttagtctaatgactgaagcaccaacagagctccctccagaggatgggaccccaccgagggagccaggggatgaatgggtcgtacttgggagtcggccat

SEQ ID NO: 416246 - DNA, 140 bp, Artificial Sequence
  Synthetic
atggccgactcccaagtacgacccattcatcccctggctccctcggtggggtcccatcctctggagggagctctgttggtgcttcagtcattagactaaccctggagggggaggagggggggagacccagcatggcgtat

SEQ ID NO: 416247 - DNA, 140 bp, Artificial Sequence
  Synthetic
aggccctggctgctgatatgctccctccagaggatgggaccccaccgagggagccaggggatgaatgggtaatagaaatcctgagagacataaaagaagaagccctaaagcactttgaccgaccttttgggacagcggtg

SEQ ID NO: 416248 - DNA, 140 bp, Artificial Sequence
  Synthetic
caccgctgtcccaaaaggtcggtcaaagtgctttagggcttcttcttttatgtctctcaggatttctattacccattcatcccctggctccctcggtggggtcccatcctctggagggagcatatcagcagccagggcct

SEQ ID NO: 416249 - DNA, 140 bp, Artificial Sequence
  Synthetic
atacgccatgctgggtctccacccttgaaagagccagagagctcattagggtcctgcaacgagccctcttcacgcacttcagggcaggatgcaaccactcaagaattggccaaactagggcgtacttgggagtcggccat

SEQ ID NO: 416250 - DNA, 140 bp, Artificial Sequence
  Synthetic
atggccgactcccaagtacgccctagtttggccaattcttgagtggttgcatcctgccctgaagtgcgtgaagagggctcgttgcaggaccctaatgagctctctggctctttcaagggtggagacccagcatggcgtat

SEQ ID NO: 416251 - DNA, 140 bp, Artificial Sequence
  Synthetic
aggccctggctgctgatatgcacgcacttcagggcaggatgcaaccactcaagaattggccaaactaggggaggaaatcctctctcagctataccaacccctagaagaatgtgataactcgaccttttgggacagcggtg

SEQ ID NO: 416252 - DNA, 140 bp, Artificial Sequence
  Synthetic
caccgctgtcccaaaaggtcgagttatcacattcttctaggggttggtatagctgagagaggatttcctcccctagtttggccaattcttgagtggttgcatcctgccctgaagtgcgtgcatatcagcagccagggcct

SEQ ID NO: 416253 - DNA, 140 bp, Artificial Sequence
  Synthetic
atacgccatgctgggtctccaggggctcgggatatgttatgaccgaaagggcagacgaagaaggactccaaagaaagctaaggctcattcgtcttctgcatcagacaagtgagtatggagcgtacttgggagtcggccat

SEQ ID NO: 416254 - DNA, 140 bp, Artificial Sequence
  Synthetic
atggccgactcccaagtacgctccatactcacttgtctgatgcagaagacgaatgagccttagctttctttggagtccttcttcgtctgccctttcggtcataacatatcccgagcccctggagacccagcatggcgtat

SEQ ID NO: 416255 - DNA, 140 bp, Artificial Sequence
  Synthetic
aggccctggctgctgatatgaagaaagctaaggctcattcgtcttctgcatcagacaagtgagtatggagcgtggcagaaatcagctgcttattgccattctactagctagtgcttgcttgaccttttgggacagcggtg

SEQ ID NO: 416256 - DNA, 140 bp, Artificial Sequence
  Synthetic
caccgctgtcccaaaaggtcaagcaagcactagctagtagaatggcaataagcagctgatttctgccacgctccatactcacttgtctgatgcagaagacgaatgagccttagctttcttcatatcagcagccagggcct

SEQ ID NO: 416257 - DNA, 140 bp, Artificial Sequence
  Synthetic
atacgccatgctgggtctccggaaaaatgcatccattcccctcttttgtgcaactaaaaatagggatacttggggaactatacagtgcttaccagacaatgatgattatcaggagatacccgtacttgggagtcggccat

SEQ ID NO: 416258 - DNA, 140 bp, Artificial Sequence
  Synthetic
atggccgactcccaagtacgggtatctcctgataatcatcattgtctggtaagcactgtatagttccccaagtatccctatttttagttgcacaaaagaggggaatggatgcatttttccggagacccagcatggcgtat

SEQ ID NO: 416259 - DNA, 140 bp, Artificial Sequence
  Synthetic
aggccctggctgctgatatgtggggaactatacagtgcttaccagacaatgatgattatcaggagatacctttaaatgtgacagaggctttcgatgcatgggataatacaataacagaacgaccttttgggacagcggtg

SEQ ID NO: 416260 - DNA, 140 bp, Artificial Sequence
  Synthetic
caccgctgtcccaaaaggtcgttctgttattgtattatcccatgcatcgaaagcctctgtcacatttaaaggtatctcctgataatcatcattgtctggtaagcactgtatagttccccacatatcagcagccagggcct

SEQ ID NO: 416261 - DNA, 140 bp, Artificial Sequence
  Synthetic
atacgccatgctgggtctccgtcaaattaacacctttatgtgtagcaatgaaatgtaacataagtacaagtgacacaactatgataaggacaaccacacccagcacagctaaagaggcaccgtacttgggagtcggccat

SEQ ID NO: 416262 - DNA, 140 bp, Artificial Sequence
  Synthetic
atggccgactcccaagtacggtgcctctttagctgtgctgggtgtggttgtccttatcatagttgtgtcacttgtacttatgttacatttcattgctacacataaaggtgttaatttgacggagacccagcatggcgtat

SEQ ID NO: 416263 - DNA, 140 bp, Artificial Sequence
  Synthetic
aggccctggctgctgatatgtgacacaactatgataaggacaaccacacccagcacagctaaagaggcaccaataagtgacaattctccttgcatacgcacaaacaactgctcaggattagaccttttgggacagcggtg

SEQ ID NO: 416264 - DNA, 140 bp, Artificial Sequence
  Synthetic
caccgctgtcccaaaaggtctaatcctgagcagttgtttgtgcgtatgcaaggagaattgtcacttattggtgcctctttagctgtgctgggtgtggttgtccttatcatagttgtgtcacatatcagcagccagggcct

SEQ ID NO: 416265 - DNA, 140 bp, Artificial Sequence
  Synthetic
atacgccatgctgggtctccagataagaaaaaacagtacaatgaaacatggtactcaagcgatgtggtttgtgataatagcacagatcagaccacaaatgagaccacgtgttacatgaaccgtacttgggagtcggccat

SEQ ID NO: 416266 - DNA, 140 bp, Artificial Sequence
  Synthetic
atggccgactcccaagtacggttcatgtaacacgtggtctcatttgtggtctgatctgtgctattatcacaaaccacatcgcttgagtaccatgtttcattgtactgttttttcttatctggagacccagcatggcgtat

SEQ ID NO: 416267 - DNA, 140 bp, Artificial Sequence
  Synthetic
aggccctggctgctgatatggtgataatagcacagatcagaccacaaatgagaccacgtgttacatgaaccattgcaacacatcagtcatcacagagtcatgtgataagcactattgggagaccttttgggacagcggtg

SEQ ID NO: 416268 - DNA, 140 bp, Artificial Sequence
  Synthetic
caccgctgtcccaaaaggtctcccaatagtgcttatcacatgactctgtgatgactgatgtgttgcaatggttcatgtaacacgtggtctcatttgtggtctgatctgtgctattatcaccatatcagcagccagggcct

SEQ ID NO: 416269 - DNA, 140 bp, Artificial Sequence
  Synthetic
atacgccatgctgggtctccgcaatgataccaagtactcaggctttgcacccaactgttctaaggtagtagcttctacatgcaccagaatgatggaaacgcagacttctacgtggtttggcgtacttgggagtcggccat

SEQ ID NO: 416270 - DNA, 140 bp, Artificial Sequence
  Synthetic
atggccgactcccaagtacgccaaaccacgtagaagtctgcgtttccatcattctggtgcatgtagaagctactaccttagaacagttgggtgcaaagcctgagtacttggtatcattgcggagacccagcatggcgtat

SEQ ID NO: 416271 - DNA, 140 bp, Artificial Sequence
  Synthetic
aggccctggctgctgatatggcttctacatgcaccagaatgatggaaacgcagacttctacgtggtttggctttaatggcaccagagcagagaatagaacatatatctattggcatggtagaccttttgggacagcggtg

SEQ ID NO: 416272 - DNA, 140 bp, Artificial Sequence
  Synthetic
caccgctgtcccaaaaggtctaccatgccaatagatatatgttctattctctgctctggtgccattaaagccaaaccacgtagaagtctgcgtttccatcattctggtgcatgtagaagccatatcagcagccagggcct

SEQ ID NO: 416273 - DNA, 140 bp, Artificial Sequence
  Synthetic
atacgccatgctgggtctcctattgtaggaggccaggaaataagacagtggtgccaataacacttatgtcagggcaaagatttcactcccggccaatcattaataaaaggcccaggcaagcgtacttgggagtcggccat

SEQ ID NO: 416274 - DNA, 140 bp, Artificial Sequence
  Synthetic
atggccgactcccaagtacgcttgcctgggccttttattaatgattggccgggagtgaaatctttgccctgacataagtgttattggcaccactgtcttatttcctggcctcctacaataggagacccagcatggcgtat

SEQ ID NO: 416275 - DNA, 140 bp, Artificial Sequence
  Synthetic
aggccctggctgctgatatgagggcaaagatttcactcccggccaatcattaataaaaggcccaggcaagcatggtgctggttcaaaggcaactggacagaagccatgcaggaggtaaaggaccttttgggacagcggtg

SEQ ID NO: 416276 - DNA, 140 bp, Artificial Sequence
  Synthetic
caccgctgtcccaaaaggtcctttacctcctgcatggcttctgtccagttgcctttgaaccagcaccatgcttgcctgggccttttattaatgattggccgggagtgaaatctttgccctcatatcagcagccagggcct

SEQ ID NO: 416277 - DNA, 140 bp, Artificial Sequence
  Synthetic
atacgccatgctgggtctcctattaccttcaaagcaccagaaagaggttcagacccagaagtgacatacatgtggtctaactgcagaggagaatttttctactgcaacatgacctggttccgtacttgggagtcggccat

SEQ ID NO: 416278 - DNA, 140 bp, Artificial Sequence
  Synthetic
atggccgactcccaagtacggaaccaggtcatgttgcagtagaaaaattctcctctgcagttagaccacatgtatgtcacttctgggtctgaacctctttctggtgctttgaaggtaataggagacccagcatggcgtat

SEQ ID NO: 416279 - DNA, 140 bp, Artificial Sequence
  Synthetic
aggccctggctgctgatatgtgtggtctaactgcagaggagaatttttctactgcaacatgacctggttcctcaattgggtagaaaataaacctaatacgacaaagcgcaattatgcaccgaccttttgggacagcggtg

SEQ ID NO: 416280 - DNA, 140 bp, Artificial Sequence
  Synthetic
caccgctgtcccaaaaggtcggtgcataattgcgctttgtcgtattaggtttattttctacccaattgaggaaccaggtcatgttgcagtagaaaaattctcctctgcagttagaccacacatatcagcagccagggcct

SEQ ID NO: 416281 - DNA, 140 bp, Artificial Sequence
  Synthetic
atacgccatgctgggtctcctatatttgcctcccagggaaggggagttgacctgcaactcaacagtgaccagcataattgctaacattgacgagagggataatcagacaacaaatattaccgtacttgggagtcggccat

SEQ ID NO: 416282 - DNA, 140 bp, Artificial Sequence
  Synthetic
atggccgactcccaagtacggtaatatttgttgtctgattatccctctcgtcaatgttagcaattatgctggtcactgttgagttgcaggtcaactccccttccctgggaggcaaatataggagacccagcatggcgtat

SEQ ID NO: 416283 - DNA, 140 bp, Artificial Sequence
  Synthetic
aggccctggctgctgatatgagcataattgctaacattgacgagagggataatcagacaacaaatattacctttagtgcagatgtggcagaactgtaccgattggaattgggggattatagaccttttgggacagcggtg

SEQ ID NO: 416284 - DNA, 140 bp, Artificial Sequence
  Synthetic
caccgctgtcccaaaaggtctataatcccccaattccaatcggtacagttctgccacatctgcactaaaggtaatatttgttgtctgattatccctctcgtcaatgttagcaattatgctcatatcagcagccagggcct

SEQ ID NO: 416285 - DNA, 140 bp, Artificial Sequence
  Synthetic
atacgccatgctgggtctcctactcccctgctcacgggagacctaaaagaggtgcgtttgtgctagggttcttgggttttctcacaacagcaggagttgcaatgggcacggcgtccttgacgtacttgggagtcggccat

SEQ ID NO: 416286 - DNA, 140 bp, Artificial Sequence
  Synthetic
atggccgactcccaagtacgtcaaggacgccgtgcccattgcaactcctgctgttgtgagaaaacccaagaaccctagcacaaacgcacctcttttaggtctcccgtgagcaggggagtaggagacccagcatggcgtat

SEQ ID NO: 416287 - DNA, 140 bp, Artificial Sequence
  Synthetic
aggccctggctgctgatatgcttgggttttctcacaacagcaggagttgcaatgggcacggcgtccttgacgctgtcagcccagtctcggactttattggccgggatagtgcagcaacaggaccttttgggacagcggtg

SEQ ID NO: 416288 - DNA, 140 bp, Artificial Sequence
  Synthetic
caccgctgtcccaaaaggtcctgttgctgcactatcccggccaataaagtccgagactgggctgacagcgtcaaggacgccgtgcccattgcaactcctgctgttgtgagaaaacccaagcatatcagcagccagggcct

SEQ ID NO: 416289 - DNA, 140 bp, Artificial Sequence
  Synthetic
atacgccatgctgggtctcccgtctggggaacaaaaattctccaggcaagagtcactgctatagagaagtacctaaaggatcaggcacagctaaattcatggggatgtgcgtttagacaacgtacttgggagtcggccat

SEQ ID NO: 416290 - DNA, 140 bp, Artificial Sequence
  Synthetic
atggccgactcccaagtacgttgtctaaacgcacatccccatgaatttagctgtgcctgatcctttaggtacttctctatagcagtgactcttgcctggagaatttttgttccccagacgggagacccagcatggcgtat

SEQ ID NO: 416291 - DNA, 140 bp, Artificial Sequence
  Synthetic
aggccctggctgctgatatgacctaaaggatcaggcacagctaaattcatggggatgtgcgtttagacaagtctgccacactactgtaccatgggcaaatgagtctttaacacctgattggaccttttgggacagcggtg

SEQ ID NO: 416292 - DNA, 140 bp, Artificial Sequence
  Synthetic
caccgctgtcccaaaaggtccaatcaggtgttaaagactcatttgcccatggtacagtagtgtggcagacttgtctaaacgcacatccccatgaatttagctgtgcctgatcctttaggtcatatcagcagccagggcct

SEQ ID NO: 416293 - DNA, 140 bp, Artificial Sequence
  Synthetic
atacgccatgctgggtctcccaaatatcagtcaaagtttagaagaggcacaacttcagcaagaaaagaatatgtatgaactacaaaaattaaacaactgggatgtttttaccaactggttcgtacttgggagtcggccat

SEQ ID NO: 416294 - DNA, 140 bp, Artificial Sequence
  Synthetic
atggccgactcccaagtacgaaccagttggtaaaaacatcccagttgtttaatttttgtagttcatacatattcttttcttgctgaagttgtgcctcttctaaactttgactgatatttgggagacccagcatggcgtat

SEQ ID NO: 416295 - DNA, 140 bp, Artificial Sequence
  Synthetic
aggccctggctgctgatatgatgtatgaactacaaaaattaaacaactgggatgtttttaccaactggtttgacttaacctcctggatcagctatattcaatatggagtttatatagtaggaccttttgggacagcggtg

SEQ ID NO: 416296 - DNA, 140 bp, Artificial Sequence
  Synthetic
caccgctgtcccaaaaggtcctactatataaactccatattgaatatagctgatccaggaggttaagtcaaaccagttggtaaaaacatcccagttgtttaatttttgtagttcatacatcatatcagcagccagggcct

SEQ ID NO: 416297 - DNA, 140 bp, Artificial Sequence
  Synthetic
atacgccatgctgggtctccaggcttagaaagggctataggcctgttttctcctcctcccccggttatatccaacagatccatatccacaaggacccggaacagccagccagcgaagaaacgtacttgggagtcggccat

SEQ ID NO: 416298 - DNA, 140 bp, Artificial Sequence
  Synthetic
atggccgactcccaagtacgtttcttcgctggctggctgttccgggtccttgtggatatggatctgttggatataaccgggggaggaggagaaaacaggcctatagccctttctaagcctggagacccagcatggcgtat

SEQ ID NO: 416299 - DNA, 140 bp, Artificial Sequence
  Synthetic
aggccctggctgctgatatgccaacagatccatatccacaaggacccggaacagccagccagcgaagaaacagaagaagacgttggaggcaacggtggagacagatcctggccttggcaggaccttttgggacagcggtg

SEQ ID NO: 416300 - DNA, 140 bp, Artificial Sequence
  Synthetic
caccgctgtcccaaaaggtcctgccaaggccaggatctgtctccaccgttgcctccaacgtcttcttctgtttcttcgctggctggctgttccgggtccttgtggatatggatctgttggcatatcagcagccagggcct

SEQ ID NO: 416301 - DNA, 140 bp, Artificial Sequence
  Synthetic
atacgccatgctgggtctccactatacaacatctgcaggaacttactatccaggatcttccagaccctccaacccatcctccagaatctcagagactggctgaggcctaaagtagccttccgtacttgggagtcggccat

SEQ ID NO: 416302 - DNA, 140 bp, Artificial Sequence
  Synthetic
atggccgactcccaagtacggaaggctactttaggcctcagccagtctctgagattctggaggatgggttggagggtctggaagatcctggatagtaagttcctgcagatgttgtatagtggagacccagcatggcgtat

SEQ ID NO: 416303 - DNA, 140 bp, Artificial Sequence
  Synthetic
aggccctggctgctgatatgaacccatcctccagaatctcagagactggctgaggcctaaagtagccttcctgcaatatgggtgcgagtggatccaagaagcgttccaggccgctgcaaggaccttttgggacagcggtg

SEQ ID NO: 416304 - DNA, 140 bp, Artificial Sequence
  Synthetic
caccgctgtcccaaaaggtccttgcagcggcctggaacgcttcttggatccactcgcacccatattgcaggaaggctactttaggcctcagccagtctctgagattctggaggatgggttcatatcagcagccagggcct

SEQ ID NO: 416305 - DNA, 140 bp, Artificial Sequence
  Synthetic
atacgccatgctgggtctcctacaacgcattggaaggggaatccttgcggtcccaagaaggatcagacagggagcagaactcgctctcctgtgagggacagcgatatcagcagggggactcgtacttgggagtcggccat

SEQ ID NO: 416306 - DNA, 140 bp, Artificial Sequence
  Synthetic
atggccgactcccaagtacgagtccccctgctgatatcgctgtccctcacaggagagcgagttctgctccctgtctgatccttcttgggaccgcaaggattccccttccaatgcgttgtaggagacccagcatggcgtat

SEQ ID NO: 416307 - DNA, 140 bp, Artificial Sequence
  Synthetic
atacgccatgctgggtctcctacaggcagcaaaatatggatgatatagattcagatgatgatgacctagtgggggttcctgccacaccaagagtaccactaagaacaatgacatataaatcgtacttgggagtcggccat

SEQ ID NO: 416308 - DNA, 140 bp, Artificial Sequence
  Synthetic
atggccgactcccaagtacgatttatatgtcattgttcttagtggtactcttggtgtggcaggaacccccactaggtcatcatcatctgaatctatatcatccatattttgctgcctgtaggagacccagcatggcgtat

SEQ ID NO: 416309 - DNA, 140 bp, Artificial Sequence
  Synthetic
aggccctggctgctgatatggacctagtgggggttcctgccacaccaagagtaccactaagaacaatgacatataaattggcagtagacatgtcacattttataaaagaaaaagggggacgaccttttgggacagcggtg

SEQ ID NO: 416310 - DNA, 140 bp, Artificial Sequence
  Synthetic
caccgctgtcccaaaaggtcgtccccctttttcttttataaaatgtgacatgtctactgccaatttatatgtcattgttcttagtggtactcttggtgtggcaggaacccccactaggtccatatcagcagccagggcct

SEQ ID NO: 416311 - DNA, 140 bp, Artificial Sequence
  Synthetic
atacgccatgctgggtctcccctagaaaggcgcaggccaaggtaccaaaggcggcgtgtggagcgggagtaaagaggcctccgggtgaaggtaagtacctacaccaaaaaattgtagccacgtacttgggagtcggccat

SEQ ID NO: 416312 - DNA, 140 bp, Artificial Sequence
  Synthetic
atggccgactcccaagtacgtggctacaattttttggtgtaggtacttaccttcacccggaggcctctttactcccgctccacacgccgcctttggtaccttggcctgcgcctttctaggggagacccagcatggcgtat

SEQ ID NO: 416313 - DNA, 140 bp, Artificial Sequence
  Synthetic
atacgccatgctgggtctccggcgcgagaaactccgtcttgaaagggaaaaaagcagacgaattagaaacaattaggttacggcccggcggaaagaaaaaatacaggctaaagcatattgcgtacttgggagtcggccat

SEQ ID NO: 416314 - DNA, 140 bp, Artificial Sequence
  Synthetic
atggccgactcccaagtacgcaatatgctttagcctgtattttttctttccgccgggccgtaacctaattgtttctaattcgtctgcttttttccctttcaagacggagtttctcgcgccggagacccagcatggcgtat

SEQ ID NO: 416315 - DNA, 140 bp, Artificial Sequence
  Synthetic
aggccctggctgctgatatgaattaggttacggcccggcggaaagaaaaaatacaggctaaagcatattgtgtgggcagcgaatgaattggacagattcggattagcagagagcctgttggaccttttgggacagcggtg

SEQ ID NO: 416316 - DNA, 140 bp, Artificial Sequence
  Synthetic
caccgctgtcccaaaaggtccaacaggctctctgctaatccgaatctgtccaattcattcgctgcccacacaatatgctttagcctgtattttttctttccgccgggccgtaacctaattcatatcagcagccagggcct

SEQ ID NO: 416317 - DNA, 140 bp, Artificial Sequence
  Synthetic
atacgccatgctgggtctccaccgacaggttcagaaaatttaaaaagcctttttaatactgtctgcgtcatttggtgcatacacgcagaagagaaagtgaaagatactgaaggagcaaaacgtacttgggagtcggccat

SEQ ID NO: 416318 - DNA, 140 bp, Artificial Sequence
  Synthetic
atggccgactcccaagtacgttttgctccttcagtatctttcactttctcttctgcgtgtatgcaccaaatgacgcagacagtattaaaaaggctttttaaattttctgaacctgtcggtggagacccagcatggcgtat

SEQ ID NO: 416319 - DNA, 140 bp, Artificial Sequence
  Synthetic
aggccctggctgctgatatgtttggtgcatacacgcagaagagaaagtgaaagatactgaaggagcaaaacaaatagtacagagacatctagcggcagaaacaggaactgcagagaaaatgaccttttgggacagcggtg

SEQ ID NO: 416320 - DNA, 140 bp, Artificial Sequence
  Synthetic
caccgctgtcccaaaaggtcattttctctgcagttcctgtttctgccgctagatgtctctgtactatttgttttgctccttcagtatctttcactttctcttctgcgtgtatgcaccaaacatatcagcagccagggcct

SEQ ID NO: 416321 - DNA, 140 bp, Artificial Sequence
  Synthetic
atacgccatgctgggtctcctccccgtacaacaagtaggcggcaattatacccatgtgccgctgagtcctcgaaccctaaatgcttgggtaaaattagtagaggaaaagaagttcggggccgtacttgggagtcggccat

SEQ ID NO: 416322 - DNA, 140 bp, Artificial Sequence
  Synthetic
atggccgactcccaagtacggccccgaacttcttttcctctactaattttacccaagcatttagggttcgaggactcagcggcacatgggtataattgccgcctacttgttgtacggggaggagacccagcatggcgtat

SEQ ID NO: 416323 - DNA, 140 bp, Artificial Sequence
  Synthetic
aggccctggctgctgatatgcgaaccctaaatgcttgggtaaaattagtagaggaaaagaagttcggggcagaggtagtgccaggatttcaggcactctcagaaggctgcacgccctatggaccttttgggacagcggtg

SEQ ID NO: 416324 - DNA, 140 bp, Artificial Sequence
  Synthetic
caccgctgtcccaaaaggtccatagggcgtgcagccttctgagagtgcctgaaatcctggcactacctctgccccgaacttcttttcctctactaattttacccaagcatttagggttcgcatatcagcagccagggcct

SEQ ID NO: 416325 - DNA, 140 bp, Artificial Sequence
  Synthetic
atacgccatgctgggtctccataatcagggagatcattaatgaagaagcagcagattgggatgtgcaacatccaataccaggtcccttaccagcggggcagcttagagaaccaagagggtcgtacttgggagtcggccat

SEQ ID NO: 416326 - DNA, 140 bp, Artificial Sequence
  Synthetic
atggccgactcccaagtacgaccctcttggttctctaagctgccccgctggtaagggacctggtattggatgttgcacatcccaatctgctgcttcttcattaatgatctccctgattatggagacccagcatggcgtat

SEQ ID NO: 416327 - DNA, 140 bp, Artificial Sequence
  Synthetic
aggccctggctgctgatatgtccaataccaggtcccttaccagcggggcagcttagagaaccaagagggtctgacatagcagggacaacaagcacagtagatgaacagatccagtggatggaccttttgggacagcggtg

SEQ ID NO: 416328 - DNA, 140 bp, Artificial Sequence
  Synthetic
caccgctgtcccaaaaggtccatccactggatctgttcatctactgtgcttgttgtccctgctatgtcagaccctcttggttctctaagctgccccgctggtaagggacctggtattggacatatcagcagccagggcct

SEQ ID NO: 416329 - DNA, 140 bp, Artificial Sequence
  Synthetic
atacgccatgctgggtctccccagataggactgcagaagtgcgtcaggatgtacaacccgaccaacatcctagacataaaacaaggaccaaaagaaccattccaaagttatgtagatagacgtacttgggagtcggccat

SEQ ID NO: 416330 - DNA, 140 bp, Artificial Sequence
  Synthetic
atggccgactcccaagtacgtctatctacataactttggaatggttcttttggtccttgttttatgtctaggatgttggtcgggttgtacatcctgacgcacttctgcagtcctatctggggagacccagcatggcgtat

SEQ ID NO: 416331 - DNA, 140 bp, Artificial Sequence
  Synthetic
atacgccatgctgggtctccgatgacccagacactactagtacagaatgccaacccagactgtaaattagtactaaaaggactagggatgaatcctaccttagaagagatgctaaccgcccgtacttgggagtcggccat

SEQ ID NO: 416332 - DNA, 140 bp, Artificial Sequence
  Synthetic
atggccgactcccaagtacgggcggttagcatctcttctaaggtaggattcatccctagtccttttagtactaatttacagtctgggttggcattctgtactagtagtgtctgggtcatcggagacccagcatggcgtat

SEQ ID NO: 416333 - DNA, 140 bp, Artificial Sequence
  Synthetic
aggccctggctgctgatatgtactaaaaggactagggatgaatcctaccttagaagagatgctaaccgcctgccaaggggtaggtgggccaggccagaaagctagactaatggcagaagcgaccttttgggacagcggtg

SEQ ID NO: 416334 - DNA, 140 bp, Artificial Sequence
  Synthetic
caccgctgtcccaaaaggtcgcttctgccattagtctagctttctggcctggcccacctaccccttggcaggcggttagcatctcttctaaggtaggattcatccctagtccttttagtacatatcagcagccagggcct

SEQ ID NO: 416335 - DNA, 140 bp, Artificial Sequence
  Synthetic
atacgccatgctgggtctcctgccaaggggtaggtgggccaggccagaaagctagactaatggcagaagccttaaaagaggccttgacaccagcccctatcccatttgcagcagcccagccgtacttgggagtcggccat

SEQ ID NO: 416336 - DNA, 140 bp, Artificial Sequence
  Synthetic
atggccgactcccaagtacggctgggctgctgcaaatgggataggggctggtgtcaaggcctcttttaaggcttctgccattagtctagctttctggcctggcccacctaccccttggcaggagacccagcatggcgtat

SEQ ID NO: 416337 - DNA, 140 bp, Artificial Sequence
  Synthetic
atacgccatgctgggtctccagacaatgccgagcacctagaagacagggctgctggaagtgtggtaaaccaggacatgtcatagcaaattgcccagatagacaggtgggttttttagggacgtacttgggagtcggccat

SEQ ID NO: 416338 - DNA, 140 bp, Artificial Sequence
  Synthetic
atggccgactcccaagtacgtccctaaaaaacccacctgtctatctgggcaatttgctatgacatgtcctggtttaccacacttccagcagccctgtcttctaggtgctcggcattgtctggagacccagcatggcgtat

SEQ ID NO: 416339 - DNA, 140 bp, Artificial Sequence
  Synthetic
atacgccatgctgggtctcccaggggctaacaccaacagcacccccagtagatccagcagtggacctactggagaaatatatgcagcaaggaaaaagacaaagagaacagagagagagaccgtacttgggagtcggccat

SEQ ID NO: 416340 - DNA, 140 bp, Artificial Sequence
  Synthetic
atggccgactcccaagtacggtctctctctctgttctctttgtctttttccttgctgcatatatttctccagtaggtccactgctggatctactgggggtgctgttggtgttagcccctgggagacccagcatggcgtat

SEQ ID NO: 416341 - DNA, 140 bp, Artificial Sequence
  Synthetic
aggccctggctgctgatatgggagaaatatatgcagcaaggaaaaagacaaagagaacagagagagagaccatacaaagaagtgacagaggacttactgcacctcgagcagggagaagcagaccttttgggacagcggtg

SEQ ID NO: 416342 - DNA, 140 bp, Artificial Sequence
  Synthetic
caccgctgtcccaaaaggtctgcttctccctgctcgaggtgcagtaagtcctctgtcacttctttgtatggtctctctctctgttctctttgtctttttccttgctgcatatatttctcccatatcagcagccagggcct

SEQ ID NO: 416343 - DNA, 140 bp, Artificial Sequence
  Synthetic
atacgccatgctgggtctccaaaagaccagtagtcacggcatacgttgagggccagccagtagaagttctgctagacacgggggctgacgactcaatagtagcagggatagagttagggacgtacttgggagtcggccat

SEQ ID NO: 416344 - DNA, 140 bp, Artificial Sequence
  Synthetic
atggccgactcccaagtacgtccctaactctatccctgctactattgagtcgtcagcccccgtgtctagcagaacttctactggctggccctcaacgtatgccgtgactactggtcttttggagacccagcatggcgtat

SEQ ID NO: 416345 - DNA, 140 bp, Artificial Sequence
  Synthetic
aggccctggctgctgatatggctagacacgggggctgacgactcaatagtagcagggatagagttagggagcaattatagtccaaagatagtaggaggaattgggggattcataaataccgaccttttgggacagcggtg

SEQ ID NO: 416346 - DNA, 140 bp, Artificial Sequence
  Synthetic
caccgctgtcccaaaaggtcggtatttatgaatcccccaattcctcctactatctttggactataattgctccctaactctatccctgctactattgagtcgtcagcccccgtgtctagccatatcagcagccagggcct

SEQ ID NO: 416347 - DNA, 140 bp, Artificial Sequence
  Synthetic
atacgccatgctgggtctcccaccataatgacaggtgacaccccaatcaacatttttggcagaaatattctgacagccttaggcatgtcattaaatttaccagtcgccaaaatagaaccacgtacttgggagtcggccat

SEQ ID NO: 416348 - DNA, 140 bp, Artificial Sequence
  Synthetic
atggccgactcccaagtacgtggttctattttggcgactggtaaatttaatgacatgcctaaggctgtcagaatatttctgccaaaaatgttgattggggtgtcacctgtcattatggtgggagacccagcatggcgtat

SEQ ID NO: 416349 - DNA, 140 bp, Artificial Sequence
  Synthetic
aggccctggctgctgatatgtgacagccttaggcatgtcattaaatttaccagtcgccaaaatagaaccaataaaaataatgttaaagccaggaaaagatggaccaaaactgaggcaatggaccttttgggacagcggtg

SEQ ID NO: 416350 - DNA, 140 bp, Artificial Sequence
  Synthetic
caccgctgtcccaaaaggtccattgcctcagttttggtccatcttttcctggctttaacattatttttattggttctattttggcgactggtaaatttaatgacatgcctaaggctgtcacatatcagcagccagggcct

SEQ ID NO: 416351 - DNA, 140 bp, Artificial Sequence
  Synthetic
atacgccatgctgggtctcctggaaagagaaggccagctagaggaagcgcctccaactaatccttataacacccccacatttgcaatcaagaaaaaggacaaaaataaatggaggatgctcgtacttgggagtcggccat

SEQ ID NO: 416352 - DNA, 140 bp, Artificial Sequence
  Synthetic
atggccgactcccaagtacgagcatcctccatttatttttgtcctttttcttgattgcaaatgtgggggtgttataaggattagttggaggcgcttcctctagctggccttctctttccaggagacccagcatggcgtat

SEQ ID NO: 416353 - DNA, 140 bp, Artificial Sequence
  Synthetic
aggccctggctgctgatatgacccccacatttgcaatcaagaaaaaggacaaaaataaatggaggatgctaatagattttagagaactaaacaaggtaactcaagatttcacagaaattcgaccttttgggacagcggtg

SEQ ID NO: 416354 - DNA, 140 bp, Artificial Sequence
  Synthetic
caccgctgtcccaaaaggtcgaatttctgtgaaatcttgagttaccttgtttagttctctaaaatctattagcatcctccatttatttttgtcctttttcttgattgcaaatgtgggggtcatatcagcagccagggcct

SEQ ID NO: 416355 - DNA, 140 bp, Artificial Sequence
  Synthetic
atacgccatgctgggtctccgtactagatataggggatgcttacttttccataccactacatgaagactttagacagtatactgcatttactttaccatcaataaacaatgcagaaccagcgtacttgggagtcggccat

SEQ ID NO: 416356 - DNA, 140 bp, Artificial Sequence
  Synthetic
atggccgactcccaagtacgctggttctgcattgtttattgatggtaaagtaaatgcagtatactgtctaaagtcttcatgtagtggtatggaaaagtaagcatcccctatatctagtacggagacccagcatggcgtat

SEQ ID NO: 416357 - DNA, 140 bp, Artificial Sequence
  Synthetic
aggccctggctgctgatatgtagacagtatactgcatttactttaccatcaataaacaatgcagaaccaggaaaaagatatatatataaggtcctgcctcagggatggaagggatcaccagaccttttgggacagcggtg

SEQ ID NO: 416358 - DNA, 140 bp, Artificial Sequence
  Synthetic
caccgctgtcccaaaaggtctggtgatcccttccatccctgaggcaggaccttatatatatatctttttcctggttctgcattgtttattgatggtaaagtaaatgcagtatactgtctacatatcagcagccagggcct

SEQ ID NO: 416359 - DNA, 140 bp, Artificial Sequence
  Synthetic
atacgccatgctgggtctccaaacctagatgtcattatcattcagtacatggatgatatcctaatagctagtgacaggacagatctagaacatgacaaggtggtcctgcagctaaaggaacgtacttgggagtcggccat

SEQ ID NO: 416360 - DNA, 140 bp, Artificial Sequence
  Synthetic
atggccgactcccaagtacgttcctttagctgcaggaccaccttgtcatgttctagatctgtcctgtcactagctattaggatatcatccatgtactgaatgataatgacatctaggtttggagacccagcatggcgtat

SEQ ID NO: 416361 - DNA, 140 bp, Artificial Sequence
  Synthetic
aggccctggctgctgatatggtgacaggacagatctagaacatgacaaggtggtcctgcagctaaaggaacttctaaataacctaggattttctaccccagatgagaagttccaaaaggagaccttttgggacagcggtg

SEQ ID NO: 416362 - DNA, 140 bp, Artificial Sequence
  Synthetic
caccgctgtcccaaaaggtctccttttggaacttctcatctggggtagaaaatcctaggttatttagaagttcctttagctgcaggaccaccttgtcatgttctagatctgtcctgtcaccatatcagcagccagggcct

SEQ ID NO: 416363 - DNA, 140 bp, Artificial Sequence
  Synthetic
atacgccatgctgggtctcctgcagaagatacagttgccccaaaaagatgtatggacagtaaatgacatccaaaagttagtgggtgtcttaaactgggcagcacaaatctacccagggatcgtacttgggagtcggccat

SEQ ID NO: 416364 - DNA, 140 bp, Artificial Sequence
  Synthetic
atggccgactcccaagtacgatccctgggtagatttgtgctgcccagtttaagacacccactaacttttggatgtcatttactgtccatacatctttttggggcaactgtatcttctgcaggagacccagcatggcgtat

SEQ ID NO: 416365 - DNA, 140 bp, Artificial Sequence
  Synthetic
aggccctggctgctgatatgcaaaagttagtgggtgtcttaaactgggcagcacaaatctacccagggataaaaaccagacacttatgtaagctaattagaggaaaaatgacactcacaggaccttttgggacagcggtg

SEQ ID NO: 416366 - DNA, 140 bp, Artificial Sequence
  Synthetic
caccgctgtcccaaaaggtcctgtgagtgtcatttttcctctaattagcttacataagtgtctggtttttatccctgggtagatttgtgctgcccagtttaagacacccactaacttttgcatatcagcagccagggcct

SEQ ID NO: 416367 - DNA, 140 bp, Artificial Sequence
  Synthetic
atacgccatgctgggtctccattatcttaagccaggagcaagagggacactattaccaagaagaaaaagggttagaagcaacagtccaaaaggatcaagacaatcagtggacatataaagcgtacttgggagtcggccat

SEQ ID NO: 416368 - DNA, 140 bp, Artificial Sequence
  Synthetic
atggccgactcccaagtacgctttatatgtccactgattgtcttgatccttttggactgttgcttctaaccctttttcttcttggtaatagtgtccctcttgctcctggcttaagataatggagacccagcatggcgtat

SEQ ID NO: 416369 - DNA, 140 bp, Artificial Sequence
  Synthetic
atacgccatgctgggtctcctacaccagggagagaaaattctaaaagtagggaaatatgcaaagataaaaaatacccataccaatggggtcagattgttagcacaagtagttcaaaagatcgtacttgggagtcggccat

SEQ ID NO: 416370 - DNA, 140 bp, Artificial Sequence
  Synthetic
atggccgactcccaagtacgatcttttgaactacttgtgctaacaatctgaccccattggtatgggtattttttatctttgcatatttccctacttttagaattttctctccctggtgtaggagacccagcatggcgtat

SEQ ID NO: 416371 - DNA, 140 bp, Artificial Sequence
  Synthetic
atacgccatgctgggtctcccagtagaaagagagacctgggaacagtggtgggatgactactggcaggtgacatggatccctgactgggacttcgtatctaccccgccgctggtcagactcgtacttgggagtcggccat

SEQ ID NO: 416372 - DNA, 140 bp, Artificial Sequence
  Synthetic
atggccgactcccaagtacgagtctgaccagcggcggggtagatacgaagtcccagtcagggatccatgtcacctgccagtagtcatcccaccactgttcccaggtctctctttctactgggagacccagcatggcgtat

SEQ ID NO: 416373 - DNA, 140 bp, Artificial Sequence
  Synthetic
aggccctggctgctgatatgacatggatccctgactgggacttcgtatctaccccgccgctggtcagactagcatttaacctggtaaaagatcctataccaagaacagagactttctacagaccttttgggacagcggtg

SEQ ID NO: 416374 - DNA, 140 bp, Artificial Sequence
  Synthetic
caccgctgtcccaaaaggtctgtagaaagtctctgttcttggtataggatcttttaccaggttaaatgctagtctgaccagcggcggggtagatacgaagtcccagtcagggatccatgtcatatcagcagccagggcct

SEQ ID NO: 416375 - DNA, 140 bp, Artificial Sequence
  Synthetic
atacgccatgctgggtctccacagatagagggagagacaaggtaaggatgctagaacaaactaccaatcagcaagcagaattagaagcctttgcaatggcactaacagactcaggtccaacgtacttgggagtcggccat

SEQ ID NO: 416376 - DNA, 140 bp, Artificial Sequence
  Synthetic
atggccgactcccaagtacgttggacctgagtctgttagtgccattgcaaaggcttctaattctgcttgctgattggtagtttgttctagcatccttaccttgtctctccctctatctgtggagacccagcatggcgtat

SEQ ID NO: 416377 - DNA, 140 bp, Artificial Sequence
  Synthetic
aggccctggctgctgatatggcaagcagaattagaagcctttgcaatggcactaacagactcaggtccaaaagccaatattatagtagactcacagtatgtaatggggatagtagcaggcgaccttttgggacagcggtg

SEQ ID NO: 416378 - DNA, 140 bp, Artificial Sequence
  Synthetic
caccgctgtcccaaaaggtcgcctgctactatccccattacatactgtgagtctactataatattggcttttggacctgagtctgttagtgccattgcaaaggcttctaattctgcttgccatatcagcagccagggcct

SEQ ID NO: 416379 - DNA, 140 bp, Artificial Sequence
  Synthetic
atacgccatgctgggtctccgataaaaaaggaagcaatctatgttgcatgggtcccagcccataaaggcataggagggaatcaggaggtagatcagttagtaagtcagggcatcagacaacgtacttgggagtcggccat

SEQ ID NO: 416380 - DNA, 140 bp, Artificial Sequence
  Synthetic
atggccgactcccaagtacgttgtctgatgccctgacttactaactgatctacctcctgattccctcctatgcctttatgggctgggacccatgcaacatagattgcttccttttttatcggagacccagcatggcgtat

SEQ ID NO: 416381 - DNA, 140 bp, Artificial Sequence
  Synthetic
atacgccatgctgggtctccccatagcaatgtaaaagaactatcccataaatttggattgcccaaattagtagcaagacaaatagtaaacacatgtgcccaatgtcaacagaaaggggagcgtacttgggagtcggccat

SEQ ID NO: 416382 - DNA, 140 bp, Artificial Sequence
  Synthetic
atggccgactcccaagtacgctcccctttctgttgacattgggcacatgtgtttactatttgtcttgctactaatttgggcaatccaaatttatgggatagttcttttacattgctatggggagacccagcatggcgtat

SEQ ID NO: 416383 - DNA, 140 bp, Artificial Sequence
  Synthetic
atacgccatgctgggtctccgattcatagaagcagaagtcatcccacaggaatcaggaaggcagacagcactcttcctattaaaactggccagtaggtggccaataacacacttgcacaccgtacttgggagtcggccat

SEQ ID NO: 416384 - DNA, 140 bp, Artificial Sequence
  Synthetic
atggccgactcccaagtacggtgtgcaagtgtgttattggccacctactggccagttttaataggaagagtgctgtctgccttcctgattcctgtgggatgacttctgcttctatgaatcggagacccagcatggcgtat

SEQ ID NO: 416385 - DNA, 140 bp, Artificial Sequence
  Synthetic
atacgccatgctgggtctccctcttcctattaaaactggccagtaggtggccaataacacacttgcacacagataatggtgccaacttcacttcacaggaagtaaaaatggtagcatggtcgtacttgggagtcggccat

SEQ ID NO: 416386 - DNA, 140 bp, Artificial Sequence
  Synthetic
atggccgactcccaagtacgaccatgctaccatttttacttcctgtgaagtgaagttggcaccattatctgtgtgcaagtgtgttattggccacctactggccagttttaataggaagagggagacccagcatggcgtat

SEQ ID NO: 416387 - DNA, 140 bp, Artificial Sequence
  Synthetic
atacgccatgctgggtctccggagtagtagaagcaatgaatcaccacctaaaaaatcagataagtagaattagagaacaggcaaatacagtagaaacaatagtactgatggcaacacactcgtacttgggagtcggccat

SEQ ID NO: 416388 - DNA, 140 bp, Artificial Sequence
  Synthetic
atggccgactcccaagtacgagtgtgttgccatcagtactattgtttctactgtatttgcctgttctctaattctacttatctgattttttaggtggtgattcattgcttctactactccggagacccagcatggcgtat

SEQ ID NO: 416389 - DNA, 140 bp, Artificial Sequence
  Synthetic
aggccctggctgctgatatgcaaaaattcaaaattaaaaaattttcgggtctatttcagagaaggcagagatcagctgtggaaaggacccggggaactactgtggaagggagacggagcagaccttttgggacagcggtg

SEQ ID NO: 416390 - DNA, 140 bp, Artificial Sequence
  Synthetic
caccgctgtcccaaaaggtctgctccgtctcccttccacagtagttccccgggtcctttccacagctgatctctgccttctctgaaatagacccgaaaattttttaattttgaatttttgcatatcagcagccagggcct

SEQ ID NO: 416391 - DNA, 140 bp, Artificial Sequence
  Synthetic
atacgccatgctgggtctcccaagatcatcaaagactatggaggaaggcaagaactggatagtggttcccacttggagggtgccagggaggatggagaaatggcatagccttgtcaaatacgtacttgggagtcggccat

SEQ ID NO: 416392 - DNA, 140 bp, Artificial Sequence
  Synthetic
atggccgactcccaagtacgtatttgacaaggctatgccatttctccatcctccctggcaccctccaagtgggaaccactatccagttcttgccttcctccatagtctttgatgatcttgggagacccagcatggcgtat

SEQ ID NO: 416393 - DNA, 140 bp, Artificial Sequence
  Synthetic
aggccctggctgctgatatgacttggagggtgccagggaggatggagaaatggcatagccttgtcaaatatctaaaatacagaacaaaagatctagaagacgtgtgctatgttccccaccgaccttttgggacagcggtg

SEQ ID NO: 416394 - DNA, 140 bp, Artificial Sequence
  Synthetic
caccgctgtcccaaaaggtcggtggggaacatagcacacgtcttctagatcttttgttctgtattttagatatttgacaaggctatgccatttctccatcctccctggcaccctccaagtcatatcagcagccagggcct

SEQ ID NO: 416395 - DNA, 140 bp, Artificial Sequence
  Synthetic
atacgccatgctgggtctccaagggaaacagtcatctagaaatacaggcatattggaacctaacgccagaaaaaggatggctctcctcttattcagtaagaatgacttggtatacggaaacgtacttgggagtcggccat

SEQ ID NO: 416396 - DNA, 140 bp, Artificial Sequence
  Synthetic
atggccgactcccaagtacgtttccgtataccaagtcattcttactgaataagaggagagccatcctttttctggcgttaggttccaatatgcctgtatttctagatgactgtttcccttggagacccagcatggcgtat

SEQ ID NO: 416397 - DNA, 140 bp, Artificial Sequence
  Synthetic
aggccctggctgctgatatgaaaaggatggctctcctcttattcagtaagaatgacttggtatacggaaaggttctggacagatgttaccccagactgtgcagactccctaatacatagcgaccttttgggacagcggtg

SEQ ID NO: 416398 - DNA, 140 bp, Artificial Sequence
  Synthetic
caccgctgtcccaaaaggtcgctatgtattagggagtctgcacagtctggggtaacatctgtccagaacctttccgtataccaagtcattcttactgaataagaggagagccatccttttcatatcagcagccagggcct

SEQ ID NO: 416399 - DNA, 140 bp, Artificial Sequence
  Synthetic
atacgccatgctgggtctccggaaaagttattgtcctgctgcaattatccccaagcccatagagcccaggtaccgtcactccaatttttggccttagtggtagtgcagcaaaatgacagacgtacttgggagtcggccat

SEQ ID NO: 416400 - DNA, 140 bp, Artificial Sequence
  Synthetic
atggccgactcccaagtacgtctgtcattttgctgcactaccactaaggccaaaaattggagtgacggtacctgggctctatgggcttggggataattgcagcaggacaataacttttccggagacccagcatggcgtat

SEQ ID NO: 416401 - DNA, 140 bp, Artificial Sequence
  Synthetic
aggccctggctgctgatatgtaccgtcactccaatttttggccttagtggtagtgcagcaaaatgacagaccccagagaaacggtacccccaggaaacagtggcgaagagactatcgaaggaccttttgggacagcggtg

SEQ ID NO: 416402 - DNA, 140 bp, Artificial Sequence
  Synthetic
caccgctgtcccaaaaggtccttcgatagtctcttcgccactgtttcctgggggtaccgtttctctggggtctgtcattttgctgcactaccactaaggccaaaaattggagtgacggtacatatcagcagccagggcct

SEQ ID NO: 416403 - DNA, 140 bp, Artificial Sequence
  Synthetic
atacgccatgctgggtctccgtgaatcacctgccccgagagcttattttccaggtgtggcagaggtcctggagatactggcatgatgaacaagggatgtcacaaagttacacaaagtatacgtacttgggagtcggccat

SEQ ID NO: 416404 - DNA, 140 bp, Artificial Sequence
  Synthetic
atggccgactcccaagtacgtatactttgtgtaactttgtgacatcccttgttcatcatgccagtatctccaggacctctgccacacctggaaaataagctctcggggcaggtgattcacggagacccagcatggcgtat

SEQ ID NO: 416405 - DNA, 140 bp, Artificial Sequence
  Synthetic
aggccctggctgctgatatggagatactggcatgatgaacaagggatgtcacaaagttacacaaagtatagatatttgtgcttaatacagaaggctatgttcacacattgtaagagaggggaccttttgggacagcggtg

SEQ ID NO: 416406 - DNA, 140 bp, Artificial Sequence
  Synthetic
caccgctgtcccaaaaggtcccctctcttacaatgtgtgaacatagccttctgtattaagcacaaatatctatactttgtgtaactttgtgacatcccttgttcatcatgccagtatctccatatcagcagccagggcct

SEQ ID NO: 416407 - DNA, 140 bp, Artificial Sequence
  Synthetic
atacgccatgctgggtctcctccccctcctccccctccaggtctagtctaatgactgaagcaccaacagagtttcccccggaggatgggaccccaccgagggaaccaggggatgagtggacgtacttgggagtcggccat

SEQ ID NO: 416408 - DNA, 140 bp, Artificial Sequence
  Synthetic
atggccgactcccaagtacgtccactcatcccctggttccctcggtggggtcccatcctccgggggaaactctgttggtgcttcagtcattagactagacctggagggggaggagggggaggagacccagcatggcgtat

SEQ ID NO: 416409 - DNA, 140 bp, Artificial Sequence
  Synthetic
aggccctggctgctgatatggtttcccccggaggatgggaccccaccgagggaaccaggggatgagtggataatagaaatcctgagaaaaataaagaaagaagctttaaagcattttgacgaccttttgggacagcggtg

SEQ ID NO: 416410 - DNA, 140 bp, Artificial Sequence
  Synthetic
caccgctgtcccaaaaggtcgtcaaaatgctttaaagcttctttctttatttttctcaggatttctattatccactcatcccctggttccctcggtggggtcccatcctccgggggaaaccatatcagcagccagggcct

SEQ ID NO: 416411 - DNA, 140 bp, Artificial Sequence
  Synthetic
atacgccatgctgggtctcccacccttgaaggcgccagagagctcattaatgtcctacaacgagccctcttcatgcacttcagagcgggatgtaggctctcaagaattggccaaacagggcgtacttgggagtcggccat

SEQ ID NO: 416412 - DNA, 140 bp, Artificial Sequence
  Synthetic
atggccgactcccaagtacgccctgtttggccaattcttgagagcctacatcccgctctgaagtgcatgaagagggctcgttgtaggacattaatgagctctctggcgccttcaagggtgggagacccagcatggcgtat

SEQ ID NO: 416413 - DNA, 140 bp, Artificial Sequence
  Synthetic
aggccctggctgctgatatgtcatgcacttcagagcgggatgtaggctctcaagaattggccaaacagggggaagaactcctttcccagctacatcgacccctagaaccatgcaataacagaccttttgggacagcggtg

SEQ ID NO: 416414 - DNA, 140 bp, Artificial Sequence
  Synthetic
caccgctgtcccaaaaggtctgttattgcatggttctaggggtcgatgtagctgggaaaggagttcttccccctgtttggccaattcttgagagcctacatcccgctctgaagtgcatgacatatcagcagccagggcct

SEQ ID NO: 416415 - DNA, 140 bp, Artificial Sequence
  Synthetic
atacgccatgctgggtctccaaggggctcggaatatgttatgaccggaagggcagacgaagaagaactccgaagaaaactaaggctcattcatcttctgcatcagacaagtgagtatgatcgtacttgggagtcggccat

SEQ ID NO: 416416 - DNA, 140 bp, Artificial Sequence
  Synthetic
atggccgactcccaagtacgatcatactcacttgtctgatgcagaagatgaatgagccttagttttcttcggagttcttcttcgtctgcccttccggtcataacatattccgagccccttggagacccagcatggcgtat

SEQ ID NO: 416417 - DNA, 140 bp, Artificial Sequence
  Synthetic
aggccctggctgctgatatggaagaaaactaaggctcattcatcttctgcatcagacaagtgagtatgatgggtggtagaaatcagctgcttgttgccattttgctagctagtacttgctgaccttttgggacagcggtg

SEQ ID NO: 416418 - DNA, 140 bp, Artificial Sequence
  Synthetic
caccgctgtcccaaaaggtcagcaagtactagctagcaaaatggcaacaagcagctgatttctaccacccatcatactcacttgtctgatgcagaagatgaatgagccttagttttcttccatatcagcagccagggcct

SEQ ID NO: 416419 - DNA, 140 bp, Artificial Sequence
  Synthetic
atacgccatgctgggtctccagaaatgcatccattcccctcttttgtgcaaccaagaatagggatacttggggaaccatacagtgcttgccagacaatgatgaatatcaggagataacttcgtacttgggagtcggccat

SEQ ID NO: 416420 - DNA, 140 bp, Artificial Sequence
  Synthetic
atggccgactcccaagtacgaagttatctcctgatattcatcattgtctggcaagcactgtatggttccccaagtatccctattcttggttgcacaaaagaggggaatggatgcatttctggagacccagcatggcgtat

SEQ ID NO: 416421 - DNA, 140 bp, Artificial Sequence
  Synthetic
aggccctggctgctgatatggggaaccatacagtgcttgccagacaatgatgaatatcaggagataactttgaatgtgacagaggctttcgatgcatgggataatacagtaacagaacaagaccttttgggacagcggtg

SEQ ID NO: 416422 - DNA, 140 bp, Artificial Sequence
  Synthetic
caccgctgtcccaaaaggtcttgttctgttactgtattatcccatgcatcgaaagcctctgtcacattcaaagttatctcctgatattcatcattgtctggcaagcactgtatggttccccatatcagcagccagggcct

SEQ ID NO: 416423 - DNA, 140 bp, Artificial Sequence
  Synthetic
atacgccatgctgggtctcccaaattaacgcctttatgtgtagcaatgagatgtaacaacacagatgcaaggaacacaaccacacccacaacagcatccccgcgtacaataaaacccgtgcgtacttgggagtcggccat

SEQ ID NO: 416424 - DNA, 140 bp, Artificial Sequence
  Synthetic
atggccgactcccaagtacgcacgggttttattgtacgcggggatgctgttgtgggtgtggttgtgttccttgcatctgtgttgttacatctcattgctacacataaaggcgttaatttgggagacccagcatggcgtat

SEQ ID NO: 416425 - DNA, 140 bp, Artificial Sequence
  Synthetic
atacgccatgctgggtctccattgggaaaagaagaggtggtcaattgtcaattcaatatgacaggattagagagagataagaaaaagcagtataatgaggcatggtactcgaaggatgtacgtacttgggagtcggccat

SEQ ID NO: 416426 - DNA, 140 bp, Artificial Sequence
  Synthetic
atggccgactcccaagtacgtacatccttcgagtaccatgcctcattatactgctttttcttatctctctctaatcctgtcatattgaattgacaattgaccacctcttcttttcccaatggagacccagcatggcgtat

SEQ ID NO: 416427 - DNA, 140 bp, Artificial Sequence
  Synthetic
aggccctggctgctgatatgagagagataagaaaaagcagtataatgaggcatggtactcgaaggatgtagtttgtgaaggaaatggcaccacaagcacatgttacatgaaccattgcaagaccttttgggacagcggtg

SEQ ID NO: 416428 - DNA, 140 bp, Artificial Sequence
  Synthetic
caccgctgtcccaaaaggtcttgcaatggttcatgtaacatgtgcttgtggtgccatttccttcacaaactacatccttcgagtaccatgcctcattatactgctttttcttatctctctcatatcagcagccagggcct

SEQ ID NO: 416429 - DNA, 140 bp, Artificial Sequence
  Synthetic
atacgccatgctgggtctccggtttagatactgtgcaccaccgggttttgccctactaagatgcaatgataccaattattcaggctttgcgcccaattgctctaaggtagtagctgctaccgtacttgggagtcggccat

SEQ ID NO: 416430 - DNA, 140 bp, Artificial Sequence
  Synthetic
atggccgactcccaagtacggtagcagctactaccttagagcaattgggcgcaaagcctgaataattggtatcattgcatcttagtagggcaaaacccggtggtgcacagtatctaaaccggagacccagcatggcgtat

SEQ ID NO: 416431 - DNA, 140 bp, Artificial Sequence
  Synthetic
aggccctggctgctgatatgaccaattattcaggctttgcgcccaattgctctaaggtagtagctgctacatgcaccagaatgatggaaacgcaaacttctacatggtttggctttaatggaccttttgggacagcggtg

SEQ ID NO: 416432 - DNA, 140 bp, Artificial Sequence
  Synthetic
caccgctgtcccaaaaggtccattaaagccaaaccatgtagaagtttgcgtttccatcattctggtgcatgtagcagctactaccttagagcaattgggcgcaaagcctgaataattggtcatatcagcagccagggcct

SEQ ID NO: 416433 - DNA, 140 bp, Artificial Sequence
  Synthetic
atacgccatgctgggtctccagaactatcatcagcttaaacaagtattataatctcactatacattgtaagaggccaggaaataagacagtggtaccaataacacttatgtcagggttaacgtacttgggagtcggccat

SEQ ID NO: 416434 - DNA, 140 bp, Artificial Sequence
  Synthetic
atggccgactcccaagtacgttaaccctgacataagtgttattggtaccactgtcttatttcctggcctcttacaatgtatagtgagattataatacttgtttaagctgatgatagttctggagacccagcatggcgtat

SEQ ID NO: 416435 - DNA, 140 bp, Artificial Sequence
  Synthetic
aggccctggctgctgatatggaggccaggaaataagacagtggtaccaataacacttatgtcagggttaaggtttcactcccagccggtcatcaataaaagacccagacaagcatggtgtgaccttttgggacagcggtg

SEQ ID NO: 416436 - DNA, 140 bp, Artificial Sequence
  Synthetic
caccgctgtcccaaaaggtcacaccatgcttgtctgggtcttttattgatgaccggctgggagtgaaaccttaaccctgacataagtgttattggtaccactgtcttatttcctggcctccatatcagcagccagggcct

SEQ ID NO: 416437 - DNA, 140 bp, Artificial Sequence
  Synthetic
atacgccatgctgggtctcctgcaaaacatcccaggtataaaggaaccaatgaaacaaagaatattaactttacagcaccaggaaagggctcagacccagaggtggcatacatgtggactcgtacttgggagtcggccat

SEQ ID NO: 416438 - DNA, 140 bp, Artificial Sequence
  Synthetic
atggccgactcccaagtacgagtccacatgtatgccacctctgggtctgagccctttcctggtgctgtaaagttaatattctttgtttcattggttcctttatacctgggatgttttgcaggagacccagcatggcgtat

SEQ ID NO: 416439 - DNA, 140 bp, Artificial Sequence
  Synthetic
aggccctggctgctgatatgttacagcaccaggaaagggctcagacccagaggtggcatacatgtggactaactgcagaggagaatttctctactgcaacatgacttggttcctcaattggaccttttgggacagcggtg

SEQ ID NO: 416440 - DNA, 140 bp, Artificial Sequence
  Synthetic
caccgctgtcccaaaaggtccaattgaggaaccaagtcatgttgcagtagagaaattctcctctgcagttagtccacatgtatgccacctctgggtctgagccctttcctggtgctgtaacatatcagcagccagggcct

SEQ ID NO: 416441 - DNA, 140 bp, Artificial Sequence
  Synthetic
atacgccatgctgggtctcctaattaacacctggcataaggtagggaaaaatgtatatttgcctcccagggaaggggagttgacctgcaactcaacagtaactagcataattgctaacatcgtacttgggagtcggccat

SEQ ID NO: 416442 - DNA, 140 bp, Artificial Sequence
  Synthetic
atggccgactcccaagtacgatgttagcaattatgctagttactgttgagttgcaggtcaactccccttccctgggaggcaaatatacatttttccctaccttatgccaggtgttaattaggagacccagcatggcgtat

SEQ ID NO: 416443 - DNA, 140 bp, Artificial Sequence
  Synthetic
atacgccatgctgggtctccaactataccgattagagttgggagattataaattggtagaaataacaccaattggcttcgcacctacagcagaaaaaagatactcctctactccaatgagcgtacttgggagtcggccat

SEQ ID NO: 416444 - DNA, 140 bp, Artificial Sequence
  Synthetic
atggccgactcccaagtacgctcattggagtagaggagtatcttttttctgctgtaggtgcgaagccaattggtgttatttctaccaatttataatctcccaactctaatcggtatagttggagacccagcatggcgtat

SEQ ID NO: 416445 - DNA, 140 bp, Artificial Sequence
  Synthetic
aggccctggctgctgatatgattggcttcgcacctacagcagaaaaaagatactcctctactccaatgaggaacaagagaggtgtgttcgtgctagggttcttgggttttctcgcaacaggaccttttgggacagcggtg

SEQ ID NO: 416446 - DNA, 140 bp, Artificial Sequence
  Synthetic
caccgctgtcccaaaaggtcctgttgcgagaaaacccaagaaccctagcacgaacacacctctcttgttcctcattggagtagaggagtatcttttttctgctgtaggtgcgaagccaatcatatcagcagccagggcct

SEQ ID NO: 416447 - DNA, 140 bp, Artificial Sequence
  Synthetic
atacgccatgctgggtctccgaacaagagaggtgtgttcgtgctagggttcttgggttttctcgcaacagcaggctctgcaatgggcgcggcgtccttaacgctgtcggctcagtctcggcgtacttgggagtcggccat

SEQ ID NO: 416448 - DNA, 140 bp, Artificial Sequence
  Synthetic
atggccgactcccaagtacgccgagactgagccgacagcgttaaggacgccgcgcccattgcagagcctgctgttgcgagaaaacccaagaaccctagcacgaacacacctctcttgttcggagacccagcatggcgtat

SEQ ID NO: 416449 - DNA, 140 bp, Artificial Sequence
  Synthetic
atacgccatgctgggtctcccaagagacaacaggaaatgttgcgactgaccgtctggggaacaaaaaatctccaggcaagagtcactgctatcgagaagtacttaaaggaccaggcgcaacgtacttgggagtcggccat

SEQ ID NO: 416450 - DNA, 140 bp, Artificial Sequence
  Synthetic
atggccgactcccaagtacgttgcgcctggtcctttaagtacttctcgatagcagtgactcttgcctggagattttttgttccccagacggtcagtcgcaacatttcctgttgtctcttgggagacccagcatggcgtat

SEQ ID NO: 416451 - DNA, 140 bp, Artificial Sequence
  Synthetic
aggccctggctgctgatatgtccaggcaagagtcactgctatcgagaagtacttaaaggaccaggcgcaactaaattcatggggatgtgcatttagacaagtctgccacactactgtaccgaccttttgggacagcggtg

SEQ ID NO: 416452 - DNA, 140 bp, Artificial Sequence
  Synthetic
caccgctgtcccaaaaggtcggtacagtagtgtggcagacttgtctaaatgcacatccccatgaatttagttgcgcctggtcctttaagtacttctcgatagcagtgactcttgcctggacatatcagcagccagggcct

SEQ ID NO: 416453 - DNA, 140 bp, Artificial Sequence
  Synthetic
atacgccatgctgggtctccaatgggaaggcaaaatccgcgacctggaggcaaatatcagtcaacaattagaacaagcacaaattcagcaagagaagaatatgtatgaactacaaaagttcgtacttgggagtcggccat

SEQ ID NO: 416454 - DNA, 140 bp, Artificial Sequence
  Synthetic
atggccgactcccaagtacgaacttttgtagttcatacatattcttctcttgctgaatttgtgcttgttctaattgttgactgatatttgcctccaggtcgcggattttgccttcccattggagacccagcatggcgtat

SEQ ID NO: 416455 - DNA, 140 bp, Artificial Sequence
  Synthetic
aggccctggctgctgatatggaacaagcacaaattcagcaagagaagaatatgtatgaactacaaaagttaaatagctgggatgtttttagtaactggtttgacttaacctcctggatcagaccttttgggacagcggtg

SEQ ID NO: 416456 - DNA, 140 bp, Artificial Sequence
  Synthetic
caccgctgtcccaaaaggtctgatccaggaggttaagtcaaaccagttactaaaaacatcccagctatttaacttttgtagttcatacatattcttctcttgctgaatttgtgcttgttccatatcagcagccagggcct

SEQ ID NO: 416457 - DNA, 140 bp, Artificial Sequence
  Synthetic
atacgccatgctgggtctccatagtaatatatatagtacagatgttaagtagacttagaaagggctataggcctgttttctcttccccccccggttacctccaacagatccatatccacacgtacttgggagtcggccat

SEQ ID NO: 416458 - DNA, 140 bp, Artificial Sequence
  Synthetic
atggccgactcccaagtacgtgtggatatggatctgttggaggtaaccggggggggaagagaaaacaggcctatagccctttctaagtctacttaacatctgtactatatatattactatggagacccagcatggcgtat

SEQ ID NO: 416459 - DNA, 140 bp, Artificial Sequence
  Synthetic
aggccctggctgctgatatggcctgttttctcttccccccccggttacctccaacagatccatatccacaaggactgggaacagccagccagagaagaaacagaagaagacgttggaaacgaccttttgggacagcggtg

SEQ ID NO: 416460 - DNA, 140 bp, Artificial Sequence
  Synthetic
caccgctgtcccaaaaggtcgtttccaacgtcttcttctgtttcttctctggctggctgttcccagtccttgtggatatggatctgttggaggtaaccggggggggaagagaaaacaggccatatcagcagccagggcct

SEQ ID NO: 416461 - DNA, 140 bp, Artificial Sequence
  Synthetic
atacgccatgctgggtctccaggactgggaacagccagccagagaagaaacagaagaagacgttggaaacaacgttggagacagcttgtagccttggccgataagatatatacatttcctcgtacttgggagtcggccat

SEQ ID NO: 416462 - DNA, 140 bp, Artificial Sequence
  Synthetic
atggccgactcccaagtacgaggaaatgtatatatcttatcggccaaggctacaagctgtctccaacgttgtttccaacgtcttcttctgtttcttctctggctggctgttcccagtcctggagacccagcatggcgtat

SEQ ID NO: 416463 - DNA, 140 bp, Artificial Sequence
  Synthetic
atacgccatgctgggtctccacttactatccaggatctccctgaccctccgaccagctttccagagtcttcagagggcactgacagcaatcagagactggctaagaactgacgcagcctacgtacttgggagtcggccat

SEQ ID NO: 416464 - DNA, 140 bp, Artificial Sequence
  Synthetic
atggccgactcccaagtacgtaggctgcgtcagttcttagccagtctctgattgctgtcagtgccctctgaagactctggaaagctggtcggagggtcagggagatcctggatagtaagtggagacccagcatggcgtat

SEQ ID NO: 416465 - DNA, 140 bp, Artificial Sequence
  Synthetic
aggccctggctgctgatatgcagagggcactgacagcaatcagagactggctaagaactgacgcagcctacttgcagtatgggtgcgagtggatccaaggagcgttccaggccttcgcaagaccttttgggacagcggtg

SEQ ID NO: 416466 - DNA, 140 bp, Artificial Sequence
  Synthetic
caccgctgtcccaaaaggtcttgcgaaggcctggaacgctccttggatccactcgcacccatactgcaagtaggctgcgtcagttcttagccagtctctgattgctgtcagtgccctctgcatatcagcagccagggcct

SEQ ID NO: 416467 - DNA, 140 bp, Artificial Sequence
  Synthetic
atacgccatgctgggtctccctgcagcggatcgggaggggaatacttgcagtcccaagaagaatcaggcagggagcagagatcgccctcctatgaaggacagcggtatcagcagggagaccgtacttgggagtcggccat

SEQ ID NO: 416468 - DNA, 140 bp, Artificial Sequence
  Synthetic
atggccgactcccaagtacggtctccctgctgataccgctgtccttcataggagggcgatctctgctccctgcctgattcttcttgggactgcaagtattcccctcccgatccgctgcagggagacccagcatggcgtat

SEQ ID NO: 416469 - DNA, 140 bp, Artificial Sequence
  Synthetic
atacgccatgctgggtctccgtacaagcaacaaaatagagatgatgtagattcagatgatgatgacctagtaaaggtctctgtcacaccaagagtaccactaagagaaatgacacatagacgtacttgggagtcggccat

SEQ ID NO: 416470 - DNA, 140 bp, Artificial Sequence
  Synthetic
atggccgactcccaagtacgtctatgtgtcatttctcttagtggtactcttggtgtgacagagacctttactaggtcatcatcatctgaatctacatcatctctattttgttgcttgtacggagacccagcatggcgtat

SEQ ID NO: 416471 - DNA, 140 bp, Artificial Sequence
  Synthetic
aggccctggctgctgatatggacctagtaaaggtctctgtcacaccaagagtaccactaagagaaatgacacatagattagcaatagatatgtcacattttataaaagaaaaagggggacgaccttttgggacagcggtg

SEQ ID NO: 416472 - DNA, 140 bp, Artificial Sequence
  Synthetic
caccgctgtcccaaaaggtcgtccccctttttcttttataaaatgtgacatatctattgctaatctatgtgtcatttctcttagtggtactcttggtgtgacagagacctttactaggtccatatcagcagccagggcct

SEQ ID NO: 416473 - DNA, 140 bp, Artificial Sequence
  Synthetic
atacgccatgctgggtctccggttggcgcccgaacagggacttagagaagactgaaaagccttggaacacggctgagtgaaggcagtaagggcggcaggaacaaaccacgacggagtgctcgtacttgggagtcggccat

SEQ ID NO: 416474 - DNA, 140 bp, Artificial Sequence
  Synthetic
atggccgactcccaagtacgagcactccgtcgtggtttgttcctgccgcccttactgccttcactcagccgtgttccaaggcttttcagtcttctctaagtccctgttcgggcgccaaccggagacccagcatggcgtat

SEQ ID NO: 416475 - DNA, 140 bp, Artificial Sequence
  Synthetic
aggccctggctgctgatatgggagaattatatgcagcaaggaaaaagacaaagagaacagagagagagaccatacaaagaagtgacagaggacttactgcacctcgagcagggagaggcagaccttttgggacagcggtg

SEQ ID NO: 416476 - DNA, 140 bp, Artificial Sequence
  Synthetic
caccgctgtcccaaaaggtctgcctctccctgctcgaggtgcagtaagtcctctgtcacttctttgtatggtctctctctctgttctctttgtctttttccttgctgcatataattctcccatatcagcagccagggcct

SEQ ID NO: 416477 - DNA, 140 bp, Artificial Sequence
  Synthetic
atacgccatgctgggtctccattgggagaagaagaggtggtcaattgtcaattcaatatgacaggattagagagagataagaaaaagcaatatagtgagacatggtactcgaaggatgtacgtacttgggagtcggccat

SEQ ID NO: 416478 - DNA, 140 bp, Artificial Sequence
  Synthetic
atggccgactcccaagtacgtacatccttcgagtaccatgtctcactatattgctttttcttatctctctctaatcctgtcatattgaattgacaattgaccacctcttcttctcccaatggagacccagcatggcgtat

SEQ ID NO: 416479 - DNA, 140 bp, Artificial Sequence
  Synthetic
aggccctggctgctgatatgagagagataagaaaaagcaatatagtgagacatggtactcgaaggatgtagtttgtgaaggaaatggcaccacagatacatgttacatgaaccattgcaagaccttttgggacagcggtg

SEQ ID NO: 416480 - DNA, 140 bp, Artificial Sequence
  Synthetic
caccgctgtcccaaaaggtcttgcaatggttcatgtaacatgtatctgtggtgccatttccttcacaaactacatccttcgagtaccatgtctcactatattgctttttcttatctctctcatatcagcagccagggcct

SEQ ID NO: 416481 - DNA, 140 bp, Artificial Sequence
  Synthetic
atacgccatgctgggtctccaggactgggaacagccagccagagaagaaacagaagaagacgttggaaacaacgttggagacagctcgtggccttggccgataagatatatacatttcctcgtacttgggagtcggccat

SEQ ID NO: 416482 - DNA, 140 bp, Artificial Sequence
  Synthetic
atggccgactcccaagtacgaggaaatgtatatatcttatcggccaaggccacgagctgtctccaacgttgtttccaacgtcttcttctgtttcttctctggctggctgttcccagtcctggagacccagcatggcgtat

SEQ ID NO: 416483 - DNA, 140 bp, Artificial Sequence
  Synthetic
atacgccatgctgggtctccgtacaagcaacaaaatagagatgatgtagattcggatgatgatgacctagtaggggtctctgtcacaccaagagtaccactaagagaattgacacatagacgtacttgggagtcggccat

SEQ ID NO: 416484 - DNA, 140 bp, Artificial Sequence
  Synthetic
atggccgactcccaagtacgtctatgtgtcaattctcttagtggtactcttggtgtgacagagacccctactaggtcatcatcatccgaatctacatcatctctattttgttgcttgtacggagacccagcatggcgtat

SEQ ID NO: 416485 - DNA, 140 bp, Artificial Sequence
  Synthetic
aggccctggctgctgatatggacctagtaggggtctctgtcacaccaagagtaccactaagagaattgacacatagattagcaatagatgtgtcacattttataaaagaaaaagggggacgaccttttgggacagcggtg

SEQ ID NO: 416486 - DNA, 140 bp, Artificial Sequence
  Synthetic
caccgctgtcccaaaaggtcgtccccctttttcttttataaaatgtgacacatctattgctaatctatgtgtcaattctcttagtggtactcttggtgtgacagagacccctactaggtccatatcagcagccagggcct

SEQ ID NO: 416487 - DNA, 140 bp, Artificial Sequence
  Synthetic
  misc_feature (116)..(116): n is a, c, g, or t
atacgccatgctgggtctccggttggcgcccgaacagggacccgagaagagtgagagtcttcgggacacagctgagtgaaggcagtaagggcggcaggaatcaaccacgacggagngctccgtacttgggagtcggccat

SEQ ID NO: 416488 - DNA, 140 bp, Artificial Sequence
  Synthetic
  misc_feature (25)..(25): n is a, c, g, or t
atggccgactcccaagtacggagcnctccgtcgtggttgattcctgccgcccttactgccttcactcagctgtgtcccgaagactctcactcttctcgggtccctgttcgggcgccaaccggagacccagcatggcgtat

SEQ ID NO: 416489 - DNA, 140 bp, Artificial Sequence
  Synthetic
  misc_feature (66)..(66): n is a, c, g, or t
aggccctggctgctgatatggctgagtgaaggcagtaagggcggcaggaatcaaccacgacggagngctcctgtaaaggcgcaggcgggtaccaagcagcgtgaggagcgagaggataaggaccttttgggacagcggtg

SEQ ID NO: 416490 - DNA, 140 bp, Artificial Sequence
  Synthetic
  misc_feature (75)..(75): n is a, c, g, or t
caccgctgtcccaaaaggtccttatcctctcgctcctcacgctgcttggtacccgcctgcgcctttacaggagcnctccgtcgtggttgattcctgccgcccttactgccttcactcagccatatcagcagccagggcct

SEQ ID NO: 416491 - DNA, 140 bp, Artificial Sequence
  Synthetic
aggccctggctgctgatatgtagaggagagtaggacataagtgggagatgggcgcgagaagctccgtcctgtcagggaagaaaacagatgaattagaaaaagttaggttacggcccggcggaccttttgggacagcggtg

SEQ ID NO: 416492 - DNA, 140 bp, Artificial Sequence
  Synthetic
caccgctgtcccaaaaggtccgccgggccgtaacctaactttttctaattcatctgttttcttccctgacaggacggagcttctcgcgcccatctcccacttatgtcctactctcctctacatatcagcagccagggcct

SEQ ID NO: 416493 - DNA, 140 bp, Artificial Sequence
  Synthetic
atacgccatgctgggtctccgacagatttggattagcagaaagcctgttggaaacaaaagaaggatgtcagaaaattcttacggccttagctccattaatgccaacagggtcagaaaatgcgtacttgggagtcggccat

SEQ ID NO: 416494 - DNA, 140 bp, Artificial Sequence
  Synthetic
atggccgactcccaagtacgcattttctgaccctgttggcattaatggagctaaggccgtaagaattttctgacatccttcttttgtttccaacaggctttctgctaatccaaatctgtcggagacccagcatggcgtat

SEQ ID NO: 416495 - DNA, 140 bp, Artificial Sequence
  Synthetic
aggccctggctgctgatatgagcggcagccactgaaaaagcaccaactgcagataaaccagcagcgacatctagtggcggaaactacccagtgcaacaagtagctggcaattatgtccacgaccttttgggacagcggtg

SEQ ID NO: 416496 - DNA, 140 bp, Artificial Sequence
  Synthetic
caccgctgtcccaaaaggtcgtggacataattgccagctacttgttgcactgggtagtttccgccactagatgtcgctgctggtttatctgcagttggtgctttttcagtggctgccgctcatatcagcagccagggcct

SEQ ID NO: 416497 - DNA, 140 bp, Artificial Sequence
  Synthetic
atacgccatgctgggtctccctagtggcggaaactacccagtgcaacaagtagctggcaattatgtccacgtgccactaagtccccgaaccctaaatgcctgggtgaaattagtggaggacgtacttgggagtcggccat

SEQ ID NO: 416498 - DNA, 140 bp, Artificial Sequence
  Synthetic
atggccgactcccaagtacgtcctccactaatttcacccaggcatttagggttcggggacttagtggcacgtggacataattgccagctacttgttgcactgggtagtttccgccactagggagacccagcatggcgtat

SEQ ID NO: 416499 - DNA, 140 bp, Artificial Sequence
  Synthetic
atacgccatgctgggtctccgatgtaccccttatgatatcaatcagatgctaaattgtgtaggagaacatcaggcagccatgcaagtcattagagaaataatcaatgaagaggctgcagacgtacttgggagtcggccat

SEQ ID NO: 416500 - DNA, 140 bp, Artificial Sequence
  Synthetic
atggccgactcccaagtacgtctgcagcctcttcattgattatttctctaatgacttgcatggctgcctgatgttctcctacacaatttagcatctgattgatatcataaggggtacatcggagacccagcatggcgtat

SEQ ID NO: 416501 - DNA, 140 bp, Artificial Sequence
  Synthetic
aggccctggctgctgatatgttatagaagatggattcaattaggattgcagaaatgtgtcaggatgtacaatcctactaatatactagatgtaaaacaagggccaaaagaaccctttcaagaccttttgggacagcggtg

SEQ ID NO: 416502 - DNA, 140 bp, Artificial Sequence
  Synthetic
caccgctgtcccaaaaggtcttgaaagggttcttttggcccttgttttacatctagtatattagtaggattgtacatcctgacacatttctgcaatcctaattgaatccatcttctataacatatcagcagccagggcct

SEQ ID NO: 416503 - DNA, 140 bp, Artificial Sequence
  Synthetic
atacgccatgctgggtctccggccgtgagagcatggatgacagagacactgttgatccagaatgctaacccagattgcaagctagtactcaagggtttggggccacaccccaccctagagcgtacttgggagtcggccat

SEQ ID NO: 416504 - DNA, 140 bp, Artificial Sequence
  Synthetic
atggccgactcccaagtacgctctagggtggggtgtggccccaaacccttgagtactagcttgcaatctgggttagcattctggatcaacagtgtctctgtcatccatgctctcacggccggagacccagcatggcgtat

SEQ ID NO: 416505 - DNA, 140 bp, Artificial Sequence
  Synthetic
aggccctggctgctgatatgcagattgcaagctagtactcaagggtttggggccacaccccaccctagaggaaatgctgacggcctgccaagggataggaggcccagggcagaaagcgaggaccttttgggacagcggtg

SEQ ID NO: 416506 - DNA, 140 bp, Artificial Sequence
  Synthetic
caccgctgtcccaaaaggtcctcgctttctgccctgggcctcctatcccttggcaggccgtcagcatttcctctagggtggggtgtggccccaaacccttgagtactagcttgcaatctgcatatcagcagccagggcct

SEQ ID NO: 416507 - DNA, 140 bp, Artificial Sequence
  Synthetic
atacgccatgctgggtctccacaggggtgctggaaatgtggaaaaacaggacacaacatggcaaattgcccagacagacaggcgggttttttagggtttggaccctggggaaagaagcctcgtacttgggagtcggccat

SEQ ID NO: 416508 - DNA, 140 bp, Artificial Sequence
  Synthetic
atggccgactcccaagtacgaggcttctttccccagggtccaaaccctaaaaaacccgcctgtctgtctgggcaatttgccatgttgtgtcctgtttttccacatttccagcacccctgtggagacccagcatggcgtat

SEQ ID NO: 416509 - DNA, 140 bp, Artificial Sequence
  Synthetic
aggccctggctgctgatatgcagacagacaggcgggttttttagggtttggaccctggggaaagaagcctcgcaacttccccgcggcccaagtgcctcaggaggtggtgccatctgcgccgaccttttgggacagcggtg

SEQ ID NO: 416510 - DNA, 140 bp, Artificial Sequence
  Synthetic
caccgctgtcccaaaaggtcggcgcagatggcaccacctcctgaggcacttgggccgcggggaagttgcgaggcttctttccccagggtccaaaccctaaaaaacccgcctgtctgtctgcatatcagcagccagggcct

SEQ ID NO: 416511 - DNA, 140 bp, Artificial Sequence
  Synthetic
atacgccatgctgggtctcccgccccctgcagatccagcagtggagatgctaaaaaactacatgcaactggggaggcaacagagagagaagcaagagagaccctacaaggaggtgacagacgtacttgggagtcggccat

SEQ ID NO: 416512 - DNA, 140 bp, Artificial Sequence
  Synthetic
atggccgactcccaagtacgtctgtcacctccttgtagggtctctcttgcttctctctctgttgcctccccagttgcatgtagttttttagcatctccactgctggatctgcagggggcgggagacccagcatggcgtat

SEQ ID NO: 416513 - DNA, 140 bp, Artificial Sequence
  Synthetic
atacgccatgctgggtctccggacttgctgcacctcaattctctctttggagaagaccagtagtccaagcatatatcgagggtcagccagtagaagtactactagacacaggggctgacgcgtacttgggagtcggccat

SEQ ID NO: 416514 - DNA, 140 bp, Artificial Sequence
  Synthetic
atggccgactcccaagtacgcgtcagcccctgtgtctagtagtacttctactggctgaccctcgatatatgcttggactactggtcttctccaaagagagaattgaggtgcagcaagtccggagacccagcatggcgtat

SEQ ID NO: 416515 - DNA, 140 bp, Artificial Sequence
  Synthetic
atacgccatgctgggtctccactcaatagtagcagggatagaattaggatgcaattacaccccaaaaatagtaggagggataggaggattcataaatactaaagaatacaaagacatagacgtacttgggagtcggccat

SEQ ID NO: 416516 - DNA, 140 bp, Artificial Sequence
  Synthetic
atggccgactcccaagtacgtctatgtctttgtattctttagtatttatgaatcctcctatccctcctactatttttggggtgtaattgcatcctaattctatccctgctactattgagtggagacccagcatggcgtat

SEQ ID NO: 416517 - DNA, 140 bp, Artificial Sequence
  Synthetic
atacgccatgctgggtctccccccaataaatatttttggcagaaatatcttaagtgccctaggcatgagtctaaatttcccaatggcaaaattagagccagtgaaggtccagttaaagcccgtacttgggagtcggccat

SEQ ID NO: 416518 - DNA, 140 bp, Artificial Sequence
  Synthetic
atggccgactcccaagtacgggctttaactggaccttcactggctctaattttgccattgggaaatttagactcatgcctagggcacttaagatatttctgccaaaaatatttattggggggagacccagcatggcgtat

SEQ ID NO: 416519 - DNA, 140 bp, Artificial Sequence
  Synthetic
atacgccatgctgggtctcctactggcccttagagagatctgtgaaaaaatggaaaaggaggggcagctagaagaagcacctcccactaatccatacaacacacccaccttcgctgtaagcgtacttgggagtcggccat

SEQ ID NO: 416520 - DNA, 140 bp, Artificial Sequence
  Synthetic
atggccgactcccaagtacgcttacagcgaaggtgggtgtgttgtatggattagtgggaggtgcttcttctagctgcccctccttttccattttttcacagatctctctaagggccagtaggagacccagcatggcgtat

SEQ ID NO: 416521 - DNA, 140 bp, Artificial Sequence
  Synthetic
aggccctggctgctgatatggaagaagcacctcccactaatccatacaacacacccaccttcgctgtaaggaaaaaagataaaaacaaatggagaatgctaatagacttcagagaattaagaccttttgggacagcggtg

SEQ ID NO: 416522 - DNA, 140 bp, Artificial Sequence
  Synthetic
caccgctgtcccaaaaggtcttaattctctgaagtctattagcattctccatttgtttttatcttttttccttacagcgaaggtgggtgtgttgtatggattagtgggaggtgcttcttccatatcagcagccagggcct

SEQ ID NO: 416523 - DNA, 140 bp, Artificial Sequence
  Synthetic
atacgccatgctgggtctccttccaccccagaagagaagttccaaaaggaccccccattccagtggatgggttatgagctctggccaaaaaagtggaaactgcagaaaatacaaataccacgtacttgggagtcggccat

SEQ ID NO: 416524 - DNA, 140 bp, Artificial Sequence
  Synthetic
atggccgactcccaagtacgtggtatttgtattttctgcagtttccacttttttggccagagctcataacccatccactggaatggggggtccttttggaacttctcttctggggtggaaggagacccagcatggcgtat

SEQ ID NO: 416525 - DNA, 140 bp, Artificial Sequence
  Synthetic
aggccctggctgctgatatggactgatcaggggaaagatgaccctgacagaagaggtgcagtggacagaactagcagaggcagagatgcaagaaaataaaatcatcctggaacaggaacagaccttttgggacagcggtg

SEQ ID NO: 416526 - DNA, 140 bp, Artificial Sequence
  Synthetic
caccgctgtcccaaaaggtctgttcctgttccaggatgattttattttcttgcatctctgcctctgctagttctgtccactgcacctcttctgtcagggtcatctttcccctgatcagtccatatcagcagccagggcct

SEQ ID NO: 416527 - DNA, 140 bp, Artificial Sequence
  Synthetic
atacgccatgctgggtctccaaaacttagcaaaccagtggacatacaaaattcatcagggagataaggtcctaaaagtaggaaaatatgcaaaggtcaaaagcacccacaccaatggagtcgtacttgggagtcggccat

SEQ ID NO: 416528 - DNA, 140 bp, Artificial Sequence
  Synthetic
atggccgactcccaagtacgactccattggtgtgggtgcttttgacctttgcatattttcctacttttaggaccttatctccctgatgaattttgtatgtccactggtttgctaagttttggagacccagcatggcgtat

SEQ ID NO: 416529 - DNA, 140 bp, Artificial Sequence
  Synthetic
atacgccatgctgggtctccggttaaaccattagagcagacaacaaaccaacaagcagaacttgaagcatttgcactggcactacaggattcaggaccacaagtcaatatcatagtagatcgtacttgggagtcggccat

SEQ ID NO: 416530 - DNA, 140 bp, Artificial Sequence
  Synthetic
atggccgactcccaagtacgatctactatgatattgacttgtggtcctgaatcctgtagtgccagtgcaaatgcttcaagttctgcttgttggtttgttgtctgctctaatggtttaaccggagacccagcatggcgtat

SEQ ID NO: 416531 - DNA, 140 bp, Artificial Sequence
  Synthetic
aggccctggctgctgatatggaccacctagtaagtcaaggaattagacaagttctatttctagaaaagatagaaccagcacaagaagaacatgaaaagtatcatggcaatgtaaaagagcgaccttttgggacagcggtg

SEQ ID NO: 416532 - DNA, 140 bp, Artificial Sequence
  Synthetic
caccgctgtcccaaaaggtcgctcttttacattgccatgatacttttcatgttcttcttgtgctggttctatcttttctagaaatagaacttgtctaattccttgacttactaggtggtccatatcagcagccagggcct

SEQ ID NO: 416533 - DNA, 140 bp, Artificial Sequence
  Synthetic
atacgccatgctgggtctcctcttgtgataaatgtcaacaaaaaggagaagctgttcatggacaggtaaatgcagaactagggacatggcaaatggactgtacacatttagaaggaaaaacgtacttgggagtcggccat

SEQ ID NO: 416534 - DNA, 140 bp, Artificial Sequence
  Synthetic
atggccgactcccaagtacgtttttccttctaaatgtgtacagtccatttgccatgtccctagttctgcatttacctgtccatgaacagcttctcctttttgttgacatttatcacaagaggagacccagcatggcgtat

SEQ ID NO: 416535 - DNA, 140 bp, Artificial Sequence
  Synthetic
aggccctggctgctgatatgataccccaagaaacaggaagacaaacagccctcttcctgttgaagctagcaagcagatggcctatcacacacctgcacacagacaatggtgccaactttagaccttttgggacagcggtg

SEQ ID NO: 416536 - DNA, 140 bp, Artificial Sequence
  Synthetic
caccgctgtcccaaaaggtctaaagttggcaccattgtctgtgtgcaggtgtgtgataggccatctgcttgctagcttcaacaggaagagggctgtttgtcttcctgtttcttggggtatcatatcagcagccagggcct

SEQ ID NO: 416537 - DNA, 140 bp, Artificial Sequence
  Synthetic
atacgccatgctgggtctcctttggagtaccctacaatccacagagtcagggagtggtagaagcaatgaaccatcatctaaaaaatcaaatagataggatcagagatcaggcagtatcatcgtacttgggagtcggccat

SEQ ID NO: 416538 - DNA, 140 bp, Artificial Sequence
  Synthetic
atggccgactcccaagtacgatgatactgcctgatctctgatcctatctatttgattttttagatgatggttcattgcttctaccactccctgactctgtggattgtagggtactccaaaggagacccagcatggcgtat

SEQ ID NO: 416539 - DNA, 140 bp, Artificial Sequence
  Synthetic
aggccctggctgctgatatgcacagaacaagaaatacaattcttccaagcaaaaaatttaaaatttcaaaatttccaggtctattacagagaaggcagagatcaactctggaagggacctgaccttttgggacagcggtg

SEQ ID NO: 416540 - DNA, 140 bp, Artificial Sequence
  Synthetic
caccgctgtcccaaaaggtcaggtcccttccagagttgatctctgccttctctgtaatagacctggaaattttgaaattttaaattttttgcttggaagaattgtatttcttgttctgtgcatatcagcagccagggcct

SEQ ID NO: 416541 - DNA, 140 bp, Artificial Sequence
  Synthetic
atacgccatgctgggtctccatttccaggtctattacagagaaggcagagatcaactctggaagggacctggtgagctattgtggaaaggggaaggagcagtcatcgtaaaggtagggaccgtacttgggagtcggccat

SEQ ID NO: 416542 - DNA, 140 bp, Artificial Sequence
  Synthetic
atggccgactcccaagtacggtccctacctttacgatgactgctccttcccctttccacaatagctcaccaggtcccttccagagttgatctctgccttctctgtaatagacctggaaatggagacccagcatggcgtat

SEQ ID NO: 416543 - DNA, 140 bp, Artificial Sequence
  Synthetic
aggccctggctgctgatatgggtgagctattgtggaaaggggaaggagcagtcatcgtaaaggtagggacagagatcaaggtagtacccagaagaaaggcaaagatcataagacactatggaccttttgggacagcggtg

SEQ ID NO: 416544 - DNA, 140 bp, Artificial Sequence
  Synthetic
caccgctgtcccaaaaggtccatagtgtcttatgatctttgcctttcttctgggtactaccttgatctctgtccctacctttacgatgactgctccttcccctttccacaatagctcacccatatcagcagccagggcct

SEQ ID NO: 416545 - DNA, 140 bp, Artificial Sequence
  Synthetic
atacgccatgctgggtctccgctagagagatggcacagtctggtcaagtacctgaagtataaaacaggagaattacaacaggtctcttatgttccccaccacaaggtgggatgggcctggcgtacttgggagtcggccat

SEQ ID NO: 416546 - DNA, 140 bp, Artificial Sequence
  Synthetic
atggccgactcccaagtacgccaggcccatcccaccttgtggtggggaacataagagacctgttgtaattctcctgttttatacttcaggtacttgaccagactgtgccatctctctagcggagacccagcatggcgtat

SEQ ID NO: 416547 - DNA, 140 bp, Artificial Sequence
  Synthetic
atacgccatgctgggtctcctggacttgcagtagagtaatattccccctaaaagacagagcatggctagaggtccaaggatattggaatctgaccccagaaaggggattcttgagttcctcgtacttgggagtcggccat

SEQ ID NO: 416548 - DNA, 140 bp, Artificial Sequence
  Synthetic
atggccgactcccaagtacgaggaactcaagaatcccctttctggggtcagattccaatatccttggacctctagccatgctctgtcttttagggggaatattactctactgcaagtccaggagacccagcatggcgtat

SEQ ID NO: 416549 - DNA, 140 bp, Artificial Sequence
  Synthetic
atacgccatgctgggtctcccctgatgtggcagaccaactattgcatgggacttatttctcttgctttacagccaatgaagtgaggagagccatcaggggagaaaaaatattgtcctactcgtacttgggagtcggccat

SEQ ID NO: 416550 - DNA, 140 bp, Artificial Sequence
  Synthetic
atggccgactcccaagtacgagtaggacaatattttttctcccctgatggctctcctcacttcattggctgtaaagcaagagaaataagtcccatgcaatagttggtctgccacatcaggggagacccagcatggcgtat

SEQ ID NO: 416551 - DNA, 140 bp, Artificial Sequence
  Synthetic
atacgccatgctgggtctccgcaactacccatcagcccacgaaaggcaggtaccaagtttacagtttctagccttaagagtagtacaagaaagaaaaaatggatccaagggagagggtgccgtacttgggagtcggccat

SEQ ID NO: 416552 - DNA, 140 bp, Artificial Sequence
  Synthetic
atggccgactcccaagtacggcaccctctcccttggatccattttttctttcttgtactactcttaaggctagaaactgtaaacttggtacctgcctttcgtgggctgatgggtagttgcggagacccagcatggcgtat

SEQ ID NO: 416553 - DNA, 140 bp, Artificial Sequence
  Synthetic
atacgccatgctgggtctccgaaagaacaataacagagctcaacagggaagcagtcaaccatttaccccgggaactcattttccaggtctggcagaggtcttgggcatattggcgtgaggcgtacttgggagtcggccat

SEQ ID NO: 416554 - DNA, 140 bp, Artificial Sequence
  Synthetic
atggccgactcccaagtacgcctcacgccaatatgcccaagacctctgccagacctggaaaatgagttcccggggtaaatggttgactgcttccctgttgagctctgttattgttctttcggagacccagcatggcgtat

SEQ ID NO: 416555 - DNA, 140 bp, Artificial Sequence
  Synthetic
aggccctggctgctgatatgggaactcattttccaggtctggcagaggtcttgggcatattggcgtgaggaacagggcatgtcaagtagctacaccaagtataggtacttacttctgatggaccttttgggacagcggtg

SEQ ID NO: 416556 - DNA, 140 bp, Artificial Sequence
  Synthetic
caccgctgtcccaaaaggtccatcagaagtaagtacctatacttggtgtagctacttgacatgccctgttcctcacgccaatatgcccaagacctctgccagacctggaaaatgagttcccatatcagcagccagggcct

SEQ ID NO: 416557 - DNA, 140 bp, Artificial Sequence
  Synthetic
atacgccatgctgggtctccgggccatgggccagggggatggagacaaggacctcctcctcctcctcccccaggcctagcctaatggcagaagcagccccagagactcctccagagaatgcgtacttgggagtcggccat

SEQ ID NO: 416558 - DNA, 140 bp, Artificial Sequence
  Synthetic
atggccgactcccaagtacgcattctctggaggagtctctggggctgcttctgccattaggctaggcctgggggaggaggaggaggaggtccttgtctccatccccctggcccatggcccggagacccagcatggcgtat

SEQ ID NO: 416559 - DNA, 140 bp, Artificial Sequence
  Synthetic
atacgccatgctgggtctccgagctaaagcaagaagccttaaaacattttgatccccgcttgctaactgcgcttggtaactttatctacagtaggcatggagacacccttgcaggagcagcgtacttgggagtcggccat

SEQ ID NO: 416560 - DNA, 140 bp, Artificial Sequence
  Synthetic
atggccgactcccaagtacgctgctcctgcaagggtgtctccatgcctactgtagataaagttaccaagcgcagttagcaagcggggatcaaaatgttttaaggcttcttgctttagctcggagacccagcatggcgtat

SEQ ID NO: 416561 - DNA, 140 bp, Artificial Sequence
  Synthetic
aggccctggctgctgatatggcttggtaactttatctacagtaggcatggagacacccttgcaggagcaggggaactcatcaaaattctccaaagagcactcttcctccacttcagaggcgaccttttgggacagcggtg

SEQ ID NO: 416562 - DNA, 140 bp, Artificial Sequence
  Synthetic
caccgctgtcccaaaaggtcgcctctgaagtggaggaagagtgctctttggagaattttgatgagttcccctgctcctgcaagggtgtctccatgcctactgtagataaagttaccaagccatatcagcagccagggcct

SEQ ID NO: 416563 - DNA, 140 bp, Artificial Sequence
  Synthetic
atacgccatgctgggtctcctgttgctaccattgccagctttgttttcttaacaagggccttgggatatgttatgaacacccgagaaaaagatcttcaaaaaaggctaggactgctacatcgtacttgggagtcggccat

SEQ ID NO: 416564 - DNA, 140 bp, Artificial Sequence
  Synthetic
atggccgactcccaagtacgatgtagcagtcctagccttttttgaagatctttttctcgggtgttcataacatatcccaaggcccttgttaagaaaacaaagctggcaatggtagcaacaggagacccagcatggcgtat

SEQ ID NO: 416565 - DNA, 140 bp, Artificial Sequence
  Synthetic
aggccctggctgctgatatgttatgaacacccgagaaaaagatcttcaaaaaaggctaggactgctacatcttctgcatcagacaagtgagtaagatgtgtggtaagaatttactctttagaccttttgggacagcggtg

SEQ ID NO: 416566 - DNA, 140 bp, Artificial Sequence
  Synthetic
caccgctgtcccaaaaggtctaaagagtaaattcttaccacacatcttactcacttgtctgatgcagaagatgtagcagtcctagccttttttgaagatctttttctcgggtgttcataacatatcagcagccagggcct

SEQ ID NO: 416567 - DNA, 140 bp, Artificial Sequence
  Synthetic
aggccctggctgctgatatggtgactgttttctatggagtgcccgtgtggagaaatgcatccattcccctcttttgtgcaactcaaaacagagatacttggggaaccgtacagtgcttgcgaccttttgggacagcggtg

SEQ ID NO: 416568 - DNA, 140 bp, Artificial Sequence
  Synthetic
caccgctgtcccaaaaggtcgcaagcactgtacggttccccaagtatctctgttttgagttgcacaaaagaggggaatggatgcatttctccacacgggcactccatagaaaacagtcaccatatcagcagccagggcct

SEQ ID NO: 416569 - DNA, 140 bp, Artificial Sequence
  Synthetic
atacgccatgctgggtctccgatgcatgggataatacagtaacagaacaagcagtagaggatgtctggaacctatttgagacatcaataaaaccatgtgtcaaactaacacctctatgtgcgtacttgggagtcggccat

SEQ ID NO: 416570 - DNA, 140 bp, Artificial Sequence
  Synthetic
atggccgactcccaagtacgcacatagaggtgttagtttgacacatggttttattgatgtctcaaataggttccagacatcctctactgcttgttctgttactgtattatcccatgcatcggagacccagcatggcgtat

SEQ ID NO: 416571 - DNA, 140 bp, Artificial Sequence
  Synthetic
atacgccatgctgggtctccaacataacaggaaccacactgataaatgaaacttctccatgcatacgaaatgacagctgcacaggattgggagaggaagggatagtccagtgtcagttcgcgtacttgggagtcggccat

SEQ ID NO: 416572 - DNA, 140 bp, Artificial Sequence
  Synthetic
atggccgactcccaagtacgcgaactgacactggactatcccttcctctcccaatcctgtgcagctgtcatttcgtatgcatggagaagtttcatttatcagtgtggttcctgttatgttggagacccagcatggcgtat

SEQ ID NO: 416573 - DNA, 140 bp, Artificial Sequence
  Synthetic
aggccctggctgctgatatgtgacagctgcacaggattgggagaggaagggatagtccagtgtcagttcgacatgacaggattagagagagataagaaaaaacgatataatgaaacatgggaccttttgggacagcggtg

SEQ ID NO: 416574 - DNA, 140 bp, Artificial Sequence
  Synthetic
caccgctgtcccaaaaggtcccatgtttcattatatcgttttttcttatctctctctaatcctgtcatgtcgaactgacactggactatcccttcctctcccaatcctgtgcagctgtcacatatcagcagccagggcct

SEQ ID NO: 416575 - DNA, 140 bp, Artificial Sequence
  Synthetic
atacgccatgctgggtctcccagatgctacatgaaacattgcaacacatcagtcatcacagagtcatgtgacaagcactattgggatgctataaggtttagatactgtgcaccaccgggccgtacttgggagtcggccat

SEQ ID NO: 416576 - DNA, 140 bp, Artificial Sequence
  Synthetic
atggccgactcccaagtacggcccggtggtgcacagtatctaaaccttatagcatcccaatagtgcttgtcacatgactctgtgatgactgatgtgttgcaatgtttcatgtagcatctgggagacccagcatggcgtat

SEQ ID NO: 416577 - DNA, 140 bp, Artificial Sequence
  Synthetic
aggccctggctgctgatatgacaagcactattgggatgctataaggtttagatactgtgcaccaccgggctttgctttgctaagatgtaatgacaccgactattcaggcttcaagtccaagaccttttgggacagcggtg

SEQ ID NO: 416578 - DNA, 140 bp, Artificial Sequence
  Synthetic
caccgctgtcccaaaaggtcttggacttgaagcctgaatagtcggtgtcattacatcttagcaaagcaaagcccggtggtgcacagtatctaaaccttatagcatcccaatagtgcttgtcatatcagcagccagggcct

SEQ ID NO: 416579 - DNA, 140 bp, Artificial Sequence
  Synthetic
atacgccatgctgggtctccttataatttaacaatgcattgtaagaggccaggaaacaagacagttttaccaataacactctcttcaggaagaaggttccactcccagccaatcatcaatcgtacttgggagtcggccat

SEQ ID NO: 416580 - DNA, 140 bp, Artificial Sequence
  Synthetic
atggccgactcccaagtacgattgatgattggctgggagtggaaccttcttcctgaagagagtgttattggtaaaactgtcttgtttcctggcctcttacaatgcattgttaaattataaggagacccagcatggcgtat

SEQ ID NO: 416581 - DNA, 140 bp, Artificial Sequence
  Synthetic
atacgccatgctgggtctcccatgcaggaggtgaaacagaccattatagaacatcccaggtatacaggaaccaaaaacataagtaaaattaactttacaagaccaggagaaggctcagaccgtacttgggagtcggccat

SEQ ID NO: 416582 - DNA, 140 bp, Artificial Sequence
  Synthetic
atggccgactcccaagtacggtctgagccttctcctggtcttgtaaagttaattttacttatgtttttggttcctgtatacctgggatgttctataatggtctgtttcacctcctgcatgggagacccagcatggcgtat

SEQ ID NO: 416583 - DNA, 140 bp, Artificial Sequence
  Synthetic
aggccctggctgctgatatgccaaaaacataagtaaaattaactttacaagaccaggagaaggctcagacccagaagtgaaattcatgtggactaactgcagaggagaatttctctactggaccttttgggacagcggtg

SEQ ID NO: 416584 - DNA, 140 bp, Artificial Sequence
  Synthetic
caccgctgtcccaaaaggtccagtagagaaattctcctctgcagttagtccacatgaatttcacttctgggtctgagccttctcctggtcttgtaaagttaattttacttatgtttttggcatatcagcagccagggcct

SEQ ID NO: 416585 - DNA, 140 bp, Artificial Sequence
  Synthetic
atacgccatgctgggtctcctcaattatgcaccgtgccatatcagtcaaataattaatacctggcacaaggtagggatgaatgtatatttgcctcctagggaaggagagttaacctgcaacgtacttgggagtcggccat

SEQ ID NO: 416586 - DNA, 140 bp, Artificial Sequence
  Synthetic
atggccgactcccaagtacgttgcaggttaactctccttccctaggaggcaaatatacattcatccctaccttgtgccaggtattaattatttgactgatatggcacggtgcataattgaggagacccagcatggcgtat

SEQ ID NO: 416587 - DNA, 140 bp, Artificial Sequence
  Synthetic
atacgccatgctgggtctccaccaagcaaacattaccttcagtgcagaggtggcagaactgtaccgattagaattgggggactataaattaatagaagtgacaccaattggctttgcacccgtacttgggagtcggccat

SEQ ID NO: 416588 - DNA, 140 bp, Artificial Sequence
  Synthetic
atggccgactcccaagtacgggtgcaaagccaattggtgtcacttctattaatttatagtcccccaattctaatcggtacagttctgccacctctgcactgaaggtaatgtttgcttggtggagacccagcatggcgtat

SEQ ID NO: 416589 - DNA, 140 bp, Artificial Sequence
  Synthetic
aggccctggctgctgatatggaattgggggactataaattaatagaagtgacaccaattggctttgcacctacagaacaaaaaagatactcctctccagggagacataaaagaggtgcgtgaccttttgggacagcggtg

SEQ ID NO: 416590 - DNA, 140 bp, Artificial Sequence
  Synthetic
caccgctgtcccaaaaggtcacgcacctcttttatgtctccctggagaggagtatcttttttgttctgtaggtgcaaagccaattggtgtcacttctattaatttatagtcccccaattccatatcagcagccagggcct

SEQ ID NO: 416591 - DNA, 140 bp, Artificial Sequence
  Synthetic
atacgccatgctgggtctcctgttgagattgaccgtctggggaacaaaaaatctccaggcaagagtcactgctattgagaaatacctaaaggaccaggcgcaactaaattcatggggatgcgtacttgggagtcggccat

SEQ ID NO: 416592 - DNA, 140 bp, Artificial Sequence
  Synthetic
atggccgactcccaagtacgcatccccatgaatttagttgcgcctggtcctttaggtatttctcaatagcagtgactcttgcctggagattttttgttccccagacggtcaatctcaacaggagacccagcatggcgtat

SEQ ID NO: 416593 - DNA, 140 bp, Artificial Sequence
  Synthetic
atacgccatgctgggtctcctggcacctgactgggacaacatgacgtggcaacaatgggagaaacaaatccgctacctagaggcaaatatcagtgtaagtttagaacaggcacaaatccacgtacttgggagtcggccat

SEQ ID NO: 416594 - DNA, 140 bp, Artificial Sequence
  Synthetic
atggccgactcccaagtacgtggatttgtgcctgttctaaacttacactgatatttgcctctaggtagcggatttgtttctcccattgttgccacgtcatgttgtcccagtcaggtgccaggagacccagcatggcgtat

SEQ ID NO: 416595 - DNA, 140 bp, Artificial Sequence
  Synthetic
aggccctggctgctgatatgcgctacctagaggcaaatatcagtgtaagtttagaacaggcacaaatccagcaagaaaagaacatgtatgacttacaaaaattaaatagctgggatgtttgaccttttgggacagcggtg

SEQ ID NO: 416596 - DNA, 140 bp, Artificial Sequence
  Synthetic
caccgctgtcccaaaaggtcaaacatcccagctatttaatttttgtaagtcatacatgttcttttcttgctggatttgtgcctgttctaaacttacactgatatttgcctctaggtagcgcatatcagcagccagggcct

SEQ ID NO: 416597 - DNA, 140 bp, Artificial Sequence
  Synthetic
atacgccatgctgggtctccgttttcatagtagtaggaatagtagctcttagaataataatatatgtagtacagatgttaggtagacttagaaagggttataggcctgttttctcctccccgtacttgggagtcggccat

SEQ ID NO: 416598 - DNA, 140 bp, Artificial Sequence
  Synthetic
atggccgactcccaagtacggggaggagaaaacaggcctataaccctttctaagtctacctaacatctgtactacatatattattattctaagagctactattcctactactatgaaaacggagacccagcatggcgtat

SEQ ID NO: 416599 - DNA, 140 bp, Artificial Sequence
  Synthetic
atacgccatgctgggtctccgccaacgaagaaacagaagaaggaggtggaagcgacgagggctacagatcttggccttggcagatcgaatacatccacttcctactccgccagctgaggacgtacttgggagtcggccat

SEQ ID NO: 416600 - DNA, 140 bp, Artificial Sequence
  Synthetic
atggccgactcccaagtacgtcctcagctggcggagtaggaagtggatgtattcgatctgccaaggccaagatctgtagccctcgtcgcttccacctccttcttctgtttcttcgttggcggagacccagcatggcgtat

SEQ ID NO: 416601 - DNA, 140 bp, Artificial Sequence
  Synthetic
aggccctggctgctgatatgttggccttggcagatcgaatacatccacttcctactccgccagctgaggaacctcttgatttggctatacgaaggctgcagaaccttactatcgaagaccgaccttttgggacagcggtg

SEQ ID NO: 416602 - DNA, 140 bp, Artificial Sequence
  Synthetic
caccgctgtcccaaaaggtcggtcttcgatagtaaggttctgcagccttcgtatagccaaatcaagaggttcctcagctggcggagtaggaagtggatgtattcgatctgccaaggccaacatatcagcagccagggcct

SEQ ID NO: 416603 - DNA, 140 bp, Artificial Sequence
  Synthetic
aggccctggctgctgatatgcctccagtatgggatcagctggctccaagaagcagtccaagccgccgcgagggctgcgggagagactcttgcgagcgccagcaggaccatatgggaggctgaccttttgggacagcggtg

SEQ ID NO: 416604 - DNA, 140 bp, Artificial Sequence
  Synthetic
caccgctgtcccaaaaggtcagcctcccatatggtcctgctggcgctcgcaagagtctctcccgcagccctcgcggcggcttggactgcttcttggagccagctgatcccatactggaggcatatcagcagccagggcct

SEQ ID NO: 416605 - DNA, 140 bp, Artificial Sequence
  Synthetic
aggccctggctgctgatatggggctgcgggagagactcttgcgagcgccagcaggaccatatgggaggctctcagaagaacggcgaggggaatcatcgcgatccccagaaggatcagacagaccttttgggacagcggtg

SEQ ID NO: 416606 - DNA, 140 bp, Artificial Sequence
  Synthetic
caccgctgtcccaaaaggtctgtctgatccttctggggatcgcgatgattcccctcgccgttcttctgagagcctcccatatggtcctgctggcgctcgcaagagtctctcccgcagccccatatcagcagccagggcct

SEQ ID NO: 416607 - DNA, 140 bp, Artificial Sequence
  Synthetic
atacgccatgctgggtctccgggggagggcaacaagacatagaagaagatgatgaggacgatgaagtgggagcatatgtcagacccaataagccactgagatcaatgacatacaaattggcgtacttgggagtcggccat

SEQ ID NO: 416608 - DNA, 140 bp, Artificial Sequence
  Synthetic
atggccgactcccaagtacgccaatttgtatgtcattgatctcagtggcttattgggtctgacatatgctcccacttcatcgtcctcatcatcttcttctatgtcttgttgccctcccccggagacccagcatggcgtat

SEQ ID NO: 416609 - DNA, 140 bp, Artificial Sequence
  Synthetic
aggccctggctgctgatatggatgaagtgggagcatatgtcagacccaataagccactgagatcaatgacatacaaattggcaatagacatgtctcattttataaaagaaaaggggggacgaccttttgggacagcggtg

SEQ ID NO: 416610 - DNA, 140 bp, Artificial Sequence
  Synthetic
caccgctgtcccaaaaggtcgtccccccttttcttttataaaatgagacatgtctattgccaatttgtatgtcattgatctcagtggcttattgggtctgacatatgctcccacttcatccatatcagcagccagggcct

SEQ ID NO: 416611 - DNA, 140 bp, Artificial Sequence
  Synthetic
atacgccatgctgggtctccggttggcgcccgaacagggacccgagaagagtgagagtcttcgggacacagctgagtgaaggcagcaagggcggcaggaatcaaccacgacggagtgctccgtacttgggagtcggccat

SEQ ID NO: 416612 - DNA, 140 bp, Artificial Sequence
  Synthetic
atggccgactcccaagtacggagcactccgtcgtggttgattcctgccgcccttgctgccttcactcagctgtgtcccgaagactctcactcttctcgggtccctgttcgggcgccaaccggagacccagcatggcgtat

SEQ ID NO: 416613 - DNA, 140 bp, Artificial Sequence
  Synthetic
aggccctggctgctgatatggctgagtgaaggcagcaagggcggcaggaatcaaccacgacggagtgctcctataacagcgcgggccggtaccaggcagcgtgaggagcgagaggagaaggaccttttgggacagcggtg

SEQ ID NO: 416614 - DNA, 140 bp, Artificial Sequence
  Synthetic
caccgctgtcccaaaaggtccttctcctctcgctcctcacgctgcctggtaccggcccgcgctgttataggagcactccgtcgtggttgattcctgccgcccttgctgccttcactcagccatatcagcagccagggcct

SEQ ID NO: 416615 - DNA, 140 bp, Artificial Sequence
  Synthetic
atacgccatgctgggtctccgaggagagtaggacataagtgggagatgggcgcgagaggctccgtcttgtcagggaaaaagacagatgaattagaaaaagttaggttacggcccggcggacgtacttgggagtcggccat

SEQ ID NO: 416616 - DNA, 140 bp, Artificial Sequence
  Synthetic
atggccgactcccaagtacgtccgccgggccgtaacctaactttttctaattcatctgtctttttccctgacaagacggagcctctcgcgcccatctcccacttatgtcctactctcctcggagacccagcatggcgtat

SEQ ID NO: 416617 - DNA, 140 bp, Artificial Sequence
  Synthetic
atacgccatgctgggtctccaagaaaaagtacgtgttaaaacatataatatgggcagcaaatgaattagacagatttggattagcagaaagcctgttggaaacaaaagaaggatgtcagacgtacttgggagtcggccat

SEQ ID NO: 416618 - DNA, 140 bp, Artificial Sequence
  Synthetic
atggccgactcccaagtacgtctgacatccttcttttgtttccaacaggctttctgctaatccaaatctgtctaattcatttgctgcccatattatatgttttaacacgtactttttcttggagacccagcatggcgtat

SEQ ID NO: 416619 - DNA, 140 bp, Artificial Sequence
  Synthetic
atacgccatgctgggtctccaaaagcctttttaatactgtctgcgtcatttggtgcttgcacgcagaaaagaaagtgaaagataccgaggaagcaaaaaagttagcacagagccatctagcgtacttgggagtcggccat

SEQ ID NO: 416620 - DNA, 140 bp, Artificial Sequence
  Synthetic
atggccgactcccaagtacgctagatggctctgtgctaacttttttgcttcctcggtatctttcactttcttttctgcgtgcaagcaccaaatgacgcagacagtattaaaaaggcttttggagacccagcatggcgtat

SEQ ID NO: 416621 - DNA, 140 bp, Artificial Sequence
  Synthetic
atacgccatgctgggtctccacatctagtggcggaaattacccagtgcaacaagtagctggcaattatgtccatgtgccgttaagtccccgaaccttaaatgcctgggtaaaattagtggcgtacttgggagtcggccat

SEQ ID NO: 416622 - DNA, 140 bp, Artificial Sequence
  Synthetic
atggccgactcccaagtacgccactaattttacccaggcatttaaggttcggggacttaacggcacatggacataattgccagctacttgttgcactgggtaatttccgccactagatgtggagacccagcatggcgtat

SEQ ID NO: 416623 - DNA, 140 bp, Artificial Sequence
  Synthetic
aggccctggctgctgatatgccatgtgccgttaagtccccgaaccttaaatgcctgggtaaaattagtggaggaaaagaagttcggggcagaaatagtaccaggatttcaggcactatcagaccttttgggacagcggtg

SEQ ID NO: 416624 - DNA, 140 bp, Artificial Sequence
  Synthetic
caccgctgtcccaaaaggtctgatagtgcctgaaatcctggtactatttctgccccgaacttcttttcctccactaattttacccaggcatttaaggttcggggacttaacggcacatggcatatcagcagccagggcct

SEQ ID NO: 416625 - DNA, 140 bp, Artificial Sequence
  Synthetic
aggccctggctgctgatatgacaccaggcagccatgcaagtcattagagaaataatcaatgaagaggcggcagactgggaccagcaacacccgataccaggtccactgccagcaggacaagaccttttgggacagcggtg

SEQ ID NO: 416626 - DNA, 140 bp, Artificial Sequence
  Synthetic
caccgctgtcccaaaaggtcttgtcctgctggcagtggacctggtatcgggtgttgctggtcccagtctgccgcctcttcattgattatttctctaatgacttgcatggctgcctggtgtcatatcagcagccagggcct

SEQ ID NO: 416627 - DNA, 140 bp, Artificial Sequence
  Synthetic
atacgccatgctgggtctcctacaatcctactaatatactagatgtaaaacaagggccaaaagaacccttccaaagctatgtagatagattctacaaaagcctacgggcagaacaagcagcgtacttgggagtcggccat

SEQ ID NO: 416628 - DNA, 140 bp, Artificial Sequence
  Synthetic
atggccgactcccaagtacgctgcttgttctgcccgtaggcttttgtagaatctatctacatagctttggaagggttcttttggcccttgttttacatctagtatattagtaggattgtaggagacccagcatggcgtat

SEQ ID NO: 416629 - DNA, 140 bp, Artificial Sequence
  Synthetic
atacgccatgctgggtctccaacccagattgcaagctagtactcaagggtttggggccacaccccaccctagaggaaatgctgacagcatgccaaggaataggaggcccagggcagaaagcgtacttgggagtcggccat

SEQ ID NO: 416630 - DNA, 140 bp, Artificial Sequence
  Synthetic
atggccgactcccaagtacgctttctgccctgggcctcctattccttggcatgctgtcagcatttcctctagggtggggtgtggccccaaacccttgagtactagcttgcaatctgggttggagacccagcatggcgtat

SEQ ID NO: 416631 - DNA, 140 bp, Artificial Sequence
  Synthetic
atacgccatgctgggtctccccattcgctgctgctcaacagaaggcaggaaaaagagggacattgacatgctggaactgtggcaaagtgggacatacagccaagcagtgcagggcccctacgtacttgggagtcggccat

SEQ ID NO: 416632 - DNA, 140 bp, Artificial Sequence
  Synthetic
atggccgactcccaagtacgtaggggccctgcactgcttggctgtatgtcccactttgccacagttccagcatgtcaatgtccctctttttcctgccttctgttgagcagcagcgaatggggagacccagcatggcgtat

SEQ ID NO: 416633 - DNA, 140 bp, Artificial Sequence
  Synthetic
atacgccatgctgggtctcctctgcgccccctgcagatccagcagtggagatgctaaaaaactacatgcaactggggaggcagcagagagagaagcaagggagaccctacaaggaggtgacgtacttgggagtcggccat

SEQ ID NO: 416634 - DNA, 140 bp, Artificial Sequence
  Synthetic
atggccgactcccaagtacgtcacctccttgtagggtctcccttgcttctctctctgctgcctccccagttgcatgtagttttttagcatctccactgctggatctgcagggggcgcagaggagacccagcatggcgtat

SEQ ID NO: 416635 - DNA, 140 bp, Artificial Sequence
  Synthetic
aggccctggctgctgatatgactggggaggcagcagagagagaagcaagggagaccctacaaggaggtgacggaggacttgctgcacctcaattctctctttggagaagaccagtagtccgaccttttgggacagcggtg

SEQ ID NO: 416636 - DNA, 140 bp, Artificial Sequence
  Synthetic
caccgctgtcccaaaaggtcggactactggtcttctccaaagagagaattgaggtgcagcaagtcctccgtcacctccttgtagggtctcccttgcttctctctctgctgcctccccagtcatatcagcagccagggcct

SEQ ID NO: 416637 - DNA, 140 bp, Artificial Sequence
  Synthetic
atacgccatgctgggtctccgacgactcaatagtggcaggaatagaattaggaagcaattacaccccaaaaatagtaggagggataggaggattcataaataccaaagaatacaaagacacgtacttgggagtcggccat

SEQ ID NO: 416638 - DNA, 140 bp, Artificial Sequence
  Synthetic
atggccgactcccaagtacgtgtctttgtattctttggtatttatgaatcctcctatccctcctactatttttggggtgtaattgcttcctaattctattcctgccactattgagtcgtcggagacccagcatggcgtat

SEQ ID NO: 416639 - DNA, 140 bp, Artificial Sequence
  Synthetic
aggccctggctgctgatatggacaccccaataaatatttttggcagaaatatcttaagcgccttaggcatgagtctaaatttcccaatggcaaaattagagccagtaaaggtccaattaagaccttttgggacagcggtg

SEQ ID NO: 416640 - DNA, 140 bp, Artificial Sequence
  Synthetic
caccgctgtcccaaaaggtcttaattggacctttactggctctaattttgccattgggaaatttagactcatgcctaaggcgcttaagatatttctgccaaaaatatttattggggtgtccatatcagcagccagggcct

SEQ ID NO: 416641 - DNA, 140 bp, Artificial Sequence
  Synthetic
atacgccatgctgggtctccaagatattggcccttagagagatctgtgaaaaaatggaaaaggaggggcaactggaagaagcacctcccactaatccatacaacacacccacctttgctacgtacttgggagtcggccat

SEQ ID NO: 416642 - DNA, 140 bp, Artificial Sequence
  Synthetic
atggccgactcccaagtacgtagcaaaggtgggtgtgttgtatggattagtgggaggtgcttcttccagttgcccctccttttccattttttcacagatctctctaagggccaatatcttggagacccagcatggcgtat

SEQ ID NO: 416643 - DNA, 140 bp, Artificial Sequence
  Synthetic
atacgccatgctgggtctccttaaataaggtaacccaagactttacagaggtccagctaggtattccccacccggcaggactggcagaaagaagaagaatatcagtactagatgtaggagcgtacttgggagtcggccat

SEQ ID NO: 416644 - DNA, 140 bp, Artificial Sequence
  Synthetic
atggccgactcccaagtacgctcctacatctagtactgatattcttcttctttctgccagtcctgccgggtggggaatacctagctggacctctgtaaagtcttgggttaccttatttaaggagacccagcatggcgtat

SEQ ID NO: 416645 - DNA, 140 bp, Artificial Sequence
  Synthetic
aggccctggctgctgatatgcccggcaggactggcagaaagaagaagaatatcagtactagatgtaggagatgcctacttcagtgtcccactagacccagacttcagacaatatacagcagaccttttgggacagcggtg

SEQ ID NO: 416646 - DNA, 140 bp, Artificial Sequence
  Synthetic
caccgctgtcccaaaaggtctgctgtatattgtctgaagtctgggtctagtgggacactgaagtaggcatctcctacatctagtactgatattcttcttctttctgccagtcctgccgggcatatcagcagccagggcct

SEQ ID NO: 416647 - DNA, 140 bp, Artificial Sequence
  Synthetic
atacgccatgctgggtctccgattttccaccccagaagaaaaattccaaaaggaccccccattccagtggatgggctatgagctctggccaaaaaagtggaagctgcaaaaaatacaaatcgtacttgggagtcggccat

SEQ ID NO: 416648 - DNA, 140 bp, Artificial Sequence
  Synthetic
atggccgactcccaagtacgatttgtattttttgcagcttccacttttttggccagagctcatagcccatccactggaatggggggtccttttggaatttttcttctggggtggaaaatcggagacccagcatggcgtat

SEQ ID NO: 416649 - DNA, 140 bp, Artificial Sequence
  Synthetic
atacgccatgctgggtctccaccagaaagggaggtttggacagtaaatgacattcagaaactagtgggggtactaaactgggcagctcaacttttccctggaatcaaaacaaagcacatccgtacttgggagtcggccat

SEQ ID NO: 416650 - DNA, 140 bp, Artificial Sequence
  Synthetic
atggccgactcccaagtacggatgtgctttgttttgattccagggaaaagttgagctgcccagtttagtacccccactagtttctgaatgtcatttactgtccaaacctccctttctggtggagacccagcatggcgtat

SEQ ID NO: 416651 - DNA, 140 bp, Artificial Sequence
  Synthetic
atacgccatgctgggtctccagaactagcagaggcagagatgcaggaaaacaagatcatcctggaacaggaacaggaaggatcctactacaaagaaggggtacctctagaagcaacagtgcgtacttgggagtcggccat

SEQ ID NO: 416652 - DNA, 140 bp, Artificial Sequence
  Synthetic
atggccgactcccaagtacgcactgttgcttctagaggtaccccttctttgtagtaggatccttcctgttcctgttccaggatgatcttgttttcctgcatctctgcctctgctagttctggagacccagcatggcgtat

SEQ ID NO: 416653 - DNA, 140 bp, Artificial Sequence
  Synthetic
atacgccatgctgggtctcccagaaaaacttagcaaaccagtggacatacaaaattcatcagggggataaagtcctaaaggtaggaaaatatgcaaaggtcaaaaatacccacaccaatgcgtacttgggagtcggccat

SEQ ID NO: 416654 - DNA, 140 bp, Artificial Sequence
  Synthetic
atggccgactcccaagtacgcattggtgtgggtatttttgacctttgcatattttcctacctttaggactttatccccctgatgaattttgtatgtccactggtttgctaagtttttctgggagacccagcatggcgtat

SEQ ID NO: 416655 - DNA, 140 bp, Artificial Sequence
  Synthetic
aggccctggctgctgatatgatgggaccaatggtggacagattactggcaagtaacttggatcccagaatgggactttgtctcgaccccaccactagtaagactagcctacaacctggtcgaccttttgggacagcggtg

SEQ ID NO: 416656 - DNA, 140 bp, Artificial Sequence
  Synthetic
caccgctgtcccaaaaggtcgaccaggttgtaggctagtcttactagtggtggggtcgagacaaagtcccattctgggatccaagttacttgccagtaatctgtccaccattggtcccatcatatcagcagccagggcct

SEQ ID NO: 416657 - DNA, 140 bp, Artificial Sequence
  Synthetic
atacgccatgctgggtctcccagagtctcaaaggaagggaaggcagggtatgtcacggacaggggaagagacaaagttaaaccattagagcagacaacaaaccaacaagcagaacttgagcgtacttgggagtcggccat

SEQ ID NO: 416658 - DNA, 140 bp, Artificial Sequence
  Synthetic
atggccgactcccaagtacgctcaagttctgcttgttggtttgttgtctgctctaatggtttaactttgtctcttcccctgtccgtgacataccctgccttcccttcctttgagactctgggagacccagcatggcgtat

SEQ ID NO: 416659 - DNA, 140 bp, Artificial Sequence
  Synthetic
atacgccatgctgggtctccagattcacagtatgtcatgggaataatagctggacaaccaacagaaacagagtcatcagtagtaaataggataattgaagaaatgatcaaaaaggaagcacgtacttgggagtcggccat

SEQ ID NO: 416660 - DNA, 140 bp, Artificial Sequence
  Synthetic
atggccgactcccaagtacgtgcttcctttttgatcatttcttcaattatcctatttactactgatgactctgtttctgttggttgtccagctattattcccatgacatactgtgaatctggagacccagcatggcgtat

SEQ ID NO: 416661 - DNA, 140 bp, Artificial Sequence
  Synthetic
atacgccatgctgggtctccagtagaccacctagtgagccaaggaattaggcaggttctatttctagaaaagatagaaccagcacaagaagaacatgaaaaatatcatggcaatgtaaaacgtacttgggagtcggccat

SEQ ID NO: 416662 - DNA, 140 bp, Artificial Sequence
  Synthetic
atggccgactcccaagtacgttttacattgccatgatatttttcatgttcttcttgtgctggttctatcttttctagaaatagaacctgcctaattccttggctcactaggtggtctactggagacccagcatggcgtat

SEQ ID NO: 416663 - DNA, 140 bp, Artificial Sequence
  Synthetic
aggccctggctgctgatatgagatagaaccagcacaagaagaacatgaaaaatatcatggcaatgtaaaagagctggttcataaatttggacttccacacctagtggcaaaacaaatagtgaccttttgggacagcggtg

SEQ ID NO: 416664 - DNA, 140 bp, Artificial Sequence
  Synthetic
caccgctgtcccaaaaggtcactatttgttttgccactaggtgtggaagtccaaatttatgaaccagctcttttacattgccatgatatttttcatgttcttcttgtgctggttctatctcatatcagcagccagggcct

SEQ ID NO: 416665 - DNA, 140 bp, Artificial Sequence
  Synthetic
atacgccatgctgggtctcctaaatgcagaactagggacatggcagatggactgtacacatttggaaggaaaaatcataatagtagcagtccatgtagccagtggattcatagaagcagacgtacttgggagtcggccat

SEQ ID NO: 416666 - DNA, 140 bp, Artificial Sequence
  Synthetic
atggccgactcccaagtacgtctgcttctatgaatccactggctacatggactgctactattatgatttttccttccaaatgtgtacagtccatctgccatgtccctagttctgcatttaggagacccagcatggcgtat

SEQ ID NO: 416667 - DNA, 140 bp, Artificial Sequence
  Synthetic
aggccctggctgctgatatgtttacctcacaagatgtaaagatggtggcctggtgggtaggaatagaacaatcctttggagtaccctacaatccacagagtcagggagtagtagaagcaagaccttttgggacagcggtg

SEQ ID NO: 416668 - DNA, 140 bp, Artificial Sequence
  Synthetic
caccgctgtcccaaaaggtcttgcttctactactccctgactctgtggattgtagggtactccaaaggattgttctattcctacccaccaggccaccatctttacatcttgtgaggtaaacatatcagcagccagggcct

SEQ ID NO: 416669 - DNA, 140 bp, Artificial Sequence
  Synthetic
aggccctggctgctgatatgacctggtgagctattgtggaaaggggaaggagcagtcatcgtaaaggtagggacagagatcaaggtagtacccagaagaaaggcaaagatcataaggcatgaccttttgggacagcggtg

SEQ ID NO: 416670 - DNA, 140 bp, Artificial Sequence
  Synthetic
caccgctgtcccaaaaggtcatgccttatgatctttgcctttcttctgggtactaccttgatctctgtccctacctttacgatgactgctccttcccctttccacaatagctcaccaggtcatatcagcagccagggcct

SEQ ID NO: 416671 - DNA, 140 bp, Artificial Sequence
  Synthetic
atacgccatgctgggtctcctatggaggaggaaaaggattggattgtggtaccgacatggaggataccaggcaggctagagaaatggcacagtctggtcaagtacctgaagcatagaacacgtacttgggagtcggccat

SEQ ID NO: 416672 - DNA, 140 bp, Artificial Sequence
  Synthetic
atggccgactcccaagtacgtgttctatgcttcaggtacttgaccagactgtgccatttctctagcctgcctggtatcctccatgtcggtaccacaatccaatccttttcctcctccataggagacccagcatggcgtat

SEQ ID NO: 416673 - DNA, 140 bp, Artificial Sequence
  Synthetic
atacgccatgctgggtctccctggtggacttgcagtagagtaatattccccctaagaaaaggagcatggctagagatccaaggatattggaatctgaccccagaagagggattcttgagccgtacttgggagtcggccat

SEQ ID NO: 416674 - DNA, 140 bp, Artificial Sequence
  Synthetic
atggccgactcccaagtacggctcaagaatccctcttctggggtcagattccaatatccttggatctctagccatgctccttttcttagggggaatattactctactgcaagtccaccagggagacccagcatggcgtat

SEQ ID NO: 416675 - DNA, 140 bp, Artificial Sequence
  Synthetic
atacgccatgctgggtctcctctagccttaagagttgtacaagaaggaaagaatggatccaagggagagagtgccaccaggaaacagcgacgaagagacaataggagaggcattcgcttgcgtacttgggagtcggccat

SEQ ID NO: 416676 - DNA, 140 bp, Artificial Sequence
  Synthetic
atggccgactcccaagtacgcaagcgaatgcctctcctattgtctcttcgtcgctgtttcctggtggcactctctcccttggatccattctttccttcttgtacaactcttaaggctagaggagacccagcatggcgtat

SEQ ID NO: 416677 - DNA, 140 bp, Artificial Sequence
  Synthetic
atacgccatgctgggtctcccccgggaactcattttccaggtctggcaaaggtcttgggcatattggcgtgaggaacagggcatgtcaactagctatgccaagtataggtacttacttctcgtacttgggagtcggccat

SEQ ID NO: 416678 - DNA, 140 bp, Artificial Sequence
  Synthetic
atggccgactcccaagtacgagaagtaagtacctatacttggcatagctagttgacatgccctgttcctcacgccaatatgcccaagacctttgccagacctggaaaatgagttcccgggggagacccagcatggcgtat

SEQ ID NO: 416679 - DNA, 140 bp, Artificial Sequence
  Synthetic
aggccctggctgctgatatgaggcggttgtcaacactcaaggattggacaaccagggggaggaaatcctctctcagctataccgccccctgggggcatgtaataataaatgctattgtaagaccttttgggacagcggtg

SEQ ID NO: 416680 - DNA, 140 bp, Artificial Sequence
  Synthetic
caccgctgtcccaaaaggtcttacaatagcatttattattacatgcccccagggggcggtatagctgagagaggatttcctccccctggttgtccaatccttgagtgttgacaaccgcctcatatcagcagccagggcct

SEQ ID NO: 416681 - DNA, 140 bp, Artificial Sequence
  Synthetic
aggccctggctgctgatatgtatgttatgaccgctcgagaaaaagatcttcaaaaagggctaagactgctacatcttctgcatcagacaagtgagtaagatgtggggtaagaatttactagaccttttgggacagcggtg

SEQ ID NO: 416682 - DNA, 140 bp, Artificial Sequence
  Synthetic
caccgctgtcccaaaaggtctagtaaattcttaccccacatcttactcacttgtctgatgcagaagatgtagcagtcttagccctttttgaagatctttttctcgagcggtcataacatacatatcagcagccagggcct

SEQ ID NO: 416683 - DNA, 140 bp, Artificial Sequence
  Synthetic
atacgccatgctgggtctccatatgtgactgttttctatggtgtgcccgtgtggagaaatgcatccattcccctcttttgtgcaaccaaaaacagagatacttggggaaccatacagtgccgtacttgggagtcggccat

SEQ ID NO: 416684 - DNA, 140 bp, Artificial Sequence
  Synthetic
atggccgactcccaagtacggcactgtatggttccccaagtatctctgtttttggttgcacaaaagaggggaatggatgcatttctccacacgggcacaccatagaaaacagtcacatatggagacccagcatggcgtat

SEQ ID NO: 416685 - DNA, 140 bp, Artificial Sequence
  Synthetic
aggccctggctgctgatatgccctcttttgtgcaaccaaaaacagagatacttggggaaccatacagtgcttgccagacaatgatgattatcaagaaatagccctgaatgtgacagaggcgaccttttgggacagcggtg

SEQ ID NO: 416686 - DNA, 140 bp, Artificial Sequence
  Synthetic
caccgctgtcccaaaaggtcgcctctgtcacattcagggctatttcttgataatcatcattgtctggcaagcactgtatggttccccaagtatctctgtttttggttgcacaaaagagggcatatcagcagccagggcct

SEQ ID NO: 416687 - DNA, 140 bp, Artificial Sequence
  Synthetic
atacgccatgctgggtctccggaatctatttgagacatcaataaaaccatgtgtcaaactaacacctctatgtgtagcgatgaactgtaccaacatcgctagcaacacaaacacatcagccgtacttgggagtcggccat

SEQ ID NO: 416688 - DNA, 140 bp, Artificial Sequence
  Synthetic
atggccgactcccaagtacggctgatgtgtttgtgttgctagcgatgttggtacagttcatcgctacacatagaggtgttagtttgacacatggttttattgatgtctcaaatagattccggagacccagcatggcgtat

SEQ ID NO: 416689 - DNA, 140 bp, Artificial Sequence
  Synthetic
atacgccatgctgggtctcccatgcatacgaaataacagctgcacaggattgggagaggaagaggtagtccagtgtcagtttgacatgacaggattacagagagataagaaaaaacgatacgtacttgggagtcggccat

SEQ ID NO: 416690 - DNA, 140 bp, Artificial Sequence
  Synthetic
atggccgactcccaagtacgtatcgttttttcttatctctctgtaatcctgtcatgtcaaactgacactggactacctcttcctctcccaatcctgtgcagctgttatttcgtatgcatgggagacccagcatggcgtat

SEQ ID NO: 416691 - DNA, 140 bp, Artificial Sequence
  Synthetic
aggccctggctgctgatatgcagtgtcagtttgacatgacaggattacagagagataagaaaaaacgatataatgagacatggtattcaaaagatgtagtttgtgagaccaataataagagaccttttgggacagcggtg

SEQ ID NO: 416692 - DNA, 140 bp, Artificial Sequence
  Synthetic
caccgctgtcccaaaaggtctcttattattggtctcacaaactacatcttttgaataccatgtctcattatatcgttttttcttatctctctgtaatcctgtcatgtcaaactgacactgcatatcagcagccagggcct

SEQ ID NO: 416693 - DNA, 140 bp, Artificial Sequence
  Synthetic
atacgccatgctgggtctccggactatcataagcttaaatagttattacaacttaacaatgcattgtaagaggccaggaaacaagacagttgtaccaataacactcatgtcagggttagtcgtacttgggagtcggccat

SEQ ID NO: 416694 - DNA, 140 bp, Artificial Sequence
  Synthetic
atggccgactcccaagtacgactaaccctgacatgagtgttattggtacaactgtcttgtttcctggcctcttacaatgcattgttaagttgtaataactatttaagcttatgatagtccggagacccagcatggcgtat

SEQ ID NO: 416695 - DNA, 140 bp, Artificial Sequence
  Synthetic
atacgccatgctgggtctccaaaaccaggaactggctcagacccagaagtggcatacatgtggactaactgcagaggagaattcctctactgcaacatgacttggttcctcaattgggtacgtacttgggagtcggccat

SEQ ID NO: 416696 - DNA, 140 bp, Artificial Sequence
  Synthetic
atggccgactcccaagtacgtacccaattgaggaaccaagtcatgttgcagtagaggaattctcctctgcagttagtccacatgtatgccacttctgggtctgagccagttcctggttttggagacccagcatggcgtat

SEQ ID NO: 416697 - DNA, 140 bp, Artificial Sequence
  Synthetic
atacgccatgctgggtctccattgattggctggatacaaaccaaacaaacattaccttcagtgcagaggtggcagaactgtaccgattggaattgggggattataaattaatagaagtgacgtacttgggagtcggccat

SEQ ID NO: 416698 - DNA, 140 bp, Artificial Sequence
  Synthetic
atggccgactcccaagtacgtcacttctattaatttataatcccccaattccaatcggtacagttctgccacctctgcactgaaggtaatgtttgtttggtttgtatccagccaatcaatggagacccagcatggcgtat

SEQ ID NO: 416699 - DNA, 140 bp, Artificial Sequence
  Synthetic
atacgccatgctgggtctcccaccaattggcttcgcacctacagaagaaaaaagatactcctctgctccagagagacataagagaggtgtgtttgtgctagggttcttaggttttctcaccgtacttgggagtcggccat

SEQ ID NO: 416700 - DNA, 140 bp, Artificial Sequence
  Synthetic
atggccgactcccaagtacggtgagaaaacctaagaaccctagcacaaacacacctctcttatgtctctctggagcagaggagtatcttttttcttctgtaggtgcgaagccaattggtgggagacccagcatggcgtat

SEQ ID NO: 416701 - DNA, 140 bp, Artificial Sequence
  Synthetic
aggccctggctgctgatatgaaatctccaggcaagagtcactgctattgagaaatacctaaaggaccaggcgcaactaaattcatggggatgcgcgtttagacaagtctgccacactactgaccttttgggacagcggtg

SEQ ID NO: 416702 - DNA, 140 bp, Artificial Sequence
  Synthetic
caccgctgtcccaaaaggtcagtagtgtggcagacttgtctaaacgcgcatccccatgaatttagttgcgcctggtcctttaggtatttctcaatagcagtgactcttgcctggagatttcatatcagcagccagggcct

SEQ ID NO: 416703 - DNA, 140 bp, Artificial Sequence
  Synthetic
atacgccatgctgggtctccgcaacaatgggaaacacaaatccgctacctagaggcaaatatcagtgaaagtctagaacaggcgcaaatccagcaagaaaagaacatgtatgaattacaacgtacttgggagtcggccat

SEQ ID NO: 416704 - DNA, 140 bp, Artificial Sequence
  Synthetic
atggccgactcccaagtacgttgtaattcatacatgttcttttcttgctggatttgcgcctgttctagactttcactgatatttgcctctaggtagcggatttgtgtttcccattgttgcggagacccagcatggcgtat

SEQ ID NO: 416705 - DNA, 140 bp, Artificial Sequence
  Synthetic
atacgccatgctgggtctccgatcaaatatattcagtatggagttctcatagtagtaggaatagtagctcttagactaataatatatgtagtacagctattaggtagacttagaaggggccgtacttgggagtcggccat

SEQ ID NO: 416706 - DNA, 140 bp, Artificial Sequence
  Synthetic
atggccgactcccaagtacggccccttctaagtctacctaatagctgtactacatatattattagtctaagagctactattcctactactatgagaactccatactgaatatatttgatcggagacccagcatggcgtat

SEQ ID NO: 416707 - DNA, 140 bp, Artificial Sequence
  Synthetic
aggccctggctgctgatatgttagactaataatatatgtagtacagctattaggtagacttagaaggggctataggcctgttttctcttccccccccggttatctccaacagatccatatgaccttttgggacagcggtg

SEQ ID NO: 416708 - DNA, 140 bp, Artificial Sequence
  Synthetic
caccgctgtcccaaaaggtcatatggatctgttggagataaccggggggggaagagaaaacaggcctatagccccttctaagtctacctaatagctgtactacatatattattagtctaacatatcagcagccagggcct

SEQ ID NO: 416709 - DNA, 140 bp, Artificial Sequence
  Synthetic
aggccctggctgctgatatggaagcgacgagggctacagatcctggccttggcagatcgagtacatccacttcctaattcgccagctgaggaacctcttgatttggctatacgaaggctggaccttttgggacagcggtg

SEQ ID NO: 416710 - DNA, 140 bp, Artificial Sequence
  Synthetic
caccgctgtcccaaaaggtccagccttcgtatagccaaatcaagaggttcctcagctggcgaattaggaagtggatgtactcgatctgccaaggccaggatctgtagccctcgtcgcttccatatcagcagccagggcct

SEQ ID NO: 416711 - DNA, 140 bp, Artificial Sequence
  Synthetic
atacgccatgctgggtctcccactcaggctcccgctcgcacacctccaatatgggatcagctggctccaagaagcagtccaagccgctgcgagagctgcgggagagactcttacgagcgccgtacttgggagtcggccat

SEQ ID NO: 416712 - DNA, 140 bp, Artificial Sequence
  Synthetic
atggccgactcccaagtacggcgctcgtaagagtctctcccgcagctctcgcagcggcttggactgcttcttggagccagctgatcccatattggaggtgtgcgagcgggagcctgagtgggagacccagcatggcgtat

SEQ ID NO: 416713 - DNA, 140 bp, Artificial Sequence
  Synthetic
atacgccatgctgggtctcccaatccccagaagaatcagacaaggacttgaactcgccctcctgtgagggacaaaacgccccaggggcagaagggggagggcaacaagacatagaagaagcgtacttgggagtcggccat

SEQ ID NO: 416714 - DNA, 140 bp, Artificial Sequence
  Synthetic
atggccgactcccaagtacgcttcttctatgtcttgttgccctcccccttctgcccctggggcgttttgtccctcacaggagggcgagttcaagtccttgtctgattcttctggggattgggagacccagcatggcgtat

SEQ ID NO: 416715 - DNA, 140 bp, Artificial Sequence
  Synthetic
atacgccatgctgggtctccaatgaagtgggagcatatgtcaggcccaataagccactgagagaaatgacatacaaattggcaatagacatgtctcattttataaaagaaaaggggggaccgtacttgggagtcggccat

SEQ ID NO: 416716 - DNA, 140 bp, Artificial Sequence
  Synthetic
atggccgactcccaagtacggtccccccttttcttttataaaatgagacatgtctattgccaatttgtatgtcatttctctcagtggcttattgggcctgacatatgctcccacttcattggagacccagcatggcgtat

SEQ ID NO: 416717 - DNA, 140 bp, Artificial Sequence
  Synthetic
  misc_feature (75)..(75): n is a, c, g, or t
atacgccatgctgggtctccaggcctctgggagtaaggtaagtactccgaattttgaattgtctactctagaggngagtaggacataagtgggagatgggcgcgagaggctccgtcttgtcgtacttgggagtcggccat

SEQ ID NO: 416718 - DNA, 140 bp, Artificial Sequence
  Synthetic
  misc_feature (66)..(66): n is a, c, g, or t
atggccgactcccaagtacgacaagacggagcctctcgcgcccatctcccacttatgtcctactcncctctagagtagacaattcaaaattcggagtacttaccttactcccagaggcctggagacccagcatggcgtat

SEQ ID NO: 416719 - DNA, 140 bp, Artificial Sequence
  Synthetic
  misc_feature (25)..(25): n is a, c, g, or t
aggccctggctgctgatatggaggngagtaggacataagtgggagatgggcgcgagaggctccgtcttgtcagggaagaagacagatgaattagaaaaagttaggttacggcccggcggagaccttttgggacagcggtg

SEQ ID NO: 416720 - DNA, 140 bp, Artificial Sequence
  Synthetic
  misc_feature (116)..(116): n is a, c, g, or t
caccgctgtcccaaaaggtctccgccgggccgtaacctaactttttctaattcatctgtcttcttccctgacaagacggagcctctcgcgcccatctcccacttatgtcctactcncctccatatcagcagccagggcct

SEQ ID NO: 416721 - DNA, 140 bp, Artificial Sequence
  Synthetic
  misc_feature (48)..(48): n is a, c, g, or t
  misc_feature (54)..(54): n is a, c, g, or t
  misc_feature (92)..(92): n is a, c, g, or t
atacgccatgctgggtctccaaaagcctttttaatactgtctgcgtcntttggngcttgcacgcagaaaagaaagtgaaagataccgaggangcaaaaaagttagcacagagccatctagcgtacttgggagtcggccat

SEQ ID NO: 416722 - DNA, 140 bp, Artificial Sequence
  Synthetic
  misc_feature (49)..(49): n is a, c, g, or t
  misc_feature (87)..(87): n is a, c, g, or t
  misc_feature (93)..(93): n is a, c, g, or t
atggccgactcccaagtacgctagatggctctgtgctaacttttttgcntcctcggtatctttcactttcttttctgcgtgcaagcnccaaangacgcagacagtattaaaaaggcttttggagacccagcatggcgtat

SEQ ID NO: 416723 - DNA, 140 bp, Artificial Sequence
  Synthetic
  misc_feature (32)..(32): n is a, c, g, or t
atacgccatgctgggtctccagtggcggaaantacccagtgcaacaagtagctggcaattatgtccatgtgccattaagtccccgaaccctaaatgcctgggtaaaattagtggaggaaacgtacttgggagtcggccat

SEQ ID NO: 416724 - DNA, 140 bp, Artificial Sequence
  Synthetic
  misc_feature (109)..(109): n is a, c, g, or t
atggccgactcccaagtacgtttcctccactaattttacccaggcatttagggttcggggacttaatggcacatggacataattgccagctacttgttgcactgggtantttccgccactggagacccagcatggcgtat

SEQ ID NO: 416725 - DNA, 140 bp, Artificial Sequence
  Synthetic
  misc_feature (44)..(44): n is a, c, g, or t
  misc_feature (77)..(77): n is a, c, g, or t
  misc_feature (92)..(92): n is a, c, g, or t
atacgccatgctgggtctcctgtaccccttatgatatcaatcanatgctaaattgtgtgggagaacaccaggcagcnatgcaagtcattagngaaataatcaatgaagaggcggcagactcgtacttgggagtcggccat

SEQ ID NO: 416726 - DNA, 140 bp, Artificial Sequence
  Synthetic
  misc_feature (49)..(49): n is a, c, g, or t
  misc_feature (64)..(64): n is a, c, g, or t
  misc_feature (97)..(97): n is a, c, g, or t
atggccgactcccaagtacgagtctgccgcctcttcattgattatttcnctaatgacttgcatngctgcctggtgttctcccacacaatttagcatntgattgatatcataaggggtacaggagacccagcatggcgtat

SEQ ID NO: 416727 - DNA, 140 bp, Artificial Sequence
  Synthetic
atacgccatgctgggtctccctatgtagatagattctacaaaagcttacgggcagaacaagcagacacggccgtgagagcatggatgacagagacactactggtccagaatgctaacccacgtacttgggagtcggccat

SEQ ID NO: 416728 - DNA, 140 bp, Artificial Sequence
  Synthetic
atggccgactcccaagtacgtgggttagcattctggaccagtagtgtctctgtcatccatgctctcacggccgtgtctgcttgttctgcccgtaagcttttgtagaatctatctacatagggagacccagcatggcgtat

SEQ ID NO: 416729 - DNA, 140 bp, Artificial Sequence
  Synthetic
atacgccatgctgggtctccccgtgagagcatggatgacagagacactactggtccagaatgctaacccagattgcaagctggtactcaagggtttggggccacaccccaccctagaggacgtacttgggagtcggccat

SEQ ID NO: 416730 - DNA, 140 bp, Artificial Sequence
  Synthetic
atggccgactcccaagtacgtcctctagggtggggtgtggccccaaacccttgagtaccagcttgcaatctgggttagcattctggaccagtagtgtctctgtcatccatgctctcacggggagacccagcatggcgtat

SEQ ID NO: 416731 - DNA, 140 bp, Artificial Sequence
  Synthetic
aggccctggctgctgatatggctgctgctcaacagaaggcaggaaagagagggacattgacatgctggaactgtggcaaagtgggacatacagccaagcaatgcagggcccctagaagacgaccttttgggacagcggtg

SEQ ID NO: 416732 - DNA, 140 bp, Artificial Sequence
  Synthetic
caccgctgtcccaaaaggtcgtcttctaggggccctgcattgcttggctgtatgtcccactttgccacagttccagcatgtcaatgtccctctctttcctgccttctgttgagcagcagccatatcagcagccagggcct

SEQ ID NO: 416733 - DNA, 140 bp, Artificial Sequence
  Synthetic
  misc_feature (44)..(44): n is a, c, g, or t
atacgccatgctgggtctccgacagacaggcgggttttttaggncttggaccctggggaaagaagcctcgcaacttccccgcggcccaagtgcctcaggaggtggtgccatctgcacccccgtacttgggagtcggccat

SEQ ID NO: 416734 - DNA, 140 bp, Artificial Sequence
  Synthetic
  misc_feature (97)..(97): n is a, c, g, or t
atggccgactcccaagtacgggggtgcagatggcaccacctcctgaggcacttgggccgcggggaagttgcgaggcttctttccccagggtccaagncctaaaaaacccgcctgtctgtcggagacccagcatggcgtat

SEQ ID NO: 416735 - DNA, 140 bp, Artificial Sequence
  Synthetic
aggccctggctgctgatatgcaacttccccgcggcccaagtgcctcaggaggtggtgccatctgcacccccgatggacacagcagagagcaagacatatcagagggcgataccatctgcggaccttttgggacagcggtg

SEQ ID NO: 416736 - DNA, 140 bp, Artificial Sequence
  Synthetic
caccgctgtcccaaaaggtccgcagatggtatcgccctctgatatgtcttgctctctgctgtgtccatcgggggtgcagatggcaccacctcctgaggcacttgggccgcggggaagttgcatatcagcagccagggcct

SEQ ID NO: 416737 - DNA, 140 bp, Artificial Sequence
  Synthetic
atacgccatgctgggtctcctagaagtagtaggaaaaaggataagagcaactataatgacaggagacaccccaataaatatttttggcagaaatatcttaagcgccttaggcatgagtctcgtacttgggagtcggccat

SEQ ID NO: 416738 - DNA, 140 bp, Artificial Sequence
  Synthetic
atggccgactcccaagtacgagactcatgcctaaggcgcttaagatatttctgccaaaaatatttattggggtgtctcctgtcattatagttgctcttatcctttttcctactacttctaggagacccagcatggcgtat

SEQ ID NO: 416739 - DNA, 140 bp, Artificial Sequence
  Synthetic
  misc_feature (46)..(46): n is a, c, g, or t
  misc_feature (118)..(118): n is a, c, g, or t
atacgccatgctgggtctccgaaaggatggaccaaaaatcagacantggcctttatctaaagaaaagatactggcccttagagagatctgtgaaaaaatggaaaaggaggggcagctngacgtacttgggagtcggccat

SEQ ID NO: 416740 - DNA, 140 bp, Artificial Sequence
  Synthetic
  misc_feature (23)..(23): n is a, c, g, or t
  misc_feature (95)..(95): n is a, c, g, or t
atggccgactcccaagtacgtcnagctgcccctccttttccattttttcacagatctctctaagggccagtatcttttctttagataaaggccantgtctgatttttggtccatcctttcggagacccagcatggcgtat

SEQ ID NO: 416741 - DNA, 140 bp, Artificial Sequence
  Synthetic
  misc_feature (68)..(68): n is a, c, g, or t
aggccctggctgctgatatgctggcccttagagagatctgtgaaaaaatggaaaaggaggggcagctngaagaagcacctcccactaatccatacaacacacccacctttgctgtaagaagaccttttgggacagcggtg

SEQ ID NO: 416742 - DNA, 140 bp, Artificial Sequence
  Synthetic
  misc_feature (73)..(73): n is a, c, g, or t
caccgctgtcccaaaaggtcttcttacagcaaaggtgggtgtgttgtatggattagtgggaggtgcttcttcnagctgcccctccttttccattttttcacagatctctctaagggccagcatatcagcagccagggcct

SEQ ID NO: 416743 - DNA, 140 bp, Artificial Sequence
  Synthetic
  misc_feature (72)..(72): n is a, c, g, or t
  misc_feature (102)..(102): n is a, c, g, or t
aggccctggctgctgatatgaggactggcagaaagaagaagaatatcagtactagatgtaggagatgcctanttcagtgtcccactagacccagacttcagncaatatacagcattcactgaccttttgggacagcggtg

SEQ ID NO: 416744 - DNA, 140 bp, Artificial Sequence
  Synthetic
  misc_feature (39)..(39): n is a, c, g, or t
  misc_feature (69)..(69): n is a, c, g, or t
caccgctgtcccaaaaggtcagtgaatgctgtatattgnctgaagtctgggtctagtgggacactgaantaggcatctcctacatctagtactgatattcttcttctttctgccagtcctcatatcagcagccagggcct

SEQ ID NO: 416745 - DNA, 140 bp, Artificial Sequence
  Synthetic
  misc_feature (91)..(91): n is a, c, g, or t
  misc_feature (94)..(94): n is a, c, g, or t
aggccctggctgctgatatggaaaggtactagaccccttcagaaaggccaacaatgatgtcaccataatccagtacatggatgacatcctngtngcaagcgatagaagtgatttagagcagaccttttgggacagcggtg

SEQ ID NO: 416746 - DNA, 140 bp, Artificial Sequence
  Synthetic
  misc_feature (47)..(47): n is a, c, g, or t
  misc_feature (50)..(50): n is a, c, g, or t
caccgctgtcccaaaaggtctgctctaaatcacttctatcgcttgcnacnaggatgtcatccatgtactggattatggtgacatcattgttggcctttctgaaggggtctagtacctttccatatcagcagccagggcct

SEQ ID NO: 416747 - DNA, 140 bp, Artificial Sequence
  Synthetic
  misc_feature (61)..(61): n is a, c, g, or t
  misc_feature (70)..(70): n is a, c, g, or t
atacgccatgctgggtctccccaccccagaagaaaagttccaaaaggaccccccattccantggatgggntatgagctctggccaaaaaagtggaaactgcaaaaaatacaaataccagacgtacttgggagtcggccat

SEQ ID NO: 416748 - DNA, 140 bp, Artificial Sequence
  Synthetic
  misc_feature (71)..(71): n is a, c, g, or t
  misc_feature (80)..(80): n is a, c, g, or t
atggccgactcccaagtacgtctggtatttgtattttttgcagtttccacttttttggccagagctcatancccatccantggaatggggggtccttttggaacttttcttctggggtggggagacccagcatggcgtat

SEQ ID NO: 416749 - DNA, 140 bp, Artificial Sequence
  Synthetic
  misc_feature (74)..(74): n is a, c, g, or t
aggccctggctgctgatatgtatgagctctggccaaaaaagtggaaactgcaaaaaatacaaataccagaaagngaggtttggacagtaaatgacattcagaaactagtgggagtattaagaccttttgggacagcggtg

SEQ ID NO: 416750 - DNA, 140 bp, Artificial Sequence
  Synthetic
  misc_feature (67)..(67): n is a, c, g, or t
caccgctgtcccaaaaggtcttaatactcccactagtttctgaatgtcatttactgtccaaacctcnctttctggtatttgtattttttgcagtttccacttttttggccagagctcatacatatcagcagccagggcct

SEQ ID NO: 416751 - DNA, 140 bp, Artificial Sequence
  Synthetic
  misc_feature (83)..(83): n is a, c, g, or t
  misc_feature (95)..(95): n is a, c, g, or t
  misc_feature (100)..(100): n is a, c, g, or t
atacgccatgctgggtctccctgatcaggggaaagatgaccctgacagaagaggtacagtggacagaactagcagaggcaganatgcaggaaaanaaaancatcctggaacaggaacaggcgtacttgggagtcggccat

SEQ ID NO: 416752 - DNA, 140 bp, Artificial Sequence
  Synthetic
  misc_feature (41)..(41): n is a, c, g, or t
  misc_feature (46)..(46): n is a, c, g, or t
  misc_feature (58)..(58): n is a, c, g, or t
atggccgactcccaagtacgcctgttcctgttccaggatgnttttnttttcctgcatntctgcctctgctagttctgtccactgtacctcttctgtcagggtcatctttcccctgatcagggagacccagcatggcgtat

SEQ ID NO: 416753 - DNA, 140 bp, Artificial Sequence
  Synthetic
  misc_feature (59)..(59): n is a, c, g, or t
  misc_feature (107)..(107): n is a, c, g, or t
atacgccatgctgggtctccaacttagcaaaccagtggacatacaaaattcatcagggngataaagtcctaaaagtaggaaaatatgcaaaggtcaaaaacacccanaccaatggagtaacgtacttgggagtcggccat

SEQ ID NO: 416754 - DNA, 140 bp, Artificial Sequence
  Synthetic
  misc_feature (34)..(34): n is a, c, g, or t
  misc_feature (82)..(82): n is a, c, g, or t
atggccgactcccaagtacgttactccattggtntgggtgtttttgacctttgcatattttcctacttttaggactttatcnccctgatgaattttgtatgtccactggtttgctaagttggagacccagcatggcgtat

SEQ ID NO: 416755 - DNA, 140 bp, Artificial Sequence
  Synthetic
  misc_feature (70)..(70): n is a, c, g, or t
atacgccatgctgggtctccttgtctcgaccccaccactggtaagactagcctacaacctggtcaaggancccctagaaaaggtagaaactttctacacagatgggtcctgcaacagagtcgtacttgggagtcggccat

SEQ ID NO: 416756 - DNA, 140 bp, Artificial Sequence
  Synthetic
  misc_feature (71)..(71): n is a, c, g, or t
atggccgactcccaagtacgactctgttgcaggacccatctgtgtagaaagtttctaccttttctaggggntccttgaccaggttgtaggctagtcttaccagtggtggggtcgagacaaggagacccagcatggcgtat

SEQ ID NO: 416757 - DNA, 140 bp, Artificial Sequence
  Synthetic
  misc_feature (36)..(36): n is a, c, g, or t
atacgccatgctgggtctccacaatatgtcatgggnataatagctggacagccaacagaaacagagtcatcaatagtaaataagataattgaagaaatgatcaaaaaggaagcagtatatcgtacttgggagtcggccat

SEQ ID NO: 416758 - DNA, 140 bp, Artificial Sequence
  Synthetic
  misc_feature (105)..(105): n is a, c, g, or t
atggccgactcccaagtacgatatactgcttcctttttgatcatttcttcaattatcttatttactattgatgactctgtttctgttggctgtccagctattatncccatgacatattgtggagacccagcatggcgtat

SEQ ID NO: 416759 - DNA, 140 bp, Artificial Sequence
  Synthetic
  misc_feature (115)..(115): n is a, c, g, or t
atacgccatgctgggtctcccagaactagggacatggcaaatggactgtacacatttagaaggaaaaatcataatagtagcagtccatgtagccagtggattcatagaagcagangtaatcgtacttgggagtcggccat

SEQ ID NO: 416760 - DNA, 140 bp, Artificial Sequence
  Synthetic
  misc_feature (26)..(26): n is a, c, g, or t
atggccgactcccaagtacgattacntctgcttctatgaatccactggctacatggactgctactattatgatttttccttctaaatgtgtacagtccatttgccatgtccctagttctgggagacccagcatggcgtat

SEQ ID NO: 416761 - DNA, 140 bp, Artificial Sequence
  Synthetic
atacgccatgctgggtctccgaaacagttgtactaatggcagctcattgcatgaattttaaaagaaggggaggaataggggatatgacccctgcagagagactagttaacatgataaccacgtacttgggagtcggccat

SEQ ID NO: 416762 - DNA, 140 bp, Artificial Sequence
  Synthetic
atggccgactcccaagtacgtggttatcatgttaactagtctctctgcaggggtcatatcccctattcctccccttcttttaaaattcatgcaatgagctgccattagtacaactgtttcggagacccagcatggcgtat

SEQ ID NO: 416763 - DNA, 140 bp, Artificial Sequence
  Synthetic
  misc_feature (50)..(50): n is a, c, g, or t
  misc_feature (52)..(52): n is a, c, g, or t
  misc_feature (72)..(72): n is a, c, g, or t
  misc_feature (101)..(101): n is a, c, g, or t
atacgccatgctgggtctccgacttgcagtagagtaatattccccctaananaaaaagcatggatagagatncaaggatattggaatctgaccccagaaangggattcttgagctcctatcgtacttgggagtcggccat

SEQ ID NO: 416764 - DNA, 140 bp, Artificial Sequence
  Synthetic
  misc_feature (40)..(40): n is a, c, g, or t
  misc_feature (69)..(69): n is a, c, g, or t
  misc_feature (89)..(89): n is a, c, g, or t
  misc_feature (91)..(91): n is a, c, g, or t
atggccgactcccaagtacgataggagctcaagaatcccntttctggggtcagattccaatatccttgnatctctatccatgctttttntnttagggggaatattactctactgcaagtcggagacccagcatggcgtat

SEQ ID NO: 416765 - DNA, 140 bp, Artificial Sequence
  Synthetic
atacgccatgctgggtctccgaactcatcaaaattctccaaagagcactcttcctccacttcagaggcggttgtcaacactcaaggattggacaaccagggggaggaaatcctctctcagcgtacttgggagtcggccat

SEQ ID NO: 416766 - DNA, 140 bp, Artificial Sequence
  Synthetic
atggccgactcccaagtacgctgagagaggatttcctccccctggttgtccaatccttgagtgttgacaaccgcctctgaagtggaggaagagtgctctttggagaattttgatgagttcggagacccagcatggcgtat

SEQ ID NO: 416767 - DNA, 140 bp, Artificial Sequence
  Synthetic
aggccctggctgctgatatgtttgtgcaaccaaaaacagagatacttggggaaccatacagtgcttaccagataatgatgattatcaagaaatagccctgaatgtaacagaggctttcgagaccttttgggacagcggtg

SEQ ID NO: 416768 - DNA, 140 bp, Artificial Sequence
  Synthetic
caccgctgtcccaaaaggtctcgaaagcctctgttacattcagggctatttcttgataatcatcattatctggtaagcactgtatggttccccaagtatctctgtttttggttgcacaaacatatcagcagccagggcct

SEQ ID NO: 416769 - DNA, 140 bp, Artificial Sequence
  Synthetic
atacgccatgctgggtctcctatttgagacatcaataaaaccatgtgtcaaactaacacctctatgtgtagcaatgaactgtaccaacacaaacacaaacaccacaaacacacccacctccgtacttgggagtcggccat

SEQ ID NO: 416770 - DNA, 140 bp, Artificial Sequence
  Synthetic
atggccgactcccaagtacggaggtgggtgtgtttgtggtgtttgtgtttgtgttggtacagttcattgctacacatagaggtgttagtttgacacatggttttattgatgtctcaaataggagacccagcatggcgtat

SEQ ID NO: 416771 - DNA, 140 bp, Artificial Sequence
  Synthetic
atacgccatgctgggtctccacagctgcacaggattgggagaggaagggatagtccaatgtcagttcgacatgacaggattacagagagataagaaaaaacgatacaatgagacatggtacgtacttgggagtcggccat

SEQ ID NO: 416772 - DNA, 140 bp, Artificial Sequence
  Synthetic
atggccgactcccaagtacgtaccatgtctcattgtatcgttttttcttatctctctgtaatcctgtcatgtcgaactgacattggactatcccttcctctcccaatcctgtgcagctgtggagacccagcatggcgtat

SEQ ID NO: 416773 - DNA, 140 bp, Artificial Sequence
  Synthetic
atacgccatgctgggtctccgatgctacatgaaccattgcaacacatcagtcatcacagagtcatgcgacaagcactattgggatgctataaggtttagatactgtgcaccaccgggcttcgtacttgggagtcggccat

SEQ ID NO: 416774 - DNA, 140 bp, Artificial Sequence
  Synthetic
atggccgactcccaagtacgaagcccggtggtgcacagtatctaaaccttatagcatcccaatagtgcttgtcgcatgactctgtgatgactgatgtgttgcaatggttcatgtagcatcggagacccagcatggcgtat

SEQ ID NO: 416775 - DNA, 140 bp, Artificial Sequence
  Synthetic
atacgccatgctgggtctccgtagcaaagtagtagtatcctcttgtacaagaatgatggagacacagacctctacatggtttggcttcaatggtacaagggcagaaaacaggacatatatcgtacttgggagtcggccat

SEQ ID NO: 416776 - DNA, 140 bp, Artificial Sequence
  Synthetic
atggccgactcccaagtacgatatatgtcctgttttctgcccttgtaccattgaagccaaaccatgtagaggtctgtgtctccatcattcttgtacaagaggatactactactttgctacggagacccagcatggcgtat

SEQ ID NO: 416777 - DNA, 140 bp, Artificial Sequence
  Synthetic
atacgccatgctgggtctccatactggcatggtagagataataggactgtcataagcttaaatagttattataatttaacaatgcattgtaagaggccaggaaacaaaacagttgtaccacgtacttgggagtcggccat

SEQ ID NO: 416778 - DNA, 140 bp, Artificial Sequence
  Synthetic
atggccgactcccaagtacgtggtacaactgttttgtttcctggcctcttacaatgcattgttaaattataataactatttaagcttatgacagtcctattatctctaccatgccagtatggagacccagcatggcgtat

SEQ ID NO: 416779 - DNA, 140 bp, Artificial Sequence
  Synthetic
  misc_feature (59)..(59): n is a, c, g, or t
atacgccatgctgggtctccgcctagacaagcatggtgctggttcaaaggcaagtgganggaagccatgcaggaggtgaagcaaacccttataaaacatcccaggtataacggaaacaaacgtacttgggagtcggccat

SEQ ID NO: 416780 - DNA, 140 bp, Artificial Sequence
  Synthetic
  misc_feature (82)..(82): n is a, c, g, or t
atggccgactcccaagtacgtttgtttccgttatacctgggatgttttataagggtttgcttcacctcctgcatggcttccntccacttgcctttgaaccagcaccatgcttgtctaggcggagacccagcatggcgtat

SEQ ID NO: 416781 - DNA, 140 bp, Artificial Sequence
  Synthetic
atacgccatgctgggtctcctatgcaccgtgccatataaagcaaataattaatacctggcacaaggtagggaaaaatgtatatttgcctcctagggaaggagagttgacctgcaactcaacgtacttgggagtcggccat

SEQ ID NO: 416782 - DNA, 140 bp, Artificial Sequence
  Synthetic
atggccgactcccaagtacgttgagttgcaggtcaactctccttccctaggaggcaaatatacatttttccctaccttgtgccaggtattaattatttgctttatatggcacggtgcataggagacccagcatggcgtat

SEQ ID NO: 416783 - DNA, 140 bp, Artificial Sequence
  Synthetic
  misc_feature (92)..(92): n is a, c, g, or t
  misc_feature (95)..(95): n is a, c, g, or t
  misc_feature (120)..(120): n is a, c, g, or t
aggccctggctgctgatatgggattataaattaatagaagtgacaccaattggcttcgcacctacagaacaaaaaagatactcctctgatcnagngagacataagagaggtgtgtttgtngaccttttgggacagcggtg

SEQ ID NO: 416784 - DNA, 140 bp, Artificial Sequence
  Synthetic
  misc_feature (21)..(21): n is a, c, g, or t
  misc_feature (46)..(46): n is a, c, g, or t
  misc_feature (49)..(49): n is a, c, g, or t
caccgctgtcccaaaaggtcnacaaacacacctctcttatgtctcnctngatcagaggagtatcttttttgttctgtaggtgcgaagccaattggtgtcacttctattaatttataatcccatatcagcagccagggcct

SEQ ID NO: 416785 - DNA, 140 bp, Artificial Sequence
  Synthetic
  misc_feature (22)..(22): n is a, c, g, or t
  misc_feature (54)..(54): n is a, c, g, or t
  misc_feature (59)..(59): n is a, c, g, or t
  misc_feature (64)..(64): n is a, c, g, or t
atacgccatgctgggtctcctnagacaagtctgccacactactgtaccatgggnaaatnacagnttgacacctaaatgggacaacatgacgtggcaacaatgggaaacgcaaatccgcttcgtacttgggagtcggccat

SEQ ID NO: 416786 - DNA, 140 bp, Artificial Sequence
  Synthetic
  misc_feature (77)..(77): n is a, c, g, or t
  misc_feature (82)..(82): n is a, c, g, or t
  misc_feature (87)..(87): n is a, c, g, or t
  misc_feature (119)..(119): n is a, c, g, or t
atggccgactcccaagtacgaagcggatttgcgtttcccattgttgccacgtcatgttgtcccatttaggtgtcaanctgtnatttncccatggtacagtagtgtggcagacttgtctnaggagacccagcatggcgtat

SEQ ID NO: 416787 - DNA, 140 bp, Artificial Sequence
  Synthetic
aggccctggctgctgatatgaactggtttgatttgacatcctggatcaaatatattcagtatggagttctcatagtggaaggaatagtagctcttagaatagtaatatatgtagtacagcgaccttttgggacagcggtg

SEQ ID NO: 416788 - DNA, 140 bp, Artificial Sequence
  Synthetic
caccgctgtcccaaaaggtcgctgtactacatatattactattctaagagctactattccttccactatgagaactccatactgaatatatttgatccaggatgtcaaatcaaaccagttcatatcagcagccagggcct

SEQ ID NO: 416789 - DNA, 140 bp, Artificial Sequence
  Synthetic
atacgccatgctgggtctccggttatctccaacagatccgtatccacaagcaccgggaacagccagacaacgaagaaacagaagaaggaggtggaaacgacgagggctacagatcctggccgtacttgggagtcggccat

SEQ ID NO: 416790 - DNA, 140 bp, Artificial Sequence
  Synthetic
atggccgactcccaagtacggccaggatctgtagccctcgtcgtttccacctccttcttctgtttcttcgttgtctggctgttcccggtgcttgtggatacggatctgttggagataaccggagacccagcatggcgtat

SEQ ID NO: 416791 - DNA, 140 bp, Artificial Sequence
  Synthetic
aggccctggctgctgatatgcgaagaaacagaagaaggaggtggaaacgacgagggctacagatcctggccttggcagatcgaatacatccacttcctaattcgccagctgaggaacctcgaccttttgggacagcggtg

SEQ ID NO: 416792 - DNA, 140 bp, Artificial Sequence
  Synthetic
caccgctgtcccaaaaggtcgaggttcctcagctggcgaattaggaagtggatgtattcgatctgccaaggccaggatctgtagccctcgtcgtttccacctccttcttctgtttcttcgcatatcagcagccagggcct

SEQ ID NO: 416793 - DNA, 140 bp, Artificial Sequence
  Synthetic
atacgccatgctgggtctccaatcctccaactagctctccaaccattcagggtcccgctcgcacacctccagtatgggatcagctggctccaagaagcagtccaagccgctgcgagagctcgtacttgggagtcggccat

SEQ ID NO: 416794 - DNA, 140 bp, Artificial Sequence
  Synthetic
atggccgactcccaagtacgagctctcgcagcggcttggactgcttcttggagccagctgatcccatactggaggtgtgcgagcgggaccctgaatggttggagagctagttggaggattggagacccagcatggcgtat

SEQ ID NO: 416795 - DNA, 140 bp, Artificial Sequence
  Synthetic
  misc_feature (57)..(57): n is a, c, g, or t
  misc_feature (79)..(79): n is a, c, g, or t
atacgccatgctgggtctccgagggcggcgaggggaatcatcgcaatccccagaagnatcagacaaggacttgaactcnccctcctgtgagggacaaaacgccccaggggcagaagggggcgtacttgggagtcggccat

SEQ ID NO: 416796 - DNA, 140 bp, Artificial Sequence
  Synthetic
  misc_feature (62)..(62): n is a, c, g, or t
  misc_feature (84)..(84): n is a, c, g, or t
atggccgactcccaagtacgcccccttctgcccctggggcgttttgtccctcacaggagggngagttcaagtccttgtctgatncttctggggattgcgatgattcccctcgccgccctcggagacccagcatggcgtat

SEQ ID NO: 416797 - DNA, 140 bp, Artificial Sequence
  Synthetic
  misc_feature (62)..(62): n is a, c, g, or t
  misc_feature (68)..(68): n is a, c, g, or t
  misc_feature (74)..(74): n is a, c, g, or t
atacgccatgctgggtctccagtttctagccttaagagttgtacaagaaggaaagaatgganccaagngagagngtgccaccaggaaacagcgacgaagagacaataggagaggcattcgcgtacttgggagtcggccat

SEQ ID NO: 416798 - DNA, 140 bp, Artificial Sequence
  Synthetic
  misc_feature (67)..(67): n is a, c, g, or t
  misc_feature (73)..(73): n is a, c, g, or t
  misc_feature (79)..(79): n is a, c, g, or t
atggccgactcccaagtacgcgaatgcctctcctattgtctcttcgtcgctgtttcctggtggcacnctctcncttggntccattctttccttcttgtacaactcttaaggctagaaactggagacccagcatggcgtat

SEQ ID NO: 416799 - DNA, 140 bp, Artificial Sequence
  Synthetic
atacgccatgctgggtctccctgtaaaggcgcgggcgggtaccaagcagcgtgaggagcgagaggagaagaggcctctgggagtaaggtaagtactccaaattttgaattgtctactctacgtacttgggagtcggccat

SEQ ID NO: 416800 - DNA, 140 bp, Artificial Sequence
  Synthetic
atggccgactcccaagtacgtagagtagacaattcaaaatttggagtacttaccttactcccagaggcctcttctcctctcgctcctcacgctgcttggtacccgcccgcgcctttacagggagacccagcatggcgtat

SEQ ID NO: 416801 - DNA, 140 bp, Artificial Sequence
  Synthetic
atacgccatgctgggtctcccagggaaaaagacagatgaattagaaaaagttaggttacggcccggcgcaaggaaaaggtacatgttaaaacatgtaatatgggcagcaaatgaattagacgtacttgggagtcggccat

SEQ ID NO: 416802 - DNA, 140 bp, Artificial Sequence
  Synthetic
atggccgactcccaagtacgtctaattcatttgctgcccatattacatgttttaacatgtaccttttccttgcgccgggccgtaacctaactttttctaattcatctgtctttttccctgggagacccagcatggcgtat

SEQ ID NO: 416803 - DNA, 140 bp, Artificial Sequence
  Synthetic
  misc_feature (119)..(119): n is a, c, g, or t
aggccctggctgctgatatgaggaaaaggtacatgttaaaacatgtaatatgggcagcaaatgaattagacagatttggattagcagagagcctgttggaatcaaaagaaggatgtcanagaccttttgggacagcggtg

SEQ ID NO: 416804 - DNA, 140 bp, Artificial Sequence
  Synthetic
  misc_feature (22)..(22): n is a, c, g, or t
caccgctgtcccaaaaggtctntgacatccttcttttgattccaacaggctctctgctaatccaaatctgtctaattcatttgctgcccatattacatgttttaacatgtaccttttcctcatatcagcagccagggcct

SEQ ID NO: 416805 - DNA, 140 bp, Artificial Sequence
  Synthetic
atacgccatgctgggtctccagaagttcggggcagaaatagtaccaggatttcaggcactatcagagggatgtaccccttatgatatcaatcagatgctaaattgtgtaggagaacaccacgtacttgggagtcggccat

SEQ ID NO: 416806 - DNA, 140 bp, Artificial Sequence
  Synthetic
atggccgactcccaagtacgtggtgttctcctacacaatttagcatctgattgatatcataaggggtacatccctctgatagtgcctgaaatcctggtactatttctgccccgaacttctggagacccagcatggcgtat

SEQ ID NO: 416807 - DNA, 140 bp, Artificial Sequence
  Synthetic
  misc_feature (67)..(67): n is a, c, g, or t
atacgccatgctgggtctccgggaccagcagcacccggtaccaggtccactgccagcaggacaactnagagaccccagaggatcagatatagcgggaaccaccagcacaccagaggaacacgtacttgggagtcggccat

SEQ ID NO: 416808 - DNA, 140 bp, Artificial Sequence
  Synthetic
  misc_feature (74)..(74): n is a, c, g, or t
atggccgactcccaagtacgtgttcctctggtgtgctggtggttcccgctatatctgatcctctggggtctctnagttgtcctgctggcagtggacctggtaccgggtgctgctggtcccggagacccagcatggcgtat

SEQ ID NO: 416809 - DNA, 140 bp, Artificial Sequence
  Synthetic
atacgccatgctgggtctccaatacagtggatgtacaggggtcaaaattccatcccagtggggaacatttatagaagatggattcaattaggattgcagaaatgcgtccggatgtacaaccgtacttgggagtcggccat

SEQ ID NO: 416810 - DNA, 140 bp, Artificial Sequence
  Synthetic
atggccgactcccaagtacggttgtacatccggacgcatttctgcaatcctaattgaatccatcttctataaatgttccccactgggatggaattttgacccctgtacatccactgtattggagacccagcatggcgtat

SEQ ID NO: 416811 - DNA, 140 bp, Artificial Sequence
  Synthetic
  misc_feature (44)..(44): n is a, c, g, or t
  misc_feature (116)..(116): n is a, c, g, or t
atacgccatgctgggtctccgattgcaagctagtactcaagggnttggggccacaccccaccctagaggaaatgctgacggcctgccaagggataggaggcccagggcagaaagcnagatcgtacttgggagtcggccat

SEQ ID NO: 416812 - DNA, 140 bp, Artificial Sequence
  Synthetic
  misc_feature (25)..(25): n is a, c, g, or t
  misc_feature (97)..(97): n is a, c, g, or t
atggccgactcccaagtacgatctngctttctgccctgggcctcctatcccttggcaggccgtcagcatttcctctagggtggggtgtggccccaancccttgagtactagcttgcaatcggagacccagcatggcgtat

SEQ ID NO: 416813 - DNA, 140 bp, Artificial Sequence
  Synthetic
  misc_feature (50)..(50): n is a, c, g, or t
  misc_feature (56)..(56): n is a, c, g, or t
  misc_feature (101)..(101): n is a, c, g, or t
atacgccatgctgggtctccccaataaatatttttggcagaaatatcttnagcacnttaggcatgagtctaaatttcccaatggcaaaattagagccagtnaaggtccagttaaagcctgcgtacttgggagtcggccat

SEQ ID NO: 416814 - DNA, 140 bp, Artificial Sequence
  Synthetic
  misc_feature (40)..(40): n is a, c, g, or t
  misc_feature (85)..(85): n is a, c, g, or t
  misc_feature (91)..(91): n is a, c, g, or t
atggccgactcccaagtacgcaggctttaactggaccttnactggctctaattttgccattgggaaatttagactcatgcctaangtgctnaagatatttctgccaaaaatatttattggggagacccagcatggcgtat

SEQ ID NO: 416815 - DNA, 140 bp, Artificial Sequence
  Synthetic
  misc_feature (69)..(69): n is a, c, g, or t
  misc_feature (84)..(84): n is a, c, g, or t
aggccctggctgctgatatgagaagcacctcccactaatccatacaacacacccacctttgctgtaagnaaaaaggacaaaaanaaatggagaatgctaatagacttcagggaattaaatgaccttttgggacagcggtg

SEQ ID NO: 416816 - DNA, 140 bp, Artificial Sequence
  Synthetic
  misc_feature (57)..(57): n is a, c, g, or t
  misc_feature (72)..(72): n is a, c, g, or t
caccgctgtcccaaaaggtcatttaattccctgaagtctattagcattctccatttntttttgtcctttttncttacagcaaaggtgggtgtgttgtatggattagtgggaggtgcttctcatatcagcagccagggcct

SEQ ID NO: 416817 - DNA, 140 bp, Artificial Sequence
  Synthetic
atacgccatgctgggtctccaagggaggtttggacagtaaatgacattcagaaactagtgggagtactaaactgggcagctcaacttttccccggaatcaaaacaaagcacatatgcagacgtacttgggagtcggccat

SEQ ID NO: 416818 - DNA, 140 bp, Artificial Sequence
  Synthetic
atggccgactcccaagtacgtctgcatatgtgctttgttttgattccggggaaaagttgagctgcccagtttagtactcccactagtttctgaatgtcatttactgtccaaacctcccttggagacccagcatggcgtat

SEQ ID NO: 416819 - DNA, 140 bp, Artificial Sequence
  Synthetic
aggccctggctgctgatatgactgggcagctcaacttttccccggaatcaaaacaaagcacatatgcagactgatcaggggaaagatgaccctgacagaagaggtgcagtggacagaactgaccttttgggacagcggtg

SEQ ID NO: 416820 - DNA, 140 bp, Artificial Sequence
  Synthetic
caccgctgtcccaaaaggtcagttctgtccactgcacctcttctgtcagggtcatctttcccctgatcagtctgcatatgtgctttgttttgattccggggaaaagttgagctgcccagtcatatcagcagccagggcct

SEQ ID NO: 416821 - DNA, 140 bp, Artificial Sequence
  Synthetic
  misc_feature (98)..(98): n is a, c, g, or t
aggccctggctgctgatatgtggggacaaataccaatgttccatttgccagtagaaagagaaacatgggaccaatggtggacagattactggcaagtnacttggatcccagaatgggactgaccttttgggacagcggtg

SEQ ID NO: 416822 - DNA, 140 bp, Artificial Sequence
  Synthetic
  misc_feature (43)..(43): n is a, c, g, or t
caccgctgtcccaaaaggtcagtcccattctgggatccaagtnacttgccagtaatctgtccaccattggtcccatgtttctctttctactggcaaatggaacattggtatttgtccccacatatcagcagccagggcct

SEQ ID NO: 416823 - DNA, 140 bp, Artificial Sequence
  Synthetic
atacgccatgctgggtctccttgtctcaaccccaccattggtaaggctagcctacaacctggtcaaggaccccctagaaaaggtagaaaccttctacacagatgggtcctgcaacagagtcgtacttgggagtcggccat

SEQ ID NO: 416824 - DNA, 140 bp, Artificial Sequence
  Synthetic
atggccgactcccaagtacgactctgttgcaggacccatctgtgtagaaggtttctaccttttctagggggtccttgaccaggttgtaggctagccttaccaatggtggggttgagacaaggagacccagcatggcgtat

SEQ ID NO: 416825 - DNA, 140 bp, Artificial Sequence
  Synthetic
  misc_feature (67)..(67): n is a, c, g, or t
atacgccatgctgggtctccttaaaccattagagcagacaacaaaccaacaagcagaacttgaggcntttgcactggcactacaggattcaggaccacaagtcaatatcatagtagattccgtacttgggagtcggccat

SEQ ID NO: 416826 - DNA, 140 bp, Artificial Sequence
  Synthetic
  misc_feature (74)..(74): n is a, c, g, or t
atggccgactcccaagtacggaatctactatgatattgacttgtggtcctgaatcctgtagtgccagtgcaaangcctcaagttctgcttgttggtttgttgtctgctctaatggtttaaggagacccagcatggcgtat

SEQ ID NO: 416827 - DNA, 140 bp, Artificial Sequence
  Synthetic
atacgccatgctgggtctccgtaggatgggtgccagctcacaaaggactaggtggtaatcaggaagtagaccacctagtaagtcaaggaattaggcaggttctattcctagaaaagatagcgtacttgggagtcggccat

SEQ ID NO: 416828 - DNA, 140 bp, Artificial Sequence
  Synthetic
atggccgactcccaagtacgctatcttttctaggaatagaacctgcctaattccttgacttactaggtggtctacttcctgattaccacctagtcctttgtgagctggcacccatcctacggagacccagcatggcgtat

SEQ ID NO: 416829 - DNA, 140 bp, Artificial Sequence
  Synthetic
atacgccatgctgggtctccaccccaagaaacaggaagacaaacagccctcttcctgttgaaactggcaagcagatggcctatcacacacctgcacacagacaatggtgccaactttacccgtacttgggagtcggccat

SEQ ID NO: 416830 - DNA, 140 bp, Artificial Sequence
  Synthetic
atggccgactcccaagtacgggtaaagttggcaccattgtctgtgtgcaggtgtgtgataggccatctgcttgccagtttcaacaggaagagggctgtttgtcttcctgtttcttggggtggagacccagcatggcgtat

SEQ ID NO: 416831 - DNA, 140 bp, Artificial Sequence
  Synthetic
aggccctggctgctgatatgatcatctaaaaaatcaaatagataggatcagagatcaggcagtatcattggaaacagttgtactaatggcagctcattgcatgaattttaaaagaagggggaccttttgggacagcggtg

SEQ ID NO: 416832 - DNA, 140 bp, Artificial Sequence
  Synthetic
caccgctgtcccaaaaggtcccccttcttttaaaattcatgcaatgagctgccattagtacaactgtttccaatgatactgcctgatctctgatcctatctatttgattttttagatgatcatatcagcagccagggcct

SEQ ID NO: 416833 - DNA, 140 bp, Artificial Sequence
  Synthetic
  misc_feature (70)..(70): n is a, c, g, or t
atacgccatgctgggtctcctagagaaatggcacagtctggtcaagtacctgaagcatagaacaagaganctacaacaggtctcttatgttccccaccacaaggtgggatgggcctggtgcgtacttgggagtcggccat

SEQ ID NO: 416834 - DNA, 140 bp, Artificial Sequence
  Synthetic
  misc_feature (71)..(71): n is a, c, g, or t
atggccgactcccaagtacgcaccaggcccatcccaccttgtggtggggaacataagagacctgttgtagntctcttgttctatgcttcaggtacttgaccagactgtgccatttctctaggagacccagcatggcgtat

SEQ ID NO: 416835 - DNA, 140 bp, Artificial Sequence
  Synthetic
atacgccatgctgggtctccgacttgcagtagagtaatattccccctaaaagaaagagcatggctagagatccaaggatattggaatctgaccccggaaaggggattcttgagctcctatcgtacttgggagtcggccat

SEQ ID NO: 416836 - DNA, 140 bp, Artificial Sequence
  Synthetic
atggccgactcccaagtacgataggagctcaagaatcccctttccggggtcagattccaatatccttggatctctagccatgctctttcttttagggggaatattactctactgcaagtcggagacccagcatggcgtat

SEQ ID NO: 416837 - DNA, 140 bp, Artificial Sequence
  Synthetic
  misc_feature (35)..(35): n is a, c, g, or t
atacgccatgctgggtctccaactacccatcagcncacgagaggcaggtaccaagtttacagtttctagccttaagagttgtacaagaaggaaaaaatggatccaagggagagggtgccacgtacttgggagtcggccat

SEQ ID NO: 416838 - DNA, 140 bp, Artificial Sequence
  Synthetic
  misc_feature (106)..(106): n is a, c, g, or t
atggccgactcccaagtacgtggcaccctctcccttggatccattttttccttcttgtacaactcttaaggctagaaactgtaaacttggtacctgcctctcgtgngctgatgggtagttggagacccagcatggcgtat

SEQ ID NO: 416839 - DNA, 140 bp, Artificial Sequence
  Synthetic
atacgccatgctgggtctccctataccgccccctgggggcatgtaataataaatgctattgtaaggcatgttgctaccattgccagctttgttttcttaacaagggccttgggatatgttcgtacttgggagtcggccat

SEQ ID NO: 416840 - DNA, 140 bp, Artificial Sequence
  Synthetic
atggccgactcccaagtacgaacatatcccaaggcccttgttaagaaaacaaagctggcaatggtagcaacatgccttacaatagcatttattattacatgcccccagggggcggtatagggagacccagcatggcgtat

SEQ ID NO: 416841 - DNA, 140 bp, Artificial Sequence
  Synthetic
atacgccatgctgggtctccatgaacgctcgagaaaaagatcttcaaaaaaggctaagactgctacatcttctgcatcagacaagtgagtaaaatgtgtggtaagaatttactatttgttcgtacttgggagtcggccat

SEQ ID NO: 416842 - DNA, 140 bp, Artificial Sequence
  Synthetic
atggccgactcccaagtacgaacaaatagtaaattcttaccacacattttactcacttgtctgatgcagaagatgtagcagtcttagccttttttgaagatctttttctcgagcgttcatggagacccagcatggcgtat

SEQ ID NO: 416843 - DNA, 140 bp, Artificial Sequence
  Synthetic
atacgccatgctgggtctccgccagcttactagctagtgcttgcttaatatacagcaccaaaaaatatgtgactgttttctatggcgtgcccgtgtggagaaatgcatccattcccctctcgtacttgggagtcggccat

SEQ ID NO: 416844 - DNA, 140 bp, Artificial Sequence
  Synthetic
atggccgactcccaagtacgagaggggaatggatgcatttctccacacgggcacgccatagaaaacagtcacatattttttggtgctgtatattaagcaagcactagctagtaagctggcggagacccagcatggcgtat

SEQ ID NO: 416845 - DNA, 140 bp, Artificial Sequence
  Synthetic
  misc_feature (120)..(120): n is a, c, g, or t
aggccctggctgctgatatgtatttgagacatcaataaaaccatgtgtcaaactaacacctctatgtgtagcaatgaactgtaccaacgccactagcagcacaaacataacaaggcccangaccttttgggacagcggtg

SEQ ID NO: 416846 - DNA, 140 bp, Artificial Sequence
  Synthetic
  misc_feature (21)..(21): n is a, c, g, or t
caccgctgtcccaaaaggtcntgggccttgttatgtttgtgctgctagtggcgttggtacagttcattgctacacatagaggtgttagtttgacacatggttttattgatgtctcaaatacatatcagcagccagggcct

SEQ ID NO: 416847 - DNA, 140 bp, Artificial Sequence
  Synthetic
atacgccatgctgggtctccgcatacaaagagacagctgcacagggttgggagaggaagagatggtccagtgtcagtttgacatgataggattagagagagataagaaaaaacggtataacgtacttgggagtcggccat

SEQ ID NO: 416848 - DNA, 140 bp, Artificial Sequence
  Synthetic
atggccgactcccaagtacgttataccgttttttcttatctctctctaatcctatcatgtcaaactgacactggaccatctcttcctctcccaaccctgtgcagctgtctctttgtatgcggagacccagcatggcgtat

SEQ ID NO: 416849 - DNA, 140 bp, Artificial Sequence
  Synthetic
aggccctggctgctgatatgtgtgacaagcactattgggatgctataaggtttagatactgtgcaccaccgggctttgctttgctaagatgtaatgacaccgaatattcaggcttcacgcgaccttttgggacagcggtg

SEQ ID NO: 416850 - DNA, 140 bp, Artificial Sequence
  Synthetic
caccgctgtcccaaaaggtcgcgtgaagcctgaatattcggtgtcattacatcttagcaaagcaaagcccggtggtgcacagtatctaaaccttatagcatcccaatagtgcttgtcacacatatcagcagccagggcct

SEQ ID NO: 416851 - DNA, 140 bp, Artificial Sequence
  Synthetic
aggccctggctgctgatatgcagacctctacatggtttggcttcaatggtacaagggcagaaaacaggacatatatatattggcatggtagagataataggactatcataagcttaaatagaccttttgggacagcggtg

SEQ ID NO: 416852 - DNA, 140 bp, Artificial Sequence
  Synthetic
caccgctgtcccaaaaggtctatttaagcttatgatagtcctattatctctaccatgccaatatatatatgtcctgttttctgcccttgtaccattgaagccaaaccatgtagaggtctgcatatcagcagccagggcct

SEQ ID NO: 416853 - DNA, 140 bp, Artificial Sequence
  Synthetic
aggccctggctgctgatatgagtattataatttaacaatgcattgtaagaggccaggaaacaagacagttgtaccaataacactcatgtcagggttagtgttccactcccagccaatcaagaccttttgggacagcggtg

SEQ ID NO: 416854 - DNA, 140 bp, Artificial Sequence
  Synthetic
caccgctgtcccaaaaggtcttgattggctgggagtggaacactaaccctgacatgagtgttattggtacaactgtcttgtttcctggcctcttacaatgcattgttaaattataatactcatatcagcagccagggcct

SEQ ID NO: 416855 - DNA, 140 bp, Artificial Sequence
  Synthetic
  misc_feature (54)..(54): n is a, c, g, or t
atacgccatgctgggtctcccccagaagtggcatacatgtggactaactgcagnggagaatttctctactgcaacatgacttggttcctcaattgggtagaaaacaggccgaatcagacacgtacttgggagtcggccat

SEQ ID NO: 416856 - DNA, 140 bp, Artificial Sequence
  Synthetic
  misc_feature (87)..(87): n is a, c, g, or t
atggccgactcccaagtacgtgtctgattcggcctgttttctacccaattgaggaaccaagtcatgttgcagtagagaaattctccnctgcagttagtccacatgtatgccacttctgggggagacccagcatggcgtat

SEQ ID NO: 416857 - DNA, 140 bp, Artificial Sequence
  Synthetic
atacgccatgctgggtctccgaaagccgaacaaacattaccttcagtgcagaggtggcagaactgtaccgattagaattgggggattataaattaatagaagtgacaccaattggcttcgcgtacttgggagtcggccat

SEQ ID NO: 416858 - DNA, 140 bp, Artificial Sequence
  Synthetic
atggccgactcccaagtacgcgaagccaattggtgtcacttctattaatttataatcccccaattctaatcggtacagttctgccacctctgcactgaaggtaatgtttgttcggctttcggagacccagcatggcgtat

SEQ ID NO: 416859 - DNA, 140 bp, Artificial Sequence
  Synthetic
  misc_feature (87)..(87): n is a, c, g, or t
aggccctggctgctgatatgcactgctattgagaaatacctaaaggaccaggcgcaactaaattcatggggatgcgcgtttagacangtctgccacactactgtaccatgggtaaatgacgaccttttgggacagcggtg

SEQ ID NO: 416860 - DNA, 140 bp, Artificial Sequence
  Synthetic
  misc_feature (54)..(54): n is a, c, g, or t
caccgctgtcccaaaaggtcgtcatttacccatggtacagtagtgtggcagacntgtctaaacgcgcatccccatgaatttagttgcgcctggtcctttaggtatttctcaatagcagtgcatatcagcagccagggcct

SEQ ID NO: 416861 - DNA, 140 bp, Artificial Sequence
  Synthetic
atacgccatgctgggtctccaatccgctacctagaggcaaatatcagtgaaagtttagaacaggcgcaaatccagcaagaaaagaacatgtatgatttacaaaaactaaatagctgggatcgtacttgggagtcggccat

SEQ ID NO: 416862 - DNA, 140 bp, Artificial Sequence
  Synthetic
atggccgactcccaagtacgatcccagctatttagtttttgtaaatcatacatgttcttttcttgctggatttgcgcctgttctaaactttcactgatatttgcctctaggtagcggattggagacccagcatggcgtat

SEQ ID NO: 416863 - DNA, 140 bp, Artificial Sequence
  Synthetic
  misc_feature (97)..(97): n is a, c, g, or t
aggccctggctgctgatatgtccagcaagaaaagaacatgtatgatttacaaaaactaaatagctgggatgtttttagcaactggtttgatttgacntcctggatcaaatatattcagtagaccttttgggacagcggtg

SEQ ID NO: 416864 - DNA, 140 bp, Artificial Sequence
  Synthetic
  misc_feature (44)..(44): n is a, c, g, or t
caccgctgtcccaaaaggtctactgaatatatttgatccaggangtcaaatcaaaccagttgctaaaaacatcccagctatttagtttttgtaaatcatacatgttcttttcttgctggacatatcagcagccagggcct

SEQ ID NO: 416865 - DNA, 140 bp, Artificial Sequence
  Synthetic
  misc_feature (32)..(32): n is a, c, g, or t
  misc_feature (70)..(70): n is a, c, g, or t
atacgccatgctgggtctcctagtacagctgntaagtagacttagaaggggctataggcctgttttctcntccccccccggttacttccaacagatccgtatccacaagcaccgggaacacgtacttgggagtcggccat

SEQ ID NO: 416866 - DNA, 140 bp, Artificial Sequence
  Synthetic
  misc_feature (71)..(71): n is a, c, g, or t
  misc_feature (109)..(109): n is a, c, g, or t
atggccgactcccaagtacgtgttcccggtgcttgtggatacggatctgttggaagtaaccggggggggangagaaaacaggcctatagccccttctaagtctacttancagctgtactaggagacccagcatggcgtat

SEQ ID NO: 416867 - DNA, 140 bp, Artificial Sequence
  Synthetic
aggccctggctgctgatatgtccccccccggttacttccaacagatccgtatccacaagcaccgggaacagccagccaacgaagaaacagaagaaggaggtggaagcgacgagggctacagaccttttgggacagcggtg

SEQ ID NO: 416868 - DNA, 140 bp, Artificial Sequence
  Synthetic
caccgctgtcccaaaaggtctgtagccctcgtcgcttccacctccttcttctgtttcttcgttggctggctgttcccggtgcttgtggatacggatctgttggaagtaaccggggggggacatatcagcagccagggcct

SEQ ID NO: 416869 - DNA, 140 bp, Artificial Sequence
  Synthetic
atacgccatgctgggtctccaggaacctcttgatttggctatacggcggctgcagaaccttgctatcgaagaccttccaaatcctccaactagctctccaaccactcaggctcccgcttgcgtacttgggagtcggccat

SEQ ID NO: 416870 - DNA, 140 bp, Artificial Sequence
  Synthetic
atggccgactcccaagtacgcaagcgggagcctgagtggttggagagctagttggaggatttggaaggtcttcgatagcaaggttctgcagccgccgtatagccaaatcaagaggttcctggagacccagcatggcgtat

SEQ ID NO: 416871 - DNA, 140 bp, Artificial Sequence
  Synthetic
atacgccatgctgggtctcccgcacctccaatatgggatcagctggttccaagaagcaatccaagccgcagcgagggctgcgggagagactcttacgagcaccagcaggaccctatgggacgtacttgggagtcggccat

SEQ ID NO: 416872 - DNA, 140 bp, Artificial Sequence
  Synthetic
atggccgactcccaagtacgtcccatagggtcctgctggtgctcgtaagagtctctcccgcagccctcgctgcggcttggattgcttcttggaaccagctgatcccatattggaggtgcgggagacccagcatggcgtat

SEQ ID NO: 416873 - DNA, 140 bp, Artificial Sequence
  Synthetic
atacgccatgctgggtctccgatgaagtgggagcatatgtcaggcccaataagccactgagagcaatgacatacaaattggcaatagacatgtctcattttataaaagaaaaggggggaccgtacttgggagtcggccat

SEQ ID NO: 416874 - DNA, 140 bp, Artificial Sequence
  Synthetic
atggccgactcccaagtacggtccccccttttcttttataaaatgagacatgtctattgccaatttgtatgtcattgctctcagtggcttattgggcctgacatatgctcccacttcatcggagacccagcatggcgtat

SEQ ID NO: 416875 - DNA, 140 bp, Artificial Sequence
  Synthetic
atacgccatgctgggtctccgtggagggaagccatgcaggaggtgaaacaaacccttataaaacatcccaggtataaaggactcaacgaaacaagtaaaattaactttacaaaaccaggacgtacttgggagtcggccat

SEQ ID NO: 416876 - DNA, 140 bp, Artificial Sequence
  Synthetic
atggccgactcccaagtacgtcctggttttgtaaagttaattttacttgtttcgttgagtcctttatacctgggatgttttataagggtttgtttcacctcctgcatggcttccctccacggagacccagcatggcgtat

SEQ ID NO: 416877 - DNA, 140 bp, Artificial Sequence
  Synthetic
atacgccatgctgggtctccaggcctctgggagtaaggtaagtactccaaaaattttgaactgtctactctaggggagagtaggacataagtgggagatgggcgcgagaggctccgtcctcgtacttgggagtcggccat

SEQ ID NO: 416878 - DNA, 140 bp, Artificial Sequence
  Synthetic
atggccgactcccaagtacgaggacggagcctctcgcgcccatctcccacttatgtcctactctcccctagagtagacagttcaaaatttttggagtacttaccttactcccagaggcctggagacccagcatggcgtat

SEQ ID NO: 416879 - DNA, 140 bp, Artificial Sequence
  Synthetic
aggccctggctgctgatatgtaggggagagtaggacataagtgggagatgggcgcgagaggctccgtcctgtcagggaaaaagacagatgaattagaaaaagttaggttacggcccggcggaccttttgggacagcggtg

SEQ ID NO: 416880 - DNA, 140 bp, Artificial Sequence
  Synthetic
caccgctgtcccaaaaggtccgccgggccgtaacctaactttttctaattcatctgtctttttccctgacaggacggagcctctcgcgcccatctcccacttatgtcctactctcccctacatatcagcagccagggcct

SEQ ID NO: 416881 - DNA, 140 bp, Artificial Sequence
  Synthetic
aggccctggctgctgatatgtcgctgctgctcaacagaaggcaggaaagagagggacattgacatgctggaactgtggcaaagggggacatacagccaggcaatgcagggcccctagaaggaccttttgggacagcggtg

SEQ ID NO: 416882 - DNA, 140 bp, Artificial Sequence
  Synthetic
caccgctgtcccaaaaggtccttctaggggccctgcattgcctggctgtatgtccccctttgccacagttccagcatgtcaatgtccctctctttcctgccttctgttgagcagcagcgacatatcagcagccagggcct

SEQ ID NO: 416883 - DNA, 140 bp, Artificial Sequence
  Synthetic
atacgccatgctgggtctccggacttgctgcacctcaattctctctttggagaagaccagtagtccaagcatatatcgagggtcagccagtagaagtgttactagacacaggggctgacgcgtacttgggagtcggccat

SEQ ID NO: 416884 - DNA, 140 bp, Artificial Sequence
  Synthetic
atggccgactcccaagtacgcgtcagcccctgtgtctagtaacacttctactggctgaccctcgatatatgcttggactactggtcttctccaaagagagaattgaggtgcagcaagtccggagacccagcatggcgtat

SEQ ID NO: 416885 - DNA, 140 bp, Artificial Sequence
  Synthetic
atacgccatgctgggtctccgtaggagggataggagggttcataaatactaaggaatacaaagacatagaaatagaagtagtaggaaaaagggtaagagcaactataatgacaggagacacgtacttgggagtcggccat

SEQ ID NO: 416886 - DNA, 140 bp, Artificial Sequence
  Synthetic
atggccgactcccaagtacgtgtctcctgtcattatagttgctcttaccctttttcctactacttctatttctatgtctttgtattccttagtatttatgaaccctcctatccctcctacggagacccagcatggcgtat

SEQ ID NO: 416887 - DNA, 140 bp, Artificial Sequence
  Synthetic
atacgccatgctgggtctccccccaataaatatttttggcagaaatatcttaagcgccttaggcatgagtctaaatttcccaatggcaaaattagagccagtgaaggtccagttaaagcccgtacttgggagtcggccat

SEQ ID NO: 416888 - DNA, 140 bp, Artificial Sequence
  Synthetic
atggccgactcccaagtacgggctttaactggaccttcactggctctaattttgccattgggaaatttagactcatgcctaaggcgcttaagatatttctgccaaaaatatttattggggggagacccagcatggcgtat

SEQ ID NO: 416889 - DNA, 140 bp, Artificial Sequence
  Synthetic
atacgccatgctgggtctcctactggcccttagagagatctgtgaaaaaatggaaaaggaagggcagttagaagaagcacctcccactaatccatacaacacacccaccttcgctgtaagcgtacttgggagtcggccat

SEQ ID NO: 416890 - DNA, 140 bp, Artificial Sequence
  Synthetic
atggccgactcccaagtacgcttacagcgaaggtgggtgtgttgtatggattagtgggaggtgcttcttctaactgcccttccttttccattttttcacagatctctctaagggccagtaggagacccagcatggcgtat

SEQ ID NO: 416891 - DNA, 140 bp, Artificial Sequence
  Synthetic
aggccctggctgctgatatggaagaagcacctcccactaatccatacaacacacccaccttcgctgtaaggaaaaaggatagaaacaaatggagaatgctaatagacttcagagaattaagaccttttgggacagcggtg

SEQ ID NO: 416892 - DNA, 140 bp, Artificial Sequence
  Synthetic
caccgctgtcccaaaaggtcttaattctctgaagtctattagcattctccatttgtttctatcctttttccttacagcgaaggtgggtgtgttgtatggattagtgggaggtgcttcttccatatcagcagccagggcct

SEQ ID NO: 416893 - DNA, 140 bp, Artificial Sequence
  Synthetic
atacgccatgctgggtctccgtcctaccacagggatggaagggatccccagcaatctttcaatacaccatgagaaaggtactagaccccttcagaaaggccaacaatgatgtcaccataacgtacttgggagtcggccat

SEQ ID NO: 416894 - DNA, 140 bp, Artificial Sequence
  Synthetic
atggccgactcccaagtacgttatggtgacatcattgttggcctttctgaaggggtctagtacctttctcatggtgtattgaaagattgctggggatcccttccatccctgtggtaggacggagacccagcatggcgtat

SEQ ID NO: 416895 - DNA, 140 bp, Artificial Sequence
  Synthetic
aggccctggctgctgatatggagaaaggtactagaccccttcagaaaggccaacaatgatgtcaccataatccagtacatggatgacatccttgtggcaagtgatagaagtgatttagaggaccttttgggacagcggtg

SEQ ID NO: 416896 - DNA, 140 bp, Artificial Sequence
  Synthetic
caccgctgtcccaaaaggtcctctaaatcacttctatcacttgccacaaggatgtcatccatgtactggattatggtgacatcattgttggcctttctgaaggggtctagtacctttctccatatcagcagccagggcct

SEQ ID NO: 416897 - DNA, 140 bp, Artificial Sequence
  Synthetic
aggccctggctgctgatatggactgatcagaggaaagatgaccctgacagaagaggtgcagtggacagaactagcagaggcagagatgcaggaaaacaaaatcatcctggaacaggaacagaccttttgggacagcggtg

SEQ ID NO: 416898 - DNA, 140 bp, Artificial Sequence
  Synthetic
caccgctgtcccaaaaggtctgttcctgttccaggatgattttgttttcctgcatctctgcctctgctagttctgtccactgcacctcttctgtcagggtcatctttcctctgatcagtccatatcagcagccagggcct

SEQ ID NO: 416899 - DNA, 140 bp, Artificial Sequence
  Synthetic
aggccctggctgctgatatgttgcactggcactacaggattcaggaccacaagtcaatatcatagtagattcacaatatgtcatggggataatagctggacagccaacagaaacagagtcgaccttttgggacagcggtg

SEQ ID NO: 416900 - DNA, 140 bp, Artificial Sequence
  Synthetic
caccgctgtcccaaaaggtcgactctgtttctgttggctgtccagctattatccccatgacatattgtgaatctactatgatattgacttgtggtcctgaatcctgtagtgccagtgcaacatatcagcagccagggcct

SEQ ID NO: 416901 - DNA, 140 bp, Artificial Sequence
  Synthetic
aggccctggctgctgatatgtcacaatatgtcatggggataatagctggacagccaacagaaacagagtcatcaatagtaaataggataattgaagaaatgatcaaaaaggaagcagtatgaccttttgggacagcggtg

SEQ ID NO: 416902 - DNA, 140 bp, Artificial Sequence
  Synthetic
caccgctgtcccaaaaggtcatactgcttcctttttgatcatttcttcaattatcctatttactattgatgactctgtttctgttggctgtccagctattatccccatgacatattgtgacatatcagcagccagggcct

SEQ ID NO: 416903 - DNA, 140 bp, Artificial Sequence
  Synthetic
aggccctggctgctgatatgagaaccagcacaagaagaacatgaaaaatatcatggcaatgtaaaagaactggttcataaatttggacttccacaactagtggcaaaacaaatagtaaacgaccttttgggacagcggtg

SEQ ID NO: 416904 - DNA, 140 bp, Artificial Sequence
  Synthetic
caccgctgtcccaaaaggtcgtttactatttgttttgccactagttgtggaagtccaaatttatgaaccagttcttttacattgccatgatatttttcatgttcttcttgtgctggttctcatatcagcagccagggcct

SEQ ID NO: 416905 - DNA, 140 bp, Artificial Sequence
  Synthetic
aggccctggctgctgatatgtcataatagtagcagtccatgtagccagtggattcatagaagcagaagtaataccccaagaaacaggaagacaaacagccctcttcctgttgaagctggcgaccttttgggacagcggtg

SEQ ID NO: 416906 - DNA, 140 bp, Artificial Sequence
  Synthetic
caccgctgtcccaaaaggtcgccagcttcaacaggaagagggctgtttgtcttcctgtttcttggggtattacttctgcttctatgaatccactggctacatggactgctactattatgacatatcagcagccagggcct

SEQ ID NO: 416907 - DNA, 140 bp, Artificial Sequence
  Synthetic
aggccctggctgctgatatgcaggcctagcctaatggcagaagcagccccagagactcctccagaggatgagaacccacagagagggccatgggaagagtgggtagaggacatcctggaggaccttttgggacagcggtg

SEQ ID NO: 416908 - DNA, 140 bp, Artificial Sequence
  Synthetic
caccgctgtcccaaaaggtcctccaggatgtcctctacccactcttcccatggccctctctgtgggttctcatcctctggaggagtctctggggctgcttctgccattaggctaggcctgcatatcagcagccagggcct

SEQ ID NO: 416909 - DNA, 140 bp, Artificial Sequence
  Synthetic
aggccctggctgctgatatggtgactgttttctatggcgtgcccgtgtggagaaatgcatccattcccctcttttgtgcaactaaaaacagagatacttgggggaccatacaatgcttgcgaccttttgggacagcggtg

SEQ ID NO: 416910 - DNA, 140 bp, Artificial Sequence
  Synthetic
caccgctgtcccaaaaggtcgcaagcattgtatggtcccccaagtatctctgtttttagttgcacaaaagaggggaatggatgcatttctccacacgggcacgccatagaaaacagtcaccatatcagcagccagggcct

SEQ ID NO: 416911 - DNA, 140 bp, Artificial Sequence
  Synthetic
atacgccatgctgggtctccgatgcatgggataatacagtaacagaacaagcagtagaggatgtctggagtctatttgagacatcaataaaaccatgtgtcaaactaacacctctatgtgcgtacttgggagtcggccat

SEQ ID NO: 416912 - DNA, 140 bp, Artificial Sequence
  Synthetic
atggccgactcccaagtacgcacatagaggtgttagtttgacacatggttttattgatgtctcaaatagactccagacatcctctactgcttgttctgttactgtattatcccatgcatcggagacccagcatggcgtat

SEQ ID NO: 416913 - DNA, 140 bp, Artificial Sequence
  Synthetic
aggccctggctgctgatatgaaataacagctgcacaggattgggacaggaagagatagtccagtgtcagttcgacatgacaggattagaaagggataagaaaaagcggtataatgaaacagaccttttgggacagcggtg

SEQ ID NO: 416914 - DNA, 140 bp, Artificial Sequence
  Synthetic
caccgctgtcccaaaaggtctgtttcattataccgctttttcttatccctttctaatcctgtcatgtcgaactgacactggactatctcttcctgtcccaatcctgtgcagctgttatttcatatcagcagccagggcct

SEQ ID NO: 416915 - DNA, 140 bp, Artificial Sequence
  Synthetic
atacgccatgctgggtctccacaagacctaggcaagcatggtgctggttcaaaggcaagtggaaggaagccatgcaggaggtgaagcaaacccttataaaacatcccaggtataacggaacgtacttgggagtcggccat

SEQ ID NO: 416916 - DNA, 140 bp, Artificial Sequence
  Synthetic
atggccgactcccaagtacgttccgttatacctgggatgttttataagggtttgcttcacctcctgcatggcttccttccacttgcctttgaaccagcaccatgcttgcctaggtcttgtggagacccagcatggcgtat

SEQ ID NO: 416917 - DNA, 140 bp, Artificial Sequence
  Synthetic
aggccctggctgctgatatgaaggtagggaaaaatgtatatttgcctcctagggaaggagagttgacctgcaactcaacagtgaccagcataattgctaacattgatgggccggataatagaccttttgggacagcggtg

SEQ ID NO: 416918 - DNA, 140 bp, Artificial Sequence
  Synthetic
caccgctgtcccaaaaggtctattatccggcccatcaatgttagcaattatgctggtcactgttgagttgcaggtcaactctccttccctaggaggcaaatatacatttttccctaccttcatatcagcagccagggcct

SEQ ID NO: 416919 - DNA, 140 bp, Artificial Sequence
  Synthetic
atacgccatgctgggtctccttagaattgggggattataaattaatagaagtgacaccaattggcttcgcacctacaggagaaaaaagatactcctctgctccagggagacataagagagcgtacttgggagtcggccat

SEQ ID NO: 416920 - DNA, 140 bp, Artificial Sequence
  Synthetic
atggccgactcccaagtacgctctcttatgtctccctggagcagaggagtatcttttttctcctgtaggtgcgaagccaattggtgtcacttctattaatttataatcccccaattctaaggagacccagcatggcgtat

SEQ ID NO: 416921 - DNA, 140 bp, Artificial Sequence
  Synthetic
atacgccatgctgggtctccatgggcgcggcgtccttgacgctgtcagctcagtcccggactttactggctgggatagtgcagcaacagcaacagctgttagacgtggtcaagagacaaccgtacttgggagtcggccat

SEQ ID NO: 416922 - DNA, 140 bp, Artificial Sequence
  Synthetic
atggccgactcccaagtacggttgtctcttgaccacgtctaacagctgttgctgttgctgcactatcccagccagtaaagtccgggactgagctgacagcgtcaaggacgccgcgcccatggagacccagcatggcgtat

SEQ ID NO: 416923 - DNA, 140 bp, Artificial Sequence
  Synthetic
aggccctggctgctgatatgtatggagttctcatagtagtaggaatagtagctcttagaataataatatatgtagtacagctgttaggtagacttagaaggggctataggcctgttttctgaccttttgggacagcggtg

SEQ ID NO: 416924 - DNA, 140 bp, Artificial Sequence
  Synthetic
caccgctgtcccaaaaggtcagaaaacaggcctatagccccttctaagtctacctaacagctgtactacatatattattattctaagagctactattcctactactatgagaactccatacatatcagcagccagggcct

SEQ ID NO: 416925 - DNA, 140 bp, Artificial Sequence
  Synthetic
atacgccatgctgggtctccaagaccttccaaatcctccaactagctctccgaccactcaggctcccgctcgcacacctccagtatgggatcagctggctccaagaagcagtccaagccgcgtacttgggagtcggccat

SEQ ID NO: 416926 - DNA, 140 bp, Artificial Sequence
  Synthetic
atggccgactcccaagtacgcggcttggactgcttcttggagccagctgatcccatactggaggtgtgcgagcgggagcctgagtggtcggagagctagttggaggatttggaaggtcttggagacccagcatggcgtat

SEQ ID NO: 416927 - DNA, 140 bp, Artificial Sequence
  Synthetic
atacgccatgctgggtctccggttggcgcccgaacagggacttgagaagagtgagagtcttcagggacacagctgagtgaaggcagtaagggcggcaggaatcaaccacgacggagcgctcgtacttgggagtcggccat

SEQ ID NO: 416928 - DNA, 140 bp, Artificial Sequence
  Synthetic
atggccgactcccaagtacgagcgctccgtcgtggttgattcctgccgcccttactgccttcactcagctgtgtccctgaagactctcactcttctcaagtccctgttcgggcgccaaccggagacccagcatggcgtat

SEQ ID NO: 416929 - DNA, 140 bp, Artificial Sequence
  Synthetic
atacgccatgctgggtctccaaagaaaaggtacatgttgaaacatgtaatatgggcagcaaatgaattagacagatttggattagcagagagcctgttggaatcaaaagaaggatgtcagcgtacttgggagtcggccat

SEQ ID NO: 416930 - DNA, 140 bp, Artificial Sequence
  Synthetic
atggccgactcccaagtacgctgacatccttcttttgattccaacaggctctctgctaatccaaatctgtctaattcatttgctgcccatattacatgtttcaacatgtaccttttctttggagacccagcatggcgtat

SEQ ID NO: 416931 - DNA, 140 bp, Artificial Sequence
  Synthetic
atacgccatgctgggtctccaaaaagcctttttaatactgtctgcgtcatttggtgcttgcacgcagaacagaaagtgaaagatactgaggaagcaaaaaagctagcacagagccatctacgtacttgggagtcggccat

SEQ ID NO: 416932 - DNA, 140 bp, Artificial Sequence
  Synthetic
atggccgactcccaagtacgtagatggctctgtgctagcttttttgcttcctcagtatctttcactttctgttctgcgtgcaagcaccaaatgacgcagacagtattaaaaaggctttttggagacccagcatggcgtat

SEQ ID NO: 416933 - DNA, 140 bp, Artificial Sequence
  Synthetic
atacgccatgctgggtctccaaatacagtggatgtacaggggtcaaaattccatcccagtggggaacatttatagaagatggattcaattaggattgcagaaatgtgtcaggatgtacaacgtacttgggagtcggccat

SEQ ID NO: 416934 - DNA, 140 bp, Artificial Sequence
  Synthetic
atggccgactcccaagtacgttgtacatcctgacacatttctgcaatcctaattgaatccatcttctataaatgttccccactgggatggaattttgacccctgtacatccactgtatttggagacccagcatggcgtat

SEQ ID NO: 416935 - DNA, 140 bp, Artificial Sequence
  Synthetic
aggccctggctgctgatatgtatagaagatggattcaattaggattgcagaaatgtgtcaggatgtacaaccccactaatatactagatgtaaaacaagggccaaaagaaccctttcaaagaccttttgggacagcggtg

SEQ ID NO: 416936 - DNA, 140 bp, Artificial Sequence
  Synthetic
caccgctgtcccaaaaggtctttgaaagggttcttttggcccttgttttacatctagtatattagtggggttgtacatcctgacacatttctgcaatcctaattgaatccatcttctatacatatcagcagccagggcct

SEQ ID NO: 416937 - DNA, 140 bp, Artificial Sequence
  Synthetic
aggccctggctgctgatatgtatatcgagggtcagccagtagaagtactactagacacaggggctgacgactcaatagtagcagggatagaattaggatgcaattacaccccaaaaataggaccttttgggacagcggtg

SEQ ID NO: 416938 - DNA, 140 bp, Artificial Sequence
  Synthetic
caccgctgtcccaaaaggtcctatttttggggtgtaattgcatcctaattctatccctgctactattgagtcgtcagcccctgtgtctagtagtacttctactggctgaccctcgatatacatatcagcagccagggcct

SEQ ID NO: 416939 - DNA, 140 bp, Artificial Sequence
  Synthetic
atacgccatgctgggtctccctcaatagtagcagggatagaattaggatgcaattacaccccaaaaatagtaggaggaataggagggttcataaatactaaagaatacaaagacatagaacgtacttgggagtcggccat

SEQ ID NO: 416940 - DNA, 140 bp, Artificial Sequence
  Synthetic
atggccgactcccaagtacgttctatgtctttgtattctttagtatttatgaaccctcctattcctcctactatttttggggtgtaattgcatcctaattctatccctgctactattgagggagacccagcatggcgtat

SEQ ID NO: 416941 - DNA, 140 bp, Artificial Sequence
  Synthetic
atacgccatgctgggtctcccccaataaatatttttggtagaaatatcttaagtgccttaggcatgagtttaaatttcccaatggcaaaattagagccagtgaaggtccagttaaagcctcgtacttgggagtcggccat

SEQ ID NO: 416942 - DNA, 140 bp, Artificial Sequence
  Synthetic
atggccgactcccaagtacgaggctttaactggaccttcactggctctaattttgccattgggaaatttaaactcatgcctaaggcacttaagatatttctaccaaaaatatttattgggggagacccagcatggcgtat

SEQ ID NO: 416943 - DNA, 140 bp, Artificial Sequence
  Synthetic
aggccctggctgctgatatgaagaagcacctcccactaatccatacaacacacccaccttcgctgtaaggaaaaaggacaaaaacaaatggagaatgctaatagacttcagggaattaaagaccttttgggacagcggtg

SEQ ID NO: 416944 - DNA, 140 bp, Artificial Sequence
  Synthetic
caccgctgtcccaaaaggtctttaattccctgaagtctattagcattctccatttgtttttgtcctttttccttacagcgaaggtgggtgtgttgtatggattagtgggaggtgcttcttcatatcagcagccagggcct

SEQ ID NO: 416945 - DNA, 140 bp, Artificial Sequence
  Synthetic
atacgccatgctgggtctcccaggattggcagaaagaaggagaatatcagtactagatgtaggagatgcctacttcagtgtcccactagatccagacttcagacaatatacagcattcaccgtacttgggagtcggccat

SEQ ID NO: 416946 - DNA, 140 bp, Artificial Sequence
  Synthetic
atggccgactcccaagtacggtgaatgctgtatattgtctgaagtctggatctagtgggacactgaagtaggcatctcctacatctagtactgatattctccttctttctgccaatcctgggagacccagcatggcgtat

SEQ ID NO: 416947 - DNA, 140 bp, Artificial Sequence
  Synthetic
atacgccatgctgggtctccatgatagagtagtatctcaactaaaagagttactaaataatatgggattctccaccccagaagaaaagttccaaaaggaccccccattccagtggatgggcgtacttgggagtcggccat

SEQ ID NO: 416948 - DNA, 140 bp, Artificial Sequence
  Synthetic
atggccgactcccaagtacgcccatccactggaatggggggtccttttggaacttttcttctggggtggagaatcccatattatttagtaactcttttagttgagatactactctatcatggagacccagcatggcgtat

SEQ ID NO: 416949 - DNA, 140 bp, Artificial Sequence
  Synthetic
aggccctggctgctgatatgactgatcagaggaaagatgaccctaacagaagaggtggagtggacagacctagcagaggcagagatgcaggaaaacaaaatcatcctggaacaggaacaggaccttttgggacagcggtg

SEQ ID NO: 416950 - DNA, 140 bp, Artificial Sequence
  Synthetic
caccgctgtcccaaaaggtcctgttcctgttccaggatgattttgttttcctgcatctctgcctctgctaggtctgtccactccacctcttctgttagggtcatctttcctctgatcagtcatatcagcagccagggcct

SEQ ID NO: 416951 - DNA, 140 bp, Artificial Sequence
  Synthetic
atacgccatgctgggtctccaaacttagcaaaccagtggacatacaaaattcatcagggagataaagtcctaaaagtaggaaaatatgcaaaggtcaaaaacacccacaccaatggagtacgtacttgggagtcggccat

SEQ ID NO: 416952 - DNA, 140 bp, Artificial Sequence
  Synthetic
atggccgactcccaagtacgtactccattggtgtgggtgtttttgacctttgcatattttcctacttttaggactttatctccctgatgaattttgtatgtccactggtttgctaagtttggagacccagcatggcgtat

SEQ ID NO: 416953 - DNA, 140 bp, Artificial Sequence
  Synthetic
atacgccatgctgggtctccttggggacaaataccaatgttccatttgccagtagaaagagaaacatgggaccaatggtggacagattactggcaagtaacttggatcccagaatgggaccgtacttgggagtcggccat

SEQ ID NO: 416954 - DNA, 140 bp, Artificial Sequence
  Synthetic
atggccgactcccaagtacggtcccattctgggatccaagttacttgccagtaatctgtccaccattggtcccatgtttctctttctactggcaaatggaacattggtatttgtccccaaggagacccagcatggcgtat

SEQ ID NO: 416955 - DNA, 140 bp, Artificial Sequence
  Synthetic
atacgccatgctgggtctccccccctagaaaaggtagaaaccttctacacagatgggtcctgcaacaaagtctcaaaggaaggaaaggcagggtatgtcacagacaggggaagagacaagcgtacttgggagtcggccat

SEQ ID NO: 416956 - DNA, 140 bp, Artificial Sequence
  Synthetic
atggccgactcccaagtacgcttgtctcttcccctgtctgtgacataccctgcctttccttcctttgagactttgttgcaggacccatctgtgtagaaggtttctaccttttctagggggggagacccagcatggcgtat

SEQ ID NO: 416957 - DNA, 140 bp, Artificial Sequence
  Synthetic
aggccctggctgctgatatgtctcaaaggaaggaaaggcagggtatgtcacagacaggggaagagacaaggtcaaaccattagagcagacaacaaaccaacaagcagaacttgaagcattgaccttttgggacagcggtg

SEQ ID NO: 416958 - DNA, 140 bp, Artificial Sequence
  Synthetic
caccgctgtcccaaaaggtcaatgcttcaagttctgcttgttggtttgttgtctgctctaatggtttgaccttgtctcttcccctgtctgtgacataccctgcctttccttcctttgagacatatcagcagccagggcct

SEQ ID NO: 416959 - DNA, 140 bp, Artificial Sequence
  Synthetic
aggccctggctgctgatatgtcaatagtaaataggataattgaagaaatgatcaagaaggaagcagtatatgtaggatgggtgccagctcacaaaggactaggtggtaatcaagaagtaggaccttttgggacagcggtg

SEQ ID NO: 416960 - DNA, 140 bp, Artificial Sequence
  Synthetic
caccgctgtcccaaaaggtcctacttcttgattaccacctagtcctttgtgagctggcacccatcctacatatactgcttccttcttgatcatttcttcaattatcctatttactattgacatatcagcagccagggcct

SEQ ID NO: 416961 - DNA, 140 bp, Artificial Sequence
  Synthetic
atacgccatgctgggtctccgaaccagcacaagaagaacatgaaaaatatcatggcaatgtaaaagagctggttcataaatttggaattccacaaatagtggcaaaacaaatagtaaactcgtacttgggagtcggccat

SEQ ID NO: 416962 - DNA, 140 bp, Artificial Sequence
  Synthetic
atggccgactcccaagtacgagtttactatttgttttgccactatttgtggaattccaaatttatgaaccagctcttttacattgccatgatatttttcatgttcttcttgtgctggttcggagacccagcatggcgtat

SEQ ID NO: 416963 - DNA, 140 bp, Artificial Sequence
  Synthetic
atacgccatgctgggtctccgcagagctagggacatggcaaatggactgtacacatttggaaggaaaagtcataatagtagcagtccatgtagccagtggatttatagaagcagaagtaacgtacttgggagtcggccat

SEQ ID NO: 416964 - DNA, 140 bp, Artificial Sequence
  Synthetic
atggccgactcccaagtacgttacttctgcttctataaatccactggctacatggactgctactattatgacttttccttccaaatgtgtacagtccatttgccatgtccctagctctgcggagacccagcatggcgtat

SEQ ID NO: 416965 - DNA, 140 bp, Artificial Sequence
  Synthetic
atacgccatgctgggtctccctagagaaatggcacagtctagtcaagcacctgaagcatagaacaagagaactacaacaggtctcttatgttccccaccacaaggtgggatgggcctggtcgtacttgggagtcggccat

SEQ ID NO: 416966 - DNA, 140 bp, Artificial Sequence
  Synthetic
atggccgactcccaagtacgaccaggcccatcccaccttgtggtggggaacataagagacctgttgtagttctcttgttctatgcttcaggtgcttgactagactgtgccatttctctagggagacccagcatggcgtat

SEQ ID NO: 416967 - DNA, 140 bp, Artificial Sequence
  Synthetic
atacgccatgctgggtctccggacttgcagtagagtaatattccccctaaataaaggagcatggctagagatccaaggatattggaatctgaccccggaaaggggattcttgagttcctacgtacttgggagtcggccat

SEQ ID NO: 416968 - DNA, 140 bp, Artificial Sequence
  Synthetic
atggccgactcccaagtacgtaggaactcaagaatcccctttccggggtcagattccaatatccttggatctctagccatgctcctttatttagggggaatattactctactgcaagtccggagacccagcatggcgtat

SEQ ID NO: 416969 - DNA, 140 bp, Artificial Sequence
  Synthetic
atacgccatgctgggtctccatgcatgggataatacagtaacagaacaagcagtagaggatgtctggaatctatttgagacatcaataaaaccatgtgtcaagctaacacctctatgtgtcgtacttgggagtcggccat

SEQ ID NO: 416970 - DNA, 140 bp, Artificial Sequence
  Synthetic
atggccgactcccaagtacgacacatagaggtgttagcttgacacatggttttattgatgtctcaaatagattccagacatcctctactgcttgttctgttactgtattatcccatgcatggagacccagcatggcgtat

SEQ ID NO: 416971 - DNA, 140 bp, Artificial Sequence
  Synthetic
atacgccatgctgggtctcccaaacatagaagggcccacactgataaatgaaacttctccatgcatacgaaataacagctgcacaggattgggacaggaagagatggtccagtgtcagttcgtacttgggagtcggccat

SEQ ID NO: 416972 - DNA, 140 bp, Artificial Sequence
  Synthetic
atggccgactcccaagtacgaactgacactggaccatctcttcctgtcccaatcctgtgcagctgttatttcgtatgcatggagaagtttcatttatcagtgtgggcccttctatgtttgggagacccagcatggcgtat

SEQ ID NO: 416973 - DNA, 140 bp, Artificial Sequence
  Synthetic
aggccctggctgctgatatgaataacagctgcacaggattgggacaggaagagatggtccagtgtcagtttgacatgataggattagagagggataagaaaaaacggtataatgaaacatgaccttttgggacagcggtg

SEQ ID NO: 416974 - DNA, 140 bp, Artificial Sequence
  Synthetic
caccgctgtcccaaaaggtcatgtttcattataccgttttttcttatccctctctaatcctatcatgtcaaactgacactggaccatctcttcctgtcccaatcctgtgcagctgttattcatatcagcagccagggcct

SEQ ID NO: 416975 - DNA, 140 bp, Artificial Sequence
  Synthetic
atacgccatgctgggtctccattggcatggtagagataataggactatcataagcttaaataagtattataatttaacaatgcattgtaagaggccaggaaacaagacagttgtaccaatcgtacttgggagtcggccat

SEQ ID NO: 416976 - DNA, 140 bp, Artificial Sequence
  Synthetic
atggccgactcccaagtacgattggtacaactgtcttgtttcctggcctcttacaatgcattgttaaattataatacttatttaagcttatgatagtcctattatctctaccatgccaatggagacccagcatggcgtat

SEQ ID NO: 416977 - DNA, 140 bp, Artificial Sequence
  Synthetic
atacgccatgctgggtctccctaggcaagcatggtgctggttcaaaggcaagtggagggaagccatgcaggaggtgaagcaaaccctcataaaacattccaggtatacaggaaccaaaaacgtacttgggagtcggccat

SEQ ID NO: 416978 - DNA, 140 bp, Artificial Sequence
  Synthetic
atggccgactcccaagtacgtttttggttcctgtatacctggaatgttttatgagggtttgcttcacctcctgcatggcttccctccacttgcctttgaaccagcaccatgcttgcctagggagacccagcatggcgtat

SEQ ID NO: 416979 - DNA, 140 bp, Artificial Sequence
  Synthetic
atacgccatgctgggtctccagcaaacatcaccttcagtgcagaggtggcagaactgtaccgattggaattgggggattataaattagtagaagtgacaccaattggcttcgcacctacacgtacttgggagtcggccat

SEQ ID NO: 416980 - DNA, 140 bp, Artificial Sequence
  Synthetic
atggccgactcccaagtacgtgtaggtgcgaagccaattggtgtcacttctactaatttataatcccccaattccaatcggtacagttctgccacctctgcactgaaggtgatgtttgctggagacccagcatggcgtat

SEQ ID NO: 416981 - DNA, 140 bp, Artificial Sequence
  Synthetic
atacgccatgctgggtctccgctagggttcttgggttttctcacgacagcaggagttgcaatgggcgcggcgtccttgacgctgtcggctcagtcccggactttactggctgggatagtgcgtacttgggagtcggccat

SEQ ID NO: 416982 - DNA, 140 bp, Artificial Sequence
  Synthetic
atggccgactcccaagtacgcactatcccagccagtaaagtccgggactgagccgacagcgtcaaggacgccgcgcccattgcaactcctgctgtcgtgagaaaacccaagaaccctagcggagacccagcatggcgtat

SEQ ID NO: 416983 - DNA, 140 bp, Artificial Sequence
  Synthetic
atacgccatgctgggtctccgaaaagaacatgtatgaattacaaaaactaaatagctgggatgtttttggcaactggtttgatttgacctcctggatcaaatatattcagtatggagttccgtacttgggagtcggccat

SEQ ID NO: 416984 - DNA, 140 bp, Artificial Sequence
  Synthetic
atggccgactcccaagtacggaactccatactgaatatatttgatccaggaggtcaaatcaaaccagttgccaaaaacatcccagctatttagtttttgtaattcatacatgttcttttcggagacccagcatggcgtat

SEQ ID NO: 416985 - DNA, 140 bp, Artificial Sequence
  Synthetic
atacgccatgctgggtctccacgaagaaacagaagaaggaggtggaagcgacgagggctacagatcttggccttggcagatcgagtacatccacttcctaattcgccagctgaggaacctcgtacttgggagtcggccat

SEQ ID NO: 416986 - DNA, 140 bp, Artificial Sequence
  Synthetic
atggccgactcccaagtacgaggttcctcagctggcgaattaggaagtggatgtactcgatctgccaaggccaagatctgtagccctcgtcgcttccacctccttcttctgtttcttcgtggagacccagcatggcgtat

SEQ ID NO: 416987 - DNA, 140 bp, Artificial Sequence
  Synthetic
aggccctggctgctgatatgcagtatgggatcagctggctccaagaagcagtccaagccgctgcgagggctgcgggagagactcttgcgagcgccagcaggaccttatgggaggctctcagaccttttgggacagcggtg

SEQ ID NO: 416988 - DNA, 140 bp, Artificial Sequence
  Synthetic
caccgctgtcccaaaaggtctgagagcctcccataaggtcctgctggcgctcgcaagagtctctcccgcagccctcgcagcggcttggactgcttcttggagccagctgatcccatactgcatatcagcagccagggcct

SEQ ID NO: 416989 - DNA, 140 bp, Artificial Sequence
  Synthetic
aggccctggctgctgatatgcttgaactcaccctcctgtgagggacaaaacgctccaggggcagaagggggagggcaacaagacatagaagaagatgatgaggacgatgaagtgggagcagaccttttgggacagcggtg

SEQ ID NO: 416990 - DNA, 140 bp, Artificial Sequence
  Synthetic
caccgctgtcccaaaaggtctgctcccacttcatcgtcctcatcatcttcttctatgtcttgttgccctcccccttctgcccctggagcgttttgtccctcacaggagggtgagttcaagcatatcagcagccagggcct

SEQ ID NO: 416991 - DNA, 140 bp, Artificial Sequence
  Synthetic
aggccctggctgctgatatggatgaagtgggagcatatgtcaggcctaataagccactgagagcaatgacacatagattggcaatagacatgtctcattttataaaagaaaaggggggacgaccttttgggacagcggtg

SEQ ID NO: 416992 - DNA, 140 bp, Artificial Sequence
  Synthetic
caccgctgtcccaaaaggtcgtccccccttttcttttataaaatgagacatgtctattgccaatctatgtgtcattgctctcagtggcttattaggcctgacatatgctcccacttcatccatatcagcagccagggcct

SEQ ID NO: 416993 - DNA, 140 bp, Artificial Sequence
  Synthetic
aggccctggctgctgatatgtgccactaagtccccgaaccctaaatgcctgggtaaaattagtggaggaaaagaagttcggggcagaaatagtaccaggatttcaggcactatcagaggggaccttttgggacagcggtg

SEQ ID NO: 416994 - DNA, 140 bp, Artificial Sequence
  Synthetic
caccgctgtcccaaaaggtcccctctgatagtgcctgaaatcctggtactatttctgccccgaacttcttttcctccactaattttacccaggcatttagggttcggggacttagtggcacatatcagcagccagggcct

SEQ ID NO: 416995 - DNA, 140 bp, Artificial Sequence
  Synthetic
atacgccatgctgggtctccatgtaccccttatgatatcaatcagatgctaaattgcgtaggagaacatcaggcagctatgcaagtcattagagaaataatcaatgaagaggcggcagaccgtacttgggagtcggccat

SEQ ID NO: 416996 - DNA, 140 bp, Artificial Sequence
  Synthetic
atggccgactcccaagtacggtctgccgcctcttcattgattatttctctaatgacttgcatagctgcctgatgttctcctacgcaatttagcatctgattgatatcataaggggtacatggagacccagcatggcgtat

SEQ ID NO: 416997 - DNA, 140 bp, Artificial Sequence
  Synthetic
atacgccatgctgggtctccagaccccagaggatcagatatagcgggaaccaccagcacagtagaggaacaaatacagtggatgtacaggggtcaaaattccgtcccagtagggaacattcgtacttgggagtcggccat

SEQ ID NO: 416998 - DNA, 140 bp, Artificial Sequence
  Synthetic
atggccgactcccaagtacgaatgttccctactgggacggaattttgacccctgtacatccactgtatttgttcctctactgtgctggtggttcccgctatatctgatcctctggggtctggagacccagcatggcgtat

SEQ ID NO: 416999 - DNA, 140 bp, Artificial Sequence
  Synthetic
atacgccatgctgggtctccttaatggctgaggctctaaaagaagccttaacgcctgcacccataccattcgctgctgctcaacagaaggcaggaaagagagggacattgacatgctggacgtacttgggagtcggccat

SEQ ID NO: 417000 - DNA, 140 bp, Artificial Sequence
  Synthetic
atggccgactcccaagtacgtccagcatgtcaatgtccctctctttcctgccttctgttgagcagcagcgaatggtatgggtgcaggcgttaaggcttcttttagagcctcagccattaaggagacccagcatggcgtat

SEQ ID NO: 417001 - DNA, 140 bp, Artificial Sequence
  Synthetic
  misc_feature (29)..(29): n is a, c, g, or t
aggccctggctgctgatatgagacagacnggcgggttttttagggtttggaccctggggaaagaagcctcgcaacttccccgcggcccaagtgcctcaggaggtggtgccatctgcacccgaccttttgggacagcggtg

SEQ ID NO: 417002 - DNA, 140 bp, Artificial Sequence
  Synthetic
  misc_feature (112)..(112): n is a, c, g, or t
caccgctgtcccaaaaggtcgggtgcagatggcaccacctcctgaggcacttgggccgcggggaagttgcgaggcttctttccccagggtccaaaccctaaaaaacccgccngtctgtctcatatcagcagccagggcct

SEQ ID NO: 417003 - DNA, 140 bp, Artificial Sequence
  Synthetic
atacgccatgctgggtctccactggcccttagagagatctgtgaaaaaatggaaaaggaggggcagctagaagaagcaccccccactaatccatacaacacacccaccttcgctataaggcgtacttgggagtcggccat

SEQ ID NO: 417004 - DNA, 140 bp, Artificial Sequence
  Synthetic
atggccgactcccaagtacgccttatagcgaaggtgggtgtgttgtatggattagtggggggtgcttcttctagctgcccctccttttccattttttcacagatctctctaagggccagtggagacccagcatggcgtat

SEQ ID NO: 417005 - DNA, 140 bp, Artificial Sequence
  Synthetic
aggccctggctgctgatatgaagaagcaccccccactaatccatacaacacacccaccttcgctataaggaaaaaggacaaaaacaaatggagaatgctaatagacttcagggaattaaagaccttttgggacagcggtg

SEQ ID NO: 417006 - DNA, 140 bp, Artificial Sequence
  Synthetic
caccgctgtcccaaaaggtctttaattccctgaagtctattagcattctccatttgtttttgtcctttttccttatagcgaaggtgggtgtgttgtatggattagtggggggtgcttcttcatatcagcagccagggcct

SEQ ID NO: 417007 - DNA, 140 bp, Artificial Sequence
  Synthetic
atacgccatgctgggtctcctcctaccacagggatggaagggatccccagcaatctttcaatactctatgaggaaggtactagaccccttcagaaaggccaacaatgatgtcaccataatcgtacttgggagtcggccat

SEQ ID NO: 417008 - DNA, 140 bp, Artificial Sequence
  Synthetic
atggccgactcccaagtacgattatggtgacatcattgttggcctttctgaaggggtctagtaccttcctcatagagtattgaaagattgctggggatcccttccatccctgtggtaggaggagacccagcatggcgtat

SEQ ID NO: 417009 - DNA, 140 bp, Artificial Sequence
  Synthetic
atacgccatgctgggtctccatgatagagtagtatctcaactaaaagagttactaaatgaaatgggattttccaccccagaagaaaagttccaaaaggaccccccattccagtggatgggcgtacttgggagtcggccat

SEQ ID NO: 417010 - DNA, 140 bp, Artificial Sequence
  Synthetic
atggccgactcccaagtacgcccatccactggaatggggggtccttttggaacttttcttctggggtggaaaatcccatttcatttagtaactcttttagttgagatactactctatcatggagacccagcatggcgtat

SEQ ID NO: 417011 - DNA, 140 bp, Artificial Sequence
  Synthetic
aggccctggctgctgatatgtccaccccagaagaaaagttccaaaaggaccccccattccagtggatgggctatgagctctggccaaaaaagtggaaattgcaaaaaatacaaataccaggaccttttgggacagcggtg

SEQ ID NO: 417012 - DNA, 140 bp, Artificial Sequence
  Synthetic
caccgctgtcccaaaaggtcctggtatttgtattttttgcaatttccacttttttggccagagctcatagcccatccactggaatggggggtccttttggaacttttcttctggggtggacatatcagcagccagggcct

SEQ ID NO: 417013 - DNA, 140 bp, Artificial Sequence
  Synthetic
atacgccatgctgggtctcctcaatagtaaacaggataattgaagaaatgatcaaaaaagaagcagtatatgtgggatgggtgccagcccacaaaggactaggtggtaatcaggaagtagcgtacttgggagtcggccat

SEQ ID NO: 417014 - DNA, 140 bp, Artificial Sequence
  Synthetic
atggccgactcccaagtacgctacttcctgattaccacctagtcctttgtgggctggcacccatcccacatatactgcttcttttttgatcatttcttcaattatcctgtttactattgaggagacccagcatggcgtat

SEQ ID NO: 417015 - DNA, 140 bp, Artificial Sequence
  Synthetic
atacgccatgctgggtctccaccacctagtaagtcaaggaattaggcaggttctatttctagaaaagatagaaccagcacaagaagaacatgacaagtatcatggcaatgtaaaagagctcgtacttgggagtcggccat

SEQ ID NO: 417016 - DNA, 140 bp, Artificial Sequence
  Synthetic
atggccgactcccaagtacgagctcttttacattgccatgatacttgtcatgttcttcttgtgctggttctatcttttctagaaatagaacctgcctaattccttgacttactaggtggtggagacccagcatggcgtat

SEQ ID NO: 417017 - DNA, 140 bp, Artificial Sequence
  Synthetic
aggccctggctgctgatatgagcagatggcctatcacacacctgcacacagacaatggtgccaactttacctcacaagatgtgaaaatggtggcctggtgggtaggaatagaacaatcctgaccttttgggacagcggtg

SEQ ID NO: 417018 - DNA, 140 bp, Artificial Sequence
  Synthetic
caccgctgtcccaaaaggtcaggattgttctattcctacccaccaggccaccattttcacatcttgtgaggtaaagttggcaccattgtctgtgtgcaggtgtgtgataggccatctgctcatatcagcagccagggcct

SEQ ID NO: 417019 - DNA, 140 bp, Artificial Sequence
  Synthetic
atacgccatgctgggtctcccccgaacagggacctggaagagtgagagtcttcaggagcacagctgagtgaaggcagtaagggcggcaggaatcaaccacgacggagagctcctgtaaagcgtacttgggagtcggccat

SEQ ID NO: 417020 - DNA, 140 bp, Artificial Sequence
  Synthetic
atggccgactcccaagtacgctttacaggagctctccgtcgtggttgattcctgccgcccttactgccttcactcagctgtgctcctgaagactctcactcttccaggtccctgttcgggggagacccagcatggcgtat

SEQ ID NO: 417021 - DNA, 140 bp, Artificial Sequence
  Synthetic
aggccctggctgctgatatgaaggcagtaagggcggcaggaatcaaccacgacggagagctcctgtaaaggcgcaggctggtaccaggcagcgtgaggagcgggaggaaaagaggcctccgaccttttgggacagcggtg

SEQ ID NO: 417022 - DNA, 140 bp, Artificial Sequence
  Synthetic
caccgctgtcccaaaaggtcggaggcctcttttcctcccgctcctcacgctgcctggtaccagcctgcgcctttacaggagctctccgtcgtggttgattcctgccgcccttactgccttcatatcagcagccagggcct

SEQ ID NO: 417023 - DNA, 140 bp, Artificial Sequence
  Synthetic
aggccctggctgctgatatgtagggcataagtgggagatgggcgcgagaagctccgtcctgtcagggaagaaaacagatgaattagaaaaagttaggttacggcccggcggaaagaaaaggaccttttgggacagcggtg

SEQ ID NO: 417024 - DNA, 140 bp, Artificial Sequence
  Synthetic
caccgctgtcccaaaaggtccttttctttccgccgggccgtaacctaactttttctaattcatctgttttcttccctgacaggacggagcttctcgcgcccatctcccacttatgccctacatatcagcagccagggcct

SEQ ID NO: 417025 - DNA, 140 bp, Artificial Sequence
  Synthetic
aggccctggctgctgatatgaaaacagatgaattagaaaaagttaggttacggcccggcggaaagaaaaggtatatgttgaaacatgtaatatgggcagtgaacgaattagatagatttggaccttttgggacagcggtg

SEQ ID NO: 417026 - DNA, 140 bp, Artificial Sequence
  Synthetic
caccgctgtcccaaaaggtccaaatctatctaattcgttcactgcccatattacatgtttcaacatataccttttctttccgccgggccgtaacctaactttttctaattcatctgttttcatatcagcagccagggcct

SEQ ID NO: 417027 - DNA, 140 bp, Artificial Sequence
  Synthetic
atacgccatgctgggtctccaaagtcttagctccattagtaccaacaggatcagaaaatttaaaaagcctttttaatactgtctgcgtcattttctgcctgcacgcagaagagaaagtgacgtacttgggagtcggccat

SEQ ID NO: 417028 - DNA, 140 bp, Artificial Sequence
  Synthetic
atggccgactcccaagtacgtcactttctcttctgcgtgcaggcagaaaatgacgcagacagtattaaaaaggctttttaaattttctgatcctgttggtactaatggagctaagactttggagacccagcatggcgtat

SEQ ID NO: 417029 - DNA, 140 bp, Artificial Sequence
  Synthetic
aggccctggctgctgatatgttttaatactgtctgcgtcattttctgcctgcacgcagaagagaaagtgaaagatacagaggaggcaaaaaagatagcacagcgacacctagcggacgcagaccttttgggacagcggtg

SEQ ID NO: 417030 - DNA, 140 bp, Artificial Sequence
  Synthetic
caccgctgtcccaaaaggtctgcgtccgctaggtgtcgctgtgctatcttttttgcctcctctgtatctttcactttctcttctgcgtgcaggcagaaaatgacgcagacagtattaaaacatatcagcagccagggcct

SEQ ID NO: 417031 - DNA, 140 bp, Artificial Sequence
  Synthetic
atacgccatgctgggtctccttatccagtgcagcaaatagctggcaactatgtccacgtgccgctaagcccccgaaccttaaatgcttgggtaaaattagtagaagaaaagaagttcgggcgtacttgggagtcggccat

SEQ ID NO: 417032 - DNA, 140 bp, Artificial Sequence
  Synthetic
atggccgactcccaagtacgcccgaacttcttttcttctactaattttacccaagcatttaaggttcgggggcttagcggcacgtggacatagttgccagctatttgctgcactggataaggagacccagcatggcgtat

SEQ ID NO: 417033 - DNA, 140 bp, Artificial Sequence
  Synthetic
aggccctggctgctgatatgcccgaaccttaaatgcttgggtaaaattagtagaagaaaagaagttcggggcagaggtagtaccaggattccaagcactatcagaaggatgcactccttagaccttttgggacagcggtg

SEQ ID NO: 417034 - DNA, 140 bp, Artificial Sequence
  Synthetic
caccgctgtcccaaaaggtctaaggagtgcatccttctgatagtgcttggaatcctggtactacctctgccccgaacttcttttcttctactaattttacccaagcatttaaggttcgggcatatcagcagccagggcct

SEQ ID NO: 417035 - DNA, 140 bp, Artificial Sequence
  Synthetic
atacgccatgctgggtctccaaattattagagaaataattaatgatgaagcagcagactgggaccaacaacacccgtcaccaggcccactgccggcaggacagcttagagacccaaggggcgtacttgggagtcggccat

SEQ ID NO: 417036 - DNA, 140 bp, Artificial Sequence
  Synthetic
atggccgactcccaagtacgccccttgggtctctaagctgtcctgccggcagtgggcctggtgacgggtgttgttggtcccagtctgctgcttcatcattaattatttctctaataatttggagacccagcatggcgtat

SEQ ID NO: 417037 - DNA, 140 bp, Artificial Sequence
  Synthetic
aggccctggctgctgatatgcacccgtcaccaggcccactgccggcaggacagcttagagacccaaggggatcagatatagcgggaaccaccagcacagtagaggaacagatacagtggagaccttttgggacagcggtg

SEQ ID NO: 417038 - DNA, 140 bp, Artificial Sequence
  Synthetic
caccgctgtcccaaaaggtctccactgtatctgttcctctactgtgctggtggttcccgctatatctgatccccttgggtctctaagctgtcctgccggcagtgggcctggtgacgggtgcatatcagcagccagggcct

SEQ ID NO: 417039 - DNA, 140 bp, Artificial Sequence
  Synthetic
atacgccatgctgggtctccattcaaatagggttgcagaaatgtgtccggatgtacaatcctaccaacatattggacataaagcagggaccaaaagaacccttccaaagttatgtagatacgtacttgggagtcggccat

SEQ ID NO: 417040 - DNA, 140 bp, Artificial Sequence
  Synthetic
atggccgactcccaagtacgtatctacataactttggaagggttcttttggtccctgctttatgtccaatatgttggtaggattgtacatccggacacatttctgcaaccctatttgaatggagacccagcatggcgtat

SEQ ID NO: 417041 - DNA, 140 bp, Artificial Sequence
  Synthetic
aggccctggctgctgatatgattggacataaagcagggaccaaaagaacccttccaaagttatgtagatagattctacaaaagcttacgggcagagcaaacagacccagcagtgaaaagtgaccttttgggacagcggtg

SEQ ID NO: 417042 - DNA, 140 bp, Artificial Sequence
  Synthetic
caccgctgtcccaaaaggtcacttttcactgctgggtctgtttgctctgcccgtaagcttttgtagaatctatctacataactttggaagggttcttttggtccctgctttatgtccaatcatatcagcagccagggcct

SEQ ID NO: 417043 - DNA, 140 bp, Artificial Sequence
  Synthetic
atacgccatgctgggtctccagtacttaagggcttgggaatgaatcccaccttagaagaaatgctgacggcctgccaaggaataggaggcccagggcagaaggcaaagctaatggccgagcgtacttgggagtcggccat

SEQ ID NO: 417044 - DNA, 140 bp, Artificial Sequence
  Synthetic
atggccgactcccaagtacgctcggccattagctttgccttctgccctgggcctcctattccttggcaggccgtcagcatttcttctaaggtgggattcattcccaagcccttaagtactggagacccagcatggcgtat

SEQ ID NO: 417045 - DNA, 140 bp, Artificial Sequence
  Synthetic
atacgccatgctgggtctccgccttaaaagaggctttaacaccggcacccataccgtttgctgcctttcaacagaaaacagggaagagagggacagtgacatgctggaactgtggcaaagcgtacttgggagtcggccat

SEQ ID NO: 417046 - DNA, 140 bp, Artificial Sequence
  Synthetic
atggccgactcccaagtacgctttgccacagttccagcatgtcactgtccctctcttccctgttttctgttgaaaggcagcaaacggtatgggtgccggtgttaaagcctcttttaaggcggagacccagcatggcgtat

SEQ ID NO: 417047 - DNA, 140 bp, Artificial Sequence
  Synthetic
atacgccatgctgggtctccaaatgtggaaaacaaggacacatcatgtcaaaatgcccagaaagacaggttggttttttagggttaggaccctggggaaagaagcctcgcaacttccccacgtacttgggagtcggccat

SEQ ID NO: 417048 - DNA, 140 bp, Artificial Sequence
  Synthetic
atggccgactcccaagtacgtggggaagttgcgaggcttctttccccagggtcctaaccctaaaaaaccaacctgtctttctgggcattttgacatgatgtgtccttgttttccacatttggagacccagcatggcgtat

SEQ ID NO: 417049 - DNA, 140 bp, Artificial Sequence
  Synthetic
aggccctggctgctgatatgtggttttttagggttaggaccctggggaaagaagcctcgcaacttccccatgacccaggtgcctcagggagtgacaccatctgcacccccgatgaacccagaccttttgggacagcggtg

SEQ ID NO: 417050 - DNA, 140 bp, Artificial Sequence
  Synthetic
caccgctgtcccaaaaggtctgggttcatcgggggtgcagatggtgtcactccctgaggcacctgggtcatggggaagttgcgaggcttctttccccagggtcctaaccctaaaaaaccacatatcagcagccagggcct

SEQ ID NO: 417051 - DNA, 140 bp, Artificial Sequence
  Synthetic
atacgccatgctgggtctcctccagcagtggagatgctgaaaagctacatgcagatggggaaacaacagagagagagccgagagagaccctacaaggaggtgacagaggacttgctgcaccgtacttgggagtcggccat

SEQ ID NO: 417052 - DNA, 140 bp, Artificial Sequence
  Synthetic
atggccgactcccaagtacggtgcagcaagtcctctgtcacctccttgtagggtctctctcggctctctctctgttgtttccccatctgcatgtagcttttcagcatctccactgctggaggagacccagcatggcgtat

SEQ ID NO: 417053 - DNA, 140 bp, Artificial Sequence
  Synthetic
  misc_feature (105)..(105): n is a, c, g, or t
aggccctggctgctgatatggagagagccgagagagaccctacaaggaggtgacagaggacttgctgcacctcaattctctctttggagaagaccagtagtcagngcatgtatcgagggtgaccttttgggacagcggtg

SEQ ID NO: 417054 - DNA, 140 bp, Artificial Sequence
  Synthetic
  misc_feature (36)..(36): n is a, c, g, or t
caccgctgtcccaaaaggtcaccctcgatacatgcnctgactactggtcttctccaaagagagaattgaggtgcagcaagtcctctgtcacctccttgtagggtctctctcggctctctccatatcagcagccagggcct

SEQ ID NO: 417055 - DNA, 140 bp, Artificial Sequence
  Synthetic
  misc_feature (31)..(31): n is a, c, g, or t
  misc_feature (66)..(66): n is a, c, g, or t
atacgccatgctgggtctccaggaatagaantaggtagcaattacaccccaaaaatagtagggggnataggagggtttataaataccaaagaatacaaagatgtagaaatagaagtagtgcgtacttgggagtcggccat

SEQ ID NO: 417056 - DNA, 140 bp, Artificial Sequence
  Synthetic
  misc_feature (75)..(75): n is a, c, g, or t
  misc_feature (110)..(110): n is a, c, g, or t
atggccgactcccaagtacgcactacttctatttctacatctttgtattctttggtatttataaaccctcctatnccccctactatttttggggtgtaattgctacctanttctattcctggagacccagcatggcgtat

SEQ ID NO: 417057 - DNA, 140 bp, Artificial Sequence
  Synthetic
aggccctggctgctgatatggagggtttataaataccaaagaatacaaagatgtagaaatagaagtagtgggaaaaacagtaagggcaactataatgacaggagacaccccaataaacatgaccttttgggacagcggtg

SEQ ID NO: 417058 - DNA, 140 bp, Artificial Sequence
  Synthetic
caccgctgtcccaaaaggtcatgtttattggggtgtctcctgtcattatagttgcccttactgtttttcccactacttctatttctacatctttgtattctttggtatttataaaccctccatatcagcagccagggcct

SEQ ID NO: 417059 - DNA, 140 bp, Artificial Sequence
  Synthetic
  misc_feature (27)..(27): n is a, c, g, or t
  misc_feature (29)..(29): n is a, c, g, or t
  misc_feature (52)..(52): n is a, c, g, or t
  misc_feature (64)..(64): n is a, c, g, or t
  misc_feature (70)..(70): n is a, c, g, or t
  misc_feature (103)..(103): n is a, c, g, or t
  misc_feature (118)..(118): n is a, c, g, or t
atacgccatgctgggtctcctggcaangntagaaccagtaaaagttgagttnaaacctggaaangatggnccaaagatcagacaatggcctctatccaggganaagatactagccctnaacgtacttgggagtcggccat

SEQ ID NO: 417060 - DNA, 140 bp, Artificial Sequence
  Synthetic
  misc_feature (23)..(23): n is a, c, g, or t
  misc_feature (38)..(38): n is a, c, g, or t
  misc_feature (71)..(71): n is a, c, g, or t
  misc_feature (77)..(77): n is a, c, g, or t
  misc_feature (89)..(89): n is a, c, g, or t
  misc_feature (112)..(112): n is a, c, g, or t
  misc_feature (114)..(114): n is a, c, g, or t
atggccgactcccaagtacgttnagggctagtatcttntccctggatagaggccattgtctgatctttggnccatcntttccaggtttnaactcaacttttactggttctancnttgccaggagacccagcatggcgtat

SEQ ID NO: 417061 - DNA, 140 bp, Artificial Sequence
  Synthetic
  misc_feature (53)..(53): n is a, c, g, or t
  misc_feature (68)..(68): n is a, c, g, or t
  misc_feature (92)..(92): n is a, c, g, or t
aggccctggctgctgatatgccaaagatcagacaatggcctctatccaggganaagatactagccctnaaagaaatctgtgaaaaaatgganaaggaggggcaattagaagaagcaccccgaccttttgggacagcggtg

SEQ ID NO: 417062 - DNA, 140 bp, Artificial Sequence
  Synthetic
  misc_feature (49)..(49): n is a, c, g, or t
  misc_feature (73)..(73): n is a, c, g, or t
  misc_feature (88)..(88): n is a, c, g, or t
caccgctgtcccaaaaggtcggggtgcttcttctaattgcccctccttntccattttttcacagatttctttnagggctagtatcttntccctggatagaggccattgtctgatctttggcatatcagcagccagggcct

SEQ ID NO: 417063 - DNA, 140 bp, Artificial Sequence
  Synthetic
  misc_feature (50)..(50): n is a, c, g, or t
  misc_feature (89)..(89): n is a, c, g, or t
atacgccatgctgggtctccaacaaatggagaatgctaatagactttagngaattaaacaaggtaacccaggacttcacagaagtccanttgggtatcccccacccggcagggttggcagcgtacttgggagtcggccat

SEQ ID NO: 417064 - DNA, 140 bp, Artificial Sequence
  Synthetic
  misc_feature (52)..(52): n is a, c, g, or t
  misc_feature (91)..(91): n is a, c, g, or t
atggccgactcccaagtacgctgccaaccctgccgggtgggggatacccaantggacttctgtgaagtcctgggttaccttgtttaattcnctaaagtctattagcattctccatttgttggagacccagcatggcgtat

SEQ ID NO: 417065 - DNA, 140 bp, Artificial Sequence
  Synthetic
  misc_feature (33)..(33): n is a, c, g, or t
  misc_feature (35)..(35): n is a, c, g, or t
  misc_feature (60)..(60): n is a, c, g, or t
  misc_feature (77)..(77): n is a, c, g, or t
  misc_feature (119)..(119): n is a, c, g, or t
atacgccatgctgggtctccccactagatccananttcagacagtatacagcattcaccntgccatcaacaaacaanacagagccaggaaagagatacatttataaagttctaccacangcgtacttgggagtcggccat

SEQ ID NO: 417066 - DNA, 140 bp, Artificial Sequence
  Synthetic
  misc_feature (22)..(22): n is a, c, g, or t
  misc_feature (64)..(64): n is a, c, g, or t
  misc_feature (81)..(81): n is a, c, g, or t
  misc_feature (106)..(106): n is a, c, g, or t
  misc_feature (108)..(108): n is a, c, g, or t
atggccgactcccaagtacgcntgtggtagaactttataaatgtatctctttcctggctctgtnttgtttgttgatggcanggtgaatgctgtatactgtctgaantntggatctagtggggagacccagcatggcgtat

SEQ ID NO: 417067 - DNA, 140 bp, Artificial Sequence
  Synthetic
  misc_feature (27)..(27): n is a, c, g, or t
  misc_feature (69)..(69): n is a, c, g, or t
  misc_feature (81)..(81): n is a, c, g, or t
aggccctggctgctgatatgaaacaanacagagccaggaaagagatacatttataaagttctaccacanggatggaagggntccccagcaatttttcaatactccatgaggaaggtattagaccttttgggacagcggtg

SEQ ID NO: 417068 - DNA, 140 bp, Artificial Sequence
  Synthetic
  misc_feature (60)..(60): n is a, c, g, or t
  misc_feature (72)..(72): n is a, c, g, or t
  misc_feature (114)..(114): n is a, c, g, or t
caccgctgtcccaaaaggtctaataccttcctcatggagtattgaaaaattgctggggancccttccatccntgtggtagaactttataaatgtatctctttcctggctctgtnttgtttcatatcagcagccagggcct

SEQ ID NO: 417069 - DNA, 140 bp, Artificial Sequence
  Synthetic
atacgccatgctgggtctcctgacatccttatagcaagtgacagaagtgatctggagcatgacagggtagtgtcccaactaaaagagctattaaataacatgggattctctaccccagaacgtacttgggagtcggccat

SEQ ID NO: 417070 - DNA, 140 bp, Artificial Sequence
  Synthetic
atggccgactcccaagtacgttctggggtagagaatcccatgttatttaatagctcttttagttgggacactaccctgtcatgctccagatcacttctgtcacttgctataaggatgtcaggagacccagcatggcgtat

SEQ ID NO: 417071 - DNA, 140 bp, Artificial Sequence
  Synthetic
  misc_feature (76)..(76): n is a, c, g, or t
  misc_feature (82)..(82): n is a, c, g, or t
  misc_feature (85)..(85): n is a, c, g, or t
  misc_feature (118)..(118): n is a, c, g, or t
aggccctggctgctgatatgtgtcccaactaaaagagctattaaataacatgggattctctaccccagaagaaaanttccanaangaccctccgttccgatggatgggttatgagctntggaccttttgggacagcggtg

SEQ ID NO: 417072 - DNA, 140 bp, Artificial Sequence
  Synthetic
  misc_feature (23)..(23): n is a, c, g, or t
  misc_feature (56)..(56): n is a, c, g, or t
  misc_feature (59)..(59): n is a, c, g, or t
  misc_feature (65)..(65): n is a, c, g, or t
caccgctgtcccaaaaggtccanagctcataacccatccatcggaacggagggtcnttntggaanttttcttctggggtagagaatcccatgttatttaatagctcttttagttgggacacatatcagcagccagggcct

SEQ ID NO: 417073 - DNA, 140 bp, Artificial Sequence
  Synthetic
  misc_feature (91)..(91): n is a, c, g, or t
  misc_feature (108)..(108): n is a, c, g, or t
atacgccatgctgggtctccggacagtgaatgacattcaaaaactggtaggagtattaaactgggcagctcaactctttcctggaatcaanacaaggcacatgtgcanactaattaggggcgtacttgggagtcggccat

SEQ ID NO: 417074 - DNA, 140 bp, Artificial Sequence
  Synthetic
  misc_feature (33)..(33): n is a, c, g, or t
  misc_feature (50)..(50): n is a, c, g, or t
atggccgactcccaagtacgcccctaattagtntgcacatgtgccttgtnttgattccaggaaagagttgagctgcccagtttaatactcctaccagtttttgaatgtcattcactgtccggagacccagcatggcgtat

SEQ ID NO: 417075 - DNA, 140 bp, Artificial Sequence
  Synthetic
  misc_feature (41)..(41): n is a, c, g, or t
  misc_feature (58)..(58): n is a, c, g, or t
  misc_feature (93)..(93): n is a, c, g, or t
aggccctggctgctgatatgcaactctttcctggaatcaanacaaggcacatgtgcanactaattaggggaaagatgaccctaacagaagaantacagtggacagaattagcagaggcaggaccttttgggacagcggtg

SEQ ID NO: 417076 - DNA, 140 bp, Artificial Sequence
  Synthetic
  misc_feature (48)..(48): n is a, c, g, or t
  misc_feature (83)..(83): n is a, c, g, or t
  misc_feature (100)..(100): n is a, c, g, or t
caccgctgtcccaaaaggtcctgcctctgctaattctgtccactgtanttcttctgttagggtcatctttcccctaattagtntgcacatgtgccttgtnttgattccaggaaagagttgcatatcagcagccagggcct

SEQ ID NO: 417077 - DNA, 140 bp, Artificial Sequence
  Synthetic
  misc_feature (101)..(101): n is a, c, g, or t
atacgccatgctgggtctcctacaaggaaggggtaccattagaagcaacagtacagaaaaacctagcaaatcagtggacatacaagattcatcagggaaanagaatgttaaaagtaggaacgtacttgggagtcggccat

SEQ ID NO: 417078 - DNA, 140 bp, Artificial Sequence
  Synthetic
  misc_feature (40)..(40): n is a, c, g, or t
atggccgactcccaagtacgttcctacttttaacattctntttccctgatgaatcttgtatgtccactgatttgctaggtttttctgtactgttgcttctaatggtaccccttccttgtaggagacccagcatggcgtat

SEQ ID NO: 417079 - DNA, 140 bp, Artificial Sequence
  Synthetic
  misc_feature (51)..(51): n is a, c, g, or t
  misc_feature (111)..(111): n is a, c, g, or t
  misc_feature (114)..(114): n is a, c, g, or t
aggccctggctgctgatatgtcagtggacatacaagattcatcagggaaanagaatgttaaaagtaggaaaatatgcaaaggttaaaaacacccacaccaacggggtaagnatnctggcagaccttttgggacagcggtg

SEQ ID NO: 417080 - DNA, 140 bp, Artificial Sequence
  Synthetic
  misc_feature (27)..(27): n is a, c, g, or t
  misc_feature (30)..(30): n is a, c, g, or t
  misc_feature (90)..(90): n is a, c, g, or t
caccgctgtcccaaaaggtctgccagnatncttaccccgttggtgtgggtgtttttaacctttgcatattttcctacttttaacattctntttccctgatgaatcttgtatgtccactgacatatcagcagccagggcct

SEQ ID NO: 417081 - DNA, 140 bp, Artificial Sequence
  Synthetic
  misc_feature (45)..(45): n is a, c, g, or t
  misc_feature (78)..(78): n is a, c, g, or t
atacgccatgctgggtctccaccaatattccatctgccagtaganagagaaacatgggaccagtggtggacagattantggcaagtgacctggatcccagagtgggactttgtctcgacccgtacttgggagtcggccat

SEQ ID NO: 417082 - DNA, 140 bp, Artificial Sequence
  Synthetic
  misc_feature (63)..(63): n is a, c, g, or t
  misc_feature (96)..(96): n is a, c, g, or t
atggccgactcccaagtacgggtcgagacaaagtcccactctgggatccaggtcacttgccantaatctgtccaccactggtcccatgtttctctntctactggcagatggaatattggtggagacccagcatggcgtat

SEQ ID NO: 417083 - DNA, 140 bp, Artificial Sequence
  Synthetic
  misc_feature (28)..(28): n is a, c, g, or t
aggccctggctgctgatatgcagattantggcaagtgacctggatcccagagtgggactttgtctcgaccccaccattaataagactagcctacaacctagtcaaagaccccatagaggggaccttttgggacagcggtg

SEQ ID NO: 417084 - DNA, 140 bp, Artificial Sequence
  Synthetic
  misc_feature (113)..(113): n is a, c, g, or t
caccgctgtcccaaaaggtcccctctatggggtctttgactaggttgtaggctagtcttattaatggtggggtcgagacaaagtcccactctgggatccaggtcacttgccantaatctgcatatcagcagccagggcct

SEQ ID NO: 417085 - DNA, 140 bp, Artificial Sequence
  Synthetic
  misc_feature (61)..(61): n is a, c, g, or t
atacgccatgctgggtctccgaaaagcaggatatgtcacagacaggggaaaagataaggtnaaagtgttagaacagacaacaaatcaacaagcagaacttgaagcatttgcattagcattcgtacttgggagtcggccat

SEQ ID NO: 417086 - DNA, 140 bp, Artificial Sequence
  Synthetic
  misc_feature (80)..(80): n is a, c, g, or t
atggccgactcccaagtacgaatgctaatgcaaatgcttcaagttctgcttgttgatttgttgtctgttctaacactttnaccttatcttttcccctgtctgtgacatatcctgcttttcggagacccagcatggcgtat

SEQ ID NO: 417087 - DNA, 140 bp, Artificial Sequence
  Synthetic
  misc_feature (71)..(71): n is a, c, g, or t
  misc_feature (80)..(80): n is a, c, g, or t
aggccctggctgctgatatggaacagacaacaaatcaacaagcagaacttgaagcatttgcattagcattncaggattcnggaccacaagttaacatcatagtagattcacaatatgtcagaccttttgggacagcggtg

SEQ ID NO: 417088 - DNA, 140 bp, Artificial Sequence
  Synthetic
  misc_feature (61)..(61): n is a, c, g, or t
  misc_feature (70)..(70): n is a, c, g, or t
caccgctgtcccaaaaggtctgacatattgtgaatctactatgatgttaacttgtggtccngaatcctgnaatgctaatgcaaatgcttcaagttctgcttgttgatttgttgtctgttccatatcagcagccagggcct

SEQ ID NO: 417089 - DNA, 140 bp, Artificial Sequence
  Synthetic
  misc_feature (22)..(22): n is a, c, g, or t
  misc_feature (47)..(47): n is a, c, g, or t
atacgccatgctgggtctccanaataattgaagaaatgatcaaaaangaggcaatatatgtaggatgggtaccagcccacaagggactaggtggtaaccaagaagtagaccacctagtaacgtacttgggagtcggccat

SEQ ID NO: 417090 - DNA, 140 bp, Artificial Sequence
  Synthetic
  misc_feature (94)..(94): n is a, c, g, or t
  misc_feature (119)..(119): n is a, c, g, or t
atggccgactcccaagtacgttactaggtggtctacttcttggttaccacctagtcccttgtgggctggtacccatcctacatatattgcctcntttttgatcatttcttcaattattntggagacccagcatggcgtat

SEQ ID NO: 417091 - DNA, 140 bp, Artificial Sequence
  Synthetic
aggccctggctgctgatatgaccagcccacaagggactaggtggtaaccaagaagtagaccacctagtaagtcaaggaatcagacaggtcttgttcctagaaaaaatagaaccagctcaggaccttttgggacagcggtg

SEQ ID NO: 417092 - DNA, 140 bp, Artificial Sequence
  Synthetic
caccgctgtcccaaaaggtcctgagctggttctattttttctaggaacaagacctgtctgattccttgacttactaggtggtctacttcttggttaccacctagtcccttgtgggctggtcatatcagcagccagggcct

SEQ ID NO: 417093 - DNA, 140 bp, Artificial Sequence
  Synthetic
  misc_feature (21)..(21): n is a, c, g, or t
  misc_feature (25)..(25): n is a, c, g, or t
  misc_feature (39)..(39): n is a, c, g, or t
  misc_feature (60)..(60): n is a, c, g, or t
  misc_feature (78)..(78): n is a, c, g, or t
  misc_feature (84)..(84): n is a, c, g, or t
atacgccatgctgggtctccnggantcccacaattagtngcaaaacagatagtaaattcntgtgacaaatgccaacanaaaggngaagctattcatggacaggtaaatgcagaactagggcgtacttgggagtcggccat

SEQ ID NO: 417094 - DNA, 140 bp, Artificial Sequence
  Synthetic
  misc_feature (57)..(57): n is a, c, g, or t
  misc_feature (63)..(63): n is a, c, g, or t
  misc_feature (81)..(81): n is a, c, g, or t
  misc_feature (102)..(102): n is a, c, g, or t
  misc_feature (116)..(116): n is a, c, g, or t
  misc_feature (120)..(120): n is a, c, g, or t
atggccgactcccaagtacgccctagttctgcatttacctgtccatgaatagcttcncctttntgttggcatttgtcacangaatttactatctgttttgcnactaattgtgggantccnggagacccagcatggcgtat

SEQ ID NO: 417095 - DNA, 140 bp, Artificial Sequence
  Synthetic
  misc_feature (28)..(28): n is a, c, g, or t
  misc_feature (34)..(34): n is a, c, g, or t
aggccctggctgctgatatggccaacanaaaggngaagctattcatggacaggtaaatgcagaactagggacatggcagatggactgcacacatttagaaggaaagattataatagtagcgaccttttgggacagcggtg

SEQ ID NO: 417096 - DNA, 140 bp, Artificial Sequence
  Synthetic
  misc_feature (107)..(107): n is a, c, g, or t
  misc_feature (113)..(113): n is a, c, g, or t
caccgctgtcccaaaaggtcgctactattataatctttccttctaaatgtgtgcagtccatctgccatgtccctagttctgcatttacctgtccatgaatagcttcncctttntgttggccatatcagcagccagggcct

SEQ ID NO: 417097 - DNA, 140 bp, Artificial Sequence
  Synthetic
  misc_feature (64)..(64): n is a, c, g, or t
atacgccatgctgggtctcccaggaagacagacagctctcttcctgttaaagttggccagcagntggcctatcacacacctgcacacagacaacggtgccaacttcacctcacaagatgtcgtacttgggagtcggccat

SEQ ID NO: 417098 - DNA, 140 bp, Artificial Sequence
  Synthetic
  misc_feature (77)..(77): n is a, c, g, or t
atggccgactcccaagtacgacatcttgtgaggtgaagttggcaccgttgtctgtgtgcaggtgtgtgataggccanctgctggccaactttaacaggaagagagctgtctgtcttcctgggagacccagcatggcgtat

SEQ ID NO: 417099 - DNA, 140 bp, Artificial Sequence
  Synthetic
atacgccatgctgggtctccgaagatggtagcctggtgggtaggaatagaacagacctttggagtaccctataacccacaaagtcaaggagtagtagaagcaatgaaccatcacctaaaacgtacttgggagtcggccat

SEQ ID NO: 417100 - DNA, 140 bp, Artificial Sequence
  Synthetic
atggccgactcccaagtacgttttaggtgatggttcattgcttctactactccttgactttgtgggttatagggtactccaaaggtctgttctattcctacccaccaggctaccatcttcggagacccagcatggcgtat

SEQ ID NO: 417101 - DNA, 140 bp, Artificial Sequence
  Synthetic
  misc_feature (24)..(24): n is a, c, g, or t
atacgccatgctgggtctccactnatggcaactcactgcatgaattttaaaagaaggggaggaataggggatatgacccctgcagaaagactagttaacatgataaccacagagcaagaacgtacttgggagtcggccat

SEQ ID NO: 417102 - DNA, 140 bp, Artificial Sequence
  Synthetic
  misc_feature (117)..(117): n is a, c, g, or t
atggccgactcccaagtacgttcttgctctgtggttatcatgttaactagtctttctgcaggggtcatatcccctattcctccccttcttttaaaattcatgcagtgagttgccatnagtggagacccagcatggcgtat

SEQ ID NO: 417103 - DNA, 140 bp, Artificial Sequence
  Synthetic
  misc_feature (94)..(94): n is a, c, g, or t
atacgccatgctgggtctccttacagagaaggcagagatcaactctggaagggacctggtgaactattgtggaaaggggaaggagcagtcatcntaaaggtagggacagaaatcaaagtacgtacttgggagtcggccat

SEQ ID NO: 417104 - DNA, 140 bp, Artificial Sequence
  Synthetic
  misc_feature (47)..(47): n is a, c, g, or t
atggccgactcccaagtacgtactttgatttctgtccctacctttangatgactgctccttcccctttccacaatagttcaccaggtcccttccagagttgatctctgccttctctgtaaggagacccagcatggcgtat

SEQ ID NO: 417105 - DNA, 140 bp, Artificial Sequence
  Synthetic
  misc_feature (44)..(44): n is a, c, g, or t
aggccctggctgctgatatgggaaaggggaaggagcagtcatcntaaaggtagggacagaaatcaaagtagtacccaggagaaaggcaaaaattataaggcactatggaggaggaaaagggaccttttgggacagcggtg

SEQ ID NO: 417106 - DNA, 140 bp, Artificial Sequence
  Synthetic
  misc_feature (97)..(97): n is a, c, g, or t
caccgctgtcccaaaaggtcccttttcctcctccatagtgccttataatttttgcctttctcctgggtactactttgatttctgtccctacctttangatgactgctccttcccctttcccatatcagcagccagggcct

SEQ ID NO: 417107 - DNA, 140 bp, Artificial Sequence
  Synthetic
  misc_feature (95)..(95): n is a, c, g, or t
atacgccatgctgggtctcccacagtctgatcaaataccttaagtataaaacaggagagttgcaacaggtctcttatgtccctcaccacaaggtnggatgggcttggtggacttgcagtacgtacttgggagtcggccat

SEQ ID NO: 417108 - DNA, 140 bp, Artificial Sequence
  Synthetic
  misc_feature (46)..(46): n is a, c, g, or t
atggccgactcccaagtacgtactgcaagtccaccaagcccatccnaccttgtggtgagggacataagagacctgttgcaactctcctgttttatacttaaggtatttgatcagactgtgggagacccagcatggcgtat

SEQ ID NO: 417109 - DNA, 140 bp, Artificial Sequence
  Synthetic
  misc_feature (45)..(45): n is a, c, g, or t
  misc_feature (50)..(50): n is a, c, g, or t
  misc_feature (58)..(58): n is a, c, g, or t
atacgccatgctgggtctccgagtaatatttcccctagacaaagnagcanacctagangtccaaggatattggaacctaaccccggaaaggggactcttgagcacctatgctgtaagactcgtacttgggagtcggccat

SEQ ID NO: 417110 - DNA, 140 bp, Artificial Sequence
  Synthetic
  misc_feature (83)..(83): n is a, c, g, or t
  misc_feature (91)..(91): n is a, c, g, or t
  misc_feature (96)..(96): n is a, c, g, or t
atggccgactcccaagtacgagtcttacagcataggtgctcaagagtcccctttccggggttaggttccaatatccttggacntctaggtntgctnctttgtctaggggaaatattactcggagacccagcatggcgtat

SEQ ID NO: 417111 - DNA, 140 bp, Artificial Sequence
  Synthetic
atacgccatgctgggtctccaccagctactgcatgggtcttatttctcttgctttacagccaatgaagtaaggagagccatcaggggagaaaagatattgtcctactgcaactatccatccgtacttgggagtcggccat

SEQ ID NO: 417112 - DNA, 140 bp, Artificial Sequence
  Synthetic
atggccgactcccaagtacggatggatagttgcagtaggacaatatcttttctcccctgatggctctccttacttcattggctgtaaagcaagagaaataagacccatgcagtagctggtggagacccagcatggcgtat

SEQ ID NO: 417113 - DNA, 140 bp, Artificial Sequence
  Synthetic
aggccctggctgctgatatgaggagagccatcaggggagaaaagatattgtcctactgcaactatccatcagctcacgaagggcaggtaccaagcttacagtttctagccctaagggtcagaccttttgggacagcggtg

SEQ ID NO: 417114 - DNA, 140 bp, Artificial Sequence
  Synthetic
caccgctgtcccaaaaggtctgacccttagggctagaaactgtaagcttggtacctgcccttcgtgagctgatggatagttgcagtaggacaatatcttttctcccctgatggctctcctcatatcagcagccagggcct

SEQ ID NO: 417115 - DNA, 140 bp, Artificial Sequence
  Synthetic
  misc_feature (51)..(51): n is a, c, g, or t
atacgccatgctgggtctcccgacgaagaaacaataggagaagcattcgantggctagaaagaacaataacagagctcaacagggtagcagtcaaccacttgccccgagaactcattttccgtacttgggagtcggccat

SEQ ID NO: 417116 - DNA, 140 bp, Artificial Sequence
  Synthetic
  misc_feature (90)..(90): n is a, c, g, or t
atggccgactcccaagtacggaaaatgagttctcggggcaagtggttgactgctaccctgttgagctctgttattgttctttctagccantcgaatgcttctcctattgtttcttcgtcgggagacccagcatggcgtat

SEQ ID NO: 417117 - DNA, 140 bp, Artificial Sequence
  Synthetic
aggccctggctgctgatatgcagagctcaacagggtagcagtcaaccacttgccccgagaactcattttccaggtctggcaaaggtgttgggcatactggcgtgatgaacagggcatgtcgaccttttgggacagcggtg

SEQ ID NO: 417118 - DNA, 140 bp, Artificial Sequence
  Synthetic
caccgctgtcccaaaaggtcgacatgccctgttcatcacgccagtatgcccaacacctttgccagacctggaaaatgagttctcggggcaagtggttgactgctaccctgttgagctctgcatatcagcagccagggcct

SEQ ID NO: 417119 - DNA, 140 bp, Artificial Sequence
  Synthetic
  misc_feature (70)..(70): n is a, c, g, or t
atacgccatgctgggtctccttgtgcactatacaaagggctgtacatgcaggcaggagggccatgggccnggaggatggagatcaggacctcctcctcctcctcccccaggcctggcctacgtacttgggagtcggccat

SEQ ID NO: 417120 - DNA, 140 bp, Artificial Sequence
  Synthetic
  misc_feature (71)..(71): n is a, c, g, or t
atggccgactcccaagtacgtaggccaggcctgggggaggaggaggaggaggtcctgatctccatcctccnggcccatggccctcctgcctgcatgtacagccctttgtatagtgcacaaggagacccagcatggcgtat

SEQ ID NO: 417121 - DNA, 140 bp, Artificial Sequence
  Synthetic
  misc_feature (83)..(83): n is a, c, g, or t
  misc_feature (86)..(86): n is a, c, g, or t
  misc_feature (91)..(91): n is a, c, g, or t
aggccctggctgctgatatgggaggatggagatcaggacctcctcctcctcctcccccaggcctggcctaatggcagaagcanccncaganatccctccagagaacgagagcccacaaaggaccttttgggacagcggtg

SEQ ID NO: 417122 - DNA, 140 bp, Artificial Sequence
  Synthetic
  misc_feature (50)..(50): n is a, c, g, or t
  misc_feature (55)..(55): n is a, c, g, or t
  misc_feature (58)..(58): n is a, c, g, or t
caccgctgtcccaaaaggtcctttgtgggctctcgttctctggagggatntctgnggntgcttctgccattaggccaggcctgggggaggaggaggaggaggtcctgatctccatcctcccatatcagcagccagggcct

SEQ ID NO: 417123 - DNA, 140 bp, Artificial Sequence
  Synthetic
  misc_feature (26)..(26): n is a, c, g, or t
  misc_feature (54)..(54): n is a, c, g, or t
atacgccatgctgggtctccaagccntaaagcattttgatcctcgcttgctaantgcgcttggtaactttatctacagtaggtatggagatacccttgcaggggcaggagagctcgttaacgtacttgggagtcggccat

SEQ ID NO: 417124 - DNA, 140 bp, Artificial Sequence
  Synthetic
  misc_feature (87)..(87): n is a, c, g, or t
  misc_feature (115)..(115): n is a, c, g, or t
atggccgactcccaagtacgttaacgagctctcctgcccctgcaagggtatctccatacctactgtagataaagttaccaagcgcanttagcaagcgaggatcaaaatgctttanggcttggagacccagcatggcgtat

SEQ ID NO: 417125 - DNA, 140 bp, Artificial Sequence
  Synthetic
aggccctggctgctgatatgatctacagtaggtatggagatacccttgcaggggcaggagagctcgttaaaatcctccagcgagccctcttcctccacttcagagccggttgtcgacactgaccttttgggacagcggtg

SEQ ID NO: 417126 - DNA, 140 bp, Artificial Sequence
  Synthetic
caccgctgtcccaaaaggtcagtgtcgacaaccggctctgaagtggaggaagagggctcgctggaggattttaacgagctctcctgcccctgcaagggtatctccatacctactgtagatcatatcagcagccagggcct

SEQ ID NO: 417127 - DNA, 140 bp, Artificial Sequence
  Synthetic
  misc_feature (56)..(56): n is a, c, g, or t
atacgccatgctgggtctccccttaaggcatgcaataataaatgctactgtaaaanatgctgctaccattgccagctttgttttcttagaaaaggtcttgggatatggtatgaccactcgcgtacttgggagtcggccat

SEQ ID NO: 417128 - DNA, 140 bp, Artificial Sequence
  Synthetic
  misc_feature (85)..(85): n is a, c, g, or t
atggccgactcccaagtacgcgagtggtcataccatatcccaagaccttttctaagaaaacaaagctggcaatggtagcagcatnttttacagtagcatttattattgcatgccttaaggggagacccagcatggcgtat

SEQ ID NO: 417129 - DNA, 140 bp, Artificial Sequence
  Synthetic
aggccctggctgctgatatggccagctttgttttcttagaaaaggtcttgggatatggtatgaccactcgagaaagagaaaaagagctaagactactgcatctcctgcaccagacaagtggaccttttgggacagcggtg

SEQ ID NO: 417130 - DNA, 140 bp, Artificial Sequence
  Synthetic
caccgctgtcccaaaaggtccacttgtctggtgcaggagatgcagtagtcttagctctttttctctttctcgagtggtcataccatatcccaagaccttttctaagaaaacaaagctggccatatcagcagccagggcct

SEQ ID NO: 417131 - DNA, 140 bp, Artificial Sequence
  Synthetic
  misc_feature (39)..(39): n is a, c, g, or t
  misc_feature (51)..(51): n is a, c, g, or t
  misc_feature (80)..(80): n is a, c, g, or t
  misc_feature (90)..(90): n is a, c, g, or t
  misc_feature (93)..(93): n is a, c, g, or t
  misc_feature (102)..(102): n is a, c, g, or t
atacgccatgctgggtctcctatctgtgggtttacatgnaaacaatatatnactgtcttctatggcatacccgcgtgganaaatgcatcnatncccctgttntgtgcaactaaaaatagacgtacttgggagtcggccat

SEQ ID NO: 417132 - DNA, 140 bp, Artificial Sequence
  Synthetic
  misc_feature (39)..(39): n is a, c, g, or t
  misc_feature (48)..(48): n is a, c, g, or t
  misc_feature (51)..(51): n is a, c, g, or t
  misc_feature (61)..(61): n is a, c, g, or t
  misc_feature (90)..(90): n is a, c, g, or t
  misc_feature (102)..(102): n is a, c, g, or t
atggccgactcccaagtacgtctatttttagttgcacanaacaggggnatngatgcatttntccacgcgggtatgccatagaagacagtnatatattgtttncatgtaaacccacagataggagacccagcatggcgtat

SEQ ID NO: 417133 - DNA, 140 bp, Artificial Sequence
  Synthetic
  misc_feature (30)..(30): n is a, c, g, or t
  misc_feature (40)..(40): n is a, c, g, or t
  misc_feature (43)..(43): n is a, c, g, or t
  misc_feature (52)..(52): n is a, c, g, or t
aggccctggctgctgatatgccgcgtgganaaatgcatcnatncccctgttntgtgcaactaaaaatagagatacttgggggaccatacagtgcttgccagacaatgatgattatcaggagaccttttgggacagcggtg

SEQ ID NO: 417134 - DNA, 140 bp, Artificial Sequence
  Synthetic
  misc_feature (89)..(89): n is a, c, g, or t
  misc_feature (98)..(98): n is a, c, g, or t
  misc_feature (101)..(101): n is a, c, g, or t
  misc_feature (111)..(111): n is a, c, g, or t
caccgctgtcccaaaaggtctcctgataatcatcattgtctggcaagcactgtatggtcccccaagtatctctatttttagttgcacanaacaggggnatngatgcatttntccacgcggcatatcagcagccagggcct

SEQ ID NO: 417135 - DNA, 140 bp, Artificial Sequence
  Synthetic
  misc_feature (94)..(94): n is a, c, g, or t
  misc_feature (97)..(97): n is a, c, g, or t
atacgccatgctgggtctcccagaacaagcaatagaggatgtctggagactatttgagacatcaataaaaccatgtgtcaagttgacacccctntgngtggcaatgaattgtacaaccaccgtacttgggagtcggccat

SEQ ID NO: 417136 - DNA, 140 bp, Artificial Sequence
  Synthetic
  misc_feature (44)..(44): n is a, c, g, or t
  misc_feature (47)..(47): n is a, c, g, or t
atggccgactcccaagtacggtggttgtacaattcattgccacncanaggggtgtcaacttgacacatggttttattgatgtctcaaatagtctccagacatcctctattgcttgttctgggagacccagcatggcgtat

SEQ ID NO: 417137 - DNA, 140 bp, Artificial Sequence
  Synthetic
  misc_feature (44)..(44): n is a, c, g, or t
  misc_feature (47)..(47): n is a, c, g, or t
aggccctggctgctgatatgccatgtgtcaagttgacacccctntgngtggcaatgaattgtacaaccacggaagccacaccccagaataccacaacacggaataccacaataatagagggaccttttgggacagcggtg

SEQ ID NO: 417138 - DNA, 140 bp, Artificial Sequence
  Synthetic
  misc_feature (94)..(94): n is a, c, g, or t
  misc_feature (97)..(97): n is a, c, g, or t
caccgctgtcccaaaaggtccctctattattgtggtattccgtgttgtggtattctggggtgtggcttccgtggttgtacaattcattgccacncanaggggtgtcaacttgacacatggcatatcagcagccagggcct

SEQ ID NO: 417139 - DNA, 140 bp, Artificial Sequence
  Synthetic
atacgccatgctgggtctccgagatggttacatgtaacttcagtatgacagggttagaacaagataagaaaaagaggtataatgagacatggtattcacaggatgtggtttgtgacaaaacgtacttgggagtcggccat

SEQ ID NO: 417140 - DNA, 140 bp, Artificial Sequence
  Synthetic
atggccgactcccaagtacgttttgtcacaaaccacatcctgtgaataccatgtctcattatacctctttttcttatcttgttctaaccctgtcatactgaagttacatgtaaccatctcggagacccagcatggcgtat

SEQ ID NO: 417141 - DNA, 140 bp, Artificial Sequence
  Synthetic
atacgccatgctgggtctccacatcagtcatcaaagaatcatgtgataagcactattgggatactatgagatttagatactgtacaccaccgggttatgccttactaagatgcaatgatacgtacttgggagtcggccat

SEQ ID NO: 417142 - DNA, 140 bp, Artificial Sequence
  Synthetic
atggccgactcccaagtacgtatcattgcatcttagtaaggcataacccggtggtgtacagtatctaaatctcatagtatcccaatagtgcttatcacatgattctttgatgactgatgtggagacccagcatggcgtat

SEQ ID NO: 417143 - DNA, 140 bp, Artificial Sequence
  Synthetic
aggccctggctgctgatatgatttagatactgtacaccaccgggttatgccttactaagatgcaatgataccaactattcaggctttcaacctaattgctctaaagtagtagctgcttcagaccttttgggacagcggtg

SEQ ID NO: 417144 - DNA, 140 bp, Artificial Sequence
  Synthetic
caccgctgtcccaaaaggtctgaagcagctactactttagagcaattaggttgaaagcctgaatagttggtatcattgcatcttagtaaggcataacccggtggtgtacagtatctaaatcatatcagcagccagggcct

SEQ ID NO: 417145 - DNA, 140 bp, Artificial Sequence
  Synthetic
aggccctggctgctgatatgcactagagcagaaaatagaacatatatctattggcatggtagagataataggactatcattagcttaaacaagtattataatctcactatgcactgtaaggaccttttgggacagcggtg

SEQ ID NO: 417146 - DNA, 140 bp, Artificial Sequence
  Synthetic
caccgctgtcccaaaaggtccttacagtgcatagtgagattataatacttgtttaagctaatgatagtcctattatctctaccatgccaatagatatatgttctattttctgctctagtgcatatcagcagccagggcct

SEQ ID NO: 417147 - DNA, 140 bp, Artificial Sequence
  Synthetic
atacgccatgctgggtctccgtttcactctcagccaatcaaccgcaggcctagacaggcatggtgctggtttagaggcaactggacagaagccatgaaggaggtgaagcaaacccttgtacgtacttgggagtcggccat

SEQ ID NO: 417148 - DNA, 140 bp, Artificial Sequence
  Synthetic
atggccgactcccaagtacgtacaagggtttgcttcacctccttcatggcttctgtccagttgcctctaaaccagcaccatgcctgtctaggcctgcggttgattggctgagagtgaaacggagacccagcatggcgtat

SEQ ID NO: 417149 - DNA, 140 bp, Artificial Sequence
  Synthetic
atacgccatgctgggtctccgaaaccaggagaaggctcagacccagaagtggcatacatgtggactaactgcagaggagaatttctctactgcaacatgacttggttcctcaattgggtacgtacttgggagtcggccat

SEQ ID NO: 417150 - DNA, 140 bp, Artificial Sequence
  Synthetic
atggccgactcccaagtacgtacccaattgaggaaccaagtcatgttgcagtagagaaattctcctctgcagttagtccacatgtatgccacttctgggtctgagccttctcctggtttcggagacccagcatggcgtat

SEQ ID NO: 417151 - DNA, 140 bp, Artificial Sequence
  Synthetic
aggccctggctgctgatatggcagaggagaatttctctactgcaacatgacttggttcctcaattgggtagagaataggacgggcacacagcacaattatgcgccgtgccatataaagcagaccttttgggacagcggtg

SEQ ID NO: 417152 - DNA, 140 bp, Artificial Sequence
  Synthetic
caccgctgtcccaaaaggtctgctttatatggcacggcgcataattgtgctgtgtgcccgtcctattctctacccaattgaggaaccaagtcatgttgcagtagagaaattctcctctgccatatcagcagccagggcct

SEQ ID NO: 417153 - DNA, 140 bp, Artificial Sequence
  Synthetic
atacgccatgctgggtctccgggaaggagaattgacttgcaattcaacagtaaccagcataattgctaacattgacacaaaaggaaatcagaccaacattaccttcagtgcagaggtggccgtacttgggagtcggccat

SEQ ID NO: 417154 - DNA, 140 bp, Artificial Sequence
  Synthetic
atggccgactcccaagtacggccacctctgcactgaaggtaatgttggtctgatttccttttgtgtcaatgttagcaattatgctggttactgttgaattgcaagtcaattctccttcccggagacccagcatggcgtat

SEQ ID NO: 417155 - DNA, 140 bp, Artificial Sequence
  Synthetic
atacgccatgctgggtctcccaattggcttcgcacctacaactgaagggaggtattcctcaactccagggaggaataaaagaggtgtatttgtgctaggattcttgggattccttgcgaccgtacttgggagtcggccat

SEQ ID NO: 417156 - DNA, 140 bp, Artificial Sequence
  Synthetic
atggccgactcccaagtacggtcgcaaggaatcccaagaatcctagcacaaatacacctcttttattcctccctggagttgaggaatacctcccttcagttgtaggtgcgaagccaattgggagacccagcatggcgtat

SEQ ID NO: 417157 - DNA, 140 bp, Artificial Sequence
  Synthetic
atacgccatgctgggtctccggcaggttctgcaatgggcgcagcgtccttgacgctgtcagctcagtcccggactttactggctgggatagtgcagcagcagcaacagctgctggacgtgcgtacttgggagtcggccat

SEQ ID NO: 417158 - DNA, 140 bp, Artificial Sequence
  Synthetic
atggccgactcccaagtacgcacgtccagcagctgttgctgctgctgcactatcccagccagtaaagtccgggactgagctgacagcgtcaaggacgctgcgcccattgcagaacctgccggagacccagcatggcgtat

SEQ ID NO: 417159 - DNA, 140 bp, Artificial Sequence
  Synthetic
aggccctggctgctgatatgggactttactggctgggatagtgcagcagcagcaacagctgctggacgtggtcaaaagacaacaggaactgttgcggctgaccgtctgggggacgaaaaagaccttttgggacagcggtg

SEQ ID NO: 417160 - DNA, 140 bp, Artificial Sequence
  Synthetic
caccgctgtcccaaaaggtctttttcgtcccccagacggtcagccgcaacagttcctgttgtcttttgaccacgtccagcagctgttgctgctgctgcactatcccagccagtaaagtcccatatcagcagccagggcct

SEQ ID NO: 417161 - DNA, 140 bp, Artificial Sequence
  Synthetic
atacgccatgctgggtctccgtcaaaagacaacaggaactgttgcggctgaccgtctgggggacgaaaaacctccaggcaagagtcactgccatcgagaagtatctaaaggatcaggcaccgtacttgggagtcggccat

SEQ ID NO: 417162 - DNA, 140 bp, Artificial Sequence
  Synthetic
atggccgactcccaagtacggtgcctgatcctttagatacttctcgatggcagtgactcttgcctggaggtttttcgtcccccagacggtcagccgcaacagttcctgttgtcttttgacggagacccagcatggcgtat

SEQ ID NO: 417163 - DNA, 140 bp, Artificial Sequence
  Synthetic
atacgccatgctgggtctccccatgggtaaatgaatccttaacgcctaactgggacaatatgacatggcagcaatgggaggaaaaggtccgcgacctagaggcaaatatcagtcaaatttcgtacttgggagtcggccat

SEQ ID NO: 417164 - DNA, 140 bp, Artificial Sequence
  Synthetic
atggccgactcccaagtacgaaatttgactgatatttgcctctaggtcgcggaccttttcctcccattgctgccatgtcatattgtcccagttaggcgttaaggattcatttacccatggggagacccagcatggcgtat

SEQ ID NO: 417165 - DNA, 140 bp, Artificial Sequence
  Synthetic
aggccctggctgctgatatggcaatgggaggaaaaggtccgcgacctagaggcaaatatcagtcaaattttagaacaggcgcaaattcaacaagaaaagaatatgtatgaattacaaaaagaccttttgggacagcggtg

SEQ ID NO: 417166 - DNA, 140 bp, Artificial Sequence
  Synthetic
caccgctgtcccaaaaggtctttttgtaattcatacatattcttttcttgttgaatttgcgcctgttctaaaatttgactgatatttgcctctaggtcgcggaccttttcctcccattgccatatcagcagccagggcct

SEQ ID NO: 417167 - DNA, 140 bp, Artificial Sequence
  Synthetic
  misc_feature (72)..(72): n is a, c, g, or t
  misc_feature (97)..(97): n is a, c, g, or t
atacgccatgctgggtctcccagatatattcaatatggagtttatatagtagcaggagtagtagttcttagnatagcaatatacatagtgcaaatgntaagtagacttaggaagggctatcgtacttgggagtcggccat

SEQ ID NO: 417168 - DNA, 140 bp, Artificial Sequence
  Synthetic
  misc_feature (44)..(44): n is a, c, g, or t
  misc_feature (69)..(69): n is a, c, g, or t
atggccgactcccaagtacgatagcccttcctaagtctacttancatttgcactatgtatattgctatnctaagaactactactcctgctactatataaactccatattgaatatatctgggagacccagcatggcgtat

SEQ ID NO: 417169 - DNA, 140 bp, Artificial Sequence
  Synthetic
  misc_feature (22)..(22): n is a, c, g, or t
  misc_feature (47)..(47): n is a, c, g, or t
aggccctggctgctgatatggnatagcaatatacatagtgcaaatgntaagtagacttaggaagggctataggcctgttttctcttccccctccggttatgtccaacagatccatatccagaccttttgggacagcggtg

SEQ ID NO: 417170 - DNA, 140 bp, Artificial Sequence
  Synthetic
  misc_feature (94)..(94): n is a, c, g, or t
  misc_feature (119)..(119): n is a, c, g, or t
caccgctgtcccaaaaggtctggatatggatctgttggacataaccggagggggaagagaaaacaggcctatagcccttcctaagtctacttancatttgcactatgtatattgctatnccatatcagcagccagggcct

SEQ ID NO: 417171 - DNA, 140 bp, Artificial Sequence
  Synthetic
atacgccatgctgggtctccacgacggggactacagatcttggccctggcagatagaatacgttcattttctgctgcgccagctgaggaacctcttaatttggctatacaacggctgcagcgtacttgggagtcggccat

SEQ ID NO: 417172 - DNA, 140 bp, Artificial Sequence
  Synthetic
atggccgactcccaagtacgctgcagccgttgtatagccaaattaagaggttcctcagctggcgcagcagaaaatgaacgtattctatctgccagggccaagatctgtagtccccgtcgtggagacccagcatggcgtat

SEQ ID NO: 417173 - DNA, 140 bp, Artificial Sequence
  Synthetic
aggccctggctgctgatatgctgctgcgccagctgaggaacctcttaatttggctatacaacggctgcagaaccttactgttgaagacctcccaaatcctccaaccaatactccaaccacgaccttttgggacagcggtg

SEQ ID NO: 417174 - DNA, 140 bp, Artificial Sequence
  Synthetic
caccgctgtcccaaaaggtcgtggttggagtattggttggaggatttgggaggtcttcaacagtaaggttctgcagccgttgtatagccaaattaagaggttcctcagctggcgcagcagcatatcagcagccagggcct

SEQ ID NO: 417175 - DNA, 140 bp, Artificial Sequence
  Synthetic
atacgccatgctgggtctccgcgctccgagcagcagcgagggctacgagagagactcttgcgagtgcgggagagaccttatgggaagctctcaggggggcggcgagagcgatcctcgcgacgtacttgggagtcggccat

SEQ ID NO: 417176 - DNA, 140 bp, Artificial Sequence
  Synthetic
atggccgactcccaagtacgtcgcgaggatcgctctcgccgcccccctgagagcttcccataaggtctctcccgcactcgcaagagtctctctcgtagccctcgctgctgctcggagcgcggagacccagcatggcgtat

SEQ ID NO: 417177 - DNA, 140 bp, Artificial Sequence
  Synthetic
atacgccatgctgggtctcctgccctgggggcagaagggggagggcaacaaaatgcagatgaaagtgatgaggacgatgaagtgggagcctatgtaagacccagtaggccactgagaccacgtacttgggagtcggccat

SEQ ID NO: 417178 - DNA, 140 bp, Artificial Sequence
  Synthetic
atggccgactcccaagtacgtggtctcagtggcctactgggtcttacataggctcccacttcatcgtcctcatcactttcatctgcattttgttgccctcccccttctgcccccagggcaggagacccagcatggcgtat

SEQ ID NO: 417179 - DNA, 140 bp, Artificial Sequence
  Synthetic
aggccctggctgctgatatgaggacgatgaagtgggagcctatgtaagacccagtaggccactgagaccaatgacatacaaaacagcaatagacatgtctcattttctaaaagaaaaggggaccttttgggacagcggtg

SEQ ID NO: 417180 - DNA, 140 bp, Artificial Sequence
  Synthetic
caccgctgtcccaaaaggtccccttttcttttagaaaatgagacatgtctattgctgttttgtatgtcattggtctcagtggcctactgggtcttacataggctcccacttcatcgtcctcatatcagcagccagggcct

SEQ ID NO: 417181 - DNA, 140 bp, Artificial Sequence
  Synthetic
atacgccatgctgggtctccgattggcgcccgaacagggacctgggaagagtgagagtcttcaagagcacagctgagtgaaggcagtaagggcggcaggaatcaaccacgacggagagctcgtacttgggagtcggccat

SEQ ID NO: 417182 - DNA, 140 bp, Artificial Sequence
  Synthetic
atggccgactcccaagtacgagctctccgtcgtggttgattcctgccgcccttactgccttcactcagctgtgctcttgaagactctcactcttcccaggtccctgttcgggcgccaatcggagacccagcatggcgtat

SEQ ID NO: 417183 - DNA, 140 bp, Artificial Sequence
  Synthetic
atacgccatgctgggtctcccctgtaaaagcgcaggccggtaccaggcagcgtgaggagcgggaggagaagaggctccgggagtaaggtaagtactccaaattttgcattgtctactctacgtacttgggagtcggccat

SEQ ID NO: 417184 - DNA, 140 bp, Artificial Sequence
  Synthetic
atggccgactcccaagtacgtagagtagacaatgcaaaatttggagtacttaccttactcccggagcctcttctcctcccgctcctcacgctgcctggtaccggcctgcgcttttacaggggagacccagcatggcgtat

SEQ ID NO: 417185 - DNA, 140 bp, Artificial Sequence
  Synthetic
atacgccatgctgggtctcctcagggaagaaaacagatgaattagaaaaagttaggttacggcccggcggaaagaaaaagtatatgctaaaacatgtagtatgggcagtgaacgaattagcgtacttgggagtcggccat

SEQ ID NO: 417186 - DNA, 140 bp, Artificial Sequence
  Synthetic
atggccgactcccaagtacgctaattcgttcactgcccatactacatgttttagcatatactttttctttccgccgggccgtaacctaactttttctaattcatctgttttcttccctgaggagacccagcatggcgtat

SEQ ID NO: 417187 - DNA, 140 bp, Artificial Sequence
  Synthetic
aggccctggctgctgatatgaaagaaaaagtatatgctaaaacatgtagtatgggcagtgaacgaattagacagatttggattagcagagagcctgttggaatcaaaagaaggatgtcaagaccttttgggacagcggtg

SEQ ID NO: 417188 - DNA, 140 bp, Artificial Sequence
  Synthetic
caccgctgtcccaaaaggtcttgacatccttcttttgattccaacaggctctctgctaatccaaatctgtctaattcgttcactgcccatactacatgttttagcatatactttttctttcatatcagcagccagggcct

SEQ ID NO: 417189 - DNA, 140 bp, Artificial Sequence
  Synthetic
atacgccatgctgggtctccaaaaagcctttttaatatcgtctgcgtcattttttgcctgcacgcagaagagaaagtgaaagatacagaggaagcaaaaaagatagcacagagacatctacgtacttgggagtcggccat

SEQ ID NO: 417190 - DNA, 140 bp, Artificial Sequence
  Synthetic
atggccgactcccaagtacgtagatgtctctgtgctatcttttttgcttcctctgtatctttcactttctcttctgcgtgcaggcaaaaaatgacgcagacgatattaaaaaggctttttggagacccagcatggcgtat

SEQ ID NO: 417191 - DNA, 140 bp, Artificial Sequence
  Synthetic
aggccctggctgctgatatgagaaagtgaaagatacagaggaagcaaaaaagatagcacagagacatctagcggcggacacagaaaaaatgccagctacaaataaaccaacagcaccaccgaccttttgggacagcggtg

SEQ ID NO: 417192 - DNA, 140 bp, Artificial Sequence
  Synthetic
caccgctgtcccaaaaggtcggtggtgctgttggtttatttgtagctggcattttttctgtgtccgccgctagatgtctctgtgctatcttttttgcttcctctgtatctttcactttctcatatcagcagccagggcct

SEQ ID NO: 417193 - DNA, 140 bp, Artificial Sequence
  Synthetic
atacgccatgctgggtctcctgccgctaagcccccgaaccttaaatgcttgggtaaagttagtagaagaaaagaagttcggggcagaagtagtaccaggatttcaggcactatcagaaggcgtacttgggagtcggccat

SEQ ID NO: 417194 - DNA, 140 bp, Artificial Sequence
  Synthetic
atggccgactcccaagtacgccttctgatagtgcctgaaatcctggtactacttctgccccgaacttcttttcttctactaactttacccaagcatttaaggttcgggggcttagcggcaggagacccagcatggcgtat

SEQ ID NO: 417195 - DNA, 140 bp, Artificial Sequence
  Synthetic
aggccctggctgctgatatgaagaagttcggggcagaagtagtaccaggatttcaggcactatcagaaggatgcaccccttatgatataaatcagatgctaaattgtgtaggagaacatcgaccttttgggacagcggtg

SEQ ID NO: 417196 - DNA, 140 bp, Artificial Sequence
  Synthetic
caccgctgtcccaaaaggtcgatgttctcctacacaatttagcatctgatttatatcataaggggtgcatccttctgatagtgcctgaaatcctggtactacttctgccccgaacttcttcatatcagcagccagggcct

SEQ ID NO: 417197 - DNA, 140 bp, Artificial Sequence
  Synthetic
atacgccatgctgggtctcctgggaccagcaacacccgtcaccaggcccaatgccggcaggacaacttagggacccaagagggtcagatatagcaggaaccaccagcacagtagaggaaccgtacttgggagtcggccat

SEQ ID NO: 417198 - DNA, 140 bp, Artificial Sequence
  Synthetic
atggccgactcccaagtacggttcctctactgtgctggtggttcctgctatatctgaccctcttgggtccctaagttgtcctgccggcattgggcctggtgacgggtgttgctggtcccaggagacccagcatggcgtat

SEQ ID NO: 417199 - DNA, 140 bp, Artificial Sequence
  Synthetic
aggccctggctgctgatatgggacccaagagggtcagatatagcaggaaccaccagcacagtagaggaacagatacagtggatgtacagggcccaaaatcctgtcccagtgggaaacattgaccttttgggacagcggtg

SEQ ID NO: 417200 - DNA, 140 bp, Artificial Sequence
  Synthetic
caccgctgtcccaaaaggtcaatgtttcccactgggacaggattttgggccctgtacatccactgtatctgttcctctactgtgctggtggttcctgctatatctgaccctcttgggtcccatatcagcagccagggcct

SEQ ID NO: 417201 - DNA, 140 bp, Artificial Sequence
  Synthetic
atacgccatgctgggtctcctcctaccaacatattagacataaagcagggaccaaaggagcccttccaaagctatgtagatagattctacaaaagcttacgggcagaacaaacagacccacgtacttgggagtcggccat

SEQ ID NO: 417202 - DNA, 140 bp, Artificial Sequence
  Synthetic
atggccgactcccaagtacgtgggtctgtttgttctgcccgtaagcttttgtagaatctatctacatagctttggaagggctcctttggtccctgctttatgtctaatatgttggtaggaggagacccagcatggcgtat

SEQ ID NO: 417203 - DNA, 140 bp, Artificial Sequence
  Synthetic
aggccctggctgctgatatggctatgtagatagattctacaaaagcttacgggcagaacaaacagacccagcagtgaaaaattggatgacacaaacactgctgattcagaatgctaacccgaccttttgggacagcggtg

SEQ ID NO: 417204 - DNA, 140 bp, Artificial Sequence
  Synthetic
caccgctgtcccaaaaggtcgggttagcattctgaatcagcagtgtttgtgtcatccaatttttcactgctgggtctgtttgttctgcccgtaagcttttgtagaatctatctacatagccatatcagcagccagggcct

SEQ ID NO: 417205 - DNA, 140 bp, Artificial Sequence
  Synthetic
atacgccatgctgggtctccaaatgctaacggcctgccaagggataggaggcccagggcagaaggcaaggctaatggccgaagccttaaaagaggccctaacacctgcacccataccgttcgtacttgggagtcggccat

SEQ ID NO: 417206 - DNA, 140 bp, Artificial Sequence
  Synthetic
atggccgactcccaagtacgaacggtatgggtgcaggtgttagggcctcttttaaggcttcggccattagccttgccttctgccctgggcctcctatcccttggcaggccgttagcatttggagacccagcatggcgtat

SEQ ID NO: 417207 - DNA, 140 bp, Artificial Sequence
  Synthetic
atacgccatgctgggtctccactgtggcaaacagggacacacagccaggcaatgcagggcccctagaagacagggatgctggaaatgtggaaaaacaggacacatcatgtcaaaatgccccgtacttgggagtcggccat

SEQ ID NO: 417208 - DNA, 140 bp, Artificial Sequence
  Synthetic
atggccgactcccaagtacggggcattttgacatgatgtgtcctgtttttccacatttccagcatccctgtcttctaggggccctgcattgcctggctgtgtgtccctgtttgccacagtggagacccagcatggcgtat

SEQ ID NO: 417209 - DNA, 140 bp, Artificial Sequence
  Synthetic
aggccctggctgctgatatggcaacttccccatgacccaagtgcctcagggagtgacaccatctgcacccccgatgaacccagcagagggcatgacacctcggggggcgacaccatctgcgaccttttgggacagcggtg

SEQ ID NO: 417210 - DNA, 140 bp, Artificial Sequence
  Synthetic
caccgctgtcccaaaaggtcgcagatggtgtcgccccccgaggtgtcatgccctctgctgggttcatcgggggtgcagatggtgtcactccctgaggcacttgggtcatggggaagttgccatatcagcagccagggcct

SEQ ID NO: 417211 - DNA, 140 bp, Artificial Sequence
  Synthetic
aggccctggctgctgatatgccgatgaacccagcagagggcatgacacctcggggggcgacaccatctgcgccccctgcagatccagcagtggagatgctgaaaagttacatgcagatgggaccttttgggacagcggtg

SEQ ID NO: 417212 - DNA, 140 bp, Artificial Sequence
  Synthetic
caccgctgtcccaaaaggtcccatctgcatgtaacttttcagcatctccactgctggatctgcagggggcgcagatggtgtcgccccccgaggtgtcatgccctctgctgggttcatcggcatatcagcagccagggcct

SEQ ID NO: 417213 - DNA, 140 bp, Artificial Sequence
  Synthetic
atacgccatgctgggtctccgatttgctgcacctcaattctctctttggagaagaccagtagtcaaagcatgtatcgagggtcagtcagtagaagtattactagacacaggagttgacgacgtacttgggagtcggccat

SEQ ID NO: 417214 - DNA, 140 bp, Artificial Sequence
  Synthetic
atggccgactcccaagtacgtcgtcaactcctgtgtctagtaatacttctactgactgaccctcgatacatgctttgactactggtcttctccaaagagagaattgaggtgcagcaaatcggagacccagcatggcgtat

SEQ ID NO: 417215 - DNA, 140 bp, Artificial Sequence
  Synthetic
aggccctggctgctgatatgtgtatcgagggtcagtcagtagaagtattactagacacaggagttgacgactcaatagtagcagggatagaattaggtagcaattacaccccaaaaataggaccttttgggacagcggtg

SEQ ID NO: 417216 - DNA, 140 bp, Artificial Sequence
  Synthetic
caccgctgtcccaaaaggtcctatttttggggtgtaattgctacctaattctatccctgctactattgagtcgtcaactcctgtgtctagtaatacttctactgactgaccctcgatacacatatcagcagccagggcct

SEQ ID NO: 417217 - DNA, 140 bp, Artificial Sequence
  Synthetic
atacgccatgctgggtctccatagaagtagtgggaaaaagagtaagggcaactataatgacaggagataccccaataaacatttttggcagaaatattttaaataccttgggcatgacttcgtacttgggagtcggccat

SEQ ID NO: 417218 - DNA, 140 bp, Artificial Sequence
  Synthetic
atggccgactcccaagtacgaagtcatgcccaaggtatttaaaatatttctgccaaaaatgtttattggggtatctcctgtcattatagttgcccttactctttttcccactacttctatggagacccagcatggcgtat

SEQ ID NO: 417219 - DNA, 140 bp, Artificial Sequence
  Synthetic
aggccctggctgctgatatgcccaataaacatttttggcagaaatattttaaataccttgggcatgactttaaatttcccagtggcaaaggtagaaccagtaaaagttgagttaaaacctgaccttttgggacagcggtg

SEQ ID NO: 417220 - DNA, 140 bp, Artificial Sequence
  Synthetic
caccgctgtcccaaaaggtcaggttttaactcaacttttactggttctacctttgccactgggaaatttaaagtcatgcccaaggtatttaaaatatttctgccaaaaatgtttattgggcatatcagcagccagggcct

SEQ ID NO: 417221 - DNA, 140 bp, Artificial Sequence
  Synthetic
atacgccatgctgggtctccactagccctcaaagaaatctgtgaaaaaatggaaaaggagggacaattagaagaagcaccccctactaatccatacaacacacccacctttgccataaagcgtacttgggagtcggccat

SEQ ID NO: 417222 - DNA, 140 bp, Artificial Sequence
  Synthetic
atggccgactcccaagtacgctttatggcaaaggtgggtgtgttgtatggattagtagggggtgcttcttctaattgtccctccttttccattttttcacagatttctttgagggctagtggagacccagcatggcgtat

SEQ ID NO: 417223 - DNA, 140 bp, Artificial Sequence
  Synthetic
atacgccatgctgggtctccaagaaagataagaacaaatggagaatgctaatagactttagagagttaaacaaggtaacccaggacttcacagaagtcaactgggtattccccacccggccgtacttgggagtcggccat

SEQ ID NO: 417224 - DNA, 140 bp, Artificial Sequence
  Synthetic
atggccgactcccaagtacggccgggtggggaatacccagttgacttctgtgaagtcctgggttaccttgtttaactctctaaagtctattagcattctccatttgttcttatctttcttggagacccagcatggcgtat

SEQ ID NO: 417225 - DNA, 140 bp, Artificial Sequence
  Synthetic
atacgccatgctgggtctccttcagtatcccactagatccaaacttcagacagtatacagcattcaccttgccatcagtaaacaatgcagagccaggaaagagatacatttataaagttccgtacttgggagtcggccat

SEQ ID NO: 417226 - DNA, 140 bp, Artificial Sequence
  Synthetic
atggccgactcccaagtacggaactttataaatgtatctctttcctggctctgcattgtttactgatggcaaggtgaatgctgtatactgtctgaagtttggatctagtgggatactgaaggagacccagcatggcgtat

SEQ ID NO: 417227 - DNA, 140 bp, Artificial Sequence
  Synthetic
atacgccatgctgggtctccaaggtattagatccttttagaaaggccaacagcgatgtcattataattcagtacatggatgacatccttatagcaagtgacagaagtgatctggagcacgcgtacttgggagtcggccat

SEQ ID NO: 417228 - DNA, 140 bp, Artificial Sequence
  Synthetic
atggccgactcccaagtacgcgtgctccagatcacttctgtcacttgctataaggatgtcatccatgtactgaattataatgacatcgctgttggcctttctaaaaggatctaataccttggagacccagcatggcgtat

SEQ ID NO: 417229 - DNA, 140 bp, Artificial Sequence
  Synthetic
aggccctggctgctgatatgaccccagaagaaaagttccaaaaagaccctccgttcaaatggatgggttatgagctctggccaaaaaagtggaaactgcaaaaaatacaactgccagaaagaccttttgggacagcggtg

SEQ ID NO: 417230 - DNA, 140 bp, Artificial Sequence
  Synthetic
caccgctgtcccaaaaggtctttctggcagttgtattttttgcagtttccacttttttggccagagctcataacccatccatttgaacggagggtctttttggaacttttcttctggggtcatatcagcagccagggcct

SEQ ID NO: 417231 - DNA, 140 bp, Artificial Sequence
  Synthetic
aggccctggctgctgatatgtgagctctggccaaaaaagtggaaactgcaaaaaatacaactgccagaaaaagaagtttggacagtgaatgcaattcaaaaactggtaggagtattaaacgaccttttgggacagcggtg

SEQ ID NO: 417232 - DNA, 140 bp, Artificial Sequence
  Synthetic
caccgctgtcccaaaaggtcgtttaatactcctaccagtttttgaattgcattcactgtccaaacttctttttctggcagttgtattttttgcagtttccacttttttggccagagctcacatatcagcagccagggcct

SEQ ID NO: 417233 - DNA, 140 bp, Artificial Sequence
  Synthetic
atacgccatgctgggtctccaattaggggaaagatgaccctaacagaagaagtacagtggacagaactagcagaagcagagctacaggagaataaaatcatcttagaacaggaacaagaacgtacttgggagtcggccat

SEQ ID NO: 417234 - DNA, 140 bp, Artificial Sequence
  Synthetic
atggccgactcccaagtacgttcttgttcctgttctaagatgattttattctcctgtagctctgcttctgctagttctgtccactgtacttcttctgttagggtcatctttcccctaattggagacccagcatggcgtat

SEQ ID NO: 417235 - DNA, 140 bp, Artificial Sequence
  Synthetic
aggccctggctgctgatatgcagaagcagagctacaggagaataaaatcatcttagaacaggaacaagaaggatcctactacaaggaaagggtaccgctagaagcaacagtacagaaaaagaccttttgggacagcggtg

SEQ ID NO: 417236 - DNA, 140 bp, Artificial Sequence
  Synthetic
caccgctgtcccaaaaggtctttttctgtactgttgcttctagcggtaccctttccttgtagtaggatccttcttgttcctgttctaagatgattttattctcctgtagctctgcttctgcatatcagcagccagggcct

SEQ ID NO: 417237 - DNA, 140 bp, Artificial Sequence
  Synthetic
atacgccatgctgggtctccaagtaggaaaatatgcaaaggttaaaaacacgcacaccaacggggtaagactactggcacatgtagttcagaaaataggcaaagaagccctagtcatctgcgtacttgggagtcggccat

SEQ ID NO: 417238 - DNA, 140 bp, Artificial Sequence
  Synthetic
atggccgactcccaagtacgcagatgactagggcttctttgcctattttctgaactacatgtgccagtagtcttaccccgttggtgtgcgtgtttttaacctttgcatattttcctacttggagacccagcatggcgtat

SEQ ID NO: 417239 - DNA, 140 bp, Artificial Sequence
  Synthetic
aggccctggctgctgatatgctactggcacatgtagttcagaaaataggcaaagaagccctagtcatctggggagagataccagtgttccatctgccagtagaaagagagacatgggaccgaccttttgggacagcggtg

SEQ ID NO: 417240 - DNA, 140 bp, Artificial Sequence
  Synthetic
caccgctgtcccaaaaggtcggtcccatgtctctctttctactggcagatggaacactggtatctctccccagatgactagggcttctttgcctattttctgaactacatgtgccagtagcatatcagcagccagggcct

SEQ ID NO: 417241 - DNA, 140 bp, Artificial Sequence
  Synthetic
atacgccatgctgggtctccgtctcgaccccaccattaataagactagcctacaacctagtcaaagaccccctagaagggagagaaacctactacacagatgggtcctgcaatagaacctcgtacttgggagtcggccat

SEQ ID NO: 417242 - DNA, 140 bp, Artificial Sequence
  Synthetic
atggccgactcccaagtacgaggttctattgcaggacccatctgtgtagtaggtttctctcccttctagggggtctttgactaggttgtaggctagtcttattaatggtggggtcgagacggagacccagcatggcgtat

SEQ ID NO: 417243 - DNA, 140 bp, Artificial Sequence
  Synthetic
aggccctggctgctgatatgcctagaagggagagaaacctactacacagatgggtcctgcaatagaacctcaaaggaaggaaaagcaggatatgtcactgacaggggaaaagataaggttgaccttttgggacagcggtg

SEQ ID NO: 417244 - DNA, 140 bp, Artificial Sequence
  Synthetic
caccgctgtcccaaaaggtcaaccttatcttttcccctgtcagtgacatatcctgcttttccttcctttgaggttctattgcaggacccatctgtgtagtaggtttctctcccttctaggcatatcagcagccagggcct

SEQ ID NO: 417245 - DNA, 140 bp, Artificial Sequence
  Synthetic
atacgccatgctgggtctccattagcattaacagactcagaaccacaagttaacatcatagtagattcacaatatgtcatgggaataatagctgcacagccaacagaaacagaatcaccacgtacttgggagtcggccat

SEQ ID NO: 417246 - DNA, 140 bp, Artificial Sequence
  Synthetic
atggccgactcccaagtacgtggtgattctgtttctgttggctgtgcagctattattcccatgacatattgtgaatctactatgatgttaacttgtggttctgagtctgttaatgctaatggagacccagcatggcgtat

SEQ ID NO: 417247 - DNA, 140 bp, Artificial Sequence
  Synthetic
aggccctggctgctgatatgaatatgtcatgggaataatagctgcacagccaacagaaacagaatcaccaatagtagcaaaaataattgaagaaatgatcaaaaaagaggcagtatatgtgaccttttgggacagcggtg

SEQ ID NO: 417248 - DNA, 140 bp, Artificial Sequence
  Synthetic
caccgctgtcccaaaaggtcacatatactgcctcttttttgatcatttcttcaattatttttgctactattggtgattctgtttctgttggctgtgcagctattattcccatgacatattcatatcagcagccagggcct

SEQ ID NO: 417249 - DNA, 140 bp, Artificial Sequence
  Synthetic
atacgccatgctgggtctccacctagtaagtcaaggaatcagacaggtcttgttcctagaaaaaatagaaccagcccaggaagagcatgaaaaatatcatggcaatgtaaaagaactggtcgtacttgggagtcggccat

SEQ ID NO: 417250 - DNA, 140 bp, Artificial Sequence
  Synthetic
atggccgactcccaagtacgaccagttcttttacattgccatgatatttttcatgctcttcctgggctggttctattttttctaggaacaagacctgtctgattccttgacttactaggtggagacccagcatggcgtat

SEQ ID NO: 417251 - DNA, 140 bp, Artificial Sequence
  Synthetic
aggccctggctgctgatatgccagcccaggaagagcatgaaaaatatcatggcaatgtaaaagaactggtccataaattcggaattccacaattagtggcaaaacagatagtaaattcctgaccttttgggacagcggtg

SEQ ID NO: 417252 - DNA, 140 bp, Artificial Sequence
  Synthetic
caccgctgtcccaaaaggtcaggaatttactatctgttttgccactaattgtggaattccgaatttatggaccagttcttttacattgccatgatatttttcatgctcttcctgggctggcatatcagcagccagggcct

SEQ ID NO: 417253 - DNA, 140 bp, Artificial Sequence
  Synthetic
atacgccatgctgggtctccgacctagggacatggcagatggactgtacacatttagaaggaaaaattataatagtggcagtccatgtagccagtgggtttatagaagcagaggtaataccgtacttgggagtcggccat

SEQ ID NO: 417254 - DNA, 140 bp, Artificial Sequence
  Synthetic
atggccgactcccaagtacggtattacctctgcttctataaacccactggctacatggactgccactattataatttttccttctaaatgtgtacagtccatctgccatgtccctaggtcggagacccagcatggcgtat

SEQ ID NO: 417255 - DNA, 140 bp, Artificial Sequence
  Synthetic
aggccctggctgctgatatgaatagtggcagtccatgtagccagtgggtttatagaagcagaggtaataccccaagagacaggaagacagacagctctcttcctactaaagttggccagcgaccttttgggacagcggtg

SEQ ID NO: 417256 - DNA, 140 bp, Artificial Sequence
  Synthetic
caccgctgtcccaaaaggtcgctggccaactttagtaggaagagagctgtctgtcttcctgtctcttggggtattacctctgcttctataaacccactggctacatggactgccactattcatatcagcagccagggcct

SEQ ID NO: 417257 - DNA, 140 bp, Artificial Sequence
  Synthetic
atacgccatgctgggtctccaccaagtgtaaagatggtagcctggtgggtaggaatagaacaaacttttggagtaccctataacccacaaagtcaaggagtagtggaagcaatgaaccatcgtacttgggagtcggccat

SEQ ID NO: 417258 - DNA, 140 bp, Artificial Sequence
  Synthetic
atggccgactcccaagtacgatggttcattgcttccactactccttgactttgtgggttatagggtactccaaaagtttgttctattcctacccaccaggctaccatctttacacttggtggagacccagcatggcgtat

SEQ ID NO: 417259 - DNA, 140 bp, Artificial Sequence
  Synthetic
aggccctggctgctgatatgaactattgtggaaaggggaaggagcagtcatcataaaggtagggacagaaatcaaagtagtacccaggagaaaagcaaaaattataaggcactatggagggaccttttgggacagcggtg

SEQ ID NO: 417260 - DNA, 140 bp, Artificial Sequence
  Synthetic
caccgctgtcccaaaaggtccctccatagtgccttataatttttgcttttctcctgggtactactttgatttctgtccctacctttatgatgactgctccttcccctttccacaatagttcatatcagcagccagggcct

SEQ ID NO: 417261 - DNA, 140 bp, Artificial Sequence
  Synthetic
atacgccatgctgggtctccgagagatggcacagtctgattaagtatcttaagtatagaacaggagagttgcaacaggtctcttatgtccctcaccacaaggtaggatgggcttggtggacgtacttgggagtcggccat

SEQ ID NO: 417262 - DNA, 140 bp, Artificial Sequence
  Synthetic
atggccgactcccaagtacgtccaccaagcccatcctaccttgtggtgagggacataagagacctgttgcaactctcctgttctatacttaagatacttaatcagactgtgccatctctcggagacccagcatggcgtat

SEQ ID NO: 417263 - DNA, 140 bp, Artificial Sequence
  Synthetic
atacgccatgctgggtctcccttgcagtagaataatatttcccctaaacaaaggagcatggctagaagtccaaggatattggaacctaaccccagaaaggggattcttgagctcctatgccgtacttgggagtcggccat

SEQ ID NO: 417264 - DNA, 140 bp, Artificial Sequence
  Synthetic
atggccgactcccaagtacggcataggagctcaagaatcccctttctggggttaggttccaatatccttggacttctagccatgctcctttgtttaggggaaatattattctactgcaagggagacccagcatggcgtat

SEQ ID NO: 417265 - DNA, 140 bp, Artificial Sequence
  Synthetic
atacgccatgctgggtctccaggaaacagcgacgaagaaacagtaggagaagcattcgcttggctagaaagaacaataacagagctcaacagggtagcggtcaaccatttgccccgagaacgtacttgggagtcggccat

SEQ ID NO: 417266 - DNA, 140 bp, Artificial Sequence
  Synthetic
atggccgactcccaagtacgttctcggggcaaatggttgaccgctaccctgttgagctctgttattgttctttctagccaagcgaatgcttctcctactgtttcttcgtcgctgtttcctggagacccagcatggcgtat

SEQ ID NO: 417267 - DNA, 140 bp, Artificial Sequence
  Synthetic
aggccctggctgctgatatggaacaataacagagctcaacagggtagcggtcaaccatttgccccgagaacttattttccaggtctggcagaggtcttgggcatactggcgtgaggaacagaccttttgggacagcggtg

SEQ ID NO: 417268 - DNA, 140 bp, Artificial Sequence
  Synthetic
caccgctgtcccaaaaggtctgttcctcacgccagtatgcccaagacctctgccagacctggaaaataagttctcggggcaaatggttgaccgctaccctgttgagctctgttattgttccatatcagcagccagggcct

SEQ ID NO: 417269 - DNA, 140 bp, Artificial Sequence
  Synthetic
atacgccatgctgggtctccaagcaatgtttgtgcactatacaaagggctgtaggtgcctgcaggagggccatgggccagggggatggagatcaggacctcctcctcctcctcccccaggcgtacttgggagtcggccat

SEQ ID NO: 417270 - DNA, 140 bp, Artificial Sequence
  Synthetic
atggccgactcccaagtacgcctgggggaggaggaggaggaggtcctgatctccatccccctggcccatggccctcctgcaggcacctacagccctttgtatagtgcacaaacattgcttggagacccagcatggcgtat

SEQ ID NO: 417271 - DNA, 140 bp, Artificial Sequence
  Synthetic
aggccctggctgctgatatgcatgggccagggggatggagatcaggacctcctcctcctcctcccccaggcctggcctaatggcagaagcagccccagagatccctccagagaacgagaagaccttttgggacagcggtg

SEQ ID NO: 417272 - DNA, 140 bp, Artificial Sequence
  Synthetic
caccgctgtcccaaaaggtcttctcgttctctggagggatctctggggctgcttctgccattaggccaggcctgggggaggaggaggaggaggtcctgatctccatccccctggcccatgcatatcagcagccagggcct

SEQ ID NO: 417273 - DNA, 140 bp, Artificial Sequence
  Synthetic
atacgccatgctgggtctcctaaagcaagaagccttaaagcattttgatcctcgcttgctaactgcgcttggtaactttatctacagtaggcatggagatacccttgcaggagcaggagacgtacttgggagtcggccat

SEQ ID NO: 417274 - DNA, 140 bp, Artificial Sequence
  Synthetic
atggccgactcccaagtacgtctcctgctcctgcaagggtatctccatgcctactgtagataaagttaccaagcgcagttagcaagcgaggatcaaaatgctttaaggcttcttgctttaggagacccagcatggcgtat

SEQ ID NO: 417275 - DNA, 140 bp, Artificial Sequence
  Synthetic
aggccctggctgctgatatgggtaactttatctacagtaggcatggagatacccttgcaggagcaggagagctcattaaaatcctccaacgagccctcttcctccacttcagagccggttgaccttttgggacagcggtg

SEQ ID NO: 417276 - DNA, 140 bp, Artificial Sequence
  Synthetic
caccgctgtcccaaaaggtcaaccggctctgaagtggaggaagagggctcgttggaggattttaatgagctctcctgctcctgcaagggtatctccatgcctactgtagataaagttacccatatcagcagccagggcct

SEQ ID NO: 417277 - DNA, 140 bp, Artificial Sequence
  Synthetic
atacgccatgctgggtctccataccgcccccttaaggcatgcgataatacatgctactgtaagaaatgctgctaccattgccagctttgttttcttaaaaagggtcttgggatatgttatcgtacttgggagtcggccat

SEQ ID NO: 417278 - DNA, 140 bp, Artificial Sequence
  Synthetic
atggccgactcccaagtacgataacatatcccaagaccctttttaagaaaacaaagctggcaatggtagcagcatttcttacagtagcatgtattatcgcatgccttaagggggcggtatggagacccagcatggcgtat

SEQ ID NO: 417279 - DNA, 140 bp, Artificial Sequence
  Synthetic
aggccctggctgctgatatggctaccattgccagctttgttttcttaaaaagggtcttgggatatgttatgaccgctcgagaaggagatctgcaaaaagagctaagactactgcaccttcgaccttttgggacagcggtg

SEQ ID NO: 417280 - DNA, 140 bp, Artificial Sequence
  Synthetic
caccgctgtcccaaaaggtcgaaggtgcagtagtcttagctctttttgcagatctccttctcgagcggtcataacatatcccaagaccctttttaagaaaacaaagctggcaatggtagccatatcagcagccagggcct

SEQ ID NO: 417281 - DNA, 140 bp, Artificial Sequence
  Synthetic
atacgccatgctgggtctccgctcctgcttataggtatcagtgggtttgtatgtaaacaatatgttactgtcttctatggcatacccgcatggaggaacgcaacagttcccctcatttgtcgtacttgggagtcggccat

SEQ ID NO: 417282 - DNA, 140 bp, Artificial Sequence
  Synthetic
atggccgactcccaagtacgacaaatgaggggaactgttgcgttcctccatgcgggtatgccatagaagacagtaacatattgtttacatacaaacccactgatacctataagcaggagcggagacccagcatggcgtat

SEQ ID NO: 417283 - DNA, 140 bp, Artificial Sequence
  Synthetic
aggccctggctgctgatatgtcttctatggcatacccgcatggaggaacgcaacagttcccctcatttgtgcaaccacaaacagagacacctggggaactgtacagtgtctcccagacaagaccttttgggacagcggtg

SEQ ID NO: 417284 - DNA, 140 bp, Artificial Sequence
  Synthetic
caccgctgtcccaaaaggtcttgtctgggagacactgtacagttccccaggtgtctctgtttgtggttgcacaaatgaggggaactgttgcgttcctccatgcgggtatgccatagaagacatatcagcagccagggcct

SEQ ID NO: 417285 - DNA, 140 bp, Artificial Sequence
  Synthetic
atacgccatgctgggtctccgggataatacagtgacacaacaggcagtagatgatgtgtggagactctttgaaacctccataaaaccatgtgtcaaactaaccccactgtgtgtggcaatcgtacttgggagtcggccat

SEQ ID NO: 417286 - DNA, 140 bp, Artificial Sequence
  Synthetic
atggccgactcccaagtacgattgccacacacagtggggttagtttgacacatggttttatggaggtttcaaagagtctccacacatcatctactgcctgttgtgtcactgtattatcccggagacccagcatggcgtat

SEQ ID NO: 417287 - DNA, 140 bp, Artificial Sequence
  Synthetic
aggccctggctgctgatatggaaacctccataaaaccatgtgtcaaactaaccccactgtgtgtggcaatgaactgtagtaaaaccgaaacaaacccagggaatgccagtagtactaccagaccttttgggacagcggtg

SEQ ID NO: 417288 - DNA, 140 bp, Artificial Sequence
  Synthetic
caccgctgtcccaaaaggtctggtagtactactggcattccctgggtttgtttcggttttactacagttcattgccacacacagtggggttagtttgacacatggttttatggaggtttccatatcagcagccagggcct

SEQ ID NO: 417289 - DNA, 140 bp, Artificial Sequence
  Synthetic
atacgccatgctgggtctccgacccatgcataaaaaatgacagctgcacaggactaggagaagaggaaataatgcaatgtaattttagtatgacgggactaagaagagatgagctaaaaccgtacttgggagtcggccat

SEQ ID NO: 417290 - DNA, 140 bp, Artificial Sequence
  Synthetic
atggccgactcccaagtacggttttagctcatctcttcttagtcccgtcatactaaaattacattgcattatttcctcttctcctagtcctgtgcagctgtcattttttatgcatgggtcggagacccagcatggcgtat

SEQ ID NO: 417291 - DNA, 140 bp, Artificial Sequence
  Synthetic
aggccctggctgctgatatgaatgcaatgtaattttagtatgacgggactaagaagagatgagctaaaacaatataaagacacctggtactcagaagatttagagtgtaataataccagggaccttttgggacagcggtg

SEQ ID NO: 417292 - DNA, 140 bp, Artificial Sequence
  Synthetic
caccgctgtcccaaaaggtccctggtattattacactctaaatcttctgagtaccaggtgtctttatattgttttagctcatctcttcttagtcccgtcatactaaaattacattgcattcatatcagcagccagggcct

SEQ ID NO: 417293 - DNA, 140 bp, Artificial Sequence
  Synthetic
atacgccatgctgggtctccagagtcatgtgacaaacattattgggacagcttaaggtttaggtattgtgctcccccggggttttttctactaagatgtaatgataccaactattcaggccgtacttgggagtcggccat

SEQ ID NO: 417294 - DNA, 140 bp, Artificial Sequence
  Synthetic
atggccgactcccaagtacggcctgaatagttggtatcattacatcttagtagaaaaaaccccgggggagcacaatacctaaaccttaagctgtcccaataatgtttgtcacatgactctggagacccagcatggcgtat

SEQ ID NO: 417295 - DNA, 140 bp, Artificial Sequence
  Synthetic
aggccctggctgctgatatgctcccccggggttttttctactaagatgtaatgataccaactattcaggcttcatgcccaactgcagtaaggtagtagcgtcctcctgcacaagaatgatgaccttttgggacagcggtg

SEQ ID NO: 417296 - DNA, 140 bp, Artificial Sequence
  Synthetic
caccgctgtcccaaaaggtcatcattcttgtgcaggaggacgctactaccttactgcagttgggcatgaagcctgaatagttggtatcattacatcttagtagaaaaaaccccgggggagcatatcagcagccagggcct

SEQ ID NO: 417297 - DNA, 140 bp, Artificial Sequence
  Synthetic
atacgccatgctgggtctccacaggacatatatatattggcatgaaaaagacaataggaccatcataagcttaaatacatactataatttgtcaatacactgtaagaggccaggaaacaacgtacttgggagtcggccat

SEQ ID NO: 417298 - DNA, 140 bp, Artificial Sequence
  Synthetic
atggccgactcccaagtacgttgtttcctggcctcttacagtgtattgacaaattatagtatgtatttaagcttatgatggtcctattgtctttttcatgccaatatatatatgtcctgtggagacccagcatggcgtat

SEQ ID NO: 417299 - DNA, 140 bp, Artificial Sequence
  Synthetic
aggccctggctgctgatatgttaaatacatactataatttgtcaatacactgtaagaggccaggaaacaagacggttgtaccaataagaaccgtgtcaggactacttttccattcacagcgaccttttgggacagcggtg

SEQ ID NO: 417300 - DNA, 140 bp, Artificial Sequence
  Synthetic
caccgctgtcccaaaaggtcgctgtgaatggaaaagtagtcctgacacggttcttattggtacaaccgtcttgtttcctggcctcttacagtgtattgacaaattatagtatgtatttaacatatcagcagccagggcct

SEQ ID NO: 417301 - DNA, 140 bp, Artificial Sequence
  Synthetic
atacgccatgctgggtctccacagaagccataaaggaggtgaaaaggaccatcataaaacatcccaggtataaaggaggtgcaaaaaatatcacaagcgtaaagttagtatcagaacatgcgtacttgggagtcggccat

SEQ ID NO: 417302 - DNA, 140 bp, Artificial Sequence
  Synthetic
atggccgactcccaagtacgcatgttctgatactaactttacgcttgtgatattttttgcacctcctttatacctgggatgttttatgatggtccttttcacctcctttatggcttctgtggagacccagcatggcgtat

SEQ ID NO: 417303 - DNA, 140 bp, Artificial Sequence
  Synthetic
aggccctggctgctgatatgtaaaggaggtgcaaaaaatatcacaagcgtaaagttagtatcagaacatggaaaaggttcagatccagaaacaacatatatgtggaccaattgtagaggagaccttttgggacagcggtg

SEQ ID NO: 417304 - DNA, 140 bp, Artificial Sequence
  Synthetic
caccgctgtcccaaaaggtctcctctacaattggtccacatatatgttgtttctggatctgaaccttttccatgttctgatactaactttacgcttgtgatattttttgcacctcctttacatatcagcagccagggcct

SEQ ID NO: 417305 - DNA, 140 bp, Artificial Sequence
  Synthetic
atacgccatgctgggtctccaacaaatacaactcggagaaattatgcgccatgtcatatcagacagataatcaacacgtggcacaaggttgggaaaaatatatatttgcctccaagagaacgtacttgggagtcggccat

SEQ ID NO: 417306 - DNA, 140 bp, Artificial Sequence
  Synthetic
atggccgactcccaagtacgttctcttggaggcaaatatatatttttcccaaccttgtgccacgtgttgattatctgtctgatatgacatggcgcataatttctccgagttgtatttgttggagacccagcatggcgtat

SEQ ID NO: 417307 - DNA, 140 bp, Artificial Sequence
  Synthetic
aggccctggctgctgatatgtcaacacgtggcacaaggttgggaaaaatatatatttgcctccaagagaaggtgagctctcatgtaattccactgtgactagcctcatagccaacatcaagaccttttgggacagcggtg

SEQ ID NO: 417308 - DNA, 140 bp, Artificial Sequence
  Synthetic
caccgctgtcccaaaaggtcttgatgttggctatgaggctagtcacagtggaattacatgagagctcaccttctcttggaggcaaatatatatttttcccaaccttgtgccacgtgttgacatatcagcagccagggcct

SEQ ID NO: 417309 - DNA, 140 bp, Artificial Sequence
  Synthetic
atacgccatgctgggtctcctgtatagattggaactgggggactataaattagtagaaataacaccaattggcttcgcacctacagatgtaagaagatactcctcagtaaaaccgaggaacgtacttgggagtcggccat

SEQ ID NO: 417310 - DNA, 140 bp, Artificial Sequence
  Synthetic
atggccgactcccaagtacgttcctcggttttactgaggagtatcttcttacatctgtaggtgcgaagccaattggtgttatttctactaatttatagtcccccagttccaatctatacaggagacccagcatggcgtat

SEQ ID NO: 417311 - DNA, 140 bp, Artificial Sequence
  Synthetic
aggccctggctgctgatatgggcttcgcacctacagatgtaagaagatactcctcagtaaaaccgaggaataaaagaggtgtaatggtgctaggattcttgggattccttgcaatggcaggaccttttgggacagcggtg

SEQ ID NO: 417312 - DNA, 140 bp, Artificial Sequence
  Synthetic
caccgctgtcccaaaaggtcctgccattgcaaggaatcccaagaatcctagcaccattacacctcttttattcctcggttttactgaggagtatcttcttacatctgtaggtgcgaagcccatatcagcagccagggcct

SEQ ID NO: 417313 - DNA, 140 bp, Artificial Sequence
  Synthetic
atacgccatgctgggtctccttactggccgggatagtgcagcagcagcaacagcctgtggacgtggtcaaaagacaacaggaactgttgcggctgaccgtctgggggacgaaaaacctcccgtacttgggagtcggccat

SEQ ID NO: 417314 - DNA, 140 bp, Artificial Sequence
  Synthetic
atggccgactcccaagtacgggaggtttttcgtcccccagacggtcagccgcaacagttcctgttgtcttttgaccacgtccacaggctgttgctgctgctgcactatcccggccagtaaggagacccagcatggcgtat

SEQ ID NO: 417315 - DNA, 140 bp, Artificial Sequence
  Synthetic
aggccctggctgctgatatgaagacaacaggaactgttgcggctgaccgtctgggggacgaaaaacctccaggcaagagtcactgccatcgagaaatacctaaaggatcaggcacaactagaccttttgggacagcggtg

SEQ ID NO: 417316 - DNA, 140 bp, Artificial Sequence
  Synthetic
caccgctgtcccaaaaggtctagttgtgcctgatcctttaggtatttctcgatggcagtgactcttgcctggaggtttttcgtcccccagacggtcagccgcaacagttcctgttgtcttcatatcagcagccagggcct

SEQ ID NO: 417317 - DNA, 140 bp, Artificial Sequence
  Synthetic
atacgccatgctgggtctccgccaaatgaaaccctcacaccaaattggaataacatgacatggcaacagtgggaaaagcaagtccatttcttggatgcaaatataacggctctgttagaacgtacttgggagtcggccat

SEQ ID NO: 417318 - DNA, 140 bp, Artificial Sequence
  Synthetic
atggccgactcccaagtacgttctaacagagccgttatatttgcatccaagaaatggacttgcttttcccactgttgccatgtcatgttattccaatttggtgtgagggtttcatttggcggagacccagcatggcgtat

SEQ ID NO: 417319 - DNA, 140 bp, Artificial Sequence
  Synthetic
atacgccatgctgggtctcctagctgggatgtttttggtaattggtttgacctcacctcctggataaaatatatccatttaggactatatatagtagcagggttagtagtgttaagaatacgtacttgggagtcggccat

SEQ ID NO: 417320 - DNA, 140 bp, Artificial Sequence
  Synthetic
atggccgactcccaagtacgtattcttaacactactaaccctgctactatatatagtcctaaatggatatattttatccaggaggtgaggtcaaaccaattaccaaaaacatcccagctaggagacccagcatggcgtat

SEQ ID NO: 417321 - DNA, 140 bp, Artificial Sequence
  Synthetic
atacgccatgctgggtctccagtattctcctcccctccctcttatactcaacagatccctatccgcaaggaccggggacagccagccaacgaagaaacagaagaaggaggtggaaacgaccgtacttgggagtcggccat

SEQ ID NO: 417322 - DNA, 140 bp, Artificial Sequence
  Synthetic
atggccgactcccaagtacggtcgtttccacctccttcttctgtttcttcgttggctggctgtccccggtccttgcggatagggatctgttgagtataagagggaggggaggagaatactggagacccagcatggcgtat

SEQ ID NO: 417323 - DNA, 140 bp, Artificial Sequence
  Synthetic
aggccctggctgctgatatgaccggggacagccagccaacgaagaaacagaagaaggaggtggaaacgacggggactacagatcctggccctggcagatagaatacattcattttctactgaccttttgggacagcggtg

SEQ ID NO: 417324 - DNA, 140 bp, Artificial Sequence
  Synthetic
caccgctgtcccaaaaggtcagtagaaaatgaatgtattctatctgccagggccaggatctgtagtccccgtcgtttccacctccttcttctgtttcttcgttggctggctgtccccggtcatatcagcagccagggcct

SEQ ID NO: 417325 - DNA, 140 bp, Artificial Sequence
  Synthetic
atacgccatgctgggtctcctactgttgaagaccttccaaatcctccaccaaatctcaaccaatctccaaccactcaggctcccggttgcgtacctccagtatgggatcagctggttccacgtacttgggagtcggccat

SEQ ID NO: 417326 - DNA, 140 bp, Artificial Sequence
  Synthetic
atggccgactcccaagtacgtggaaccagctgatcccatactggaggtacgcaaccgggagcctgagtggttggagattggttgagatttggtggaggatttggaaggtcttcaacagtaggagacccagcatggcgtat

SEQ ID NO: 417327 - DNA, 140 bp, Artificial Sequence
  Synthetic
aggccctggctgctgatatgccactcaggctcccggttgcgtacctccagtatgggatcagctggttccaagaagcgctccgagcggcagcaagggctacgggagaaactcttgcgagtggaccttttgggacagcggtg

SEQ ID NO: 417328 - DNA, 140 bp, Artificial Sequence
  Synthetic
caccgctgtcccaaaaggtccactcgcaagagtttctcccgtagcccttgctgccgctcggagcgcttcttggaaccagctgatcccatactggaggtacgcaaccgggagcctgagtggcatatcagcagccagggcct

SEQ ID NO: 417329 - DNA, 140 bp, Artificial Sequence
  Synthetic
atacgccatgctgggtctccgcgatccccaggagaatcagacaaggacttgaactcaccctcttgtgagggacaaaatgcccggggggcagaagggggagggcaacaagatgcagatgaacgtacttgggagtcggccat

SEQ ID NO: 417330 - DNA, 140 bp, Artificial Sequence
  Synthetic
atggccgactcccaagtacgttcatctgcatcttgttgccctcccccttctgccccccgggcattttgtccctcacaagagggtgagttcaagtccttgtctgattctcctggggatcgcggagacccagcatggcgtat

SEQ ID NO: 417331 - DNA, 140 bp, Artificial Sequence
  Synthetic
atacgccatgctgggtctccagtgatgaggacgatgaagtgggagccatatgtaagaccccaatagtaccactgagaccaatgacatacaaactagcagtagacatgtctcattttataacgtacttgggagtcggccat

SEQ ID NO: 417332 - DNA, 140 bp, Artificial Sequence
  Synthetic
atggccgactcccaagtacgttataaaatgagacatgtctactgctagtttgtatgtcattggtctcagtggtactattggggtcttacatatggctcccacttcatcgtcctcatcactggagacccagcatggcgtat

SEQ ID NO: 417333 - DNA, 140 bp, Artificial Sequence
  Synthetic
atacgccatgctgggtctccgattggcgcccgaacagggacatgaagaagagtgagagtcttcggagcacggctgagtgaaggcagtaagggcggcaggaatcaaccacgacggagagctcgtacttgggagtcggccat

SEQ ID NO: 417334 - DNA, 140 bp, Artificial Sequence
  Synthetic
atggccgactcccaagtacgagctctccgtcgtggttgattcctgccgcccttactgccttcactcagccgtgctccgaagactctcactcttcttcatgtccctgttcgggcgccaatcggagacccagcatggcgtat

SEQ ID NO: 417335 - DNA, 140 bp, Artificial Sequence
  Synthetic
atacgccatgctgggtctcctaagaaaggagtagggcataagtgggagatgggcgcgagaagctccgtcttgtcagggaagaaaacagatgaattagaaaaagttaggttacggcccggccgtacttgggagtcggccat

SEQ ID NO: 417336 - DNA, 140 bp, Artificial Sequence
  Synthetic
atggccgactcccaagtacggccgggccgtaacctaactttttctaattcatctgttttcttccctgacaagacggagcttctcgcgcccatctcccacttatgccctactcctttcttaggagacccagcatggcgtat

SEQ ID NO: 417337 - DNA, 140 bp, Artificial Sequence
  Synthetic
atacgccatgctgggtctccggaaagaaaaggtattgtctaaaacatataatatgggcagtgaacgaattggacagatttggattagcagagagcctgttggaatcaaaagaaggatgtccgtacttgggagtcggccat

SEQ ID NO: 417338 - DNA, 140 bp, Artificial Sequence
  Synthetic
atggccgactcccaagtacggacatccttcttttgattccaacaggctctctgctaatccaaatctgtccaattcgttcactgcccatattatatgttttagacaataccttttctttccggagacccagcatggcgtat

SEQ ID NO: 417339 - DNA, 140 bp, Artificial Sequence
  Synthetic
atacgccatgctgggtctccttaaaaagcctttttaatactgtctgcgtcatttactgcttgcacgcagaagagaaagtgaaagatactgaggaagcaaaaaagatagcacagagacatccgtacttgggagtcggccat

SEQ ID NO: 417340 - DNA, 140 bp, Artificial Sequence
  Synthetic
atggccgactcccaagtacggatgtctctgtgctatcttttttgcttcctcagtatctttcactttctcttctgcgtgcaagcagtaaatgacgcagacagtattaaaaaggctttttaaggagacccagcatggcgtat

SEQ ID NO: 417341 - DNA, 140 bp, Artificial Sequence
  Synthetic
aggccctggctgctgatatgagagaaagtgaaagatactgaggaagcaaaaaagatagcacagagacatctagcggcggacacagagaaaatgccagctacaagtagaccaacagcaccagaccttttgggacagcggtg

SEQ ID NO: 417342 - DNA, 140 bp, Artificial Sequence
  Synthetic
caccgctgtcccaaaaggtctggtgctgttggtctacttgtagctggcattttctctgtgtccgccgctagatgtctctgtgctatcttttttgcttcctcagtatctttcactttctctcatatcagcagccagggcct

SEQ ID NO: 417343 - DNA, 140 bp, Artificial Sequence
  Synthetic
atacgccatgctgggtctcccatgccgctaagccctcgaaccttaaatgcctgggtaaagttagtagaagaaaagaagttcggggcagaagtagtaccaggattccaggcactatcagaacgtacttgggagtcggccat

SEQ ID NO: 417344 - DNA, 140 bp, Artificial Sequence
  Synthetic
atggccgactcccaagtacgttctgatagtgcctggaatcctggtactacttctgccccgaacttcttttcttctactaactttacccaggcatttaaggttcgagggcttagcggcatgggagacccagcatggcgtat

SEQ ID NO: 417345 - DNA, 140 bp, Artificial Sequence
  Synthetic
aggccctggctgctgatatgaaaagaagttcggggcagaagtagtaccaggattccaggcactatcagaaggatgcactccttatgatataaatcagatgctaaattgtgtaggagaccagaccttttgggacagcggtg

SEQ ID NO: 417346 - DNA, 140 bp, Artificial Sequence
  Synthetic
caccgctgtcccaaaaggtctggtctcctacacaatttagcatctgatttatatcataaggagtgcatccttctgatagtgcctggaatcctggtactacttctgccccgaacttcttttcatatcagcagccagggcct

SEQ ID NO: 417347 - DNA, 140 bp, Artificial Sequence
  Synthetic
atacgccatgctgggtctccactgggaccagcagcacccgataccaggtccactgccagcaggacaacttagggaccccagagggtcagatatagcaggaaccaccagcacagtagaggacgtacttgggagtcggccat

SEQ ID NO: 417348 - DNA, 140 bp, Artificial Sequence
  Synthetic
atggccgactcccaagtacgtcctctactgtgctggtggttcctgctatatctgaccctctggggtccctaagttgtcctgctggcagtggacctggtatcgggtgctgctggtcccagtggagacccagcatggcgtat

SEQ ID NO: 417349 - DNA, 140 bp, Artificial Sequence
  Synthetic
atacgccatgctgggtctccacaaatacagtggatgtacagggcacaaaatcctgttccggtagggaacatttacagaagatggattcaaatagggctgcagaaatgtgtccggatgtaccgtacttgggagtcggccat

SEQ ID NO: 417350 - DNA, 140 bp, Artificial Sequence
  Synthetic
atggccgactcccaagtacggtacatccggacacatttctgcagccctatttgaatccatcttctgtaaatgttccctaccggaacaggattttgtgccctgtacatccactgtatttgtggagacccagcatggcgtat

SEQ ID NO: 417351 - DNA, 140 bp, Artificial Sequence
  Synthetic
aggccctggctgctgatatgtttacagaagatggattcaaatagggctgcagaaatgtgtccggatgtacaatcctaccaacatattagacataaagcagggaccaaaagaacctttccagaccttttgggacagcggtg

SEQ ID NO: 417352 - DNA, 140 bp, Artificial Sequence
  Synthetic
caccgctgtcccaaaaggtctggaaaggttcttttggtccctgctttatgtctaatatgttggtaggattgtacatccggacacatttctgcagccctatttgaatccatcttctgtaaacatatcagcagccagggcct

SEQ ID NO: 417353 - DNA, 140 bp, Artificial Sequence
  Synthetic
atacgccatgctgggtctcccagcagtgaaaaattggatgacacaaacactgctaattcagaatgctaacccagattgcaagttagtacttaagggcttaggaatgaatcccaccttagacgtacttgggagtcggccat

SEQ ID NO: 417354 - DNA, 140 bp, Artificial Sequence
  Synthetic
atggccgactcccaagtacgtctaaggtgggattcattcctaagcccttaagtactaacttgcaatctgggttagcattctgaattagcagtgtttgtgtcatccaatttttcactgctgggagacccagcatggcgtat

SEQ ID NO: 417355 - DNA, 140 bp, Artificial Sequence
  Synthetic
atacgccatgctgggtctccggctaatggctgaggccttaaaagaggccttaacacctgcacccataccgtttgctgccgctcaacaaaaagcaggaaagagagggacggtgacatgctgcgtacttgggagtcggccat

SEQ ID NO: 417356 - DNA, 140 bp, Artificial Sequence
  Synthetic
atggccgactcccaagtacgcagcatgtcaccgtccctctctttcctgctttttgttgagcggcagcaaacggtatgggtgcaggtgttaaggcctcttttaaggcctcagccattagccggagacccagcatggcgtat

SEQ ID NO: 417357 - DNA, 140 bp, Artificial Sequence
  Synthetic
aggccctggctgctgatatgtttgctgccgctcaacaaaaagcaggaaagagagggacggtgacatgctggaactgtggcaaggtaggacacacagccaagcaatgcagggcccctagaagaccttttgggacagcggtg

SEQ ID NO: 417358 - DNA, 140 bp, Artificial Sequence
  Synthetic
caccgctgtcccaaaaggtcttctaggggccctgcattgcttggctgtgtgtcctaccttgccacagttccagcatgtcaccgtccctctctttcctgctttttgttgagcggcagcaaacatatcagcagccagggcct

SEQ ID NO: 417359 - DNA, 140 bp, Artificial Sequence
  Synthetic
atacgccatgctgggtctccccccgatggacccagcagagggcatgacacctcggggggcgacaccatctgcgccccctgcagatccagcagtggagatgctgaaaagctacatgaagatcgtacttgggagtcggccat

SEQ ID NO: 417360 - DNA, 140 bp, Artificial Sequence
  Synthetic
atggccgactcccaagtacgatcttcatgtagcttttcagcatctccactgctggatctgcagggggcgcagatggtgtcgccccccgaggtgtcatgccctctgctgggtccatcggggggagacccagcatggcgtat

SEQ ID NO: 417361 - DNA, 140 bp, Artificial Sequence
  Synthetic
atacgccatgctgggtctccaggatttgctgcacctcaattctctctttggagaagaccagtagtcagagcatgtatcgagggtcagccagtggaagtattactagacacaggagctgaccgtacttgggagtcggccat

SEQ ID NO: 417362 - DNA, 140 bp, Artificial Sequence
  Synthetic
atggccgactcccaagtacggtcagctcctgtgtctagtaatacttccactggctgaccctcgatacatgctctgactactggtcttctccaaagagagaattgaggtgcagcaaatcctggagacccagcatggcgtat

SEQ ID NO: 417363 - DNA, 140 bp, Artificial Sequence
  Synthetic
aggccctggctgctgatatgcatgtatcgagggtcagccagtggaagtattactagacacaggagctgacgactcaatagtagcaggaatagaattaggtagcaattacaccccaaaaatgaccttttgggacagcggtg

SEQ ID NO: 417364 - DNA, 140 bp, Artificial Sequence
  Synthetic
caccgctgtcccaaaaggtcatttttggggtgtaattgctacctaattctattcctgctactattgagtcgtcagctcctgtgtctagtaatacttccactggctgaccctcgatacatgcatatcagcagccagggcct

SEQ ID NO: 417365 - DNA, 140 bp, Artificial Sequence
  Synthetic
atacgccatgctgggtctccaaatagaagtagtgggaaaaagagtaagggcaactataatgacaggagacaccccaataaacatttttggcagaaatattttaaatacattaggcatgaccgtacttgggagtcggccat

SEQ ID NO: 417366 - DNA, 140 bp, Artificial Sequence
  Synthetic
atggccgactcccaagtacggtcatgcctaatgtatttaaaatatttctgccaaaaatgtttattggggtgtctcctgtcattatagttgcccttactctttttcccactacttctatttggagacccagcatggcgtat

SEQ ID NO: 417367 - DNA, 140 bp, Artificial Sequence
  Synthetic
aggccctggctgctgatatgaccccaataaacatttttggcagaaatattttaaatacattaggcatgactctaaatttcccagtagcaaagatagaaccagtaaaagtcaaactaaagcgaccttttgggacagcggtg

SEQ ID NO: 417368 - DNA, 140 bp, Artificial Sequence
  Synthetic
caccgctgtcccaaaaggtcgctttagtttgacttttactggttctatctttgctactgggaaatttagagtcatgcctaatgtatttaaaatatttctgccaaaaatgtttattggggtcatatcagcagccagggcct

SEQ ID NO: 417369 - DNA, 140 bp, Artificial Sequence
  Synthetic
atacgccatgctgggtctccatattggccctcaaggaaatctgtgaaaagatggaaaaggagggacagctagaagaagcgccccctactaatccatacaacacacccacctttgccataacgtacttgggagtcggccat

SEQ ID NO: 417370 - DNA, 140 bp, Artificial Sequence
  Synthetic
atggccgactcccaagtacgttatggcaaaggtgggtgtgttgtatggattagtagggggcgcttcttctagctgtccctccttttccatcttttcacagatttccttgagggccaatatggagacccagcatggcgtat

SEQ ID NO: 417371 - DNA, 140 bp, Artificial Sequence
  Synthetic
atacgccatgctgggtctccaaaagagagataaaaacaaatggagaatgctaatagattttagagaattaaacaaggtgacccaagactttacagaagtccaactgggtattccccaccccgtacttgggagtcggccat

SEQ ID NO: 417372 - DNA, 140 bp, Artificial Sequence
  Synthetic
atggccgactcccaagtacggggtggggaatacccagttggacttctgtaaagtcttgggtcaccttgtttaattctctaaaatctattagcattctccatttgtttttatctctcttttggagacccagcatggcgtat

SEQ ID NO: 417373 - DNA, 140 bp, Artificial Sequence
  Synthetic
aggccctggctgctgatatgagttctaccacaaggatggaaggggtccccagcaatttttcaatactccatgaggaaggtattagatcctttcagaaaggccaacagcgatgtcattatagaccttttgggacagcggtg

SEQ ID NO: 417374 - DNA, 140 bp, Artificial Sequence
  Synthetic
caccgctgtcccaaaaggtctataatgacatcgctgttggcctttctgaaaggatctaataccttcctcatggagtattgaaaaattgctggggaccccttccatccttgtggtagaactcatatcagcagccagggcct

SEQ ID NO: 417375 - DNA, 140 bp, Artificial Sequence
  Synthetic
atacgccatgctgggtctccggttatgagctctggccaaaaaggtggaaactgcaaaaaatacaactgccagaaaaggaagtttggacagtgaatgacattcaaaaactagtgggagtatcgtacttgggagtcggccat

SEQ ID NO: 417376 - DNA, 140 bp, Artificial Sequence
  Synthetic
atggccgactcccaagtacgatactcccactagtttttgaatgtcattcactgtccaaacttccttttctggcagttgtattttttgcagtttccacctttttggccagagctcataaccggagacccagcatggcgtat

SEQ ID NO: 417377 - DNA, 140 bp, Artificial Sequence
  Synthetic
atacgccatgctgggtctccaaactaattaggggaaagatgaccctaacagaagaagtacaatggacagaattagcagaggcagagttacaggagaacaaaatcattttagaacaggaaccgtacttgggagtcggccat

SEQ ID NO: 417378 - DNA, 140 bp, Artificial Sequence
  Synthetic
atggccgactcccaagtacggttcctgttctaaaatgattttgttctcctgtaactctgcctctgctaattctgtccattgtacttcttctgttagggtcatctttcccctaattagtttggagacccagcatggcgtat

SEQ ID NO: 417379 - DNA, 140 bp, Artificial Sequence
  Synthetic
aggccctggctgctgatatgattagcagaggcagagttacaggagaacaaaatcattttagaacaggaacaagaaggatcctactacaaggaaggggtaccactagaagcaacagtacaggaccttttgggacagcggtg

SEQ ID NO: 417380 - DNA, 140 bp, Artificial Sequence
  Synthetic
caccgctgtcccaaaaggtcctgtactgttgcttctagtggtaccccttccttgtagtaggatccttcttgttcctgttctaaaatgattttgttctcctgtaactctgcctctgctaatcatatcagcagccagggcct

SEQ ID NO: 417381 - DNA, 140 bp, Artificial Sequence
  Synthetic
atacgccatgctgggtctcctttaaaagtaggaaaatatgcaaaggttaaaaacacccacaccaacggggtaagactactggcacatgtagttcagaaaataggaaaagaagccctagtccgtacttgggagtcggccat

SEQ ID NO: 417382 - DNA, 140 bp, Artificial Sequence
  Synthetic
atggccgactcccaagtacggactagggcttcttttcctattttctgaactacatgtgccagtagtcttaccccgttggtgtgggtgtttttaacctttgcatattttcctacttttaaaggagacccagcatggcgtat

SEQ ID NO: 417383 - DNA, 140 bp, Artificial Sequence
  Synthetic
aggccctggctgctgatatgtaagactactggcacatgtagttcagaaaataggaaaagaagccctagtcatctggggagagataccagtattccatctgccagtagaaagagagacatggaccttttgggacagcggtg

SEQ ID NO: 417384 - DNA, 140 bp, Artificial Sequence
  Synthetic
caccgctgtcccaaaaggtccatgtctctctttctactggcagatggaatactggtatctctccccagatgactagggcttcttttcctattttctgaactacatgtgccagtagtcttacatatcagcagccagggcct

SEQ ID NO: 417385 - DNA, 140 bp, Artificial Sequence
  Synthetic
atacgccatgctgggtctccattttgtctcaaccccaccattagtaagactagcctacaacctagtcaaagaccccctagaaaaggtggaaacctactacacagatggatcctgcaacagcgtacttgggagtcggccat

SEQ ID NO: 417386 - DNA, 140 bp, Artificial Sequence
  Synthetic
atggccgactcccaagtacgctgttgcaggatccatctgtgtagtaggtttccaccttttctagggggtctttgactaggttgtaggctagtcttactaatggtggggttgagacaaaatggagacccagcatggcgtat

SEQ ID NO: 417387 - DNA, 140 bp, Artificial Sequence
  Synthetic
aggccctggctgctgatatggaccccctagaaaaggtggaaacctactacacagatggatcctgcaacagagcctcaaaggagggaaaggcaggatatgtcacagacaggggaaaagatagaccttttgggacagcggtg

SEQ ID NO: 417388 - DNA, 140 bp, Artificial Sequence
  Synthetic
caccgctgtcccaaaaggtctatcttttcccctgtctgtgacatatcctgcctttccctcctttgaggctctgttgcaggatccatctgtgtagtaggtttccaccttttctagggggtccatatcagcagccagggcct

SEQ ID NO: 417389 - DNA, 140 bp, Artificial Sequence
  Synthetic
atacgccatgctgggtctcctttgcactagcactacaggattcaggaccacaagtcaacatcatagtagactcacaatatgtcatgggaatagtagctggacagccaacagaaacggagtcgtacttgggagtcggccat

SEQ ID NO: 417390 - DNA, 140 bp, Artificial Sequence
  Synthetic
atggccgactcccaagtacgactccgtttctgttggctgtccagctactattcccatgacatattgtgagtctactatgatgttgacttgtggtcctgaatcctgtagtgctagtgcaaaggagacccagcatggcgtat

SEQ ID NO: 417391 - DNA, 140 bp, Artificial Sequence
  Synthetic
aggccctggctgctgatatgagaccacctagtaagtcaaggaattaggcaggttctattcctagaaaagatagaaccagcacaagaagaacatgaaaagtaccatggcaatgtaaaagaagaccttttgggacagcggtg

SEQ ID NO: 417392 - DNA, 140 bp, Artificial Sequence
  Synthetic
caccgctgtcccaaaaggtcttcttttacattgccatggtacttttcatgttcttcttgtgctggttctatcttttctaggaatagaacctgcctaattccttgacttactaggtggtctcatatcagcagccagggcct

SEQ ID NO: 417393 - DNA, 140 bp, Artificial Sequence
  Synthetic
aggccctggctgctgatatgatgcagaactaggaacatggcagatggactgtacacacttagaaggaaaggtcataatagtggcagtccatgtagccagtggatttatagaggcagaggtgaccttttgggacagcggtg

SEQ ID NO: 417394 - DNA, 140 bp, Artificial Sequence
  Synthetic
caccgctgtcccaaaaggtcacctctgcctctataaatccactggctacatggactgccactattatgacctttccttctaagtgtgtacagtccatctgccatgttcctagttctgcatcatatcagcagccagggcct

SEQ ID NO: 417395 - DNA, 140 bp, Artificial Sequence
  Synthetic
atacgccatgctgggtctccccagcagatggcctatcacacacctgcacacagacaacggcgccaacttcacctcacaagacgtgaagatggcggcctggtggatagggatagaacaaaccgtacttgggagtcggccat

SEQ ID NO: 417396 - DNA, 140 bp, Artificial Sequence
  Synthetic
atggccgactcccaagtacggtttgttctatccctatccaccaggccgccatcttcacgtcttgtgaggtgaagttggcgccgttgtctgtgtgcaggtgtgtgataggccatctgctggggagacccagcatggcgtat

SEQ ID NO: 417397 - DNA, 140 bp, Artificial Sequence
  Synthetic
atacgccatgctgggtctcccttcggggtaccctataacccacaaagtcagggagtagtagaagcaatgaaccatcacctaaaaaaccaaatagatagaatcagggaccaggcagtatcacgtacttgggagtcggccat

SEQ ID NO: 417398 - DNA, 140 bp, Artificial Sequence
  Synthetic
atggccgactcccaagtacgtgatactgcctggtccctgattctatctatttggttttttaggtgatggttcattgcttctactactccctgactttgtgggttatagggtaccccgaagggagacccagcatggcgtat

SEQ ID NO: 417399 - DNA, 140 bp, Artificial Sequence
  Synthetic
aggccctggctgctgatatggggaggaataggggatatgacccctgcagagagactagttaacatgataaccacagaacaagaaatacagttcttccaagcaaaaaatttaaaatttcaagaccttttgggacagcggtg

SEQ ID NO: 417400 - DNA, 140 bp, Artificial Sequence
  Synthetic
caccgctgtcccaaaaggtcttgaaattttaaattttttgcttggaagaactgtatttcttgttctgtggttatcatgttaactagtctctctgcaggggtcatatcccctattcctccccatatcagcagccagggcct

SEQ ID NO: 417401 - DNA, 140 bp, Artificial Sequence
  Synthetic
aggccctggctgctgatatgccacagaacaagaaatacagttcttccaagcaaaaaatttaaaatttcaaaatttccaggtctattacagagaaggcagagatcaactctggaaaggaccgaccttttgggacagcggtg

SEQ ID NO: 417402 - DNA, 140 bp, Artificial Sequence
  Synthetic
caccgctgtcccaaaaggtcggtcctttccagagttgatctctgccttctctgtaatagacctggaaattttgaaattttaaattttttgcttggaagaactgtatttcttgttctgtggcatatcagcagccagggcct

SEQ ID NO: 417403 - DNA, 140 bp, Artificial Sequence
  Synthetic
atacgccatgctgggtctcccagagatcaaagtaatacccagaaggaaagcaaagatcataaggcactatggagggggaaaagaattggattgtggtaccgacatggaggataccaggcacgtacttgggagtcggccat

SEQ ID NO: 417404 - DNA, 140 bp, Artificial Sequence
  Synthetic
atggccgactcccaagtacgtgcctggtatcctccatgtcggtaccacaatccaattcttttccccctccatagtgccttatgatctttgctttccttctgggtattactttgatctctgggagacccagcatggcgtat

SEQ ID NO: 417405 - DNA, 140 bp, Artificial Sequence
  Synthetic
aggccctggctgctgatatgggagggggaaaagaattggattgtggtaccgacatggaggataccaggcaggctagagaaatggcacagtctggtcaagtacctgaagcatagaacaaaagaccttttgggacagcggtg

SEQ ID NO: 417406 - DNA, 140 bp, Artificial Sequence
  Synthetic
caccgctgtcccaaaaggtcttttgttctatgcttcaggtacttgaccagactgtgccatttctctagcctgcctggtatcctccatgtcggtaccacaatccaattcttttccccctcccatatcagcagccagggcct

SEQ ID NO: 417407 - DNA, 140 bp, Artificial Sequence
  Synthetic
atacgccatgctgggtctccgtggacttgcagtagagtaatattccccctaaaagaagaagcatacttagaggtccaagggtattggaatctgaccccggaaaggggattcttgagctcccgtacttgggagtcggccat

SEQ ID NO: 417408 - DNA, 140 bp, Artificial Sequence
  Synthetic
atggccgactcccaagtacgggagctcaagaatcccctttccggggtcagattccaatacccttggacctctaagtatgcttcttcttttagggggaatattactctactgcaagtccacggagacccagcatggcgtat

SEQ ID NO: 417409 - DNA, 140 bp, Artificial Sequence
  Synthetic
aggccctggctgctgatatgaggtccaagggtattggaatctgaccccggaaaggggattcttgagctcctatgctgtaagactaacatggtataaaaggagcttttatacagatgtgacgaccttttgggacagcggtg

SEQ ID NO: 417410 - DNA, 140 bp, Artificial Sequence
  Synthetic
caccgctgtcccaaaaggtcgtcacatctgtataaaagctccttttataccatgttagtcttacagcataggagctcaagaatcccctttccggggtcagattccaatacccttggacctcatatcagcagccagggcct

SEQ ID NO: 417411 - DNA, 140 bp, Artificial Sequence
  Synthetic
aggccctggctgctgatatgagaaagaacaataacagagctcaacagggtagcagtcaaccacttgccccgagaactcattttccaggtctggcagaggtgttgggcatactggcgtgaggaccttttgggacagcggtg

SEQ ID NO: 417412 - DNA, 140 bp, Artificial Sequence
  Synthetic
caccgctgtcccaaaaggtcctcacgccagtatgcccaacacctctgccagacctggaaaatgagttctcggggcaagtggttgactgctaccctgttgagctctgttattgttctttctcatatcagcagccagggcct

SEQ ID NO: 417413 - DNA, 140 bp, Artificial Sequence
  Synthetic
aggccctggctgctgatatgagggccatgggccagggggatggagatcaggacctcctcctcctcctcccccaggcctagcctaatggcagaagcagccccagagactcctccagagaatgaccttttgggacagcggtg

SEQ ID NO: 417414 - DNA, 140 bp, Artificial Sequence
  Synthetic
caccgctgtcccaaaaggtcattctctggaggagtctctggggctgcttctgccattaggctaggcctgggggaggaggaggaggaggtcctgatctccatccccctggcccatggccctcatatcagcagccagggcct

SEQ ID NO: 417415 - DNA, 140 bp, Artificial Sequence
  Synthetic
atacgccatgctgggtctccggaaataaagcaagaagccttaaggcattttgatccccgcttgctaactgcgcttggtaattttatctacagtaggcatggagatacccttgcaggagcacgtacttgggagtcggccat

SEQ ID NO: 417416 - DNA, 140 bp, Artificial Sequence
  Synthetic
atggccgactcccaagtacgtgctcctgcaagggtatctccatgcctactgtagataaaattaccaagcgcagttagcaagcggggatcaaaatgccttaaggcttcttgctttatttccggagacccagcatggcgtat

SEQ ID NO: 417417 - DNA, 140 bp, Artificial Sequence
  Synthetic
aggccctggctgctgatatgcgcttggtaattttatctacagtaggcatggagatacccttgcaggagcaggagagctcattaaaatcctccagcgagccctcttcctccacttcagagcgaccttttgggacagcggtg

SEQ ID NO: 417418 - DNA, 140 bp, Artificial Sequence
  Synthetic
caccgctgtcccaaaaggtcgctctgaagtggaggaagagggctcgctggaggattttaatgagctctcctgctcctgcaagggtatctccatgcctactgtagataaaattaccaagcgcatatcagcagccagggcct

SEQ ID NO: 417419 - DNA, 140 bp, Artificial Sequence
  Synthetic
atacgccatgctgggtctcccagctataccgccctcttgaagcatgcgataataaatgctactgtaaaaaatgctgttaccattgccagctttgtttccttaaaaagggccttgggatatcgtacttgggagtcggccat

SEQ ID NO: 417420 - DNA, 140 bp, Artificial Sequence
  Synthetic
atggccgactcccaagtacgatatcccaaggccctttttaaggaaacaaagctggcaatggtaacagcattttttacagtagcatttattatcgcatgcttcaagagggcggtatagctgggagacccagcatggcgtat

SEQ ID NO: 417421 - DNA, 140 bp, Artificial Sequence
  Synthetic
aggccctggctgctgatatgatgctgttaccattgccagctttgtttccttaaaaagggccttgggatatggtatgaccactcgagaaaaagatcttcaaaaagggctaaggttactgcagaccttttgggacagcggtg

SEQ ID NO: 417422 - DNA, 140 bp, Artificial Sequence
  Synthetic
caccgctgtcccaaaaggtctgcagtaaccttagccctttttgaagatctttttctcgagtggtcataccatatcccaaggccctttttaaggaaacaaagctggcaatggtaacagcatcatatcagcagccagggcct

SEQ ID NO: 417423 - DNA, 140 bp, Artificial Sequence
  Synthetic
atacgccatgctgggtctccattttgctcctacttataagtgtctatgggtttctgggtcataagaaaaactatgtcactgtcttctatggcatacctgcatggaggaacgcaacggttccgtacttgggagtcggccat

SEQ ID NO: 417424 - DNA, 140 bp, Artificial Sequence
  Synthetic
atggccgactcccaagtacggaaccgttgcgttcctccatgcaggtatgccatagaagacagtgacatagtttttcttatgacccagaaacccatagacacttataagtaggagcaaaatggagacccagcatggcgtat

SEQ ID NO: 417425 - DNA, 140 bp, Artificial Sequence
  Synthetic
aggccctggctgctgatatgctatgtcactgtcttctatggcatacctgcatggaggaacgcaacggttcctctcttctgtgcaaccacaaacagggatacctggggaactgtacagtgcgaccttttgggacagcggtg

SEQ ID NO: 417426 - DNA, 140 bp, Artificial Sequence
  Synthetic
caccgctgtcccaaaaggtcgcactgtacagttccccaggtatccctgtttgtggttgcacagaagagaggaaccgttgcgttcctccatgcaggtatgccatagaagacagtgacatagcatatcagcagccagggcct

SEQ ID NO: 417427 - DNA, 140 bp, Artificial Sequence
  Synthetic
atacgccatgctgggtctccttttgatgcatggaataatacagtaacagaacaggcagtagatgatgtgtggagtctttttgaaacctccataaaaccatgtgttaagctgacgccgctgcgtacttgggagtcggccat

SEQ ID NO: 417428 - DNA, 140 bp, Artificial Sequence
  Synthetic
atggccgactcccaagtacgcagcggcgtcagcttaacacatggttttatggaggtttcaaaaagactccacacatcatctactgcctgttctgttactgtattattccatgcatcaaaaggagacccagcatggcgtat

SEQ ID NO: 417429 - DNA, 140 bp, Artificial Sequence
  Synthetic
aggccctggctgctgatatgggagtctttttgaaacctccataaaaccatgtgttaagctgacgccgctgtgcgtggcaatgagatgtaataacacaggaaccaatactactactaaaccgaccttttgggacagcggtg

SEQ ID NO: 417430 - DNA, 140 bp, Artificial Sequence
  Synthetic
caccgctgtcccaaaaggtcggtttagtagtagtattggttcctgtgttattacatctcattgccacgcacagcggcgtcagcttaacacatggttttatggaggtttcaaaaagactcccatatcagcagccagggcct

SEQ ID NO: 417431 - DNA, 140 bp, Artificial Sequence
  Synthetic
atacgccatgctgggtctccacacaagtccatgtattaaaaatgacacctgcccgggaataggactagaaaacacagttgactgttactttaacatgacaggactaagaagagatgagaacgtacttgggagtcggccat

SEQ ID NO: 417432 - DNA, 140 bp, Artificial Sequence
  Synthetic
atggccgactcccaagtacgttctcatctcttcttagtcctgtcatgttaaagtaacagtcaactgtgttttctagtcctattcccgggcaggtgtcatttttaatacatggacttgtgtggagacccagcatggcgtat

SEQ ID NO: 417433 - DNA, 140 bp, Artificial Sequence
  Synthetic
aggccctggctgctgatatgaacacagttgactgttactttaacatgacaggactaagaagagatgagaaaaaacaatataaggacacctggtacgaaaaagatttagagtgcaacggcagaccttttgggacagcggtg

SEQ ID NO: 417434 - DNA, 140 bp, Artificial Sequence
  Synthetic
caccgctgtcccaaaaggtctgccgttgcactctaaatctttttcgtaccaggtgtccttatattgttttttctcatctcttcttagtcctgtcatgttaaagtaacagtcaactgtgttcatatcagcagccagggcct

SEQ ID NO: 417435 - DNA, 140 bp, Artificial Sequence
  Synthetic
atacgccatgctgggtctcccaagagtcatgtgataaacattactgggacagcttaagatttaggtactgtgctcccccaggatatgctctgctaagatgtaatgacaccaactattcagcgtacttgggagtcggccat

SEQ ID NO: 417436 - DNA, 140 bp, Artificial Sequence
  Synthetic
atggccgactcccaagtacgctgaatagttggtgtcattacatcttagcagagcatatcctgggggagcacagtacctaaatcttaagctgtcccagtaatgtttatcacatgactcttgggagacccagcatggcgtat

SEQ ID NO: 417437 - DNA, 140 bp, Artificial Sequence
  Synthetic
aggccctggctgctgatatgtgctcccccaggatatgctctgctaagatgtaatgacaccaactattcaggctttatgccaaaatgtagtaaagtagtagtgtcctcttgcacaagaatggaccttttgggacagcggtg

SEQ ID NO: 417438 - DNA, 140 bp, Artificial Sequence
  Synthetic
caccgctgtcccaaaaggtccattcttgtgcaagaggacactactactttactacattttggcataaagcctgaatagttggtgtcattacatcttagcagagcatatcctgggggagcacatatcagcagccagggcct

SEQ ID NO: 417439 - DNA, 140 bp, Artificial Sequence
  Synthetic
atacgccatgctgggtctccaaataggacatatatgtattggcatagtaaagataataggaccatcataagcttgaataagtattataatctaacaatgcattgcagaaggccagggaaccgtacttgggagtcggccat

SEQ ID NO: 417440 - DNA, 140 bp, Artificial Sequence
  Synthetic
atggccgactcccaagtacggttccctggccttctgcaatgcattgttagattataatacttattcaagcttatgatggtcctattatctttactatgccaatacatatatgtcctatttggagacccagcatggcgtat

SEQ ID NO: 417441 - DNA, 140 bp, Artificial Sequence
  Synthetic
aggccctggctgctgatatggcttgaataagtattataatctaacaatgcattgcagaaggccagggaacaagacagtcataccaataacaatcatgtcaggactgaatttccattcgcagaccttttgggacagcggtg

SEQ ID NO: 417442 - DNA, 140 bp, Artificial Sequence
  Synthetic
caccgctgtcccaaaaggtctgcgaatggaaattcagtcctgacatgattgttattggtatgactgtcttgttccctggccttctgcaatgcattgttagattataatacttattcaagccatatcagcagccagggcct

SEQ ID NO: 417443 - DNA, 140 bp, Artificial Sequence
  Synthetic
atacgccatgctgggtctccggatagaagccataagggaggtaaaggagaccatcataaaacatcccaggtataaaggaacaaataacaccgagaggataagattggtagggccctcggccgtacttgggagtcggccat

SEQ ID NO: 417444 - DNA, 140 bp, Artificial Sequence
  Synthetic
atggccgactcccaagtacggccgagggccctaccaatcttatcctctcggtgttatttgttcctttatacctgggatgttttatgatggtctcctttacctcccttatggcttctatccggagacccagcatggcgtat

SEQ ID NO: 417445 - DNA, 140 bp, Artificial Sequence
  Synthetic
aggccctggctgctgatatgtataaaggaacaaataacaccgagaggataagattggtagggccctcggcaggttcagacccagaggtgagacatatgtggactaactgtaggggagaatgaccttttgggacagcggtg

SEQ ID NO: 417446 - DNA, 140 bp, Artificial Sequence
  Synthetic
caccgctgtcccaaaaggtcattctcccctacagttagtccacatatgtctcacctctgggtctgaacctgccgagggccctaccaatcttatcctctcggtgttatttgttcctttatacatatcagcagccagggcct

SEQ ID NO: 417447 - DNA, 140 bp, Artificial Sequence
  Synthetic
atacgccatgctgggtctccggtacaactcagaagaattatgtgacgtgccacatcaaacagatagtcaacacgtggcacaaggttggaaaatacgtatatttgcctccaagggagggtacgtacttgggagtcggccat

SEQ ID NO: 417448 - DNA, 140 bp, Artificial Sequence
  Synthetic
atggccgactcccaagtacgtaccctcccttggaggcaaatatacgtattttccaaccttgtgccacgtgttgactatctgtttgatgtggcacgtcacataattcttctgagttgtaccggagacccagcatggcgtat

SEQ ID NO: 417449 - DNA, 140 bp, Artificial Sequence
  Synthetic
aggccctggctgctgatatgcacgtggcacaaggttggaaaatacgtatatttgcctccaagggagggtacgctctcctgtaattccagtgtcaccagtcttatagccaacattgacgtggaccttttgggacagcggtg

SEQ ID NO: 417450 - DNA, 140 bp, Artificial Sequence
  Synthetic
caccgctgtcccaaaaggtccacgtcaatgttggctataagactggtgacactggaattacaggagagcgtaccctcccttggaggcaaatatacgtattttccaaccttgtgccacgtgcatatcagcagccagggcct

SEQ ID NO: 417451 - DNA, 140 bp, Artificial Sequence
  Synthetic
atacgccatgctgggtctccgggagaactgtacagattggaactgggggactacaaattagtagaaataacaccgattggctttgcacctacagagataaaaagatattcctcaacgacacgtacttgggagtcggccat

SEQ ID NO: 417452 - DNA, 140 bp, Artificial Sequence
  Synthetic
atggccgactcccaagtacgtgtcgttgaggaatatctttttatctctgtaggtgcaaagccaatcggtgttatttctactaatttgtagtcccccagttccaatctgtacagttctcccggagacccagcatggcgtat

SEQ ID NO: 417453 - DNA, 140 bp, Artificial Sequence
  Synthetic
aggccctggctgctgatatggtggtcaaaagacaacaggaactgttgcggctgaccgtctggggaacgaaaaacctccagacaagagtcactgccatcgagaaatacctaaaggaccagggaccttttgggacagcggtg

SEQ ID NO: 417454 - DNA, 140 bp, Artificial Sequence
  Synthetic
caccgctgtcccaaaaggtccctggtcctttaggtatttctcgatggcagtgactcttgtctggaggtttttcgttccccagacggtcagccgcaacagttcctgttgtcttttgaccaccatatcagcagccagggcct

SEQ ID NO: 417455 - DNA, 140 bp, Artificial Sequence
  Synthetic
atacgccatgctgggtctccgtaccatggccaaatgaaactctcacaccagactgggaaaacatgacatggcaacagtgggaaaagcgagtcaatttcttggatgcaaatataacagccccgtacttgggagtcggccat

SEQ ID NO: 417456 - DNA, 140 bp, Artificial Sequence
  Synthetic
atggccgactcccaagtacggggctgttatatttgcatccaagaaattgactcgcttttcccactgttgccatgtcatgttttcccagtctggtgtgagagtttcatttggccatggtacggagacccagcatggcgtat

SEQ ID NO: 417457 - DNA, 140 bp, Artificial Sequence
  Synthetic
aggccctggctgctgatatggcaacagtgggaaaagcgagtcaatttcttggatgcaaatataacagccctgttagaagaggctcagatacaacaagaaaggaacatgtatgaattacaggaccttttgggacagcggtg

SEQ ID NO: 417458 - DNA, 140 bp, Artificial Sequence
  Synthetic
caccgctgtcccaaaaggtcctgtaattcatacatgttcctttcttgttgtatctgagcctcttctaacagggctgttatatttgcatccaagaaattgactcgcttttcccactgttgccatatcagcagccagggcct

SEQ ID NO: 417459 - DNA, 140 bp, Artificial Sequence
  Synthetic
atacgccatgctgggtctccgatggcatacatcaggttaggactatatgtagtagcaggattaatagtgttaagaatagtaatatacattatgcagatgctagcaagacttaggaagggccgtacttgggagtcggccat

SEQ ID NO: 417460 - DNA, 140 bp, Artificial Sequence
  Synthetic
atggccgactcccaagtacggcccttcctaagtcttgctagcatctgcataatgtatattactattcttaacactattaatcctgctactacatatagtcctaacctgatgtatgccatcggagacccagcatggcgtat

SEQ ID NO: 417461 - DNA, 140 bp, Artificial Sequence
  Synthetic
aggccctggctgctgatatgtaagaatagtaatatacattatgcagatgctagcaagacttaggaagggctataggccagtattctcctcccctccctcttatactcaacagatccctatgaccttttgggacagcggtg

SEQ ID NO: 417462 - DNA, 140 bp, Artificial Sequence
  Synthetic
caccgctgtcccaaaaggtcatagggatctgttgagtataagagggaggggaggagaatactggcctatagcccttcctaagtcttgctagcatctgcataatgtatattactattcttacatatcagcagccagggcct

SEQ ID NO: 417463 - DNA, 140 bp, Artificial Sequence
  Synthetic
atacgccatgctgggtctccgaaacgaaggggcttacagatcttggccctggcagatagaatacgctcactttctgattcgccaactgaggaacctcttgatttggctgtacaacggctgcgtacttgggagtcggccat

SEQ ID NO: 417464 - DNA, 140 bp, Artificial Sequence
  Synthetic
atggccgactcccaagtacgcagccgttgtacagccaaatcaagaggttcctcagttggcgaatcagaaagtgagcgtattctatctgccagggccaagatctgtaagccccttcgtttcggagacccagcatggcgtat

SEQ ID NO: 417465 - DNA, 140 bp, Artificial Sequence
  Synthetic
aggccctggctgctgatatgtttctgattcgccaactgaggaacctcttgatttggctgtacaacggctgcaggaacttactgttgaagacctcccaaatcctccaaccagcactccaacgaccttttgggacagcggtg

SEQ ID NO: 417466 - DNA, 140 bp, Artificial Sequence
  Synthetic
caccgctgtcccaaaaggtcgttggagtgctggttggaggatttgggaggtcttcaacagtaagttcctgcagccgttgtacagccaaatcaagaggttcctcagttggcgaatcagaaacatatcagcagccagggcct

SEQ ID NO: 417467 - DNA, 140 bp, Artificial Sequence
  Synthetic
atacgccatgctgggtctccgaagcaatccaagcagcaacgagggctgcgagagagactcttgcgaacacaggaagagccctatggaaagctctcagaaggacagcggaagcaatcatcgcgtacttgggagtcggccat

SEQ ID NO: 417468 - DNA, 140 bp, Artificial Sequence
  Synthetic
atggccgactcccaagtacgcgatgattgcttccgctgtccttctgagagctttccatagggctcttcctgtgttcgcaagagtctctctcgcagccctcgttgctgcttggattgcttcggagacccagcatggcgtat

SEQ ID NO: 417469 - DNA, 140 bp, Artificial Sequence
  Synthetic
atacgccatgctgggtctccacgcaatgccccaagagcagaagggggagggcaacaagatacagatgatagtgatgaggataatgaagtgggggtctatgtaagacccaataggccactgcgtacttgggagtcggccat

SEQ ID NO: 417470 - DNA, 140 bp, Artificial Sequence
  Synthetic
atggccgactcccaagtacgcagtggcctattgggtcttacatagacccccacttcattatcctcatcactatcatctgtatcttgttgccctcccccttctgctcttggggcattgcgtggagacccagcatggcgtat

SEQ ID NO: 417471 - DNA, 140 bp, Artificial Sequence
  Synthetic
aggccctggctgctgatatggtgatgaggataatgaagtgggggtctatgtaagacccaataggccactgagatcaatgacatacaagatggcaatagacatgtctcattttataaaagagaccttttgggacagcggtg

SEQ ID NO: 417472 - DNA, 140 bp, Artificial Sequence
  Synthetic
caccgctgtcccaaaaggtctcttttataaaatgagacatgtctattgccatcttgtatgtcattgatctcagtggcctattgggtcttacatagacccccacttcattatcctcatcaccatatcagcagccagggcct

SEQ ID NO: 417473 - DNA, 140 bp, Artificial Sequence
  Synthetic
atacgccatgctgggtctccgattggcgcccgaacagggacttgaagaagagtgagagtcttcggagcacggttgagtgaaggcagtaagggcggcaggaatcaaccacgacggagagctcgtacttgggagtcggccat

SEQ ID NO: 417474 - DNA, 140 bp, Artificial Sequence
  Synthetic
atggccgactcccaagtacgagctctccgtcgtggttgattcctgccgcccttactgccttcactcaaccgtgctccgaagactctcactcttcttcaagtccctgttcgggcgccaatcggagacccagcatggcgtat

SEQ ID NO: 417475 - DNA, 140 bp, Artificial Sequence
  Synthetic
aggccctggctgctgatatgggttgagtgaaggcagtaagggcggcaggaatcaaccacgacggagagctcctgtaaaggcgcgggccggtaccaggcggcgtgaggagcgggaggaaaagaccttttgggacagcggtg

SEQ ID NO: 417476 - DNA, 140 bp, Artificial Sequence
  Synthetic
caccgctgtcccaaaaggtcttttcctcccgctcctcacgccgcctggtaccggcccgcgcctttacaggagctctccgtcgtggttgattcctgccgcccttactgccttcactcaacccatatcagcagccagggcct

SEQ ID NO: 417477 - DNA, 140 bp, Artificial Sequence
  Synthetic
atacgccatgctgggtctcccctgtaaaggcgcgggccggtaccaggcggcgtgaggagcgggaggaaaagaggcctccgggaggaaaggtgagtactccaaattttgaattgtctgctccgtacttgggagtcggccat

SEQ ID NO: 417478 - DNA, 140 bp, Artificial Sequence
  Synthetic
atggccgactcccaagtacggagcagacaattcaaaatttggagtactcacctttcctcccggaggcctcttttcctcccgctcctcacgccgcctggtaccggcccgcgcctttacaggggagacccagcatggcgtat

SEQ ID NO: 417479 - DNA, 140 bp, Artificial Sequence
  Synthetic
atacgccatgctgggtctcctgtcagggaagaaaacagatgaattagaaaaagttaggttacggcccggcggaaagaaaaagtattgtctaaagcatgtagtatgggcagtgaacgaattcgtacttgggagtcggccat

SEQ ID NO: 417480 - DNA, 140 bp, Artificial Sequence
  Synthetic
atggccgactcccaagtacgaattcgttcactgcccatactacatgctttagacaatactttttctttccgccgggccgtaacctaactttttctaattcatctgttttcttccctgacaggagacccagcatggcgtat

SEQ ID NO: 417481 - DNA, 140 bp, Artificial Sequence
  Synthetic
aggccctggctgctgatatgggaaagaaaaagtattgtctaaagcatgtagtatgggcagtgaacgaattggatagatatggattagcagagaccctgttggagtcaaaacaaggatgtcgaccttttgggacagcggtg

SEQ ID NO: 417482 - DNA, 140 bp, Artificial Sequence
  Synthetic
caccgctgtcccaaaaggtcgacatccttgttttgactccaacagggtctctgctaatccatatctatccaattcgttcactgcccatactacatgctttagacaatactttttctttcccatatcagcagccagggcct

SEQ ID NO: 417483 - DNA, 140 bp, Artificial Sequence
  Synthetic
aggccctggctgctgatatgagagaaagtgaaagatactgaggaagcaaaaaagatagcacagagccatctagcggtggacaaggaaaaaatgccagctacaagtagaccaacagcaccagaccttttgggacagcggtg

SEQ ID NO: 417484 - DNA, 140 bp, Artificial Sequence
  Synthetic
caccgctgtcccaaaaggtctggtgctgttggtctacttgtagctggcattttttccttgtccaccgctagatggctctgtgctatcttttttgcttcctcagtatctttcactttctctcatatcagcagccagggcct

SEQ ID NO: 417485 - DNA, 140 bp, Artificial Sequence
  Synthetic
atacgccatgctgggtctcccgtgccgctaagtccccgaaccctaaacgcctgggtaaaattagtggaggacaagaagttcggggcagaagtggtgccaggattccaagcactatcggaacgtacttgggagtcggccat

SEQ ID NO: 417486 - DNA, 140 bp, Artificial Sequence
  Synthetic
atggccgactcccaagtacgttccgatagtgcttggaatcctggcaccacttctgccccgaacttcttgtcctccactaattttacccaggcgtttagggttcggggacttagcggcacgggagacccagcatggcgtat

SEQ ID NO: 417487 - DNA, 140 bp, Artificial Sequence
  Synthetic
aggccctggctgctgatatgacaagaagttcggggcagaagtggtgccaggattccaagcactatcggaagggtgcaccccttacgatattaatcagatgctaaattgtgtaggagatcagaccttttgggacagcggtg

SEQ ID NO: 417488 - DNA, 140 bp, Artificial Sequence
  Synthetic
caccgctgtcccaaaaggtctgatctcctacacaatttagcatctgattaatatcgtaaggggtgcacccttccgatagtgcttggaatcctggcaccacttctgccccgaacttcttgtcatatcagcagccagggcct

SEQ ID NO: 417489 - DNA, 140 bp, Artificial Sequence
  Synthetic
atacgccatgctgggtctccaatcccaccaatatattagatgtaaaacaggggccgaaggagtccttccaaagctatgtagataggttctacaaaagcctacgggcagagcaaacggacccgtacttgggagtcggccat

SEQ ID NO: 417490 - DNA, 140 bp, Artificial Sequence
  Synthetic
atggccgactcccaagtacgggtccgtttgctctgcccgtaggcttttgtagaacctatctacatagctttggaaggactccttcggcccctgttttacatctaatatattggtgggattggagacccagcatggcgtat

SEQ ID NO: 417491 - DNA, 140 bp, Artificial Sequence
  Synthetic
aggccctggctgctgatatgaagctatgtagataggttctacaaaagcctacgggcagagcaaacggacccagcagtgaaaaattggatgacacagacactgctaattcagaatgccaacgaccttttgggacagcggtg

SEQ ID NO: 417492 - DNA, 140 bp, Artificial Sequence
  Synthetic
caccgctgtcccaaaaggtcgttggcattctgaattagcagtgtctgtgtcatccaatttttcactgctgggtccgtttgctctgcccgtaggcttttgtagaacctatctacatagcttcatatcagcagccagggcct

SEQ ID NO: 417493 - DNA, 140 bp, Artificial Sequence
  Synthetic
atacgccatgctgggtctccggaaatgctaacggcctgccaaggagtaggaggcccaggacaaaaggcaagactaatggctgaggccttaaaagaagccctaacacctgcacccataccgcgtacttgggagtcggccat

SEQ ID NO: 417494 - DNA, 140 bp, Artificial Sequence
  Synthetic
atggccgactcccaagtacgcggtatgggtgcaggtgttagggcttcttttaaggcctcagccattagtcttgccttttgtcctgggcctcctactccttggcaggccgttagcatttccggagacccagcatggcgtat

SEQ ID NO: 417495 - DNA, 140 bp, Artificial Sequence
  Synthetic
aggccctggctgctgatatggactaatggctgaggccttaaaagaagccctaacacctgcacccataccgtttgctgccgctcagcagaaagcaggaaagaggacaataacatgctggaagaccttttgggacagcggtg

SEQ ID NO: 417496 - DNA, 140 bp, Artificial Sequence
  Synthetic
caccgctgtcccaaaaggtcttccagcatgttattgtcctctttcctgctttctgctgagcggcagcaaacggtatgggtgcaggtgttagggcttcttttaaggcctcagccattagtccatatcagcagccagggcct

SEQ ID NO: 417497 - DNA, 140 bp, Artificial Sequence
  Synthetic
atacgccatgctgggtctccagggatgctggaaatgtgggaaaccaggacacgtcatgtcacaatgcccagatagacaggtgggttttttaggattcggaccctggggaaagaagcctcgcgtacttgggagtcggccat

SEQ ID NO: 417498 - DNA, 140 bp, Artificial Sequence
  Synthetic
atggccgactcccaagtacgcgaggcttctttccccagggtccgaatcctaaaaaacccacctgtctatctgggcattgtgacatgacgtgtcctggtttcccacatttccagcatccctggagacccagcatggcgtat

SEQ ID NO: 417499 - DNA, 140 bp, Artificial Sequence
  Synthetic
aggccctggctgctgatatggatagacaggtgggttttttaggattcggaccctggggaaagaagcctcgcaacttccccatggcccaagtgcctcagagggtgacaccatctgcaccccgaccttttgggacagcggtg

SEQ ID NO: 417500 - DNA, 140 bp, Artificial Sequence
  Synthetic
caccgctgtcccaaaaggtcggggtgcagatggtgtcaccctctgaggcacttgggccatggggaagttgcgaggcttctttccccagggtccgaatcctaaaaaacccacctgtctatccatatcagcagccagggcct

SEQ ID NO: 417501 - DNA, 140 bp, Artificial Sequence
  Synthetic
atacgccatgctgggtctccccccctgcagatccagcagtggagatgctgaaaaactacatgcagctagggaagcagcagagagagagccgagagagaccctacaaggaggtgacagaggcgtacttgggagtcggccat

SEQ ID NO: 417502 - DNA, 140 bp, Artificial Sequence
  Synthetic
atggccgactcccaagtacgcctctgtcacctccttgtagggtctctctcggctctctctctgctgcttccctagctgcatgtagtttttcagcatctccactgctggatctgcagggggggagacccagcatggcgtat

SEQ ID NO: 417503 - DNA, 140 bp, Artificial Sequence
  Synthetic
aggccctggctgctgatatggaagcagcagagagagagccgagagagaccctacaaggaggtgacagaggacttgctgcacctcaattctctctttggagaagaccagtagtcaaagcaagaccttttgggacagcggtg

SEQ ID NO: 417504 - DNA, 140 bp, Artificial Sequence
  Synthetic
caccgctgtcccaaaaggtcttgctttgactactggtcttctccaaagagagaattgaggtgcagcaagtcctctgtcacctccttgtagggtctctctcggctctctctctgctgcttccatatcagcagccagggcct

SEQ ID NO: 417505 - DNA, 140 bp, Artificial Sequence
  Synthetic
atacgccatgctgggtctcctcaatagtagcaggaatagaattaggtagtaattacaccccaaaaatagtaggaggaataggaggattcataaatactaaagagtacaaagatgtagaaacgtacttgggagtcggccat

SEQ ID NO: 417506 - DNA, 140 bp, Artificial Sequence
  Synthetic
atggccgactcccaagtacgtttctacatctttgtactctttagtatttatgaatcctcctattcctcctactatttttggggtgtaattactacctaattctattcctgctactattgaggagacccagcatggcgtat

SEQ ID NO: 417507 - DNA, 140 bp, Artificial Sequence
  Synthetic
aggccctggctgctgatatgaggaggaataggaggattcataaatactaaagagtacaaagatgtagaaatagaagtattagggaaaagggtaagagcaactataatgacaggagacaccgaccttttgggacagcggtg

SEQ ID NO: 417508 - DNA, 140 bp, Artificial Sequence
  Synthetic
caccgctgtcccaaaaggtcggtgtctcctgtcattatagttgctcttacccttttccctaatacttctatttctacatctttgtactctttagtatttatgaatcctcctattcctcctcatatcagcagccagggcct

SEQ ID NO: 417509 - DNA, 140 bp, Artificial Sequence
  Synthetic
atacgccatgctgggtctccaaatttcccagtagcaaaaatagaaccagtaaaagtcaaactgaagcctgggaaagatggaccaaaaatcagacaatggcccctatccaaagaaaagatacgtacttgggagtcggccat

SEQ ID NO: 417510 - DNA, 140 bp, Artificial Sequence
  Synthetic
atggccgactcccaagtacgtatcttttctttggataggggccattgtctgatttttggtccatctttcccaggcttcagtttgacttttactggttctatttttgctactgggaaatttggagacccagcatggcgtat

SEQ ID NO: 417511 - DNA, 140 bp, Artificial Sequence
  Synthetic
aggccctggctgctgatatgggaaagatggaccaaaaatcagacaatggcccctatccaaagaaaagatactggccctcaaggaaatctgtgaaaaaatggaaaaggagggacagctagagaccttttgggacagcggtg

SEQ ID NO: 417512 - DNA, 140 bp, Artificial Sequence
  Synthetic
caccgctgtcccaaaaggtctctagctgtccctccttttccattttttcacagatttccttgagggccagtatcttttctttggataggggccattgtctgatttttggtccatctttcccatatcagcagccagggcct

SEQ ID NO: 417513 - DNA, 140 bp, Artificial Sequence
  Synthetic
atacgccatgctgggtctccagaaagataaaaacaaatggagaatgctaatagattttagagagttaaacaaggtaacccaagactttacagaagtccagctgggtattccccacccggccgtacttgggagtcggccat

SEQ ID NO: 417514 - DNA, 140 bp, Artificial Sequence
  Synthetic
atggccgactcccaagtacggccgggtggggaatacccagctggacttctgtaaagtcttgggttaccttgtttaactctctaaaatctattagcattctccatttgtttttatctttctggagacccagcatggcgtat

SEQ ID NO: 417515 - DNA, 140 bp, Artificial Sequence
  Synthetic
aggccctggctgctgatatgaaggtaacccaagactttacagaagtccagctgggtattccccacccggctgggctggcagaaaaaagaagaataacagtattagatgtaggagatgcctgaccttttgggacagcggtg

SEQ ID NO: 417516 - DNA, 140 bp, Artificial Sequence
  Synthetic
caccgctgtcccaaaaggtcaggcatctcctacatctaatactgttattcttcttttttctgccagcccagccgggtggggaatacccagctggacttctgtaaagtcttgggttaccttcatatcagcagccagggcct

SEQ ID NO: 417517 - DNA, 140 bp, Artificial Sequence
  Synthetic
atacgccatgctgggtctccttgccaccagtgaataattcaggaccaggaaaaagatacatttataaggtcctaccacaaggttggaaggggtccccagcaatttttcaatacaccatggcgtacttgggagtcggccat

SEQ ID NO: 417518 - DNA, 140 bp, Artificial Sequence
  Synthetic
atggccgactcccaagtacgccatggtgtattgaaaaattgctggggaccccttccaaccttgtggtaggaccttataaatgtatctttttcctggtcctgaattattcactggtggcaaggagacccagcatggcgtat

SEQ ID NO: 417519 - DNA, 140 bp, Artificial Sequence
  Synthetic
aggccctggctgctgatatgcctaccacaaggttggaaggggtccccagcaatttttcaatacaccatggggaaggtactagaccccttcagaaaagccaacgatgatgtcaccatagtcgaccttttgggacagcggtg

SEQ ID NO: 417520 - DNA, 140 bp, Artificial Sequence
  Synthetic
caccgctgtcccaaaaggtcgactatggtgacatcatcgttggcttttctgaaggggtctagtaccttccccatggtgtattgaaaaattgctggggaccccttccaaccttgtggtaggcatatcagcagccagggcct

SEQ ID NO: 417521 - DNA, 140 bp, Artificial Sequence
  Synthetic
atacgccatgctgggtctcctgacagggtagtatctcaactaaaacaactattaaatgacatgggattctctaccccagaagagaagttccaaaaagaccccccattcaaatggatggggcgtacttgggagtcggccat

SEQ ID NO: 417522 - DNA, 140 bp, Artificial Sequence
  Synthetic
atggccgactcccaagtacgccccatccatttgaatggggggtctttttggaacttctcttctggggtagagaatcccatgtcatttaatagttgttttagttgagatactaccctgtcaggagacccagcatggcgtat

SEQ ID NO: 417523 - DNA, 140 bp, Artificial Sequence
  Synthetic
aggccctggctgctgatatgctaccccagaagagaagttccaaaaagaccccccattcaaatggatggggtatgagctctggccaaaaaagtggaaactgcaaaaaatacagctaccagagaccttttgggacagcggtg

SEQ ID NO: 417524 - DNA, 140 bp, Artificial Sequence
  Synthetic
caccgctgtcccaaaaggtctctggtagctgtattttttgcagtttccacttttttggccagagctcataccccatccatttgaatggggggtctttttggaacttctcttctggggtagcatatcagcagccagggcct

SEQ ID NO: 417525 - DNA, 140 bp, Artificial Sequence
  Synthetic
atacgccatgctgggtctccactgggcatctcagctttttccaggaattaagacaaggaacatatgcaaattaatcagaggaaagatgaccctaacagaagaagtacagtggacagaactcgtacttgggagtcggccat

SEQ ID NO: 417526 - DNA, 140 bp, Artificial Sequence
  Synthetic
atggccgactcccaagtacgagttctgtccactgtacttcttctgttagggtcatctttcctctgattaatttgcatatgttccttgtcttaattcctggaaaaagctgagatgcccagtggagacccagcatggcgtat

SEQ ID NO: 417527 - DNA, 140 bp, Artificial Sequence
  Synthetic
aggccctggctgctgatatgttaatcagaggaaagatgaccctaacagaagaagtacagtggacagaactggcagaggcagaacttcaggaaaataaaatcatcctagagcaggaacagggaccttttgggacagcggtg

SEQ ID NO: 417528 - DNA, 140 bp, Artificial Sequence
  Synthetic
caccgctgtcccaaaaggtccctgttcctgctctaggatgattttattttcctgaagttctgcctctgccagttctgtccactgtacttcttctgttagggtcatctttcctctgattaacatatcagcagccagggcct

SEQ ID NO: 417529 - DNA, 140 bp, Artificial Sequence
  Synthetic
atacgccatgctgggtctccaatctagcaaaccagtggacatacaaaattcatcaggggaataggaccctgaaagtaggaaaatatgcaaaggttaaaaacacccataccaatggagtgacgtacttgggagtcggccat

SEQ ID NO: 417530 - DNA, 140 bp, Artificial Sequence
  Synthetic
atggccgactcccaagtacgtcactccattggtatgggtgtttttaacctttgcatattttcctactttcagggtcctattcccctgatgaattttgtatgtccactggtttgctagattggagacccagcatggcgtat

SEQ ID NO: 417531 - DNA, 140 bp, Artificial Sequence
  Synthetic
aggccctggctgctgatatggaaagtaggaaaatatgcaaaggttaaaaacacccataccaatggagtgagactactggcgcatgtggtccagaaaataggaaaagaagcattagttatcgaccttttgggacagcggtg

SEQ ID NO: 417532 - DNA, 140 bp, Artificial Sequence
  Synthetic
caccgctgtcccaaaaggtcgataactaatgcttcttttcctattttctggaccacatgcgccagtagtctcactccattggtatgggtgtttttaacctttgcatattttcctactttccatatcagcagccagggcct

SEQ ID NO: 417533 - DNA, 140 bp, Artificial Sequence
  Synthetic
atacgccatgctgggtctcctcagtggtggacagactactggcaggtaacttggatcccagaatgggattttatttcaaccccaccattagtaagactagcctacaacctagtcaaggaccgtacttgggagtcggccat

SEQ ID NO: 417534 - DNA, 140 bp, Artificial Sequence
  Synthetic
atggccgactcccaagtacggtccttgactaggttgtaggctagtcttactaatggtggggttgaaataaaatcccattctgggatccaagttacctgccagtagtctgtccaccactgaggagacccagcatggcgtat

SEQ ID NO: 417535 - DNA, 140 bp, Artificial Sequence
  Synthetic
aggccctggctgctgatatgttatttcaaccccaccattagtaagactagcctacaacctagtcaaggaccccctagaaaaggtggaaacctactacacagatgggtcctgcaacagagcgaccttttgggacagcggtg

SEQ ID NO: 417536 - DNA, 140 bp, Artificial Sequence
  Synthetic
caccgctgtcccaaaaggtcgctctgttgcaggacccatctgtgtagtaggtttccaccttttctagggggtccttgactaggttgtaggctagtcttactaatggtggggttgaaataacatatcagcagccagggcct

SEQ ID NO: 417537 - DNA, 140 bp, Artificial Sequence
  Synthetic
atacgccatgctgggtctcctgaaagtgctagagcaaacaacaaatcaacaagcagaacttgaagcatttgcactagcactacaggattcaggaccacaagtcaacatcatagtagactccgtacttgggagtcggccat

SEQ ID NO: 417538 - DNA, 140 bp, Artificial Sequence
  Synthetic
atggccgactcccaagtacggagtctactatgatgttgacttgtggtcctgaatcctgtagtgctagtgcaaatgcttcaagttctgcttgttgatttgttgtttgctctagcactttcaggagacccagcatggcgtat

SEQ ID NO: 417539 - DNA, 140 bp, Artificial Sequence
  Synthetic
aggccctggctgctgatatggcactagcactacaggattcaggaccacaagtcaacatcatagtagactcacaatatgtcatgggaataatagctggacaaccaacagaaacagactcacgaccttttgggacagcggtg

SEQ ID NO: 417540 - DNA, 140 bp, Artificial Sequence
  Synthetic
caccgctgtcccaaaaggtcgtgagtctgtttctgttggttgtccagctattattcccatgacatattgtgagtctactatgatgttgacttgtggtcctgaatcctgtagtgctagtgccatatcagcagccagggcct

SEQ ID NO: 417541 - DNA, 140 bp, Artificial Sequence
  Synthetic
atacgccatgctgggtctccgtaggatgggtgccagctcacaaaggactaggtggtaatcaggaagtagaccacctagtaagtcagggaatcaggcaggttctattcctagaaaagatagcgtacttgggagtcggccat

SEQ ID NO: 417542 - DNA, 140 bp, Artificial Sequence
  Synthetic
atggccgactcccaagtacgctatcttttctaggaatagaacctgcctgattccctgacttactaggtggtctacttcctgattaccacctagtcctttgtgagctggcacccatcctacggagacccagcatggcgtat

SEQ ID NO: 417543 - DNA, 140 bp, Artificial Sequence
  Synthetic
aggccctggctgctgatatgccacctagtaagtcagggaatcaggcaggttctattcctagaaaagatagaaccagcacaagaagaacatgaaaaataccatggcaatgtaaaagaactagaccttttgggacagcggtg

SEQ ID NO: 417544 - DNA, 140 bp, Artificial Sequence
  Synthetic
caccgctgtcccaaaaggtctagttcttttacattgccatggtatttttcatgttcttcttgtgctggttctatcttttctaggaatagaacctgcctgattccctgacttactaggtggcatatcagcagccagggcct

SEQ ID NO: 417545 - DNA, 140 bp, Artificial Sequence
  Synthetic
atacgccatgctgggtctccctgtgataaatgccaacaaaaaggggaagctattcatggacaggtaaatgcagaactaggaacatggcagatggactgtacacacttagaaggaaaggtccgtacttgggagtcggccat

SEQ ID NO: 417546 - DNA, 140 bp, Artificial Sequence
  Synthetic
atggccgactcccaagtacggacctttccttctaagtgtgtacagtccatctgccatgttcctagttctgcatttacctgtccatgaatagcttcccctttttgttggcatttatcacagggagacccagcatggcgtat

SEQ ID NO: 417547 - DNA, 140 bp, Artificial Sequence
  Synthetic
aggccctggctgctgatatgcagaactaggaacatggcagatggactgtacacacttagaaggaaaggtcataatagtggcagtccatgtagccagtgggttcatagaggcagaggtaatgaccttttgggacagcggtg

SEQ ID NO: 417548 - DNA, 140 bp, Artificial Sequence
  Synthetic
caccgctgtcccaaaaggtcattacctctgcctctatgaacccactggctacatggactgccactattatgacctttccttctaagtgtgtacagtccatctgccatgttcctagttctgcatatcagcagccagggcct

SEQ ID NO: 417549 - DNA, 140 bp, Artificial Sequence
  Synthetic
atacgccatgctgggtctccgcagatggcctatcacacacctgcacacagacaatggcgccaacttcacctcacaagatgtgaagatggtggcctggtgggtagggatagagcaatccttcgtacttgggagtcggccat

SEQ ID NO: 417550 - DNA, 140 bp, Artificial Sequence
  Synthetic
atggccgactcccaagtacgaaggattgctctatccctacccaccaggccaccatcttcacatcttgtgaggtgaagttggcgccattgtctgtgtgcaggtgtgtgataggccatctgcggagacccagcatggcgtat

SEQ ID NO: 417551 - DNA, 140 bp, Artificial Sequence
  Synthetic
atacgccatgctgggtctccatcacctaaaaaatcaaatagatagaatcagggaccaagcagtatcaatagagacagttgtgctaatggcagctcactgcatgaattttaaaagaaggggcgtacttgggagtcggccat

SEQ ID NO: 417552 - DNA, 140 bp, Artificial Sequence
  Synthetic
atggccgactcccaagtacgccccttcttttaaaattcatgcagtgagctgccattagcacaactgtctctattgatactgcttggtccctgattctatctatttgattttttaggtgatggagacccagcatggcgtat

SEQ ID NO: 417553 - DNA, 140 bp, Artificial Sequence
  Synthetic
atacgccatgctgggtctcctgagctattgtggaaaggggaaggagcagtcctcgtaaaggtagggacagagatcaaagtaatacccagaagaaaagcaaagatcataaggcactatggacgtacttgggagtcggccat

SEQ ID NO: 417554 - DNA, 140 bp, Artificial Sequence
  Synthetic
atggccgactcccaagtacgtccatagtgccttatgatctttgcttttcttctgggtattactttgatctctgtccctacctttacgaggactgctccttcccctttccacaatagctcaggagacccagcatggcgtat

SEQ ID NO: 417555 - DNA, 140 bp, Artificial Sequence
  Synthetic
atacgccatgctgggtctcctagagagatggcacagtctggtcaagtacctgaagcatagaacaaaagagttgcaacaggtctcttatgtcccccaccacaaggtaggatgggcctggtgcgtacttgggagtcggccat

SEQ ID NO: 417556 - DNA, 140 bp, Artificial Sequence
  Synthetic
atggccgactcccaagtacgcaccaggcccatcctaccttgtggtgggggacataagagacctgttgcaactcttttgttctatgcttcaggtacttgaccagactgtgccatctctctaggagacccagcatggcgtat

SEQ ID NO: 417557 - DNA, 140 bp, Artificial Sequence
  Synthetic
atacgccatgctgggtctcctccaggggtattggaatctgaccccggaaaggggactcttaagttcctatgctgtgagaataacatggtacagagagagcttttacacagatgtaacacccgtacttgggagtcggccat

SEQ ID NO: 417558 - DNA, 140 bp, Artificial Sequence
  Synthetic
atggccgactcccaagtacgggtgttacatctgtgtaaaagctctctctgtaccatgttattctcacagcataggaacttaagagtcccctttccggggtcagattccaatacccctggaggagacccagcatggcgtat

SEQ ID NO: 417559 - DNA, 140 bp, Artificial Sequence
  Synthetic
aggccctggctgctgatatgccaatgaagtaaggagagccatcaggggagaaaagatattgtcctactgcaactatccatcagcccacgacaggcaggtaccaagtttacagtttctagcgaccttttgggacagcggtg

SEQ ID NO: 417560 - DNA, 140 bp, Artificial Sequence
  Synthetic
caccgctgtcccaaaaggtcgctagaaactgtaaacttggtacctgcctgtcgtgggctgatggatagttgcagtaggacaatatcttttctcccctgatggctctccttacttcattggcatatcagcagccagggcct

SEQ ID NO: 417561 - DNA, 140 bp, Artificial Sequence
  Synthetic
atacgccatgctgggtctccccaggaaacagcgacgaggagacagtaggagaggcattcgcatggctagaaagaacactagcagaactcaacaaggaagcagtcaatcatttgccccgagcgtacttgggagtcggccat

SEQ ID NO: 417562 - DNA, 140 bp, Artificial Sequence
  Synthetic
atggccgactcccaagtacgctcggggcaaatgattgactgcttccttgttgagttctgctagtgttctttctagccatgcgaatgcctctcctactgtctcctcgtcgctgtttcctggggagacccagcatggcgtat

SEQ ID NO: 417563 - DNA, 140 bp, Artificial Sequence
  Synthetic
atacgccatgctgggtctccaactcattttccaggtctggcaaaagtcttgggcatattggcgtgatgagcagggcatgtccattagctacaccaaatataggtacttgcttctaatgcacgtacttgggagtcggccat

SEQ ID NO: 417564 - DNA, 140 bp, Artificial Sequence
  Synthetic
atggccgactcccaagtacgtgcattagaagcaagtacctatatttggtgtagctaatggacatgccctgctcatcacgccaatatgcccaagacttttgccagacctggaaaatgagttggagacccagcatggcgtat

SEQ ID NO: 417565 - DNA, 140 bp, Artificial Sequence
  Synthetic
aggccctggctgctgatatgggcctagcctaatggcagaagcagccccagagactcctccagagaatgaggacccacagagagagccatgggaagagtgggtagaggacgtcctggaggagaccttttgggacagcggtg

SEQ ID NO: 417566 - DNA, 140 bp, Artificial Sequence
  Synthetic
caccgctgtcccaaaaggtctcctccaggacgtcctctacccactcttcccatggctctctctgtgggtcctcattctctggaggagtctctggggctgcttctgccattaggctaggcccatatcagcagccagggcct

SEQ ID NO: 417567 - DNA, 140 bp, Artificial Sequence
  Synthetic
atacgccatgctgggtctccttggtaattttatctacagtaggcatggagataccctcgcaggagcaggagaactcattaagattctccaacgagcgctcttcctccacttcaggggaggcgtacttgggagtcggccat

SEQ ID NO: 417568 - DNA, 140 bp, Artificial Sequence
  Synthetic
atggccgactcccaagtacgcctcccctgaagtggaggaagagcgctcgttggagaatcttaatgagttctcctgctcctgcgagggtatctccatgcctactgtagataaaattaccaaggagacccagcatggcgtat

SEQ ID NO: 417569 - DNA, 140 bp, Artificial Sequence
  Synthetic
aggccctggctgctgatatggaactcattaagattctccaacgagcgctcttcctccacttcaggggagggtgccagcactcaaggattggacaaccagggggaggaaatcctctctcaggaccttttgggacagcggtg

SEQ ID NO: 417570 - DNA, 140 bp, Artificial Sequence
  Synthetic
caccgctgtcccaaaaggtcctgagagaggatttcctccccctggttgtccaatccttgagtgctggcaccctcccctgaagtggaggaagagcgctcgttggagaatcttaatgagttccatatcagcagccagggcct

SEQ ID NO: 417571 - DNA, 140 bp, Artificial Sequence
  Synthetic
atacgccatgctgggtctccctgtttccattgccagttttgtttccttaaaaagggcctggggatatggtatgaccactcgagaaaaagatcttcaaaaagggctaaggttactgcatctcgtacttgggagtcggccat

SEQ ID NO: 417572 - DNA, 140 bp, Artificial Sequence
  Synthetic
atggccgactcccaagtacgagatgcagtaaccttagccctttttgaagatctttttctcgagtggtcataccatatccccaggccctttttaaggaaacaaaactggcaatggaaacagggagacccagcatggcgtat

SEQ ID NO: 417573 - DNA, 140 bp, Artificial Sequence
  Synthetic
aggccctggctgctgatatgatgaccactcgagaaaaagatcttcaaaaagggctaaggttactgcatcttctgcaccagacgagtgagtatggcacacattaacagtcacctgcttattgaccttttgggacagcggtg

SEQ ID NO: 417574 - DNA, 140 bp, Artificial Sequence
  Synthetic
caccgctgtcccaaaaggtcaataagcaggtgactgttaatgtgtgccatactcactcgtctggtgcagaagatgcagtaaccttagccctttttgaagatctttttctcgagtggtcatcatatcagcagccagggcct

SEQ ID NO: 417575 - DNA, 140 bp, Artificial Sequence
  Synthetic
atacgccatgctgggtctcctgtcttttatggcatacctgcatggaggaacgcaacggttcctctcttctgtgcaaccgcaaacagggatacctggggaactgtgcagtgcctcccagatcgtacttgggagtcggccat

SEQ ID NO: 417576 - DNA, 140 bp, Artificial Sequence
  Synthetic
atggccgactcccaagtacgatctgggaggcactgcacagttccccaggtatccctgtttgcggttgcacagaagagaggaaccgttgcgttcctccatgcaggtatgccataaaagacaggagacccagcatggcgtat

SEQ ID NO: 417577 - DNA, 140 bp, Artificial Sequence
  Synthetic
aggccctggctgctgatatggtgcaaccgcaaacagggatacctggggaactgtgcagtgcctcccagatagtggtgattacaccgagatcagtgtgaatataacagaggcttttgatgcgaccttttgggacagcggtg

SEQ ID NO: 417578 - DNA, 140 bp, Artificial Sequence
  Synthetic
caccgctgtcccaaaaggtcgcatcaaaagcctctgttatattcacactgatctcggtgtaatcaccactatctgggaggcactgcacagttccccaggtatccctgtttgcggttgcaccatatcagcagccagggcct

SEQ ID NO: 417579 - DNA, 140 bp, Artificial Sequence
  Synthetic
atacgccatgctgggtctccttgaaacctccctaaaaccatgtgttaagctgacgccgctatgtgtggcaatgaattgttctacaaataacacaagaactaacaatactactgcatctaccgtacttgggagtcggccat

SEQ ID NO: 417580 - DNA, 140 bp, Artificial Sequence
  Synthetic
atggccgactcccaagtacggtagatgcagtagtattgttagttcttgtgttatttgtagaacaattcattgccacacatagcggcgtcagcttaacacatggttttagggaggtttcaaggagacccagcatggcgtat

SEQ ID NO: 417581 - DNA, 140 bp, Artificial Sequence
  Synthetic
aggccctggctgctgatatgatgaattgttctacaaataacacaagaactaacaatactactgcatctactactactggtaattctactacaccaatagtagtcaatgaagcaattccatgaccttttgggacagcggtg

SEQ ID NO: 417582 - DNA, 140 bp, Artificial Sequence
  Synthetic
caccgctgtcccaaaaggtcatggaattgcttcattgactactattggtgtagtagaattaccagtagtagtagatgcagtagtattgttagttcttgtgttatttgtagaacaattcatcatatcagcagccagggcct

SEQ ID NO: 417583 - DNA, 140 bp, Artificial Sequence
  Synthetic
atacgccatgctgggtctcctgtacctttaacatgacaggactaagacaagatgagagaaaacaatataatgacacctggtacaggagagatttagagtgcgagggtaccagatgttacacgtacttgggagtcggccat

SEQ ID NO: 417584 - DNA, 140 bp, Artificial Sequence
  Synthetic
atggccgactcccaagtacgtgtaacatctggtaccctcgcactctaaatctctcctgtaccaggtgtcattatattgttttctctcatcttgtcttagtcctgtcatgttaaaggtacaggagacccagcatggcgtat

SEQ ID NO: 417585 - DNA, 140 bp, Artificial Sequence
  Synthetic
aggccctggctgctgatatgtgacacctggtacaggagagatttagagtgcgagggtaccagatgttacatgagaacttgtaatacatcagtgatccaagagtcatgtgataaacattacgaccttttgggacagcggtg

SEQ ID NO: 417586 - DNA, 140 bp, Artificial Sequence
  Synthetic
caccgctgtcccaaaaggtcgtaatgtttatcacatgactcttggatcactgatgtattacaagttctcatgtaacatctggtaccctcgcactctaaatctctcctgtaccaggtgtcacatatcagcagccagggcct

SEQ ID NO: 417587 - DNA, 140 bp, Artificial Sequence
  Synthetic
atacgccatgctgggtctccgagatgtaatgataccaactattcaggcttcatgcacaactgtagtaaagtagtagtgtcctcttgcacaagaatgatggagacacagacctccacatggcgtacttgggagtcggccat

SEQ ID NO: 417588 - DNA, 140 bp, Artificial Sequence
  Synthetic
atggccgactcccaagtacgccatgtggaggtctgtgtctccatcattcttgtgcaagaggacactactactttactacagttgtgcatgaagcctgaatagttggtatcattacatctcggagacccagcatggcgtat

SEQ ID NO: 417589 - DNA, 140 bp, Artificial Sequence
  Synthetic
aggccctggctgctgatatgtagtagtgtcctcttgcacaagaatgatggagacacagacctccacatggtttggcttcaatggtacaagagcagaaaacaggacatatatgtattggcagaccttttgggacagcggtg

SEQ ID NO: 417590 - DNA, 140 bp, Artificial Sequence
  Synthetic
caccgctgtcccaaaaggtctgccaatacatatatgtcctgttttctgctcttgtaccattgaagccaaaccatgtggaggtctgtgtctccatcattcttgtgcaagaggacactactacatatcagcagccagggcct

SEQ ID NO: 417591 - DNA, 140 bp, Artificial Sequence
  Synthetic
atacgccatgctgggtctcccaatgcattgcagaaggccagggaacaagacagtcctaccaataacaatcatgtcagggcgaagattccattcgcggcctgttatcaatgagagacccagcgtacttgggagtcggccat

SEQ ID NO: 417592 - DNA, 140 bp, Artificial Sequence
  Synthetic
atggccgactcccaagtacgctgggtctctcattgataacaggccgcgaatggaatcttcgccctgacatgattgttattggtaggactgtcttgttccctggccttctgcaatgcattgggagacccagcatggcgtat

SEQ ID NO: 417593 - DNA, 140 bp, Artificial Sequence
  Synthetic
aggccctggctgctgatatgatgtcagggcgaagattccattcgcggcctgttatcaatgagagacccagacaggcttggtgctggtttgagggaaactggacagaggccatgagggagggaccttttgggacagcggtg

SEQ ID NO: 417594 - DNA, 140 bp, Artificial Sequence
  Synthetic
caccgctgtcccaaaaggtccctccctcatggcctctgtccagtttccctcaaaccagcaccaagcctgtctgggtctctcattgataacaggccgcgaatggaatcttcgccctgacatcatatcagcagccagggcct

SEQ ID NO: 417595 - DNA, 140 bp, Artificial Sequence
  Synthetic
atacgccatgctgggtctccacgaaaataaatttggtagggccctcggcaggttcagacccagaggcaagatatatgtggactaactgtaggggagaattcttctattgtaacatgacatcgtacttgggagtcggccat

SEQ ID NO: 417596 - DNA, 140 bp, Artificial Sequence
  Synthetic
atggccgactcccaagtacgatgtcatgttacaatagaagaattctcccctacagttagtccacatatatcttgcctctgggtctgaacctgccgagggccctaccaaatttattttcgtggagacccagcatggcgtat

SEQ ID NO: 417597 - DNA, 140 bp, Artificial Sequence
  Synthetic
aggccctggctgctgatatgatatatgtggactaactgtaggggagaattcttctattgtaacatgacatggtttttaaactgggtagaaggcaaaaatggaaccaaaagaaattatgtggaccttttgggacagcggtg

SEQ ID NO: 417598 - DNA, 140 bp, Artificial Sequence
  Synthetic
caccgctgtcccaaaaggtccacataatttcttttggttccatttttgccttctacccagtttaaaaaccatgtcatgttacaatagaagaattctcccctacagttagtccacatatatcatatcagcagccagggcct

SEQ ID NO: 417599 - DNA, 140 bp, Artificial Sequence
  Synthetic
atacgccatgctgggtctcccgtatatttgcctccaagggagggcctgctctcctgtaactccactgtcaccagtattatagccaacattgaatggattgatagcaacgagaccaatattcgtacttgggagtcggccat

SEQ ID NO: 417600 - DNA, 140 bp, Artificial Sequence
  Synthetic
atggccgactcccaagtacgaatattggtctcgttgctatcaatccattcaatgttggctataatactggtgacagtggagttacaggagagcaggccctcccttggaggcaaatatacgggagacccagcatggcgtat

SEQ ID NO: 417601 - DNA, 140 bp, Artificial Sequence
  Synthetic
aggccctggctgctgatatgccagtattatagccaacattgaatggattgatagcaacgagaccaatattaccatgagtgcagaagtgggagaactgtatagattggaactgggggactagaccttttgggacagcggtg

SEQ ID NO: 417602 - DNA, 140 bp, Artificial Sequence
  Synthetic
caccgctgtcccaaaaggtctagtcccccagttccaatctatacagttctcccacttctgcactcatggtaatattggtctcgttgctatcaatccattcaatgttggctataatactggcatatcagcagccagggcct

SEQ ID NO: 417603 - DNA, 140 bp, Artificial Sequence
  Synthetic
atacgccatgctgggtctccgatattcctcagcaacaccgaggaataggagaggtgtaatggtgctagggttcctgggatttctggcaacggcaggttctgcaatgggcgcagcgtccttcgtacttgggagtcggccat

SEQ ID NO: 417604 - DNA, 140 bp, Artificial Sequence
  Synthetic
atggccgactcccaagtacgaaggacgctgcgcccattgcagaacctgccgttgccagaaatcccaggaaccctagcaccattacacctctcctattcctcggtgttgctgaggaatatcggagacccagcatggcgtat

SEQ ID NO: 417605 - DNA, 140 bp, Artificial Sequence
  Synthetic
aggccctggctgctgatatgttcctgggatttctggcaacggcaggttctgcaatgggcgcagcgtccttgacgctgtcagctcagtcccggactttattggctgggatagtgcagcagcgaccttttgggacagcggtg

SEQ ID NO: 417606 - DNA, 140 bp, Artificial Sequence
  Synthetic
caccgctgtcccaaaaggtcgctgctgcactatcccagccaataaagtccgggactgagctgacagcgtcaaggacgctgcgcccattgcagaacctgccgttgccagaaatcccaggaacatatcagcagccagggcct

SEQ ID NO: 417607 - DNA, 140 bp, Artificial Sequence
  Synthetic
atacgccatgctgggtctccaccgtctgggggacgaaaaacctccagtcaagagtcactgccatcgagaaatacctaaaggaccaggcactgctaaattcgtggggatgtgcttttagaccgtacttgggagtcggccat

SEQ ID NO: 417608 - DNA, 140 bp, Artificial Sequence
  Synthetic
atggccgactcccaagtacggtctaaaagcacatccccacgaatttagcagtgcctggtcctttaggtatttctcgatggcagtgactcttgactggaggtttttcgtcccccagacggtggagacccagcatggcgtat

SEQ ID NO: 417609 - DNA, 140 bp, Artificial Sequence
  Synthetic
aggccctggctgctgatatgatacctaaaggaccaggcactgctaaattcgtggggatgtgcttttagacaggtctgtcacacgactgtaccatggccaaatgaatctctcacacccaacgaccttttgggacagcggtg

SEQ ID NO: 417610 - DNA, 140 bp, Artificial Sequence
  Synthetic
caccgctgtcccaaaaggtcgttgggtgtgagagattcatttggccatggtacagtcgtgtgacagacctgtctaaaagcacatccccacgaatttagcagtgcctggtcctttaggtatcatatcagcagccagggcct

SEQ ID NO: 417611 - DNA, 140 bp, Artificial Sequence
  Synthetic
atacgccatgctgggtctcctgcaaatataacacaattattagaagaggcacagatacagcaggaaaagaatatgtatgagctacagaaattgaatcattgggatgtttttagtaattggcgtacttgggagtcggccat

SEQ ID NO: 417612 - DNA, 140 bp, Artificial Sequence
  Synthetic
atggccgactcccaagtacgccaattactaaaaacatcccaatgattcaatttctgtagctcatacatattcttttcctgctgtatctgtgcctcttctaataattgtgttatatttgcaggagacccagcatggcgtat

SEQ ID NO: 417613 - DNA, 140 bp, Artificial Sequence
  Synthetic
aggccctggctgctgatatgatatgtatgagctacagaaattgaatcattgggatgtttttagtaattggtttgacttcacctcctggatggcatacatcaggttaggactgtatgtagtgaccttttgggacagcggtg

SEQ ID NO: 417614 - DNA, 140 bp, Artificial Sequence
  Synthetic
caccgctgtcccaaaaggtcactacatacagtcctaacctgatgtatgccatccaggaggtgaagtcaaaccaattactaaaaacatcccaatgattcaatttctgtagctcatacatatcatatcagcagccagggcct

SEQ ID NO: 417615 - DNA, 140 bp, Artificial Sequence
  Synthetic
atacgccatgctgggtctcccaaggcttaggaagggctataggccagtattctcctcccctccctcttatactcaacagatccctatccacaagcaccggggacagccagccaacgaagacgtacttgggagtcggccat

SEQ ID NO: 417616 - DNA, 140 bp, Artificial Sequence
  Synthetic
atggccgactcccaagtacgtcttcgttggctggctgtccccggtgcttgtggatagggatctgttgagtataagagggaggggaggagaatactggcctatagcccttcctaagccttgggagacccagcatggcgtat

SEQ ID NO: 417617 - DNA, 140 bp, Artificial Sequence
  Synthetic
aggccctggctgctgatatgactcaacagatccctatccacaagcaccggggacagccagccaacgaagaaacagaagacgaaggtggaagagaaggggattacagatcttggccctggcgaccttttgggacagcggtg

SEQ ID NO: 417618 - DNA, 140 bp, Artificial Sequence
  Synthetic
caccgctgtcccaaaaggtcgccagggccaagatctgtaatccccttctcttccaccttcgtcttctgtttcttcgttggctggctgtccccggtgcttgtggatagggatctgttgagtcatatcagcagccagggcct

SEQ ID NO: 417619 - DNA, 140 bp, Artificial Sequence
  Synthetic
atacgccatgctgggtctcctggctgtacaacggctgcaggaacttactattgaggacctcccaaatcctccaaccagcactccaaccactcaggctttcgcttgcatacctccagtatgcgtacttgggagtcggccat

SEQ ID NO: 417620 - DNA, 140 bp, Artificial Sequence
  Synthetic
atggccgactcccaagtacgcatactggaggtatgcaagcgaaagcctgagtggttggagtgctggttggaggatttgggaggtcctcaatagtaagttcctgcagccgttgtacagccaggagacccagcatggcgtat

SEQ ID NO: 417621 - DNA, 140 bp, Artificial Sequence
  Synthetic
aggccctggctgctgatatgccaaccagcactccaaccactcaggctttcgcttgcatacctccagtatgggatcagctggctccaagaagcaatccaagcagcaacgagggctgcgggagaccttttgggacagcggtg

SEQ ID NO: 417622 - DNA, 140 bp, Artificial Sequence
  Synthetic
caccgctgtcccaaaaggtctcccgcagccctcgttgctgcttggattgcttcttggagccagctgatcccatactggaggtatgcaagcgaaagcctgagtggttggagtgctggttggcatatcagcagccagggcct

SEQ ID NO: 417623 - DNA, 140 bp, Artificial Sequence
  Synthetic
atacgccatgctgggtctccggcgggggcaatcatcgcggtccccaggagaatcagacaaggacttgaactcgccctcttatgagggacgcatgccccaaggacaaaaggggggagggcacgtacttgggagtcggccat

SEQ ID NO: 417624 - DNA, 140 bp, Artificial Sequence
  Synthetic
atggccgactcccaagtacgtgccctccccccttttgtccttggggcatgcgtccctcataagagggcgagttcaagtccttgtctgattctcctggggaccgcgatgattgcccccgccggagacccagcatggcgtat

SEQ ID NO: 417625 - DNA, 140 bp, Artificial Sequence
  Synthetic
atacgccatgctgggtctccacaagataaagataatagtgatgaggatgatgaagtgggagcctatgtaagacccagtaagccactgagagcaatgacatacaaattggcagtagacatgcgtacttgggagtcggccat

SEQ ID NO: 417626 - DNA, 140 bp, Artificial Sequence
  Synthetic
atggccgactcccaagtacgcatgtctactgccaatttgtatgtcattgctctcagtggcttactgggtcttacataggctcccacttcatcatcctcatcactattatctttatcttgtggagacccagcatggcgtat

SEQ ID NO: 417627 - DNA, 140 bp, Artificial Sequence
  Synthetic
atacgccatgctgggtctccgattggcgcccgaacagggacctgaggaagagtgagagtcttcgggacacggctgagtgaaggcagtaagggcggcaggaatcaaccacgacggagtgctcgtacttgggagtcggccat

SEQ ID NO: 417628 - DNA, 140 bp, Artificial Sequence
  Synthetic
atggccgactcccaagtacgagcactccgtcgtggttgattcctgccgcccttactgccttcactcagccgtgtcccgaagactctcactcttcctcaggtccctgttcgggcgccaatcggagacccagcatggcgtat

SEQ ID NO: 417629 - DNA, 140 bp, Artificial Sequence
  Synthetic
aggccctggctgctgatatgggctgagtgaaggcagtaagggcggcaggaatcaaccacgacggagtgctcctgtaaaaacgcaggccggtaccaggcagcgtgaggagcgggaggagaagaccttttgggacagcggtg

SEQ ID NO: 417630 - DNA, 140 bp, Artificial Sequence
  Synthetic
caccgctgtcccaaaaggtcttctcctcccgctcctcacgctgcctggtaccggcctgcgtttttacaggagcactccgtcgtggttgattcctgccgcccttactgccttcactcagcccatatcagcagccagggcct

SEQ ID NO: 417631 - DNA, 140 bp, Artificial Sequence
  Synthetic
atacgccatgctgggtctcccctgtaaaaacgcaggccggtaccaggcagcgtgaggagcgggaggagaagaggctccgggagtaaaaggtaagtactccaaatttgcaattcgtctactcgtacttgggagtcggccat

SEQ ID NO: 417632 - DNA, 140 bp, Artificial Sequence
  Synthetic
atggccgactcccaagtacgagtagacgaattgcaaatttggagtacttaccttttactcccggagcctcttctcctcccgctcctcacgctgcctggtaccggcctgcgtttttacaggggagacccagcatggcgtat

SEQ ID NO: 417633 - DNA, 140 bp, Artificial Sequence
  Synthetic
atacgccatgctgggtctcctgtcagggaagaagacagatgaattagaaaaggttaggttacggcccggcggaaagaaaagatacatgctaaaacatatagtatgggcagtgaatgaattcgtacttgggagtcggccat

SEQ ID NO: 417634 - DNA, 140 bp, Artificial Sequence
  Synthetic
atggccgactcccaagtacgaattcattcactgcccatactatatgttttagcatgtatcttttctttccgccgggccgtaacctaaccttttctaattcatctgtcttcttccctgacaggagacccagcatggcgtat

SEQ ID NO: 417635 - DNA, 140 bp, Artificial Sequence
  Synthetic
aggccctggctgctgatatgggaaagaaaagatacatgctaaaacatatagtatgggcagtgaatgaattagagagatttggattggcagagagccggttgggatcaaaagaaggatgccgaccttttgggacagcggtg

SEQ ID NO: 417636 - DNA, 140 bp, Artificial Sequence
  Synthetic
caccgctgtcccaaaaggtcggcatccttcttttgatcccaaccggctctctgccaatccaaatctctctaattcattcactgcccatactatatgttttagcatgtatcttttctttcccatatcagcagccagggcct

SEQ ID NO: 417637 - DNA, 140 bp, Artificial Sequence
  Synthetic
atacgccatgctgggtctccttaaaaagtctttataataccgtctgcgtcatcttttgcctgcacgcagaagagaaagtgaaagatactgaggaagcaaaaaagatagcacagcgacatccgtacttgggagtcggccat

SEQ ID NO: 417638 - DNA, 140 bp, Artificial Sequence
  Synthetic
atggccgactcccaagtacggatgtcgctgtgctatcttttttgcttcctcagtatctttcactttctcttctgcgtgcaggcaaaagatgacgcagacggtattataaagactttttaaggagacccagcatggcgtat

SEQ ID NO: 417639 - DNA, 140 bp, Artificial Sequence
  Synthetic
aggccctggctgctgatatgagagaaagtgaaagatactgaggaagcaaaaaagatagcacagcgacatctagcagcggacacagaaaaaatgccagctatgagtaaaccaagtaaaccagaccttttgggacagcggtg

SEQ ID NO: 417640 - DNA, 140 bp, Artificial Sequence
  Synthetic
caccgctgtcccaaaaggtctggtttacttggtttactcatagctggcattttttctgtgtccgctgctagatgtcgctgtgctatcttttttgcttcctcagtatctttcactttctctcatatcagcagccagggcct

SEQ ID NO: 417641 - DNA, 140 bp, Artificial Sequence
  Synthetic
atacgccatgctgggtctcccctgccgctaagcccccgaaccttaaatgcctgggtaaaattagtagaagagaagaagttcggggcagaagtagtaccaggatttcaggcactatcagaacgtacttgggagtcggccat

SEQ ID NO: 417642 - DNA, 140 bp, Artificial Sequence
  Synthetic
atggccgactcccaagtacgttctgatagtgcctgaaatcctggtactacttctgccccgaacttcttctcttctactaattttacccaggcatttaaggttcgggggcttagcggcaggggagacccagcatggcgtat

SEQ ID NO: 417643 - DNA, 140 bp, Artificial Sequence
  Synthetic
aggccctggctgctgatatgagaagaagttcggggcagaagtagtaccaggatttcaggcactatcagaagggtgcaccccttatgatattaatcagatgttaaattgtgtaggagaacagaccttttgggacagcggtg

SEQ ID NO: 417644 - DNA, 140 bp, Artificial Sequence
  Synthetic
caccgctgtcccaaaaggtctgttctcctacacaatttaacatctgattaatatcataaggggtgcacccttctgatagtgcctgaaatcctggtactacttctgccccgaacttcttctcatatcagcagccagggcct

SEQ ID NO: 417645 - DNA, 140 bp, Artificial Sequence
  Synthetic
atacgccatgctgggtctccactgggaccaacagcatccatcgccaggcccaatgccagcagggcaactcagggaaccaagagggtcagacatagcgggaaccaccagcacagtagaagacgtacttgggagtcggccat

SEQ ID NO: 417646 - DNA, 140 bp, Artificial Sequence
  Synthetic
atggccgactcccaagtacgtcttctactgtgctggtggttcccgctatgtctgaccctcttggttccctgagttgccctgctggcattgggcctggcgatggatgctgttggtcccagtggagacccagcatggcgtat

SEQ ID NO: 417647 - DNA, 140 bp, Artificial Sequence
  Synthetic
aggccctggctgctgatatgagggaaccaagagggtcagacatagcgggaaccaccagcacagtagaagaacagatacagtggatgtacagaccccaaaatcctgtcccagtgggaaacagaccttttgggacagcggtg

SEQ ID NO: 417648 - DNA, 140 bp, Artificial Sequence
  Synthetic
caccgctgtcccaaaaggtctgtttcccactgggacaggattttggggtctgtacatccactgtatctgttcttctactgtgctggtggttcccgctatgtctgaccctcttggttccctcatatcagcagccagggcct

SEQ ID NO: 417649 - DNA, 140 bp, Artificial Sequence
  Synthetic
atacgccatgctgggtctccaatcctactaatatactggacataaagcaagggccaaaagaacccttccaaagctatgtagatagattctacaaaagcttacgggcagagcaaacagacccgtacttgggagtcggccat

SEQ ID NO: 417650 - DNA, 140 bp, Artificial Sequence
  Synthetic
atggccgactcccaagtacgggtctgtttgctctgcccgtaagcttttgtagaatctatctacatagctttggaagggttcttttggcccttgctttatgtccagtatattagtaggattggagacccagcatggcgtat

SEQ ID NO: 417651 - DNA, 140 bp, Artificial Sequence
  Synthetic
aggccctggctgctgatatgaagctatgtagatagattctacaaaagcttacgggcagagcaaacagacccagcagtaaaaaattggatgacacaaacactgctgattcagaatgctaacgaccttttgggacagcggtg

SEQ ID NO: 417652 - DNA, 140 bp, Artificial Sequence
  Synthetic
caccgctgtcccaaaaggtcgttagcattctgaatcagcagtgtttgtgtcatccaattttttactgctgggtctgtttgctctgcccgtaagcttttgtagaatctatctacatagcttcatatcagcagccagggcct

SEQ ID NO: 417653 - DNA, 140 bp, Artificial Sequence
  Synthetic
atacgccatgctgggtctccagaaatgctaacagcctgccaggggataggaggcccagggcagaaggcaaggctaatggctgaggctttaaaagaagccttgacaccttccaccaatccgcgtacttgggagtcggccat

SEQ ID NO: 417654 - DNA, 140 bp, Artificial Sequence
  Synthetic
atggccgactcccaagtacgcggattggtggaaggtgtcaaggcttcttttaaagcctcagccattagccttgccttctgccctgggcctcctatcccctggcaggctgttagcatttctggagacccagcatggcgtat

SEQ ID NO: 417655 - DNA, 140 bp, Artificial Sequence
  Synthetic
aggccctggctgctgatatgggctaatggctgaggctttaaaagaagccttgacaccttccaccaatccgtttgccgccgctcaaccaagagcagggaagaggacagtgacatgctggaagaccttttgggacagcggtg

SEQ ID NO: 417656 - DNA, 140 bp, Artificial Sequence
  Synthetic
caccgctgtcccaaaaggtcttccagcatgtcactgtcctcttccctgctcttggttgagcggcggcaaacggattggtggaaggtgtcaaggcttcttttaaagcctcagccattagcccatatcagcagccagggcct

SEQ ID NO: 417657 - DNA, 140 bp, Artificial Sequence
  Synthetic
atacgccatgctgggtctccagggatgctggaaatgtggacagcaaggacacatcatgtcaaaatgcccagaaagacaggcgggttttttagggttcggcccctggggaaagaagcctcgcgtacttgggagtcggccat

SEQ ID NO: 417658 - DNA, 140 bp, Artificial Sequence
  Synthetic
atggccgactcccaagtacgcgaggcttctttccccaggggccgaaccctaaaaaacccgcctgtctttctgggcattttgacatgatgtgtccttgctgtccacatttccagcatccctggagacccagcatggcgtat

SEQ ID NO: 417659 - DNA, 140 bp, Artificial Sequence
  Synthetic
aggccctggctgctgatatggaaagacaggcgggttttttagggttcggcccctggggaaagaagcctcgcaatttccccgtccaggcaccccaggggatagtgccatctgcgcccccgagaccttttgggacagcggtg

SEQ ID NO: 417660 - DNA, 140 bp, Artificial Sequence
  Synthetic
caccgctgtcccaaaaggtctcgggggcgcagatggcactatcccctggggtgcctggacggggaaattgcgaggcttctttccccaggggccgaaccctaaaaaacccgcctgtctttccatatcagcagccagggcct

SEQ ID NO: 417661 - DNA, 140 bp, Artificial Sequence
  Synthetic
atacgccatgctgggtctcccctgcagatccagcagaggagatgctaaagaactacatgcaactagggaagaagcagaaggagaacagagagagaccctacaaggaggtgacagaggattcgtacttgggagtcggccat

SEQ ID NO: 417662 - DNA, 140 bp, Artificial Sequence
  Synthetic
atggccgactcccaagtacgaatcctctgtcacctccttgtagggtctctctctgttctccttctgcttcttccctagttgcatgtagttctttagcatctcctctgctggatctgcaggggagacccagcatggcgtat

SEQ ID NO: 417663 - DNA, 140 bp, Artificial Sequence
  Synthetic
aggccctggctgctgatatggaagcagaaggagaacagagagagaccctacaaggaggtgacagaggatttgctgcacctcaattctctctttggagaagaccagtagtcaaagcaactagaccttttgggacagcggtg

SEQ ID NO: 417664 - DNA, 140 bp, Artificial Sequence
  Synthetic
caccgctgtcccaaaaggtctagttgctttgactactggtcttctccaaagagagaattgaggtgcagcaaatcctctgtcacctccttgtagggtctctctctgttctccttctgcttccatatcagcagccagggcct

SEQ ID NO: 417665 - DNA, 140 bp, Artificial Sequence
  Synthetic
atacgccatgctgggtctccatagtagcagggatagaattaggcagcaattacaccccaaaaatagtaggtgggataggaggatttataaataccaatgaatacaaaaatgtagaaatagcgtacttgggagtcggccat

SEQ ID NO: 417666 - DNA, 140 bp, Artificial Sequence
  Synthetic
atggccgactcccaagtacgctatttctacatttttgtattcattggtatttataaatcctcctatcccacctactatttttggggtgtaattgctgcctaattctatccctgctactatggagacccagcatggcgtat

SEQ ID NO: 417667 - DNA, 140 bp, Artificial Sequence
  Synthetic
aggccctggctgctgatatgtgggataggaggatttataaataccaatgaatacaaaaatgtagaaatagaagtagtaggaaaaagagtaagagcaacagtaatgacaggggacaccccagaccttttgggacagcggtg

SEQ ID NO: 417668 - DNA, 140 bp, Artificial Sequence
  Synthetic
caccgctgtcccaaaaggtctggggtgtcccctgtcattactgttgctcttactctttttcctactacttctatttctacatttttgtattcattggtatttataaatcctcctatcccacatatcagcagccagggcct

SEQ ID NO: 417669 - DNA, 140 bp, Artificial Sequence
  Synthetic
atacgccatgctgggtctcctttcccagtagcaaggatagaaccagtaaaagtccagttaaagcctgaaaaagatgggccaaaaatcagacaatggcccctatccaaagagaaaatactacgtacttgggagtcggccat

SEQ ID NO: 417670 - DNA, 140 bp, Artificial Sequence
  Synthetic
atggccgactcccaagtacgtagtattttctctttggataggggccattgtctgatttttggcccatctttttcaggctttaactggacttttactggttctatccttgctactgggaaaggagacccagcatggcgtat

SEQ ID NO: 417671 - DNA, 140 bp, Artificial Sequence
  Synthetic
aggccctggctgctgatatgaagatgggccaaaaatcagacaatggcccctatccaaagagaaaatactagccctcaaagaaatctgtgaaaaaatggaaaaagagggacagttagaagagaccttttgggacagcggtg

SEQ ID NO: 417672 - DNA, 140 bp, Artificial Sequence
  Synthetic
caccgctgtcccaaaaggtctcttctaactgtccctctttttccattttttcacagatttctttgagggctagtattttctctttggataggggccattgtctgatttttggcccatcttcatatcagcagccagggcct

SEQ ID NO: 417673 - DNA, 140 bp, Artificial Sequence
  Synthetic
atacgccatgctgggtctccaagacaaaaacaaatggaggatgctaatagatttcagagaactaaacaaggtaacccaagaatttacagaggtccagctgggtattcctcacccagcaggcgtacttgggagtcggccat

SEQ ID NO: 417674 - DNA, 140 bp, Artificial Sequence
  Synthetic
atggccgactcccaagtacgcctgctgggtgaggaatacccagctggacctctgtaaattcttgggttaccttgtttagttctctgaaatctattagcatcctccatttgtttttgtcttggagacccagcatggcgtat

SEQ ID NO: 417675 - DNA, 140 bp, Artificial Sequence
  Synthetic
aggccctggctgctgatatggtaacccaagaatttacagaggtccagctgggtattcctcacccagcaggactggcatcaaagaaaagaataacagtactagatgtaggagatgcctactgaccttttgggacagcggtg

SEQ ID NO: 417676 - DNA, 140 bp, Artificial Sequence
  Synthetic
caccgctgtcccaaaaggtcagtaggcatctcctacatctagtactgttattcttttctttgatgccagtcctgctgggtgaggaatacccagctggacctctgtaaattcttgggttaccatatcagcagccagggcct

SEQ ID NO: 417677 - DNA, 140 bp, Artificial Sequence
  Synthetic
atacgccatgctgggtctccccagcagtaaataatgcagaaccaggaaagagatatctttacaaagtcctaccacagggatggaagggatccccagcaattttccagtacaccatggcaacgtacttgggagtcggccat

SEQ ID NO: 417678 - DNA, 140 bp, Artificial Sequence
  Synthetic
atggccgactcccaagtacgttgccatggtgtactggaaaattgctggggatcccttccatccctgtggtaggactttgtaaagatatctctttcctggttctgcattatttactgctggggagacccagcatggcgtat

SEQ ID NO: 417679 - DNA, 140 bp, Artificial Sequence
  Synthetic
aggccctggctgctgatatgaccacagggatggaagggatccccagcaattttccagtacaccatggcaaaggtactagaccctttcagaaaagccaacaatgatgtcactataatccaggaccttttgggacagcggtg

SEQ ID NO: 417680 - DNA, 140 bp, Artificial Sequence
  Synthetic
caccgctgtcccaaaaggtcctggattatagtgacatcattgttggcttttctgaaagggtctagtacctttgccatggtgtactggaaaattgctggggatcccttccatccctgtggtcatatcagcagccagggcct

SEQ ID NO: 417681 - DNA, 140 bp, Artificial Sequence
  Synthetic
atacgccatgctgggtctcccagggtagtgtctcaactaaaagagctattaaataacatgggattctctactccagaagaaaagttccaaaaagaccctccattcaaatggatggggtatcgtacttgggagtcggccat

SEQ ID NO: 417682 - DNA, 140 bp, Artificial Sequence
  Synthetic
atggccgactcccaagtacgataccccatccatttgaatggagggtctttttggaacttttcttctggagtagagaatcccatgttatttaatagctcttttagttgagacactaccctgggagacccagcatggcgtat

SEQ ID NO: 417683 - DNA, 140 bp, Artificial Sequence
  Synthetic
aggccctggctgctgatatgctccagaagaaaagttccaaaaagaccctccattcaaatggatggggtatgagctctggccaaagaaatggaaactgcaaaaaatacagctaccagaaaagaccttttgggacagcggtg

SEQ ID NO: 417684 - DNA, 140 bp, Artificial Sequence
  Synthetic
caccgctgtcccaaaaggtcttttctggtagctgtattttttgcagtttccatttctttggccagagctcataccccatccatttgaatggagggtctttttggaacttttcttctggagcatatcagcagccagggcct

SEQ ID NO: 417685 - DNA, 140 bp, Artificial Sequence
  Synthetic
atacgccatgctgggtctccgggcagctcaacttttcccggggattaagaccaggcatatatgtaaactaataaggggaaagatgaccctaacagaagaggtacaatggactgaattggccgtacttgggagtcggccat

SEQ ID NO: 417686 - DNA, 140 bp, Artificial Sequence
  Synthetic
atggccgactcccaagtacggccaattcagtccattgtacctcttctgttagggtcatctttccccttattagtttacatatatgcctggtcttaatccccgggaaaagttgagctgcccggagacccagcatggcgtat

SEQ ID NO: 417687 - DNA, 140 bp, Artificial Sequence
  Synthetic
aggccctggctgctgatatgataaggggaaagatgaccctaacagaagaggtacaatggactgaattggcagaggcagaattccaggaaaacaaaatcatcctagaacaagagcaggaaggaccttttgggacagcggtg

SEQ ID NO: 417688 - DNA, 140 bp, Artificial Sequence
  Synthetic
caccgctgtcccaaaaggtccttcctgctcttgttctaggatgattttgttttcctggaattctgcctctgccaattcagtccattgtacctcttctgttagggtcatctttccccttatcatatcagcagccagggcct

SEQ ID NO: 417689 - DNA, 140 bp, Artificial Sequence
  Synthetic
atacgccatgctgggtctccctagcaaatcagtggacatacaagattcatcagggagataaaatcctaaaagtaggaaaatatgcaaaggttaaaaacactcacaccaatggagtaagaccgtacttgggagtcggccat

SEQ ID NO: 417690 - DNA, 140 bp, Artificial Sequence
  Synthetic
atggccgactcccaagtacggtcttactccattggtgtgagtgtttttaacctttgcatattttcctacttttaggattttatctccctgatgaatcttgtatgtccactgatttgctagggagacccagcatggcgtat

SEQ ID NO: 417691 - DNA, 140 bp, Artificial Sequence
  Synthetic
aggccctggctgctgatatgagtaggaaaatatgcaaaggttaaaaacactcacaccaatggagtaagactattggctcatgtagtccaaaaaataggaaaggaagcattggtcatctgggaccttttgggacagcggtg

SEQ ID NO: 417692 - DNA, 140 bp, Artificial Sequence
  Synthetic
caccgctgtcccaaaaggtcccagatgaccaatgcttcctttcctattttttggactacatgagccaatagtcttactccattggtgtgagtgtttttaacctttgcatattttcctactcatatcagcagccagggcct

SEQ ID NO: 417693 - DNA, 140 bp, Artificial Sequence
  Synthetic
atacgccatgctgggtctccgtggtggacagattactggcaagtaacctggatcccagaatgggattttgtctcaaccccaccattaataaggttagcctataacctggtcaaagacccccgtacttgggagtcggccat

SEQ ID NO: 417694 - DNA, 140 bp, Artificial Sequence
  Synthetic
atggccgactcccaagtacgggggtctttgaccaggttataggctaaccttattaatggtggggttgagacaaaatcccattctgggatccaggttacttgccagtaatctgtccaccacggagacccagcatggcgtat

SEQ ID NO: 417695 - DNA, 140 bp, Artificial Sequence
  Synthetic
aggccctggctgctgatatgtctcaaccccaccattaataaggttagcctataacctggtcaaagaccccctagaaggagtagaaacttactacacagatggatcctgtaacaaagcctcgaccttttgggacagcggtg

SEQ ID NO: 417696 - DNA, 140 bp, Artificial Sequence
  Synthetic
caccgctgtcccaaaaggtcgaggctttgttacaggatccatctgtgtagtaagtttctactccttctagggggtctttgaccaggttataggctaaccttattaatggtggggttgagacatatcagcagccagggcct

SEQ ID NO: 417697 - DNA, 140 bp, Artificial Sequence
  Synthetic
atacgccatgctgggtctccaaccattagaacaaacaacaaatcagcaagcagagcttgaagcatttgcactagcactacaggactcaggaccacaggtcaatatcatagtagattcacacgtacttgggagtcggccat

SEQ ID NO: 417698 - DNA, 140 bp, Artificial Sequence
  Synthetic
atggccgactcccaagtacgtgtgaatctactatgatattgacctgtggtcctgagtcctgtagtgctagtgcaaatgcttcaagctctgcttgctgatttgttgtttgttctaatggttggagacccagcatggcgtat

SEQ ID NO: 417699 - DNA, 140 bp, Artificial Sequence
  Synthetic
aggccctggctgctgatatgctagcactacaggactcaggaccacaggtcaatatcatagtagattcacaatatgtcatgggaatagtagctgcacaaccaacagaaacagaatcaccgagaccttttgggacagcggtg

SEQ ID NO: 417700 - DNA, 140 bp, Artificial Sequence
  Synthetic
caccgctgtcccaaaaggtctcggtgattctgtttctgttggttgtgcagctactattcccatgacatattgtgaatctactatgatattgacctgtggtcctgagtcctgtagtgctagcatatcagcagccagggcct

SEQ ID NO: 417701 - DNA, 140 bp, Artificial Sequence
  Synthetic
atacgccatgctgggtctccggatgggtaccagctcacaagggactgggtggtaatcaggaagtagaccacctagtgagccaaggaattagacaaatcctatttctagaaaaaatagaaccgtacttgggagtcggccat

SEQ ID NO: 417702 - DNA, 140 bp, Artificial Sequence
  Synthetic
atggccgactcccaagtacggttctattttttctagaaataggatttgtctaattccttggctcactaggtggtctacttcctgattaccacccagtcccttgtgagctggtacccatccggagacccagcatggcgtat

SEQ ID NO: 417703 - DNA, 140 bp, Artificial Sequence
  Synthetic
aggccctggctgctgatatgcctagtgagccaaggaattagacaaatcctatttctagaaaaaatagaaccagctcaagaagaacatgaaaaatatcataataatgtaaaagaactagtcgaccttttgggacagcggtg

SEQ ID NO: 417704 - DNA, 140 bp, Artificial Sequence
  Synthetic
caccgctgtcccaaaaggtcgactagttcttttacattattatgatatttttcatgttcttcttgagctggttctattttttctagaaataggatttgtctaattccttggctcactaggcatatcagcagccagggcct

SEQ ID NO: 417705 - DNA, 140 bp, Artificial Sequence
  Synthetic
atacgccatgctgggtctcctgataaatgccaacaaaaaggggaagctattcatggacaggtaaattcagaactagggacatggcaaatggactgtacacatttagagggaaaggttatacgtacttgggagtcggccat

SEQ ID NO: 417706 - DNA, 140 bp, Artificial Sequence
  Synthetic
atggccgactcccaagtacgtataacctttccctctaaatgtgtacagtccatttgccatgtccctagttctgaatttacctgtccatgaatagcttcccctttttgttggcatttatcaggagacccagcatggcgtat

SEQ ID NO: 417707 - DNA, 140 bp, Artificial Sequence
  Synthetic
aggccctggctgctgatatgaactagggacatggcaaatggactgtacacatttagagggaaaggttataatagtggcagttcatgtagccagtggattcatagaagcagaagtaataccgaccttttgggacagcggtg

SEQ ID NO: 417708 - DNA, 140 bp, Artificial Sequence
  Synthetic
caccgctgtcccaaaaggtcggtattacttctgcttctatgaatccactggctacatgaactgccactattataacctttccctctaaatgtgtacagtccatttgccatgtccctagttcatatcagcagccagggcct

SEQ ID NO: 417709 - DNA, 140 bp, Artificial Sequence
  Synthetic
atacgccatgctgggtctccgatggcctatcacacacctgcacacagacaacggtgccaacttcacttcacaagatgtgaaaatggcagcctggtggatagggatagaacaaacattcggcgtacttgggagtcggccat

SEQ ID NO: 417710 - DNA, 140 bp, Artificial Sequence
  Synthetic
atggccgactcccaagtacgccgaatgtttgttctatccctatccaccaggctgccattttcacatcttgtgaagtgaagttggcaccgttgtctgtgtgcaggtgtgtgataggccatcggagacccagcatggcgtat

SEQ ID NO: 417711 - DNA, 140 bp, Artificial Sequence
  Synthetic
aggccctggctgctgatatgcaagatgtgaaaatggcagcctggtggatagggatagaacaaacattcggagtgccctataatccagaaagtcagggagtagtagaagcaatgaaccatcgaccttttgggacagcggtg

SEQ ID NO: 417712 - DNA, 140 bp, Artificial Sequence
  Synthetic
caccgctgtcccaaaaggtcgatggttcattgcttctactactccctgactttctggattatagggcactccgaatgtttgttctatccctatccaccaggctgccattttcacatcttgcatatcagcagccagggcct

SEQ ID NO: 417713 - DNA, 140 bp, Artificial Sequence
  Synthetic
atacgccatgctgggtctccacagttgtgttaatggcaactcactgcatgaattttaaaagaaggggaggaataggggatatgacccctgcagaaagaatagtcaacatgataactacagcgtacttgggagtcggccat

SEQ ID NO: 417714 - DNA, 140 bp, Artificial Sequence
  Synthetic
atggccgactcccaagtacgctgtagttatcatgttgactattctttctgcaggggtcatatcccctattcctccccttcttttaaaattcatgcagtgagttgccattaacacaactgtggagacccagcatggcgtat

SEQ ID NO: 417715 - DNA, 140 bp, Artificial Sequence
  Synthetic
aggccctggctgctgatatgaataggggatatgacccctgcagaaagaatagtcaacatgataactacagaacaagaaatacaattcctccaaacaaaaaatttaaaattccaaaatttcgaccttttgggacagcggtg

SEQ ID NO: 417716 - DNA, 140 bp, Artificial Sequence
  Synthetic
caccgctgtcccaaaaggtcgaaattttggaattttaaattttttgtttggaggaattgtatttcttgttctgtagttatcatgttgactattctttctgcaggggtcatatcccctattcatatcagcagccagggcct

SEQ ID NO: 417717 - DNA, 140 bp, Artificial Sequence
  Synthetic
atacgccatgctgggtctcctctattgtggaaaggggaaggagcagtcatcataaaggtagggacagaaatcaaagtaatacccagaagaaaagcaaagatcataaggaactatggaggacgtacttgggagtcggccat

SEQ ID NO: 417718 - DNA, 140 bp, Artificial Sequence
  Synthetic
atggccgactcccaagtacgtcctccatagttccttatgatctttgcttttcttctgggtattactttgatttctgtccctacctttatgatgactgctccttcccctttccacaatagaggagacccagcatggcgtat

SEQ ID NO: 417719 - DNA, 140 bp, Artificial Sequence
  Synthetic
aggccctggctgctgatatgtcaaagtaatacccagaagaaaagcaaagatcataaggaactatggaggaggaaaagaattggattgcagtgccgacgtggaggataccatgcaggctaggaccttttgggacagcggtg

SEQ ID NO: 417720 - DNA, 140 bp, Artificial Sequence
  Synthetic
caccgctgtcccaaaaggtcctagcctgcatggtatcctccacgtcggcactgcaatccaattcttttcctcctccatagttccttatgatctttgcttttcttctgggtattactttgacatatcagcagccagggcct

SEQ ID NO: 417721 - DNA, 140 bp, Artificial Sequence
  Synthetic
atacgccatgctgggtctcccaacaggtctcttatgttcctcaccataaggtaggatgggcttggtggacttgcagtagagtaatatttcccctgaaagaaggagcacatctagaagtcccgtacttgggagtcggccat

SEQ ID NO: 417722 - DNA, 140 bp, Artificial Sequence
  Synthetic
atggccgactcccaagtacgggacttctagatgtgctccttctttcaggggaaatattactctactgcaagtccaccaagcccatcctaccttatggtgaggaacataagagacctgttgggagacccagcatggcgtat

SEQ ID NO: 417723 - DNA, 140 bp, Artificial Sequence
  Synthetic
aggccctggctgctgatatgttgcagtagagtaatatttcccctgaaagaaggagcacatctagaagtccaaggatactggaacctgaccccagaaaggggattcttgagttcctatgctgaccttttgggacagcggtg

SEQ ID NO: 417724 - DNA, 140 bp, Artificial Sequence
  Synthetic
caccgctgtcccaaaaggtcagcataggaactcaagaatcccctttctggggtcaggttccagtatccttggacttctagatgtgctccttctttcaggggaaatattactctactgcaacatatcagcagccagggcct

SEQ ID NO: 417725 - DNA, 140 bp, Artificial Sequence
  Synthetic
atacgccatgctgggtctcctgtagcagaccgattactgcatgggtcttatttctcttcgtttacagctaatgaagtaaggagagccatcaggggagaaaagatattgtcccactgcaaccgtacttgggagtcggccat

SEQ ID NO: 417726 - DNA, 140 bp, Artificial Sequence
  Synthetic
atggccgactcccaagtacggttgcagtgggacaatatcttttctcccctgatggctctccttacttcattagctgtaaacgaagagaaataagacccatgcagtaatcggtctgctacaggagacccagcatggcgtat

SEQ ID NO: 417727 - DNA, 140 bp, Artificial Sequence
  Synthetic
aggccctggctgctgatatgatgaagtaaggagagccatcaggggagaaaagatattgtcccactgcaactacccatcagctcatacaggccaggtaccaagtttacagtttctagccctgaccttttgggacagcggtg

SEQ ID NO: 417728 - DNA, 140 bp, Artificial Sequence
  Synthetic
caccgctgtcccaaaaggtcagggctagaaactgtaaacttggtacctggcctgtatgagctgatgggtagttgcagtgggacaatatcttttctcccctgatggctctccttacttcatcatatcagcagccagggcct

SEQ ID NO: 417729 - DNA, 140 bp, Artificial Sequence
  Synthetic
atacgccatgctgggtctccggaaacagcggcgaagaaacagtaggagaggcattcgaatggctagagacaacattagaacatctcaacagagtagcagtcaatcacttgcccagggaaccgtacttgggagtcggccat

SEQ ID NO: 417730 - DNA, 140 bp, Artificial Sequence
  Synthetic
atggccgactcccaagtacggttccctgggcaagtgattgactgctactctgttgagatgttctaatgttgtctctagccattcgaatgcctctcctactgtttcttcgccgctgtttccggagacccagcatggcgtat

SEQ ID NO: 417731 - DNA, 140 bp, Artificial Sequence
  Synthetic
aggccctggctgctgatatgaacattagaacatctcaacagagtagcagtcaatcacttgcccagggaacttattttccaggtctggcagaagtcttgggcatattggcgtgaggaacaggaccttttgggacagcggtg

SEQ ID NO: 417732 - DNA, 140 bp, Artificial Sequence
  Synthetic
caccgctgtcccaaaaggtcctgttcctcacgccaatatgcccaagacttctgccagacctggaaaataagttccctgggcaagtgattgactgctactctgttgagatgttctaatgttcatatcagcagccagggcct

SEQ ID NO: 417733 - DNA, 140 bp, Artificial Sequence
  Synthetic
atacgccatgctgggtctccagcaatgtttatacactttgcaaagggttgtggatgtctgcgggaaggccatgggccagggggatggagatcaggacctcctcctcctcctcccccaggtcgtacttgggagtcggccat

SEQ ID NO: 417734 - DNA, 140 bp, Artificial Sequence
  Synthetic
atggccgactcccaagtacgacctgggggaggaggaggaggaggtcctgatctccatccccctggcccatggccttcccgcagacatccacaaccctttgcaaagtgtataaacattgctggagacccagcatggcgtat

SEQ ID NO: 417735 - DNA, 140 bp, Artificial Sequence
  Synthetic
aggccctggctgctgatatgatgggccagggggatggagatcaggacctcctcctcctcctcccccaggtctagcctaatggcagaagcagtcccagagattcctccagaggataaaaacgaccttttgggacagcggtg

SEQ ID NO: 417736 - DNA, 140 bp, Artificial Sequence
  Synthetic
caccgctgtcccaaaaggtcgtttttatcctctggaggaatctctgggactgcttctgccattaggctagacctgggggaggaggaggaggaggtcctgatctccatccccctggcccatcatatcagcagccagggcct

SEQ ID NO: 417737 - DNA, 140 bp, Artificial Sequence
  Synthetic
atacgccatgctgggtctccaaaacaagaagccttaaagcattttgacccccgcttattaactgcacttggcaattttatctacaataggcatggaaatacccttgaaggagcaggagagcgtacttgggagtcggccat

SEQ ID NO: 417738 - DNA, 140 bp, Artificial Sequence
  Synthetic
atggccgactcccaagtacgctctcctgctccttcaagggtatttccatgcctattgtagataaaattgccaagtgcagttaataagcgggggtcaaaatgctttaaggcttcttgttttggagacccagcatggcgtat

SEQ ID NO: 417739 - DNA, 140 bp, Artificial Sequence
  Synthetic
aggccctggctgctgatatggcaattttatctacaataggcatggaaatacccttgaaggagcaggagagctcattaaactcctccagcgggcactcttcctccacttcagagggggttggaccttttgggacagcggtg

SEQ ID NO: 417740 - DNA, 140 bp, Artificial Sequence
  Synthetic
caccgctgtcccaaaaggtccaaccccctctgaagtggaggaagagtgcccgctggaggagtttaatgagctctcctgctccttcaagggtatttccatgcctattgtagataaaattgccatatcagcagccagggcct

SEQ ID NO: 417741 - DNA, 140 bp, Artificial Sequence
  Synthetic
atacgccatgctgggtctcctaccgccctcttaaggcatgcagtaatacatgctactgtaaaaaatgttcctaccattgccagctttgctttcttaaaaagggcctggggatatgttatgcgtacttgggagtcggccat

SEQ ID NO: 417742 - DNA, 140 bp, Artificial Sequence
  Synthetic
atggccgactcccaagtacgcataacatatccccaggccctttttaagaaagcaaagctggcaatggtaggaacattttttacagtagcatgtattactgcatgccttaagagggcggtaggagacccagcatggcgtat

SEQ ID NO: 417743 - DNA, 140 bp, Artificial Sequence
  Synthetic
aggccctggctgctgatatgctaccattgccagctttgctttcttaaaaagggcctggggatatgttatgaacgctcgagaaagagatcttcaaaaagggctaagactactacatcttctgaccttttgggacagcggtg

SEQ ID NO: 417744 - DNA, 140 bp, Artificial Sequence
  Synthetic
caccgctgtcccaaaaggtcagaagatgtagtagtcttagccctttttgaagatctctttctcgagcgttcataacatatccccaggccctttttaagaaagcaaagctggcaatggtagcatatcagcagccagggcct

SEQ ID NO: 417745 - DNA, 140 bp, Artificial Sequence
  Synthetic
atacgccatgctgggtctccctcctgcttataagtatctatgggtatatgggcaagaactttgtcactgtcttctatggtatacccgcatggaaaaatgcatcaattcccctcttttgtgcgtacttgggagtcggccat

SEQ ID NO: 417746 - DNA, 140 bp, Artificial Sequence
  Synthetic
atggccgactcccaagtacgcacaaaagaggggaattgatgcatttttccatgcgggtataccatagaagacagtgacaaagttcttgcccatatacccatagatacttataagcaggagggagacccagcatggcgtat

SEQ ID NO: 417747 - DNA, 140 bp, Artificial Sequence
  Synthetic
aggccctggctgctgatatgcttctatggtatacccgcatggaaaaatgcatcaattcccctcttttgtgctaccagaaacagagatacctggggaactgtacaatgcctcccagataatgaccttttgggacagcggtg

SEQ ID NO: 417748 - DNA, 140 bp, Artificial Sequence
  Synthetic
caccgctgtcccaaaaggtcattatctgggaggcattgtacagttccccaggtatctctgtttctggtagcacaaaagaggggaattgatgcatttttccatgcgggtataccatagaagcatatcagcagccagggcct

SEQ ID NO: 417749 - DNA, 140 bp, Artificial Sequence
  Synthetic
atacgccatgctgggtctccggataatacagtgacagatcaggcaacaaaggatgtgtggagtctctttgagacctcaataaaaccatgtgttaaattaaccccactgtgtgtgacaatgcgtacttgggagtcggccat

SEQ ID NO: 417750 - DNA, 140 bp, Artificial Sequence
  Synthetic
atggccgactcccaagtacgcattgtcacacacagtggggttaatttaacacatggttttattgaggtctcaaagagactccacacatcctttgttgcctgatctgtcactgtattatccggagacccagcatggcgtat

SEQ ID NO: 417751 - DNA, 140 bp, Artificial Sequence
  Synthetic
aggccctggctgctgatatgagacctcaataaaaccatgtgttaaattaaccccactgtgtgtgacaatgaagtgtaataagacgtggagctcagctagcaaagagaccactacgtcctcgaccttttgggacagcggtg

SEQ ID NO: 417752 - DNA, 140 bp, Artificial Sequence
  Synthetic
caccgctgtcccaaaaggtcgaggacgtagtggtctctttgctagctgagctccacgtcttattacacttcattgtcacacacagtggggttaatttaacacatggttttattgaggtctcatatcagcagccagggcct

SEQ ID NO: 417753 - DNA, 140 bp, Artificial Sequence
  Synthetic
atacgccatgctgggtctccgtattcaaaatgacagctgtgcagggataggactagaagaaatgatagactgtcaattcaaaatgacaggattaaaaagagatgagtcaaaacaatataacgtacttgggagtcggccat

SEQ ID NO: 417754 - DNA, 140 bp, Artificial Sequence
  Synthetic
atggccgactcccaagtacgttatattgttttgactcatctctttttaatcctgtcattttgaattgacagtctatcatttcttctagtcctatccctgcacagctgtcattttgaatacggagacccagcatggcgtat

SEQ ID NO: 417755 - DNA, 140 bp, Artificial Sequence
  Synthetic
aggccctggctgctgatatgtgtcaattcaaaatgacaggattaaaaagagatgagtcaaaacaatataaggacacctggtataaacaagatttagtgtgtgaaaaggggacaaggagtagaccttttgggacagcggtg

SEQ ID NO: 417756 - DNA, 140 bp, Artificial Sequence
  Synthetic
caccgctgtcccaaaaggtctactccttgtccccttttcacacactaaatcttgtttataccaggtgtccttatattgttttgactcatctctttttaatcctgtcattttgaattgacacatatcagcagccagggcct

SEQ ID NO: 417757 - DNA, 140 bp, Artificial Sequence
  Synthetic
atacgccatgctgggtctcctcatgtgacaaacattattgggatagtttaagatttaggtattgtgctcccccaggatttgctttgctaagatgcaatgatactaaatattcaggcttcacgtacttgggagtcggccat

SEQ ID NO: 417758 - DNA, 140 bp, Artificial Sequence
  Synthetic
atggccgactcccaagtacgtgaagcctgaatatttagtatcattgcatcttagcaaagcaaatcctgggggagcacaatacctaaatcttaaactatcccaataatgtttgtcacatgaggagacccagcatggcgtat

SEQ ID NO: 417759 - DNA, 140 bp, Artificial Sequence
  Synthetic
aggccctggctgctgatatgcccaggatttgctttgctaagatgcaatgatactaaatattcaggcttcatgcccaactgtagtaaggtagtagtatctctgtacagaatgatggaaacagaccttttgggacagcggtg

SEQ ID NO: 417760 - DNA, 140 bp, Artificial Sequence
  Synthetic
caccgctgtcccaaaaggtctgtttccatcattctgtacagagatactactaccttactacagttgggcatgaagcctgaatatttagtatcattgcatcttagcaaagcaaatcctgggcatatcagcagccagggcct

SEQ ID NO: 417761 - DNA, 140 bp, Artificial Sequence
  Synthetic
atacgccatgctgggtctccatatatctattggcatggtaaagacaataggactatcataagcttaaattcatattataatctgacaatgcactgtaaaaggccaggaaacaaaatggttcgtacttgggagtcggccat

SEQ ID NO: 417762 - DNA, 140 bp, Artificial Sequence
  Synthetic
atggccgactcccaagtacgaaccattttgtttcctggccttttacagtgcattgtcagattataatatgaatttaagcttatgatagtcctattgtctttaccatgccaatagatatatggagacccagcatggcgtat

SEQ ID NO: 417763 - DNA, 140 bp, Artificial Sequence
  Synthetic
aggccctggctgctgatatgcatattataatctgacaatgcactgtaaaaggccaggaaacaaaatggttgtgccaataagaaccgtgtcaggtattctcttccattcacagcctatcaagaccttttgggacagcggtg

SEQ ID NO: 417764 - DNA, 140 bp, Artificial Sequence
  Synthetic
caccgctgtcccaaaaggtcttgataggctgtgaatggaagagaatacctgacacggttcttattggcacaaccattttgtttcctggccttttacagtgcattgtcagattataatatgcatatcagcagccagggcct

SEQ ID NO: 417765 - DNA, 140 bp, Artificial Sequence
  Synthetic
atacgccatgctgggtctccccatacaggaggtgaaagagaccattaaaaatcatcccagatattcaggaacaacaaatatctcacagataaggttagcagagcacgcgagaagctcagacgtacttgggagtcggccat

SEQ ID NO: 417766 - DNA, 140 bp, Artificial Sequence
  Synthetic
atggccgactcccaagtacgtctgagcttctcgcgtgctctgctaaccttatctgtgagatatttgttgttcctgaatatctgggatgatttttaatggtctctttcacctcctgtatggggagacccagcatggcgtat

SEQ ID NO: 417767 - DNA, 140 bp, Artificial Sequence
  Synthetic
aggccctggctgctgatatgacaacaaatatctcacagataaggttagcagagcacgcgagaagctcagatccagaagtaagatatatgtggactaactgtaggggagagtttctctactgaccttttgggacagcggtg

SEQ ID NO: 417768 - DNA, 140 bp, Artificial Sequence
  Synthetic
caccgctgtcccaaaaggtcagtagagaaactctcccctacagttagtccacatatatcttacttctggatctgagcttctcgcgtgctctgctaaccttatctgtgagatatttgttgtcatatcagcagccagggcct

SEQ ID NO: 417769 - DNA, 140 bp, Artificial Sequence
  Synthetic
atacgccatgctgggtctccagaaattatgcgtcatgccacatcagacagatagtcaacacgtggcacaagattggaagaaatgtgtatttgcctccaagagagggtgaactctcctgtacgtacttgggagtcggccat

SEQ ID NO: 417770 - DNA, 140 bp, Artificial Sequence
  Synthetic
atggccgactcccaagtacgtacaggagagttcaccctctcttggaggcaaatacacatttcttccaatcttgtgccacgtgttgactatctgtctgatgtggcatgacgcataatttctggagacccagcatggcgtat

SEQ ID NO: 417771 - DNA, 140 bp, Artificial Sequence
  Synthetic
aggccctggctgctgatatggattggaagaaatgtgtatttgcctccaagagagggtgaactctcctgtaattccactgttaccagcctcatagccaacattgactggatagataagaacgaccttttgggacagcggtg

SEQ ID NO: 417772 - DNA, 140 bp, Artificial Sequence
  Synthetic
caccgctgtcccaaaaggtcgttcttatctatccagtcaatgttggctatgaggctggtaacagtggaattacaggagagttcaccctctcttggaggcaaatacacatttcttccaatccatatcagcagccagggcct

SEQ ID NO: 417773 - DNA, 140 bp, Artificial Sequence
  Synthetic
atacgccatgctgggtctccactgggggactacaaattagtagagataacaccaattggctttgcacctacaagtataaaaagatattcctcagtgacaccgaggaataaaagaggtgtacgtacttgggagtcggccat

SEQ ID NO: 417774 - DNA, 140 bp, Artificial Sequence
  Synthetic
atggccgactcccaagtacgtacacctcttttattcctcggtgtcactgaggaatatctttttatacttgtaggtgcaaagccaattggtgttatctctactaatttgtagtcccccagtggagacccagcatggcgtat

SEQ ID NO: 417775 - DNA, 140 bp, Artificial Sequence
  Synthetic
aggccctggctgctgatatgcaagtataaaaagatattcctcagtgacaccgaggaataaaagaggtgtacttgtgctagggtttttgggattccttgcgacggcaggttctgcaatggggaccttttgggacagcggtg

SEQ ID NO: 417776 - DNA, 140 bp, Artificial Sequence
  Synthetic
caccgctgtcccaaaaggtccccattgcagaacctgccgtcgcaaggaatcccaaaaaccctagcacaagtacacctcttttattcctcggtgtcactgaggaatatctttttatacttgcatatcagcagccagggcct

SEQ ID NO: 417777 - DNA, 140 bp, Artificial Sequence
  Synthetic
atacgccatgctgggtctcctagtgcagcagcagcaacagctcgtggacgtggtcaaaagacaacaagaactgttgcggctgaccgtctgggggacgaaaaacctccaggcaagagtcaccgtacttgggagtcggccat

SEQ ID NO: 417778 - DNA, 140 bp, Artificial Sequence
  Synthetic
atggccgactcccaagtacggtgactcttgcctggaggtttttcgtcccccagacggtcagccgcaacagttcttgttgtcttttgaccacgtccacgagctgttgctgctgctgcactaggagacccagcatggcgtat

SEQ ID NO: 417779 - DNA, 140 bp, Artificial Sequence
  Synthetic
aggccctggctgctgatatgctgttgcggctgaccgtctgggggacgaaaaacctccaggcaagagtcactgccatcgagaaatatctcaaagaccaggcacaactaaattcatggggatgaccttttgggacagcggtg

SEQ ID NO: 417780 - DNA, 140 bp, Artificial Sequence
  Synthetic
caccgctgtcccaaaaggtcatccccatgaatttagttgtgcctggtctttgagatatttctcgatggcagtgactcttgcctggaggtttttcgtcccccagacggtcagccgcaacagcatatcagcagccagggcct

SEQ ID NO: 417781 - DNA, 140 bp, Artificial Sequence
  Synthetic
atacgccatgctgggtctcccttaagccagactggaataacatgacatggcaacaatgggagaggcaagtccgcttcttggatgcaaatataacaaaattactagaagaggcacagataccgtacttgggagtcggccat

SEQ ID NO: 417782 - DNA, 140 bp, Artificial Sequence
  Synthetic
atggccgactcccaagtacggtatctgtgcctcttctagtaattttgttatatttgcatccaagaagcggacttgcctctcccattgttgccatgtcatgttattccagtctggcttaagggagacccagcatggcgtat

SEQ ID NO: 417783 - DNA, 140 bp, Artificial Sequence
  Synthetic
atacgccatgctgggtctccttcagtaattggtttgacttcacctcctggatggcatacatcaggttaggattatatatagtaataggaatagtagtattaagaatagcaatatacattacgtacttgggagtcggccat

SEQ ID NO: 417784 - DNA, 140 bp, Artificial Sequence
  Synthetic
atggccgactcccaagtacgtaatgtatattgctattcttaatactactattcctattactatatataatcctaacctgatgtatgccatccaggaggtgaagtcaaaccaattactgaaggagacccagcatggcgtat

SEQ ID NO: 417785 - DNA, 140 bp, Artificial Sequence
  Synthetic
aggccctggctgctgatatgcctccctcttatactcaacagatccctatccgcaaggaccggggacagccagccaacgaagaaacagaagaaggaggtggaaacaacgagggctacagatgaccttttgggacagcggtg

SEQ ID NO: 417786 - DNA, 140 bp, Artificial Sequence
  Synthetic
caccgctgtcccaaaaggtcatctgtagccctcgttgtttccacctccttcttctgtttcttcgttggctggctgtccccggtccttgcggatagggatctgttgagtataagagggaggcatatcagcagccagggcct

SEQ ID NO: 417787 - DNA, 140 bp, Artificial Sequence
  Synthetic
atacgccatgctgggtctccgacctcttgatttggctatacagcggctgcagaaccttattatcaaagaccttccaaaccctccaaccagtactccaaccgctcaggcttccacctgcatcgtacttgggagtcggccat

SEQ ID NO: 417788 - DNA, 140 bp, Artificial Sequence
  Synthetic
atggccgactcccaagtacgatgcaggtggaagcctgagcggttggagtactggttggagggtttggaaggtctttgataataaggttctgcagccgctgtatagccaaatcaagaggtcggagacccagcatggcgtat

SEQ ID NO: 417789 - DNA, 140 bp, Artificial Sequence
  Synthetic
aggccctggctgctgatatgcttccaaaccctccaaccagtactccaaccgctcaggcttccacctgcatacctccgatatgggatcagctggttccaagaagcaatccaagcagcagccgaccttttgggacagcggtg

SEQ ID NO: 417790 - DNA, 140 bp, Artificial Sequence
  Synthetic
caccgctgtcccaaaaggtcggctgctgcttggattgcttcttggaaccagctgatcccatatcggaggtatgcaggtggaagcctgagcggttggagtactggttggagggtttggaagcatatcagcagccagggcct

SEQ ID NO: 417791 - DNA, 140 bp, Artificial Sequence
  Synthetic
atacgccatgctgggtctcccctcaggagagcggcaggagagatcattgcaatacccaggaggatcagacaaggggctgaactcgccctcttgtgatggacaaaagactttgggagcagacgtacttgggagtcggccat

SEQ ID NO: 417792 - DNA, 140 bp, Artificial Sequence
  Synthetic
atggccgactcccaagtacgtctgctcccaaagtcttttgtccatcacaagagggcgagttcagccccttgtctgatcctcctgggtattgcaatgatctctcctgccgctctcctgaggggagacccagcatggcgtat

SEQ ID NO: 417793 - DNA, 140 bp, Artificial Sequence
  Synthetic
atacgccatgctgggtctccaatgaagtaggggtccgtgtaagacccggggtcccactgaggccaatgacattcaaactagcagtagacatgtctcattttttaaaagaaaagggggaaccgtacttgggagtcggccat

SEQ ID NO: 417794 - DNA, 140 bp, Artificial Sequence
  Synthetic
atggccgactcccaagtacggttcccccttttcttttaaaaaatgagacatgtctactgctagtttgaatgtcattggcctcagtgggaccccgggtcttacacggacccctacttcattggagacccagcatggcgtat

SEQ ID NO: 417795 - DNA, 140 bp, Artificial Sequence
  Synthetic
atacgccatgctgggtctcctggcgcccgaacagggacttgaggaagagtgagagtcttcggagcacggctgagtgagggcagtaagggcggcaggaatcaaccacgacggagagctcctcgtacttgggagtcggccat

SEQ ID NO: 417796 - DNA, 140 bp, Artificial Sequence
  Synthetic
atggccgactcccaagtacgaggagctctccgtcgtggttgattcctgccgcccttactgccctcactcagccgtgctccgaagactctcactcttcctcaagtccctgttcgggcgccaggagacccagcatggcgtat

SEQ ID NO: 417797 - DNA, 140 bp, Artificial Sequence
  Synthetic
aggccctggctgctgatatgtgagtgagggcagtaagggcggcaggaatcaaccacgacggagagctcctgtaaaagcgcaggccggtaccaggcagcgtgaggagcgggaggagaagaggaccttttgggacagcggtg

SEQ ID NO: 417798 - DNA, 140 bp, Artificial Sequence
  Synthetic
caccgctgtcccaaaaggtcctcttctcctcccgctcctcacgctgcctggtaccggcctgcgcttttacaggagctctccgtcgtggttgattcctgccgcccttactgccctcactcacatatcagcagccagggcct

SEQ ID NO: 417799 - DNA, 140 bp, Artificial Sequence
  Synthetic
aggccctggctgctgatatgagggaagaaaacagatgaattagaaaaagttaggttacggcccggcggaaagaaaaaatattgtctaaagcatatagtatgggcagtgaacgaattggacgaccttttgggacagcggtg

SEQ ID NO: 417800 - DNA, 140 bp, Artificial Sequence
  Synthetic
caccgctgtcccaaaaggtcgtccaattcgttcactgcccatactatatgctttagacaatattttttctttccgccgggccgtaacctaactttttctaattcatctgttttcttccctcatatcagcagccagggcct

SEQ ID NO: 417801 - DNA, 140 bp, Artificial Sequence
  Synthetic
atacgccatgctgggtctccagaaaaaatattgtctaaagcatatagtatgggcagtgaacgaattggacagatatggattagcagagagcctgttggagtcaaaagaaggatgtcacaacgtacttgggagtcggccat

SEQ ID NO: 417802 - DNA, 140 bp, Artificial Sequence
  Synthetic
atggccgactcccaagtacgttgtgacatccttcttttgactccaacaggctctctgctaatccatatctgtccaattcgttcactgcccatactatatgctttagacaatattttttctggagacccagcatggcgtat

SEQ ID NO: 417803 - DNA, 140 bp, Artificial Sequence
  Synthetic
atacgccatgctgggtctccaaagcctttttaatactgtctgcgtcatttactgtctgcacgcagaagtgaaagtgaaagatactgaggatgctaaaaagatagcacagagccatctagccgtacttgggagtcggccat

SEQ ID NO: 417804 - DNA, 140 bp, Artificial Sequence
  Synthetic
atggccgactcccaagtacggctagatggctctgtgctatctttttagcatcctcagtatctttcactttcacttctgcgtgcagacagtaaatgacgcagacagtattaaaaaggctttggagacccagcatggcgtat

SEQ ID NO: 417805 - DNA, 140 bp, Artificial Sequence
  Synthetic
aggccctggctgctgatatgaaagtgaaagatactgaggatgctaaaaagatagcacagagccatctagcggcgaacacggaaaaagcgccagctacaagtaaaccaacagcaccacctagaccttttgggacagcggtg

SEQ ID NO: 417806 - DNA, 140 bp, Artificial Sequence
  Synthetic
caccgctgtcccaaaaggtctaggtggtgctgttggtttacttgtagctggcgctttttccgtgttcgccgctagatggctctgtgctatctttttagcatcctcagtatctttcactttcatatcagcagccagggcct

SEQ ID NO: 417807 - DNA, 140 bp, Artificial Sequence
  Synthetic
atacgccatgctgggtctccccgctaagcccccgaaccttaaatgcctgggtaaaattagtagaggaaaagaaattcggggcagaagtagtaccaggattccaggcactatcagaaggatcgtacttgggagtcggccat

SEQ ID NO: 417808 - DNA, 140 bp, Artificial Sequence
  Synthetic
atggccgactcccaagtacgatccttctgatagtgcctggaatcctggtactacttctgccccgaatttcttttcctctactaattttacccaggcatttaaggttcgggggcttagcggggagacccagcatggcgtat

SEQ ID NO: 417809 - DNA, 140 bp, Artificial Sequence
  Synthetic
aggccctggctgctgatatggaaattcggggcagaagtagtaccaggattccaggcactatcagaaggatgcaccccttatgatattaatcagatgctaaattgtgtaggagaacatcaagaccttttgggacagcggtg

SEQ ID NO: 417810 - DNA, 140 bp, Artificial Sequence
  Synthetic
caccgctgtcccaaaaggtcttgatgttctcctacacaatttagcatctgattaatatcataaggggtgcatccttctgatagtgcctggaatcctggtactacttctgccccgaatttccatatcagcagccagggcct

SEQ ID NO: 417811 - DNA, 140 bp, Artificial Sequence
  Synthetic
atacgccatgctgggtctccggaccagcagcacccgtcaccgggcccaatgccagcaggacagcttagggacccaagagggtcagacatagcaggaaccactagcacagtggaggagcagcgtacttgggagtcggccat

SEQ ID NO: 417812 - DNA, 140 bp, Artificial Sequence
  Synthetic
atggccgactcccaagtacgctgctcctccactgtgctagtggttcctgctatgtctgaccctcttgggtccctaagctgtcctgctggcattgggcccggtgacgggtgctgctggtccggagacccagcatggcgtat

SEQ ID NO: 417813 - DNA, 140 bp, Artificial Sequence
  Synthetic
aggccctggctgctgatatgacccaagagggtcagacatagcaggaaccactagcacagtggaggagcagatacagtggatgtacaggccccaaaaccctatcccagtaggaaacatttagaccttttgggacagcggtg

SEQ ID NO: 417814 - DNA, 140 bp, Artificial Sequence
  Synthetic
caccgctgtcccaaaaggtctaaatgtttcctactgggatagggttttggggcctgtacatccactgtatctgctcctccactgtgctagtggttcctgctatgtctgaccctcttgggtcatatcagcagccagggcct

SEQ ID NO: 417815 - DNA, 140 bp, Artificial Sequence
  Synthetic
atacgccatgctgggtctccctaccaatatactggacataaagcagggaccaaaggaacccttccaaagctatgtagacagattctacaaaagtttacgggcagaacaaacagacccggccgtacttgggagtcggccat

SEQ ID NO: 417816 - DNA, 140 bp, Artificial Sequence
  Synthetic
atggccgactcccaagtacggccgggtctgtttgttctgcccgtaaacttttgtagaatctgtctacatagctttggaagggttcctttggtccctgctttatgtccagtatattggtagggagacccagcatggcgtat

SEQ ID NO: 417817 - DNA, 140 bp, Artificial Sequence
  Synthetic
aggccctggctgctgatatgtatgtagacagattctacaaaagtttacgggcagaacaaacagacccggcagtaaaaaattgggtgacgcaaacactgctgattcagaatgctaacccaggaccttttgggacagcggtg

SEQ ID NO: 417818 - DNA, 140 bp, Artificial Sequence
  Synthetic
caccgctgtcccaaaaggtcctgggttagcattctgaatcagcagtgtttgcgtcacccaattttttactgccgggtctgtttgttctgcccgtaaacttttgtagaatctgtctacatacatatcagcagccagggcct

SEQ ID NO: 417819 - DNA, 140 bp, Artificial Sequence
  Synthetic
atacgccatgctgggtctccatgctaacagcctgccaagggataggaggcccagggcaaaaggcaaggctaatggccgaggctttaaaggaagccttgacacctccacctttaccatttgcgtacttgggagtcggccat

SEQ ID NO: 417820 - DNA, 140 bp, Artificial Sequence
  Synthetic
atggccgactcccaagtacgcaaatggtaaaggtggaggtgtcaaggcttcctttaaagcctcggccattagccttgccttttgccctgggcctcctatcccttggcaggctgttagcatggagacccagcatggcgtat

SEQ ID NO: 417821 - DNA, 140 bp, Artificial Sequence
  Synthetic
aggccctggctgctgatatgaatggccgaggctttaaaggaagccttgacacctccacctttaccatttgctgcagttcaacaaagagcagggaagagaggagcagtgacatgctggaacgaccttttgggacagcggtg

SEQ ID NO: 417822 - DNA, 140 bp, Artificial Sequence
  Synthetic
caccgctgtcccaaaaggtcgttccagcatgtcactgctcctctcttccctgctctttgttgaactgcagcaaatggtaaaggtggaggtgtcaaggcttcctttaaagcctcggccattcatatcagcagccagggcct

SEQ ID NO: 417823 - DNA, 140 bp, Artificial Sequence
  Synthetic
atacgccatgctgggtctccgggatgctggaaatgcggaaaacaaggacacatcatgtcaaaatgcccagaaagacaggcgggttttttaggatttggcccctggggaaagaagcctcgccgtacttgggagtcggccat

SEQ ID NO: 417824 - DNA, 140 bp, Artificial Sequence
  Synthetic
atggccgactcccaagtacggcgaggcttctttccccaggggccaaatcctaaaaaacccgcctgtctttctgggcattttgacatgatgtgtccttgttttccgcatttccagcatcccggagacccagcatggcgtat

SEQ ID NO: 417825 - DNA, 140 bp, Artificial Sequence
  Synthetic
aggccctggctgctgatatgaaagacaggcgggttttttaggatttggcccctggggaaagaagcctcgcaacttccctgtagcccaagcaccccaggggatactgccatctgcaccaccgaccttttgggacagcggtg

SEQ ID NO: 417826 - DNA, 140 bp, Artificial Sequence
  Synthetic
caccgctgtcccaaaaggtcggtggtgcagatggcagtatcccctggggtgcttgggctacagggaagttgcgaggcttctttccccaggggccaaatcctaaaaaacccgcctgtctttcatatcagcagccagggcct

SEQ ID NO: 417827 - DNA, 140 bp, Artificial Sequence
  Synthetic
atacgccatgctgggtctcccccctgcagatccagcagtggagatgttgaaggactacatgcagctagggagaaagcagaaagggggcagggagaaaccctacaaggaggtgacagaggacgtacttgggagtcggccat

SEQ ID NO: 417828 - DNA, 140 bp, Artificial Sequence
  Synthetic
atggccgactcccaagtacgtcctctgtcacctccttgtagggtttctccctgccccctttctgctttctccctagctgcatgtagtccttcaacatctccactgctggatctgcaggggggagacccagcatggcgtat

SEQ ID NO: 417829 - DNA, 140 bp, Artificial Sequence
  Synthetic
aggccctggctgctgatatgagaaagcagaaagggggcagggagaaaccctacaaggaggtgacagaggatttgctgcacctcaattctctctttggagaagaccagtagttaaagcatagaccttttgggacagcggtg

SEQ ID NO: 417830 - DNA, 140 bp, Artificial Sequence
  Synthetic
caccgctgtcccaaaaggtctatgctttaactactggtcttctccaaagagagaattgaggtgcagcaaatcctctgtcacctccttgtagggtttctccctgccccctttctgctttctcatatcagcagccagggcct

SEQ ID NO: 417831 - DNA, 140 bp, Artificial Sequence
  Synthetic
atacgccatgctgggtctcccaatagtagcaggaatagaattaggtagtgattacaccccaaaaatagtaggaggaataggaggattcataaatactaaagagtacaaaaatgtagaaatcgtacttgggagtcggccat

SEQ ID NO: 417832 - DNA, 140 bp, Artificial Sequence
  Synthetic
atggccgactcccaagtacgatttctacatttttgtactctttagtatttatgaatcctcctattcctcctactatttttggggtgtaatcactacctaattctattcctgctactattgggagacccagcatggcgtat

SEQ ID NO: 417833 - DNA, 140 bp, Artificial Sequence
  Synthetic
aggccctggctgctgatatgggaggaataggaggattcataaatactaaagagtacaaaaatgtagaaatagaagtagtaggaaaaaagataagagcaactataatgacaggagatacccgaccttttgggacagcggtg

SEQ ID NO: 417834 - DNA, 140 bp, Artificial Sequence
  Synthetic
caccgctgtcccaaaaggtcgggtatctcctgtcattatagttgctcttatcttttttcctactacttctatttctacatttttgtactctttagtatttatgaatcctcctattcctcccatatcagcagccagggcct

SEQ ID NO: 417835 - DNA, 140 bp, Artificial Sequence
  Synthetic
atacgccatgctgggtctccaatttcccagtagcaaaaatagaaccagtaaaggtcaaactaaaacctggaaaagatggaccaaaaatcagacaatggcctctatctaaagaaaagataccgtacttgggagtcggccat

SEQ ID NO: 417836 - DNA, 140 bp, Artificial Sequence
  Synthetic
atggccgactcccaagtacggtatcttttctttagatagaggccattgtctgatttttggtccatcttttccaggttttagtttgacctttactggttctatttttgctactgggaaattggagacccagcatggcgtat

SEQ ID NO: 417837 - DNA, 140 bp, Artificial Sequence
  Synthetic
aggccctggctgctgatatgaaaagatggaccaaaaatcagacaatggcctctatctaaagaaaagatactggcccttaaagagatctgtgaaaaaaatggaaaaagagggacaactagagaccttttgggacagcggtg

SEQ ID NO: 417838 - DNA, 140 bp, Artificial Sequence
  Synthetic
caccgctgtcccaaaaggtctctagttgtccctctttttccatttttttcacagatctctttaagggccagtatcttttctttagatagaggccattgtctgatttttggtccatcttttcatatcagcagccagggcct

SEQ ID NO: 417839 - DNA, 140 bp, Artificial Sequence
  Synthetic
atacgccatgctgggtctccagagagacaaaaacaaatggagaatgttgatagattttagagaattaaacaaggtaacccaagactttacagaagtccagctgggcattccccacccggccgtacttgggagtcggccat

SEQ ID NO: 417840 - DNA, 140 bp, Artificial Sequence
  Synthetic
atggccgactcccaagtacggccgggtggggaatgcccagctggacttctgtaaagtcttgggttaccttgtttaattctctaaaatctatcaacattctccatttgtttttgtctctctggagacccagcatggcgtat

SEQ ID NO: 417841 - DNA, 140 bp, Artificial Sequence
  Synthetic
aggccctggctgctgatatgaaggtaacccaagactttacagaagtccagctgggcattccccacccggcagggctggcagaaagaaaaagaataacagtactagatataggagatgcctgaccttttgggacagcggtg

SEQ ID NO: 417842 - DNA, 140 bp, Artificial Sequence
  Synthetic
caccgctgtcccaaaaggtcaggcatctcctatatctagtactgttattctttttctttctgccagccctgccgggtggggaatgcccagctggacttctgtaaagtcttgggttaccttcatatcagcagccagggcct

SEQ ID NO: 417843 - DNA, 140 bp, Artificial Sequence
  Synthetic
atacgccatgctgggtctccttgccatcagtgaataatgcagaaccaggaaaaagatacatctataaggtcctaccacaagggtggaaagggtccccagcaatttttcaatactccgtagcgtacttgggagtcggccat

SEQ ID NO: 417844 - DNA, 140 bp, Artificial Sequence
  Synthetic
atggccgactcccaagtacgctacggagtattgaaaaattgctggggaccctttccacccttgtggtaggaccttatagatgtatctttttcctggttctgcattattcactgatggcaaggagacccagcatggcgtat

SEQ ID NO: 417845 - DNA, 140 bp, Artificial Sequence
  Synthetic
aggccctggctgctgatatgcctaccacaagggtggaaagggtccccagcaatttttcaatactccgtagggaaagtactagaccccttcagaaaagccaatgatgatgtcaccatagtcgaccttttgggacagcggtg

SEQ ID NO: 417846 - DNA, 140 bp, Artificial Sequence
  Synthetic
caccgctgtcccaaaaggtcgactatggtgacatcatcattggcttttctgaaggggtctagtactttccctacggagtattgaaaaattgctggggaccctttccacccttgtggtaggcatatcagcagccagggcct

SEQ ID NO: 417847 - DNA, 140 bp, Artificial Sequence
  Synthetic
atacgccatgctgggtctcctgacagggtagtgcttcaactgaaagagctattaaatgacataggattctctaccccagaagaaaagttccaaaaggaccccccattcaaatggatggggcgtacttgggagtcggccat

SEQ ID NO: 417848 - DNA, 140 bp, Artificial Sequence
  Synthetic
atggccgactcccaagtacgccccatccatttgaatggggggtccttttggaacttttcttctggggtagagaatcctatgtcatttaatagctctttcagttgaagcactaccctgtcaggagacccagcatggcgtat

SEQ ID NO: 417849 - DNA, 140 bp, Artificial Sequence
  Synthetic
aggccctggctgctgatatgctaccccagaagaaaagttccaaaaggaccccccattcaaatggatggggtatgagctctggccaaaaaagtggaaactgcaaaaaatacagctgccagagaccttttgggacagcggtg

SEQ ID NO: 417850 - DNA, 140 bp, Artificial Sequence
  Synthetic
caccgctgtcccaaaaggtctctggcagctgtattttttgcagtttccacttttttggccagagctcataccccatccatttgaatggggggtccttttggaacttttcttctggggtagcatatcagcagccagggcct

SEQ ID NO: 417851 - DNA, 140 bp, Artificial Sequence
  Synthetic
atacgccatgctgggtctccactgggcagctcaactctttcctgggattaaaacaaggcatatatgcagactaatcaggggaaaaatgaccttgacagaagaagtacagtggacagaattcgtacttgggagtcggccat

SEQ ID NO: 417852 - DNA, 140 bp, Artificial Sequence
  Synthetic
atggccgactcccaagtacgaattctgtccactgtacttcttctgtcaaggtcatttttcccctgattagtctgcatatatgccttgttttaatcccaggaaagagttgagctgcccagtggagacccagcatggcgtat

SEQ ID NO: 417853 - DNA, 140 bp, Artificial Sequence
  Synthetic
aggccctggctgctgatatgctaatcaggggaaaaatgaccttgacagaagaagtacagtggacagaattagcagaggcagaatttcaggaaaacaaaattatcttagaacaagaacagggaccttttgggacagcggtg

SEQ ID NO: 417854 - DNA, 140 bp, Artificial Sequence
  Synthetic
caccgctgtcccaaaaggtccctgttcttgttctaagataattttgttttcctgaaattctgcctctgctaattctgtccactgtacttcttctgtcaaggtcatttttcccctgattagcatatcagcagccagggcct

SEQ ID NO: 417855 - DNA, 140 bp, Artificial Sequence
  Synthetic
atacgccatgctgggtctccaacctagcaaatcagtggacatacaaaatccatcagggagacagaatcctaagagtaggaaaatatgcaaaggttaaaaacacccacaccaacggagtaacgtacttgggagtcggccat

SEQ ID NO: 417856 - DNA, 140 bp, Artificial Sequence
  Synthetic
atggccgactcccaagtacgttactccgttggtgtgggtgtttttaacctttgcatattttcctactcttaggattctgtctccctgatggattttgtatgtccactgatttgctaggttggagacccagcatggcgtat

SEQ ID NO: 417857 - DNA, 140 bp, Artificial Sequence
  Synthetic
aggccctggctgctgatatgaagagtaggaaaatatgcaaaggttaaaaacacccacaccaacggagtaagactactggcacatgtaatccagaaaataggaaaggaagcattggtcaccgaccttttgggacagcggtg

SEQ ID NO: 417858 - DNA, 140 bp, Artificial Sequence
  Synthetic
caccgctgtcccaaaaggtcggtgaccaatgcttcctttcctattttctggattacatgtgccagtagtcttactccgttggtgtgggtgtttttaacctttgcatattttcctactcttcatatcagcagccagggcct

SEQ ID NO: 417859 - DNA, 140 bp, Artificial Sequence
  Synthetic
atacgccatgctgggtctcctcaatggtggacagattactggcaagtaacctggatcccagaatgggattttgtctcaacaccacctttgataagactagcctataacctagtcaaagaccgtacttgggagtcggccat

SEQ ID NO: 417860 - DNA, 140 bp, Artificial Sequence
  Synthetic
atggccgactcccaagtacggtctttgactaggttataggctagtcttatcaaaggtggtgttgagacaaaatcccattctgggatccaggttacttgccagtaatctgtccaccattgaggagacccagcatggcgtat

SEQ ID NO: 417861 - DNA, 140 bp, Artificial Sequence
  Synthetic
aggccctggctgctgatatgttgtctcaacaccacctttgataagactagcctataacctagtcaaagaccccctggagggagtagagacctactacacagatggatcctgtaacaggacgaccttttgggacagcggtg

SEQ ID NO: 417862 - DNA, 140 bp, Artificial Sequence
  Synthetic
caccgctgtcccaaaaggtcgtcctgttacaggatccatctgtgtagtaggtctctactccctccagggggtctttgactaggttataggctagtcttatcaaaggtggtgttgagacaacatatcagcagccagggcct

SEQ ID NO: 417863 - DNA, 140 bp, Artificial Sequence
  Synthetic
atacgccatgctgggtctccttaaagcattagagcaaacaacaaatcagcaagcagaacttgaagcatttgcactagcattacaggattcaggaccacaggtcaatatcatagtggactccgtacttgggagtcggccat

SEQ ID NO: 417864 - DNA, 140 bp, Artificial Sequence
  Synthetic
atggccgactcccaagtacggagtccactatgatattgacctgtggtcctgaatcctgtaatgctagtgcaaatgcttcaagttctgcttgctgatttgttgtttgctctaatgctttaaggagacccagcatggcgtat

SEQ ID NO: 417865 - DNA, 140 bp, Artificial Sequence
  Synthetic
aggccctggctgctgatatggcactagcattacaggattcaggaccacaggtcaatatcatagtggactcacaatatgtcatgggaataatagctgcacagccaacagaaacagaatcacgaccttttgggacagcggtg

SEQ ID NO: 417866 - DNA, 140 bp, Artificial Sequence
  Synthetic
caccgctgtcccaaaaggtcgtgattctgtttctgttggctgtgcagctattattcccatgacatattgtgagtccactatgatattgacctgtggtcctgaatcctgtaatgctagtgccatatcagcagccagggcct

SEQ ID NO: 417867 - DNA, 140 bp, Artificial Sequence
  Synthetic
atacgccatgctgggtctccgtaggatgggtgccagctcataaaggactgggtggtaatcaagaagtagaccacctagtgagtcaaggaatcagacacatcctgtttctagaaaatatagcgtacttgggagtcggccat

SEQ ID NO: 417868 - DNA, 140 bp, Artificial Sequence
  Synthetic
atggccgactcccaagtacgctatattttctagaaacaggatgtgtctgattccttgactcactaggtggtctacttcttgattaccacccagtcctttatgagctggcacccatcctacggagacccagcatggcgtat

SEQ ID NO: 417869 - DNA, 140 bp, Artificial Sequence
  Synthetic
aggccctggctgctgatatgccacctagtgagtcaaggaatcagacacatcctgtttctagaaaatatagaaccagcccaagaagagcatgaaaaatatcatggtaatgtaaaagaattagaccttttgggacagcggtg

SEQ ID NO: 417870 - DNA, 140 bp, Artificial Sequence
  Synthetic
caccgctgtcccaaaaggtctaattcttttacattaccatgatatttttcatgctcttcttgggctggttctatattttctagaaacaggatgtgtctgattccttgactcactaggtggcatatcagcagccagggcct

SEQ ID NO: 417871 - DNA, 140 bp, Artificial Sequence
  Synthetic
atacgccatgctgggtctccctgtgacaaatgtcaacagaaaggagaagctatccatggacaggtgaatgcagaactagggacatggcaaatggattgtacacacttagagggaaaaattcgtacttgggagtcggccat

SEQ ID NO: 417872 - DNA, 140 bp, Artificial Sequence
  Synthetic
atggccgactcccaagtacgaatttttccctctaagtgtgtacaatccatttgccatgtccctagttctgcattcacctgtccatggatagcttctcctttctgttgacatttgtcacagggagacccagcatggcgtat

SEQ ID NO: 417873 - DNA, 140 bp, Artificial Sequence
  Synthetic
aggccctggctgctgatatgcagaactagggacatggcaaatggattgtacacacttagagggaaaaattataatagtggcagtccatgtagccagtggatttatagaagcagaagtaatgaccttttgggacagcggtg

SEQ ID NO: 417874 - DNA, 140 bp, Artificial Sequence
  Synthetic
caccgctgtcccaaaaggtcattacttctgcttctataaatccactggctacatggactgccactattataatttttccctctaagtgtgtacaatccatttgccatgtccctagttctgcatatcagcagccagggcct

SEQ ID NO: 417875 - DNA, 140 bp, Artificial Sequence
  Synthetic
atacgccatgctgggtctccgcagatggcctatcacacacctacacacagacaatggtgccaacttcacttcacaagacgtgaaaatggcagcctggtggataggagtagaacagaccttcgtacttgggagtcggccat

SEQ ID NO: 417876 - DNA, 140 bp, Artificial Sequence
  Synthetic
atggccgactcccaagtacgaaggtctgttctactcctatccaccaggctgccattttcacgtcttgtgaagtgaagttggcaccattgtctgtgtgtaggtgtgtgataggccatctgcggagacccagcatggcgtat

SEQ ID NO: 417877 - DNA, 140 bp, Artificial Sequence
  Synthetic
aggccctggctgctgatatgtcacaagacgtgaaaatggcagcctggtggataggagtagaacagaccttcggagtaccttataatccacaaagtcagggagtagtagaagcaatgaaccgaccttttgggacagcggtg

SEQ ID NO: 417878 - DNA, 140 bp, Artificial Sequence
  Synthetic
caccgctgtcccaaaaggtcggttcattgcttctactactccctgactttgtggattataaggtactccgaaggtctgttctactcctatccaccaggctgccattttcacgtcttgtgacatatcagcagccagggcct

SEQ ID NO: 417879 - DNA, 140 bp, Artificial Sequence
  Synthetic
atacgccatgctgggtctccgagacagttgtactaatggcagctcattgcatgaattttaaaagaaggggaggaataggggatatgacccctgcagaaagaatagttaacatgataactgcgtacttgggagtcggccat

SEQ ID NO: 417880 - DNA, 140 bp, Artificial Sequence
  Synthetic
atggccgactcccaagtacgcagttatcatgttaactattctttctgcaggggtcatatcccctattcctccccttcttttaaaattcatgcaatgagctgccattagtacaactgtctcggagacccagcatggcgtat

SEQ ID NO: 417881 - DNA, 140 bp, Artificial Sequence
  Synthetic
aggccctggctgctgatatgaggaataggggatatgacccctgcagaaagaatagttaacatgataactgcagaacaggagatacaattcctccaaacaaaaaagttaaaatttcaaaatgaccttttgggacagcggtg

SEQ ID NO: 417882 - DNA, 140 bp, Artificial Sequence
  Synthetic
caccgctgtcccaaaaggtcattttgaaattttaacttttttgtttggaggaattgtatctcctgttctgcagttatcatgttaactattctttctgcaggggtcatatcccctattcctcatatcagcagccagggcct

SEQ ID NO: 417883 - DNA, 140 bp, Artificial Sequence
  Synthetic
atacgccatgctgggtctcctgagctattgtggaaaggggaaggagcagtcatcataaaggtagggacagaaatcaaagtaatacccagaagaaaagcaaagattatcaagaattatggacgtacttgggagtcggccat

SEQ ID NO: 417884 - DNA, 140 bp, Artificial Sequence
  Synthetic
atggccgactcccaagtacgtccataattcttgataatctttgcttttcttctgggtattactttgatttctgtccctacctttatgatgactgctccttcccctttccacaatagctcaggagacccagcatggcgtat

SEQ ID NO: 417885 - DNA, 140 bp, Artificial Sequence
  Synthetic
aggccctggctgctgatatgaaatcaaagtaatacccagaagaaaagcaaagattatcaagaattatggaggaggaaaagaattggattgcagtgccaacatggaggataccgggcaggcgaccttttgggacagcggtg

SEQ ID NO: 417886 - DNA, 140 bp, Artificial Sequence
  Synthetic
caccgctgtcccaaaaggtcgcctgcccggtatcctccatgttggcactgcaatccaattcttttcctcctccataattcttgataatctttgcttttcttctgggtattactttgatttcatatcagcagccagggcct

SEQ ID NO: 417887 - DNA, 140 bp, Artificial Sequence
  Synthetic
atacgccatgctgggtctccttggaacaggtcacttatgttcctcaccataaggtaggatgggcttggtggacctgcagtagagtaatattccccctaaaagaaggagcatatctagagacgtacttgggagtcggccat

SEQ ID NO: 417888 - DNA, 140 bp, Artificial Sequence
  Synthetic
atggccgactcccaagtacgtctctagatatgctccttcttttagggggaatattactctactgcaggtccaccaagcccatcctaccttatggtgaggaacataagtgacctgttccaaggagacccagcatggcgtat

SEQ ID NO: 417889 - DNA, 140 bp, Artificial Sequence
  Synthetic
aggccctggctgctgatatggacctgcagtagagtaatattccccctaaaagaaggagcatatctagagatccaaggatattggaacctgaccccggaaaggggattcctgagtgcctatgaccttttgggacagcggtg

SEQ ID NO: 417890 - DNA, 140 bp, Artificial Sequence
  Synthetic
caccgctgtcccaaaaggtcataggcactcaggaatcccctttccggggtcaggttccaatatccttggatctctagatatgctccttcttttagggggaatattactctactgcaggtccatatcagcagccagggcct

SEQ ID NO: 417891 - DNA, 140 bp, Artificial Sequence
  Synthetic
atacgccatgctgggtctcctgatgtagcagaccacctattgcatgggtcttatttcttttgctttacagctaatgaagtaaggagagccatcaggggagaaaagatattgtcctactgccgtacttgggagtcggccat

SEQ ID NO: 417892 - DNA, 140 bp, Artificial Sequence
  Synthetic
atggccgactcccaagtacggcagtaggacaatatcttttctcccctgatggctctccttacttcattagctgtaaagcaaaagaaataagacccatgcaataggtggtctgctacatcaggagacccagcatggcgtat

SEQ ID NO: 417893 - DNA, 140 bp, Artificial Sequence
  Synthetic
aggccctggctgctgatatgctaatgaagtaaggagagccatcaggggagaaaagatattgtcctactgcaactacccatcagcccatagaggacaggtaccaagtttacagtttctagcgaccttttgggacagcggtg

SEQ ID NO: 417894 - DNA, 140 bp, Artificial Sequence
  Synthetic
caccgctgtcccaaaaggtcgctagaaactgtaaacttggtacctgtcctctatgggctgatgggtagttgcagtaggacaatatcttttctcccctgatggctctccttacttcattagcatatcagcagccagggcct

SEQ ID NO: 417895 - DNA, 140 bp, Artificial Sequence
  Synthetic
atacgccatgctgggtctccccaggaaacagcggcgaagaaacaataggagaagcattcgaatggctagaaagaacaataacagagctcaacagagtagctgtcaatcatctgcccagggcgtacttgggagtcggccat

SEQ ID NO: 417896 - DNA, 140 bp, Artificial Sequence
  Synthetic
atggccgactcccaagtacgccctgggcagatgattgacagctactctgttgagctctgttattgttctttctagccattcgaatgcttctcctattgtttcttcgccgctgtttcctggggagacccagcatggcgtat

SEQ ID NO: 417897 - DNA, 140 bp, Artificial Sequence
  Synthetic
aggccctggctgctgatatgaagaacaataacagagctcaacagagtagctgtcaatcatctgcccagggaacttattttccaggtctggcagaggtcttgggcatattggcacgaggaagaccttttgggacagcggtg

SEQ ID NO: 417898 - DNA, 140 bp, Artificial Sequence
  Synthetic
caccgctgtcccaaaaggtcttcctcgtgccaatatgcccaagacctctgccagacctggaaaataagttccctgggcagatgattgacagctactctgttgagctctgttattgttcttcatatcagcagccagggcct

SEQ ID NO: 417899 - DNA, 140 bp, Artificial Sequence
  Synthetic
atacgccatgctgggtctccgaaagcactgtatatgcaccttgcaaggggatgtgcatgcttgcgggagggtcatgggccagggggatggagaccaggacctcctcctcctcctcctccacgtacttgggagtcggccat

SEQ ID NO: 417900 - DNA, 140 bp, Artificial Sequence
  Synthetic
atggccgactcccaagtacgtggaggaggaggaggaggaggtcctggtctccatccccctggcccatgaccctcccgcaagcatgcacatccccttgcaaggtgcatatacagtgctttcggagacccagcatggcgtat

SEQ ID NO: 417901 - DNA, 140 bp, Artificial Sequence
  Synthetic
aggccctggctgctgatatggtcatgggccagggggatggagaccaggacctcctcctcctcctcctccaggcttggcctaatgacagaagcagccccagagactcctccagagaatgaggaccttttgggacagcggtg

SEQ ID NO: 417902 - DNA, 140 bp, Artificial Sequence
  Synthetic
caccgctgtcccaaaaggtcctcattctctggaggagtctctggggctgcttctgtcattaggccaagcctggaggaggaggaggaggaggtcctggtctccatccccctggcccatgaccatatcagcagccagggcct

SEQ ID NO: 417903 - DNA, 140 bp, Artificial Sequence
  Synthetic
atacgccatgctgggtctccattaaagcaagaagccttaaggcattttgatccccgcttgctaactgcgcttggtaattttatctacggtaggcatggggataccattgcaggagcaggacgtacttgggagtcggccat

SEQ ID NO: 417904 - DNA, 140 bp, Artificial Sequence
  Synthetic
atggccgactcccaagtacgtcctgctcctgcaatggtatccccatgcctaccgtagataaaattaccaagcgcagttagcaagcggggatcaaaatgccttaaggcttcttgctttaatggagacccagcatggcgtat

SEQ ID NO: 417905 - DNA, 140 bp, Artificial Sequence
  Synthetic
aggccctggctgctgatatgttggtaattttatctacggtaggcatggggataccattgcaggagcaggagaactcattagaattctccagcgagcgctcttcctccacttcagaggagggaccttttgggacagcggtg

SEQ ID NO: 417906 - DNA, 140 bp, Artificial Sequence
  Synthetic
caccgctgtcccaaaaggtccctcctctgaagtggaggaagagcgctcgctggagaattctaatgagttctcctgctcctgcaatggtatccccatgcctaccgtagataaaattaccaacatatcagcagccagggcct

SEQ ID NO: 417907 - DNA, 140 bp, Artificial Sequence
  Synthetic
atacgccatgctgggtctccttataccgccctcttgaagcatgcagaaataagtgctactgtaagaaatgctgttaccattgccagctttgtttccttaaaaagggccttgggatatgttcgtacttgggagtcggccat

SEQ ID NO: 417908 - DNA, 140 bp, Artificial Sequence
  Synthetic
atggccgactcccaagtacgaacatatcccaaggccctttttaaggaaacaaagctggcaatggtaacagcatttcttacagtagcacttatttctgcatgcttcaagagggcggtataaggagacccagcatggcgtat

SEQ ID NO: 417909 - DNA, 140 bp, Artificial Sequence
  Synthetic
aggccctggctgctgatatgctgttaccattgccagctttgtttccttaaaaagggccttgggatatgttatgaccactcgagaaaaagatcttcaaaaagggctaaggttactgcgcctgaccttttgggacagcggtg

SEQ ID NO: 417910 - DNA, 140 bp, Artificial Sequence
  Synthetic
caccgctgtcccaaaaggtcaggcgcagtaaccttagccctttttgaagatctttttctcgagtggtcataacatatcccaaggccctttttaaggaaacaaagctggcaatggtaacagcatatcagcagccagggcct

SEQ ID NO: 417911 - DNA, 140 bp, Artificial Sequence
  Synthetic
atacgccatgctgggtctccgcactcctgcttataagtatctatggctttatgggcgaggatttcgtcactgtcttctatggcataccagcatggaagaatgcaacagttcccctcttttcgtacttgggagtcggccat

SEQ ID NO: 417912 - DNA, 140 bp, Artificial Sequence
  Synthetic
atggccgactcccaagtacgaaaagaggggaactgttgcattcttccatgctggtatgccatagaagacagtgacgaaatcctcgcccataaagccatagatacttataagcaggagtgcggagacccagcatggcgtat

SEQ ID NO: 417913 - DNA, 140 bp, Artificial Sequence
  Synthetic
aggccctggctgctgatatgtgtcttctatggcataccagcatggaagaatgcaacagttcccctcttttgtgccaccaaaaatagagatatttggggaactgtgcaatgcctcccagacgaccttttgggacagcggtg

SEQ ID NO: 417914 - DNA, 140 bp, Artificial Sequence
  Synthetic
caccgctgtcccaaaaggtcgtctgggaggcattgcacagttccccaaatatctctatttttggtggcacaaaagaggggaactgttgcattcttccatgctggtatgccatagaagacacatatcagcagccagggcct

SEQ ID NO: 417915 - DNA, 140 bp, Artificial Sequence
  Synthetic
atacgccatgctgggtctccatgggataacacagtgacagaacaggcagtagcggatgtgtggaatctatttgagacttcaataaaaccatgtgttaaattaaccccactatgtgtaacacgtacttgggagtcggccat

SEQ ID NO: 417916 - DNA, 140 bp, Artificial Sequence
  Synthetic
atggccgactcccaagtacgtgttacacatagtggggttaatttaacacatggttttattgaagtctcaaatagattccacacatccgctactgcctgttctgtcactgtgttatcccatggagacccagcatggcgtat

SEQ ID NO: 417917 - DNA, 140 bp, Artificial Sequence
  Synthetic
aggccctggctgctgatatgttgagacttcaataaaaccatgtgttaaattaaccccactatgtgtaacaatgaattgtagtaaccttaacaccacagccaacaccaccacagccaacaagaccttttgggacagcggtg

SEQ ID NO: 417918 - DNA, 140 bp, Artificial Sequence
  Synthetic
caccgctgtcccaaaaggtcttgttggctgtggtggtgttggctgtggtgttaaggttactacaattcattgttacacatagtggggttaatttaacacatggttttattgaagtctcaacatatcagcagccagggcct

SEQ ID NO: 417919 - DNA, 140 bp, Artificial Sequence
  Synthetic
atacgccatgctgggtctcctccgagatgacaactgcacaggtatagaatttgagaacatggtaacatgtcgattcaatatgacaggattaaaagtagatgaaccgaaaacgtataatgacgtacttgggagtcggccat

SEQ ID NO: 417920 - DNA, 140 bp, Artificial Sequence
  Synthetic
atggccgactcccaagtacgtcattatacgttttcggttcatctacttttaatcctgtcatattgaatcgacatgttaccatgttctcaaattctatacctgtgcagttgtcatctcggaggagacccagcatggcgtat

SEQ ID NO: 417921 - DNA, 140 bp, Artificial Sequence
  Synthetic
aggccctggctgctgatatgcgattcaatatgacaggattaaaagtagatgaaccgaaaacgtataatgacacctggtatgcagaagatgtacagtgtaatgggagcagatgccatataagaccttttgggacagcggtg

SEQ ID NO: 417922 - DNA, 140 bp, Artificial Sequence
  Synthetic
caccgctgtcccaaaaggtcttatatggcatctgctcccattacactgtacatcttctgcataccaggtgtcattatacgttttcggttcatctacttttaatcctgtcatattgaatcgcatatcagcagccagggcct

SEQ ID NO: 417923 - DNA, 140 bp, Artificial Sequence
  Synthetic
atacgccatgctgggtctccgaccaattaagatttaggtattgtgcccccccaggctttgcttttatgagatgcaatgattctaactattcaggctttatgcccaactgtagcaaggtagcgtacttgggagtcggccat

SEQ ID NO: 417924 - DNA, 140 bp, Artificial Sequence
  Synthetic
atggccgactcccaagtacgctaccttgctacagttgggcataaagcctgaatagttagaatcattgcatctcataaaagcaaagcctgggggggcacaatacctaaatcttaattggtcggagacccagcatggcgtat

SEQ ID NO: 417925 - DNA, 140 bp, Artificial Sequence
  Synthetic
aggccctggctgctgatatgatgcaatgattctaactattcaggctttatgcccaactgtagcaaggtagtagtatcctcctgtacaagaatgatggaaacacagacctctacgtggtttgaccttttgggacagcggtg

SEQ ID NO: 417926 - DNA, 140 bp, Artificial Sequence
  Synthetic
caccgctgtcccaaaaggtcaaaccacgtagaggtctgtgtttccatcattcttgtacaggaggatactactaccttgctacagttgggcataaagcctgaatagttagaatcattgcatcatatcagcagccagggcct

SEQ ID NO: 417927 - DNA, 140 bp, Artificial Sequence
  Synthetic
atacgccatgctgggtctcctaaaagcaataggaccgtcataagcttaaataaaaaatataatctgacaatacactgtagaaggccaggaaacaaaacagtcgtgccagtaacaattatgcgtacttgggagtcggccat

SEQ ID NO: 417928 - DNA, 140 bp, Artificial Sequence
  Synthetic
atggccgactcccaagtacgcataattgttactggcacgactgttttgtttcctggccttctacagtgtattgtcagattatattttttatttaagcttatgacggtcctattgcttttaggagacccagcatggcgtat

SEQ ID NO: 417929 - DNA, 140 bp, Artificial Sequence
  Synthetic
aggccctggctgctgatatgtacactgtagaaggccaggaaacaaaacagtcgtgccagtaacaattatgtcaggtctaatcttccattcacagcctattaatcaaagacccaggcaagcgaccttttgggacagcggtg

SEQ ID NO: 417930 - DNA, 140 bp, Artificial Sequence
  Synthetic
caccgctgtcccaaaaggtcgcttgcctgggtctttgattaataggctgtgaatggaagattagacctgacataattgttactggcacgactgttttgtttcctggccttctacagtgtacatatcagcagccagggcct

SEQ ID NO: 417931 - DNA, 140 bp, Artificial Sequence
  Synthetic
atacgccatgctgggtctccagaccattgcaaagcatcccagatatacaggaacaaacgataccgcaaaaataaagttagcagagcactcgcaaggctcagatccagaagtaagatatatcgtacttgggagtcggccat

SEQ ID NO: 417932 - DNA, 140 bp, Artificial Sequence
  Synthetic
atggccgactcccaagtacgatatatcttacttctggatctgagccttgcgagtgctctgctaactttatttttgcggtatcgtttgttcctgtatatctgggatgctttgcaatggtctggagacccagcatggcgtat

SEQ ID NO: 417933 - DNA, 140 bp, Artificial Sequence
  Synthetic
aggccctggctgctgatatgataaagttagcagagcactcgcaaggctcagatccagaagtaagatatatgtggactaactgtagaggagagtttttgtactgtaatatgacttggttccgaccttttgggacagcggtg

SEQ ID NO: 417934 - DNA, 140 bp, Artificial Sequence
  Synthetic
caccgctgtcccaaaaggtcggaaccaagtcatattacagtacaaaaactctcctctacagttagtccacatatatcttacttctggatctgagccttgcgagtgctctgctaactttatcatatcagcagccagggcct

SEQ ID NO: 417935 - DNA, 140 bp, Artificial Sequence
  Synthetic
atacgccatgctgggtctcccacatcagacaggtaatcaacacgtggcataaggttggaaaaaatgtatatttgcctccaagagaaggtcaccttacctgtaattccactgttaccagtacgtacttgggagtcggccat

SEQ ID NO: 417936 - DNA, 140 bp, Artificial Sequence
  Synthetic
atggccgactcccaagtacgtactggtaacagtggaattacaggtaaggtgaccttctcttggaggcaaatatacattttttccaaccttatgccacgtgttgattacctgtctgatgtgggagacccagcatggcgtat

SEQ ID NO: 417937 - DNA, 140 bp, Artificial Sequence
  Synthetic
aggccctggctgctgatatgtttgcctccaagagaaggtcaccttacctgtaattccactgttaccagtatcatagccaatattgattggacaaataataataggactaatattaccatggaccttttgggacagcggtg

SEQ ID NO: 417938 - DNA, 140 bp, Artificial Sequence
  Synthetic
caccgctgtcccaaaaggtccatggtaatattagtcctattattatttgtccaatcaatattggctatgatactggtaacagtggaattacaggtaaggtgaccttctcttggaggcaaacatatcagcagccagggcct

SEQ ID NO: 417939 - DNA, 140 bp, Artificial Sequence
  Synthetic
atacgccatgctgggtctccagtagaaataacaccaattggctttgcacctacaagtgtaaaaaggtattcctcagcgacaccgaggaataagagaggtgtaccggtgctagggtttttgcgtacttgggagtcggccat

SEQ ID NO: 417940 - DNA, 140 bp, Artificial Sequence
  Synthetic
atggccgactcccaagtacgcaaaaaccctagcaccggtacacctctcttattcctcggtgtcgctgaggaatacctttttacacttgtaggtgcaaagccaattggtgttatttctactggagacccagcatggcgtat

SEQ ID NO: 417941 - DNA, 140 bp, Artificial Sequence
  Synthetic
aggccctggctgctgatatgcctcagcgacaccgaggaataagagaggtgtaccggtgctagggtttttgggatttcttgcaacggcaggttctgcaatgggcgcggcgtccttgacgttgaccttttgggacagcggtg

SEQ ID NO: 417942 - DNA, 140 bp, Artificial Sequence
  Synthetic
caccgctgtcccaaaaggtcaacgtcaaggacgccgcgcccattgcagaacctgccgttgcaagaaatcccaaaaaccctagcaccggtacacctctcttattcctcggtgtcgctgaggcatatcagcagccagggcct

SEQ ID NO: 417943 - DNA, 140 bp, Artificial Sequence
  Synthetic
aggccctggctgctgatatgagctgctggacgtggtcaaaagacaacaggaactgttgcggctgaccgtctgggggacgaaaaacctccaggcaagagtcactgccatcgagaaatacctgaccttttgggacagcggtg

SEQ ID NO: 417944 - DNA, 140 bp, Artificial Sequence
  Synthetic
caccgctgtcccaaaaggtcaggtatttctcgatggcagtgactcttgcctggaggtttttcgtcccccagacggtcagccgcaacagttcctgttgtcttttgaccacgtccagcagctcatatcagcagccagggcct

SEQ ID NO: 417945 - DNA, 140 bp, Artificial Sequence
  Synthetic
atacgccatgctgggtctccgtcacacgactgtaccatggccaaacaaaaatttcactccaaactgggacaacatgacatggcagcagtgggagaaccaggtccgcttcttggatgaaaacgtacttgggagtcggccat

SEQ ID NO: 417946 - DNA, 140 bp, Artificial Sequence
  Synthetic
atggccgactcccaagtacgttttcatccaagaagcggacctggttctcccactgctgccatgtcatgttgtcccagtttggagtgaaatttttgtttggccatggtacagtcgtgtgacggagacccagcatggcgtat

SEQ ID NO: 417947 - DNA, 140 bp, Artificial Sequence
  Synthetic
aggccctggctgctgatatgaacatgacatggcagcagtgggagaaccaggtccgcttcttggatgaaaatataacaaaattattagaagtggcacagatacaacaagaagagaacatgtgaccttttgggacagcggtg

SEQ ID NO: 417948 - DNA, 140 bp, Artificial Sequence
  Synthetic
caccgctgtcccaaaaggtcacatgttctcttcttgttgtatctgtgccacttctaataattttgttatattttcatccaagaagcggacctggttctcccactgctgccatgtcatgttcatatcagcagccagggcct

SEQ ID NO: 417949 - DNA, 140 bp, Artificial Sequence
  Synthetic
atacgccatgctgggtctccttcacctcctggatagcgtatatccaaataggattatatgtaatagtagggttagtagtactaagaatagtaatatacattttgcagatgctagcaagaccgtacttgggagtcggccat

SEQ ID NO: 417950 - DNA, 140 bp, Artificial Sequence
  Synthetic
atggccgactcccaagtacggtcttgctagcatctgcaaaatgtatattactattcttagtactactaaccctactattacatataatcctatttggatatacgctatccaggaggtgaaggagacccagcatggcgtat

SEQ ID NO: 417951 - DNA, 140 bp, Artificial Sequence
  Synthetic
aggccctggctgctgatatggttagtagtactaagaatagtaatatacattttgcagatgctagcaagacttagaaagggctataggccagtattctcctcccctccctcttatgttcaagaccttttgggacagcggtg

SEQ ID NO: 417952 - DNA, 140 bp, Artificial Sequence
  Synthetic
caccgctgtcccaaaaggtcttgaacataagagggaggggaggagaatactggcctatagccctttctaagtcttgctagcatctgcaaaatgtatattactattcttagtactactaaccatatcagcagccagggcct

SEQ ID NO: 417953 - DNA, 140 bp, Artificial Sequence
  Synthetic
atacgccatgctgggtctccagaaggaggtggagacgacgaggactacagatcctggccttggcagatcagatacatccacttcctgattcgccaactgaggaacctcttaatttggctacgtacttgggagtcggccat

SEQ ID NO: 417954 - DNA, 140 bp, Artificial Sequence
  Synthetic
atggccgactcccaagtacgtagccaaattaagaggttcctcagttggcgaatcaggaagtggatgtatctgatctgccaaggccaggatctgtagtcctcgtcgtctccacctccttctggagacccagcatggcgtat

SEQ ID NO: 417955 - DNA, 140 bp, Artificial Sequence
  Synthetic
aggccctggctgctgatatggatacatccacttcctgattcgccaactgaggaacctcttaatttggctatacaacagctgcagaagcttactgttgaagatcttccaacccctccaactgaccttttgggacagcggtg

SEQ ID NO: 417956 - DNA, 140 bp, Artificial Sequence
  Synthetic
caccgctgtcccaaaaggtcagttggaggggttggaagatcttcaacagtaagcttctgcagctgttgtatagccaaattaagaggttcctcagttggcgaatcaggaagtggatgtatccatatcagcagccagggcct

SEQ ID NO: 417957 - DNA, 140 bp, Artificial Sequence
  Synthetic
atacgccatgctgggtctccgctggttccaagaagcaatccaagcagcgacgagggctgcgggagagactcttacaaacacaggaagggccctatgggaggctctcagaagaacagcgagcgtacttgggagtcggccat

SEQ ID NO: 417958 - DNA, 140 bp, Artificial Sequence
  Synthetic
atggccgactcccaagtacgctcgctgttcttctgagagcctcccatagggcccttcctgtgtttgtaagagtctctcccgcagccctcgtcgctgcttggattgcttcttggaaccagcggagacccagcatggcgtat

SEQ ID NO: 417959 - DNA, 140 bp, Artificial Sequence
  Synthetic
aggccctggctgctgatatgcttacaaacacaggaagggccctatgggaggctctcagaagaacagcgagggcaatcgtcgcgatccccaggaggatcagacaaggactcgaactcgcccgaccttttgggacagcggtg

SEQ ID NO: 417960 - DNA, 140 bp, Artificial Sequence
  Synthetic
caccgctgtcccaaaaggtcgggcgagttcgagtccttgtctgatcctcctggggatcgcgacgattgccctcgctgttcttctgagagcctcccatagggcccttcctgtgtttgtaagcatatcagcagccagggcct

SEQ ID NO: 417961 - DNA, 140 bp, Artificial Sequence
  Synthetic
atacgccatgctgggtctcctatagaagatagtgatgaagataatgaagtgggagtctatgtaagacccaataggccactaagaccaatgacatataaattggcaatagacatgtctcatcgtacttgggagtcggccat

SEQ ID NO: 417962 - DNA, 140 bp, Artificial Sequence
  Synthetic
atggccgactcccaagtacgatgagacatgtctattgccaatttatatgtcattggtcttagtggcctattgggtcttacatagactcccacttcattatcttcatcactatcttctataggagacccagcatggcgtat

SEQ ID NO: 417963 - DNA, 140 bp, Artificial Sequence
  Synthetic
aggccctggctgctgatatgtcgaacttgcagaaaaagcaatgaaagagtatggggaggatctgaaaattgaaaccaacaaatttgcagcaatatgcactcacttggaggtgtgtttcatgaccttttgggacagcggtg

SEQ ID NO: 417964 - DNA, 140 bp, Artificial Sequence
  Synthetic
caccgctgtcccaaaaggtcatgaaacacacctccaagtgagtgcatattgctgcaaatttgttggtttcaattttcagatcctccccatactctttcattgctttttctgcaagttcgacatatcagcagccagggcct

SEQ ID NO: 417965 - DNA, 140 bp, Artificial Sequence
  Synthetic
aggccctggctgctgatatggaaaccaacaaatttgcagcaatatgcactcacttggaggtgtgtttcatgtattcagatttccatttcatcaatgaacaaggcgaatcaatagtggtaggaccttttgggacagcggtg

SEQ ID NO: 417966 - DNA, 140 bp, Artificial Sequence
  Synthetic
caccgctgtcccaaaaggtcctaccactattgattcgccttgttcattgatgaaatggaaatctgaatacatgaaacacacctccaagtgagtgcatattgctgcaaatttgttggtttccatatcagcagccagggcct

SEQ ID NO: 417967 - DNA, 140 bp, Artificial Sequence
  Synthetic
aggccctggctgctgatatgtttcccaaatgaggttggagccaaaatactgacatcagagtcacaattaacaataacaaaggagaagaaggaggaactccaggactgtaagattgctcccgaccttttgggacagcggtg

SEQ ID NO: 417968 - DNA, 140 bp, Artificial Sequence
  Synthetic
caccgctgtcccaaaaggtcgggagcaatcttacagtcctggagttcctccttcttctcctttgttattgttaattgtgactctgatgtcagtattttggctccaacctcatttgggaaacatatcagcagccagggcct

SEQ ID NO: 417969 - DNA, 140 bp, Artificial Sequence
  Synthetic
atacgccatgctgggtctcccagagcaaggatcaagaccagactattcaccattagacaggaaatggccatcaggggcctatgggactcctttcgtcagtccgaaagaggcgaagacacacgtacttgggagtcggccat

SEQ ID NO: 417970 - DNA, 140 bp, Artificial Sequence
  Synthetic
atggccgactcccaagtacgtgtgtcttcgcctctttcggactgacgaaaggagtcccataggcccctgatggccatttcctgtctaatggtgaatagtctggtcttgatccttgctctgggagacccagcatggcgtat

SEQ ID NO: 417971 - DNA, 140 bp, Artificial Sequence
  Synthetic
atacgccatgctgggtctccgggagagacagaacaatggcctggacagtagtaaacagtatctgcaacactactggagctggaaaaccgaagtttctaccggatttgtatgattacaaagcgtacttgggagtcggccat

SEQ ID NO: 417972 - DNA, 140 bp, Artificial Sequence
  Synthetic
atggccgactcccaagtacgctttgtaatcatacaaatccggtagaaacttcggttttccagctccagtagtgttgcagatactgtttactactgtccaggccattgttctgtctctcccggagacccagcatggcgtat

SEQ ID NO: 417973 - DNA, 140 bp, Artificial Sequence
  Synthetic
atacgccatgctgggtctcccctaccagttgccggaggaacaagcagcgtatatattgaggtgctacatttgactcaagggacctgctgggaacaaatgtacactccaggaggggaagtgcgtacttgggagtcggccat

SEQ ID NO: 417974 - DNA, 140 bp, Artificial Sequence
  Synthetic
atggccgactcccaagtacgcacttcccctcctggagtgtacatttgttcccagcaggtcccttgagtcaaatgtagcacctcaatatatacgctgcttgttcctccggcaactggtaggggagacccagcatggcgtat

SEQ ID NO: 417975 - DNA, 140 bp, Artificial Sequence
  Synthetic
aggccctggctgctgatatgcaggcagctatagatcaaataaccgggaaattgaataggctgatagagaagacaaacacagagttcgaatccatagaatctgaattcagtgaaatagaacgaccttttgggacagcggtg

SEQ ID NO: 417976 - DNA, 140 bp, Artificial Sequence
  Synthetic
caccgctgtcccaaaaggtcgttctatttcactgaattcagattctatggattcgaactctgtgtttgtcttctctatcagcctattcaatttcccggttatttgatctatagctgcctgcatatcagcagccagggcct

SEQ ID NO: 417977 - DNA, 140 bp, Artificial Sequence
  Synthetic
atacgccatgctgggtctcctgggctataaggaccaggagcggaggaaacactaaccagcaaagagcatccgcagggcaaatcagcgtgcagcccacgttctctgtacagagaaacctcccgtacttgggagtcggccat

SEQ ID NO: 417978 - DNA, 140 bp, Artificial Sequence
  Synthetic
atggccgactcccaagtacgggaggtttctctgtacagagaacgtgggctgcacgctgatttgccctgcggatgctctttgctggttagtgtttcctccgctcctggtccttatagcccaggagacccagcatggcgtat

SEQ ID NO: 417979 - DNA, 140 bp, Artificial Sequence
  Synthetic
aggccctggctgctgatatgaacccgacagaggaacaagctgtagatatatgcaaggcagcaatgggtctgaaaatcagttcatcattcagctttgggggtttcactttcaaaagaacaagaccttttgggacagcggtg

SEQ ID NO: 417980 - DNA, 140 bp, Artificial Sequence
  Synthetic
caccgctgtcccaaaaggtcttgttcttttgaaagtgaaacccccaaagctgaatgatgaactgattttcagacccattgctgccttgcatatatctacagcttgttcctctgtcgggttcatatcagcagccagggcct

SEQ ID NO: 417981 - DNA, 140 bp, Artificial Sequence
  Synthetic
atacgccatgctgggtctcccatgcagacctcagtgccaaagaagcacaagatgtcatcatggaagtcgttttcccaaatgaggttggagccaaaatactgacatcagagtcacaattaacgtacttgggagtcggccat

SEQ ID NO: 417982 - DNA, 140 bp, Artificial Sequence
  Synthetic
atggccgactcccaagtacgttaattgtgactctgatgtcagtattttggctccaacctcatttgggaaaacgacttccatgatgacatcttgtgcttctttggcactgaggtctgcatgggagacccagcatggcgtat

SEQ ID NO: 417983 - DNA, 140 bp, Artificial Sequence
  Synthetic
atacgccatgctgggtctccatcaatgaccgaaatttctggaggggtgaaaatggacgaaggacaagggttgcttatgaaagaatgtgcaatatcctcaaaggaaaatttcaaacagctgcgtacttgggagtcggccat

SEQ ID NO: 417984 - DNA, 140 bp, Artificial Sequence
  Synthetic
atggccgactcccaagtacgcagctgtttgaaattttcctttgaggatattgcacattctttcataagcaacccttgtccttcgtccattttcacccctccagaaatttcggtcattgatggagacccagcatggcgtat

SEQ ID NO: 417985 - DNA, 140 bp, Artificial Sequence
  Synthetic
aggccctggctgctgatatggcggagagcaacagcaattctaagaaaagcaaccagaaggttgattcaactgatagttagtggaagagacgaacaatcaatcgctgaagcgatcatagtagaccttttgggacagcggtg

SEQ ID NO: 417986 - DNA, 140 bp, Artificial Sequence
  Synthetic
caccgctgtcccaaaaggtctactatgatcgcttcagcgattgattgttcgtctcttccactaactatcagttgaatcaaccttctggttgcttttcttagaattgctgttgctctccgccatatcagcagccagggcct

SEQ ID NO: 417987 - DNA, 140 bp, Artificial Sequence
  Synthetic
atacgccatgctgggtctccaaattcctcctgatggatgctttgaaattgagcattgaagacccaagtcacgaaggagaagggatcccattatatgatgcgatcaagtgcataaaaacatcgtacttgggagtcggccat

SEQ ID NO: 417988 - DNA, 140 bp, Artificial Sequence
  Synthetic
atggccgactcccaagtacgatgtttttatgcacttgatcgcatcatataatgggatcccttctccttcgtgacttgggtcttcaatgctcaatttcaaagcatccatcaggaggaatttggagacccagcatggcgtat

SEQ ID NO: 417989 - DNA, 140 bp, Artificial Sequence
  Synthetic
atacgccatgctgggtctcctttgaatttcgtgaatagagcgaaccaacggctgaaccccatgcatcaacttctgagacactttcagagggatgcaaaagtgttatttcaaaattgggggcgtacttgggagtcggccat

SEQ ID NO: 417990 - DNA, 140 bp, Artificial Sequence
  Synthetic
atggccgactcccaagtacgcccccaattttgaaataacacttttgcatccctctgaaagtgtctcagaagttgatgcatggggttcagccgttggttcgctctattcacgaaattcaaaggagacccagcatggcgtat

SEQ ID NO: 417991 - DNA, 140 bp, Artificial Sequence
  Synthetic
atacgccatgctgggtctcctctttgggtggaaagaaccttatatagtcaaaccacacgaaaagggaataaattcaaattacctgctgtcatggaagcaagtactgtcagaattgcaggacgtacttgggagtcggccat

SEQ ID NO: 417992 - DNA, 140 bp, Artificial Sequence
  Synthetic
atggccgactcccaagtacgtcctgcaattctgacagtacttgcttccatgacagcaggtaatttgaatttattcccttttcgtgtggtttgactatataaggttctttccacccaaagaggagacccagcatggcgtat

SEQ ID NO: 417993 - DNA, 140 bp, Artificial Sequence
  Synthetic
atacgccatgctgggtctccgtcaactgaagtgggctcttggtgaaaacatggcaccagagaaggtagactttgaaaactgcagagacataagcgatttgaagcaatatgatagtgaagacgtacttgggagtcggccat

SEQ ID NO: 417994 - DNA, 140 bp, Artificial Sequence
  Synthetic
atggccgactcccaagtacgtcttcactatcatattgcttcaaatcgcttatgtctctgcagttttcaaagtctaccttctctggtgccatgttttcaccaagagcccacttcagttgacggagacccagcatggcgtat

SEQ ID NO: 417995 - DNA, 140 bp, Artificial Sequence
  Synthetic
aggccctggctgctgatatgttcctaagagtccgagatcagaggggaaacgtgctcttatctccagaagaagttagtgaaacacaaggaacggagaaactgacgataacctactcatcgtgaccttttgggacagcggtg

SEQ ID NO: 417996 - DNA, 140 bp, Artificial Sequence
  Synthetic
caccgctgtcccaaaaggtcacgatgagtaggttatcgtcagtttctccgttccttgtgtttcactaacttcttctggagataagagcacgtttcccctctgatctcggactcttaggaacatatcagcagccagggcct

SEQ ID NO: 417997 - DNA, 140 bp, Artificial Sequence
  Synthetic
atacgccatgctgggtctccacctgaattaaggtcactttcaagctggatacagagtgagttcaacaaggcctgtgagctaactgattcagtctggatagagctcgatgaaattggagagcgtacttgggagtcggccat

SEQ ID NO: 417998 - DNA, 140 bp, Artificial Sequence
  Synthetic
atggccgactcccaagtacgctctccaatttcatcgagctctatccagactgaatcagttagctcacaggccttgttgaactcactctgtatccagcttgaaagtgaccttaattcaggtggagacccagcatggcgtat

SEQ ID NO: 417999 - DNA, 140 bp, Artificial Sequence
  Synthetic
atacgccatgctgggtctccgccatggtattttcacaagaggattgcatgatcaaagcagttaggggcgatctgaactttgtcaatagggcaaaccagcggctgaatcccatgcaccaaccgtacttgggagtcggccat

SEQ ID NO: 418000 - DNA, 140 bp, Artificial Sequence
  Synthetic
atggccgactcccaagtacggttggtgcatgggattcagccgctggtttgccctattgacaaagttcagatcgcccctaactgctttgatcatgcaatcctcttgtgaaaataccatggcggagacccagcatggcgtat

SEQ ID NO: 418001 - DNA, 140 bp, Artificial Sequence
  Synthetic
atacgccatgctgggtctccgacgtagccccaattgagcacattgcaagcatgagaaggaattatttcacagcagaggtgtcccattgtagagctactgaatacataatgaagggggtatcgtacttgggagtcggccat

SEQ ID NO: 418002 - DNA, 140 bp, Artificial Sequence
  Synthetic
atggccgactcccaagtacgatacccccttcattatgtattcagtagctctacaatgggacacctctgctgtgaaataattccttctcatgcttgcaatgtgctcaattggggctacgtcggagacccagcatggcgtat

SEQ ID NO: 418003 - DNA, 140 bp, Artificial Sequence
  Synthetic
aggccctggctgctgatatgtcccacaataatatacaataaaatggaatttgagcctttccagtccttagtgcctaaggctgctaggggccaatatagtggatttgtgaggacattattcgaccttttgggacagcggtg

SEQ ID NO: 418004 - DNA, 140 bp, Artificial Sequence
  Synthetic
caccgctgtcccaaaaggtcgaataatgtcctcacaaatccactatattggcccctagcagccttaggcactaaggactggaaaggctcaaattccattttattgtatattattgtgggacatatcagcagccagggcct

SEQ ID NO: 418005 - DNA, 140 bp, Artificial Sequence
  Synthetic
atacgccatgctgggtctccacattaacactgccctgctcaatgcatcctgtgcagcaatggacgattttcaactaattcccatgataagcaagtgcagaactaaagagggaaggcgaaacgtacttgggagtcggccat

SEQ ID NO: 418006 - DNA, 140 bp, Artificial Sequence
  Synthetic
atggccgactcccaagtacgtttcgccttccctctttagttctgcacttgcttatcatgggaattagttgaaaatcgtccattgctgcacaggatgcattgagcagggcagtgttaatgtggagacccagcatggcgtat

SEQ ID NO: 418007 - DNA, 140 bp, Artificial Sequence
  Synthetic
atacgccatgctgggtctccactactaccgtttgcagcagctccaccagagcagagtagaatgcaattctcctcgttgactgtgaatgtgagaggctctggaatgaggatactggtgagacgtacttgggagtcggccat

SEQ ID NO: 418008 - DNA, 140 bp, Artificial Sequence
  Synthetic
atggccgactcccaagtacgtctcaccagtatcctcattccagagcctctcacattcacagtcaacgaggagaattgcattctactctgctctggtggagctgctgcaaacggtagtagtggagacccagcatggcgtat

SEQ ID NO: 418009 - DNA, 140 bp, Artificial Sequence
  Synthetic
atacgccatgctgggtctccacacagacgtggtaaattttgtgagcatggagttttctctcacagacccgagacttgaaccacataaatgggagaaatactgtgtccttgagataggagacgtacttgggagtcggccat

SEQ ID NO: 418010 - DNA, 140 bp, Artificial Sequence
  Synthetic
atggccgactcccaagtacgtctcctatctcaaggacacagtatttctcccatttatgtggttcaagtctcgggtctgtgagagaaaactccatgctcacaaaatttaccacgtctgtgtggagacccagcatggcgtat

SEQ ID NO: 418011 - DNA, 140 bp, Artificial Sequence
  Synthetic
aggccctggctgctgatatgagacttgaaccacataaatgggagaaatactgtgtccttgagataggagatatgttactaagaagtgccataggccaaatttcaaggccgatgttcttgtgaccttttgggacagcggtg

SEQ ID NO: 418012 - DNA, 140 bp, Artificial Sequence
  Synthetic
caccgctgtcccaaaaggtcacaagaacatcggccttgaaatttggcctatggcacttcttagtaacatatctcctatctcaaggacacagtatttctcccatttatgtggttcaagtctcatatcagcagccagggcct

SEQ ID NO: 418013 - DNA, 140 bp, Artificial Sequence
  Synthetic
atacgccatgctgggtctcctctcgggaaggatgcaggagcactggcagaagacccagatgaggggacagcaggagtggaatctgcagtattgagaggattcttaattctagggaaggaacgtacttgggagtcggccat

SEQ ID NO: 418014 - DNA, 140 bp, Artificial Sequence
  Synthetic
atggccgactcccaagtacgttccttccctagaattaagaatcctctcaatactgcagattccactcctgctgtcccctcatctgggtcttctgccagtgctcctgcatccttcccgagaggagacccagcatggcgtat

SEQ ID NO: 418015 - DNA, 140 bp, Artificial Sequence
  Synthetic
atacgccatgctgggtctccgcgaatcactaattcccaagaaatcatggtcctacattgtagaaacaccaaggcctgagtatggaacatgttacccaggggagttcgctgactatgaggacgtacttgggagtcggccat

SEQ ID NO: 418016 - DNA, 140 bp, Artificial Sequence
  Synthetic
atggccgactcccaagtacgtcctcatagtcagcgaactcccctgggtaacatgttccatactcaggccttggtgtttctacaatgtaggaccatgatttcttgggaattagtgattcgcggagacccagcatggcgtat

SEQ ID NO: 418017 - DNA, 140 bp, Artificial Sequence
  Synthetic
atacgccatgctgggtctccatgagacgttgcctccttcagtcactccagcagatcgagagcatgattgaagccgagtcctcagttaaagagaaagacatgaccaaagagttttttgagacgtacttgggagtcggccat

SEQ ID NO: 418018 - DNA, 140 bp, Artificial Sequence
  Synthetic
atggccgactcccaagtacgtctcaaaaaactctttggtcatgtctttctctttaactgaggactcggcttcaatcatgctctcgatctgctggagtgactgaaggaggcaacgtctcatggagacccagcatggcgtat

SEQ ID NO: 418019 - DNA, 140 bp, Artificial Sequence
  Synthetic
atacgccatgctgggtctcctccccaaagaaaactcatggcccaaccacactgcagccggagtgtcagcatcatgctcccataatggggaaagaagtttttacagaaatctaatatggctcgtacttgggagtcggccat

SEQ ID NO: 418020 - DNA, 140 bp, Artificial Sequence
  Synthetic
atggccgactcccaagtacgagccatattagatttctgtaaaaacttctttccccattatgggagcatgatgctgacactccggctgcagtgtggttgggccatgagttttctttggggaggagacccagcatggcgtat

SEQ ID NO: 418021 - DNA, 140 bp, Artificial Sequence
  Synthetic
aggccctggctgctgatatgtagcctgtatgcatcaccacaattggaaggattttcagcggagtcaagaaaactgctccttgttgttcaggctcttagggacaacctcgaacctgggaccgaccttttgggacagcggtg

SEQ ID NO: 418022 - DNA, 140 bp, Artificial Sequence
  Synthetic
caccgctgtcccaaaaggtcggtcccaggttcgaggttgtccctaagagcctgaacaacaaggagcagttttcttgactccgctgaaaatccttccaattgtggtgatgcatacaggctacatatcagcagccagggcct

SEQ ID NO: 418023 - DNA, 140 bp, Artificial Sequence
  Synthetic
atacgccatgctgggtctccacaaagagaaagaagtccttatactatggggtgttcatcatccgcctaacatagagaaccaaaggactctctatcacacagagacaacttatgtctctgtcgtacttgggagtcggccat

SEQ ID NO: 418024 - DNA, 140 bp, Artificial Sequence
  Synthetic
atggccgactcccaagtacgacagagacataagttgtctctgtgtgatagagagtcctttggttctctatgttaggcggatgatgaacaccccatagtataaggacttctttctctttgtggagacccagcatggcgtat

SEQ ID NO: 418025 - DNA, 140 bp, Artificial Sequence
  Synthetic
atacgccatgctgggtctccaagaagctgaagagggaaatgacattccatggggcaaaggaagttgcactcagttactcaaccggtgcacttgccagttgtatgggtctcatatacaacccgtacttgggagtcggccat

SEQ ID NO: 418026 - DNA, 140 bp, Artificial Sequence
  Synthetic
atggccgactcccaagtacgggttgtatatgagacccatacaactggcaagtgcaccggttgagtaactgagtgcaacttcctttgccccatggaatgtcatttccctcttcagcttcttggagacccagcatggcgtat

SEQ ID NO: 418027 - DNA, 140 bp, Artificial Sequence
  Synthetic
atacgccatgctgggtctcccaatgatgtgggagatcaatggtcctgagtcagtgctggtcaacacttatcaatggatcataaggaactgggaaagtttgaaaattcaatggtcacaagacgtacttgggagtcggccat

SEQ ID NO: 418028 - DNA, 140 bp, Artificial Sequence
  Synthetic
atggccgactcccaagtacgtcttgtgaccattgaattttcaaactttcccagttccttatgatccattgataagtgttgaccagcactgactcaggaccattgatctcccacatcattgggagacccagcatggcgtat

SEQ ID NO: 418029 - DNA, 140 bp, Artificial Sequence
  Synthetic
aggccctggctgctgatatggaacccggggatacaataatatttgaggcaaatggtaatctaatagcgccatggtatgctttcatactgagtagaggccttggatcaggaatcatcacctgaccttttgggacagcggtg

SEQ ID NO: 418030 - DNA, 140 bp, Artificial Sequence
  Synthetic
caccgctgtcccaaaaggtcaggtgatgattcctgatccaaggcctctactcagtatgaaagcataccatggcgctattagattaccatttgcctcaaatattattgtatccccgggttccatatcagcagccagggcct

SEQ ID NO: 418031 - DNA, 140 bp, Artificial Sequence
  Synthetic
aggccctggctgctgatatgcatggaacagggacagggtacactatggacacagtcaacagaacacaccaatattcagagagggggaagtggacgacaaatacagaaactggggcgccccgaccttttgggacagcggtg

SEQ ID NO: 418032 - DNA, 140 bp, Artificial Sequence
  Synthetic
caccgctgtcccaaaaggtcggggcgccccagtttctgtatttgtcgtccacttccccctctctgaatattggtgtgttctgttgactgtgtccatagtgtaccctgtccctgttccatgcatatcagcagccagggcct

SEQ ID NO: 418033 - DNA, 140 bp, Artificial Sequence
  Synthetic
aggccctggctgctgatatgtactaccaacccactaatcaggcatgagaacagaatggtgctggccagcactacagctaaggccatggagcaagtagctggatcaagtgagcaggcagcagaccttttgggacagcggtg

SEQ ID NO: 418034 - DNA, 140 bp, Artificial Sequence
  Synthetic
caccgctgtcccaaaaggtctgctgcctgctcacttgatccagctacttgctccatggccttagctgtagtgctggccagcaccattctgttctcatgcctgattagtgggttggtagtacatatcagcagccagggcct

SEQ ID NO: 418035 - DNA, 140 bp, Artificial Sequence
  Synthetic
aggccctggctgctgatatgtatgcacaaacagactgtgtcctggaggctatggccttccttgaagaatcccacccaggtatctttgagaactcatgccttgaaacaatggaagccgttcgaccttttgggacagcggtg

SEQ ID NO: 418036 - DNA, 140 bp, Artificial Sequence
  Synthetic
caccgctgtcccaaaaggtcgaacggcttccattgtttcaaggcatgagttctcaaagatacctgggtgggattcttcaaggaaggccatagcctccaggacacagtctgtttgtgcatacatatcagcagccagggcct

SEQ ID NO: 418037 - DNA, 140 bp, Artificial Sequence
  Synthetic
atacgccatgctgggtctccaacaattggaactcaccctagctccagtgcaggtctaaaagatgatcttattgaaaatttgcaggcttaccagaaacgaatgggtttgcaaatgcagcgacgtacttgggagtcggccat

SEQ ID NO: 418038 - DNA, 140 bp, Artificial Sequence
  Synthetic
atggccgactcccaagtacgtcgctgcatttgcaaacccattcgtttctggtaagcctgcaaattttcaataagatcatcttttagacctgcactggagctagggtgagttccaattgttggagacccagcatggcgtat

SEQ ID NO: 418039 - DNA, 140 bp, Artificial Sequence
  Synthetic
atacgccatgctgggtctcctcatcatcagaatgagcagggatctggctatgctgcagatcaagaaagcacacaaaatgccattaacgggattacaaacaaagtgaattctgtaattgagcgtacttgggagtcggccat

SEQ ID NO: 418040 - DNA, 140 bp, Artificial Sequence
  Synthetic
atggccgactcccaagtacgctcaattacagaattcactttgtttgtaatcccgttaatggcattttgtgtgctttcttgatctgcagcatagccagatccctgctcattctgatgatgaggagacccagcatggcgtat

SEQ ID NO: 418041 - DNA, 140 bp, Artificial Sequence
  Synthetic
aggccctggctgctgatatgacattaaacaggaatcagccggcagcaactgcattagccaacaccatagaagtctttagatcgaacggattaacagctaatgaatcaggaaggctaataggaccttttgggacagcggtg

SEQ ID NO: 418042 - DNA, 140 bp, Artificial Sequence
  Synthetic
caccgctgtcccaaaaggtcctattagccttcctgattcattagctgttaatccgttcgatctaaagacttctatggtgttggctaatgcagttgctgccggctgattcctgtttaatgtcatatcagcagccagggcct

SEQ ID NO: 418043 - DNA, 140 bp, Artificial Sequence
  Synthetic
atacgccatgctgggtctccaaaatgaacactcaattcacagctgtgggcaaggaattcaacaaattggaaagaaggatggaaaacttaaataaaaaggttgatgatgggtttctagacacgtacttgggagtcggccat

SEQ ID NO: 418044 - DNA, 140 bp, Artificial Sequence
  Synthetic
atggccgactcccaagtacgtgtctagaaacccatcatcaacctttttatttaagttttccatccttctttccaatttgttgaattccttgcccacagctgtgaattgagtgttcattttggagacccagcatggcgtat

SEQ ID NO: 418045 - DNA, 140 bp, Artificial Sequence
  Synthetic
atacgccatgctgggtctccgggataccattatatgatgcgatcaaatgcatgaaaacattcttcgggtggaaagagcccaacattatcaaaccacatgagaaaggaataaaccccaattcgtacttgggagtcggccat

SEQ ID NO: 418046 - DNA, 140 bp, Artificial Sequence
  Synthetic
atggccgactcccaagtacgaattggggtttattcctttctcatgtggtttgataatgttgggctctttccacccgaagaatgttttcatgcatttgatcgcatcatataatggtatcccggagacccagcatggcgtat

SEQ ID NO: 418047 - DNA, 140 bp, Artificial Sequence
  Synthetic
atacgccatgctgggtctccgaaagagcccaacattatcaaaccacatgagaaaggaataaaccccaattatctcctgacttggaagcagatgctagcagagcttcaggacattgaaaatcgtacttgggagtcggccat

SEQ ID NO: 418048 - DNA, 140 bp, Artificial Sequence
  Synthetic
atggccgactcccaagtacgattttcaatgtcctgaagctctgctagcatctgcttccaagtcaggagataattggggtttattcctttctcatgtggtttgataatgttgggctctttcggagacccagcatggcgtat

SEQ ID NO: 418049 - DNA, 140 bp, Artificial Sequence
  Synthetic
atacgccatgctgggtctccatgaatccaaatcaaaagataatagcacttggctccgcttctctaactatagcgatagtatgtctactcatccagattgccatcttggcaacgactatgacgtacttgggagtcggccat

SEQ ID NO: 418050 - DNA, 140 bp, Artificial Sequence
  Synthetic
atggccgactcccaagtacgtcatagtcgttgccaagatggcaatctggatgagtagacatactatcgctatagttagagaagcggagccaagtgctattatcttttgatttggattcatggagacccagcatggcgtat

SEQ ID NO: 418051 - DNA, 140 bp, Artificial Sequence
  Synthetic
atacgccatgctgggtctccatcacaagtgtaacaacgaatgcatggagagtgtgaaaaatggaacttatgactatccaaaatattccgaagaatcaaagttaaacagggaaaaaattgacgtacttgggagtcggccat

SEQ ID NO: 418052 - DNA, 140 bp, Artificial Sequence
  Synthetic
atggccgactcccaagtacgtcaattttttccctgtttaactttgattcttcggaatattttggatagtcataagttccatttttcacactctccatgcattcgttgttacacttgtgatggagacccagcatggcgtat

SEQ ID NO: 418053 - DNA, 140 bp, Artificial Sequence
  Synthetic
aggccctggctgctgatatggagagaggcaaattaaaaagaagggctattgcaacacccgggatgcaaattagagggttcgtgtacttcgttgaaactttagctagaagcatttgcgaaagaccttttgggacagcggtg

SEQ ID NO: 418054 - DNA, 140 bp, Artificial Sequence
  Synthetic
caccgctgtcccaaaaggtctttcgcaaatgcttctagctaaagtttcaacgaagtacacgaaccctctaatttgcatcccgggtgttgcaatagcccttctttttaatttgcctctctccatatcagcagccagggcct

SEQ ID NO: 418055 - DNA, 140 bp, Artificial Sequence
  Synthetic
atacgccatgctgggtctccataccatgtgaatcaatcataatagaaaggaacataacagagatagtgcacttgaatggtactatcatagagaaagagagttgtcctaaagcagcagaatcgtacttgggagtcggccat

SEQ ID NO: 418056 - DNA, 140 bp, Artificial Sequence
  Synthetic
atggccgactcccaagtacgattctgctgctttaggacaactctctttctctatgatagtaccattcaagtgcactatctctgttatgttcctttctattatgattgattcacatggtatggagacccagcatggcgtat

SEQ ID NO: 418057 - DNA, 140 bp, Artificial Sequence
  Synthetic
aggccctggctgctgatatgcttgaatggtactatcatagagaaagagagttgtcctaaagcagcagaatacaagaattggtcaaaacctcaatgtcagattacagggtttgcccctttcgaccttttgggacagcggtg

SEQ ID NO: 418058 - DNA, 140 bp, Artificial Sequence
  Synthetic
caccgctgtcccaaaaggtcgaaaggggcaaaccctgtaatctgacattgaggttttgaccaattcttgtattctgctgctttaggacaactctctttctctatgatagtaccattcaagcatatcagcagccagggcct

SEQ ID NO: 418059 - DNA, 140 bp, Artificial Sequence
  Synthetic
atacgccatgctgggtctccgccatagtacattaattggcggggttaggatggtggacatccttaggcaaaacccgacagaggaacaagctgtagatatatgcaaggcagcaatgggtctcgtacttgggagtcggccat

SEQ ID NO: 418060 - DNA, 140 bp, Artificial Sequence
  Synthetic
atggccgactcccaagtacgagacccattgctgccttgcatatatctacagcttgttcctctgtcgggttttgcctaaggatgtccaccatcctaaccccgccaattaatgtactatggcggagacccagcatggcgtat

SEQ ID NO: 418061 - DNA, 140 bp, Artificial Sequence
  Synthetic
atacgccatgctgggtctccaagagaaccttatgtgtcgtgcagtctcagtaaatgttatcaatttgcacttgggcagggaaccactttgaacaacagacactcaaatggcacaacacatcgtacttgggagtcggccat

SEQ ID NO: 418062 - DNA, 140 bp, Artificial Sequence
  Synthetic
atggccgactcccaagtacgatgtgttgtgccatttgagtgtctgttgttcaaagtggttccctgcccaagtgcaaattgataacatttactgagactgcacgacacataaggttctcttggagacccagcatggcgtat

SEQ ID NO: 418063 - DNA, 140 bp, Artificial Sequence
  Synthetic
atacgccatgctgggtctcctcatttgggaaccaagcaagtgtgcatagcatggtccagctcaagctgccatgatggtagggcatggctacatgtttgtgtcactggagatgataagaatcgtacttgggagtcggccat

SEQ ID NO: 418064 - DNA, 140 bp, Artificial Sequence
  Synthetic
atggccgactcccaagtacgattcttatcatctccagtgacacaaacatgtagccatgccctaccatcatggcagcttgagctggaccatgctatgcacacttgcttggttcccaaatgaggagacccagcatggcgtat

SEQ ID NO: 418065 - DNA, 140 bp, Artificial Sequence
  Synthetic
aggccctggctgctgatatggaaatggccaacagaggcctctgggattcctttcgtcagtccgaaagaggcgaagaaacaattgaagaaaaatttgaaatcacaggaactatgcgcaggcgaccttttgggacagcggtg

SEQ ID NO: 418066 - DNA, 140 bp, Artificial Sequence
  Synthetic
caccgctgtcccaaaaggtcgcctgcgcatagttcctgtgatttcaaatttttcttcaattgtttcttcgcctctttcggactgacgaaaggaatcccagaggcctctgttggccatttccatatcagcagccagggcct

SEQ ID NO: 418067 - DNA, 140 bp, Artificial Sequence
  Synthetic
atacgccatgctgggtctccatggtctaaaaacatcctcagaactcaggagtctgaatgcgtctgcatcaatggaacttgtacagtagtaatgactgatgggagtgcatcaggaagggctcgtacttgggagtcggccat

SEQ ID NO: 418068 - DNA, 140 bp, Artificial Sequence
  Synthetic
atggccgactcccaagtacgagcccttcctgatgcactcccatcagtcattactactgtacaagttccattgatgcagacgcattcagactcctgagttctgaggatgtttttagaccatggagacccagcatggcgtat

SEQ ID NO: 418069 - DNA, 140 bp, Artificial Sequence
  Synthetic
atacgccatgctgggtctcctaattctattaaccatgaagactatcattgctttgagctacattctatgtctggttttcgctcaaaaacttcctggaaatgacaacagcacggcaacgctcgtacttgggagtcggccat

SEQ ID NO: 418070 - DNA, 140 bp, Artificial Sequence
  Synthetic
atggccgactcccaagtacgagcgttgccgtgctgttgtcatttccaggaagtttttgagcgaaaaccagacatagaatgtagctcaaagcaatgatagtcttcatggttaatagaattaggagacccagcatggcgtat

SEQ ID NO: 418071 - DNA, 140 bp, Artificial Sequence
  Synthetic
aggccctggctgctgatatggcatctccacaactcgaggggttctcagctgaatcgagaaaattgctactcattgttcaggcacttagggataacctggaacctggaacattcgatcttggaccttttgggacagcggtg

SEQ ID NO: 418072 - DNA, 140 bp, Artificial Sequence
  Synthetic
caccgctgtcccaaaaggtccaagatcgaatgttccaggttccaggttatccctaagtgcctgaacaatgagtagcaattttctcgattcagctgagaacccctcgagttgtggagatgccatatcagcagccagggcct

SEQ ID NO: 418073 - DNA, 140 bp, Artificial Sequence
  Synthetic
aggccctggctgctgatatgatccagaagttagatgtgtttgcagagacaattggaaaggctccaatagacctgtattatacataaatatggcagattatagtattgattccagttatgtgaccttttgggacagcggtg

SEQ ID NO: 418074 - DNA, 140 bp, Artificial Sequence
  Synthetic
caccgctgtcccaaaaggtcacataactggaatcaatactataatctgccatatttatgtataatacaggtctattggagcctttccaattgtctctgcaaacacatctaacttctggatcatatcagcagccagggcct

SEQ ID NO: 418075 - DNA, 140 bp, Artificial Sequence
  Synthetic
aggccctggctgctgatatgctggaataaatgagtcagctgacatgagcattggagtaacagtgataaagaacaacatgataaacaatgaccttggaccagcaacagcccaaatggctctgaccttttgggacagcggtg

SEQ ID NO: 418076 - DNA, 140 bp, Artificial Sequence
  Synthetic
caccgctgtcccaaaaggtcagagccatttgggctgttgctggtccaaggtcattgtttatcatgttgttctttatcactgttactccaatgctcatgtcagctgactcatttattccagcatatcagcagccagggcct

SEQ ID NO: 418077 - DNA, 140 bp, Artificial Sequence
  Synthetic
atacgccatgctgggtctccgcagcaactgcagggatcctaataatgagagaggaggcccaggagtgaaagggtgggcgtttgacaatggagatgatgtttggatgggaagaacaatcaacgtacttgggagtcggccat

SEQ ID NO: 418078 - DNA, 140 bp, Artificial Sequence
  Synthetic
atggccgactcccaagtacgttgattgttcttcccatccaaacatcatctccattgtcaaacgcccaccctttcactcctgggcctcctctctcattattaggatccctgcagttgctgcggagacccagcatggcgtat

SEQ ID NO: 418079 - DNA, 140 bp, Artificial Sequence
  Synthetic
aggccctggctgctgatatggggtgggcgtttgacaatggagatgatgtttggatgggaagaacaatcaaaaaggactcgcgcgcaggttatgaaactttcagggttgttgatggttggagaccttttgggacagcggtg

SEQ ID NO: 418080 - DNA, 140 bp, Artificial Sequence
  Synthetic
caccgctgtcccaaaaggtctccaaccatcaacaaccctgaaagtttcataacctgcgcgcgagtcctttttgattgttcttcccatccaaacatcatctccattgtcaaacgcccaccccatatcagcagccagggcct

SEQ ID NO: 418081 - DNA, 140 bp, Artificial Sequence
  Synthetic
aggccctggctgctgatatgtccgattgatggaccattgcctgaggacaatgagccgagtgggtatgcacaaacggattgtgtattggaagcaatggctttccttgaagaatctcacccagaccttttgggacagcggtg

SEQ ID NO: 418082 - DNA, 140 bp, Artificial Sequence
  Synthetic
caccgctgtcccaaaaggtctgggtgagattcttcaaggaaagccattgcttccaatacacaatccgtttgtgcatacccactcggctcattgtcctcaggcaatggtccatcaatcggacatatcagcagccagggcct

SEQ ID NO: 418083 - DNA, 140 bp, Artificial Sequence
  Synthetic
atacgccatgctgggtctcccaaacccaatcaaggacaggactattggtatcagatgggggaccaaacttatacaatatccggaatcttcacatccctgaagtctgcttaaagtgggagccgtacttgggagtcggccat

SEQ ID NO: 418084 - DNA, 140 bp, Artificial Sequence
  Synthetic
atggccgactcccaagtacggctcccactttaagcagacttcagggatgtgaagattccggatattgtataagtttggtcccccatctgataccaatagtcctgtccttgattgggtttgggagacccagcatggcgtat

SEQ ID NO: 418085 - DNA, 140 bp, Artificial Sequence
  Synthetic
atacgccatgctgggtctcctcatctggggaccaagcaagtgtgcatagcatggtccagctcaagttgtcacgatggaaaagcatggctgcatgtttgtataacgggggatgataaaaatcgtacttgggagtcggccat

SEQ ID NO: 418086 - DNA, 140 bp, Artificial Sequence
  Synthetic
atggccgactcccaagtacgatttttatcatcccccgttatacaaacatgcagccatgcttttccatcgtgacaacttgagctggaccatgctatgcacacttgcttggtccccagatgaggagacccagcatggcgtat

SEQ ID NO: 418087 - DNA, 140 bp, Artificial Sequence
  Synthetic
aggccctggctgctgatatgccagagtgtggtggacttcaaatagcatcattgtattttgtgggacttcaggtacctatggaacaggctcatggcctgatggagcggatatcaatttcatgaccttttgggacagcggtg

SEQ ID NO: 418088 - DNA, 140 bp, Artificial Sequence
  Synthetic
caccgctgtcccaaaaggtcatgaaattgatatccgctccatcaggccatgagcctgttccataggtacctgaagtcccacaaaatacaatgatgctatttgaagtccaccacactctggcatatcagcagccagggcct

SEQ ID NO: 418089 - DNA, 140 bp, Artificial Sequence
  Synthetic
atacgccatgctgggtctccatggcgtctcaaggcaccaaacgatcctatgaacagatggagactggtggagagcgccagaatgccactgagatcagggcatctgttggaagaatggtcgcgtacttgggagtcggccat

SEQ ID NO: 418090 - DNA, 140 bp, Artificial Sequence
  Synthetic
atggccgactcccaagtacgcgaccattcttccaacagatgccctgatctcagtggcattctggcgctctccaccagtctccatctgttcataggatcgtttggtgccttgagacgccatggagacccagcatggcgtat

SEQ ID NO: 418091 - DNA, 140 bp, Artificial Sequence
  Synthetic
atacgccatgctgggtctccacaaattcgccgcaatatgcacacacttagaagtctgcttcatgtattcggatttccactttatagatgaacgaggcgagtcaataattgcagaatctggcgtacttgggagtcggccat

SEQ ID NO: 418092 - DNA, 140 bp, Artificial Sequence
  Synthetic
atggccgactcccaagtacgccagattctgcaattattgactcgcctcgttcatctataaagtggaaatccgaatacatgaagcagacttctaagtgtgtgcatattgcggcgaatttgtggagacccagcatggcgtat

SEQ ID NO: 418093 - DNA, 140 bp, Artificial Sequence
  Synthetic
atacgccatgctgggtctccacattgaaaataagagtgcatgaagggtatgaggaattcacaatggttgggcggagagcaacagcaattctaagaaaagcaaccagaaggttgattcaaccgtacttgggagtcggccat

SEQ ID NO: 418094 - DNA, 140 bp, Artificial Sequence
  Synthetic
atggccgactcccaagtacggttgaatcaaccttctggttgcttttcttagaattgctgttgctctccgcccaaccattgtgaattcctcatacccttcatgcactcttattttcaatgtggagacccagcatggcgtat

SEQ ID NO: 418095 - DNA, 140 bp, Artificial Sequence
  Synthetic
atacgccatgctgggtctcctctctctgcatttgatgaaaggaggaaccggtacttagaggaacatcctagtgcagggaaggacccgaagaagaccggaggtccaatctaccgaaggagacgtacttgggagtcggccat

SEQ ID NO: 418096 - DNA, 140 bp, Artificial Sequence
  Synthetic
atggccgactcccaagtacgtctccttcggtagattggacctccggtcttcttcgggtccttccctgcactaggatgttcctctaagtaccggttcctcctttcatcaaatgcagagagaggagacccagcatggcgtat

SEQ ID NO: 418097 - DNA, 140 bp, Artificial Sequence
  Synthetic
atacgccatgctgggtctccgcactaattccaggagcggctttgaaatgatttgggacccaaatgggtggactggaacggacagtagcttttcagtgaagcaagatatcgtagcaataaccgtacttgggagtcggccat

SEQ ID NO: 418098 - DNA, 140 bp, Artificial Sequence
  Synthetic
atggccgactcccaagtacggttattgctacgatatcttgcttcactgaaaagctactgtccgttccagtccacccatttgggtcccaaatcatttcaaagccgctcctggaattagtgcggagacccagcatggcgtat

SEQ ID NO: 418099 - DNA, 140 bp, Artificial Sequence
  Synthetic
atacgccatgctgggtctccgagaatttggcgccaagcaaacaatggagaagacgcaactgctggtctcactcacattatgatatggcattccaacctaaatgatgccacataccagagacgtacttgggagtcggccat

SEQ ID NO: 418100 - DNA, 140 bp, Artificial Sequence
  Synthetic
atggccgactcccaagtacgtctctggtatgtggcatcatttaggttggaatgccatatcataatgtgagtgagaccagcagttgcgtcttctccattgtttgcttggcgccaaattctcggagacccagcatggcgtat

SEQ ID NO: 418101 - DNA, 140 bp, Artificial Sequence
  Synthetic
aggccctggctgctgatatgctcacattatgatatggcattccaacctaaatgatgccacataccagagaacaagagcccttgttcgaactggaatggatcccagaatgtgctctctaatgaccttttgggacagcggtg

SEQ ID NO: 418102 - DNA, 140 bp, Artificial Sequence
  Synthetic
caccgctgtcccaaaaggtcattagagagcacattctgggatccattccagttcgaacaagggctcttgttctctggtatgtggcatcatttaggttggaatgccatatcataatgtgagcatatcagcagccagggcct

SEQ ID NO: 418103 - DNA, 140 bp, Artificial Sequence
  Synthetic
atacgccatgctgggtctccaacagaaatggttccggagagaaatgaacaaggacaaactctatggagtaaaatgagtgatgctggatcagatagagtgatggtatcacctttggctgtacgtacttgggagtcggccat

SEQ ID NO: 418104 - DNA, 140 bp, Artificial Sequence
  Synthetic
atggccgactcccaagtacgtacagccaaaggtgataccatcactctatctgatccagcatcactcattttactccatagagtttgtccttgttcatttctctccggaaccatttctgttggagacccagcatggcgtat

SEQ ID NO: 418105 - DNA, 140 bp, Artificial Sequence
  Synthetic
aggccctggctgctgatatgagggagtcgggactatggtaatggaactaattcggatgataaagcgaggtattaatgaccggaacttctggagaggcgataatggacggaaaacaaggatgaccttttgggacagcggtg

SEQ ID NO: 418106 - DNA, 140 bp, Artificial Sequence
  Synthetic
caccgctgtcccaaaaggtcatccttgttttccgtccattatcgcctctccagaagttccggtcattaatacctcgctttatcatccgaattagttccattaccatagtcccgactccctcatatcagcagccagggcct

SEQ ID NO: 418107 - DNA, 140 bp, Artificial Sequence
  Synthetic
atacgccatgctgggtctccataaaccctggtcatgcagacctcagtgccaaagaggcacaagatgtaattatggaagttgtttttcccaatgaagtgggagccagaatactaacatcagcgtacttgggagtcggccat

SEQ ID NO: 418108 - DNA, 140 bp, Artificial Sequence
  Synthetic
atggccgactcccaagtacgctgatgttagtattctggctcccacttcattgggaaaaacaacttccataattacatcttgtgcctctttggcactgaggtctgcatgaccagggtttatggagacccagcatggcgtat

SEQ ID NO: 418109 - DNA, 140 bp, Artificial Sequence
  Synthetic
aggccctggctgctgatatgctttccttgaagaatctcacccagggatctttgaaaactcgtgtctcgaaacgatggaaattgttcagcaaacaagagtggataaactgacccaaggccggaccttttgggacagcggtg

SEQ ID NO: 418110 - DNA, 140 bp, Artificial Sequence
  Synthetic
caccgctgtcccaaaaggtccggccttgggtcagtttatccactcttgtttgctgaacaatttccatcgtttcgagacacgagttttcaaagatccctgggtgagattcttcaaggaaagcatatcagcagccagggcct

SEQ ID NO: 418111 - DNA, 140 bp, Artificial Sequence
  Synthetic
atacgccatgctgggtctccatagaccctttccggctgcttcagaacagccaggtcttcagcctcgtgagaccaaatgaaaaccccgcacataaaagtcaattggtatggatggcatgcccgtacttgggagtcggccat

SEQ ID NO: 418112 - DNA, 140 bp, Artificial Sequence
  Synthetic
atggccgactcccaagtacgggcatgccatccataccaattgacttttatgtgcggggttttcatttggtctcacgaggctgaagacctggctgttctgaagcagccggaaagggtctatggagacccagcatggcgtat

SEQ ID NO: 418113 - DNA, 140 bp, Artificial Sequence
  Synthetic
aggccctggctgctgatatgaccaaatgaaaaccccgcacataaaagtcaattggtatggatggcatgccattctgcagcatttgaagacctgagagtatcaagtttcattagagggacggaccttttgggacagcggtg

SEQ ID NO: 418114 - DNA, 140 bp, Artificial Sequence
  Synthetic
caccgctgtcccaaaaggtccgtccctctaatgaaacttgatactctcaggtcttcaaatgctgcagaatggcatgccatccataccaattgacttttatgtgcggggttttcatttggtcatatcagcagccagggcct

SEQ ID NO: 418115 - DNA, 140 bp, Artificial Sequence
  Synthetic
aggccctggctgctgatatggctgcaatgagacagtcattagagaatacaatgaaacagtaagggttgaaaaggtaacacaatggcacaataccagtgtcattgaatatatagagaggccgaccttttgggacagcggtg

SEQ ID NO: 418116 - DNA, 140 bp, Artificial Sequence
  Synthetic
caccgctgtcccaaaaggtcggcctctctatatattcaatgacactggtattgtgccattgtgttaccttttcaacccttactgtttcattgtattctctaatgactgtctcattgcagccatatcagcagccagggcct

SEQ ID NO: 418117 - DNA, 140 bp, Artificial Sequence
  Synthetic
atacgccatgctgggtctccaaatgagaacgtagatgcgatggactccagcactcttgaactgagaagcaggtattgggctataaggactaggagtggaggaaacaccaaccaacagagacgtacttgggagtcggccat

SEQ ID NO: 418118 - DNA, 140 bp, Artificial Sequence
  Synthetic
atggccgactcccaagtacgtctctgttggttggtgtttcctccactcctagtccttatagcccaatacctgcttctcagttcaagagtgctggagtccatcgcatctacgttctcatttggagacccagcatggcgtat

SEQ ID NO: 418119 - DNA, 140 bp, Artificial Sequence
  Synthetic
atacgccatgctgggtctccatccggaacctccacattccagaggtctgcttgaaatgggaattgatggatgaagactaccaaggcaggctgtgtaatcctatgaacccgtttgtcagtccgtacttgggagtcggccat

SEQ ID NO: 418120 - DNA, 140 bp, Artificial Sequence
  Synthetic
atggccgactcccaagtacggactgacaaacgggttcataggattacacagcctgccttggtagtcttcatccatcaattcccatttcaagcagacctctggaatgtggaggttccggatggagacccagcatggcgtat

SEQ ID NO: 418121 - DNA, 140 bp, Artificial Sequence
  Synthetic
atacgccatgctgggtctccgcatctgcggggcaaatcagtgtgcagcccactttctcagtgcagagaagtcttcccttcgaaagggctaccattatggctgcttttaaagggaataccgcgtacttgggagtcggccat

SEQ ID NO: 418122 - DNA, 140 bp, Artificial Sequence
  Synthetic
atggccgactcccaagtacgcggtattccctttaaaagcagccataatggtagccctttcgaagggaagacttctctgcactgagaaagtgggctgcacactgatttgccccgcagatgcggagacccagcatggcgtat

SEQ ID NO: 418123 - DNA, 140 bp, Artificial Sequence
  Synthetic
atacgccatgctgggtctccccagccaaaagcatggagtatgatgccgttgcaactacacattcatggattcctaagaggaatcgctccattctcaacaccagccaaagggggattcttgcgtacttgggagtcggccat

SEQ ID NO: 418124 - DNA, 140 bp, Artificial Sequence
  Synthetic
atggccgactcccaagtacgcaagaatccccctttggctggtgttgagaatggagcgattcctcttaggaatccatgaatgtgtagttgcaacggcatcatactccatgcttttggctggggagacccagcatggcgtat

SEQ ID NO: 418125 - DNA, 140 bp, Artificial Sequence
  Synthetic
atacgccatgctgggtctccggcaatctccaaacattgagaataagagtacatgaggggtatgaggagttcacaatggtggggaaaagagcaacagctatactaagaaaagcaaccagaacgtacttgggagtcggccat

SEQ ID NO: 418126 - DNA, 140 bp, Artificial Sequence
  Synthetic
atggccgactcccaagtacgttctggttgcttttcttagtatagctgttgctcttttccccaccattgtgaactcctcatacccctcatgtactcttattctcaatgtttggagattgccggagacccagcatggcgtat

SEQ ID NO: 418127 - DNA, 140 bp, Artificial Sequence
  Synthetic
atacgccatgctgggtctcccccagcagttcatatcggaggccagttggaatttccagtatggtggaggccatggtgtctagggcccgaattgatgcacgaattgacttcgaatctggaacgtacttgggagtcggccat

SEQ ID NO: 418128 - DNA, 140 bp, Artificial Sequence
  Synthetic
atggccgactcccaagtacgttccagattcgaagtcaattcgtgcatcaattcgggccctagacaccatggcctccaccatactggaaattccaactggcctccgatatgaactgctgggggagacccagcatggcgtat

SEQ ID NO: 418129 - DNA, 140 bp, Artificial Sequence
  Synthetic
aggccctggctgctgatatgtgcagacaaaatctgtatcggccaccaatcaacaaattctacagaaactgtggacacgctaacagaaactaatgttcctgtgacacatgccaaggaattggaccttttgggacagcggtg

SEQ ID NO: 418130 - DNA, 140 bp, Artificial Sequence
  Synthetic
caccgctgtcccaaaaggtccaattccttggcatgtgtcacaggaacattagtttctgttagcgtgtccacagtttctgtagaatttgttgattggtggccgatacagattttgtctgcacatatcagcagccagggcct

SEQ ID NO: 418131 - DNA, 140 bp, Artificial Sequence
  Synthetic
aggccctggctgctgatatgcgagatactgacaaaaacaactgtggaccatatggccataatcaagaaatatacatcgggaagacaggagaagaatcctgcccttaggatgaagtggatggaccttttgggacagcggtg

SEQ ID NO: 418132 - DNA, 140 bp, Artificial Sequence
  Synthetic
caccgctgtcccaaaaggtccatccacttcatcctaagggcaggattcttctcctgtcttcccgatgtatatttcttgattatggccatatggtccacagttgtttttgtcagtatctcgcatatcagcagccagggcct

SEQ ID NO: 418133 - DNA, 140 bp, Artificial Sequence
  Synthetic
atacgccatgctgggtctcccaaaattggggagttgaacacatcgacagtgtgatgggaatggttggagtattaccagatatgactccaagcacagagatgtcaatgagaggaataagagcgtacttgggagtcggccat

SEQ ID NO: 418134 - DNA, 140 bp, Artificial Sequence
  Synthetic
atggccgactcccaagtacgctcttattcctctcattgacatctctgtgcttggagtcatatctggtaatactccaaccattcccatcacactgtcgatgtgttcaactccccaattttgggagacccagcatggcgtat

SEQ ID NO: 418135 - DNA, 140 bp, Artificial Sequence
  Synthetic
aggccctggctgctgatatgattaccagatatgactccaagcacagagatgtcaatgagaggaataagagtcagcaaaatgggtgtggatgaatactccagtacagagagggtggtggttgaccttttgggacagcggtg

SEQ ID NO: 418136 - DNA, 140 bp, Artificial Sequence
  Synthetic
caccgctgtcccaaaaggtcaaccaccaccctctctgtactggagtattcatccacacccattttgctgactcttattcctctcattgacatctctgtgcttggagtcatatctggtaatcatatcagcagccagggcct

SEQ ID NO: 418137 - DNA, 140 bp, Artificial Sequence
  Synthetic
atacgccatgctgggtctccccgtcggcagtgaatggaacgtgttaccctgggaatgtagaaaacttggaggaactcagaacactttttagttcctctagttcctaccaaagaatccaaacgtacttgggagtcggccat

SEQ ID NO: 418138 - DNA, 140 bp, Artificial Sequence
  Synthetic
atggccgactcccaagtacgtttggattctttggtaggaactagaggaactaaaaagtgttctgagttcctccaagttttctacattcccagggtaacacgttccattcactgccgacggggagacccagcatggcgtat

SEQ ID NO: 418139 - DNA, 140 bp, Artificial Sequence
  Synthetic
aggccctggctgctgatatgggaactcagaacactttttagttcctctagttcctaccaaagaatccaaattttcccagatgcaatctggaatgtgacttacactggaacaagcaaatcagaccttttgggacagcggtg

SEQ ID NO: 418140 - DNA, 140 bp, Artificial Sequence
  Synthetic
caccgctgtcccaaaaggtctgatttgcttgttccagtgtaagtcacattccagattgcatctgggaaaatttggattctttggtaggaactagaggaactaaaaagtgttctgagttcccatatcagcagccagggcct

SEQ ID NO: 418141 - DNA, 140 bp, Artificial Sequence
  Synthetic
aggccctggctgctgatatgctattttgaaaaggtcgaaaggctaaaacatggaaccttcggccctgttcacttccgaaaccaggttaaaatacgccgcagggtcgacataaacccgggcgaccttttgggacagcggtg

SEQ ID NO: 418142 - DNA, 140 bp, Artificial Sequence
  Synthetic
caccgctgtcccaaaaggtcgcccgggtttatgtcgaccctgcggcgtattttaacctggtttcggaagtgaacagggccgaaggttccatgttttagcctttcgaccttttcaaaatagcatatcagcagccagggcct

SEQ ID NO: 418143 - DNA, 140 bp, Artificial Sequence
  Synthetic
atacgccatgctgggtctcctctctaccctgttcaagatgcccaattcacaaacaatcggggaaaggacatcctttttgtctggggcatacatcatccacccactgatactgcacagacacgtacttgggagtcggccat

SEQ ID NO: 418144 - DNA, 140 bp, Artificial Sequence
  Synthetic
atggccgactcccaagtacgtgtctgtgcagtatcagtgggtggatgatgtatgccccagacaaaaaggatgtcctttccccgattgtttgtgaattgggcatcttgaacagggtagagaggagacccagcatggcgtat

SEQ ID NO: 418145 - DNA, 140 bp, Artificial Sequence
  Synthetic
atacgccatgctgggtctccatggtctcagaatcctgcaatgttgtacaacaaaatggaatttgaaccatttcaatctttagtccccaaggccattagaagccaatacagtgggtttgtccgtacttgggagtcggccat

SEQ ID NO: 418146 - DNA, 140 bp, Artificial Sequence
  Synthetic
atggccgactcccaagtacggacaaacccactgtattggcttctaatggccttggggactaaagattgaaatggttcaaattccattttgttgtacaacattgcaggattctgagaccatggagacccagcatggcgtat

SEQ ID NO: 418147 - DNA, 140 bp, Artificial Sequence
  Synthetic
atacgccatgctgggtctccccagataataaagcttctcccttttgcagctgctccaccgaagcaaagcagaatgcagttctcttcactgactgtgaatgtgaggggatcagggatgagacgtacttgggagtcggccat

SEQ ID NO: 418148 - DNA, 140 bp, Artificial Sequence
  Synthetic
atggccgactcccaagtacgtctcatccctgatcccctcacattcacagtcagtgaagagaactgcattctgctttgcttcggtggagcagctgcaaaagggagaagctttattatctggggagacccagcatggcgtat

SEQ ID NO: 418149 - DNA, 140 bp, Artificial Sequence
  Synthetic
aggccctggctgctgatatggaatgcagttctcttcactgactgtgaatgtgaggggatcagggatgagaatacttgtaaggggcaattctcctgtattcaactacaacaagaccactaagaccttttgggacagcggtg

SEQ ID NO: 418150 - DNA, 140 bp, Artificial Sequence
  Synthetic
caccgctgtcccaaaaggtcttagtggtcttgttgtagttgaatacaggagaattgccccttacaagtattctcatccctgatcccctcacattcacagtcagtgaagagaactgcattccatatcagcagccagggcct

SEQ ID NO: 418151 - DNA, 140 bp, Artificial Sequence
  Synthetic
atacgccatgctgggtctccctgccattccacaatatcagtaaatatgcattcgggaactgccccaaatatattggagtcaagagtctcaagctagcaataggtctgagaaacgtgcctgcgtacttgggagtcggccat

SEQ ID NO: 418152 - DNA, 140 bp, Artificial Sequence
  Synthetic
atggccgactcccaagtacgcaggcacgtttctcagacctattgctagcttgagactcttgactccaatatatttggggcagttcccgaatgcatatttactgatattgtggaatggcagggagacccagcatggcgtat

SEQ ID NO: 418153 - DNA, 140 bp, Artificial Sequence
  Synthetic
atacgccatgctgggtctccattcacaatggtcgggagaagagcaacagctattctcagaaaagcaaccaggagattgatccagttaatagtaagtgggagagacgagcagtcaattgctcgtacttgggagtcggccat

SEQ ID NO: 418154 - DNA, 140 bp, Artificial Sequence
  Synthetic
atggccgactcccaagtacgagcaattgactgctcgtctctcccacttactattaactggatcaatctcctggttgcttttctgagaatagctgttgctcttctcccgaccattgtgaatggagacccagcatggcgtat

SEQ ID NO: 418155 - DNA, 140 bp, Artificial Sequence
  Synthetic
atacgccatgctgggtctccgagtggatgaatattctagcactgagagagtggtcgttagcattgatcggttcctaagagtccgagatcagaggggaaacgtgctcttatctccagaagacgtacttgggagtcggccat

SEQ ID NO: 418156 - DNA, 140 bp, Artificial Sequence
  Synthetic
atggccgactcccaagtacgtcttctggagataagagcacgtttcccctctgatctcggactcttaggaaccgatcaatgctaacgaccactctctcagtgctagaatattcatccactcggagacccagcatggcgtat

SEQ ID NO: 418157 - DNA, 140 bp, Artificial Sequence
  Synthetic
atacgccatgctgggtctcctcagggagttggtatagcggcagataaggtttcaacccaaaaggcagttgataaaataacgtccaaggtgaataatatagtggataagatgaacaagcaacgtacttgggagtcggccat

SEQ ID NO: 418158 - DNA, 140 bp, Artificial Sequence
  Synthetic
atggccgactcccaagtacgttgcttgttcatcttatccactatattattcaccttggacgttattttatcaactgccttttgggttgaaaccttatctgccgctataccaactccctgaggagacccagcatggcgtat

SEQ ID NO: 418159 - DNA, 140 bp, Artificial Sequence
  Synthetic
atacgccatgctgggtctcctatgaaataattgatcatgaattcaatgaggttgaaactagactcaatatgatcaataataaaattgatgaccaaatacaagacgtatgggcatataatgcgtacttgggagtcggccat

SEQ ID NO: 418160 - DNA, 140 bp, Artificial Sequence
  Synthetic
atggccgactcccaagtacgcattatatgcccatacgtcttgtatttggtcatcaattttattattgatcatattgagtctagtttcaacctcattgaattcatgatcaattatttcataggagacccagcatggcgtat

SEQ ID NO: 418161 - DNA, 140 bp, Artificial Sequence
  Synthetic
aggccctggctgctgatatgctagatcgctagcaagctggatccagagtgaattcaacaaggcatgtgaattgactgattcaagctggatagaacttgatgagataggggaagatgttgcgaccttttgggacagcggtg

SEQ ID NO: 418162 - DNA, 140 bp, Artificial Sequence
  Synthetic
caccgctgtcccaaaaggtcgcaacatcttcccctatctcatcaagttctatccagcttgaatcagtcaattcacatgccttgttgaattcactctggatccagcttgctagcgatctagcatatcagcagccagggcct

SEQ ID NO: 418163 - DNA, 140 bp, Artificial Sequence
  Synthetic
aggccctggctgctgatatggaactgataccaaaatggaaaactttgtgcgacaatgtttcaatccaataattgtcgaacttgcggaaaagacaatgaaagagtatggtgaagacccgaagaccttttgggacagcggtg

SEQ ID NO: 418164 - DNA, 140 bp, Artificial Sequence
  Synthetic
caccgctgtcccaaaaggtcttcgggtcttcaccatactctttcattgtcttttccgcaagttcgacaattattggattgaaacattgtcgcacaaagttttccattttggtatcagttccatatcagcagccagggcct

SEQ ID NO: 418165 - DNA, 140 bp, Artificial Sequence
  Synthetic
atacgccatgctgggtctccaccaatgcatggaaacaattcggaacgggacctataataggagaaagtatcaagaggaatcaagactagaaaggcagaaaatagaagggataaagctggacgtacttgggagtcggccat

SEQ ID NO: 418166 - DNA, 140 bp, Artificial Sequence
  Synthetic
atggccgactcccaagtacgtccagctttatcccttctattttctgcctttctagtcttgattcctcttgatactttctcctattataggtcccgttccgaattgtttccatgcattggtggagacccagcatggcgtat

SEQ ID NO: 418167 - DNA, 140 bp, Artificial Sequence
  Synthetic
atacgccatgctgggtctccaaatagctctcagttattctgctggtgcacttgccagttgcatgggcctcatatacaataggatgggggctgtaaccactgaagtggcatttggcctggtcgtacttgggagtcggccat

SEQ ID NO: 418168 - DNA, 140 bp, Artificial Sequence
  Synthetic
atggccgactcccaagtacgaccaggccaaatgccacttcagtggttacagcccccatcctattgtatatgaggcccatgcaactggcaagtgcaccagcagaataactgagagctatttggagacccagcatggcgtat

SEQ ID NO: 418169 - DNA, 140 bp, Artificial Sequence
  Synthetic
aggccctggctgctgatatgatatacaataggatgggggctgtaaccactgaagtggcatttggcctggtgtgtgcaacatgtgagcagattgctgattcccagcacaggtctcataggcgaccttttgggacagcggtg

SEQ ID NO: 418170 - DNA, 140 bp, Artificial Sequence
  Synthetic
caccgctgtcccaaaaggtcgcctatgagacctgtgctgggaatcagcaatctgctcacatgttgcacacaccaggccaaatgccacttcagtggttacagcccccatcctattgtatatcatatcagcagccagggcct

SEQ ID NO: 418171 - DNA, 140 bp, Artificial Sequence
  Synthetic
atacgccatgctgggtctccttcgactgtcgcctcatctcttgtacttgcaatggggtttgctgccttcttgttctgggccatgtctaatggatcatgcaggtgcaacatttgtatataacgtacttgggagtcggccat

SEQ ID NO: 418172 - DNA, 140 bp, Artificial Sequence
  Synthetic
atggccgactcccaagtacgttatatacaaatgttgcacctgcatgatccattagacatggcccagaacaagaaggcagcaaaccccattgcaagtacaagagatgaggcgacagtcgaaggagacccagcatggcgtat

SEQ ID NO: 418173 - DNA, 140 bp, Artificial Sequence
  Synthetic
aggccctggctgctgatatggtggtaaactttgtgagtatggagttttccctcacagacccgagactggagccacacaaatgggaaaagtactgtgttctcgaaatagggaatatgctctgaccttttgggacagcggtg

SEQ ID NO: 418174 - DNA, 140 bp, Artificial Sequence
  Synthetic
caccgctgtcccaaaaggtcagagcatattccctatttcgagaacacagtacttttcccatttgtgtggctccagtctcgggtctgtgagggaaaactccatactcacaaagtttaccaccatatcagcagccagggcct

SEQ ID NO: 418175 - DNA, 140 bp, Artificial Sequence
  Synthetic
atacgccatgctgggtctccttggccagcactacagctaaggctatggagcaaatggctggatcaagtgagcaggcagcggaggccatggagattgctagtcaggccaggcagatggtgccgtacttgggagtcggccat

SEQ ID NO: 418176 - DNA, 140 bp, Artificial Sequence
  Synthetic
atggccgactcccaagtacggcaccatctgcctggcctgactagcaatctccatggcctccgctgcctgctcacttgatccagccatttgctccatagccttagctgtagtgctggccaaggagacccagcatggcgtat

SEQ ID NO: 418177 - DNA, 140 bp, Artificial Sequence
  Synthetic
aggccctggctgctgatatggcaggcagcggaggccatggagattgctagtcaggccaggcagatggtgcaggcaatgagagccattgggactcatcctagttccagtactggtctaagagaccttttgggacagcggtg

SEQ ID NO: 418178 - DNA, 140 bp, Artificial Sequence
  Synthetic
caccgctgtcccaaaaggtctcttagaccagtactggaactaggatgagtcccaatggctctcattgcctgcaccatctgcctggcctgactagcaatctccatggcctccgctgcctgccatatcagcagccagggcct

SEQ ID NO: 418179 - DNA, 140 bp, Artificial Sequence
  Synthetic
aggccctggctgctgatatgggtctggatatcggtacagctactcgtgcgggaaggcaaattgtggagcagattctagaggaagaatctgatgagacacttaaaatgactattgcttctggaccttttgggacagcggtg

SEQ ID NO: 418180 - DNA, 140 bp, Artificial Sequence
  Synthetic
caccgctgtcccaaaaggtccagaagcaatagtcattttaagtgtctcatcagattcttcctctagaatctgctccacaatttgccttcccgcacgagtagctgtaccgatatccagacccatatcagcagccagggcct

SEQ ID NO: 418181 - DNA, 140 bp, Artificial Sequence
  Synthetic
atacgccatgctgggtctccctgccttcttcagtctcttcagcagattgagagcatgattgaggccgagtcttccgtcaaggagaaagacatgaccaaggagttcttcgaaaacaaatcgcgtacttgggagtcggccat

SEQ ID NO: 418182 - DNA, 140 bp, Artificial Sequence
  Synthetic
atggccgactcccaagtacgcgatttgttttcgaagaactccttggtcatgtctttctccttgacggaagactcggcctcaatcatgctctcaatctgctgaagagactgaagaaggcagggagacccagcatggcgtat

SEQ ID NO: 418183 - DNA, 140 bp, Artificial Sequence
  Synthetic
atacgccatgctgggtctccgatgcaacgattcaagtgacccgcttgttgttgccgcgaatatcattgggatcttgcacttgatattgtggattcttgatcgtctttttttcaaatgcgtcgtacttgggagtcggccat

SEQ ID NO: 418184 - DNA, 140 bp, Artificial Sequence
  Synthetic
atggccgactcccaagtacgacgcatttgaaaaaaagacgatcaagaatccacaatatcaagtgcaagatcccaatgatattcgcggcaacaacaagcgggtcacttgaatcgttgcatcggagacccagcatggcgtat

SEQ ID NO: 418185 - DNA, 140 bp, Artificial Sequence
  Synthetic
aggccctggctgctgatatggactggttcatgctcatgccaaagcagaaagtggctggttccctgtgcattagaatggaccaggcaataatggataaaaccatcatattgaaagcaaattgaccttttgggacagcggtg

SEQ ID NO: 418186 - DNA, 140 bp, Artificial Sequence
  Synthetic
caccgctgtcccaaaaggtcaatttgctttcaatatgatggttttatccattattgcctggtccattctaatgcacagggaaccagccactttctgctttggcatgagcatgaaccagtccatatcagcagccagggcct

SEQ ID NO: 418187 - DNA, 140 bp, Artificial Sequence
  Synthetic
aggccctggctgctgatatgcgggaaggtgtgcagaaccttactggcaaagtctgtattcaacagtctatatgcatctccacaactcgaggggttttcagctgaatcgagaaaattgcttgaccttttgggacagcggtg

SEQ ID NO: 418188 - DNA, 140 bp, Artificial Sequence
  Synthetic
caccgctgtcccaaaaggtcaagcaattttctcgattcagctgaaaacccctcgagttgtggagatgcatatagactgttgaatacagactttgccagtaaggttctgcacaccttcccgcatatcagcagccagggcct

SEQ ID NO: 418189 - DNA, 140 bp, Artificial Sequence
  Synthetic
atacgccatgctgggtctccatgcatctccacaactcgaggggttttcagctgaatcgagaaaattgcttctcattgttcaggcacttagggacaacctggaacctgggaccttcgatctcgtacttgggagtcggccat

SEQ ID NO: 418190 - DNA, 140 bp, Artificial Sequence
  Synthetic
atggccgactcccaagtacgagatcgaaggtcccaggttccaggttgtccctaagtgcctgaacaatgagaagcaattttctcgattcagctgaaaacccctcgagttgtggagatgcatggagacccagcatggcgtat

SEQ ID NO: 418191 - DNA, 140 bp, Artificial Sequence
  Synthetic
atacgccatgctgggtctcccattgcatttcaagcaatatgaattcaactcccccccaaacaaccaagtgatgctgtgtgaaccaacaataatagaaagaaacataacagagatagtgtacgtacttgggagtcggccat

SEQ ID NO: 418192 - DNA, 140 bp, Artificial Sequence
  Synthetic
atggccgactcccaagtacgtacactatctctgttatgtttctttctattattgttggttcacacagcatcacttggttgtttgggggggagttgaattcatattgcttgaaatgcaatgggagacccagcatggcgtat

SEQ ID NO: 418193 - DNA, 140 bp, Artificial Sequence
  Synthetic
aggccctggctgctgatatgatgctgtgtgaaccaacaataatagaaagaaacataacagagatagtgtatctgaccaacaccaccatagagaaggaaatatgccccaaaccagcagaatgaccttttgggacagcggtg

SEQ ID NO: 418194 - DNA, 140 bp, Artificial Sequence
  Synthetic
caccgctgtcccaaaaggtcattctgctggtttggggcatatttccttctctatggtggtgttggtcagatacactatctctgttatgtttctttctattattgttggttcacacagcatcatatcagcagccagggcct

SEQ ID NO: 418195 - DNA, 140 bp, Artificial Sequence
  Synthetic
atacgccatgctgggtctcctctgaccaacaccaccatagagaaggaaatatgccccaaaccagcagaatacagaaattggtcaaaaccgcaatgtggcattacaggatttgcacctttccgtacttgggagtcggccat

SEQ ID NO: 418196 - DNA, 140 bp, Artificial Sequence
  Synthetic
atggccgactcccaagtacggaaaggtgcaaatcctgtaatgccacattgcggttttgaccaatttctgtattctgctggtttggggcatatttccttctctatggtggtgttggtcagaggagacccagcatggcgtat

SEQ ID NO: 418197 - DNA, 140 bp, Artificial Sequence
  Synthetic
atacgccatgctgggtctcccccgttcaaaggcaggactgttggtttcagatggaggaccaaatctatacaatatccgaaatctccatattcctgaggtctgcttgaaatgggaattgatcgtacttgggagtcggccat

SEQ ID NO: 418198 - DNA, 140 bp, Artificial Sequence
  Synthetic
atggccgactcccaagtacgatcaattcccatttcaagcagacctcaggaatatggagatttcggatattgtatagatttggtcctccatctgaaaccaacagtcctgcctttgaacgggggagacccagcatggcgtat

SEQ ID NO: 418199 - DNA, 140 bp, Artificial Sequence
  Synthetic
atacgccatgctgggtctccgccatagggaaatcgaatcagtcaacaatgctatagtaatgccagctcatggcccggccaagagtatggaatatgatgccgttgcaaccacacattcatgcgtacttgggagtcggccat

SEQ ID NO: 418200 - DNA, 140 bp, Artificial Sequence
  Synthetic
atggccgactcccaagtacgcatgaatgtgtggttgcaacggcatcatattccatactcttggccgggccatgagctggcattactatagcattgttgactgattcgatttccctatggcggagacccagcatggcgtat

SEQ ID NO: 418201 - DNA, 140 bp, Artificial Sequence
  Synthetic
aggccctggctgctgatatgcagttactcaactggtgcgcttgccagctgcatgggtctcatatacaacaggatggggacagtaaccgcagaaggggctcttggactagtatgtgccactgaccttttgggacagcggtg

SEQ ID NO: 418202 - DNA, 140 bp, Artificial Sequence
  Synthetic
caccgctgtcccaaaaggtcagtggcacatactagtccaagagccccttctgcggttactgtccccatcctgttgtatatgagacccatgcagctggcaagcgcaccagttgagtaactgcatatcagcagccagggcct

SEQ ID NO: 418203 - DNA, 140 bp, Artificial Sequence
  Synthetic
aggccctggctgctgatatgggatggggacagtaaccgcagaaggggctcttggactagtatgtgccacttgtgagcagattgctgacgcacaacatcggtcccacaggcagatggcgacgaccttttgggacagcggtg

SEQ ID NO: 418204 - DNA, 140 bp, Artificial Sequence
  Synthetic
caccgctgtcccaaaaggtcgtcgccatctgcctgtgggaccgatgttgtgcgtcagcaatctgctcacaagtggcacatactagtccaagagccccttctgcggttactgtccccatcccatatcagcagccagggcct

SEQ ID NO: 418205 - DNA, 140 bp, Artificial Sequence
  Synthetic
atacgccatgctgggtctcctgtgagcagattgctgacgcacaacatcggtcccacaggcagatggcgactactaccaacccactaattaggcatgagaatagaatggtactagccagcacgtacttgggagtcggccat

SEQ ID NO: 418206 - DNA, 140 bp, Artificial Sequence
  Synthetic
atggccgactcccaagtacgtgctggctagtaccattctattctcatgcctaattagtgggttggtagtagtcgccatctgcctgtgggaccgatgttgtgcgtcagcaatctgctcacaggagacccagcatggcgtat

SEQ ID NO: 418207 - DNA, 140 bp, Artificial Sequence
  Synthetic
atacgccatgctgggtctccgtagccattgtttggatcctaacaatgaagaaggtggtcatggagtgaaaggctgggcctttgatgatggaaatgacgtgtggatgggaagaacaatcaacgtacttgggagtcggccat

SEQ ID NO: 418208 - DNA, 140 bp, Artificial Sequence
  Synthetic
atggccgactcccaagtacgttgattgttcttcccatccacacgtcatttccatcatcaaaggcccagcctttcactccatgaccaccttcttcattgttaggatccaaacaatggctacggagacccagcatggcgtat

SEQ ID NO: 418209 - DNA, 140 bp, Artificial Sequence
  Synthetic
aggccctggctgctgatatgggctgggcctttgatgatggaaatgacgtgtggatgggaagaacaatcaacgagacgtcacgcttagggtatgaaaccttcaaagtcattgaaggctggtgaccttttgggacagcggtg

SEQ ID NO: 418210 - DNA, 140 bp, Artificial Sequence
  Synthetic
caccgctgtcccaaaaggtcaccagccttcaatgactttgaaggtttcataccctaagcgtgacgtctcgttgattgttcttcccatccacacgtcatttccatcatcaaaggcccagcccatatcagcagccagggcct

SEQ ID NO: 418211 - DNA, 140 bp, Artificial Sequence
  Synthetic
aggccctggctgctgatatgatgaggagaaaatcccaaagacaaagaacatgaagaagacaagtcaattaaagtgggcacttggtgaaaacatggcaccagaaaaagtggactttgaggagaccttttgggacagcggtg

SEQ ID NO: 418212 - DNA, 140 bp, Artificial Sequence
  Synthetic
caccgctgtcccaaaaggtctcctcaaagtccactttttctggtgccatgttttcaccaagtgcccactttaattgacttgtcttcttcatgttctttgtctttgggattttctcctcatcatatcagcagccagggcct

SEQ ID NO: 418213 - DNA, 140 bp, Artificial Sequence
  Synthetic
atacgccatgctgggtctccaactcaattaggctttctgcaggtggagatatctgggtaacaagagaaccttatgtttcatgcagtcttggcaaatgttatcaatttgcacttgggcaggcgtacttgggagtcggccat

SEQ ID NO: 418214 - DNA, 140 bp, Artificial Sequence
  Synthetic
atggccgactcccaagtacgcctgcccaagtgcaaattgataacatttgccaagactgcatgaaacataaggttctcttgttacccagatatctccacctgcagaaagcctaattgagttggagacccagcatggcgtat

SEQ ID NO: 418215 - DNA, 140 bp, Artificial Sequence
  Synthetic
aggccctggctgctgatatgcaacatactggtgggacggactccaatcctccgatgactttgctctcatagtgaatgctccgaatcatgagggaatacaagcaggagtagatagattctagaccttttgggacagcggtg

SEQ ID NO: 418216 - DNA, 140 bp, Artificial Sequence
  Synthetic
caccgctgtcccaaaaggtctagaatctatctactcctgcttgtattccctcatgattcggagcattcactatgagagcaaagtcatcggaggattggagtccgtcccaccagtatgttgcatatcagcagccagggcct

SEQ ID NO: 418217 - DNA, 140 bp, Artificial Sequence
  Synthetic
atacgccatgctgggtctccataatcactcactgagtgacatcaaaatcatggcgtcccaaggcaccaaacggtcttatgaacagatggaaactgatggagatcgccagaatgcaactgacgtacttgggagtcggccat

SEQ ID NO: 418218 - DNA, 140 bp, Artificial Sequence
  Synthetic
atggccgactcccaagtacgtcagttgcattctggcgatctccatcagtttccatctgttcataagaccgtttggtgccttgggacgccatgattttgatgtcactcagtgagtgattatggagacccagcatggcgtat

SEQ ID NO: 418219 - DNA, 140 bp, Artificial Sequence
  Synthetic
atacgccatgctgggtctccaagcatggttacatatttgtgttactggggatgataaaaatgctactgctagtatcatttatgatgggatgcttgttgacagtattggttcatggtccaacgtacttgggagtcggccat

SEQ ID NO: 418220 - DNA, 140 bp, Artificial Sequence
  Synthetic
atggccgactcccaagtacgttggaccatgaaccaatactgtcaacaagcatcccatcataaatgatactagcagtagcatttttatcatccccagtaacacaaatatgtaaccatgcttggagacccagcatggcgtat

SEQ ID NO: 418221 - DNA, 140 bp, Artificial Sequence
  Synthetic
atacgccatgctgggtctccgattagggcatccgtcgggaagatgattgatggaattgggagattctacatccaaatgtgcactgaacttaaactcagtgatcatgaagggcggttgatccgtacttgggagtcggccat

SEQ ID NO: 418222 - DNA, 140 bp, Artificial Sequence
  Synthetic
atggccgactcccaagtacggatcaaccgcccttcatgatcactgagtttaagttcagtgcacatttggatgtagaatctcccaattccatcaatcatcttcccgacggatgccctaatcggagacccagcatggcgtat

SEQ ID NO: 418223 - DNA, 140 bp, Artificial Sequence
  Synthetic
aggccctggctgctgatatgtccaaatgtgcactgaacttaaactcagtgatcatgaagggcggttgatccagaacagcttgacaatagagaaaatggtactctctgcttttgatgaaaggaccttttgggacagcggtg

SEQ ID NO: 418224 - DNA, 140 bp, Artificial Sequence
  Synthetic
caccgctgtcccaaaaggtcctttcatcaaaagcagagagtaccattttctctattgtcaagctgttctggatcaaccgcccttcatgatcactgagtttaagttcagtgcacatttggacatatcagcagccagggcct

SEQ ID NO: 418225 - DNA, 140 bp, Artificial Sequence
  Synthetic
atacgccatgctgggtctccgtgcagtagtaatgactgatggaagtgcatcaggaaaggctgacactagaatattattcataagagaggggaaaattataaacattagcccattgtcaggcgtacttgggagtcggccat

SEQ ID NO: 418226 - DNA, 140 bp, Artificial Sequence
  Synthetic
atggccgactcccaagtacgcctgacaatgggctaatgtttataattttcccctctcttatgaataatattctagtgtcagcctttcctgatgcacttccatcagtcattactactgcacggagacccagcatggcgtat

SEQ ID NO: 418227 - DNA, 140 bp, Artificial Sequence
  Synthetic
aggccctggctgctgatatgatgggtttgaggatcagctcatcctttagttttgggggtttcactttcaaaagaacaagtgggtcatccgtcacgaaggaagaggaagtgcttacgggcagaccttttgggacagcggtg

SEQ ID NO: 418228 - DNA, 140 bp, Artificial Sequence
  Synthetic
caccgctgtcccaaaaggtctgcccgtaagcacttcctcttccttcgtgacggatgacccacttgttcttttgaaagtgaaacccccaaaactaaaggatgagctgatcctcaaacccatcatatcagcagccagggcct

SEQ ID NO: 418229 - DNA, 140 bp, Artificial Sequence
  Synthetic
atacgccatgctgggtctccaaactggggggcccatatacaggagaatcgatgggaaatggatgagggaactcgtcctttatgacaaagaagaaataaggcgaatctggcgccaagccaacgtacttgggagtcggccat

SEQ ID NO: 418230 - DNA, 140 bp, Artificial Sequence
  Synthetic
atggccgactcccaagtacgttggcttggcgccagattcgccttatttcttctttgtcataaaggacgagttccctcatccatttcccatcgattctcctgtatatgggccccccagtttggagacccagcatggcgtat

SEQ ID NO: 418231 - DNA, 140 bp, Artificial Sequence
  Synthetic
aggccctggctgctgatatgctcgtcctttatgacaaagaagaaataaggcgaatctggcgccaagccaacaatggtgaggatgctacatctggtctaactcacataatgatttggcattgaccttttgggacagcggtg

SEQ ID NO: 418232 - DNA, 140 bp, Artificial Sequence
  Synthetic
caccgctgtcccaaaaggtcaatgccaaatcattatgtgagttagaccagatgtagcatcctcaccattgttggcttggcgccagattcgccttatttcttctttgtcataaaggacgagcatatcagcagccagggcct

SEQ ID NO: 418233 - DNA, 140 bp, Artificial Sequence
  Synthetic
aggccctggctgctgatatgacaaagagatagagtctgtaaacaatgctgtggtaatgccagctcatggcccggccaagagcatggaatatgatgctgttgctactacgcactcctggatgaccttttgggacagcggtg

SEQ ID NO: 418234 - DNA, 140 bp, Artificial Sequence
  Synthetic
caccgctgtcccaaaaggtcatccaggagtgcgtagtagcaacagcatcatattccatgctcttggccgggccatgagctggcattaccacagcattgtttacagactctatctctttgtcatatcagcagccagggcct

SEQ ID NO: 418235 - DNA, 140 bp, Artificial Sequence
  Synthetic
atacgccatgctgggtctccggaatggatcccagaatgtgctctctgatgcagggctcgactctccctagaaggtccggagctgcaggtgctgcagtcaaaggaatcgggacaatggtgacgtacttgggagtcggccat

SEQ ID NO: 418236 - DNA, 140 bp, Artificial Sequence
  Synthetic
atggccgactcccaagtacgtcaccattgtcccgattcctttgactgcagcacctgcagctccggaccttctagggagagtcgagccctgcatcagagagcacattctgggatccattccggagacccagcatggcgtat

SEQ ID NO: 418237 - DNA, 140 bp, Artificial Sequence
  Synthetic
aggccctggctgctgatatgaaggtccggagctgcaggtgctgcagtcaaaggaatcgggacaatggtgatggaactgatcagaatggtcaaacgggggatcaacgatcgaaatttttgggaccttttgggacagcggtg

SEQ ID NO: 418238 - DNA, 140 bp, Artificial Sequence
  Synthetic
caccgctgtcccaaaaggtcccaaaaatttcgatcgttgatcccccgtttgaccattctgatcagttccatcaccattgtcccgattcctttgactgcagcacctgcagctccggaccttcatatcagcagccagggcct

SEQ ID NO: 418239 - DNA, 140 bp, Artificial Sequence
  Synthetic
atacgccatgctgggtctcccattcttaaaggaaaatttcaaacagctgcacaaagagcaatggtggatcaagttagagaaagtcggaacccaggaaacgctgagatcgaagatctcatacgtacttgggagtcggccat

SEQ ID NO: 418240 - DNA, 140 bp, Artificial Sequence
  Synthetic
atggccgactcccaagtacgtatgagatcttcgatctcagcgtttcctgggttccgactttctctaacttgatccaccattgctctttgtgcagctgtttgaaattttcctttaagaatgggagacccagcatggcgtat

SEQ ID NO: 418241 - DNA, 140 bp, Artificial Sequence
  Synthetic
aggccctggctgctgatatggtgtttttatgtggagttgataagagggagaccacaggagcccagagtgtggtggacttcaaatagcatcattgtattctgtggaacctcaggtacatatgaccttttgggacagcggtg

SEQ ID NO: 418242 - DNA, 140 bp, Artificial Sequence
  Synthetic
caccgctgtcccaaaaggtcatatgtacctgaggttccacagaatacaatgatgctatttgaagtccaccacactctgggctcctgtggtctccctcttatcaactccacataaaaacaccatatcagcagccagggcct

SEQ ID NO: 418243 - DNA, 140 bp, Artificial Sequence
  Synthetic
atacgccatgctgggtctccttgcctacctgcctgtgcgtatggacctgcagtatccagtgggtacgacttcgaaaaagagggatattccttggtgggaatagaccctttcaaactgcttcgtacttgggagtcggccat

SEQ ID NO: 418244 - DNA, 140 bp, Artificial Sequence
  Synthetic
atggccgactcccaagtacgaagcagtttgaaagggtctattcccaccaaggaatatccctctttttcgaagtcgtacccactggatactgcaggtccatacgcacaggcaggtaggcaaggagacccagcatggcgtat

SEQ ID NO: 418245 - DNA, 140 bp, Artificial Sequence
  Synthetic
aggccctggctgctgatatgatggcgtctcaaggcaccaaacgatcctatgaacagatggaaactggtggagaacgccagaatgctactgagatcagggcatctgttggaagaatggttagaccttttgggacagcggtg

SEQ ID NO: 418246 - DNA, 140 bp, Artificial Sequence
  Synthetic
caccgctgtcccaaaaggtctaaccattcttccaacagatgccctgatctcagtagcattctggcgttctccaccagtttccatctgttcataggatcgtttggtgccttgagacgccatcatatcagcagccagggcct

SEQ ID NO: 418247 - DNA, 140 bp, Artificial Sequence
  Synthetic
atacgccatgctgggtctcccaaaatagccaaatatacagcttaatcagacctaacgagaatccagcacacaagagtcagctggtgtggatggcatgccattctgctgcatttgaagattcgtacttgggagtcggccat

SEQ ID NO: 418248 - DNA, 140 bp, Artificial Sequence
  Synthetic
atggccgactcccaagtacgaatcttcaaatgcagcagaatggcatgccatccacaccagctgactcttgtgtgctggattctcgttaggtctgattaagctgtatatttggctattttgggagacccagcatggcgtat

SEQ ID NO: 418249 - DNA, 140 bp, Artificial Sequence
  Synthetic
aggccctggctgctgatatgcaagagtcagctggtgtggatggcatgccattctgctgcatttgaagatttaagattgttaagcttcatcagagggacaaaagtatctcctcgggggaaagaccttttgggacagcggtg

SEQ ID NO: 418250 - DNA, 140 bp, Artificial Sequence
  Synthetic
caccgctgtcccaaaaggtctttcccccgaggagatacttttgtccctctgatgaagcttaacaatcttaaatcttcaaatgcagcagaatggcatgccatccacaccagctgactcttgcatatcagcagccagggcct

SEQ ID NO: 418251 - DNA, 140 bp, Artificial Sequence
  Synthetic
aggccctggctgctgatatgactctctgcatttgatgaaagaaggaacagatacctggaagagcaccccagtacgggaaaggacccgaagaaaactggaggtccaatttaccgaagaagagaccttttgggacagcggtg

SEQ ID NO: 418252 - DNA, 140 bp, Artificial Sequence
  Synthetic
caccgctgtcccaaaaggtctcttcttcggtaaattggacctccagttttcttcgggtcctttcccgtactggggtgctcttccaggtatctgttccttctttcatcaaatgcagagagtcatatcagcagccagggcct

SEQ ID NO: 418253 - DNA, 140 bp, Artificial Sequence
  Synthetic
atacgccatgctgggtctccgggatcgagcactcttgaactgagaagcgggtactgggccataaggaccaggagtggaggaaacactaatcaacagagggcctccgcaggccaaaccagtcgtacttgggagtcggccat

SEQ ID NO: 418254 - DNA, 140 bp, Artificial Sequence
  Synthetic
atggccgactcccaagtacgactggtttggcctgcggaggccctctgttgattagtgtttcctccactcctggtccttatggcccagtacccgcttctcagttcaagagtgctcgatcccggagacccagcatggcgtat

SEQ ID NO: 418255 - DNA, 140 bp, Artificial Sequence
  Synthetic
aggccctggctgctgatatgggagtggaggaaacactaatcaacagagggcctccgcaggccaaaccagtgtgcaacctacgttttctgtacaaagaaacctcccatttgaaaagtcaacgaccttttgggacagcggtg

SEQ ID NO: 418256 - DNA, 140 bp, Artificial Sequence
  Synthetic
caccgctgtcccaaaaggtcgttgacttttcaaatgggaggtttctttgtacagaaaacgtaggttgcacactggtttggcctgcggaggccctctgttgattagtgtttcctccactcccatatcagcagccagggcct

SEQ ID NO: 418257 - DNA, 140 bp, Artificial Sequence
  Synthetic
atacgccatgctgggtctccgggcagaaatcataaggatgatggaaggtgcaaaaccagaagaagtgtcattccgggggaggggagttttcgagctctcagacgagaaggcaacgaaccccgtacttgggagtcggccat

SEQ ID NO: 418258 - DNA, 140 bp, Artificial Sequence
  Synthetic
atggccgactcccaagtacggggttcgttgccttctcgtctgagagctcgaaaactcccctcccccggaatgacacttcttctggttttgcaccttccatcatccttatgatttctgcccggagacccagcatggcgtat

SEQ ID NO: 418259 - DNA, 140 bp, Artificial Sequence
  Synthetic
atacgccatgctgggtctccgcaaggaggacaaaagatatggaccagcattgagcatcaatgaactgagcaatcttgcaaaaggggagaaagctaatgtgctgatagggcaaggagacgtcgtacttgggagtcggccat

SEQ ID NO: 418260 - DNA, 140 bp, Artificial Sequence
  Synthetic
atggccgactcccaagtacgacgtctccttgccctatcagcacattagctttctccccttttgcaagattgctcagttcattgatgctcaatgctggtccatatcttttgtcctccttgcggagacccagcatggcgtat

SEQ ID NO: 418261 - DNA, 140 bp, Artificial Sequence
  Synthetic
aggccctggctgctgatatggaggagaaaattccaaaaacaaagaacatgaagaaaacaagccaattgaagtgggcacttggtgagaacatggcaccagagaaagtagactttgaggactgaccttttgggacagcggtg

SEQ ID NO: 418262 - DNA, 140 bp, Artificial Sequence
  Synthetic
caccgctgtcccaaaaggtcagtcctcaaagtctactttctctggtgccatgttctcaccaagtgcccacttcaattggcttgttttcttcatgttctttgtttttggaattttctcctccatatcagcagccagggcct

SEQ ID NO: 418263 - DNA, 140 bp, Artificial Sequence
  Synthetic
atacgccatgctgggtctcccgacaaaaaagaaaattgaaaagataagacctcttctaatagatggtacagcctcattgagtcccggaatgatgatgggcatgttcaacatgctaagtaccgtacttgggagtcggccat

SEQ ID NO: 418264 - DNA, 140 bp, Artificial Sequence
  Synthetic
atggccgactcccaagtacggtacttagcatgttgaacatgcccatcatcattccgggactcaatgaggctgtaccatctattagaagaggtcttatcttttcaattttcttttttgtcgggagacccagcatggcgtat

SEQ ID NO: 418265 - DNA, 140 bp, Artificial Sequence
  Synthetic
aggccctggctgctgatatgtgtctggttttcgctcaaaaacttcctggaaatgacaatagcacggcaacgctgtgccttgggcaccatgcagtaccaaacggaacgatagtgagaacaagaccttttgggacagcggtg

SEQ ID NO: 418266 - DNA, 140 bp, Artificial Sequence
  Synthetic
caccgctgtcccaaaaggtcttgttctcactatcgttccgtttggtactgcatggtgcccaaggcacagcgttgccgtgctattgtcatttccaggaagtttttgagcgaaaaccagacacatatcagcagccagggcct

SEQ ID NO: 418267 - DNA, 140 bp, Artificial Sequence
  Synthetic
atacgccatgctgggtctcctgccacagcacacagattggaggaataaggatggtggacatccttaggcagaatccaacagaggaacaagccgtagacatatgcaaggcagcaatgggaccgtacttgggagtcggccat

SEQ ID NO: 418268 - DNA, 140 bp, Artificial Sequence
  Synthetic
atggccgactcccaagtacggtcccattgctgccttgcatatgtctacggcttgttcctctgttggattctgcctaaggatgtccaccatccttattcctccaatctgtgtgctgtggcaggagacccagcatggcgtat

SEQ ID NO: 418269 - DNA, 140 bp, Artificial Sequence
  Synthetic
aggccctggctgctgatatgtcctcaataggtgaaatatgcgacagtcctcatcagatccttgatggagaaaactgcacactaatagatgctctattgggagaccctcagtgtgatggctgaccttttgggacagcggtg

SEQ ID NO: 418270 - DNA, 140 bp, Artificial Sequence
  Synthetic
caccgctgtcccaaaaggtcagccatcacactgagggtctcccaatagagcatctattagtgtgcagttttctccatcaaggatctgatgaggactgtcgcatatttcacctattgaggacatatcagcagccagggcct

SEQ ID NO: 418271 - DNA, 140 bp, Artificial Sequence
  Synthetic
aggccctggctgctgatatgtcccattgcagggctactgaatacataatgaagggagtgtacataaacacagccctgttgaatgcatcctgtgcagccatggatgacttccaactgattcgaccttttgggacagcggtg

SEQ ID NO: 418272 - DNA, 140 bp, Artificial Sequence
  Synthetic
caccgctgtcccaaaaggtcgaatcagttggaagtcatccatggctgcacaggatgcattcaacagggctgtgtttatgtacactcccttcattatgtattcagtagccctgcaatgggacatatcagcagccagggcct

SEQ ID NO: 418273 - DNA, 140 bp, Artificial Sequence
  Synthetic
atacgccatgctgggtctccagtttctttagtagattaaattggttgacccacttaaacttcaaatacccagcattgaacgtgactatgccaaacaatgaacaatttgacaaattgtacacgtacttgggagtcggccat

SEQ ID NO: 418274 - DNA, 140 bp, Artificial Sequence
  Synthetic
atggccgactcccaagtacgtgtacaatttgtcaaattgttcattgtttggcatagtcacgttcaatgctgggtatttgaagtttaagtgggtcaaccaatttaatctactaaagaaactggagacccagcatggcgtat

SEQ ID NO: 418275 - DNA, 140 bp, Artificial Sequence
  Synthetic
aggccctggctgctgatatgagcattgaacgtgactatgccaaacaatgaacaatttgacaaattgtacatttggggggttcaccacccgggtacggacaaggaccaaatcttcctgtatgaccttttgggacagcggtg

SEQ ID NO: 418276 - DNA, 140 bp, Artificial Sequence
  Synthetic
caccgctgtcccaaaaggtcatacaggaagatttggtccttgtccgtacccgggtggtgaaccccccaaatgtacaatttgtcaaattgttcattgtttggcatagtcacgttcaatgctcatatcagcagccagggcct

SEQ ID NO: 418277 - DNA, 140 bp, Artificial Sequence
  Synthetic
atacgccatgctgggtctcctttggggggttcaccacccgggtacggacaaggaccaaatcttcctgtatgctcaatcatcaggaagaatcacagtatctaccaaaagaagccaacaagccgtacttgggagtcggccat

SEQ ID NO: 418278 - DNA, 140 bp, Artificial Sequence
  Synthetic
atggccgactcccaagtacggcttgttggcttcttttggtagatactgtgattcttcctgatgattgagcatacaggaagatttggtccttgtccgtacccgggtggtgaaccccccaaaggagacccagcatggcgtat

SEQ ID NO: 418279 - DNA, 140 bp, Artificial Sequence
  Synthetic
atacgccatgctgggtctccgccttcttcaatcccttcaacaaattgagagcatgattgaggccgagtcttctgtcaaagagaaagacatgaccaaagaattctttgagaacaaatcagacgtacttgggagtcggccat

SEQ ID NO: 418280 - DNA, 140 bp, Artificial Sequence
  Synthetic
atggccgactcccaagtacgtctgatttgttctcaaagaattctttggtcatgtctttctctttgacagaagactcggcctcaatcatgctctcaatttgttgaagggattgaagaaggcggagacccagcatggcgtat

SEQ ID NO: 418281 - DNA, 140 bp, Artificial Sequence
  Synthetic
atacgccatgctgggtctccatggagacagtatcactgataactatactactagtagtaacagtaagcaatgcagataagatctgcatcggctatcaatcaacaaactccacagaaactgcgtacttgggagtcggccat

SEQ ID NO: 418282 - DNA, 140 bp, Artificial Sequence
  Synthetic
atggccgactcccaagtacgcagtttctgtggagtttgttgattgatagccgatgcagatcttatctgcattgcttactgttactactagtagtatagttatcagtgatactgtctccatggagacccagcatggcgtat

SEQ ID NO: 418283 - DNA, 140 bp, Artificial Sequence
  Synthetic
aggccctggctgctgatatgatgagccttctaaccgaggtcgaaacgtatgttctctctatcgttccatcaggccccctcaaagccgagatcgcgcagagacttgaagatgtctttgctggaccttttgggacagcggtg

SEQ ID NO: 418284 - DNA, 140 bp, Artificial Sequence
  Synthetic
caccgctgtcccaaaaggtccagcaaagacatcttcaagtctctgcgcgatctcggctttgagggggcctgatggaacgatagagagaacatacgtttcgacctcggttagaaggctcatcatatcagcagccagggcct

SEQ ID NO: 418285 - DNA, 140 bp, Artificial Sequence
  Synthetic
aggccctggctgctgatatggatggcaatgaaatatccaatcacagcagataagaggataatggaaatgattcctgaaagaaatgaacaaggacaaaccctctggagcaaaacaaacgatgaccttttgggacagcggtg

SEQ ID NO: 418286 - DNA, 140 bp, Artificial Sequence
  Synthetic
caccgctgtcccaaaaggtcatcgtttgttttgctccagagggtttgtccttgttcatttctttcaggaatcatttccattatcctcttatctgctgtgattggatatttcattgccatccatatcagcagccagggcct

SEQ ID NO: 418287 - DNA, 140 bp, Artificial Sequence
  Synthetic
aggccctggctgctgatatgtataagtactacatttccttatactggagaccctccatacagccatggaacgggaacaggatacaccatggatacagtcaacagaacacatcaatattcagaccttttgggacagcggtg

SEQ ID NO: 418288 - DNA, 140 bp, Artificial Sequence
  Synthetic
caccgctgtcccaaaaggtctgaatattgatgtgttctgttgactgtatccatggtgtatcctgttcccgttccatggctgtatggagggtctccagtataaggaaatgtagtacttatacatatcagcagccagggcct

SEQ ID NO: 418289 - DNA, 140 bp, Artificial Sequence
  Synthetic
atacgccatgctgggtctccacaagcagcagatctcaaaagcactcaagcagcaatcgatcaaatcaatgggaagctgaatcgattgatcgggaaaaccaacgagaaattccatcagattcgtacttgggagtcggccat

SEQ ID NO: 418290 - DNA, 140 bp, Artificial Sequence
  Synthetic
atggccgactcccaagtacgaatctgatggaatttctcgttggttttcccgatcaatcgattcagcttcccattgatttgatcgattgctgcttgagtgcttttgagatctgctgcttgtggagacccagcatggcgtat

SEQ ID NO: 418291 - DNA, 140 bp, Artificial Sequence
  Synthetic
atacgccatgctgggtctccaggcaattctccagtgttcaactacaacaaggctaccaagaggcttacggttcttgggaaggatgctggtgcgttgaccgaagatcctgatgaaggcacacgtacttgggagtcggccat

SEQ ID NO: 418292 - DNA, 140 bp, Artificial Sequence
  Synthetic
atggccgactcccaagtacgtgtgccttcatcaggatcttcggtcaacgcaccagcatccttcccaagaaccgtaagcctcttggtagccttgttgtagttgaacactggagaattgcctggagacccagcatggcgtat

SEQ ID NO: 418293 - DNA, 140 bp, Artificial Sequence
  Synthetic
aggccctggctgctgatatgtcttcccaaatgaagtgggagcgagaatacttacgtcggagtcacaactgacgataacaaaagagaagaaggaggaactccaggactgcaaaatcgctccgaccttttgggacagcggtg

SEQ ID NO: 418294 - DNA, 140 bp, Artificial Sequence
  Synthetic
caccgctgtcccaaaaggtcggagcgattttgcagtcctggagttcctccttcttctcttttgttatcgtcagttgtgactccgacgtaagtattctcgctcccacttcatttgggaagacatatcagcagccagggcct

SEQ ID NO: 418295 - DNA, 140 bp, Artificial Sequence
  Synthetic
aggccctggctgctgatatggagtagatgaatattccagcacggagagagtagtggtgagcattgaccgatttttgagggttcgggatcaacgagggaacgtactattgtctcccgaagagaccttttgggacagcggtg

SEQ ID NO: 418296 - DNA, 140 bp, Artificial Sequence
  Synthetic
caccgctgtcccaaaaggtctcttcgggagacaatagtacgttccctcgttgatcccgaaccctcaaaaatcggtcaatgctcaccactactctctccgtgctggaatattcatctactccatatcagcagccagggcct

SEQ ID NO: 418297 - DNA, 140 bp, Artificial Sequence
  Synthetic
aggccctggctgctgatatgttcgactgtcgcctcatctcttgtacttgcaatggggtttgctgccttcttattctgggccatgtcaaacggatcatgcaggtgcaacatctgtatataagaccttttgggacagcggtg

SEQ ID NO: 418298 - DNA, 140 bp, Artificial Sequence
  Synthetic
caccgctgtcccaaaaggtcttatatacagatgttgcacctgcatgatccgtttgacatggcccagaataagaaggcagcaaaccccattgcaagtacaagagatgaggcgacagtcgaacatatcagcagccagggcct

SEQ ID NO: 418299 - DNA, 140 bp, Artificial Sequence
  Synthetic
atacgccatgctgggtctcccaaggacgtaatggaatcaatggataaggaaggaatggaaataacgacacatttccagagaaagagaagagtgagagacaacatgaccaagaaaatgatccgtacttgggagtcggccat

SEQ ID NO: 418300 - DNA, 140 bp, Artificial Sequence
  Synthetic
atggccgactcccaagtacggatcattttcttggtcatgttgtctctcactcttctctttctctggaaatgtgtcgttatttccattccttccttatccattgattccattacgtccttgggagacccagcatggcgtat

SEQ ID NO: 418301 - DNA, 140 bp, Artificial Sequence
  Synthetic
aggccctggctgctgatatgatttccagagaaagagaagagtgagagacaacatgaccaagaaaatgatcacacagagaacaataggaaagaaaaagcaaaggttgaacaagaggagctagaccttttgggacagcggtg

SEQ ID NO: 418302 - DNA, 140 bp, Artificial Sequence
  Synthetic
caccgctgtcccaaaaggtctagctcctcttgttcaacctttgctttttctttcctattgttctctgtgtgatcattttcttggtcatgttgtctctcactcttctctttctctggaaatcatatcagcagccagggcct

SEQ ID NO: 418303 - DNA, 140 bp, Artificial Sequence
  Synthetic
atacgccatgctgggtctccagatagattctacagaacctgcaagttagtagggatcaatatgagcaaaaagaagtcctacataaataagactggaacatttgaattcacaagcttttttcgtacttgggagtcggccat

SEQ ID NO: 418304 - DNA, 140 bp, Artificial Sequence
  Synthetic
atggccgactcccaagtacgaaaaaagcttgtgaattcaaatgttccagtcttatttatgtaggacttctttttgctcatattgatccctactaacttgcaggttctgtagaatctatctggagacccagcatggcgtat

SEQ ID NO: 418305 - DNA, 140 bp, Artificial Sequence
  Synthetic
atacgccatgctgggtctccgcaaactgaagagacgggcaattgcaacacccggaatgcaaatcaggggatttgtatactttgtcgagacactagcaaggagtatctgtgagaaacttgacgtacttgggagtcggccat

SEQ ID NO: 418306 - DNA, 140 bp, Artificial Sequence
  Synthetic
atggccgactcccaagtacgtcaagtttctcacagatactccttgctagtgtctcgacaaagtatacaaatcccctgatttgcattccgggtgttgcaattgcccgtctcttcagtttgcggagacccagcatggcgtat

SEQ ID NO: 418307 - DNA, 140 bp, Artificial Sequence
  Synthetic
aggccctggctgctgatatgcccattccttgatcggcttcgccgagatcagaggtccctaaggggaagaggcaatactctcggtctagacatcaaagcagccacctatgttggaaagcaagaccttttgggacagcggtg

SEQ ID NO: 418308 - DNA, 140 bp, Artificial Sequence
  Synthetic
caccgctgtcccaaaaggtcttgctttccaacataggtggctgctttgatgtctagaccgagagtattgcctcttccccttagggacctctgatctcggcgaagccgatcaaggaatgggcatatcagcagccagggcct

SEQ ID NO: 418309 - DNA, 140 bp, Artificial Sequence
  Synthetic
atacgccatgctgggtctccgcaatactctcggtctagacatcaaagcagccacctatgttggaaagcaaattgtagaaaagattctgaaagaagaatctgatgaggcacttaaaatgaccgtacttgggagtcggccat

SEQ ID NO: 418310 - DNA, 140 bp, Artificial Sequence
  Synthetic
atggccgactcccaagtacggtcattttaagtgcctcatcagattcttctttcagaatcttttctacaatttgctttccaacataggtggctgctttgatgtctagaccgagagtattgcggagacccagcatggcgtat

SEQ ID NO: 418311 - DNA, 140 bp, Artificial Sequence
  Synthetic
atacgccatgctgggtctccataaaataacatccaaagtgaataacatagtcgacaaaatgaacaagcagtatgaaattatcgatcatgaattcagcgaggttgaaactagacttaacatcgtacttgggagtcggccat

SEQ ID NO: 418312 - DNA, 140 bp, Artificial Sequence
  Synthetic
atggccgactcccaagtacgatgttaagtctagtttcaacctcgctgaattcatgatcgataatttcatactgcttgttcattttgtcgactatgttattcactttggatgttattttatggagacccagcatggcgtat

SEQ ID NO: 418313 - DNA, 140 bp, Artificial Sequence
  Synthetic
atacgccatgctgggtctccgatcaataataagattgatgatcaaatccaagatatatgggcatataatgcagaattgctagttctgcttgaaaaccagaaaacactcgatgagcatgatcgtacttgggagtcggccat

SEQ ID NO: 418314 - DNA, 140 bp, Artificial Sequence
  Synthetic
atggccgactcccaagtacgatcatgctcatcgagtgttttctggttttcaagcagaactagcaattctgcattatatgcccatatatcttggatttgatcatcaatcttattattgatcggagacccagcatggcgtat

SEQ ID NO: 418315 - DNA, 140 bp, Artificial Sequence
  Synthetic
aggccctggctgctgatatgcagaattgctagttctgcttgaaaaccagaaaacactcgatgagcatgatgcaaatgtaaacaatctatataataaagtgaagagggcgttgggttccaagaccttttgggacagcggtg

SEQ ID NO: 418316 - DNA, 140 bp, Artificial Sequence
  Synthetic
caccgctgtcccaaaaggtcttggaacccaacgccctcttcactttattatatagattgtttacatttgcatcatgctcatcgagtgttttctggttttcaagcagaactagcaattctgcatatcagcagccagggcct

SEQ ID NO: 418317 - DNA, 140 bp, Artificial Sequence
  Synthetic
atacgccatgctgggtctccgcaaatgtaaacaatctatataataaagtgaagagggcgttgggttccaatgcggtggaagatgggaaaggatgtttcgagctataccacaaatgtgatgcgtacttgggagtcggccat

SEQ ID NO: 418318 - DNA, 140 bp, Artificial Sequence
  Synthetic
atggccgactcccaagtacgcatcacatttgtggtatagctcgaaacatcctttcccatcttccaccgcattggaacccaacgccctcttcactttattatatagattgtttacatttgcggagacccagcatggcgtat

SEQ ID NO: 418319 - DNA, 140 bp, Artificial Sequence
  Synthetic
atacgccatgctgggtctcccaacgaaaaagaagattgaaaaaataagacctctactaatagatggcacagcctcattgagccctggaatgatgatgggcatgttcaacatgctgagtaccgtacttgggagtcggccat

SEQ ID NO: 418320 - DNA, 140 bp, Artificial Sequence
  Synthetic
atggccgactcccaagtacggtactcagcatgttgaacatgcccatcatcattccagggctcaatgaggctgtgccatctattagtagaggtcttattttttcaatcttctttttcgttgggagacccagcatggcgtat

SEQ ID NO: 418321 - DNA, 140 bp, Artificial Sequence
  Synthetic
aggccctggctgctgatatgacaatatacatcctctcactattggagaatgccccaaatatgtgaaatcaaccagattagtccttgcgactgggctcagaaatagccctcaaagagaggagaccttttgggacagcggtg

SEQ ID NO: 418322 - DNA, 140 bp, Artificial Sequence
  Synthetic
caccgctgtcccaaaaggtctcctctctttgagggctatttctgagcccagtcgcaaggactaatctggttgatttcacatatttggggcattctccaatagtgagaggatgtatattgtcatatcagcagccagggcct

SEQ ID NO: 418323 - DNA, 140 bp, Artificial Sequence
  Synthetic
atacgccatgctgggtctcccaagaggagtcaaaattagaaagacagaaaatagagggggtcaagctggaatctgaaggaacttacaaaatcctcaccatttattcgactgtcgcctcatcgtacttgggagtcggccat

SEQ ID NO: 418324 - DNA, 140 bp, Artificial Sequence
  Synthetic
atggccgactcccaagtacgatgaggcgacagtcgaataaatggtgaggattttgtaagttccttcagattccagcttgaccccctctattttctgtctttctaattttgactcctcttgggagacccagcatggcgtat

SEQ ID NO: 418325 - DNA, 140 bp, Artificial Sequence
  Synthetic
aggccctggctgctgatatgatctgaaggaacttacaaaatcctcaccatttattcgactgtcgcctcatctcttgtgattgcaatggggtttgctgccttcttgttctgggccatgtccgaccttttgggacagcggtg

SEQ ID NO: 418326 - DNA, 140 bp, Artificial Sequence
  Synthetic
caccgctgtcccaaaaggtcggacatggcccagaacaagaaggcagcaaaccccattgcaatcacaagagatgaggcgacagtcgaataaatggtgaggattttgtaagttccttcagatcatatcagcagccagggcct

SEQ ID NO: 418327 - DNA, 140 bp, Artificial Sequence
  Synthetic
aggccctggctgctgatatggtgaatgcaccgaatcatgaggggatacaagcaggagtggataggttctataggacttgcaaactagttgggatcaatatgagcaagaagaaatcttacagaccttttgggacagcggtg

SEQ ID NO: 418328 - DNA, 140 bp, Artificial Sequence
  Synthetic
caccgctgtcccaaaaggtctgtaagatttcttcttgctcatattgatcccaactagtttgcaagtcctatagaacctatccactcctgcttgtatcccctcatgattcggtgcattcaccatatcagcagccagggcct

SEQ ID NO: 418329 - DNA, 140 bp, Artificial Sequence
  Synthetic
aggccctggctgctgatatggggcatcatgttttcttcttctagccattgcaatgggattggttttcatttgcataaagaatggaaacatgcggtgcactatttgtatatagtttgagaagaccttttgggacagcggtg

SEQ ID NO: 418330 - DNA, 140 bp, Artificial Sequence
  Synthetic
caccgctgtcccaaaaggtcttctcaaactatatacaaatagtgcaccgcatgtttccattctttatgcaaatgaaaaccaatcccattgcaatggctagaagaagaaaacatgatgccccatatcagcagccagggcct

SEQ ID NO: 418331 - DNA, 140 bp, Artificial Sequence
  Synthetic
atacgccatgctgggtctcctttgtggccaatttcagtatggagctgcccagctttggagtgtctggaatcaatgagtcagctgacatgagcatcggtgttacagtgataaagaacaatacgtacttgggagtcggccat

SEQ ID NO: 418332 - DNA, 140 bp, Artificial Sequence
  Synthetic
atggccgactcccaagtacgtattgttctttatcactgtaacaccgatgctcatgtcagctgactcattgattccagacactccaaagctgggcagctccatactgaaattggccacaaaggagacccagcatggcgtat

SEQ ID NO: 418333 - DNA, 140 bp, Artificial Sequence
  Synthetic
aggccctggctgctgatatgggtctggacatcagaaccgcaactcgtgaaggaaagcatatagtggagcgaattttggaggaagagtcagacgaagcatttaaaatgactattgcttcaggaccttttgggacagcggtg

SEQ ID NO: 418334 - DNA, 140 bp, Artificial Sequence
  Synthetic
caccgctgtcccaaaaggtcctgaagcaatagtcattttaaatgcttcgtctgactcttcctccaaaattcgctccactatatgctttccttcacgagttgcggttctgatgtccagacccatatcagcagccagggcct

SEQ ID NO: 418335 - DNA, 140 bp, Artificial Sequence
  Synthetic
atacgccatgctgggtctcctcgaaactaacaaattcgcagcaatatgcactcacttggaagtatgtttcatgtattcggatttccacttcattgatgagcggggcgaatcaataattgccgtacttgggagtcggccat

SEQ ID NO: 418336 - DNA, 140 bp, Artificial Sequence
  Synthetic
atggccgactcccaagtacggcaattattgattcgccccgctcatcaatgaagtggaaatccgaatacatgaaacatacttccaagtgagtgcatattgctgcgaatttgttagtttcgaggagacccagcatggcgtat

SEQ ID NO: 418337 - DNA, 140 bp, Artificial Sequence
  Synthetic
atacgccatgctgggtctcctgccagctccacgctatctaactgacatgactcttgaagaaatgtcaagagattggttaatgctcattcccaaacagaaagtgacagggtccctttgcatcgtacttgggagtcggccat

SEQ ID NO: 418338 - DNA, 140 bp, Artificial Sequence
  Synthetic
atggccgactcccaagtacgatgcaaagggaccctgtcactttctgtttgggaatgagcattaaccaatctcttgacatttcttcaagagtcatgtcagttagatagcgtggagctggcaggagacccagcatggcgtat

SEQ ID NO: 418339 - DNA, 140 bp, Artificial Sequence
  Synthetic
atacgccatgctgggtctccaattcaaacgaggagatcattcgagttgaagaagctgtgggagcagacccgttcaaaggcgggactgctggtttcagatgggggaccaaacctatacaaccgtacttgggagtcggccat

SEQ ID NO: 418340 - DNA, 140 bp, Artificial Sequence
  Synthetic
atggccgactcccaagtacggttgtataggtttggtcccccatctgaaaccagcagtcccgcctttgaacgggtctgctcccacagcttcttcaactcgaatgatctcctcgtttgaattggagacccagcatggcgtat

SEQ ID NO: 418341 - DNA, 140 bp, Artificial Sequence
  Synthetic
aggccctggctgctgatatgtagaatggaccaagcaatagtggacaaaaacatcacattgaaagcaaatttcagtgtgattttcaatcgactggaagccctaatactacttagagcttttgaccttttgggacagcggtg

SEQ ID NO: 418342 - DNA, 140 bp, Artificial Sequence
  Synthetic
caccgctgtcccaaaaggtcaaaagctctaagtagtattagggcttccagtcgattgaaaatcacactgaaatttgctttcaatgtgatgtttttgtccactattgcttggtccattctacatatcagcagccagggcct

SEQ ID NO: 418343 - DNA, 140 bp, Artificial Sequence
  Synthetic
aggccctggctgctgatatgactgatgtgatcaactcctgggcaggagacattctaagaacccaggaatcatcatgcacttgcattcaaggtgattgttattgggtaatgacggatggacgaccttttgggacagcggtg

SEQ ID NO: 418344 - DNA, 140 bp, Artificial Sequence
  Synthetic
caccgctgtcccaaaaggtcgtccatccgtcattacccaataacaatcaccttgaatgcaagtgcatgatgattcctgggttcttagaatgtctcctgcccaggagttgatcacatcagtcatatcagcagccagggcct

SEQ ID NO: 418345 - DNA, 140 bp, Artificial Sequence
  Synthetic
aggccctggctgctgatatgactccaaaacagccaagtggtcagcctgatgagaccaaatgaaaacccagctcacaagagtcaattggtatggatggcatgccactctgctgcatttgaagaccttttgggacagcggtg

SEQ ID NO: 418346 - DNA, 140 bp, Artificial Sequence
  Synthetic
caccgctgtcccaaaaggtcttcaaatgcagcagagtggcatgccatccataccaattgactcttgtgagctgggttttcatttggtctcatcaggctgaccacttggctgttttggagtcatatcagcagccagggcct

SEQ ID NO: 418347 - DNA, 140 bp, Artificial Sequence
  Synthetic
aggccctggctgctgatatgagacaagagatatggcccagcattgagcatcaatgagctgagcaatcttgcaaaaggagagaaggctaatgtgctaattgggcaaggagacgtggtgttggaccttttgggacagcggtg

SEQ ID NO: 418348 - DNA, 140 bp, Artificial Sequence
  Synthetic
caccgctgtcccaaaaggtccaacaccacgtctccttgcccaattagcacattagccttctctccttttgcaagattgctcagctcattgatgctcaatgctgggccatatctcttgtctcatatcagcagccagggcct

SEQ ID NO: 418349 - DNA, 140 bp, Artificial Sequence
  Synthetic
atacgccatgctgggtctccggtctatccttatggatgtgctccaatgggtcgttacaatgcagaatttgcatttaaatttgtgagttcagattgtagttaaaaacacccttgtttctaccgtacttgggagtcggccat

SEQ ID NO: 418350 - DNA, 140 bp, Artificial Sequence
  Synthetic
atggccgactcccaagtacggtagaaacaagggtgtttttaactacaatctgaactcacaaatttaaatgcaaattctgcattgtaacgacccattggagcacatccataaggatagaccggagacccagcatggcgtat

SEQ ID NO: 418351 - DNA, 140 bp, Artificial Sequence
  Synthetic
atacgccatgctgggtctcctcctaagaggaaccgctccattcttaacaccagccaaaggggaattcttgaagatgagcagatgtatcaaaagtgctgcagtctattcgagaagtttttccgtacttgggagtcggccat

SEQ ID NO: 418352 - DNA, 140 bp, Artificial Sequence
  Synthetic
atggccgactcccaagtacggaaaaacttctcgaatagactgcagcacttttgatacatctgctcatcttcaagaattcccctttggctggtgttaagaatggagcggttcctcttaggaggagacccagcatggcgtat

SEQ ID NO: 418353 - DNA, 140 bp, Artificial Sequence
  Synthetic
aggccctggctgctgatatgggactggaaccaacaggccagtattggttatctctccagatttgtcttacagagtcgggtacttgtgtgcaggtctccccagcgacactccaagaggagagaccttttgggacagcggtg

SEQ ID NO: 418354 - DNA, 140 bp, Artificial Sequence
  Synthetic
caccgctgtcccaaaaggtctctcctcttggagtgtcgctggggagacctgcacacaagtacccgactctgtaagacaaatctggagagataaccaatactggcctgttggttccagtcccatatcagcagccagggcct

SEQ ID NO: 418355 - DNA, 140 bp, Artificial Sequence
  Synthetic
aggccctggctgctgatatggcttgccgaccaaagtctcccaccgaacttctccagccttgaaaactttagagcctatgtggatggattcgaaccgaacggctgcattgagggcaagcttgaccttttgggacagcggtg

SEQ ID NO: 418356 - DNA, 140 bp, Artificial Sequence
  Synthetic
caccgctgtcccaaaaggtcaagcttgccctcaatgcagccgttcggttcgaatccatccacataggctctaaagttttcaaggctggagaagttcggtgggagactttggtcggcaagccatatcagcagccagggcct

SEQ ID NO: 418357 - DNA, 140 bp, Artificial Sequence
  Synthetic
atacgccatgctgggtctcctcccattgcagggccactgagtacataatgaagggagtgtacataaacacagctctgttgaatgcgtcatgtgcagctatggatgacttccagctgattccgtacttgggagtcggccat

SEQ ID NO: 418358 - DNA, 140 bp, Artificial Sequence
  Synthetic
atggccgactcccaagtacggaatcagctggaagtcatccatagctgcacatgacgcattcaacagagctgtgtttatgtacactcccttcattatgtactcagtggccctgcaatgggaggagacccagcatggcgtat

SEQ ID NO: 418359 - DNA, 140 bp, Artificial Sequence
  Synthetic
aggccctggctgctgatatgtctcaaatgtcaaaagaagtgaacgccaggattgagccattcctgaagacaacaccacgccctctcaaattacctgatgggcccccttgctctcagcggtgaccttttgggacagcggtg

SEQ ID NO: 418360 - DNA, 140 bp, Artificial Sequence
  Synthetic
caccgctgtcccaaaaggtcaccgctgagagcaagggggcccatcaggtaatttgagagggcgtggtgttgtcttcaggaatggctcaatcctggcgttcacttcttttgacatttgagacatatcagcagccagggcct

SEQ ID NO: 418361 - DNA, 140 bp, Artificial Sequence
  Synthetic
atacgccatgctgggtctccaacaccacgccctctcaaattacctgatgggcccccttgctctcagcggtcaaaattcttgctgatggatgccttgaaactgagcattgaagacccgagtcgtacttgggagtcggccat

SEQ ID NO: 418362 - DNA, 140 bp, Artificial Sequence
  Synthetic
atggccgactcccaagtacgactcgggtcttcaatgctcagtttcaaggcatccatcagcaagaattttgaccgctgagagcaagggggcccatcaggtaatttgagagggcgtggtgttggagacccagcatggcgtat

SEQ ID NO: 418363 - DNA, 140 bp, Artificial Sequence
  Synthetic
atacgccatgctgggtctcctaaagaacaacatgataaacaatgaccttggacctgcaacagcccagatggctcttcaattgttcatcaaagactacagatacacatataggtgccatagcgtacttgggagtcggccat

SEQ ID NO: 418364 - DNA, 140 bp, Artificial Sequence
  Synthetic
atggccgactcccaagtacgctatggcacctatatgtgtatctgtagtctttgatgaacaattgaagagccatctgggctgttgcaggtccaaggtcattgtttatcatgttgttctttaggagacccagcatggcgtat

SEQ ID NO: 418365 - DNA, 140 bp, Artificial Sequence
  Synthetic
aggccctggctgctgatatgcacgagggagagggtataccactatacgatgcaatcaaatgcatgaagacatttttcggctggaaagagcccaacataatcaaaccacatgagaaaggcagaccttttgggacagcggtg

SEQ ID NO: 418366 - DNA, 140 bp, Artificial Sequence
  Synthetic
caccgctgtcccaaaaggtctgcctttctcatgtggtttgattatgttgggctctttccagccgaaaaatgtcttcatgcatttgattgcatcgtatagtggtataccctctccctcgtgcatatcagcagccagggcct

SEQ ID NO: 418367 - DNA, 140 bp, Artificial Sequence
  Synthetic
atacgccatgctgggtctccatttttcggctggaaagagcccaacataatcaaaccacatgagaaaggcataaatcccaattaccttctggcttggaagcaagtgctagcagaactccagcgtacttgggagtcggccat

SEQ ID NO: 418368 - DNA, 140 bp, Artificial Sequence
  Synthetic
atggccgactcccaagtacgctggagttctgctagcacttgcttccaagccagaaggtaattgggatttatgcctttctcatgtggtttgattatgttgggctctttccagccgaaaaatggagacccagcatggcgtat

SEQ ID NO: 418369 - DNA, 140 bp, Artificial Sequence
  Synthetic
aggccctggctgctgatatgtaaatcccaattaccttctggcttggaagcaagtgctagcagaactccaggaccttgaaaatgaagagaagatcccaaagacaaagaacatgaagaagacgaccttttgggacagcggtg

SEQ ID NO: 418370 - DNA, 140 bp, Artificial Sequence
  Synthetic
caccgctgtcccaaaaggtcgtcttcttcatgttctttgtctttgggatcttctcttcattttcaaggtcctggagttctgctagcacttgcttccaagccagaaggtaattgggatttacatatcagcagccagggcct

SEQ ID NO: 418371 - DNA, 140 bp, Artificial Sequence
  Synthetic
aggccctggctgctgatatggccagaatgccactgaaatcagagcatctgttgggagaatggttggtggaattgggagattctacatacagatgtgcactgaactcaagctcagcgactagaccttttgggacagcggtg

SEQ ID NO: 418372 - DNA, 140 bp, Artificial Sequence
  Synthetic
caccgctgtcccaaaaggtctagtcgctgagcttgagttcagtgcacatctgtatgtagaatctcccaattccaccaaccattctcccaacagatgctctgatttcagtggcattctggccatatcagcagccagggcct

SEQ ID NO: 418373 - DNA, 140 bp, Artificial Sequence
  Synthetic
aggccctggctgctgatatgactttgaggattgcaaggatattggcgatctaaagcaatatgatagtgatgagccagagcctagatcgctggcaagctggatccagagtgaattcaataagaccttttgggacagcggtg

SEQ ID NO: 418374 - DNA, 140 bp, Artificial Sequence
  Synthetic
caccgctgtcccaaaaggtcttattgaattcactctggatccagcttgccagcgatctaggctctggctcatcactatcatattgctttagatcgccaatatccttgcaatcctcaaagtcatatcagcagccagggcct

SEQ ID NO: 418375 - DNA, 140 bp, Artificial Sequence
  Synthetic
atacgccatgctgggtctccacaataaagatgagctacaataataccaatagggaagatcttttgatactgtgggggattcatcattccaacaatgcagcagagcagacaaatctctatacgtacttgggagtcggccat

SEQ ID NO: 418376 - DNA, 140 bp, Artificial Sequence
  Synthetic
atggccgactcccaagtacgtatagagatttgtctgctctgctgcattgttggaatgatgaatcccccacagtatcaaaagatcttccctattggtattattgtagctcatctttattgtggagacccagcatggcgtat

SEQ ID NO: 418377 - DNA, 140 bp, Artificial Sequence
  Synthetic
aggccctggctgctgatatgggcatgtgaattgaccgactcaagctggatagaacttgatgaaataggagaagatgtcgctccaattgaacacattgcaagtatgaggaggaactattttgaccttttgggacagcggtg

SEQ ID NO: 418378 - DNA, 140 bp, Artificial Sequence
  Synthetic
caccgctgtcccaaaaggtcaaaatagttcctcctcatacttgcaatgtgttcaattggagcgacatcttctcctatttcatcaagttctatccagcttgagtcggtcaattcacatgcccatatcagcagccagggcct

SEQ ID NO: 418379 - DNA, 140 bp, Artificial Sequence
  Synthetic
aggccctggctgctgatatgacagcagaagtatcccactgcagggccactgaatacataatgaaaggagtctacataaatacagccctgctcaatgcatcttgtgcagccatggatgactgaccttttgggacagcggtg

SEQ ID NO: 418380 - DNA, 140 bp, Artificial Sequence
  Synthetic
caccgctgtcccaaaaggtcagtcatccatggctgcacaagatgcattgagcagggctgtatttatgtagactcctttcattatgtattcagtggccctgcagtgggatacttctgctgtcatatcagcagccagggcct

SEQ ID NO: 418381 - DNA, 140 bp, Artificial Sequence
  Synthetic
atacgccatgctgggtctccctacataaatacagccctgctcaatgcatcttgtgcagccatggatgacttccagctgattccaatgataagcaaatgtagaacaaaggaaggaagacggcgtacttgggagtcggccat

SEQ ID NO: 418382 - DNA, 140 bp, Artificial Sequence
  Synthetic
atggccgactcccaagtacgccgtcttccttcctttgttctacatttgcttatcattggaatcagctggaagtcatccatggctgcacaagatgcattgagcagggctgtatttatgtagggagacccagcatggcgtat

SEQ ID NO: 418383 - DNA, 140 bp, Artificial Sequence
  Synthetic
aggccctggctgctgatatggctgcagtgaaacaatcattagggaatacaatgaaacagtacggattgagaaggtaacacagtggcacaacaccaatgtcattgagtatatagagagatcgaccttttgggacagcggtg

SEQ ID NO: 418384 - DNA, 140 bp, Artificial Sequence
  Synthetic
caccgctgtcccaaaaggtcgatctctctatatactcaatgacattggtgttgtgccactgtgttaccttctcaatccgtactgtttcattgtattccctaatgattgtttcactgcagccatatcagcagccagggcct

SEQ ID NO: 418385 - DNA, 140 bp, Artificial Sequence
  Synthetic
aggccctggctgctgatatgaaaaccaacctgtatgggttcatcataaaagggagatctcatttgaggaatgatactgatgtggtaaactttgtgagcatggaattttctctcactgaccgaccttttgggacagcggtg

SEQ ID NO: 418386 - DNA, 140 bp, Artificial Sequence
  Synthetic
caccgctgtcccaaaaggtcggtcagtgagagaaaattccatgctcacaaagtttaccacatcagtatcattcctcaaatgagatctcccttttatgatgaacccatacaggttggttttcatatcagcagccagggcct

SEQ ID NO: 418387 - DNA, 140 bp, Artificial Sequence
  Synthetic
atacgccatgctgggtctccgatcaactctcccgagaaggtctggggctgctggagcagcagtgaaaggagttggaacaatggtgatggaattgattcggatgatcaaacgagggatcaacgtacttgggagtcggccat

SEQ ID NO: 418388 - DNA, 140 bp, Artificial Sequence
  Synthetic
atggccgactcccaagtacgttgatccctcgtttgatcatccgaatcaattccatcaccattgttccaactcctttcactgctgctccagcagccccagaccttctcgggagagttgatcggagacccagcatggcgtat

SEQ ID NO: 418389 - DNA, 140 bp, Artificial Sequence
  Synthetic
atacgccatgctgggtctccgccacagtacacaaattggcggggtaaggatggtggacattcttagacagaacccaacagaagagcaagctgtggatatatgcaaagcagcaatgggtttcgtacttgggagtcggccat

SEQ ID NO: 418390 - DNA, 140 bp, Artificial Sequence
  Synthetic
atggccgactcccaagtacgaaacccattgctgctttgcatatatccacagcttgctcttctgttgggttctgtctaagaatgtccaccatccttaccccgccaatttgtgtactgtggcggagacccagcatggcgtat

SEQ ID NO: 418391 - DNA, 140 bp, Artificial Sequence
  Synthetic
aggccctggctgctgatatgacactgaaaataagagtacatgaaggatatgaggaattcacaatggttgggcgaagagctacagccattttgaggaaagcaaccagaaggctgatccaatgaccttttgggacagcggtg

SEQ ID NO: 418392 - DNA, 140 bp, Artificial Sequence
  Synthetic
caccgctgtcccaaaaggtcattggatcagccttctggttgctttcctcaaaatggctgtagctcttcgcccaaccattgtgaattcctcatatccttcatgtactcttattttcagtgtcatatcagcagccagggcct

SEQ ID NO: 418393 - DNA, 140 bp, Artificial Sequence
  Synthetic
aggccctggctgctgatatgaaacaagtcggaaacatggccgattggagaatcccccagaggagtggaggaaggctctattgggaaagtatgcagaaccttactggcaaagtctgtattcgaccttttgggacagcggtg

SEQ ID NO: 418394 - DNA, 140 bp, Artificial Sequence
  Synthetic
caccgctgtcccaaaaggtcgaatacagactttgccagtaaggttctgcatactttcccaatagagccttcctccactcctctgggggattctccaatcggccatgtttccgacttgtttcatatcagcagccagggcct

SEQ ID NO: 418395 - DNA, 140 bp, Artificial Sequence
  Synthetic
atacgccatgctgggtctccgcaatggttttctcacaagaggactgcatgataaaagcagtacgaggtgatctgaattttgttaacagagcgaatcagcggctaaatcctatgcatcaaccgtacttgggagtcggccat

SEQ ID NO: 418396 - DNA, 140 bp, Artificial Sequence
  Synthetic
atggccgactcccaagtacggttgatgcataggatttagccgctgattcgctctgttaacaaaattcagatcacctcgtactgcttttatcatgcagtcctcttgtgagaaaaccattgcggagacccagcatggcgtat

SEQ ID NO: 418397 - DNA, 140 bp, Artificial Sequence
  Synthetic
aggccctggctgctgatatgtctgaattttgttaacagagcgaatcagcggctaaatcctatgcatcaacttctgaggcattttcaaaaggatgcaaaagtgctgtttcagaactggggggaccttttgggacagcggtg

SEQ ID NO: 418398 - DNA, 140 bp, Artificial Sequence
  Synthetic
caccgctgtcccaaaaggtccccccagttctgaaacagcacttttgcatccttttgaaaatgcctcagaagttgatgcataggatttagccgctgattcgctctgttaacaaaattcagacatatcagcagccagggcct

SEQ ID NO: 418399 - DNA, 140 bp, Artificial Sequence
  Synthetic
atacgccatgctgggtctccgacccccagcacagagatgtcactgagaggagtgagagtcagcaaaatgggagtggatgaatactccagtactgagagagtggtcgtgagcattgatcgtcgtacttgggagtcggccat

SEQ ID NO: 418400 - DNA, 140 bp, Artificial Sequence
  Synthetic
atggccgactcccaagtacgacgatcaatgctcacgaccactctctcagtactggagtattcatccactcccattttgctgactctcactcctctcagtgacatctctgtgctgggggtcggagacccagcatggcgtat

SEQ ID NO: 418401 - DNA, 140 bp, Artificial Sequence
  Synthetic
aggccctggctgctgatatgatggatgtcaatccgactttacttttcttgaaagttccagcgcaaaatgccataagcaccacattcccgtacactggagatcctccatacagccatggaagaccttttgggacagcggtg

SEQ ID NO: 418402 - DNA, 140 bp, Artificial Sequence
  Synthetic
caccgctgtcccaaaaggtcttccatggctgtatggaggatctccagtgtacgggaatgtggtgcttatggcattttgcgctggaactttcaagaaaagtaaagtcggattgacatccatcatatcagcagccagggcct

SEQ ID NO: 418403 - DNA, 140 bp, Artificial Sequence
  Synthetic
atacgccatgctgggtctcctgcaggacagatcagcatacagcccactttctctgtgcagagaaacctcccattcgagagagcaaccattatggcagcattcactggaaacactgaaggccgtacttgggagtcggccat

SEQ ID NO: 418404 - DNA, 140 bp, Artificial Sequence
  Synthetic
atggccgactcccaagtacggccttcagtgtttccagtgaatgctgccataatggttgctctctcgaatgggaggtttctctgcacagagaaagtgggctgtatgctgatctgtcctgcaggagacccagcatggcgtat

SEQ ID NO: 418405 - DNA, 140 bp, Artificial Sequence
  Synthetic
atacgccatgctgggtctccagcagagctctatgggaaattcagctcttgtgaagaaatacctataatgtttgaaccattccagattctttcaatttgttcttttattttatcagctctccgtacttgggagtcggccat

SEQ ID NO: 418406 - DNA, 140 bp, Artificial Sequence
  Synthetic
atggccgactcccaagtacggagagctgataaaataaaagaacaaattgaaagaatctggaatggttcaaacattataggtatttcttcacaagagctgaatttcccatagagctctgctggagacccagcatggcgtat

SEQ ID NO: 418407 - DNA, 140 bp, Artificial Sequence
  Synthetic
aggccctggctgctgatatgtgatgtgtggagtggatcatgaaattgccgactggtcttggcacgatggagctattcttccttttgacatcgataagatgtaatttacgaaaaaactcctgaccttttgggacagcggtg

SEQ ID NO: 418408 - DNA, 140 bp, Artificial Sequence
  Synthetic
caccgctgtcccaaaaggtcaggagttttttcgtaaattacatcttatcgatgtcaaaaggaagaatagctccatcgtgccaagaccagtcggcaatttcatgatccactccacacatcacatatcagcagccagggcct

SEQ ID NO: 418409 - DNA, 140 bp, Artificial Sequence
  Synthetic
aggccctggctgctgatatgcaatggatcattagaaattgggaaactgtgaagattcagtggtcccaagaccctacaatgttgtacaataagatggaatttgagcccttccaatccttgggaccttttgggacagcggtg

SEQ ID NO: 418410 - DNA, 140 bp, Artificial Sequence
  Synthetic
caccgctgtcccaaaaggtcccaaggattggaagggctcaaattccatcttattgtacaacattgtagggtcttgggaccactgaatcttcacagtttcccaatttctaatgatccattgcatatcagcagccagggcct

SEQ ID NO: 418411 - DNA, 140 bp, Artificial Sequence
  Synthetic
atacgccatgctgggtctccatagggcaatcacccaatgtgtatcaggcaaggtttgaagcagtagcgtggtcagccactgcgtgtcacgatgggaagaaatggatgacaattggagtaacgtacttgggagtcggccat

SEQ ID NO: 418412 - DNA, 140 bp, Artificial Sequence
  Synthetic
atggccgactcccaagtacgttactccaattgtcatccatttcttcccatcgtgacacgcagtggctgaccacgctactgcttcaaaccttgcctgatacacattgggtgattgccctatggagacccagcatggcgtat

SEQ ID NO: 418413 - DNA, 140 bp, Artificial Sequence
  Synthetic
aggccctggctgctgatatggcaactgctagcttcatttacaatgggaggcttgtagatagtattggttcatggtccaaaaatatactcagaacccaggagtcggaatgcgtttgtatcagaccttttgggacagcggtg

SEQ ID NO: 418414 - DNA, 140 bp, Artificial Sequence
  Synthetic
caccgctgtcccaaaaggtctgatacaaacgcattccgactcctgggttctgagtatatttttggaccatgaaccaatactatctacaagcctcccattgtaaatgaagctagcagttgccatatcagcagccagggcct

SEQ ID NO: 418415 - DNA, 140 bp, Artificial Sequence
  Synthetic
aggccctggctgctgatatgcaatggaacctccaaaatcaaaatgaaatggggcatggaaatgaggcgatgcctccttcaatctcttcaacagattgagagcatgattgaggccgagtctgaccttttgggacagcggtg

SEQ ID NO: 418416 - DNA, 140 bp, Artificial Sequence
  Synthetic
caccgctgtcccaaaaggtcagactcggcctcaatcatgctctcaatctgttgaagagattgaaggaggcatcgcctcatttccatgccccatttcattttgattttggaggttccattgcatatcagcagccagggcct

SEQ ID NO: 418417 - DNA, 140 bp, Artificial Sequence
  Synthetic
aggccctggctgctgatatgaatttcacaaccactcaagatggaagcagcaacaacaataataactatactactagcaataacaggaagcaatgcggacaaaatctgcattggctaccaagaccttttgggacagcggtg

SEQ ID NO: 418418 - DNA, 140 bp, Artificial Sequence
  Synthetic
caccgctgtcccaaaaggtcttggtagccaatgcagattttgtccgcattgcttcctgttattgctagtagtatagttattattgttgttgctgcttccatcttgagtggttgtgaaattcatatcagcagccagggcct

SEQ ID NO: 418419 - DNA, 140 bp, Artificial Sequence
  Synthetic
atacgccatgctgggtctccggaatgtcttgagcattgcacctataatgttctcaaataaaatggcaagactagggaaaggatacatgttcgaaagtaagagcatgaagcttcgaacacacgtacttgggagtcggccat

SEQ ID NO: 418420 - DNA, 140 bp, Artificial Sequence
  Synthetic
atggccgactcccaagtacgtgtgttcgaagcttcatgctcttactttcgaacatgtatcctttccctagtcttgccattttatttgagaacattataggtgcaatgctcaagacattccggagacccagcatggcgtat

SEQ ID NO: 418421 - DNA, 140 bp, Artificial Sequence
  Synthetic
atacgccatgctgggtctccgaaagccaacaagataaaatccgaaaagacacacattcacatcttctcatttactggagaagaaatggccaccaaagcagactacactcttgacgaagaacgtacttgggagtcggccat

SEQ ID NO: 418422 - DNA, 140 bp, Artificial Sequence
  Synthetic
atggccgactcccaagtacgttcttcgtcaagagtgtagtctgctttggtggccatttcttctccagtaaatgagaagatgtgaatgtgtgtcttttcggattttatcttgttggctttcggagacccagcatggcgtat

SEQ ID NO: 418423 - DNA, 140 bp, Artificial Sequence
  Synthetic
aggccctggctgctgatatgtgtgagcagattgctgactcacagcaccggtctcaccggcagatggtgactactaccaacccactaatcaggcatgagaacagaatggtactggccagtagaccttttgggacagcggtg

SEQ ID NO: 418424 - DNA, 140 bp, Artificial Sequence
  Synthetic
caccgctgtcccaaaaggtctactggccagtaccattctgttctcatgcctgattagtgggttggtagtagtcaccatctgccggtgagaccggtgctgtgagtcagcaatctgctcacacatatcagcagccagggcct

SEQ ID NO: 418425 - DNA, 140 bp, Artificial Sequence
  Synthetic
atacgccatgctgggtctcctgatgaagagagcagagcaagaattaaaaccagactgttcactataagacaagaaatggccagcaggggtctatgggattcctttcgtcagtccgaaagacgtacttgggagtcggccat

SEQ ID NO: 418426 - DNA, 140 bp, Artificial Sequence
  Synthetic
atggccgactcccaagtacgtctttcggactgacgaaaggaatcccatagacccctgctggccatttcttgtcttatagtgaacagtctggttttaattcttgctctgctctcttcatcaggagacccagcatggcgtat

SEQ ID NO: 418427 - DNA, 140 bp, Artificial Sequence
  Synthetic
atacgccatgctgggtctccccaaactggcaaatgttgtgagaaagatgatgactaattcacaagacacagagatttctttcacaatcactggggacaacactaagtggaatgaaaatcacgtacttgggagtcggccat

SEQ ID NO: 418428 - DNA, 140 bp, Artificial Sequence
  Synthetic
atggccgactcccaagtacgtgattttcattccacttagtgttgtccccagtgattgtgaaagaaatctctgtgtcttgtgaattagtcatcatctttctcacaacatttgccagtttggggagacccagcatggcgtat

SEQ ID NO: 418429 - DNA, 140 bp, Artificial Sequence
  Synthetic
atacgccatgctgggtctccagtgaaaatgaatccaaatcagaagataataacaattggttccgtctctctaaccattgcaacaatatgtttccttatgcagattgccatcctagcaacacgtacttgggagtcggccat

SEQ ID NO: 418430 - DNA, 140 bp, Artificial Sequence
  Synthetic
atggccgactcccaagtacgtgttgctaggatggcaatctgcataaggaaacatattgttgcaatggttagagagacggaaccaattgttattatcttctgatttggattcattttcactggagacccagcatggcgtat

SEQ ID NO: 418431 - DNA, 140 bp, Artificial Sequence
  Synthetic
atacgccatgctgggtctcccaatgaatctgcagacatgagcattggagtaacagtgataaaaaacaacatgatcaacaatgatcttggaccagcaacagcccaaatggctcttcagctacgtacttgggagtcggccat

SEQ ID NO: 418432 - DNA, 140 bp, Artificial Sequence
  Synthetic
atggccgactcccaagtacgtagctgaagagccatttgggctgttgctggtccaagatcattgttgatcatgttgttttttatcactgttactccaatgctcatgtctgcagattcattgggagacccagcatggcgtat

SEQ ID NO: 418433 - DNA, 140 bp, Artificial Sequence
  Synthetic
aggccctggctgctgatatgacaaagagatagagtctgtaaataatgctgtagtgatgccagctcatggcccagccaagagcatggaatatgatgctgttgccaccacgcattcctggatgaccttttgggacagcggtg

SEQ ID NO: 418434 - DNA, 140 bp, Artificial Sequence
  Synthetic
caccgctgtcccaaaaggtcatccaggaatgcgtggtggcaacagcatcatattccatgctcttggctgggccatgagctggcatcactacagcattatttacagactctatctctttgtcatatcagcagccagggcct

SEQ ID NO: 418435 - DNA, 140 bp, Artificial Sequence
  Synthetic
atacgccatgctgggtctccatgaatccaaatcaaaagataatatgcatttcagccacaggaatgacactatcggtagtaagcctgctgataggaattgccaatttgggcctaaacatcgcgtacttgggagtcggccat

SEQ ID NO: 418436 - DNA, 140 bp, Artificial Sequence
  Synthetic
atggccgactcccaagtacgcgatgtttaggcccaaattggcaattcctatcagcaggcttactaccgatagtgtcattcctgtggctgaaatgcatattatcttttgatttggattcatggagacccagcatggcgtat

SEQ ID NO: 418437 - DNA, 140 bp, Artificial Sequence
  Synthetic
atacgccatgctgggtctcccatggtttctagggcccgaattgatgcgcgaattgacttcgaatctggacggattaagaaggaggagtttgctgagatcatgaagatctgttccaccattcgtacttgggagtcggccat

SEQ ID NO: 418438 - DNA, 140 bp, Artificial Sequence
  Synthetic
atggccgactcccaagtacgaatggtggaacagatcttcatgatctcagcaaactcctccttcttaatccgtccagattcgaagtcaattcgcgcatcaattcgggccctagaaaccatgggagacccagcatggcgtat

SEQ ID NO: 418439 - DNA, 140 bp, Artificial Sequence
  Synthetic
atacgccatgctgggtctccgactccattataaggtgggtgatacaccagatgtgagcatcccaaacatgaatgagaccaactcaacaacaacaataataaacaataatactcaaaataacgtacttgggagtcggccat

SEQ ID NO: 418440 - DNA, 140 bp, Artificial Sequence
  Synthetic
atggccgactcccaagtacgttattttgagtattattgtttattattgttgttgttgagttggtctcattcatgtttgggatgctcacatctggtgtatcacccaccttataatggagtcggagacccagcatggcgtat

SEQ ID NO: 418441 - DNA, 140 bp, Artificial Sequence
  Synthetic
aggccctggctgctgatatgtggatccagggagcgattgggatcatggtcctggcatgatggtgcagaaatcatctactttaagtagaaataatttaagaaaaacacccttgtttctactgaccttttgggacagcggtg

SEQ ID NO: 418442 - DNA, 140 bp, Artificial Sequence
  Synthetic
caccgctgtcccaaaaggtcagtagaaacaagggtgtttttcttaaattatttctacttaaagtagatgatttctgcaccatcatgccaggaccatgatcccaatcgctccctggatccacatatcagcagccagggcct

SEQ ID NO: 418443 - DNA, 140 bp, Artificial Sequence
  Synthetic
atacgccatgctgggtctccttaatcattcaattcagacatgcattacttatgaaaacaacacctgggtaaatcagacatatgtcagcaataccaactttcttactgggcaggctatggccgtacttgggagtcggccat

SEQ ID NO: 418444 - DNA, 140 bp, Artificial Sequence
  Synthetic
atggccgactcccaagtacggccatagcctgcccagtaagaaagttggtattgctgacatatgtctgatttacccaggtgttgttttcataagtaatgcatgtctgaattgaatgattaaggagacccagcatggcgtat

SEQ ID NO: 418445 - DNA, 140 bp, Artificial Sequence
  Synthetic
aggccctggctgctgatatgacagtcccgcacccgcgagatactcaccaagaccactgtggaccatatggccataatcaaaaagtatacatcaggaagacaagagaagaaccccgcactcgaccttttgggacagcggtg

SEQ ID NO: 418446 - DNA, 140 bp, Artificial Sequence
  Synthetic
caccgctgtcccaaaaggtcgagtgcggggttcttctcttgtcttcctgatgtatactttttgattatggccatatggtccacagtggtcttggtgagtatctcgcgggtgcgggactgtcatatcagcagccagggcct

SEQ ID NO: 418447 - DNA, 140 bp, Artificial Sequence
  Synthetic
aggccctggctgctgatatgtcgaaagacaatgcaataagaataggagaggatgctcatatactagtcacaagggagccctacctgtcttgcgatccacaaggctgcaggatgtttgctcgaccttttgggacagcggtg

SEQ ID NO: 418448 - DNA, 140 bp, Artificial Sequence
  Synthetic
caccgctgtcccaaaaggtcgagcaaacatcctgcagccttgtggatcgcaagacaggtagggctcccttgtgactagtatatgagcatcctctcctattcttattgcattgtctttcgacatatcagcagccagggcct

SEQ ID NO: 418449 - DNA, 140 bp, Artificial Sequence
  Synthetic
atacgccatgctgggtctccaataatggaaatgattcctgagaggaatgagcaaggacaaaccctctggagcaaaacaaatgatgccggctcagaccgagtgatggtatcacctttggcccgtacttgggagtcggccat

SEQ ID NO: 418450 - DNA, 140 bp, Artificial Sequence
  Synthetic
atggccgactcccaagtacgggccaaaggtgataccatcactcggtctgagccggcatcatttgttttgctccagagggtttgtccttgctcattcctctcaggaatcatttccattattggagacccagcatggcgtat

SEQ ID NO: 418451 - DNA, 140 bp, Artificial Sequence
  Synthetic
aggccctggctgctgatatggcaaaacaaatgatgccggctcagaccgagtgatggtatcacctttggccgtgacatggtggaataggaatggaccgacaacaagcacagtccattacccgaccttttgggacagcggtg

SEQ ID NO: 418452 - DNA, 140 bp, Artificial Sequence
  Synthetic
caccgctgtcccaaaaggtcgggtaatggactgtgcttgttgtcggtccattcctattccaccatgtcacggccaaaggtgataccatcactcggtctgagccggcatcatttgttttgccatatcagcagccagggcct

SEQ ID NO: 418453 - DNA, 140 bp, Artificial Sequence
  Synthetic
aggccctggctgctgatatgggagattgatccaattgatagtaagcgggagagacgagcagtcaattgctgaggcaataattgtggccatggtattctcacaagaggattgcatgatcaagaccttttgggacagcggtg

SEQ ID NO: 418454 - DNA, 140 bp, Artificial Sequence
  Synthetic
caccgctgtcccaaaaggtcttgatcatgcaatcctcttgtgagaataccatggccacaattattgcctcagcaattgactgctcgtctctcccgcttactatcaattggatcaatctcccatatcagcagccagggcct

SEQ ID NO: 418455 - DNA, 140 bp, Artificial Sequence
  Synthetic
atacgccatgctgggtctcccctttggccccgtccacttcaggaatcaagttaagataagaaggagagttgacataaaccctggccatgcagatcttagtgctaaggaggcgcaggatgtcgtacttgggagtcggccat

SEQ ID NO: 418456 - DNA, 140 bp, Artificial Sequence
  Synthetic
atggccgactcccaagtacgacatcctgcgcctccttagcactaagatctgcatggccagggtttatgtcaactctccttcttatcttaacttgattcctgaagtggacggggccaaaggggagacccagcatggcgtat

SEQ ID NO: 418457 - DNA, 140 bp, Artificial Sequence
  Synthetic
aggccctggctgctgatatggacataaaccctggccatgcagatcttagtgctaaggaggcgcaggatgtaatcatggaagttgtcttcccaaatgaagtaggagctagaatactaacgtgaccttttgggacagcggtg

SEQ ID NO: 418458 - DNA, 140 bp, Artificial Sequence
  Synthetic
caccgctgtcccaaaaggtcacgttagtattctagctcctacttcatttgggaagacaacttccatgattacatcctgcgcctccttagcactaagatctgcatggccagggtttatgtccatatcagcagccagggcct

SEQ ID NO: 418459 - DNA, 140 bp, Artificial Sequence
  Synthetic
aggccctggctgctgatatgataaagggatctgtccagtagtcatgacggatggcccagcaaacaacagagcagcaactaagataatctatttcaaagggggaaagatacagaaaatcgagaccttttgggacagcggtg

SEQ ID NO: 418460 - DNA, 140 bp, Artificial Sequence
  Synthetic
caccgctgtcccaaaaggtctcgattttctgtatctttccccctttgaaatagattatcttagttgctgctctgttgtttgctgggccatccgtcatgactactggacagatccctttatcatatcagcagccagggcct

SEQ ID NO: 418461 - DNA, 140 bp, Artificial Sequence
  Synthetic
atacgccatgctgggtctcctgtaaaatcgcccctttgatggtggcatacatgctagaaagagagttagtccgcaaaacaaggttcctcccagtggctggtgggacaagcagtgtctatacgtacttgggagtcggccat

SEQ ID NO: 418462 - DNA, 140 bp, Artificial Sequence
  Synthetic
atggccgactcccaagtacgtatagacactgcttgtcccaccagccactgggaggaaccttgttttgcggactaactctctttctagcatgtatgccaccatcaaaggggcgattttacaggagacccagcatggcgtat

SEQ ID NO: 418463 - DNA, 140 bp, Artificial Sequence
  Synthetic
atacgccatgctgggtctcccagtcgaggtgatcaaatgcatatgcagagacaattggaaaggggcaaatagaccagtaattactataaaccctgaaatgatgacccacacgagcaagtacgtacttgggagtcggccat

SEQ ID NO: 418464 - DNA, 140 bp, Artificial Sequence
  Synthetic
atggccgactcccaagtacgtacttgctcgtgtgggtcatcatttcagggtttatagtaattactggtctatttgcccctttccaattgtctctgcatatgcatttgatcacctcgactgggagacccagcatggcgtat

SEQ ID NO: 418465 - DNA, 140 bp, Artificial Sequence
  Synthetic
aggccctggctgctgatatgagaccagtaattactataaaccctgaaatgatgacccacacgagcaagtatttgtgctcgaaggtcctaaccgatacaagtcgccccaatgatcccattagaccttttgggacagcggtg

SEQ ID NO: 418466 - DNA, 140 bp, Artificial Sequence
  Synthetic
caccgctgtcccaaaaggtctaatgggatcattggggcgacttgtatcggttaggaccttcgagcacaaatacttgctcgtgtgggtcatcatttcagggtttatagtaattactggtctcatatcagcagccagggcct

SEQ ID NO: 418467 - DNA, 140 bp, Artificial Sequence
  Synthetic
atacgccatgctgggtctccccaggaggagaagtgagaaatgatgatgtcgaccaaagtctgattattgctgccaggaacatagtaagaagagcaacggtatcggcagacccattggcatcgtacttgggagtcggccat

SEQ ID NO: 418468 - DNA, 140 bp, Artificial Sequence
  Synthetic
atggccgactcccaagtacgatgccaatgggtctgccgataccgttgctcttcttactatgttcctggcagcaataatcagactttggtcgacatcatcatttctcacttctcctcctggggagacccagcatggcgtat

SEQ ID NO: 418469 - DNA, 140 bp, Artificial Sequence
  Synthetic
atacgccatgctgggtctccaaggggtttgcgttcctagatggggagaattcatggcttggaaggacaattagcaaagactccaggtcgggctacgaaatgttgaaagtcccaaatgcagcgtacttgggagtcggccat

SEQ ID NO: 418470 - DNA, 140 bp, Artificial Sequence
  Synthetic
atggccgactcccaagtacgctgcatttgggactttcaacatttcgtagcccgacctggagtctttgctaattgtccttccaagccatgaattctccccatctaggaacgcaaaccccttggagacccagcatggcgtat

SEQ ID NO: 418471 - DNA, 140 bp, Artificial Sequence
  Synthetic
aggccctggctgctgatatgtagcaaagactccaggtcgggctacgaaatgttgaaagtcccaaatgcagagaccgacactcaatcagggccgacatcacaccaagtaattgtcaacaacgaccttttgggacagcggtg

SEQ ID NO: 418472 - DNA, 140 bp, Artificial Sequence
  Synthetic
caccgctgtcccaaaaggtcgttgttgacaattacttggtgtgatgtcggccctgattgagtgtcggtctctgcatttgggactttcaacatttcgtagcccgacctggagtctttgctacatatcagcagccagggcct

SEQ ID NO: 418473 - DNA, 140 bp, Artificial Sequence
  Synthetic
aggccctggctgctgatatgggcagcaatgggactgagaattagctcatctttcagcttcggcggattcactttcaaaaggacaagtggatcgtcagtcaaaaaagaagaagaagtgcttgaccttttgggacagcggtg

SEQ ID NO: 418474 - DNA, 140 bp, Artificial Sequence
  Synthetic
caccgctgtcccaaaaggtcaagcacttcttcttcttttttgactgacgatccacttgtccttttgaaagtgaatccgccgaagctgaaagatgagctaattctcagtcccattgctgcccatatcagcagccagggcct

SEQ ID NO: 418475 - DNA, 140 bp, Artificial Sequence
  Synthetic
aggccctggctgctgatatgtcccactgcagggctactgaatacataatgaagggagtgtacataaatacagctttgcttaacgcatcttgtgcggccatggatgatttccaactgattcgaccttttgggacagcggtg

SEQ ID NO: 418476 - DNA, 140 bp, Artificial Sequence
  Synthetic
caccgctgtcccaaaaggtcgaatcagttggaaatcatccatggccgcacaagatgcgttaagcaaagctgtatttatgtacactcccttcattatgtattcagtagccctgcagtgggacatatcagcagccagggcct

SEQ ID NO: 418477 - DNA, 140 bp, Artificial Sequence
  Synthetic
atacgccatgctgggtctccagagtgcttcaatccttgtttttatgtggaactaatcagagggagacccaaggagagtagtgtactgtggacttcaaatagcattgtagctctctgtggacgtacttgggagtcggccat

SEQ ID NO: 418478 - DNA, 140 bp, Artificial Sequence
  Synthetic
atggccgactcccaagtacgtccacagagagctacaatgctatttgaagtccacagtacactactctccttgggtctccctctgattagttccacataaaaacaaggattgaagcactctggagacccagcatggcgtat

SEQ ID NO: 418479 - DNA, 140 bp, Artificial Sequence
  Synthetic
atacgccatgctgggtctccattcacaatggttggaagaagagcaacggctattctcagaaaggcaaccaggagattgatccaactaatagtaagtgggagggatgagcagtcaattgctcgtacttgggagtcggccat

SEQ ID NO: 418480 - DNA, 140 bp, Artificial Sequence
  Synthetic
atggccgactcccaagtacgagcaattgactgctcatccctcccacttactattagttggatcaatctcctggttgcctttctgagaatagccgttgctcttcttccaaccattgtgaatggagacccagcatggcgtat

SEQ ID NO: 418481 - DNA, 140 bp, Artificial Sequence
  Synthetic
aggccctggctgctgatatgggagattgatccaactaatagtaagtgggagggatgagcagtcaattgctgaggcaataatcgtagccatggtattttcgcaagaggattgcatgatcaagaccttttgggacagcggtg

SEQ ID NO: 418482 - DNA, 140 bp, Artificial Sequence
  Synthetic
caccgctgtcccaaaaggtcttgatcatgcaatcctcttgcgaaaataccatggctacgattattgcctcagcaattgactgctcatccctcccacttactattagttggatcaatctcccatatcagcagccagggcct

SEQ ID NO: 418483 - DNA, 140 bp, Artificial Sequence
  Synthetic
atacgccatgctgggtctccatggccatcatttatctaattcttttgcttgcaacagtgagaggagaccagatatgcattggataccactccaacaattccacagaaaaagtagacacaacgtacttgggagtcggccat

SEQ ID NO: 418484 - DNA, 140 bp, Artificial Sequence
  Synthetic
atggccgactcccaagtacgttgtgtctactttttctgtggaattgttggagtggtatccaatgcatatctggtctcctctcactgttgcaagcaaaagaattagataaatgatggccatggagacccagcatggcgtat

SEQ ID NO: 418485 - DNA, 140 bp, Artificial Sequence
  Synthetic
aggccctggctgctgatatggatatgcattggataccactccaacaattccacagaaaaagtagacacaattctagagaggaatgtcactgtgactcacgctcaagacattcttgagaaggaccttttgggacagcggtg

SEQ ID NO: 418486 - DNA, 140 bp, Artificial Sequence
  Synthetic
caccgctgtcccaaaaggtccttctcaagaatgtcttgagcgtgagtcacagtgacattcctctctagaattgtgtctactttttctgtggaattgttggagtggtatccaatgcatatccatatcagcagccagggcct

SEQ ID NO: 418487 - DNA, 140 bp, Artificial Sequence
  Synthetic
atacgccatgctgggtctccatcccatgcatcaacttttgaggcacttccaaaaagatgcaaaggtgctttttcagaactggggaattgaacccattgacaacgtaatgggaatgatcggcgtacttgggagtcggccat

SEQ ID NO: 418488 - DNA, 140 bp, Artificial Sequence
  Synthetic
atggccgactcccaagtacgccgatcattcccattacgttgtcaatgggttcaattccccagttctgaaaaagcacctttgcatctttttggaagtgcctcaaaagttgatgcatgggatggagacccagcatggcgtat

SEQ ID NO: 418489 - DNA, 140 bp, Artificial Sequence
  Synthetic
atacgccatgctgggtctccaatattacctgacatgactccaagtactgagatgtcgctgaggggaataagagttagcaaaatgggagtggatgagtactccagcacggagagagtggtgcgtacttgggagtcggccat

SEQ ID NO: 418490 - DNA, 140 bp, Artificial Sequence
  Synthetic
atggccgactcccaagtacgcaccactctctccgtgctggagtactcatccactcccattttgctaactcttattcccctcagcgacatctcagtacttggagtcatgtcaggtaatattggagacccagcatggcgtat

SEQ ID NO: 418491 - DNA, 140 bp, Artificial Sequence
  Synthetic
atacgccatgctgggtctccggcttctaactgtgccagaatggtcatatataatggagaaagaaaatccaaggaatggtttgtgctacccaggcagtttcaatgactatgaagaattgaacgtacttgggagtcggccat

SEQ ID NO: 418492 - DNA, 140 bp, Artificial Sequence
  Synthetic
atggccgactcccaagtacgttcaattcttcatagtcattgaaactgcctgggtagcacaaaccattccttggattttctttctccattatatatgaccattctggcacagttagaagccggagacccagcatggcgtat

SEQ ID NO: 418493 - DNA, 140 bp, Artificial Sequence
  Synthetic
aggccctggctgctgatatgaggaatggtttgtgctacccaggcagtttcaatgactatgaagaattgaaacacctccttagtagtgtaacacacttcgagaaagtgaagattttgcccagaccttttgggacagcggtg

SEQ ID NO: 418494 - DNA, 140 bp, Artificial Sequence
  Synthetic
caccgctgtcccaaaaggtctgggcaaaatcttcactttctcgaagtgtgttacactactaaggaggtgtttcaattcttcatagtcattgaaactgcctgggtagcacaaaccattcctcatatcagcagccagggcct

SEQ ID NO: 418495 - DNA, 140 bp, Artificial Sequence
  Synthetic
atacgccatgctgggtctccattgtctcccgaagaagtcagtgagacacagggaacagagaagttgacaataacttactcgtcatcaatgatgtgggaaatcaacggtcctgagtcagtgcgtacttgggagtcggccat

SEQ ID NO: 418496 - DNA, 140 bp, Artificial Sequence
  Synthetic
atggccgactcccaagtacgcactgactcaggaccgttgatttcccacatcattgatgacgagtaagttattgtcaacttctctgttccctgtgtctcactgacttcttcgggagacaatggagacccagcatggcgtat

SEQ ID NO: 418497 - DNA, 140 bp, Artificial Sequence
  Synthetic
aggccctggctgctgatatgtaacttactcgtcatcaatgatgtgggaaatcaacggtcctgagtcagtgctggtcaatacttatcagtggatcattagaaactgggaaactgtgaaaatgaccttttgggacagcggtg

SEQ ID NO: 418498 - DNA, 140 bp, Artificial Sequence
  Synthetic
caccgctgtcccaaaaggtcattttcacagtttcccagtttctaatgatccactgataagtattgaccagcactgactcaggaccgttgatttcccacatcattgatgacgagtaagttacatatcagcagccagggcct

SEQ ID NO: 418499 - DNA, 140 bp, Artificial Sequence
  Synthetic
  misc_feature (56)..(56): n is a, c, g, or t
atacgccatgctgggtctccgtatctggtaacccgtcattcttcagaaacatggtntggttgacaaagaaagggtcgaattacccaattgccaagggatcatacaataatacaagtggggcgtacttgggagtcggccat

SEQ ID NO: 418500 - DNA, 140 bp, Artificial Sequence
  Synthetic
  misc_feature (85)..(85): n is a, c, g, or t
atggccgactcccaagtacgccccacttgtattattgtatgatcccttggcaattgggtaattcgaccctttctttgtcaaccanaccatgtttctgaagaatgacgggttaccagatacggagacccagcatggcgtat

SEQ ID NO: 418501 - DNA, 140 bp, Artificial Sequence
  Synthetic
aggccctggctgctgatatgagggtcgaattacccaattgccaagggatcatacaataatacaagtggggaacaaatgctgatcatttggggagtacaccatcccaatgatgatgctgaagaccttttgggacagcggtg

SEQ ID NO: 418502 - DNA, 140 bp, Artificial Sequence
  Synthetic
caccgctgtcccaaaaggtcttcagcatcatcattgggatggtgtactccccaaatgatcagcatttgttccccacttgtattattgtatgatcccttggcaattgggtaattcgaccctcatatcagcagccagggcct

SEQ ID NO: 418503 - DNA, 140 bp, Artificial Sequence
  Synthetic
atacgccatgctgggtctcccatttcagtctcttgtccctaaagctgccagaagtcaatacagcggattcgtgaggacactgttccaacagatgcgagatgtgcttggaacatttgacaccgtacttgggagtcggccat

SEQ ID NO: 418504 - DNA, 140 bp, Artificial Sequence
  Synthetic
atggccgactcccaagtacggtgtcaaatgttccaagcacatctcgcatctgttggaacagtgtcctcacgaatccgctgtattgacttctggcagctttagggacaagagactgaaatgggagacccagcatggcgtat

SEQ ID NO: 418505 - DNA, 140 bp, Artificial Sequence
  Synthetic
aggccctggctgctgatatgtattacctgacatgactcccagcacagaaatgtcactgagaggagtgagagttagtaaaatgggagtggatgaatattccagcactgagagaatagtagtgaccttttgggacagcggtg

SEQ ID NO: 418506 - DNA, 140 bp, Artificial Sequence
  Synthetic
caccgctgtcccaaaaggtcactactattctctcagtgctggaatattcatccactcccattttactaactctcactcctctcagtgacatttctgtgctgggagtcatgtcaggtaatacatatcagcagccagggcct

SEQ ID NO: 418507 - DNA, 140 bp, Artificial Sequence
  Synthetic
atacgccatgctgggtctccgacattgaacaaaagatcaatcccagaaatagccataagacctaaagtgaatggacagggaggcagaatggaattctcgtggactatattggatatgttgcgtacttgggagtcggccat

SEQ ID NO: 418508 - DNA, 140 bp, Artificial Sequence
  Synthetic
atggccgactcccaagtacgcaacatatccaatatagtccacgagaattccattctgcctccctgtccattcactttaggtcttatggctatttctgggattgatcttttgttcaatgtcggagacccagcatggcgtat

SEQ ID NO: 418509 - DNA, 140 bp, Artificial Sequence
  Synthetic
aggccctggctgctgatatggtaggatgcaattttcttcactgactgtgaatgtgagaggatcaggaatgaggatactagtgagaggcaattctccagtgttcaactacaataaggctacgaccttttgggacagcggtg

SEQ ID NO: 418510 - DNA, 140 bp, Artificial Sequence
  Synthetic
caccgctgtcccaaaaggtcgtagccttattgtagttgaacactggagaattgcctctcactagtatcctcattcctgatcctctcacattcacagtcagtgaagaaaattgcatcctaccatatcagcagccagggcct

SEQ ID NO: 418511 - DNA, 140 bp, Artificial Sequence
  Synthetic
atacgccatgctgggtctcctaatggagatgattcctgaaaggaatgaacaagggcagacgctttggagcaagacaaatgatgctggatcggacagggtgatggtgtctcccctggccgtcgtacttgggagtcggccat

SEQ ID NO: 418512 - DNA, 140 bp, Artificial Sequence
  Synthetic
atggccgactcccaagtacgacggccaggggagacaccatcaccctgtccgatccagcatcatttgtcttgctccaaagcgtctgcccttgttcattcctttcaggaatcatctccattaggagacccagcatggcgtat

SEQ ID NO: 418513 - DNA, 140 bp, Artificial Sequence
  Synthetic
atacgccatgctgggtctcccacttgaaaactgcgaaactaaatgtcaaactccattgggagcaataaatacaacattgcccttccataatatccatccattgaccattggtgaatgtcccgtacttgggagtcggccat

SEQ ID NO: 418514 - DNA, 140 bp, Artificial Sequence
  Synthetic
atggccgactcccaagtacgggacattcaccaatggtcaatggatggatattatggaagggcaatgttgtatttattgctcccaatggagtttgacatttagtttcgcagttttcaagtgggagacccagcatggcgtat

SEQ ID NO: 418515 - DNA, 140 bp, Artificial Sequence
  Synthetic
aggccctggctgctgatatgacaacattgcccttccataatatccatccattgaccattggtgaatgtcccaaatatgtaaaatcagagaggttagtcttggcaacaggattaagaaatggaccttttgggacagcggtg

SEQ ID NO: 418516 - DNA, 140 bp, Artificial Sequence
  Synthetic
caccgctgtcccaaaaggtccatttcttaatcctgttgccaagactaacctctctgattttacatatttgggacattcaccaatggtcaatggatggatattatggaagggcaatgttgtcatatcagcagccagggcct

SEQ ID NO: 418517 - DNA, 140 bp, Artificial Sequence
  Synthetic
atacgccatgctgggtctccgagacgtggtgttggtaatgaaacggaaacgggactctagcatacttactgacagccagacagcgaccaaaagaattcggatggccatcaattagtgtcgcgtacttgggagtcggccat

SEQ ID NO: 418518 - DNA, 140 bp, Artificial Sequence
  Synthetic
atggccgactcccaagtacgcgacactaattgatggccatccgaattcttttggtcgctgtctggctgtcagtaagtatgctagagtcccgtttccgtttcattaccaacaccacgtctcggagacccagcatggcgtat

SEQ ID NO: 418519 - DNA, 140 bp, Artificial Sequence
  Synthetic
atacgccatgctgggtctccgaaggaggatggcaaggaatggttgatggttggtatggatatcatcacagcaatgatcaaggatctgggtatgcagcagacaaagagtccactcaaaaggcgtacttgggagtcggccat

SEQ ID NO: 418520 - DNA, 140 bp, Artificial Sequence
  Synthetic
atggccgactcccaagtacgccttttgagtggactctttgtctgctgcatacccagatccttgatcattgctgtgatgatatccataccaaccatcaaccattccttgccatcctccttcggagacccagcatggcgtat

SEQ ID NO: 418521 - DNA, 140 bp, Artificial Sequence
  Synthetic
aggccctggctgctgatatgcctcatcggaggacttgaatggaatgataacacagttcaagtctctgaaaatctacagagattcgcttggagaagcagtaatgagaatgggggacctccagaccttttgggacagcggtg

SEQ ID NO: 418522 - DNA, 140 bp, Artificial Sequence
  Synthetic
caccgctgtcccaaaaggtctggaggtcccccattctcattactgcttctccaagcgaatctctgtagattttcagagacttgaactgtgttatcattccattcaagtcctccgatgaggcatatcagcagccagggcct

SEQ ID NO: 418523 - DNA, 140 bp, Artificial Sequence
  Synthetic
aggccctggctgctgatatgaatactcgtaaggggcaattcccctgtgttcaactacaataaggcaaccaaaaggcttaccgttcttggaaaggacgcaggtgcattaacagaggatccagaccttttgggacagcggtg

SEQ ID NO: 418524 - DNA, 140 bp, Artificial Sequence
  Synthetic
caccgctgtcccaaaaggtctggatcctctgttaatgcacctgcgtcctttccaagaacggtaagccttttggttgccttattgtagttgaacacaggggaattgccccttacgagtattcatatcagcagccagggcct

SEQ ID NO: 418525 - DNA, 140 bp, Artificial Sequence
  Synthetic
atacgccatgctgggtctccaaagacaagaccaatcctgtcacctctgactaaggggattttaggatttgtgttcacgctcaccgtgcccagtgagcgaggactgcagcgtagacgctttcgtacttgggagtcggccat

SEQ ID NO: 418526 - DNA, 140 bp, Artificial Sequence
  Synthetic
atggccgactcccaagtacgaaagcgtctacgctgcagtcctcgctcactgggcacggtgagcgtgaacacaaatcctaaaatccccttagtcagaggtgacaggattggtcttgtctttggagacccagcatggcgtat

SEQ ID NO: 418527 - DNA, 140 bp, Artificial Sequence
  Synthetic
aggccctggctgctgatatgacaatgctgagcttctagttctaatggaaaatgaaagaacacttgacttccatgactccaatgtcaagaatctatatgacaaagtcagaatgcaattgaggaccttttgggacagcggtg

SEQ ID NO: 418528 - DNA, 140 bp, Artificial Sequence
  Synthetic
caccgctgtcccaaaaggtcctcaattgcattctgactttgtcatatagattcttgacattggagtcatggaagtcaagtgttctttcattttccattagaactagaagctcagcattgtcatatcagcagccagggcct

SEQ ID NO: 418529 - DNA, 140 bp, Artificial Sequence
  Synthetic
atacgccatgctgggtctccgtgatgatgaatgcatgaatagcgtaaagaatgggacatatgattatcccaaatatgaagaggaatctaaattaaacaggaatgagatcaaaggggttaacgtacttgggagtcggccat

SEQ ID NO: 418530 - DNA, 140 bp, Artificial Sequence
  Synthetic
atggccgactcccaagtacgttaacccctttgatctcattcctgtttaatttagattcctcttcatatttgggataatcatatgtcccattctttacgctattcatgcattcatcatcacggagacccagcatggcgtat

SEQ ID NO: 418531 - DNA, 140 bp, Artificial Sequence
  Synthetic
atacgccatgctgggtctcctgctacagtggcaggctccttgtcactggcaatcatgatagctgggatcttcttatggatgtgctctaacgggtctctgcaatgcaggatctgcatatgacgtacttgggagtcggccat

SEQ ID NO: 418532 - DNA, 140 bp, Artificial Sequence
  Synthetic
atggccgactcccaagtacgtcatatgcagatcctgcattgcagagacccgttagagcacatccataagaagatcccagctatcatgattgccagtgacaaggagcctgccactgtagcaggagacccagcatggcgtat

SEQ ID NO: 418533 - DNA, 140 bp, Artificial Sequence
  Synthetic
aggccctggctgctgatatgtgtccgcaaacgatttgcagaccaagaactgggtgatgccccattccttgaccggcttcgccgagatcagaagtccctgagaggaagaggcagcactcttgaccttttgggacagcggtg

SEQ ID NO: 418534 - DNA, 140 bp, Artificial Sequence
  Synthetic
caccgctgtcccaaaaggtcaagagtgctgcctcttcctctcagggacttctgatctcggcgaagccggtcaaggaatggggcatcacccagttcttggtctgcaaatcgtttgcggacacatatcagcagccagggcct

SEQ ID NO: 418535 - DNA, 140 bp, Artificial Sequence
  Synthetic
atacgccatgctgggtctccggtctggacatcgaaacagctactcgaacaggaaagcagatagtggagcggattctggaagaagaatctaatgaggcacttaaaatgactattgcttcagcgtacttgggagtcggccat

SEQ ID NO: 418536 - DNA, 140 bp, Artificial Sequence
  Synthetic
atggccgactcccaagtacgctgaagcaatagtcattttaagtgcctcattagattcttcttccagaatccgctccactatctgctttcctgttcgagtagctgtttcgatgtccagaccggagacccagcatggcgtat

SEQ ID NO: 418537 - DNA, 140 bp, Artificial Sequence
  Synthetic
aggccctggctgctgatatggattatgaagaattgaaacacctattgagcaggataaaccattttgagaaaatacagatcatccccaaaagttcttggtccgatcatgaagcctcatcaggaccttttgggacagcggtg

SEQ ID NO: 418538 - DNA, 140 bp, Artificial Sequence
  Synthetic
caccgctgtcccaaaaggtcctgatgaggcttcatgatcggaccaagaacttttggggatgatctgtattttctcaaaatggtttatcctgctcaataggtgtttcaattcttcataatccatatcagcagccagggcct

SEQ ID NO: 418539 - DNA, 140 bp, Artificial Sequence
  Synthetic
atacgccatgctgggtctccgcaaatgcagcgattcaagtgatcctctcgttattgccgcaagtatcattgggatcttgcacttgatattgtggattcttgatcgtcttttcttcaaatgcgtacttgggagtcggccat

SEQ ID NO: 418540 - DNA, 140 bp, Artificial Sequence
  Synthetic
atggccgactcccaagtacgcatttgaagaaaagacgatcaagaatccacaatatcaagtgcaagatcccaatgatacttgcggcaataacgagaggatcacttgaatcgctgcatttgcggagacccagcatggcgtat

SEQ ID NO: 418541 - DNA, 140 bp, Artificial Sequence
  Synthetic
aggccctggctgctgatatggggatcttgcacttgatattgtggattcttgatcgtcttttcttcaaatgcatttatcgtcgccttaaatacggtttgaaaagagggccttctacggaaggaccttttgggacagcggtg

SEQ ID NO: 418542 - DNA, 140 bp, Artificial Sequence
  Synthetic
caccgctgtcccaaaaggtccttccgtagaaggccctcttttcaaaccgtatttaaggcgacgataaatgcatttgaagaaaagacgatcaagaatccacaatatcaagtgcaagatccccatatcagcagccagggcct

SEQ ID NO: 418543 - DNA, 140 bp, Artificial Sequence
  Synthetic
atacgccatgctgggtctccgtggtatggcttatcaaaaagaaccatacatacccaacaataaagagaagctacaataataccaaccaggaagatcttttgatactgtgggggattcatccgtacttgggagtcggccat

SEQ ID NO: 418544 - DNA, 140 bp, Artificial Sequence
  Synthetic
atggccgactcccaagtacggatgaatcccccacagtatcaaaagatcttcctggttggtattattgtagcttctctttattgttgggtatgtatggttctttttgataagccataccacggagacccagcatggcgtat

SEQ ID NO: 418545 - DNA, 140 bp, Artificial Sequence
  Synthetic
atacgccatgctgggtctccattctaacgatgcagcagagcagacaaagctttatcaaaacccaaccacctatatttccgttgggacatcaacactgaaccagagattggtaccaacaatcgtacttgggagtcggccat

SEQ ID NO: 418546 - DNA, 140 bp, Artificial Sequence
  Synthetic
atggccgactcccaagtacgattgttggtaccaatctctggttcagtgttgatgtcccaacggaaatataggtggttgggttttgataaagctttgtctgctctgctgcatcgttagaatggagacccagcatggcgtat

SEQ ID NO: 418547 - DNA, 140 bp, Artificial Sequence
  Synthetic
atacgccatgctgggtctccagtttaaaatgaatccaaatcagaaaataataacaattggttctgtgtcattggcactagttgtactcaacatactgcttcatattgcatcaatagttatcgtacttgggagtcggccat

SEQ ID NO: 418548 - DNA, 140 bp, Artificial Sequence
  Synthetic
atggccgactcccaagtacgataactattgatgcaatatgaagcagtatgttgagtacaactagtgccaatgacacagaaccaattgttattattttctgatttggattcattttaaactggagacccagcatggcgtat

SEQ ID NO: 418549 - DNA, 140 bp, Artificial Sequence
  Synthetic
aggccctggctgctgatatgttggcactagttgtactcaacatactgcttcatattgcatcaatagttatagggataatatcagtgacaaaagaaagcagtatatcatcaccctgcaacagaccttttgggacagcggtg

SEQ ID NO: 418550 - DNA, 140 bp, Artificial Sequence
  Synthetic
caccgctgtcccaaaaggtctgttgcagggtgatgatatactgctttcttttgtcactgatattatccctataactattgatgcaatatgaagcagtatgttgagtacaactagtgccaacatatcagcagccagggcct

SEQ ID NO: 418551 - DNA, 140 bp, Artificial Sequence
  Synthetic
atacgccatgctgggtctccagggataatatcagtgacaaaagaaagcagtatatcatcaccctgcaacaccactgaggtttacaatgaaactgtaaggctggaaactataacaattcctcgtacttgggagtcggccat

SEQ ID NO: 418552 - DNA, 140 bp, Artificial Sequence
  Synthetic
atggccgactcccaagtacgaggaattgttatagtttccagccttacagtttcattgtaaacctcagtggtgttgcagggtgatgatatactgctttcttttgtcactgatattatccctggagacccagcatggcgtat

SEQ ID NO: 418553 - DNA, 140 bp, Artificial Sequence
  Synthetic
aggccctggctgctgatatgagaagttgacagtaacatattcatcatcaatgatgtgggaaattaacggccctgagtcagtacttgttaacacctaccaatggatcatcagaaactgggagaccttttgggacagcggtg

SEQ ID NO: 418554 - DNA, 140 bp, Artificial Sequence
  Synthetic
caccgctgtcccaaaaggtctcccagtttctgatgatccattggtaggtgttaacaagtactgactcagggccgttaatttcccacatcattgatgatgaatatgttactgtcaacttctcatatcagcagccagggcct

SEQ ID NO: 418555 - DNA, 140 bp, Artificial Sequence
  Synthetic
atacgccatgctgggtctcccagactacagcttaaggacaatgcaaaagagctgggtaacggttgtttcgagttctatcacaaatgtaataatgaatgtatggaaagtgtaagaaacggacgtacttgggagtcggccat

SEQ ID NO: 418556 - DNA, 140 bp, Artificial Sequence
  Synthetic
atggccgactcccaagtacgtccgtttcttacactttccatacattcattattacatttgtgatagaactcgaaacaaccgttacccagctcttttgcattgtccttaagctgtagtctgggagacccagcatggcgtat

SEQ ID NO: 418557 - DNA, 140 bp, Artificial Sequence
  Synthetic
atacgccatgctgggtctcctttaaacaacacagaacctctctgcaatgtatccgggtttgcaatagtctccaaagacaatggaatcagaattgggtcaaggggacatgtgtttgtcatacgtacttgggagtcggccat

SEQ ID NO: 418558 - DNA, 140 bp, Artificial Sequence
  Synthetic
atggccgactcccaagtacgtatgacaaacacatgtccccttgacccaattctgattccattgtctttggagactattgcaaacccggatacattgcagagaggttctgtgttgtttaaaggagacccagcatggcgtat

SEQ ID NO: 418559 - DNA, 140 bp, Artificial Sequence
  Synthetic
aggccctggctgctgatatgccaaagacaatggaatcagaattgggtcaaggggacatgtgtttgtcataagagaaccttttgtagcatgtggtccaacagaatgtcggacatttttcctgaccttttgggacagcggtg

SEQ ID NO: 418560 - DNA, 140 bp, Artificial Sequence
  Synthetic
caccgctgtcccaaaaggtcaggaaaaatgtccgacattctgttggaccacatgctacaaaaggttctcttatgacaaacacatgtccccttgacccaattctgattccattgtctttggcatatcagcagccagggcct

SEQ ID NO: 418561 - DNA, 140 bp, Artificial Sequence
  Synthetic
atacgccatgctgggtctccataggagtccttaccgcgcattgatgagtgtgccattaggatcttcacccaatgcttaccaggccaagtttgagtctgtcgcatggtcggccacagcatgcgtacttgggagtcggccat

SEQ ID NO: 418562 - DNA, 140 bp, Artificial Sequence
  Synthetic
atggccgactcccaagtacgcatgctgtggccgaccatgcgacagactcaaacttggcctggtaagcattgggtgaagatcctaatggcacactcatcaatgcgcggtaaggactcctatggagacccagcatggcgtat

SEQ ID NO: 418563 - DNA, 140 bp, Artificial Sequence
  Synthetic
aggccctggctgctgatatgaatgcttaccaggccaagtttgagtctgtcgcatggtcggccacagcatgccatgatggcaaagagtggttggcagtagggataagtggtgcagatgacggaccttttgggacagcggtg

SEQ ID NO: 418564 - DNA, 140 bp, Artificial Sequence
  Synthetic
caccgctgtcccaaaaggtccgtcatctgcaccacttatccctactgccaaccactctttgccatcatggcatgctgtggccgaccatgcgacagactcaaacttggcctggtaagcattcatatcagcagccagggcct

SEQ ID NO: 418565 - DNA, 140 bp, Artificial Sequence
  Synthetic
  misc_feature (98)..(98): n is a, c, g, or t
atacgccatgctgggtctcctcctgggacaatggaactggcctgatggggctaaaatagagtacttcctctaactgtggaggtcgctagatggtcagntcgtggaggtcgctagatggtccgtacttgggagtcggccat

SEQ ID NO: 418566 - DNA, 140 bp, Artificial Sequence
  Synthetic
  misc_feature (43)..(43): n is a, c, g, or t
atggccgactcccaagtacggaccatctagcgacctccacganctgaccatctagcgacctccacagttagaggaagtactctattttagccccatcaggccagttccattgtcccaggaggagacccagcatggcgtat

SEQ ID NO: 418567 - DNA, 140 bp, Artificial Sequence
  Synthetic
atacgccatgctgggtctcctcatggagaaagcagattctaagaacacaagaatcgtcatgtgtgtgtgtgaaagggcactgttattgggtaatgacggatggtcctgcgaataatcaggcgtacttgggagtcggccat

SEQ ID NO: 418568 - DNA, 140 bp, Artificial Sequence
  Synthetic
atggccgactcccaagtacgcctgattattcgcaggaccatccgtcattacccaataacagtgccctttcacacacacacatgacgattcttgtgttcttagaatctgctttctccatgaggagacccagcatggcgtat

SEQ ID NO: 418569 - DNA, 140 bp, Artificial Sequence
  Synthetic
aggccctggctgctgatatggaaagggcactgttattgggtaatgacggatggtcctgcgaataatcaggctagttacaaaattttcaagtctcataaagggatggtgacaaatgaaagagaccttttgggacagcggtg

SEQ ID NO: 418570 - DNA, 140 bp, Artificial Sequence
  Synthetic
caccgctgtcccaaaaggtctctttcatttgtcaccatccctttatgagacttgaaaattttgtaactagcctgattattcgcaggaccatccgtcattacccaataacagtgccctttccatatcagcagccagggcct

SEQ ID NO: 418571 - DNA, 140 bp, Artificial Sequence
  Synthetic
atacgccatgctgggtctccccctgggttttgcttaatgcgtcttggttcaactccttccttacacatgcattgaaatagttgtggcaatgctactatttgctatccatactgtccaaaacgtacttgggagtcggccat

SEQ ID NO: 418572 - DNA, 140 bp, Artificial Sequence
  Synthetic
atggccgactcccaagtacgttttggacagtatggatagcaaatagtagcattgccacaactatttcaatgcatgtgtaaggaaggagttgaaccaagacgcattaagcaaaacccagggggagacccagcatggcgtat

SEQ ID NO: 418573 - DNA, 140 bp, Artificial Sequence
  Synthetic
atacgccatgctgggtctcccttgggtaaagtggaatgcgtttgccgagataattggaatggaatgaatagaccaattttgacttttgatgaggacttgaactatgaggtgggttatttacgtacttgggagtcggccat

SEQ ID NO: 418574 - DNA, 140 bp, Artificial Sequence
  Synthetic
atggccgactcccaagtacgtaaataacccacctcatagttcaagtcctcatcaaaagtcaaaattggtctattcattccattccaattatctcggcaaacgcattccactttacccaagggagacccagcatggcgtat

SEQ ID NO: 418575 - DNA, 140 bp, Artificial Sequence
  Synthetic
aggccctggctgctgatatggaccaattttgacttttgatgaggacttgaactatgaggtgggttatttatgtgccggaataccgacagacactccacgggttcaagacagtagtttcaggaccttttgggacagcggtg

SEQ ID NO: 418576 - DNA, 140 bp, Artificial Sequence
  Synthetic
caccgctgtcccaaaaggtcctgaaactactgtcttgaacccgtggagtgtctgtcggtattccggcacataaataacccacctcatagttcaagtcctcatcaaaagtcaaaattggtccatatcagcagccagggcct

SEQ ID NO: 418577 - DNA, 140 bp, Artificial Sequence
  Synthetic
atacgccatgctgggtctcctgaaggggtttggcttcagacaaggtaatagtgtgtgggcaggaagaacagttagcatttcatcccgaagtgggtttgagatcttattgatagaagatggcgtacttgggagtcggccat

SEQ ID NO: 418578 - DNA, 140 bp, Artificial Sequence
  Synthetic
atggccgactcccaagtacgccatcttctatcaataagatctcaaacccacttcgggatgaaatgctaactgttcttcctgcccacacactattaccttgtctgaagccaaaccccttcaggagacccagcatggcgtat

SEQ ID NO: 418579 - DNA, 140 bp, Artificial Sequence
  Synthetic
aggccctggctgctgatatggttagcatttcatcccgaagtgggtttgagatcttattgatagaagatggttggaccaaaacgagcaaaaatgttgtcagaaaggtggaggtcctcaacagaccttttgggacagcggtg

SEQ ID NO: 418580 - DNA, 140 bp, Artificial Sequence
  Synthetic
caccgctgtcccaaaaggtctgttgaggacctccacctttctgacaacatttttgctcgttttggtccaaccatcttctatcaataagatctcaaacccacttcgggatgaaatgctaaccatatcagcagccagggcct

SEQ ID NO: 418581 - DNA, 140 bp, Artificial Sequence
  Synthetic
aggccctggctgctgatatgatggaacttgtacagtagtgatgactgatgggagcgcttcaggaaaagctgatactaaaatactatttgttgaggaggggaaaatcgttcatattagcacgaccttttgggacagcggtg

SEQ ID NO: 418582 - DNA, 140 bp, Artificial Sequence
  Synthetic
caccgctgtcccaaaaggtcgtgctaatatgaacgattttcccctcctcaacaaatagtattttagtatcagcttttcctgaagcgctcccatcagtcatcactactgtacaagttccatcatatcagcagccagggcct

SEQ ID NO: 418583 - DNA, 140 bp, Artificial Sequence
  Synthetic
atacgccatgctgggtctccactaataaacaatgcttagttccatgtttctggctggaaatgataagaggaaaaccagaagagagaacaagcatttggacctctagtagctccactgtatcgtacttgggagtcggccat

SEQ ID NO: 418584 - DNA, 140 bp, Artificial Sequence
  Synthetic
atggccgactcccaagtacgatacagtggagctactagaggtccaaatgcttgttctctcttctggttttcctcttatcatttccagccagaaacatggaactaagcattgtttattagtggagacccagcatggcgtat

SEQ ID NO: 418585 - DNA, 140 bp, Artificial Sequence
  Synthetic
aggccctggctgctgatatgcagaatgtgctctctaatgcaaggttcaacacttcccagaaggtctggggccgcaggagctgcagtgaaaggagttggaacactagcaatggaattgatcgaccttttgggacagcggtg

SEQ ID NO: 418586 - DNA, 140 bp, Artificial Sequence
  Synthetic
caccgctgtcccaaaaggtcgatcaattccattgctagtgttccaactcctttcactgcagctcctgcggccccagaccttctgggaagtgttgaaccttgcattagagagcacattctgcatatcagcagccagggcct

SEQ ID NO: 418587 - DNA, 140 bp, Artificial Sequence
  Synthetic
aggccctggctgctgatatgcatacagcggaataagaactaatggagcaaccagtgcatgtaggagatcaggatcttcattctatgcagaaatgaaatggctcctatcaaacacagataagaccttttgggacagcggtg

SEQ ID NO: 418588 - DNA, 140 bp, Artificial Sequence
  Synthetic
caccgctgtcccaaaaggtcttatctgtgtttgataggagccatttcatttctgcatagaatgaagatcctgatctcctacatgcactggttgctccattagttcttattccgctgtatgcatatcagcagccagggcct

SEQ ID NO: 418589 - DNA, 140 bp, Artificial Sequence
  Synthetic
aggccctggctgctgatatggtagataatcactcactgagtgacatccacatcatggcgtctcaaggcaccaaacgatcttatgaacagatggaaactggtggagaacgccagaatgccagaccttttgggacagcggtg

SEQ ID NO: 418590 - DNA, 140 bp, Artificial Sequence
  Synthetic
caccgctgtcccaaaaggtctggcattctggcgttctccaccagtttccatctgttcataagatcgtttggtgccttgagacgccatgatgtggatgtcactcagtgagtgattatctaccatatcagcagccagggcct

SEQ ID NO: 418591 - DNA, 140 bp, Artificial Sequence
  Synthetic
aggccctggctgctgatatgcaaacgatcttatgaacagatggaaactggtggagaacgccagaatgccactgaaatcagagcatctgttgggaggatggttggtggaatcgggagattcgaccttttgggacagcggtg

SEQ ID NO: 418592 - DNA, 140 bp, Artificial Sequence
  Synthetic
caccgctgtcccaaaaggtcgaatctcccgattccaccaaccatcctcccaacagatgctctgatttcagtggcattctggcgttctccaccagtttccatctgttcataagatcgtttgcatatcagcagccagggcct

SEQ ID NO: 418593 - DNA, 140 bp, Artificial Sequence
  Synthetic
aggccctggctgctgatatgagatcgaacggtctgacagctaatgaatcaggaaggctgatagattttctcaaggatgtgatggaatcaatggataaagaggaaatggaaataacaacgcgaccttttgggacagcggtg

SEQ ID NO: 418594 - DNA, 140 bp, Artificial Sequence
  Synthetic
caccgctgtcccaaaaggtcgcgttgttatttccatttcctctttatccattgattccatcacatccttgagaaaatctatcagccttcctgattcattagctgtcagaccgttcgatctcatatcagcagccagggcct

SEQ ID NO: 418595 - DNA, 140 bp, Artificial Sequence
  Synthetic
aggccctggctgctgatatggggatctttgaaaactcatgccttgaaacgatggaagttattcagcaaacaagagttgataaactaacccaaggccgccagacctacgactggacattgagaccttttgggacagcggtg

SEQ ID NO: 418596 - DNA, 140 bp, Artificial Sequence
  Synthetic
caccgctgtcccaaaaggtctcaatgtccagtcgtaggtctggcggccttgggttagtttatcaactcttgtttgctgaataacttccatcgtttcaaggcatgagttttcaaagatccccatatcagcagccagggcct

SEQ ID NO: 418597 - DNA, 140 bp, Artificial Sequence
  Synthetic
atacgccatgctgggtctccgcccttcagttgttcatcaaagactacaggtacacatacagatgccatagaggagacacacaaattcagacaaaaagatcattcgagctaaagagcctgtcgtacttgggagtcggccat

SEQ ID NO: 418598 - DNA, 140 bp, Artificial Sequence
  Synthetic
atggccgactcccaagtacgacaggctctttagctcgaatgatctttttgtctgaatttgtgtgtctcctctatggcatctgtatgtgtacctgtagtctttgatgaacaactgaagggcggagacccagcatggcgtat

SEQ ID NO: 418599 - DNA, 140 bp, Artificial Sequence
  Synthetic
atacgccatgctgggtctcccgaggagatctggagctgctggagcggcagtgaaaggggttggaacaatggtgatggaattgatccggatgatcaagagaggaatcaatgacaggaatttcgtacttgggagtcggccat

SEQ ID NO: 418600 - DNA, 140 bp, Artificial Sequence
  Synthetic
atggccgactcccaagtacgaaattcctgtcattgattcctctcttgatcatccggatcaattccatcaccattgttccaacccctttcactgccgctccagcagctccagatctcctcgggagacccagcatggcgtat

SEQ ID NO: 418601 - DNA, 140 bp, Artificial Sequence
  Synthetic
aggccctggctgctgatatgttgccttcttcaatctcttcaacagattgaaagcatgattgaggccgagtcttctgtcaaagaaaaagacatgactaaagaattttttgagaacaagtcggaccttttgggacagcggtg

SEQ ID NO: 418602 - DNA, 140 bp, Artificial Sequence
  Synthetic
caccgctgtcccaaaaggtccgacttgttctcaaaaaattctttagtcatgtctttttctttgacagaagactcggcctcaatcatgctttcaatctgttgaagagattgaagaaggcaacatatcagcagccagggcct

SEQ ID NO: 418603 - DNA, 140 bp, Artificial Sequence
  Synthetic
aggccctggctgctgatatgcccatctgatgatatggcattccaacctgaatgatgccacctatcagagaacgagagctctcgtgcgtactggaatggatccccggatgtgctctctgatgaccttttgggacagcggtg

SEQ ID NO: 418604 - DNA, 140 bp, Artificial Sequence
  Synthetic
caccgctgtcccaaaaggtcatcagagagcacatccggggatccattccagtacgcacgagagctctcgttctctgataggtggcatcattcaggttggaatgccatatcatcagatgggcatatcagcagccagggcct

SEQ ID NO: 418605 - DNA, 140 bp, Artificial Sequence
  Synthetic
atacgccatgctgggtctcctgggcgaaggacaagagttgcatatgaaagaatgtgcaatattctcaaaggaaaattccagacagctgcccagagggcaatgatggatcaagtgagagaacgtacttgggagtcggccat

SEQ ID NO: 418606 - DNA, 140 bp, Artificial Sequence
  Synthetic
atggccgactcccaagtacgttctctcacttgatccatcattgccctctgggcagctgtctggaattttcctttgagaatattgcacattctttcatatgcaactcttgtccttcgcccaggagacccagcatggcgtat

SEQ ID NO: 418607 - DNA, 140 bp, Artificial Sequence
  Synthetic
aggccctggctgctgatatgacaactgtccaccagaggagttcaaattgcttcaaatgagaacatggagacaatggactccagtactcttgaactaaggagcagatactgggctataagggaccttttgggacagcggtg

SEQ ID NO: 418608 - DNA, 140 bp, Artificial Sequence
  Synthetic
caccgctgtcccaaaaggtcccttatagcccagtatctgctccttagttcaagagtactggagtccattgtctccatgttctcatttgaagcaatttgaactcctctggtggacagttgtcatatcagcagccagggcct

SEQ ID NO: 418609 - DNA, 140 bp, Artificial Sequence
  Synthetic
aggccctggctgctgatatggtctttccaggggcggggagtcttcgagctctcggacgaaaaggcaacgaacccgatcgtgccttcctttgacatgagtaatgaaggatcttatttcttcgaccttttgggacagcggtg

SEQ ID NO: 418610 - DNA, 140 bp, Artificial Sequence
  Synthetic
caccgctgtcccaaaaggtcgaagaaataagatccttcattactcatgtcaaaggaaggcacgatcgggttcgttgccttttcgtccgagagctcgaagactccccgcccctggaaagaccatatcagcagccagggcct

SEQ ID NO: 418611 - DNA, 140 bp, Artificial Sequence
  Synthetic
aggccctggctgctgatatgttgaaataatcgaagggagagaccggacaatggcctggacagttgtgaatagtatctgcaacaccacgggagtcgacaaacctaaatttcttccggatctgaccttttgggacagcggtg

SEQ ID NO: 418612 - DNA, 140 bp, Artificial Sequence
  Synthetic
caccgctgtcccaaaaggtcagatccggaagaaatttaggtttgtcgactcccgtggtgttgcagatactattcacaactgtccaggccattgtccggtctctcccttcgattatttcaacatatcagcagccagggcct

SEQ ID NO: 418613 - DNA, 140 bp, Artificial Sequence
  Synthetic
atacgccatgctgggtctccggtccaaactataaaaatggaaagaatagtgattgccctcgcaataatcagcattgtcaaaggtgaccaaatctgcattggttatcatgcaaacaattcacgtacttgggagtcggccat

SEQ ID NO: 418614 - DNA, 140 bp, Artificial Sequence
  Synthetic
atggccgactcccaagtacgtgaattgtttgcatgataaccaatgcagatttggtcacctttgacaatgctgattattgcgagggcaatcactattctttccatttttatagtttggaccggagacccagcatggcgtat

SEQ ID NO: 418615 - DNA, 140 bp, Artificial Sequence
  Synthetic
aggccctggctgctgatatggcattgtcaaaggtgaccaaatctgcattggttatcatgcaaacaattcaacagagcaggttgatacaatcatggagaagaatgtgacggtcacacatgcgaccttttgggacagcggtg

SEQ ID NO: 418616 - DNA, 140 bp, Artificial Sequence
  Synthetic
caccgctgtcccaaaaggtcgcatgtgtgaccgtcacattcttctccatgattgtatcaacctgctctgttgaattgtttgcatgataaccaatgcagatttggtcacctttgacaatgccatatcagcagccagggcct

SEQ ID NO: 418617 - DNA, 140 bp, Artificial Sequence
  Synthetic
atacgccatgctgggtctccacagagcaggttgatacaatcatggagaagaatgtgacggtcacacatgctcaggatatactggaaaaagagcacaatggaaaactttgcagtcttaaagcgtacttgggagtcggccat

SEQ ID NO: 418618 - DNA, 140 bp, Artificial Sequence
  Synthetic
atggccgactcccaagtacgctttaagactgcaaagttttccattgtgctctttttccagtatatcctgagcatgtgtgaccgtcacattcttctccatgattgtatcaacctgctctgtggagacccagcatggcgtat

SEQ ID NO: 418619 - DNA, 140 bp, Artificial Sequence
  Synthetic
atacgccatgctgggtctccacacacatccacattttctcattcactggagaagagatggccaccaaagcagattacactcttgatgaagagagcagggcaagaatcaaaaccaggctgtcgtacttgggagtcggccat

SEQ ID NO: 418620 - DNA, 140 bp, Artificial Sequence
  Synthetic
atggccgactcccaagtacgacagcctggttttgattcttgccctgctctcttcatcaagagtgtaatctgctttggtggccatctcttctccagtgaatgagaaaatgtggatgtgtgtggagacccagcatggcgtat

SEQ ID NO: 418621 - DNA, 140 bp, Artificial Sequence
  Synthetic
atacgccatgctgggtctccggaaacccaatgtgtgatgaattcctgaatgtaccggaatggtcatacatcgtggaaaaagataatccagtcaatggcctgtgctatccaggaaacttcacgtacttgggagtcggccat

SEQ ID NO: 418622 - DNA, 140 bp, Artificial Sequence
  Synthetic
atggccgactcccaagtacgtgaagtttcctggatagcacaggccattgactggattatctttttccacgatgtatgaccattccggtacattcaggaattcatcacacattgggtttccggagacccagcatggcgtat

SEQ ID NO: 418623 - DNA, 140 bp, Artificial Sequence
  Synthetic
atacgccatgctgggtctcccagtccgaaagaggcgaagaaacaattgaagaaagatttgaaatcacaggaaccatgcgcaggcttgccgaccaaagtctcccaccgaacttctccagcccgtacttgggagtcggccat

SEQ ID NO: 418624 - DNA, 140 bp, Artificial Sequence
  Synthetic
atggccgactcccaagtacgggctggagaagttcggtgggagactttggtcggcaagcctgcgcatggttcctgtgatttcaaatctttcttcaattgtttcttcgcctctttcggactgggagacccagcatggcgtat

SEQ ID NO: 418625 - DNA, 140 bp, Artificial Sequence
  Synthetic
atacgccatgctgggtctccatggcaatgaaatatccaatcacagcagacaaaagaatactggaaatgatccctgatcgaattgaacaggggcagacgctttggaacaggacaaatgatgcgtacttgggagtcggccat

SEQ ID NO: 418626 - DNA, 140 bp, Artificial Sequence
  Synthetic
atggccgactcccaagtacgcatcatttgtcctgttccaaagcgtctgcccctgttcaattcgatcagggatcatttccagtattcttttgtctgctgtgattggatatttcattgccatggagacccagcatggcgtat

SEQ ID NO: 418627 - DNA, 140 bp, Artificial Sequence
  Synthetic
atacgccatgctgggtctccaggagtaagttcggcatgcccatacaatggcagatcttcctttttcaggaatgtggtgtggttgatcaagaagaacaatgcgtacccaacaataaagaggcgtacttgggagtcggccat

SEQ ID NO: 418628 - DNA, 140 bp, Artificial Sequence
  Synthetic
atggccgactcccaagtacgcctctttattgttgggtacgcattgttcttcttgatcaaccacaccacattcctgaaaaaggaagatctgccattgtatgggcatgccgaacttactcctggagacccagcatggcgtat

SEQ ID NO: 418629 - DNA, 140 bp, Artificial Sequence
  Synthetic
aggccctggctgctgatatgatgtggtgtggttgatcaagaagaacaatgcgtacccaacaataaagaggacctacaacaacaccaatgtagaagaccttttaataatatggggaattcagaccttttgggacagcggtg

SEQ ID NO: 418630 - DNA, 140 bp, Artificial Sequence
  Synthetic
caccgctgtcccaaaaggtctgaattccccatattattaaaaggtcttctacattggtgttgttgtaggtcctctttattgttgggtacgcattgttcttcttgatcaaccacaccacatcatatcagcagccagggcct

SEQ ID NO: 418631 - DNA, 140 bp, Artificial Sequence
  Synthetic
aggccctggctgctgatatgatgggttcgaaccaaacggctacattgaaggcaagctttctcaaatgtcaaaagaagtgagtgcccaaattgaaccatttttgaagaaaacaccacgcccgaccttttgggacagcggtg

SEQ ID NO: 418632 - DNA, 140 bp, Artificial Sequence
  Synthetic
caccgctgtcccaaaaggtcgggcgtggtgttttcttcaaaaatggttcaatttgggcactcacttcttttgacatttgagaaagcttgccttcaatgtagccgtttggttcgaacccatcatatcagcagccagggcct

SEQ ID NO: 418633 - DNA, 140 bp, Artificial Sequence
  Synthetic
atacgccatgctgggtctcccttatgtgtctgtaggaacatcaacactgaatcagagatcaatcccagaaatagccactagacccaaagtaaacgggcaaagtggaagaatggaatttttcgtacttgggagtcggccat

SEQ ID NO: 418634 - DNA, 140 bp, Artificial Sequence
  Synthetic
atggccgactcccaagtacgaaaaattccattcttccactttgcccgtttactttgggtctagtggctatttctgggattgatctctgattcagtgttgatgttcctacagacacataagggagacccagcatggcgtat

SEQ ID NO: 418635 - DNA, 140 bp, Artificial Sequence
  Synthetic
aggccctggctgctgatatgatagccactagacccaaagtaaacgggcaaagtggaagaatggaatttttctggacaatactgaggccgaatgatgcaatcagctttgaaagcaatgggagaccttttgggacagcggtg

SEQ ID NO: 418636 - DNA, 140 bp, Artificial Sequence
  Synthetic
caccgctgtcccaaaaggtctcccattgctttcaaagctgattgcatcattcggcctcagtattgtccagaaaaattccattcttccactttgcccgtttactttgggtctagtggctatcatatcagcagccagggcct

SEQ ID NO: 418637 - DNA, 140 bp, Artificial Sequence
  Synthetic
aggccctggctgctgatatgcttgaaagtgccagtgcaaaatgctataagtaccacgttcccttatactggagaccctccatacagccatggaacaggaacaggatacaccatggacacagaccttttgggacagcggtg

SEQ ID NO: 418638 - DNA, 140 bp, Artificial Sequence
  Synthetic
caccgctgtcccaaaaggtctgtgtccatggtgtatcctgttcctgttccatggctgtatggagggtctccagtataagggaacgtggtacttatagcattttgcactggcactttcaagcatatcagcagccagggcct

SEQ ID NO: 418639 - DNA, 140 bp, Artificial Sequence
  Synthetic
aggccctggctgctgatatgattattgtattttgtgggacttcaggtacatatggaacaggctcatggcctgatggggcggatatcaatttcatgcctatataagctttcgcaattttaggaccttttgggacagcggtg

SEQ ID NO: 418640 - DNA, 140 bp, Artificial Sequence
  Synthetic
caccgctgtcccaaaaggtcctaaaattgcgaaagcttatataggcatgaaattgatatccgccccatcaggccatgagcctgttccatatgtacctgaagtcccacaaaatacaataatcatatcagcagccagggcct

SEQ ID NO: 418641 - DNA, 140 bp, Artificial Sequence
  Synthetic
atacgccatgctgggtctccgcaatcatgagaagtgaattggagtatggtaactgtgacaccaaatgtcagaccccagtgggagctataaattccagtatgccattccacaatgttcatccgtacttgggagtcggccat

SEQ ID NO: 418642 - DNA, 140 bp, Artificial Sequence
  Synthetic
atggccgactcccaagtacggatgaacattgtggaatggcatactggaatttatagctcccactggggtctgacatttggtgtcacagttaccatactccaattcacttctcatgattgcggagacccagcatggcgtat

SEQ ID NO: 418643 - DNA, 140 bp, Artificial Sequence
  Synthetic
aggccctggctgctgatatggaccccagtgggagctataaattccagtatgccattccacaatgttcatcctcttaccattggggggtgccccaagtatgtcaaatcggacaagctggtcgaccttttgggacagcggtg

SEQ ID NO: 418644 - DNA, 140 bp, Artificial Sequence
  Synthetic
caccgctgtcccaaaaggtcgaccagcttgtccgatttgacatacttggggcaccccccaatggtaagaggatgaacattgtggaatggcatactggaatttatagctcccactggggtccatatcagcagccagggcct

SEQ ID NO: 418645 - DNA, 140 bp, Artificial Sequence
  Synthetic
atacgccatgctgggtctccatggatgtcaatccgactttacttttcttgaaagttccagcgcaaaatgctataagtactacatttccttatactggagaccctccatacagccatggaacgtacttgggagtcggccat

SEQ ID NO: 418646 - DNA, 140 bp, Artificial Sequence
  Synthetic
atggccgactcccaagtacgttccatggctgtatggagggtctccagtataaggaaatgtagtacttatagcattttgcgctggaactttcaagaaaagtaaagtcggattgacatccatggagacccagcatggcgtat

SEQ ID NO: 418647 - DNA, 140 bp, Artificial Sequence
  Synthetic
atacgccatgctgggtctcctggagcaatagcaggattcatagaaggaggatggcaaggaatggttgatggatggtacggataccatcatagcaatgagcagggaagtggatatgctgcacgtacttgggagtcggccat

SEQ ID NO: 418648 - DNA, 140 bp, Artificial Sequence
  Synthetic
atggccgactcccaagtacgtgcagcatatccacttccctgctcattgctatgatggtatccgtaccatccatcaaccattccttgccatcctccttctatgaatcctgctattgctccaggagacccagcatggcgtat

SEQ ID NO: 418649 - DNA, 140 bp, Artificial Sequence
  Synthetic
aggccctggctgctgatatggatggtacggataccatcatagcaatgagcagggaagtggatatgctgcagacaaagaatctacccagaaagcaatcgatgggatcaccaataaagtaaagaccttttgggacagcggtg

SEQ ID NO: 418650 - DNA, 140 bp, Artificial Sequence
  Synthetic
caccgctgtcccaaaaggtctttactttattggtgatcccatcgattgctttctgggtagattctttgtctgcagcatatccacttccctgctcattgctatgatggtatccgtaccatccatatcagcagccagggcct

SEQ ID NO: 418651 - DNA, 140 bp, Artificial Sequence
  Synthetic
atacgccatgctgggtctcctcaacaacctggaaaggagaatagaaaatttgaataggaaaatggaagatgggtttttagatgtatggacttacaatgcagaacttcttgtgctcatggacgtacttgggagtcggccat

SEQ ID NO: 418652 - DNA, 140 bp, Artificial Sequence
  Synthetic
atggccgactcccaagtacgtccatgagcacaagaagttctgcattgtaagtccatacatctaaaaacccatcttccattttcctattcaaattttctattctcctttccaggttgttgaggagacccagcatggcgtat

SEQ ID NO: 418653 - DNA, 140 bp, Artificial Sequence
  Synthetic
aggccctggctgctgatatggggtttttagatgtatggacttacaatgcagaacttcttgtgctcatggaaaatgagagaactttggacttccatgattcaaatgtcaagaacctatacggaccttttgggacagcggtg

SEQ ID NO: 418654 - DNA, 140 bp, Artificial Sequence
  Synthetic
caccgctgtcccaaaaggtccgtataggttcttgacatttgaatcatggaagtccaaagttctctcattttccatgagcacaagaagttctgcattgtaagtccatacatctaaaaaccccatatcagcagccagggcct

SEQ ID NO: 418655 - DNA, 140 bp, Artificial Sequence
  Synthetic
aggccctggctgctgatatgagagcgccagaatgccactgagatcagggcatctgttggaagaatggtcggtggcattggccggttttacatacagatgtgcactgaactcaaacttagcgaccttttgggacagcggtg

SEQ ID NO: 418656 - DNA, 140 bp, Artificial Sequence
  Synthetic
caccgctgtcccaaaaggtcgctaagtttgagttcagtgcacatctgtatgtaaaaccggccaatgccaccgaccattcttccaacagatgccctgatctcagtggcattctggcgctctcatatcagcagccagggcct

SEQ ID NO: 418657 - DNA, 140 bp, Artificial Sequence
  Synthetic
atacgccatgctgggtctcctgctttgaattctaccacaagtgtgacaatgaatgcatggaaagtgtgagaaatggaacgtatgactatccgcaatattcggaagaatcaagactgaacacgtacttgggagtcggccat

SEQ ID NO: 418658 - DNA, 140 bp, Artificial Sequence
  Synthetic
atggccgactcccaagtacgtgttcagtcttgattcttccgaatattgcggatagtcatacgttccatttctcacactttccatgcattcattgtcacacttgtggtagaattcaaagcaggagacccagcatggcgtat

SEQ ID NO: 418659 - DNA, 140 bp, Artificial Sequence
  Synthetic
atacgccatgctgggtctccctatcaatctactcaacagtggcgagttccctagcactggcaatcatgatagctggtctatctttttggatgtgctccaatggatcattgcagtgcagaacgtacttgggagtcggccat

SEQ ID NO: 418660 - DNA, 140 bp, Artificial Sequence
  Synthetic
atggccgactcccaagtacgttctgcactgcaatgatccattggagcacatccaaaaagatagaccagctatcatgattgccagtgctagggaactcgccactgttgagtagattgatagggagacccagcatggcgtat

SEQ ID NO: 418661 - DNA, 140 bp, Artificial Sequence
  Synthetic
aggccctggctgctgatatgatcatgatagctggtctatctttttggatgtgctccaatggatcattgcagtgcagaatttgcatctagagctgtgagttcagattataattaaaaacacgaccttttgggacagcggtg

SEQ ID NO: 418662 - DNA, 140 bp, Artificial Sequence
  Synthetic
caccgctgtcccaaaaggtcgtgtttttaattataatctgaactcacagctctagatgcaaattctgcactgcaatgatccattggagcacatccaaaaagatagaccagctatcatgatcatatcagcagccagggcct

SEQ ID NO: 418663 - DNA, 140 bp, Artificial Sequence
  Synthetic
aggccctggctgctgatatgtgctatctatggcacataagaaagctgctcagcatgagagacatgtgtgatgctccctttgatgatagactcagaagagatcagaaggcattaaaggggagaccttttgggacagcggtg

SEQ ID NO: 418664 - DNA, 140 bp, Artificial Sequence
  Synthetic
caccgctgtcccaaaaggtctcccctttaatgccttctgatctcttctgagtctatcatcaaagggagcatcacacatgtctctcatgctgagcagctttcttatgtgccatagatagcacatatcagcagccagggcct

SEQ ID NO: 418665 - DNA, 140 bp, Artificial Sequence
  Synthetic
aggccctggctgctgatatgaagattgttgaggacatcctaaagagtgaaacggatgaaaacctcaaaattgcaattgcatccagccctgctcctcggtacatcaccgacatgagcataggaccttttgggacagcggtg

SEQ ID NO: 418666 - DNA, 140 bp, Artificial Sequence
  Synthetic
caccgctgtcccaaaaggtcctatgctcatgtcggtgatgtaccgaggagcagggctggatgcaattgcaattttgaggttttcatccgtttcactctttaggatgtcctcaacaatcttcatatcagcagccagggcct

SEQ ID NO: 418667 - DNA, 140 bp, Artificial Sequence
  Synthetic
atacgccatgctgggtctcctttgtagccaacttcagtatggagctgcctagttttggagtgtctgggattaatgaatcggctgacatgagcattggagttacagtgataaagaacaatacgtacttgggagtcggccat

SEQ ID NO: 418668 - DNA, 140 bp, Artificial Sequence
  Synthetic
atggccgactcccaagtacgtattgttctttatcactgtaactccaatgctcatgtcagccgattcattaatcccagacactccaaaactaggcagctccatactgaagttggctacaaaggagacccagcatggcgtat

SEQ ID NO: 418669 - DNA, 140 bp, Artificial Sequence
  Synthetic
aggccctggctgctgatatgattccttccatgccaggacattctacagaggatgtcaaaaatgcaattggaatcctcatcggtggacttgaatggaatgataactcaattcgagcgtctggaccttttgggacagcggtg

SEQ ID NO: 418670 - DNA, 140 bp, Artificial Sequence
  Synthetic
caccgctgtcccaaaaggtccagacgctcgaattgagttatcattccattcaagtccaccgatgaggattccaattgcatttttgacatcctctgtagaatgtcctggcatggaaggaatcatatcagcagccagggcct

SEQ ID NO: 418671 - DNA, 140 bp, Artificial Sequence
  Synthetic
atacgccatgctgggtctccaaaatatacagagattcgcttggggagtccgtgatgagaatgggggacctccactccctccaaagcagaaacgctacatggcgagaagagttgagtcagacgtacttgggagtcggccat

SEQ ID NO: 418672 - DNA, 140 bp, Artificial Sequence
  Synthetic
atggccgactcccaagtacgtctgactcaactcttctcgccatgtagcgtttctgctttggagggagtggaggtcccccattctcatcacggactccccaagcgaatctctgtatattttggagacccagcatggcgtat

SEQ ID NO: 418673 - DNA, 140 bp, Artificial Sequence
  Synthetic
atacgccatgctgggtctcctgccagggtcgacttcgagtctggacggatcaagaaagaagagttctctgagatcatgaagatctgttccaccattgaagaactcagacggcaaaaataacgtacttgggagtcggccat

SEQ ID NO: 418674 - DNA, 140 bp, Artificial Sequence
  Synthetic
atggccgactcccaagtacgttatttttgccgtctgagttcttcaatggtggaacagatcttcatgatctcagagaactcttctttcttgatccgtccagactcgaagtcgaccctggcaggagacccagcatggcgtat

SEQ ID NO: 418675 - DNA, 140 bp, Artificial Sequence
  Synthetic
atacgccatgctgggtctccatggagagaataaaagaactgagagatctaatgtcacagtcccgcactcgcgagatactcactaagaccactgtggaccatatggccataatcaaaaagtcgtacttgggagtcggccat

SEQ ID NO: 418676 - DNA, 140 bp, Artificial Sequence
  Synthetic
atggccgactcccaagtacgactttttgattatggccatatggtccacagtggtcttagtgagtatctcgcgagtgcgggactgtgacattagatctctcagttcttttattctctccatggagacccagcatggcgtat

SEQ ID NO: 418677 - DNA, 140 bp, Artificial Sequence
  Synthetic
atacgccatgctgggtctccatggcaatgagatacccaattacagcagacaagagaataatggacatgattccagagaggaatgaacaaggacaaaccctctggagcaaaacaaacgatgcgtacttgggagtcggccat

SEQ ID NO: 418678 - DNA, 140 bp, Artificial Sequence
  Synthetic
atggccgactcccaagtacgcatcgtttgttttgctccagagggtttgtccttgttcattcctctctggaatcatgtccattattctcttgtctgctgtaattgggtatctcattgccatggagacccagcatggcgtat

SEQ ID NO: 418679 - DNA, 140 bp, Artificial Sequence
  Synthetic
aggccctggctgctgatatgcaaggaaccaaccagaatggtttagaaatgtcttaagcattgctcctataatgttctcaaacaagatggcgagattagggaaaggatacatgttcgaaaggaccttttgggacagcggtg

SEQ ID NO: 418680 - DNA, 140 bp, Artificial Sequence
  Synthetic
caccgctgtcccaaaaggtcctttcgaacatgtatcctttccctaatctcgccatcttgtttgagaacattataggagcaatgcttaagacatttctaaaccattctggttggttccttgcatatcagcagccagggcct

SEQ ID NO: 418681 - DNA, 140 bp, Artificial Sequence
  Synthetic
aggccctggctgctgatatgcaaggaagcaatgggattcacatacagtggaataagaactaatggagcaaccagtgcatgtaggagatcaggatcttcattctatgcagaaatgaaatgggaccttttgggacagcggtg

SEQ ID NO: 418682 - DNA, 140 bp, Artificial Sequence
  Synthetic
caccgctgtcccaaaaggtcccatttcatttctgcatagaatgaagatcctgatctcctacatgcactggttgctccattagttcttattccactgtatgtgaatcccattgcttccttgcatatcagcagccagggcct

SEQ ID NO: 418683 - DNA, 140 bp, Artificial Sequence
  Synthetic
aggccctggctgctgatatgatcctggtgtcagatgtgtctgcagagacaactggaaaggctccaacaggcccatcgtagatataaatgtaaaggattatagcatcgtttccagttatgtgaccttttgggacagcggtg

SEQ ID NO: 418684 - DNA, 140 bp, Artificial Sequence
  Synthetic
caccgctgtcccaaaaggtcacataactggaaacgatgctataatcctttacatttatatctacgatgggcctgttggagcctttccagttgtctctgcagacacatctgacaccaggatcatatcagcagccagggcct

SEQ ID NO: 418685 - DNA, 140 bp, Artificial Sequence
  Synthetic
aggccctggctgctgatatggaaatatcctgagcatggcacccataatgttctcaaacaaaatggcaagacttggaaaaggttacatgttcgagagtaaaaaaatgaggctccgaacacagaccttttgggacagcggtg

SEQ ID NO: 418686 - DNA, 140 bp, Artificial Sequence
  Synthetic
caccgctgtcccaaaaggtctgtgttcggagcctcatttttttactctcgaacatgtaaccttttccaagtcttgccattttgtttgagaacattatgggtgccatgctcaggatatttccatatcagcagccagggcct

SEQ ID NO: 418687 - DNA, 140 bp, Artificial Sequence
  Synthetic
atacgccatgctgggtctcccaatgataagtaaatgcagaaccaaagaaggaagacggaaaacaaacctatatggattcattataaaaggaagatctcatttgaggaatgataccgacgtcgtacttgggagtcggccat

SEQ ID NO: 418688 - DNA, 140 bp, Artificial Sequence
  Synthetic
atggccgactcccaagtacgacgtcggtatcattcctcaaatgagatcttccttttataatgaatccatataggtttgttttccgtcttccttctttggttctgcatttacttatcattgggagacccagcatggcgtat

SEQ ID NO: 418689 - DNA, 140 bp, Artificial Sequence
  Synthetic
aggccctggctgctgatatgcgccgcagggtcgacataaacccaggccatgcagatcttagtgctaaagaagcacaagatgtcatcatggaggtcgtattcccaaacgaagttggagccagaccttttgggacagcggtg

SEQ ID NO: 418690 - DNA, 140 bp, Artificial Sequence
  Synthetic
caccgctgtcccaaaaggtctggctccaacttcgtttgggaatacgacctccatgatgacatcttgtgcttctttagcactaagatctgcatggcctgggtttatgtcgaccctgcggcgcatatcagcagccagggcct

SEQ ID NO: 418691 - DNA, 140 bp, Artificial Sequence
  Synthetic
aggccctggctgctgatatgagtcgaaacccaggaaatgctgagattgaagatctcattttcctggcacggtcagcacttattctaaggggatcagttgcacataagtcttgcctgcctggaccttttgggacagcggtg

SEQ ID NO: 418692 - DNA, 140 bp, Artificial Sequence
  Synthetic
caccgctgtcccaaaaggtccaggcaggcaagacttatgtgcaactgatccccttagaataagtgctgaccgtgccaggaaaatgagatcttcaatctcagcatttcctgggtttcgactcatatcagcagccagggcct

SEQ ID NO: 418693 - DNA, 140 bp, Artificial Sequence
  Synthetic
atacgccatgctgggtctccgactggttcatgcttatgcctaggcaaaagataataggccctctttgcgtgcgattggaccaggcggtcatggaaaagaacatagtactgaaagcgaactcgtacttgggagtcggccat

SEQ ID NO: 418694 - DNA, 140 bp, Artificial Sequence
  Synthetic
atggccgactcccaagtacgagttcgctttcagtactatgttcttttccatgaccgcctggtccaatcgcacgcaaagagggcctattatcttttgcctaggcataagcatgaaccagtcggagacccagcatggcgtat

SEQ ID NO: 418695 - DNA, 140 bp, Artificial Sequence
  Synthetic
aggccctggctgctgatatgcaccaatattcagaaaaagggaaatggacgacaaacacagagactggggcaccccagctcaacccgattgatgggccactacctgaagataatgaaccaagaccttttgggacagcggtg

SEQ ID NO: 418696 - DNA, 140 bp, Artificial Sequence
  Synthetic
caccgctgtcccaaaaggtcttggttcattatcttcaggtagtggcccatcaatcgggttgagctggggtgccccagtctctgtgtttgtcgtccatttccctttttctgaatattggtgcatatcagcagccagggcct

SEQ ID NO: 418697 - DNA, 140 bp, Artificial Sequence
  Synthetic
aggccctggctgctgatatgatccggaatcttcacattcctgaagtctgcttaaaatgggacctaatggatgaggattatcggggaagactttgtaatcccctgaacccctttgtcagtcgaccttttgggacagcggtg

SEQ ID NO: 418698 - DNA, 140 bp, Artificial Sequence
  Synthetic
caccgctgtcccaaaaggtcgactgacaaaggggttcaggggattacaaagtcttccccgataatcctcatccattaggtcccattttaagcagacttcaggaatgtgaagattccggatcatatcagcagccagggcct

SEQ ID NO: 418699 - DNA, 140 bp, Artificial Sequence
  Synthetic
aggccctggctgctgatatgcctgccaaaagcatggaatatgatgccgttgcaactacacactcatggattcccaagaggaaccgctctattctaaatacaagccaaaggggaattctcggaccttttgggacagcggtg

SEQ ID NO: 418700 - DNA, 140 bp, Artificial Sequence
  Synthetic
caccgctgtcccaaaaggtccgagaattcccctttggcttgtatttagaatagagcggttcctcttgggaatccatgagtgtgtagttgcaacggcatcatattccatgcttttggcaggcatatcagcagccagggcct

SEQ ID NO: 418701 - DNA, 140 bp, Artificial Sequence
  Synthetic
aggccctggctgctgatatgggcaattctccagtgttcaattacaacaaggcaaccaaacggcttacagttcttggaaaggatgcaggtgcattgactgaagatccagatgaaggcacatgaccttttgggacagcggtg

SEQ ID NO: 418702 - DNA, 140 bp, Artificial Sequence
  Synthetic
caccgctgtcccaaaaggtcatgtgccttcatctggatcttcagtcaatgcacctgcatcctttccaagaactgtaagccgtttggttgccttgttgtaattgaacactggagaattgcccatatcagcagccagggcct

SEQ ID NO: 418703 - DNA, 140 bp, Artificial Sequence
  Synthetic
atacgccatgctgggtctccgcaaggatcaactctcccaaggagatctggagctgctggtgcggcaataaagggagtcgggactatggtaatggaactaattcggatgataaagcgaggtcgtacttgggagtcggccat

SEQ ID NO: 418704 - DNA, 140 bp, Artificial Sequence
  Synthetic
atggccgactcccaagtacgacctcgctttatcatccgaattagttccattaccatagtcccgactccctttattgccgcaccagcagctccagatctccttgggagagttgatccttgcggagacccagcatggcgtat

SEQ ID NO: 418705 - DNA, 140 bp, Artificial Sequence
  Synthetic
aggccctggctgctgatatgcttgaactgagaagtagatattgggctataagaaccagaagcggagggaacaccaaccaacagagggcatctgcaggacaggtcagcgttcaacccacttgaccttttgggacagcggtg

SEQ ID NO: 418706 - DNA, 140 bp, Artificial Sequence
  Synthetic
caccgctgtcccaaaaggtcaagtgggttgaacgctgacctgtcctgcagatgccctctgttggttggtgttccctccgcttctggttcttatagcccaatatctacttctcagttcaagcatatcagcagccagggcct

SEQ ID NO: 418707 - DNA, 140 bp, Artificial Sequence
  Synthetic
aggccctggctgctgatatggcacacaaaacgcaattgatgggatcagcaacaaagtgaactcaataattgaaaaaatgaacattcagtttacttcagtgagcaaggaattcaatagtctgaccttttgggacagcggtg

SEQ ID NO: 418708 - DNA, 140 bp, Artificial Sequence
  Synthetic
caccgctgtcccaaaaggtcagactattgaattccttgctcactgaagtaaactgaatgttcattttttcaattattgagttcactttgttgctgatcccatcaattgcgttttgtgtgccatatcagcagccagggcct

SEQ ID NO: 418709 - DNA, 140 bp, Artificial Sequence
  Synthetic
atacgccatgctgggtctccattatattcagtatggaaagaataaaagaactacggaatctgatgtcgcagtctcgcactcgcgagatactgacaaaaaccacagtggaccatatggccacgtacttgggagtcggccat

SEQ ID NO: 418710 - DNA, 140 bp, Artificial Sequence
  Synthetic
atggccgactcccaagtacgtggccatatggtccactgtggtttttgtcagtatctcgcgagtgcgagactgcgacatcagattccgtagttcttttattctttccatactgaatataatggagacccagcatggcgtat

SEQ ID NO: 418711 - DNA, 140 bp, Artificial Sequence
  Synthetic
atacgccatgctgggtctccgcatccgcaggacaaatcagtgtccaacctactttctcagtacagagaaacctccctttcgagagagcaactatcatggcagcattcacggggaatactgcgtacttgggagtcggccat

SEQ ID NO: 418712 - DNA, 140 bp, Artificial Sequence
  Synthetic
atggccgactcccaagtacgcagtattccccgtgaatgctgccatgatagttgctctctcgaaagggaggtttctctgtactgagaaagtaggttggacactgatttgtcctgcggatgcggagacccagcatggcgtat

SEQ ID NO: 418713 - DNA, 140 bp, Artificial Sequence
  Synthetic
aggccctggctgctgatatgggcactcaaaatgactattgcctctgtacctacttcacgctacctaactgacatgactcttgaagagatgtcaagagactggttcatgctcatgcccaaagaccttttgggacagcggtg

SEQ ID NO: 418714 - DNA, 140 bp, Artificial Sequence
  Synthetic
caccgctgtcccaaaaggtctttgggcatgagcatgaaccagtctcttgacatctcttcaagagtcatgtcagttaggtagcgtgaagtaggtacagaggcaatagtcattttgagtgcccatatcagcagccagggcct

SEQ ID NO: 418715 - DNA, 140 bp, Artificial Sequence
  Synthetic
atacgccatgctgggtctccatgaatcccaatcaaaggaaaatagcacttggctctgcttccctaactattgcgacaatatgtttactcattcagattgccatcttagcaacgactatgacgtacttgggagtcggccat

SEQ ID NO: 418716 - DNA, 140 bp, Artificial Sequence
  Synthetic
atggccgactcccaagtacgtcatagtcgttgctaagatggcaatctgaatgagtaaacatattgtcgcaatagttagggaagcagagccaagtgctattttcctttgattgggattcatggagacccagcatggcgtat

SEQ ID NO: 418717 - DNA, 140 bp, Artificial Sequence
  Synthetic
aggccctggctgctgatatgtgcgacaatatgtttactcattcagattgccatcttagcaacgactatgacactacatttcaaacagaacgagtacacaaatacctcgaaaaaccaagcagaccttttgggacagcggtg

SEQ ID NO: 418718 - DNA, 140 bp, Artificial Sequence
  Synthetic
caccgctgtcccaaaaggtctgcttggtttttcgaggtatttgtgtactcgttctgtttgaaatgtagtgtcatagtcgttgctaagatggcaatctgaatgagtaaacatattgtcgcacatatcagcagccagggcct

SEQ ID NO: 418719 - DNA, 140 bp, Artificial Sequence
  Synthetic
atacgccatgctgggtctccatgaaagcacatccggagtggagtccgccgtcttgagagggttcctcattataggtaaggaagacagaagatacggaccagcattaagcatcaatgaactcgtacttgggagtcggccat

SEQ ID NO: 418720 - DNA, 140 bp, Artificial Sequence
  Synthetic
atggccgactcccaagtacgagttcattgatgcttaatgctggtccgtatcttctgtcttccttacctataatgaggaaccctctcaagacggcggactccactccggatgtgctttcatggagacccagcatggcgtat

SEQ ID NO: 418721 - DNA, 140 bp, Artificial Sequence
  Synthetic
aggccctggctgctgatatgaattcagacaaggaggtcattcgagctgaagaaattgtgggaacaaacccgctcaaaagcgggactgctggtctcagacggaggaccaaacctatacaatgaccttttgggacagcggtg

SEQ ID NO: 418722 - DNA, 140 bp, Artificial Sequence
  Synthetic
caccgctgtcccaaaaggtcattgtataggtttggtcctccgtctgagaccagcagtcccgcttttgagcgggtttgttcccacaatttcttcagctcgaatgacctccttgtctgaattcatatcagcagccagggcct

SEQ ID NO: 418723 - DNA, 140 bp, Artificial Sequence
  Synthetic
atacgccatgctgggtctccactgtcaggaagtgctcagcatgtggaggagtgctcttgttaccctcggtacccagaagttagatgtgtttgcagagacaattggaagggctccaatagacgtacttgggagtcggccat

SEQ ID NO: 418724 - DNA, 140 bp, Artificial Sequence
  Synthetic
atggccgactcccaagtacgtctattggagcccttccaattgtctctgcaaacacatctaacttctgggtaccgagggtaacaagagcactcctccacatgctgagcacttcctgacagtggagacccagcatggcgtat

SEQ ID NO: 418725 - DNA, 140 bp, Artificial Sequence
  Synthetic
aggccctggctgctgatatgtgaagactaccagggcaggctgtgtaatcctctgaacccgtttgtcagtcataaggaaattgagtccgtaaacaatgctgtggtaatgccagcccatggcgaccttttgggacagcggtg

SEQ ID NO: 418726 - DNA, 140 bp, Artificial Sequence
  Synthetic
caccgctgtcccaaaaggtcgccatgggctggcattaccacagcattgtttacggactcaatttccttatgactgacaaacgggttcagaggattacacagcctgccctggtagtcttcacatatcagcagccagggcct

SEQ ID NO: 418727 - DNA, 140 bp, Artificial Sequence
  Synthetic
aggccctggctgctgatatgacgatcctatgagcagatggaaactggtggtgaacgccagaatgccactgagatcagagcatctgttgggagaatggttggtggaattggaaggttttacgaccttttgggacagcggtg

SEQ ID NO: 418728 - DNA, 140 bp, Artificial Sequence
  Synthetic
caccgctgtcccaaaaggtcgtaaaaccttccaattccaccaaccattctcccaacagatgctctgatctcagtggcattctggcgttcaccaccagtttccatctgctcataggatcgtcatatcagcagccagggcct

SEQ ID NO: 418729 - DNA, 140 bp, Artificial Sequence
  Synthetic
aggccctggctgctgatatgaaacatcctcagaactcaggagtcagaatgcgtttgcatcaatggaaactgtacagtagtaatgactgatggaagtgcatcaggagtggccgacactagagaccttttgggacagcggtg

SEQ ID NO: 418730 - DNA, 140 bp, Artificial Sequence
  Synthetic
caccgctgtcccaaaaggtctctagtgtcggccactcctgatgcacttccatcagtcattactactgtacagtttccattgatgcaaacgcattctgactcctgagttctgaggatgtttcatatcagcagccagggcct

SEQ ID NO: 418731 - DNA, 140 bp, Artificial Sequence
  Synthetic
aggccctggctgctgatatgggagaaacaggtacctggaagaacatccaagtgctgggaaggacccaaagaaaactggaggtccgatataccgacggagagacgggaagtgggtgagagagaccttttgggacagcggtg

SEQ ID NO: 418732 - DNA, 140 bp, Artificial Sequence
  Synthetic
caccgctgtcccaaaaggtctctctcacccacttcccgtctctccgtcggtatatcggacctccagttttctttgggtccttcccagcacttggatgttcttccaggtacctgtttctcccatatcagcagccagggcct

SEQ ID NO: 418733 - DNA, 140 bp, Artificial Sequence
  Synthetic
atacgccatgctgggtctccaacccaacagaagaacaggctgtggatatatgtaaggcagcaatgggtctaaggatcagttcatccttcagctttggaggtttcactttcaaaaggacaacgtacttgggagtcggccat

SEQ ID NO: 418734 - DNA, 140 bp, Artificial Sequence
  Synthetic
atggccgactcccaagtacgttgtccttttgaaagtgaaacctccaaagctgaaggatgaactgatccttagacccattgctgccttacatatatccacagcctgttcttctgttgggttggagacccagcatggcgtat

SEQ ID NO: 418735 - DNA, 140 bp, Artificial Sequence
  Synthetic
atacgccatgctgggtctccgtggatatgcacaaacagactgcgtcctggaggccatggctttccttgaggaatctcacccagggatatttgagaattcatgccttgaaacgatagaaatcgtacttgggagtcggccat

SEQ ID NO: 418736 - DNA, 140 bp, Artificial Sequence
  Synthetic
atggccgactcccaagtacgatttctatcgtttcaaggcatgaattctcaaatatccctgggtgagattcctcaaggaaagccatggcctccaggacgcagtctgtttgtgcatatccacggagacccagcatggcgtat

SEQ ID NO: 418737 - DNA, 140 bp, Artificial Sequence
  Synthetic
atacgccatgctgggtctccagcaaaagcaggggaatttcacaatcaaccaagatggaaacaacaacaataatagctatactgctaatggtaactgcaagcaatgcagataaaatctgcacgtacttgggagtcggccat

SEQ ID NO: 418738 - DNA, 140 bp, Artificial Sequence
  Synthetic
atggccgactcccaagtacgtgcagattttatctgcattgcttgcagttaccattagcagtatagctattattgttgttgtttccatcttggttgattgtgaaattcccctgcttttgctggagacccagcatggcgtat

SEQ ID NO: 418739 - DNA, 140 bp, Artificial Sequence
  Synthetic
atacgccatgctgggtctccagcaaaagcaggagtaaaatgaatccaaatcagaagataatagcaattggtgtcgtctctctaactactgcgataatatgcctcctcatgcagaccgccacgtacttgggagtcggccat

SEQ ID NO: 418740 - DNA, 140 bp, Artificial Sequence
  Synthetic
atggccgactcccaagtacgtggcggtctgcatgaggaggcatattatcgcagtagttagagagacgacaccaattgctattatcttctgatttggattcattttactcctgcttttgctggagacccagcatggcgtat

SEQ ID NO: 418741 - DNA, 140 bp, Artificial Sequence
  Synthetic
aggccctggctgctgatatgacgctcaggttatgagacttttagggtcataaatggttggaccatggctaattcaaagtcacagataaataggcaagtcatagttgacagtgacgactgggaccttttgggacagcggtg

SEQ ID NO: 418742 - DNA, 140 bp, Artificial Sequence
  Synthetic
caccgctgtcccaaaaggtcccagtcgtcactgtcaactatgacttgcctatttatctgtgactttgaattagccatggtccaaccatttatgaccctaaaagtctcataacctgagcgtcatatcagcagccagggcct

SEQ ID NO: 418743 - DNA, 140 bp, Artificial Sequence
  Synthetic
atacgccatgctgggtctccaggactgcaataggccaagtttcaaggcccatgttcctgtatgtgagaaccaatggaacctccaagatcaaaatgaaatggggcatggaaatgaggcggtcgtacttgggagtcggccat

SEQ ID NO: 418744 - DNA, 140 bp, Artificial Sequence
  Synthetic
atggccgactcccaagtacgaccgcctcatttccatgccccatttcattttgatcttggaggttccattggttctcacatacaggaacatgggccttgaaacttggcctattgcagtcctggagacccagcatggcgtat

SEQ ID NO: 418745 - DNA, 140 bp, Artificial Sequence
  Synthetic
atacgccatgctgggtctccgccctaaagtagcaggatacaggaattggtcgaaaccacaatgtcaaataacagggttcgctcctttctccaaggacaattcaattaggctctccgcaggcgtacttgggagtcggccat

SEQ ID NO: 418746 - DNA, 140 bp, Artificial Sequence
  Synthetic
atggccgactcccaagtacgcctgcggagagcctaattgaattgtccttggagaaaggagcgaaccctgttatttgacattgtggtttcgaccaattcctgtatcctgctactttagggcggagacccagcatggcgtat

SEQ ID NO: 418747 - DNA, 140 bp, Artificial Sequence
  Synthetic
atacgccatgctgggtctccaactgttacccttatgatgtgccggattatgcctcccttaggtcactagttgcctcatccggcacactggagtttaacaatgaaagcttcaattggactgcgtacttgggagtcggccat

SEQ ID NO: 418748 - DNA, 140 bp, Artificial Sequence
  Synthetic
atggccgactcccaagtacgcagtccaattgaagctttcattgttaaactccagtgtgccggatgaggcaactagtgacctaagggaggcataatccggcacatcataagggtaacagttggagacccagcatggcgtat

SEQ ID NO: 418749 - DNA, 140 bp, Artificial Sequence
  Synthetic
atacgccatgctgggtctccaatgttatcagtttgcacttgggcaggggactaccttagacaacagccactcaaatggcacatcacatgataggactccttataggacacttttgatgaacgtacttgggagtcggccat

SEQ ID NO: 418750 - DNA, 140 bp, Artificial Sequence
  Synthetic
atggccgactcccaagtacgttcatcaaaagtgtcctataaggagtcctatcatgtgatgtgccatttgagtggctgttgtctaaggtagtcccctgcccaagtgcaaactgataacattggagacccagcatggcgtat

SEQ ID NO: 418751 - DNA, 140 bp, Artificial Sequence
  Synthetic
atacgccatgctgggtctccggtccagctcaagctgtcatgatgggaaagcatggttacatgtttgtgttactggagatgatagaaatgcaactgccagtatcatctatggtggtatactcgtacttgggagtcggccat

SEQ ID NO: 418752 - DNA, 140 bp, Artificial Sequence
  Synthetic
atggccgactcccaagtacgagtataccaccatagatgatactggcagttgcatttctatcatctccagtaacacaaacatgtaaccatgctttcccatcatgacagcttgagctggaccggagacccagcatggcgtat

SEQ ID NO: 418753 - DNA, 140 bp, Artificial Sequence
  Synthetic
aggccctggctgctgatatgactggagatgatagaaatgcaactgccagtatcatctatggtggtatacttgttgatagcattggttcatggtctaaaaatatccccagaactcaggagtgaccttttgggacagcggtg

SEQ ID NO: 418754 - DNA, 140 bp, Artificial Sequence
  Synthetic
caccgctgtcccaaaaggtcactcctgagttctggggatatttttagaccatgaaccaatgctatcaacaagtataccaccatagatgatactggcagttgcatttctatcatctccagtcatatcagcagccagggcct

SEQ ID NO: 418755 - DNA, 140 bp, Artificial Sequence
  Synthetic
aggccctggctgctgatatgaatgtaaacaggatcacatacggggcctgtcccagatatgttaagcaaagcactctgaaattggcaacaggaatgcgaaatgtaccagagaaacaaactagaccttttgggacagcggtg

SEQ ID NO: 418756 - DNA, 140 bp, Artificial Sequence
  Synthetic
caccgctgtcccaaaaggtctagtttgtttctctggtacatttcgcattcctgttgccaatttcagagtgctttgcttaacatatctgggacaggccccgtatgtgatcctgtttacattcatatcagcagccagggcct

SEQ ID NO: 418757 - DNA, 140 bp, Artificial Sequence
  Synthetic
atacgccatgctgggtctccagtgcttctgggaaagctgacactagaatactatttattagagaggggaaaatagtacacattagccctttgtcaggaagtgctcagcatgtggaggaatcgtacttgggagtcggccat

SEQ ID NO: 418758 - DNA, 140 bp, Artificial Sequence
  Synthetic
atggccgactcccaagtacgattcctccacatgctgagcacttcctgacaaagggctaatgtgtactattttcccctctctaataaatagtattctagtgtcagctttcccagaagcactggagacccagcatggcgtat

SEQ ID NO: 418759 - DNA, 140 bp, Artificial Sequence
  Synthetic
aggccctggctgctgatatgtgtgagcagattgctgactcccagcatcggtcccacaggcagatggtgacaacaaccaacccattaatcagacacgagaatagaatggtgctggcaagcagaccttttgggacagcggtg

SEQ ID NO: 418760 - DNA, 140 bp, Artificial Sequence
  Synthetic
caccgctgtcccaaaaggtctgcttgccagcaccattctattctcgtgtctgattaatgggttggttgttgtcaccatctgcctgtgggaccgatgctgggagtcagcaatctgctcacacatatcagcagccagggcct

SEQ ID NO: 418761 - DNA, 140 bp, Artificial Sequence
  Synthetic
atacgccatgctgggtctcccaatccaatgattgtcgagcttgcggaaaagacaatgaaagagtatggggaagacccgaaagtagagacgaataaatttgctgccatatgcacacacttgcgtacttgggagtcggccat

SEQ ID NO: 418762 - DNA, 140 bp, Artificial Sequence
  Synthetic
atggccgactcccaagtacgcaagtgtgtgcatatggcagcaaatttattcgtctctactttcgggtcttccccatactctttcattgtcttttccgcaagctcgacaatcattggattgggagacccagcatggcgtat

SEQ ID NO: 418763 - DNA, 140 bp, Artificial Sequence
  Synthetic
aggccctggctgctgatatgatcagtaattgtggaatctggcgatccgaatgcattgttgaaacaccgattcgaaataattgaaggacgagaccgaacaatggcctggacagtggtgaacgaccttttgggacagcggtg

SEQ ID NO: 418764 - DNA, 140 bp, Artificial Sequence
  Synthetic
caccgctgtcccaaaaggtcgttcaccactgtccaggccattgttcggtctcgtccttcaattatttcgaatcggtgtttcaacaatgcattcggatcgccagattccacaattactgatcatatcagcagccagggcct

SEQ ID NO: 418765 - DNA, 140 bp, Artificial Sequence
  Synthetic
aggccctggctgctgatatgccttttcacaaggacaatgcaatacgactgggtgagaacaaagacgtcatagtcacaagggagccctatattagctgtgataatgacaactgctggtcctgaccttttgggacagcggtg

SEQ ID NO: 418766 - DNA, 140 bp, Artificial Sequence
  Synthetic
caccgctgtcccaaaaggtcaggaccagcagttgtcattatcacagctaatatagggctcccttgtgactatgacgtctttgttctcacccagtcgtattgcattgtccttgtgaaaaggcatatcagcagccagggcct

SEQ ID NO: 418767 - DNA, 140 bp, Artificial Sequence
  Synthetic
aggccctggctgctgatatgatggagacagtatcactaataactatactactagtagcaacagtaagcaatgcagataaaatctgcatcggctatcaatcaacaaactccacagaaactggaccttttgggacagcggtg

SEQ ID NO: 418768 - DNA, 140 bp, Artificial Sequence
  Synthetic
caccgctgtcccaaaaggtccagtttctgtggagtttgttgattgatagccgatgcagattttatctgcattgcttactgttgctactagtagtatagttattagtgatactgtctccatcatatcagcagccagggcct

SEQ ID NO: 418769 - DNA, 140 bp, Artificial Sequence
  Synthetic
aggccctggctgctgatatgtgctcgtagtatggtcgttgttaggccctctgtggcaagcaaagtggtgcttcccataagcatttacgccaaaatacctcaactagggttcaatgttgaagaccttttgggacagcggtg

SEQ ID NO: 418770 - DNA, 140 bp, Artificial Sequence
  Synthetic
caccgctgtcccaaaaggtcttcaacattgaaccctagttgaggtattttggcgtaaatgcttatgggaagcaccactttgcttgccacagagggcctaacaacgaccatactacgagcacatatcagcagccagggcct

SEQ ID NO: 418771 - DNA, 140 bp, Artificial Sequence
  Synthetic
aggccctggctgctgatatgatgagtgacatcgaagccatggcgtctcaaggcaccaaacgatcatatgaacaaatggagactggtggggagcgccaggatgccacagaaatcagagcatgaccttttgggacagcggtg

SEQ ID NO: 418772 - DNA, 140 bp, Artificial Sequence
  Synthetic
caccgctgtcccaaaaggtcatgctctgatttctgtggcatcctggcgctccccaccagtctccatttgttcatatgatcgtttggtgccttgagacgccatggcttcgatgtcactcatcatatcagcagccagggcct

SEQ ID NO: 418773 - DNA, 140 bp, Artificial Sequence
  Synthetic
aggccctggctgctgatatggccagaatgctactgagatcagggcatctgttggaagaatggttagtggcattgggagattctacatacagatgtgtacagaactcaaactcagtgacaagaccttttgggacagcggtg

SEQ ID NO: 418774 - DNA, 140 bp, Artificial Sequence
  Synthetic
caccgctgtcccaaaaggtcttgtcactgagtttgagttctgtacacatctgtatgtagaatctcccaatgccactaaccattcttccaacagatgccctgatctcagtagcattctggccatatcagcagccagggcct

SEQ ID NO: 418775 - DNA, 140 bp, Artificial Sequence
  Synthetic
atacgccatgctgggtctccagtttgaagagataagatggctaattgaagaagtgagacacagattaagaacaactgaaaatagctttgaacaaataacattcatgcaagcattacaactcgtacttgggagtcggccat

SEQ ID NO: 418776 - DNA, 140 bp, Artificial Sequence
  Synthetic
atggccgactcccaagtacgagttgtaatgcttgcatgaatgttatttgttcaaagctattttcagttgttcttaatctgtgtctcacttcttcaattagccatcttatctcttcaaactggagacccagcatggcgtat

SEQ ID NO: 418777 - DNA, 140 bp, Artificial Sequence
  Synthetic
aggccctggctgctgatatgacaactgaaaatagctttgaacaaataacattcatgcaagcattacaactgctgtttgaagtggaacaggagataagaactttctcatttcagcttatttgaccttttgggacagcggtg

SEQ ID NO: 418778 - DNA, 140 bp, Artificial Sequence
  Synthetic
caccgctgtcccaaaaggtcaaataagctgaaatgagaaagttcttatctcctgttccacttcaaacagcagttgtaatgcttgcatgaatgttatttgttcaaagctattttcagttgtcatatcagcagccagggcct

SEQ ID NO: 418779 - DNA, 140 bp, Artificial Sequence
  Synthetic
aggccctggctgctgatatggctctcagaggtcaaagttcctgttaatggatgccttaaaattaagcatcgaagacccgagtcatgaaggggaggggataccactttatgatgcaatcaagaccttttgggacagcggtg

SEQ ID NO: 418780 - DNA, 140 bp, Artificial Sequence
  Synthetic
caccgctgtcccaaaaggtcttgattgcatcataaagtggtatcccctccccttcatgactcgggtcttcgatgcttaattttaaggcatccattaacaggaactttgacctctgagagccatatcagcagccagggcct

SEQ ID NO: 418781 - DNA, 140 bp, Artificial Sequence
  Synthetic
atacgccatgctgggtctccgaagacccgagtcatgaaggggaggggataccactttatgatgcaatcaaatgcatgaagacttttttcgggtggaaagagcctaaaatcataaaaccaccgtacttgggagtcggccat

SEQ ID NO: 418782 - DNA, 140 bp, Artificial Sequence
  Synthetic
atggccgactcccaagtacggtggttttatgattttaggctctttccacccgaaaaaagtcttcatgcatttgattgcatcataaagtggtatcccctccccttcatgactcgggtcttcggagacccagcatggcgtat

SEQ ID NO: 418783 - DNA, 140 bp, Artificial Sequence
  Synthetic
atacgccatgctgggtctccccagatcaagtagagggctatttggagccatagctggattcatagaaggaggttggccagggctggtttccggttggtatggtttccaacattcaaatgacgtacttgggagtcggccat

SEQ ID NO: 418784 - DNA, 140 bp, Artificial Sequence
  Synthetic
atggccgactcccaagtacgtcatttgaatgttggaaaccataccaaccggaaaccagccctggccaacctccttctatgaatccagctatggctccaaatagccctctacttgatctggggagacccagcatggcgtat

SEQ ID NO: 418785 - DNA, 140 bp, Artificial Sequence
  Synthetic
aggccctggctgctgatatggcagaactccaagatatcgaaaatgacgagaaaattccgaaaacaaagaacttgaagaaaacgagccagttaaaatgggcacttggtgaaaacatggcacgaccttttgggacagcggtg

SEQ ID NO: 418786 - DNA, 140 bp, Artificial Sequence
  Synthetic
caccgctgtcccaaaaggtcgtgccatgttttcaccaagtgcccattttaactggctcgttttcttcaagttctttgttttcggaattttctcgtcattttcgatatcttggagttctgccatatcagcagccagggcct

SEQ ID NO: 418787 - DNA, 140 bp, Artificial Sequence
  Synthetic
atacgccatgctgggtctcccttgaagaaaacgagccagttaaaatgggcacttggtgaaaacatggcaccagagaaagtagactttgaagactgcaaaaatgttagtgatctaagacagcgtacttgggagtcggccat

SEQ ID NO: 418788 - DNA, 140 bp, Artificial Sequence
  Synthetic
atggccgactcccaagtacgctgtcttagatcactaacatttttgcagtcttcaaagtctactttctctggtgccatgttttcaccaagtgcccattttaactggctcgttttcttcaagggagacccagcatggcgtat

SEQ ID NO: 418789 - DNA, 140 bp, Artificial Sequence
  Synthetic
aggccctggctgctgatatgtgaattcaacaaggcctgcgaattgacagattcaagttggattgaacttgatgagataggggaggatgttgctccaatcgagcacattgcaagtatgagagaccttttgggacagcggtg

SEQ ID NO: 418790 - DNA, 140 bp, Artificial Sequence
  Synthetic
caccgctgtcccaaaaggtctctcatacttgcaatgtgctcgattggagcaacatcctcccctatctcatcaagttcaatccaacttgaatctgtcaattcgcaggccttgttgaattcacatatcagcagccagggcct

SEQ ID NO: 418791 - DNA, 140 bp, Artificial Sequence
  Synthetic
atacgccatgctgggtctccatgagataggggaggatgttgctccaatcgagcacattgcaagtatgagaaggaactacttcacagcagaagtatcccactgcagggccactgaatacatcgtacttgggagtcggccat

SEQ ID NO: 418792 - DNA, 140 bp, Artificial Sequence
  Synthetic
atggccgactcccaagtacgatgtattcagtggccctgcagtgggatacttctgctgtgaagtagttccttctcatacttgcaatgtgctcgattggagcaacatcctcccctatctcatggagacccagcatggcgtat

SEQ ID NO: 418793 - DNA, 140 bp, Artificial Sequence
  Synthetic
atacgccatgctgggtctccatcaatgcatggaaactattcggaacgggacctataataggagaaagtacaaagaggaatcaagactagaaaggcagaaaatagagggagttaaactggacgtacttgggagtcggccat

SEQ ID NO: 418794 - DNA, 140 bp, Artificial Sequence
  Synthetic
atggccgactcccaagtacgtccagtttaactccctctattttctgcctttctagtcttgattcctctttgtactttctcctattataggtcccgttccgaatagtttccatgcattgatggagacccagcatggcgtat

SEQ ID NO: 418795 - DNA, 140 bp, Artificial Sequence
  Synthetic
aggccctggctgctgatatgccatggatgacttccagctaattccgatgataagcaaatgcagaaccaaagaaggaagacgtaaaactaatttgtatggtttcattataaaaggaagatcgaccttttgggacagcggtg

SEQ ID NO: 418796 - DNA, 140 bp, Artificial Sequence
  Synthetic
caccgctgtcccaaaaggtcgatcttccttttataatgaaaccatacaaattagttttacgtcttccttctttggttctgcatttgcttatcatcggaattagctggaagtcatccatggcatatcagcagccagggcct

SEQ ID NO: 418797 - DNA, 140 bp, Artificial Sequence
  Synthetic
atacgccatgctgggtctccagtttcataagagggaagaaagtgattccaagaggaaagctttccacaagaggggtccagattgcttcaaatgagaatgtggaaaccatggactccaatacgtacttgggagtcggccat

SEQ ID NO: 418798 - DNA, 140 bp, Artificial Sequence
  Synthetic
atggccgactcccaagtacgtattggagtccatggtttccacattctcatttgaagcaatctggacccctcttgtggaaagctttcctcttggaatcactttcttccctcttatgaaactggagacccagcatggcgtat

SEQ ID NO: 418799 - DNA, 140 bp, Artificial Sequence
  Synthetic
aggccctggctgctgatatgcaatgataagcaaatgtaggaccaaagaaggaagacgaagaacaaatctgtacggtttcattataaaaggaaggtcccatctgagaaatgatactgacgtgaccttttgggacagcggtg

SEQ ID NO: 418800 - DNA, 140 bp, Artificial Sequence
  Synthetic
caccgctgtcccaaaaggtcacgtcagtatcatttctcagatgggaccttccttttataatgaaaccgtacagatttgttcttcgtcttccttctttggtcctacatttgcttatcattgcatatcagcagccagggcct

SEQ ID NO: 418801 - DNA, 140 bp, Artificial Sequence
  Synthetic
atacgccatgctgggtctcctgcaggacaggtcagcgttcaacccactttctcagtacagagaaatcttccattcgaaagagcaacaatcatggcagcatttacagggaatgctgagggtcgtacttgggagtcggccat

SEQ ID NO: 418802 - DNA, 140 bp, Artificial Sequence
  Synthetic
atggccgactcccaagtacgaccctcagcattccctgtaaatgctgccatgattgttgctctttcgaatggaagatttctctgtactgagaaagtgggttgaacgctgacctgtcctgcaggagacccagcatggcgtat

SEQ ID NO: 418803 - DNA, 140 bp, Artificial Sequence
  Synthetic
aggccctggctgctgatatgtccaaatgcactgctgaaacaccgatttgaaataattgaaggaagagaccgaacaatggcctggacagtggtgaatagtatctgcaacaccacaggagtcgaccttttgggacagcggtg

SEQ ID NO: 418804 - DNA, 140 bp, Artificial Sequence
  Synthetic
caccgctgtcccaaaaggtcgactcctgtggtgttgcagatactattcaccactgtccaggccattgttcggtctcttccttcaattatttcaaatcggtgtttcagcagtgcatttggacatatcagcagccagggcct

SEQ ID NO: 418805 - DNA, 140 bp, Artificial Sequence
  Synthetic
atacgccatgctgggtctccacacaaataccagcagaaatgctcgcaaacattgatcttaaatacttcaatgagtcaactaaaaagaaaattgaaaaaataagacctctattaatagatgcgtacttgggagtcggccat

SEQ ID NO: 418806 - DNA, 140 bp, Artificial Sequence
  Synthetic
atggccgactcccaagtacgcatctattaatagaggtcttattttttcaattttctttttagttgactcattgaagtatttaagatcaatgtttgcgagcatttctgctggtatttgtgtggagacccagcatggcgtat

SEQ ID NO: 418807 - DNA, 140 bp, Artificial Sequence
  Synthetic
atacgccatgctgggtctccttggctaccagtcaacaaactccacagagactgttgatacactaatagaaaacaatgttcctgtgacacataccaaagaattgctacacacagagcacaacgtacttgggagtcggccat

SEQ ID NO: 418808 - DNA, 140 bp, Artificial Sequence
  Synthetic
atggccgactcccaagtacgttgtgctctgtgtgtagcaattctttggtatgtgtcacaggaacattgttttctattagtgtatcaacagtctctgtggagtttgttgactggtagccaaggagacccagcatggcgtat

SEQ ID NO: 418809 - DNA, 140 bp, Artificial Sequence
  Synthetic
aggccctggctgctgatatgtcggctatcaatcaacaaactccacagaaactgtagacacactaacagaaaacaatgtccctgtgacacatgccaaagaactgctccacacagagcataagaccttttgggacagcggtg

SEQ ID NO: 418810 - DNA, 140 bp, Artificial Sequence
  Synthetic
caccgctgtcccaaaaggtcttatgctctgtgtggagcagttctttggcatgtgtcacagggacattgttttctgttagtgtgtctacagtttctgtggagtttgttgattgatagccgacatatcagcagccagggcct

SEQ ID NO: 418811 - DNA, 140 bp, Artificial Sequence
  Synthetic
atacgccatgctgggtctccatggaaacagtaacactgatgactatactactatttgtaacaacaagcaatgcagacaaaatctgtatcggccaccaatcaacaaattctacagaaactgcgtacttgggagtcggccat

SEQ ID NO: 418812 - DNA, 140 bp, Artificial Sequence
  Synthetic
atggccgactcccaagtacgcagtttctgtagaatttgttgattggtggccgatacagattttgtctgcattgcttgttgttacaaatagtagtatagtcatcagtgttactgtttccatggagacccagcatggcgtat

SEQ ID NO: 418813 - DNA, 140 bp, Artificial Sequence
  Synthetic
aggccctggctgctgatatggctaagggagcaattgagttcagtatcttcatttgagagattcgaaatattccccaaagaaagctcatggcccaaccacactgcaaccggagtgtcagccgaccttttgggacagcggtg

SEQ ID NO: 418814 - DNA, 140 bp, Artificial Sequence
  Synthetic
caccgctgtcccaaaaggtcggctgacactccggttgcagtgtggttgggccatgagctttctttggggaatatttcgaatctctcaaatgaagatactgaactcaattgctcccttagccatatcagcagccagggcct

SEQ ID NO: 418815 - DNA, 140 bp, Artificial Sequence
  Synthetic
atacgccatgctgggtctccgagaaggggaagtggacaacaaacactgagactggagcactccagctcaatccaatcgatgggccattacctgaagataacgagccaagcggatatgcaccgtacttgggagtcggccat

SEQ ID NO: 418816 - DNA, 140 bp, Artificial Sequence
  Synthetic
atggccgactcccaagtacggtgcatatccgcttggctcgttatcttcaggtaatggcccatcgattggattgagctggagtgctccagtctcagtgtttgttgtccacttccccttctcggagacccagcatggcgtat

SEQ ID NO: 418817 - DNA, 140 bp, Artificial Sequence
  Synthetic
aggccctggctgctgatatgtccaatcgatgggccattacctgaagataacgagccaagcggatatgcacaaacagactgtgtgttggaagcaatggccttccttgaggagtcccacccagaccttttgggacagcggtg

SEQ ID NO: 418818 - DNA, 140 bp, Artificial Sequence
  Synthetic
caccgctgtcccaaaaggtctgggtgggactcctcaaggaaggccattgcttccaacacacagtctgtttgtgcatatccgcttggctcgttatcttcaggtaatggcccatcgattggacatatcagcagccagggcct

SEQ ID NO: 418819 - DNA, 140 bp, Artificial Sequence
  Synthetic
aggccctggctgctgatatgccagccaaaagcatggaatatgatgccgttgcaactacacactcctggattcccaagaggaatcgctctattctcaacacaagccaaaggggaattcttggaccttttgggacagcggtg

SEQ ID NO: 418820 - DNA, 140 bp, Artificial Sequence
  Synthetic
caccgctgtcccaaaaggtccaagaattcccctttggcttgtgttgagaatagagcgattcctcttgggaatccaggagtgtgtagttgcaacggcatcatattccatgcttttggctggcatatcagcagccagggcct

SEQ ID NO: 418821 - DNA, 140 bp, Artificial Sequence
  Synthetic
atacgccatgctgggtctccgcgagtggacaaactgactcaaggtcgccagacctatgactggactttgaatagaaaccagcctgctgcaactgctttggccaacaccatagaggtcttccgtacttgggagtcggccat

SEQ ID NO: 418822 - DNA, 140 bp, Artificial Sequence
  Synthetic
atggccgactcccaagtacggaagacctctatggtgttggccaaagcagttgcagcaggctggtttctattcaaagtccagtcataggtctggcgaccttgagtcagtttgtccactcgcggagacccagcatggcgtat

SEQ ID NO: 418823 - DNA, 140 bp, Artificial Sequence
  Synthetic
atacgccatgctgggtctccgggataccgctatatgatgcgatcaaatgcatgaaaacattcttcggctggaaagagcccaacattatcaaaccacatgagaaaggcataaaccccaattcgtacttgggagtcggccat

SEQ ID NO: 418824 - DNA, 140 bp, Artificial Sequence
  Synthetic
atggccgactcccaagtacgaattggggtttatgcctttctcatgtggtttgataatgttgggctctttccagccgaagaatgttttcatgcatttgatcgcatcatatagcggtatcccggagacccagcatggcgtat

SEQ ID NO: 418825 - DNA, 140 bp, Artificial Sequence
  Synthetic
aggccctggctgctgatatgccaaagtaagagatcaggaaggaagaatcaactactactggactctgctggaacccggggatacaataatatttgaggcaaatggaaatctaatagcgccgaccttttgggacagcggtg

SEQ ID NO: 418826 - DNA, 140 bp, Artificial Sequence
  Synthetic
caccgctgtcccaaaaggtcggcgctattagatttccatttgcctcaaatattattgtatccccgggttccagcagagtccagtagtagttgattcttccttcctgatctcttactttggcatatcagcagccagggcct

SEQ ID NO: 418827 - DNA, 140 bp, Artificial Sequence
  Synthetic
atacgccatgctgggtctcccaaggatgtaatggagtcaatggacaaagaaaagatggaggtaataacacattttcagagaaaaagaagagtaagggacaacatgaccaaaaaaatgatccgtacttgggagtcggccat

SEQ ID NO: 418828 - DNA, 140 bp, Artificial Sequence
  Synthetic
atggccgactcccaagtacggatcatttttttggtcatgttgtcccttactcttctttttctctgaaaatgtgttattacctccatcttttctttgtccattgactccattacatccttgggagacccagcatggcgtat

SEQ ID NO: 418829 - DNA, 140 bp, Artificial Sequence
  Synthetic
atacgccatgctgggtctccacacaaagaacaataggcaagaaaaagcaggggctgaacaaaaggagttacttaataagagctttgacactaaacacaatgacaaaagatgcagaaagagcgtacttgggagtcggccat

SEQ ID NO: 418830 - DNA, 140 bp, Artificial Sequence
  Synthetic
atggccgactcccaagtacgctctttctgcatcttttgtcattgtgtttagtgtcaaagctcttattaagtaactccttttgttcagcccctgctttttcttgcctattgttctttgtgtggagacccagcatggcgtat

SEQ ID NO: 418831 - DNA, 140 bp, Artificial Sequence
  Synthetic
aggccctggctgctgatatggctataaacagcagtcttcctttccagaatgtacacccagtcacaataggagaatgtccaaagtatgtcaggagtgcaaaattaaggatggttacaggacgaccttttgggacagcggtg

SEQ ID NO: 418832 - DNA, 140 bp, Artificial Sequence
  Synthetic
caccgctgtcccaaaaggtcgtcctgtaaccatccttaattttgcactcctgacatactttggacattctcctattgtgactgggtgtacattctggaaaggaagactgctgtttatagccatatcagcagccagggcct

SEQ ID NO: 418833 - DNA, 140 bp, Artificial Sequence
  Synthetic
atacgccatgctgggtctccgaaagttaaagaggcgagcaattgcaacaccgggaatgcaaattagaggatttgtgtattttgtggaaacactagcgaggagcatatgtgagaaacttgacgtacttgggagtcggccat

SEQ ID NO: 418834 - DNA, 140 bp, Artificial Sequence
  Synthetic
atggccgactcccaagtacgtcaagtttctcacatatgctcctcgctagtgtttccacaaaatacacaaatcctctaatttgcattcccggtgttgcaattgctcgcctctttaactttcggagacccagcatggcgtat

SEQ ID NO: 418835 - DNA, 140 bp, Artificial Sequence
  Synthetic
aggccctggctgctgatatgtttgtgtattttgtggaaacactagcgaggagcatatgtgagaaacttgagcaatccgggctcccagttggagggaatgagaagaaggctaaattggcaagaccttttgggacagcggtg

SEQ ID NO: 418836 - DNA, 140 bp, Artificial Sequence
  Synthetic
caccgctgtcccaaaaggtcttgccaatttagccttcttctcattccctccaactgggagcccggattgctcaagtttctcacatatgctcctcgctagtgtttccacaaaatacacaaacatatcagcagccagggcct

SEQ ID NO: 418837 - DNA, 140 bp, Artificial Sequence
  Synthetic
atacgccatgctgggtctccacaatcactggagacaataccaaatggaacgagaaccagaatcctcgtatatttctggcaatgataacatacatcacaaggaaccaacctgaatggttcacgtacttgggagtcggccat

SEQ ID NO: 418838 - DNA, 140 bp, Artificial Sequence
  Synthetic
atggccgactcccaagtacgtgaaccattcaggttggttccttgtgatgtatgttatcattgccagaaatatacgaggattctggttctcgttccatttggtattgtctccagtgattgtggagacccagcatggcgtat

SEQ ID NO: 418839 - DNA, 140 bp, Artificial Sequence
  Synthetic
atacgccatgctgggtctcccgatgataagcaaatgcagaaccaaggaaggaagacggaaaactaacctgtatggattcattataaaaggaagatcccacttgaggaatgataccgatgtcgtacttgggagtcggccat

SEQ ID NO: 418840 - DNA, 140 bp, Artificial Sequence
  Synthetic
atggccgactcccaagtacgacatcggtatcattcctcaagtgggatcttccttttataatgaatccatacaggttagttttccgtcttccttccttggttctgcatttgcttatcatcgggagacccagcatggcgtat

SEQ ID NO: 418841 - DNA, 140 bp, Artificial Sequence
  Synthetic
aggccctggctgctgatatgaataccagcagaaatgcttgcaaacattgatctgaaatatttcaacgaatcaacgaaaaagaaaattatgaaaataagacctatcctaatagatggcacagaccttttgggacagcggtg

SEQ ID NO: 418842 - DNA, 140 bp, Artificial Sequence
  Synthetic
caccgctgtcccaaaaggtctgtgccatctattaggataggtcttattttcataattttctttttcgttgattcgttgaaatatttcagatcaatgtttgcaagcatttctgctggtattcatatcagcagccagggcct

SEQ ID NO: 418843 - DNA, 140 bp, Artificial Sequence
  Synthetic
atacgccatgctgggtctcccaacgaaaaagaaaattatgaaaataagacctatcctaatagatggcacagcctcattaagccctggaatgatgatgggcatgtttaacatgctaagtaccgtacttgggagtcggccat

SEQ ID NO: 418844 - DNA, 140 bp, Artificial Sequence
  Synthetic
atggccgactcccaagtacggtacttagcatgttaaacatgcccatcatcattccagggcttaatgaggctgtgccatctattaggataggtcttattttcataattttctttttcgttgggagacccagcatggcgtat

SEQ ID NO: 418845 - DNA, 140 bp, Artificial Sequence
  Synthetic
aggccctggctgctgatatgtaggaatggaccaacaacaagtacagttcactatccaaaggtatataaaacttatttcgaaaaagttgaaaggttgaaacacgggacctttggccctgtagaccttttgggacagcggtg

SEQ ID NO: 418846 - DNA, 140 bp, Artificial Sequence
  Synthetic
caccgctgtcccaaaaggtctacagggccaaaggtcccgtgtttcaacctttcaactttttcgaaataagttttatatacctttggatagtgaactgtacttgttgttggtccattcctacatatcagcagccagggcct

SEQ ID NO: 418847 - DNA, 140 bp, Artificial Sequence
  Synthetic
aggccctggctgctgatatgtttttccctagtagttcatataggagaccgattggaatttctagcatggtggaggccatggtgtctagggcccggattgatgccagaattgacttcgagtgaccttttgggacagcggtg

SEQ ID NO: 418848 - DNA, 140 bp, Artificial Sequence
  Synthetic
caccgctgtcccaaaaggtcactcgaagtcaattctggcatcaatccgggccctagacaccatggcctccaccatgctagaaattccaatcggtctcctatatgaactactagggaaaaacatatcagcagccagggcct

SEQ ID NO: 418849 - DNA, 140 bp, Artificial Sequence
  Synthetic
atacgccatgctgggtctccatggactccaacaccatgtcaagctttcaggtagactgtttcctttggcatatccgcaagcgatttgcagacaatggattgggtgatgccccattccttgcgtacttgggagtcggccat

SEQ ID NO: 418850 - DNA, 140 bp, Artificial Sequence
  Synthetic
atggccgactcccaagtacgcaaggaatggggcatcacccaatccattgtctgcaaatcgcttgcggatatgccaaaggaaacagtctacctgaaagcttgacatggtgttggagtccatggagacccagcatggcgtat

SEQ ID NO: 418851 - DNA, 140 bp, Artificial Sequence
  Synthetic
atacgccatgctgggtctcccaagttcgctgcaatatgcacacacttagaagtctgtttcatgtattcggatttccatttcatcgatgaacggggtgaatcagtaattgtagaatctggtcgtacttgggagtcggccat

SEQ ID NO: 418852 - DNA, 140 bp, Artificial Sequence
  Synthetic
atggccgactcccaagtacgaccagattctacaattactgattcaccccgttcatcgatgaaatggaaatccgaatacatgaaacagacttctaagtgtgtgcatattgcagcgaacttgggagacccagcatggcgtat

SEQ ID NO: 418853 - DNA, 140 bp, Artificial Sequence
  Synthetic
aggccctggctgctgatatgtaatgaatcggctgacatgagcattggagtaacagtgataaagaacaatatgataaacaatgaccttggaccagcaacagctcagatggctcttcaactggaccttttgggacagcggtg

SEQ ID NO: 418854 - DNA, 140 bp, Artificial Sequence
  Synthetic
caccgctgtcccaaaaggtccagttgaagagccatctgagctgttgctggtccaaggtcattgtttatcatattgttctttatcactgttactccaatgctcatgtcagccgattcattacatatcagcagccagggcct

SEQ ID NO: 418855 - DNA, 140 bp, Artificial Sequence
  Synthetic
atacgccatgctgggtctccaattcaaacaaggagatctttcgagctgaagaaactgtgggagcaaacccgctcaaaagcaggactgttggtttcagatggcgggccaaacctatacaaccgtacttgggagtcggccat

SEQ ID NO: 418856 - DNA, 140 bp, Artificial Sequence
  Synthetic
atggccgactcccaagtacggttgtataggtttggcccgccatctgaaaccaacagtcctgcttttgagcgggtttgctcccacagtttcttcagctcgaaagatctccttgtttgaattggagacccagcatggcgtat

SEQ ID NO: 418857 - DNA, 140 bp, Artificial Sequence
  Synthetic
aggccctggctgctgatatggctcaaaagcaggactgttggtttcagatggcgggccaaacctatacaacatccggaatctccatattccagaggtctgcctgaaatgggaattaatggagaccttttgggacagcggtg

SEQ ID NO: 418858 - DNA, 140 bp, Artificial Sequence
  Synthetic
caccgctgtcccaaaaggtctccattaattcccatttcaggcagacctctggaatatggagattccggatgttgtataggtttggcccgccatctgaaaccaacagtcctgcttttgagccatatcagcagccagggcct

SEQ ID NO: 418859 - DNA, 140 bp, Artificial Sequence
  Synthetic
atacgccatgctgggtctccatccggaatctccatattccagaggtctgcctgaaatgggaattaatggatgaagactatcagggcaggctttgtaaccctctcaacccatttgtcaccccgtacttgggagtcggccat

SEQ ID NO: 418860 - DNA, 140 bp, Artificial Sequence
  Synthetic
atggccgactcccaagtacggggtgacaaatgggttgagagggttacaaagcctgccctgatagtcttcatccattaattcccatttcaggcagacctctggaatatggagattccggatggagacccagcatggcgtat

SEQ ID NO: 418861 - DNA, 140 bp, Artificial Sequence
  Synthetic
aggccctggctgctgatatgtgaagactatcagggcaggctttgtaaccctctcaacccatttgtcacccataaggaaattgagtctgtaaacaatgctgtagtgatgccagctcatggtgaccttttgggacagcggtg

SEQ ID NO: 418862 - DNA, 140 bp, Artificial Sequence
  Synthetic
caccgctgtcccaaaaggtcaccatgagctggcatcactacagcattgtttacagactcaatttccttatgggtgacaaatgggttgagagggttacaaagcctgccctgatagtcttcacatatcagcagccagggcct

SEQ ID NO: 418863 - DNA, 140 bp, Artificial Sequence
  Synthetic
atacgccatgctgggtctccataaggaaattgagtctgtaaacaatgctgtagtgatgccagctcatggtccagccaaaagcatggaatatgatgctgttgcaaccactcactcatggatcgtacttgggagtcggccat

SEQ ID NO: 418864 - DNA, 140 bp, Artificial Sequence
  Synthetic
atggccgactcccaagtacgatccatgagtgagtggttgcaacagcatcatattccatgcttttggctggaccatgagctggcatcactacagcattgtttacagactcaatttccttatggagacccagcatggcgtat

SEQ ID NO: 418865 - DNA, 140 bp, Artificial Sequence
  Synthetic
aggccctggctgctgatatgcttcatgccatgacggcatctcaagaatgtcgatctgcatgtcaggacctaataacaatgcttcggcagtggtctggtacaatggaaggccagtcaccgagaccttttgggacagcggtg

SEQ ID NO: 418866 - DNA, 140 bp, Artificial Sequence
  Synthetic
caccgctgtcccaaaaggtctcggtgactggccttccattgtaccagaccactgccgaagcattgttattaggtcctgacatgcagatcgacattcttgagatgccgtcatggcatgaagcatatcagcagccagggcct

SEQ ID NO: 418867 - DNA, 140 bp, Artificial Sequence
  Synthetic
atacgccatgctgggtctccccctaagagaaatcgttccattctcaataccagccaaagggggatccttgaagatgagcagatgtaccaaaagtgctgcaatctatttgaaaaattcttccgtacttgggagtcggccat

SEQ ID NO: 418868 - DNA, 140 bp, Artificial Sequence
  Synthetic
atggccgactcccaagtacggaagaatttttcaaatagattgcagcacttttggtacatctgctcatcttcaaggatccccctttggctggtattgagaatggaacgatttctcttagggggagacccagcatggcgtat

SEQ ID NO: 418869 - DNA, 140 bp, Artificial Sequence
  Synthetic
aggccctggctgctgatatgcatggtatctagggcccgaattgatgcacggattgacttcgagtctggaaggattaagaaagaagagtttgctgagatcatgaagatctgttccaccattgaccttttgggacagcggtg

SEQ ID NO: 418870 - DNA, 140 bp, Artificial Sequence
  Synthetic
caccgctgtcccaaaaggtcaatggtggaacagatcttcatgatctcagcaaactcttctttcttaatccttccagactcgaagtcaatccgtgcatcaattcgggccctagataccatgcatatcagcagccagggcct

SEQ ID NO: 418871 - DNA, 140 bp, Artificial Sequence
  Synthetic
aggccctggctgctgatatgacggattgacttcgagtctggaaggattaagaaagaagagtttgctgagatcatgaagatctgttccaccattgaagagctcagacggcaaaaacagtgagaccttttgggacagcggtg

SEQ ID NO: 418872 - DNA, 140 bp, Artificial Sequence
  Synthetic
caccgctgtcccaaaaggtctcactgtttttgccgtctgagctcttcaatggtggaacagatcttcatgatctcagcaaactcttctttcttaatccttccagactcgaagtcaatccgtcatatcagcagccagggcct

SEQ ID NO: 418873 - DNA, 140 bp, Artificial Sequence
  Synthetic
aggccctggctgctgatatgttgcaaggacattggcgatctaaaacagtatgatagtgatgaaccggagcctagatcgctagcaagctggatccagagtgaattcaataaggcatgtgaagaccttttgggacagcggtg

SEQ ID NO: 418874 - DNA, 140 bp, Artificial Sequence
  Synthetic
caccgctgtcccaaaaggtcttcacatgccttattgaattcactctggatccagcttgctagcgatctaggctccggttcatcactatcatactgttttagatcgccaatgtccttgcaacatatcagcagccagggcct

SEQ ID NO: 418875 - DNA, 140 bp, Artificial Sequence
  Synthetic
aggccctggctgctgatatgacacatcaggaagacaggagaagaatcccgcactcaggatgaaatggatgatggcgatgaaatatccgatcactgctgacaaaaggataatggaaatgatgaccttttgggacagcggtg

SEQ ID NO: 418876 - DNA, 140 bp, Artificial Sequence
  Synthetic
caccgctgtcccaaaaggtcatcatttccattatccttttgtcagcagtgatcggatatttcatcgccatcatccatttcatcctgagtgcgggattcttctcctgtcttcctgatgtgtcatatcagcagccagggcct

SEQ ID NO: 418877 - DNA, 140 bp, Artificial Sequence
  Synthetic
aggccctggctgctgatatgtaaacaggacaggaacatttgaattcacaagttttttctaccgctatggatttgtagccaacttcagcatggagttgcccagctttggagtgtctgggatgaccttttgggacagcggtg

SEQ ID NO: 418878 - DNA, 140 bp, Artificial Sequence
  Synthetic
caccgctgtcccaaaaggtcatcccagacactccaaagctgggcaactccatgctgaagttggctacaaatccatagcggtagaaaaaacttgtgaattcaaatgttcctgtcctgtttacatatcagcagccagggcct

SEQ ID NO: 418879 - DNA, 140 bp, Artificial Sequence
  Synthetic
aggccctggctgctgatatgcaggatcggacagagtgatggtgtcccctcttgctgtgacgtggtggaacaggaatgggccaactacaagcacagttcattatccaaaggtatacaaaacgaccttttgggacagcggtg

SEQ ID NO: 418880 - DNA, 140 bp, Artificial Sequence
  Synthetic
caccgctgtcccaaaaggtcgttttgtatacctttggataatgaactgtgcttgtagttggcccattcctgttccaccacgtcacagcaagaggggacaccatcactctgtccgatcctgcatatcagcagccagggcct

SEQ ID NO: 418881 - DNA, 140 bp, Artificial Sequence
  Synthetic
atacgccatgctgggtctccaggaatgggccaactacaagcacagttcattatccaaaggtatacaaaacgtactttgaaaaggtcgaaaggttgaagcatggaattttcggccctgtaccgtacttgggagtcggccat

SEQ ID NO: 418882 - DNA, 140 bp, Artificial Sequence
  Synthetic
atggccgactcccaagtacggtacagggccgaaaattccatgcttcaacctttcgaccttttcaaagtacgttttgtatacctttggataatgaactgtgcttgtagttggcccattcctggagacccagcatggcgtat

SEQ ID NO: 418883 - DNA, 140 bp, Artificial Sequence
  Synthetic
aggccctggctgctgatatgcatgctgatcttagtgcaaaagaagcacaagatgtcatcatggaagtcgtctttccaaatgaagttggagccagggtattgacatcagagtcacagttgagaccttttgggacagcggtg

SEQ ID NO: 418884 - DNA, 140 bp, Artificial Sequence
  Synthetic
caccgctgtcccaaaaggtctcaactgtgactctgatgtcaataccctggctccaacttcatttggaaagacgacttccatgatgacatcttgtgcttcttttgcactaagatcagcatgcatatcagcagccagggcct

SEQ ID NO: 418885 - DNA, 140 bp, Artificial Sequence
  Synthetic
atacgccatgctgggtctccctttccaaatgaagttggagccagggtattgacatcagagtcacagttgacaataacaaaagaaaagaaagaggagcttcaagactgtaagattgctcctcgtacttgggagtcggccat

SEQ ID NO: 418886 - DNA, 140 bp, Artificial Sequence
  Synthetic
atggccgactcccaagtacgaggagcaatcttacagtcttgaagctcctctttcttttcttttgttattgtcaactgtgactctgatgtcaataccctggctccaacttcatttggaaagggagacccagcatggcgtat

SEQ ID NO: 418887 - DNA, 140 bp, Artificial Sequence
  Synthetic
aggccctggctgctgatatggctgtgccttgggcaccatgcagtaccaaacggaacgatagtgaaaacaatcacgaatgaccaaattgaagttactaatgctactgagctggttcagaatgaccttttgggacagcggtg

SEQ ID NO: 418888 - DNA, 140 bp, Artificial Sequence
  Synthetic
caccgctgtcccaaaaggtcattctgaaccagctcagtagcattagtaacttcaatttggtcattcgtgattgttttcactatcgttccgtttggtactgcatggtgcccaaggcacagccatatcagcagccagggcct

SEQ ID NO: 418889 - DNA, 140 bp, Artificial Sequence
  Synthetic
aggccctggctgctgatatgcctacctgtagctggcgggacaagcagcgtgtatatcgaggtattgcatttgactcaggggacctgctgggaacaaatgtacactccaggaggagaggtggaccttttgggacagcggtg

SEQ ID NO: 418890 - DNA, 140 bp, Artificial Sequence
  Synthetic
caccgctgtcccaaaaggtccacctctcctcctggagtgtacatttgttcccagcaggtcccctgagtcaaatgcaatacctcgatatacacgctgcttgtcccgccagctacaggtaggcatatcagcagccagggcct

SEQ ID NO: 418891 - DNA, 140 bp, Artificial Sequence
  Synthetic
atacgccatgctgggtctcctgactcaggggacctgctgggaacaaatgtacactccaggaggagaggtgaggaatgatgatgttgaccagagcttaatcattgctgccaggaacattgtcgtacttgggagtcggccat

SEQ ID NO: 418892 - DNA, 140 bp, Artificial Sequence
  Synthetic
atggccgactcccaagtacgacaatgttcctggcagcaatgattaagctctggtcaacatcatcattcctcacctctcctcctggagtgtacatttgttcccagcaggtcccctgagtcaggagacccagcatggcgtat

SEQ ID NO: 418893 - DNA, 140 bp, Artificial Sequence
  Synthetic
aggccctggctgctgatatgttgataacttaaattggtcaggatacagcggctccttcacactaccagtggagttaacaaaaagaaactgtctggttccatgtttttgggttgagatgatgaccttttgggacagcggtg

SEQ ID NO: 418894 - DNA, 140 bp, Artificial Sequence
  Synthetic
caccgctgtcccaaaaggtcatcatctcaacccaaaaacatggaaccagacagtttctttttgttaactccactggtagtgtgaaggagccgctgtatcctgaccaatttaagttatcaacatatcagcagccagggcct

SEQ ID NO: 418895 - DNA, 140 bp, Artificial Sequence
  Synthetic
aggccctggctgctgatatggccatagcacacaaattggaggaacacggatggtggacatccttagacaaaatccaacagaagagcaagccgtggacatatgcaaggcggcaatgggtctgaccttttgggacagcggtg

SEQ ID NO: 418896 - DNA, 140 bp, Artificial Sequence
  Synthetic
caccgctgtcccaaaaggtcagacccattgccgccttgcatatgtccacggcttgctcttctgttggattttgtctaaggatgtccaccatccgtgttcctccaatttgtgtgctatggccatatcagcagccagggcct

SEQ ID NO: 418897 - DNA, 140 bp, Artificial Sequence
  Synthetic
atacgccatgctgggtctcccaatgaatcggctgacatgagcattggagttacagtgataaagaacaatatgataaacaatgaccttggaccagcaacagctcagatggctcttcagttacgtacttgggagtcggccat

SEQ ID NO: 418898 - DNA, 140 bp, Artificial Sequence
  Synthetic
atggccgactcccaagtacgtaactgaagagccatctgagctgttgctggtccaaggtcattgtttatcatattgttctttatcactgtaactccaatgctcatgtcagccgattcattgggagacccagcatggcgtat

SEQ ID NO: 418899 - DNA, 140 bp, Artificial Sequence
  Synthetic
aggccctggctgctgatatgaaaagccaacaagataaaatccgagaagacacacattcacattttctcattcactggagaggaaatggccaccaaagcagactacacccttgatgaagaagaccttttgggacagcggtg

SEQ ID NO: 418900 - DNA, 140 bp, Artificial Sequence
  Synthetic
caccgctgtcccaaaaggtcttcttcatcaagggtgtagtctgctttggtggccatttcctctccagtgaatgagaaaatgtgaatgtgtgtcttctcggattttatcttgttggcttttcatatcagcagccagggcct

SEQ ID NO: 418901 - DNA, 140 bp, Artificial Sequence
  Synthetic
aggccctggctgctgatatgtgatagtgagtggaagagatgaacagtcaattgctgaagctatcattgtggcaatggtattttcacaagaagattgcatgataaaggcggtccgaggtgagaccttttgggacagcggtg

SEQ ID NO: 418902 - DNA, 140 bp, Artificial Sequence
  Synthetic
caccgctgtcccaaaaggtctcacctcggaccgcctttatcatgcaatcttcttgtgaaaataccattgccacaatgatagcttcagcaattgactgttcatctcttccactcactatcacatatcagcagccagggcct

SEQ ID NO: 418903 - DNA, 140 bp, Artificial Sequence
  Synthetic
atacgccatgctgggtctccgcaatggtattttcacaagaagattgcatgataaaggcggtccgaggtgatttgaactttgtgaacagagctaaccaacgactaaatcccatgcaccagccgtacttgggagtcggccat

SEQ ID NO: 418904 - DNA, 140 bp, Artificial Sequence
  Synthetic
atggccgactcccaagtacggctggtgcatgggatttagtcgttggttagctctgttcacaaagttcaaatcacctcggaccgcctttatcatgcaatcttcttgtgaaaataccattgcggagacccagcatggcgtat

SEQ ID NO: 418905 - DNA, 140 bp, Artificial Sequence
  Synthetic
atacgccatgctgggtctcctcctaagaggaaccgttccattctcaataccagccaaaggggaattcttgaggatgagcaaatgtaccagaagtgctgcagtctattcgaaaaattcttccgtacttgggagtcggccat

SEQ ID NO: 418906 - DNA, 140 bp, Artificial Sequence
  Synthetic
atggccgactcccaagtacggaagaatttttcgaatagactgcagcacttctggtacatttgctcatcctcaagaattcccctttggctggtattgagaatggaacggttcctcttaggaggagacccagcatggcgtat

SEQ ID NO: 418907 - DNA, 140 bp, Artificial Sequence
  Synthetic
aggccctggctgctgatatgattgaaactatcgacaacgtcatggggatgattggaatattgcccgacatgacccccagcacggacatgtcactaagaggagtaagagtgagcaaaatgggaccttttgggacagcggtg

SEQ ID NO: 418908 - DNA, 140 bp, Artificial Sequence
  Synthetic
caccgctgtcccaaaaggtcccattttgctcactcttactcctcttagtgacatgtccgtgctgggggtcatgtcgggcaatattccaatcatccccatgacgttgtcgatagtttcaatcatatcagcagccagggcct

SEQ ID NO: 418909 - DNA, 140 bp, Artificial Sequence
  Synthetic
atacgccatgctgggtctccgacccccagcacggacatgtcactaagaggagtaagagtgagcaaaatgggagtggatgaatattctagtactgagagaattgccgtgagcattgatcgtcgtacttgggagtcggccat

SEQ ID NO: 418910 - DNA, 140 bp, Artificial Sequence
  Synthetic
atggccgactcccaagtacgacgatcaatgctcacggcaattctctcagtactagaatattcatccactcccattttgctcactcttactcctcttagtgacatgtccgtgctgggggtcggagacccagcatggcgtat

SEQ ID NO: 418911 - DNA, 140 bp, Artificial Sequence
  Synthetic
aggccctggctgctgatatgactatgcccggactgtctcaactgtacagatctggatgtggccttgggcaggccaatgtgtgtggggaccacaccttctgctaaagcttcaatactccacgaccttttgggacagcggtg

SEQ ID NO: 418912 - DNA, 140 bp, Artificial Sequence
  Synthetic
caccgctgtcccaaaaggtcgtggagtattgaagctttagcagaaggtgtggtccccacacacattggcctgcccaaggccacatccagatctgtacagttgagacagtccgggcatagtcatatcagcagccagggcct

SEQ ID NO: 418913 - DNA, 140 bp, Artificial Sequence
  Synthetic
aggccctggctgctgatatgggtcagtgaaacacaaggaatggagaggttgactataacatattcatcttccatgatgtgggagattaacggacctgattcggtactaattaatacatacgaccttttgggacagcggtg

SEQ ID NO: 418914 - DNA, 140 bp, Artificial Sequence
  Synthetic
caccgctgtcccaaaaggtcgtatgtattaattagtaccgaatcaggtccgttaatctcccacatcatggaagatgaatatgttatagtcaacctctccattccttgtgtttcactgacccatatcagcagccagggcct

SEQ ID NO: 418915 - DNA, 140 bp, Artificial Sequence
  Synthetic
atacgccatgctgggtctcccacctgcttcgcgatacataactgacatgactattgaggaattgtcaagaaactggttcatgctaatgcccaagcagaaagtggaaggacctctttgcatcgtacttgggagtcggccat

SEQ ID NO: 418916 - DNA, 140 bp, Artificial Sequence
  Synthetic
atggccgactcccaagtacgatgcaaagaggtccttccactttctgcttgggcattagcatgaaccagtttcttgacaattcctcaatagtcatgtcagttatgtatcgcgaagcaggtgggagacccagcatggcgtat

SEQ ID NO: 418917 - DNA, 140 bp, Artificial Sequence
  Synthetic
aggccctggctgctgatatgcaatggatcattaggaactgggagaccgtgaagattcaatggtcccaagacccaacaatactatacaataaactggaatttgaaccctttcaatcgttgggaccttttgggacagcggtg

SEQ ID NO: 418918 - DNA, 140 bp, Artificial Sequence
  Synthetic
caccgctgtcccaaaaggtcccaacgattgaaagggttcaaattccagtttattgtatagtattgttgggtcttgggaccattgaatcttcacggtctcccagttcctaatgatccattgcatatcagcagccagggcct

SEQ ID NO: 418919 - DNA, 140 bp, Artificial Sequence
  Synthetic
aggccctggctgctgatatgccctgaaagaaatgagcaaggtcagactctttggagcaaaacaaatgatgctggatcagacagagtgatggtgtcacctctggctgtgacgtggtggaatgaccttttgggacagcggtg

SEQ ID NO: 418920 - DNA, 140 bp, Artificial Sequence
  Synthetic
caccgctgtcccaaaaggtcattccaccacgtcacagccagaggtgacaccatcactctgtctgatccagcatcatttgttttgctccaaagagtctgaccttgctcatttctttcagggcatatcagcagccagggcct

SEQ ID NO: 418921 - DNA, 140 bp, Artificial Sequence
  Synthetic
atacgccatgctgggtctcctcaatgtgatttttggccgactagagaccatagtattactaagggctttcaccgaagagggagcaattgttggcgaaatctcaccattgccttcttttcccgtacttgggagtcggccat

SEQ ID NO: 418922 - DNA, 140 bp, Artificial Sequence
  Synthetic
atggccgactcccaagtacgggaaaagaaggcaatggtgagatttcgccaacaattgctccctcttcggtgaaagcccttagtaatactatggtctctagtcggccaaaaatcacattgaggagacccagcatggcgtat

SEQ ID NO: 418923 - DNA, 140 bp, Artificial Sequence
  Synthetic
aggccctggctgctgatatgcaacagatgcgtgatgttttggggacattcgatactgtccaaataataaagctactaccatttgcagcagctccaccagtgcagagtaggatgcagttttgaccttttgggacagcggtg

SEQ ID NO: 418924 - DNA, 140 bp, Artificial Sequence
  Synthetic
caccgctgtcccaaaaggtcaaaactgcatcctactctgcactggtggagctgctgcaaatggtagtagctttattatttggacagtatcgaatgtccccaaaacatcacgcatctgttgcatatcagcagccagggcct

SEQ ID NO: 418925 - DNA, 140 bp, Artificial Sequence
  Synthetic
aggccctggctgctgatatgcttctctaaccgtgaatgtgaggggcactgggatgagaatacttgtgagaggtaactcccctgtgtttaattataacaaggcaaccaagaggcttatagtgaccttttgggacagcggtg

SEQ ID NO: 418926 - DNA, 140 bp, Artificial Sequence
  Synthetic
caccgctgtcccaaaaggtcactataagcctcttggttgccttgttataattaaacacaggggagttacctctcacaagtattctcatcccagtgcccctcacattcacggttagagaagcatatcagcagccagggcct

SEQ ID NO: 418927 - DNA, 140 bp, Artificial Sequence
  Synthetic
atacgccatgctgggtctcctaattggaagaattaattattattggtcagtactaaaaccaggccaaacattgcgagtaagatccaatgggaatctaattgctccatggtatggacatgtcgtacttgggagtcggccat

SEQ ID NO: 418928 - DNA, 140 bp, Artificial Sequence
  Synthetic
atggccgactcccaagtacgacatgtccataccatggagcaattagattcccattggatcttactcgcaatgtttggcctggttttagtactgaccaataataattaattcttccaattaggagacccagcatggcgtat

SEQ ID NO: 418929 - DNA, 140 bp, Artificial Sequence
  Synthetic
aggccctggctgctgatatgcctcggaaaggatgcaggtgcacttacagaggaccaagatgagggaacagcaggaatagagtctgcagtgttgagagggtttctgatcttgggcaaagaagaccttttgggacagcggtg

SEQ ID NO: 418930 - DNA, 140 bp, Artificial Sequence
  Synthetic
caccgctgtcccaaaaggtcttctttgcccaagatcagaaaccctctcaacactgcagactctattcctgctgttccctcatcttggtcctctgtaagtgcacctgcatcctttccgaggcatatcagcagccagggcct

SEQ ID NO: 418931 - DNA, 140 bp, Artificial Sequence
  Synthetic
atacgccatgctgggtctcccaataacaaaggaaaagaaggaggagcttcaggactgtaagattgctcctttaatggtggcatacatgttggagagagaactggttcgcaaaaccagattcgtacttgggagtcggccat

SEQ ID NO: 418932 - DNA, 140 bp, Artificial Sequence
  Synthetic
atggccgactcccaagtacgaatctggttttgcgaaccagttctctctccaacatgtatgccaccattaaaggagcaatcttacagtcctgaagctcctccttcttttcctttgttattgggagacccagcatggcgtat

SEQ ID NO: 418933 - DNA, 140 bp, Artificial Sequence
  Synthetic
aggccctggctgctgatatgtaaatgggaacggagacccaaacaacatggacagagcggtaaagctttacagaaagctgaagagagagataacattccacggtgctaaggaggtggcactgaccttttgggacagcggtg

SEQ ID NO: 418934 - DNA, 140 bp, Artificial Sequence
  Synthetic
caccgctgtcccaaaaggtcagtgccacctccttagcaccgtggaatgttatctctctcttcagctttctgtaaagctttaccgctctgtccatgttgtttgggtctccgttcccatttacatatcagcagccagggcct

SEQ ID NO: 418935 - DNA, 140 bp, Artificial Sequence
  Synthetic
atacgccatgctgggtctcctgactcaagggacctgctgggaacaaatgtacacaccgggaggggaggtgagaaatgatgatgttgatcagagtttaattattgctgctagaaatattgtcgtacttgggagtcggccat

SEQ ID NO: 418936 - DNA, 140 bp, Artificial Sequence
  Synthetic
atggccgactcccaagtacgacaatatttctagcagcaataattaaactctgatcaacatcatcatttctcacctcccctcccggtgtgtacatttgttcccagcaggtcccttgagtcaggagacccagcatggcgtat

SEQ ID NO: 418937 - DNA, 140 bp, Artificial Sequence
  Synthetic
atacgccatgctgggtctccatgagtcttctaaccgaggtcgaaacgtatgttctctccataatcccatcaggccccctcaaagccgagatcgcgcagagacttgaggatgtttttgcagcgtacttgggagtcggccat

SEQ ID NO: 418938 - DNA, 140 bp, Artificial Sequence
  Synthetic
atggccgactcccaagtacgctgcaaaaacatcctcaagtctctgcgcgatctcggctttgagggggcctgatgggattatggagagaacatacgtttcgacctcggttagaagactcatggagacccagcatggcgtat

SEQ ID NO: 418939 - DNA, 140 bp, Artificial Sequence
  Synthetic
aggccctggctgctgatatgaacagagaatagtttcgaacaaataacatttatgcaagccttacaactactgcttgaagtagagcaagagataagaactttctcgtttcagcttatttaagaccttttgggacagcggtg

SEQ ID NO: 418940 - DNA, 140 bp, Artificial Sequence
  Synthetic
caccgctgtcccaaaaggtcttaaataagctgaaacgagaaagttcttatctcttgctctacttcaagcagtagttgtaaggcttgcataaatgttatttgttcgaaactattctctgttcatatcagcagccagggcct

SEQ ID NO: 418941 - DNA, 140 bp, Artificial Sequence
  Synthetic
aggccctggctgctgatatgcagttactcaactggtgcgcttgccagttgcatgggtctcatatacaaccggatggggacagtgaacacagaagtggctcttggtctagtgtgtgccactgaccttttgggacagcggtg

SEQ ID NO: 418942 - DNA, 140 bp, Artificial Sequence
  Synthetic
caccgctgtcccaaaaggtcagtggcacacactagaccaagagccacttctgtgttcactgtccccatccggttgtatatgagacccatgcaactggcaagcgcaccagttgagtaactgcatatcagcagccagggcct

SEQ ID NO: 418943 - DNA, 140 bp, Artificial Sequence
  Synthetic
aggccctggctgctgatatggcaatggtgttctcacaagaggattgtatgataaaagcagtacgaggtgatttgaattttgtcaacagagcgaaccagcggctaaatcctatgcatcaacgaccttttgggacagcggtg

SEQ ID NO: 418944 - DNA, 140 bp, Artificial Sequence
  Synthetic
caccgctgtcccaaaaggtcgttgatgcataggatttagccgctggttcgctctgttgacaaaattcaaatcacctcgtactgcttttatcatacaatcctcttgtgagaacaccattgccatatcagcagccagggcct

SEQ ID NO: 418945 - DNA, 140 bp, Artificial Sequence
  Synthetic
atacgccatgctgggtctccaaccaccaacccactgatcaggcatgagaacagaatggtgctggccagcactacagctaaggccatggagcaggtggctggatcaagtgagcaggcagcacgtacttgggagtcggccat

SEQ ID NO: 418946 - DNA, 140 bp, Artificial Sequence
  Synthetic
atggccgactcccaagtacgtgctgcctgctcacttgatccagccacctgctccatggccttagctgtagtgctggccagcaccattctgttctcatgcctgatcagtgggttggtggttggagacccagcatggcgtat

SEQ ID NO: 418947 - DNA, 140 bp, Artificial Sequence
  Synthetic
atacgccatgctgggtctccattgaacccattgacaatgtcatggggatgatcggagtattacctgacatgacccccagcacagagctgtcactaagaggagtgagagtcagtaaaatggcgtacttgggagtcggccat

SEQ ID NO: 418948 - DNA, 140 bp, Artificial Sequence
  Synthetic
atggccgactcccaagtacgccattttactgactctcactcctcttagtgacagctctgtgctgggggtcatgtcaggtaatactccgatcatccccatgacattgtcaatgggttcaatggagacccagcatggcgtat

SEQ ID NO: 418949 - DNA, 140 bp, Artificial Sequence
  Synthetic
atacgccatgctgggtctccgacaattgggactcaccctagttccagtgcaggtctaaaagatgatcttattgaaaatttgcaggcttaccagaagcgaatggggttgcagatgcagcgacgtacttgggagtcggccat

SEQ ID NO: 418950 - DNA, 140 bp, Artificial Sequence
  Synthetic
atggccgactcccaagtacgtcgctgcatctgcaaccccattcgcttctggtaagcctgcaaattttcaataagatcatcttttagacctgcactggaactagggtgagtcccaattgtcggagacccagcatggcgtat

SEQ ID NO: 418951 - DNA, 140 bp, Artificial Sequence
  Synthetic
aggccctggctgctgatatgttgaaaatttgcaggcttaccagaagcgaatggggttgcagatgcagcgattcaagtgatcctctcgtcgttgcagcaagtgtcattgggatattgcactgaccttttgggacagcggtg

SEQ ID NO: 418952 - DNA, 140 bp, Artificial Sequence
  Synthetic
caccgctgtcccaaaaggtcagtgcaatatcccaatgacacttgctgcaacgacgagaggatcacttgaatcgctgcatctgcaaccccattcgcttctggtaagcctgcaaattttcaacatatcagcagccagggcct

SEQ ID NO: 418953 - DNA, 140 bp, Artificial Sequence
  Synthetic
atacgccatgctgggtctccatgaatccaaatcagagaataatagcacttggctctgcctccctagctgttgcgacaatatgtttactcattcagattgccatcttagcaacgactatgacgtacttgggagtcggccat

SEQ ID NO: 418954 - DNA, 140 bp, Artificial Sequence
  Synthetic
atggccgactcccaagtacgtcatagtcgttgctaagatggcaatctgaatgagtaaacatattgtcgcaacagctagggaggcagagccaagtgctattattctctgatttggattcatggagacccagcatggcgtat

SEQ ID NO: 418955 - DNA, 140 bp, Artificial Sequence
  Synthetic
aggccctggctgctgatatgacttccgaaaccaggttaaaatacgccgcagggtcgacataaacccaggccatgcagatcttagtgctaaggaagcacaagatgtcatcatggaggtcgtgaccttttgggacagcggtg

SEQ ID NO: 418956 - DNA, 140 bp, Artificial Sequence
  Synthetic
caccgctgtcccaaaaggtcacgacctccatgatgacatcttgtgcttccttagcactaagatctgcatggcctgggtttatgtcgaccctgcggcgtattttaacctggtttcggaagtcatatcagcagccagggcct

SEQ ID NO: 418957 - DNA, 140 bp, Artificial Sequence
  Synthetic
aggccctggctgctgatatgatgaatccaaaccagaagataacagcaattggctctatttctctaatcattgcgataatatgtctcctcatgcagattgccatcctaacaacgactatgagaccttttgggacagcggtg

SEQ ID NO: 418958 - DNA, 140 bp, Artificial Sequence
  Synthetic
caccgctgtcccaaaaggtctcatagtcgttgttaggatggcaatctgcatgaggagacatattatcgcaatgattagagaaatagagccaattgctgttatcttctggtttggattcatcatatcagcagccagggcct

SEQ ID NO: 418959 - DNA, 140 bp, Artificial Sequence
  Synthetic
aggccctggctgctgatatggctgatggatgcgctgaaattaagtatcgaagatccgagtcatgagggggaggggataccgctatatgatgcaatcaaatgcatgaaaacattttttggcgaccttttgggacagcggtg

SEQ ID NO: 418960 - DNA, 140 bp, Artificial Sequence
  Synthetic
caccgctgtcccaaaaggtcgccaaaaaatgttttcatgcatttgattgcatcatatagcggtatcccctccccctcatgactcggatcttcgatacttaatttcagcgcatccatcagccatatcagcagccagggcct

SEQ ID NO: 418961 - DNA, 140 bp, Artificial Sequence
  Synthetic
atacgccatgctgggtctcctccaaggacaactcaattaggctttctgcaggtggggatatttgggtgacaagagaaccctatgtgtcgtgcggtctcaacaagtgttaccaatttgcaccgtacttgggagtcggccat

SEQ ID NO: 418962 - DNA, 140 bp, Artificial Sequence
  Synthetic
atggccgactcccaagtacggtgcaaattggtaacacttgttgagaccgcacgacacatagggttctcttgtcacccaaatatccccacctgcagaaagcctaattgagttgtccttggaggagacccagcatggcgtat

SEQ ID NO: 418963 - DNA, 140 bp, Artificial Sequence
  Synthetic
atacgccatgctgggtctccttgggcagggaaccactttaaacaacaaacactcaaatggcacaacacatgatagaagtccctatagaacccttttgatgagcgaactgggtgttccattcgtacttgggagtcggccat

SEQ ID NO: 418964 - DNA, 140 bp, Artificial Sequence
  Synthetic
atggccgactcccaagtacgaatggaacacccagttcgctcatcaaaagggttctatagggacttctatcatgtgttgtgccatttgagtgtttgttgtttaaagtggttccctgcccaaggagacccagcatggcgtat

SEQ ID NO: 418965 - DNA, 140 bp, Artificial Sequence
  Synthetic
aggccctggctgctgatatggatagaagtccctatagaacccttttgatgagcgaactgggtgttccatttcatttgggaaccaaacaagtgtgcatcgcttggtccagctcaagctgccgaccttttgggacagcggtg

SEQ ID NO: 418966 - DNA, 140 bp, Artificial Sequence
  Synthetic
caccgctgtcccaaaaggtcggcagcttgagctggaccaagcgatgcacacttgtttggttcccaaatgaaatggaacacccagttcgctcatcaaaagggttctatagggacttctatccatatcagcagccagggcct

SEQ ID NO: 418967 - DNA, 140 bp, Artificial Sequence
  Synthetic
aggccctggctgctgatatgaggccccctcaaagccgagatcgcgcagagacttgaagatgtctttgcagggaagaacacagatctcgaggctctcatggaatggctaaagacaagaccagaccttttgggacagcggtg

SEQ ID NO: 418968 - DNA, 140 bp, Artificial Sequence
  Synthetic
caccgctgtcccaaaaggtctggtcttgtctttagccattccatgagagcctcgagatctgtgttcttccctgcaaagacatcttcaagtctctgcgcgatctcggctttgagggggcctcatatcagcagccagggcct

SEQ ID NO: 418969 - DNA, 140 bp, Artificial Sequence
  Synthetic
atacgccatgctgggtctccgctactgctagcattatttatgacggaatgcttaccgacagtattggttcatggtctaaaaacatcctcagaacccaggagtcagaatgcgtttgcatcacgtacttgggagtcggccat

SEQ ID NO: 418970 - DNA, 140 bp, Artificial Sequence
  Synthetic
atggccgactcccaagtacgtgatgcaaacgcattctgactcctgggttctgaggatgtttttagaccatgaaccaatactgtcggtaagcattccgtcataaataatgctagcagtagcggagacccagcatggcgtat

SEQ ID NO: 418971 - DNA, 140 bp, Artificial Sequence
  Synthetic
aggccctggctgctgatatgatggtctaaaaacatcctcagaacccaggagtcagaatgcgtttgcatcaatggaacgtgtgcagtagtaatgactgatggaagcgcatcagggagggctgaccttttgggacagcggtg

SEQ ID NO: 418972 - DNA, 140 bp, Artificial Sequence
  Synthetic
caccgctgtcccaaaaggtcagccctccctgatgcgcttccatcagtcattactactgcacacgttccattgatgcaaacgcattctgactcctgggttctgaggatgtttttagaccatcatatcagcagccagggcct

SEQ ID NO: 418973 - DNA, 140 bp, Artificial Sequence
  Synthetic
atacgccatgctgggtctcccgggaacaggatacaccatggatacagtcaacagaacacatcaatattcagaaaaggggaaatggacaacaaacacagagactggagcacctcaactcaacgtacttgggagtcggccat

SEQ ID NO: 418974 - DNA, 140 bp, Artificial Sequence
  Synthetic
atggccgactcccaagtacgttgagttgaggtgctccagtctctgtgtttgttgtccatttccccttttctgaatattgatgtgttctgttgactgtatccatggtgtatcctgttcccgggagacccagcatggcgtat

SEQ ID NO: 418975 - DNA, 140 bp, Artificial Sequence
  Synthetic
aggccctggctgctgatatgtagggtcgaatgcataggatggtcaagcacgtcatgccatgatggcatatcaaggatgtcaatatgcatatcaggaccgaataacaatgcatcggcagtggaccttttgggacagcggtg

SEQ ID NO: 418976 - DNA, 140 bp, Artificial Sequence
  Synthetic
caccgctgtcccaaaaggtccactgccgatgcattgttattcggtcctgatatgcatattgacatccttgatatgccatcatggcatgacgtgcttgaccatcctatgcattcgaccctacatatcagcagccagggcct

SEQ ID NO: 418977 - DNA, 140 bp, Artificial Sequence
  Synthetic
aggccctggctgctgatatgacccagaagttagatgtgtttgcagagacaattggaagggctccaatagacctgtgctatatataaatgtggcagattatagtattgattcaagttatgtgaccttttgggacagcggtg

SEQ ID NO: 418978 - DNA, 140 bp, Artificial Sequence
  Synthetic
caccgctgtcccaaaaggtcacataacttgaatcaatactataatctgccacatttatatatagcacaggtctattggagcccttccaattgtctctgcaaacacatctaacttctgggtcatatcagcagccagggcct

SEQ ID NO: 418979 - DNA, 140 bp, Artificial Sequence
  Synthetic
aggccctggctgctgatatgaccacgccctctcagattacctgatggtcctccttgctctcagcggtcgaaattcttactgatggatgcccttaaattgagcatcgaagacccaagccatgaccttttgggacagcggtg

SEQ ID NO: 418980 - DNA, 140 bp, Artificial Sequence
  Synthetic
caccgctgtcccaaaaggtcatggcttgggtcttcgatgctcaatttaagggcatccatcagtaagaatttcgaccgctgagagcaaggaggaccatcaggtaatctgagagggcgtggtcatatcagcagccagggcct

SEQ ID NO: 418981 - DNA, 140 bp, Artificial Sequence
  Synthetic
atacgccatgctgggtctccgaaagattcgcgtgcaggttatgagactttcaaggtcattggtggttggaacgcggctaattcaaagtcacaaataaataggcaagtcatagttgatagtcgtacttgggagtcggccat

SEQ ID NO: 418982 - DNA, 140 bp, Artificial Sequence
  Synthetic
atggccgactcccaagtacgactatcaactatgacttgcctatttatttgtgactttgaattagccgcgttccaaccaccaatgaccttgaaagtctcataacctgcacgcgaatctttcggagacccagcatggcgtat

SEQ ID NO: 418983 - DNA, 140 bp, Artificial Sequence
  Synthetic
aggccctggctgctgatatgacgcggctaattcaaagtcacaaataaataggcaagtcatagttgatagtgatagctggtctgggtattctggtatgttctctgttgaaggaaaaatctggaccttttgggacagcggtg

SEQ ID NO: 418984 - DNA, 140 bp, Artificial Sequence
  Synthetic
caccgctgtcccaaaaggtccagatttttccttcaacagagaacataccagaatacccagaccagctatcactatcaactatgacttgcctatttatttgtgactttgaattagccgcgtcatatcagcagccagggcct

SEQ ID NO: 418985 - DNA, 140 bp, Artificial Sequence
  Synthetic
aggccctggctgctgatatgtatacgggacctgcatcgtggcagtaacagatgggccagcagacaataaggctgaccataggatatattggataaaagaggggaaagtcataaaatacgagaccttttgggacagcggtg

SEQ ID NO: 418986 - DNA, 140 bp, Artificial Sequence
  Synthetic
caccgctgtcccaaaaggtctcgtattttatgactttcccctcttttatccaatatatcctatggtcagccttattgtctgctggcccatctgttactgccacgatgcaggtcccgtatacatatcagcagccagggcct

SEQ ID NO: 418987 - DNA, 140 bp, Artificial Sequence
  Synthetic
aggccctggctgctgatatgccagagtatggtggacttcaaatagcattattgtattttgtgggacttcaggtacatatggaacaggctcatggcctgatggggcggatatcaatttcatgaccttttgggacagcggtg

SEQ ID NO: 418988 - DNA, 140 bp, Artificial Sequence
  Synthetic
caccgctgtcccaaaaggtcatgaaattgatatccgccccatcaggccatgagcctgttccatatgtacctgaagtcccacaaaatacaataatgctatttgaagtccaccatactctggcatatcagcagccagggcct

SEQ ID NO: 418989 - DNA, 140 bp, Artificial Sequence
  Synthetic
aggccctggctgctgatatggagaaatttttccctagtagttcatacaggagaccggttggaatttctagcatggtagaggccatggtgtctagggcccggattgatgccaggattgactgaccttttgggacagcggtg

SEQ ID NO: 418990 - DNA, 140 bp, Artificial Sequence
  Synthetic
caccgctgtcccaaaaggtcagtcaatcctggcatcaatccgggccctagacaccatggcctctaccatgctagaaattccaaccggtctcctgtatgaactactagggaaaaatttctccatatcagcagccagggcct

SEQ ID NO: 418991 - DNA, 140 bp, Artificial Sequence
  Synthetic
aggccctggctgctgatatgatgaatccaaatcagaagataataacaattggtgtagtgaatacgactctatcaacaatagcccttcttattggaattgggaatctgattttcaacactggaccttttgggacagcggtg

SEQ ID NO: 418992 - DNA, 140 bp, Artificial Sequence
  Synthetic
caccgctgtcccaaaaggtccagtgttgaaaatcagattcccaattccaataagaagggctattgttgatagagtcgtattcactacaccaattgttattatcttctgatttggattcatcatatcagcagccagggcct

SEQ ID NO: 418993 - DNA, 140 bp, Artificial Sequence
  Synthetic
atacgccatgctgggtctccatcaacaatagcccttcttattggaattgggaatctgattttcaacactgttatacatgagaaaataggagtccaccaaactgtggtatgcccaacaatacgtacttgggagtcggccat

SEQ ID NO: 418994 - DNA, 140 bp, Artificial Sequence
  Synthetic
atggccgactcccaagtacgtattgttgggcataccacagtttggtggactcctattttctcatgtataacagtgttgaaaatcagattcccaattccaataagaagggctattgttgatggagacccagcatggcgtat

SEQ ID NO: 418995 - DNA, 140 bp, Artificial Sequence
  Synthetic
aggccctggctgctgatatgacatccccagcggtaccaaactgcagtgacaccacaattacatacaacaacactgtggtaaacaacataacaacaacaataataagtaaagcagaaaagcgaccttttgggacagcggtg

SEQ ID NO: 418996 - DNA, 140 bp, Artificial Sequence
  Synthetic
caccgctgtcccaaaaggtcgcttttctgctttacttattattgttgttgttatgttgtttaccacagtgttgttgtatgtaattgtggtgtcactgcagtttggtaccgctggggatgtcatatcagcagccagggcct

SEQ ID NO: 418997 - DNA, 140 bp, Artificial Sequence
  Synthetic
atacgccatgctgggtctccacagcataacaatagagagaatggttctctctgcctttgatgaaaggagaaacaggtacctggaagaacatccaagtgctgggaaggacccaaagaaaaccgtacttgggagtcggccat

SEQ ID NO: 418998 - DNA, 140 bp, Artificial Sequence
  Synthetic
atggccgactcccaagtacggttttctttgggtccttcccagcacttggatgttcttccaggtacctgtttctcctttcatcaaaggcagagagaaccattctctctattgttatgctgtggagacccagcatggcgtat

SEQ ID NO: 418999 - DNA, 140 bp, Artificial Sequence
  Synthetic
aggccctggctgctgatatggaccaactagcgacctccaccatacctgaccatctagcgacctccacavgcagggtgacaaaaacataatggattccaatactgtgtcaagcttccaggtgaccttttgggacagcggtg

SEQ ID NO: 419000 - DNA, 140 bp, Artificial Sequence
  Synthetic
caccgctgtcccaaaaggtcacctggaagcttgacacagtattggaatccattatgtttttgtcaccctgcvtgtggaggtcgctagatggtcaggtatggtggaggtcgctagttggtccatatcagcagccagggcct

SEQ ID NO: 419001 - DNA, 140 bp, Artificial Sequence
  Synthetic
aggccctggctgctgatatgcataaggacaatgcaatacgattgggtgagaacaaagatgtaatagtcacgagggagccttatgtcagttgcgacaatgatgattgctggtcctttgcccgaccttttgggacagcggtg

SEQ ID NO: 419002 - DNA, 140 bp, Artificial Sequence
  Synthetic
caccgctgtcccaaaaggtcgggcaaaggaccagcaatcatcattgtcgcaactgacataaggctccctcgtgactattacatctttgttctcacccaatcgtattgcattgtccttatgcatatcagcagccagggcct

SEQ ID NO: 419003 - DNA, 140 bp, Artificial Sequence
  Synthetic
atacgccatgctgggtctccgagggagccttatgtcagttgcgacaatgatgattgctggtcctttgcccttgctcaaggggctctattaggaactaaacacagcaatgggaccatcaagcgtacttgggagtcggccat

SEQ ID NO: 419004 - DNA, 140 bp, Artificial Sequence
  Synthetic
atggccgactcccaagtacgcttgatggtcccattgctgtgtttagttcctaatagagccccttgagcaagggcaaaggaccagcaatcatcattgtcgcaactgacataaggctccctcggagacccagcatggcgtat

SEQ ID NO: 419005 - DNA, 140 bp, Artificial Sequence
  Synthetic
atacgccatgctgggtctccggagaagatgcaactgctggcctcacccacctgatgatctggcattccaatttaaatgatgccacataccaaagaacaagagctcttgtgcgtactggaacgtacttgggagtcggccat

SEQ ID NO: 419006 - DNA, 140 bp, Artificial Sequence
  Synthetic
atggccgactcccaagtacgttccagtacgcacaagagctcttgttctttggtatgtggcatcatttaaattggaatgccagatcatcaggtgggtgaggccagcagttgcatcttctccggagacccagcatggcgtat

SEQ ID NO: 419007 - DNA, 140 bp, Artificial Sequence
  Synthetic
aggccctggctgctgatatgtttaaatgatgccacataccaaagaacaagagctcttgtgcgtactggaatggaccctagaatgtgctccttgatgcaaggatcaactcttccgaggagagaccttttgggacagcggtg

SEQ ID NO: 419008 - DNA, 140 bp, Artificial Sequence
  Synthetic
caccgctgtcccaaaaggtctctcctcggaagagttgatccttgcatcaaggagcacattctagggtccattccagtacgcacaagagctcttgttctttggtatgtggcatcatttaaacatatcagcagccagggcct

SEQ ID NO: 419009 - DNA, 140 bp, Artificial Sequence
  Synthetic
aggccctggctgctgatatgagtgctgggtaactacaaggagatatgtgttgcttggtcaagcagcagttgcttcgatggaaaggaatggatgcatgtttgcatgactgggaatgacaatgaccttttgggacagcggtg

SEQ ID NO: 419010 - DNA, 140 bp, Artificial Sequence
  Synthetic
caccgctgtcccaaaaggtcattgtcattcccagtcatgcaaacatgcatccattcctttccatcgaagcaactgctgcttgaccaagcaacacatatctccttgtagttacccagcactcatatcagcagccagggcct

SEQ ID NO: 419011 - DNA, 140 bp, Artificial Sequence
  Synthetic
atacgccatgctgggtctccgttagtaaaatgggagtggatgaatattccagcactgagagagtggttgtaagtattgaccgtttcttaagggttcgagatcaacggggaaacgtactctcgtacttgggagtcggccat

SEQ ID NO: 419012 - DNA, 140 bp, Artificial Sequence
  Synthetic
atggccgactcccaagtacgagagtacgtttccccgttgatctcgaacccttaagaaacggtcaatacttacaaccactctctcagtgctggaatattcatccactcccattttactaacggagacccagcatggcgtat

SEQ ID NO: 419013 - DNA, 140 bp, Artificial Sequence
  Synthetic
atacgccatgctgggtctccactagttaggatgataaaaagaggaattaacgatcgaaatttctggagaggtgaaaatggaagaaaaacaagaattgcgtatgagagaatgtgcaacattcgtacttgggagtcggccat

SEQ ID NO: 419014 - DNA, 140 bp, Artificial Sequence
  Synthetic
atggccgactcccaagtacgaatgttgcacattctctcatacgcaattcttgtttttcttccattttcacctctccagaaatttcgatcgttaattcctctttttatcatcctaactagtggagacccagcatggcgtat

SEQ ID NO: 419015 - DNA, 140 bp, Artificial Sequence
  Synthetic
aggccctggctgctgatatggtgaaaatggaagaaaaacaagaattgcgtatgagagaatgtgcaacattctcaaagggaaattccaaacagcagcacagcgagcaatgatggatcaagtgaccttttgggacagcggtg

SEQ ID NO: 419016 - DNA, 140 bp, Artificial Sequence
  Synthetic
caccgctgtcccaaaaggtcacttgatccatcattgctcgctgtgctgctgtttggaatttccctttgagaatgttgcacattctctcatacgcaattcttgtttttcttccattttcaccatatcagcagccagggcct

SEQ ID NO: 419017 - DNA, 140 bp, Artificial Sequence
  Synthetic
atacgccatgctgggtctcctggcacggtctgcactcattctaagaggatcagtggctcataaatcctgcctgcctgcttgtgtgtacggactggccgtagccagtggatatgacttcgacgtacttgggagtcggccat

SEQ ID NO: 419018 - DNA, 140 bp, Artificial Sequence
  Synthetic
atggccgactcccaagtacgtcgaagtcatatccactggctacggccagtccgtacacacaagcaggcaggcaggatttatgagccactgatcctcttagaatgagtgcagaccgtgccaggagacccagcatggcgtat

SEQ ID NO: 419019 - DNA, 140 bp, Artificial Sequence
  Synthetic
atacgccatgctgggtctccaagggaaggatactctctagtgggaatagacccttttcgtctgctgcaaaacagccaggtcttcagcctaattagaccaaatgagaacccagcacataaacgtacttgggagtcggccat

SEQ ID NO: 419020 - DNA, 140 bp, Artificial Sequence
  Synthetic
atggccgactcccaagtacgtttatgtgctgggttctcatttggtctaattaggctgaagacctggctgttttgcagcagacgaaaagggtctattcccactagagagtatccttcccttggagacccagcatggcgtat

SEQ ID NO: 419021 - DNA, 140 bp, Artificial Sequence
  Synthetic
aggccctggctgctgatatgatgtagcaaattccattcagacacccccaggccagccgatccttcaacagtgtcatgtgattccccaagtaacatcaatggaggacctggagtcaaaggagaccttttgggacagcggtg

SEQ ID NO: 419022 - DNA, 140 bp, Artificial Sequence
  Synthetic
caccgctgtcccaaaaggtctcctttgactccaggtcctccattgatgttacttggggaatcacatgacactgttgaaggatcggctggcctgggggtgtctgaatggaatttgctacatcatatcagcagccagggcct

SEQ ID NO: 419023 - DNA, 140 bp, Artificial Sequence
  Synthetic
atacgccatgctgggtctccagtcaattagtatggatggcatgccattcagcagcattcgaagatctgagagtctcaagtttcatcagaggaacaagagtaatcccaaggggacaactatcgtacttgggagtcggccat

SEQ ID NO: 419024 - DNA, 140 bp, Artificial Sequence
  Synthetic
atggccgactcccaagtacgatagttgtccccttgggattactcttgttcctctgatgaaacttgagactctcagatcttcgaatgctgctgaatggcatgccatccatactaattgactggagacccagcatggcgtat

SEQ ID NO: 419025 - DNA, 140 bp, Artificial Sequence
  Synthetic
aggccctggctgctgatatggctctcagacgagaaggcaacgaacccgatcgtgccctcttttgatatgagtaacgaaggatcttatttcttcggagacaatgcagaagagtacgacaatgaccttttgggacagcggtg

SEQ ID NO: 419026 - DNA, 140 bp, Artificial Sequence
  Synthetic
caccgctgtcccaaaaggtcattgtcgtactcttctgcattgtctccgaagaaataagatccttcgttactcatatcaaaagagggcacgatcgggttcgttgccttctcgtctgagagccatatcagcagccagggcct

SEQ ID NO: 419027 - DNA, 140 bp, Artificial Sequence
  Synthetic
atacgccatgctgggtctcctccagcactcttgaactgaggagcagatattgggccataagaaccaggagtgggggaaataccaaccagcagagagcatctgcaggacaaatcagtgttccgtacttgggagtcggccat

SEQ ID NO: 419028 - DNA, 140 bp, Artificial Sequence
  Synthetic
atggccgactcccaagtacggaacactgatttgtcctgcagatgctctctgctggttggtatttcccccactcctggttcttatggcccaatatctgctcctcagttcaagagtgctggaggagacccagcatggcgtat

SEQ ID NO: 419029 - DNA, 140 bp, Artificial Sequence
  Synthetic
aggccctggctgctgatatgtgggggaaataccaaccagcagagagcatctgcaggacaaatcagtgttcagcctactttttcagtacaaagaaatcttccattcgaaagagcaaccattgaccttttgggacagcggtg

SEQ ID NO: 419030 - DNA, 140 bp, Artificial Sequence
  Synthetic
caccgctgtcccaaaaggtcaatggttgctctttcgaatggaagatttctttgtactgaaaaagtaggctgaacactgatttgtcctgcagatgctctctgctggttggtatttcccccacatatcagcagccagggcct

SEQ ID NO: 419031 - DNA, 140 bp, Artificial Sequence
  Synthetic
aggccctggctgctgatatgtcaatgatgtgggaaatcaatggtcctgaatcagttttggtcaatacttatcaatggatcatcagaaattgggaaactgtgaaaattcaatggtcacaaggaccttttgggacagcggtg

SEQ ID NO: 419032 - DNA, 140 bp, Artificial Sequence
  Synthetic
caccgctgtcccaaaaggtccttgtgaccattgaattttcacagtttcccaatttctgatgatccattgataagtattgaccaaaactgattcaggaccattgatttcccacatcattgacatatcagcagccagggcct

SEQ ID NO: 419033 - DNA, 140 bp, Artificial Sequence
  Synthetic
aggccctggctgctgatatgttggacaagcaatagtatagttactttctgtggactagacaatgaacctggatcgggaaattggcctgatggttctaacattgggtttatgcccaagtaagaccttttgggacagcggtg

SEQ ID NO: 419034 - DNA, 140 bp, Artificial Sequence
  Synthetic
caccgctgtcccaaaaggtcttacttgggcataaacccaatgttagaaccatcaggccaatttcccgatccaggttcattgtctagtccacagaaagtaactatactattgcttgtccaacatatcagcagccagggcct

SEQ ID NO: 419035 - DNA, 140 bp, Artificial Sequence
  Synthetic
atacgccatgctgggtctccggatcttcattctatgcagaaatgaaatggctcctgtcaaacacagataatgctgcattcccgcagatgactaagtcatataaaaatacaagaaaaagcccgtacttgggagtcggccat

SEQ ID NO: 419036 - DNA, 140 bp, Artificial Sequence
  Synthetic
atggccgactcccaagtacgggctttttcttgtatttttatatgacttagtcatctgcgggaatgcagcattatctgtgtttgacaggagccatttcatttctgcatagaatgaagatccggagacccagcatggcgtat

SEQ ID NO: 419037 - DNA, 140 bp, Artificial Sequence
  Synthetic
aggccctggctgctgatatgttggacagggaacaacactaaacaacaggcattcaaataacacagtacatgatagaaccccttatcgaaccctattgatgaatgaattgggtattccattgaccttttgggacagcggtg

SEQ ID NO: 419038 - DNA, 140 bp, Artificial Sequence
  Synthetic
caccgctgtcccaaaaggtcaatggaatacccaattcattcatcaatagggttcgataaggggttctatcatgtactgtgttatttgaatgcctgttgtttagtgttgttccctgtccaacatatcagcagccagggcct

SEQ ID NO: 419039 - DNA, 140 bp, Artificial Sequence
  Synthetic
aggccctggctgctgatatgggaatgctgtgtgcaacaaatctgggaaatcccctcatcctagacacatgcactatcgaaggacttatctatggtaacccttcttgtgacatgttgttgggaccttttgggacagcggtg

SEQ ID NO: 419040 - DNA, 140 bp, Artificial Sequence
  Synthetic
caccgctgtcccaaaaggtcccaacaacatgtcacaagaagggttaccatagataagtccttcgatagtgcatgtgtctaggatgaggggatttcccagatttgttgcacacagcattcccatatcagcagccagggcct

SEQ ID NO: 419041 - DNA, 140 bp, Artificial Sequence
  Synthetic
atacgccatgctgggtctccgaaaagtatgcagaaccttattggcaaaatctgtattcaatagcctgtatgcatccccacaactcgagggattttcagctgaatcaaggaagttacttctcgtacttgggagtcggccat

SEQ ID NO: 419042 - DNA, 140 bp, Artificial Sequence
  Synthetic
atggccgactcccaagtacgagaagtaacttccttgattcagctgaaaatccctcgagttgtggggatgcatacaggctattgaatacagattttgccaataaggttctgcatacttttcggagacccagcatggcgtat

SEQ ID NO: 419043 - DNA, 140 bp, Artificial Sequence
  Synthetic
atacgccatgctgggtctccacatgttaccctgggaatgtggaaaacttagaggaactcagaatactttttagttcctctagttcctatcaaagaattcaaatgttcccagacacaatctcgtacttgggagtcggccat

SEQ ID NO: 419044 - DNA, 140 bp, Artificial Sequence
  Synthetic
atggccgactcccaagtacgagattgtgtctgggaacatttgaattctttgataggaactagaggaactaaaaagtattctgagttcctctaagttttccacattcccagggtaacatgtggagacccagcatggcgtat

SEQ ID NO: 419045 - DNA, 140 bp, Artificial Sequence
  Synthetic
atacgccatgctgggtctccagcaaaagcaggggaaaataaaagcaaccaaaatgaaagcaatactagtagtcctgctatatacatttacaaccgcaaatgccgacacattatgtataggcgtacttgggagtcggccat

SEQ ID NO: 419046 - DNA, 140 bp, Artificial Sequence
  Synthetic
atggccgactcccaagtacgcctatacataatgtgtcggcatttgcggttgtaaatgtatatagcaggactactagtattgctttcattttggttgcttttattttcccctgcttttgctggagacccagcatggcgtat

SEQ ID NO: 419047 - DNA, 140 bp, Artificial Sequence
  Synthetic
atacgccatgctgggtctccaggaatatgagatggctaactcaaaagaacgggaattatcctgtccaagacgcccaatacacaaatactcggggaaaggacattcttttcgtttggggcacgtacttgggagtcggccat

SEQ ID NO: 419048 - DNA, 140 bp, Artificial Sequence
  Synthetic
atggccgactcccaagtacgtgccccaaacgaaaagaatgtcctttccccgagtatttgtgtattgggcgtcttggacaggataattcccgttcttttgagttagccatctcatattcctggagacccagcatggcgtat

SEQ ID NO: 419049 - DNA, 140 bp, Artificial Sequence
  Synthetic
aggccctggctgctgatatgcgcccaatacacaaatactcggggaaaggacattcttttcgtttggggcatacatcatccacccactgatactgcacagacgaatttgtacacaagaaccgaccttttgggacagcggtg

SEQ ID NO: 419050 - DNA, 140 bp, Artificial Sequence
  Synthetic
caccgctgtcccaaaaggtcggttcttgtgtacaaattcgtctgtgcagtatcagtgggtggatgatgtatgccccaaacgaaaagaatgtcctttccccgagtatttgtgtattgggcgcatatcagcagccagggcct

SEQ ID NO: 419051 - DNA, 140 bp, Artificial Sequence
  Synthetic
atacgccatgctgggtctcctacatcatccacccactgatactgcacagacgaatttgtacacaagaaccgacacaacaacaagcgtaacaacagaaaatttggataggaccttcaaacccgtacttgggagtcggccat

SEQ ID NO: 419052 - DNA, 140 bp, Artificial Sequence
  Synthetic
atggccgactcccaagtacgggtttgaaggtcctatccaaattttctgttgttacgcttgttgttgtgtcggttcttgtgtacaaattcgtctgtgcagtatcagtgggtggatgatgtaggagacccagcatggcgtat

SEQ ID NO: 419053 - DNA, 140 bp, Artificial Sequence
  Synthetic
atacgccatgctgggtctccattactggtcggtactaaaaccaggccagacattgcgagtaagatccaatgggaatctaattgctccatggtttggacacgttctctcaggagagagccacgtacttgggagtcggccat

SEQ ID NO: 419054 - DNA, 140 bp, Artificial Sequence
  Synthetic
atggccgactcccaagtacgtggctctctcctgagagaacgtgtccaaaccatggagcaattagattcccattggatcttactcgcaatgtctggcctggttttagtaccgaccagtaatggagacccagcatggcgtat

SEQ ID NO: 419055 - DNA, 140 bp, Artificial Sequence
  Synthetic
aggccctggctgctgatatggggaatctaattgctccatggtttggacacgttctctcaggagagagccatgggagaattctgaaaactgatttaaacagtggtaattgtgtagtgcaatgaccttttgggacagcggtg

SEQ ID NO: 419056 - DNA, 140 bp, Artificial Sequence
  Synthetic
caccgctgtcccaaaaggtcattgcactacacaattaccactgtttaaatcagttttcagaattctcccatggctctctcctgagagaacgtgtccaaaccatggagcaattagattccccatatcagcagccagggcct

SEQ ID NO: 419057 - DNA, 140 bp, Artificial Sequence
  Synthetic
atacgccatgctgggtctcccagcagatgcgtgatgtgctggggacatttgacactgtccagataataaagctgctaccatttgcagcagccccgccagaacagagtaggatgcagttctcgtacttgggagtcggccat

SEQ ID NO: 419058 - DNA, 140 bp, Artificial Sequence
  Synthetic
atggccgactcccaagtacgagaactgcatcctactctgttctggcggggctgctgcaaatggtagcagctttattatctggacagtgtcaaatgtccccagcacatcacgcatctgctgggagacccagcatggcgtat

SEQ ID NO: 419059 - DNA, 140 bp, Artificial Sequence
  Synthetic
aggccctggctgctgatatgtcctccttgactgtgaacgtgaggggatcaggaatgagaatactaataaggggcaattctccagtgttcaattacaataaggccaccaagaggcttacaggaccttttgggacagcggtg

SEQ ID NO: 419060 - DNA, 140 bp, Artificial Sequence
  Synthetic
caccgctgtcccaaaaggtcctgtaagcctcttggtggccttattgtaattgaacactggagaattgccccttattagtattctcattcctgatcccctcacgttcacagtcaaggaggacatatcagcagccagggcct

SEQ ID NO: 419061 - DNA, 140 bp, Artificial Sequence
  Synthetic
aggccctggctgctgatatgtgaacaatatagtcgacaagatgaacaagcaatatgaaataattgatcatgaattcagtgaggttgaaactagactcaatatgatcaataacaagattgagaccttttgggacagcggtg

SEQ ID NO: 419062 - DNA, 140 bp, Artificial Sequence
  Synthetic
caccgctgtcccaaaaggtctcaatcttgttattgatcatattgagtctagtttcaacctcactgaattcatgatcaattatttcatattgcttgttcatcttgtcgactatattgttcacatatcagcagccagggcct

SEQ ID NO: 419063 - DNA, 140 bp, Artificial Sequence
  Synthetic
atacgccatgctgggtctccttgagaaccagaaaacactcgatgagcatgatgcaaacgtgaacaacctatacaacaaggtgaaaagggccttaggctccaatgcgatggaagatgggaacgtacttgggagtcggccat

SEQ ID NO: 419064 - DNA, 140 bp, Artificial Sequence
  Synthetic
atggccgactcccaagtacgttcccatcttccatcgcattggagcctaaggcccttttcaccttgttgtataggttgttcacgtttgcatcatgctcatcgagtgttttctggttctcaaggagacccagcatggcgtat

SEQ ID NO: 419065 - DNA, 140 bp, Artificial Sequence
  Synthetic
aggccctggctgctgatatgggacctcacagggaatgacaacagtacggcaacactgtgcctgggacaccatgcagtgccgaacgggacaatagtgaagacaatcacagatgatcagattgaccttttgggacagcggtg

SEQ ID NO: 419066 - DNA, 140 bp, Artificial Sequence
  Synthetic
caccgctgtcccaaaaggtcaatctgatcatctgtgattgtcttcactattgtcccgttcggcactgcatggtgtcccaggcacagtgttgccgtactgttgtcattccctgtgaggtcccatatcagcagccagggcct

SEQ ID NO: 419067 - DNA, 140 bp, Artificial Sequence
  Synthetic
atacgccatgctgggtctccatgcagtgccgaacgggacaatagtgaagacaatcacagatgatcagattgaggtgactaatgctaccgagctagttcaaagctcttcaacagggaaaatcgtacttgggagtcggccat

SEQ ID NO: 419068 - DNA, 140 bp, Artificial Sequence
  Synthetic
atggccgactcccaagtacgattttccctgttgaagagctttgaactagctcggtagcattagtcacctcaatctgatcatctgtgattgtcttcactattgtcccgttcggcactgcatggagacccagcatggcgtat

SEQ ID NO: 419069 - DNA, 140 bp, Artificial Sequence
  Synthetic
atacgccatgctgggtctccatgccctactgggggatcctcattgtgatgtctttcaagatgaaacatgggacctctttgtagagcggagcaatgctttcagcaattgttacccttacgacgtacttgggagtcggccat

SEQ ID NO: 419070 - DNA, 140 bp, Artificial Sequence
  Synthetic
atggccgactcccaagtacgtcgtaagggtaacaattgctgaaagcattgctccgctctacaaagaggtcccatgtttcatcttgaaagacatcacaatgaggatcccccagtagggcatggagacccagcatggcgtat

SEQ ID NO: 419071 - DNA, 140 bp, Artificial Sequence
  Synthetic
aggccctggctgctgatatggacctctttgtagagcggagcaatgctttcagcaattgttacccttacgacgtaccagattatgcatctcttcgatccctagttgcatcatcaggcacatgaccttttgggacagcggtg

SEQ ID NO: 419072 - DNA, 140 bp, Artificial Sequence
  Synthetic
caccgctgtcccaaaaggtcatgtgcctgatgatgcaactagggatcgaagagatgcataatctggtacgtcgtaagggtaacaattgctgaaagcattgctccgctctacaaagaggtccatatcagcagccagggcct

SEQ ID NO: 419073 - DNA, 140 bp, Artificial Sequence
  Synthetic
aggccctggctgctgatatgatggattccaacactgtgtcaagctttcaggtagattgctttctttggcatgtccgcaaacgatttgcagaccaagaactgggtgatgccccatttcttggaccttttgggacagcggtg

SEQ ID NO: 419074 - DNA, 140 bp, Artificial Sequence
  Synthetic
caccgctgtcccaaaaggtccaagaaatggggcatcacccagttcttggtctgcaaatcgtttgcggacatgccaaagaaagcaatctacctgaaagcttgacacagtgttggaatccatcatatcagcagccagggcct

SEQ ID NO: 419075 - DNA, 140 bp, Artificial Sequence
  Synthetic
atacgccatgctgggtctccgggagcaatgcttgcaaaaggggacctgctagcggtttctttagtagattgaactggttgactaaatcaggaaacgcatatccagtgttgaacgtgactacgtacttgggagtcggccat

SEQ ID NO: 419076 - DNA, 140 bp, Artificial Sequence
  Synthetic
atggccgactcccaagtacgtagtcacgttcaacactggatatgcgtttcctgatttagtcaaccagttcaatctactaaagaaaccgctagcaggtccccttttgcaagcattgctcccggagacccagcatggcgtat

SEQ ID NO: 419077 - DNA, 140 bp, Artificial Sequence
  Synthetic
aggccctggctgctgatatggccacacaaatgggaaaagtactgtgttctcgaaatagggaatatgctcttgaggactgcgataggccaagtgtcacggcccatgttcctatatgtgagagaccttttgggacagcggtg

SEQ ID NO: 419078 - DNA, 140 bp, Artificial Sequence
  Synthetic
caccgctgtcccaaaaggtctctcacatataggaacatgggccgtgacacttggcctatcgcagtcctcaagagcatattccctatttcgagaacacagtacttttcccatttgtgtggccatatcagcagccagggcct

SEQ ID NO: 419079 - DNA, 140 bp, Artificial Sequence
  Synthetic
atacgccatgctgggtctcctgccagctgcacgatatctgagtgatatgactcttgaagaaatgtcaagggactggtttatgctcatgccaaagcagaaagtggctggttccctgtgcatcgtacttgggagtcggccat

SEQ ID NO: 419080 - DNA, 140 bp, Artificial Sequence
  Synthetic
atggccgactcccaagtacgatgcacagggaaccagccactttctgctttggcatgagcataaaccagtcccttgacatttcttcaagagtcatatcactcagatatcgtgcagctggcaggagacccagcatggcgtat

SEQ ID NO: 419081 - DNA, 140 bp, Artificial Sequence
  Synthetic
aggccctggctgctgatatggactggtttatgctcatgccaaagcagaaagtggctggttccctgtgcatcagaatggaccaggcaataatggacaaaaccataacattgaaagcaaattgaccttttgggacagcggtg

SEQ ID NO: 419082 - DNA, 140 bp, Artificial Sequence
  Synthetic
caccgctgtcccaaaaggtcaatttgctttcaatgttatggttttgtccattattgcctggtccattctgatgcacagggaaccagccactttctgctttggcatgagcataaaccagtccatatcagcagccagggcct

SEQ ID NO: 419083 - DNA, 140 bp, Artificial Sequence
  Synthetic
atacgccatgctgggtctccgcaacggttgcttcaaaatataccacaaatgtgacaacgcatgtatagagtcaataaggaacgggacctatgatcatgacatatacagggatgaagcattcgtacttgggagtcggccat

SEQ ID NO: 419084 - DNA, 140 bp, Artificial Sequence
  Synthetic
atggccgactcccaagtacgaatgcttcatccctgtatatgtcatgatcataggtcccgttccttattgactctatacatgcgttgtcacatttgtggtatattttgaagcaaccgttgcggagacccagcatggcgtat

SEQ ID NO: 419085 - DNA, 140 bp, Artificial Sequence
  Synthetic
atacgccatgctgggtctccacaatagtcaaacctggggacgtactggtaatcaatagcaatggaaacctaatcgctcctcggggctacttcaaaatgcgcactgggaaaagctcaataacgtacttgggagtcggccat

SEQ ID NO: 419086 - DNA, 140 bp, Artificial Sequence
  Synthetic
atggccgactcccaagtacgttattgagcttttcccagtgcgcattttgaagtagccccgaggagcgattaggtttccattgctattgattaccagtacgtccccaggtttgactattgtggagacccagcatggcgtat

SEQ ID NO: 419087 - DNA, 140 bp, Artificial Sequence
  Synthetic
atacgccatgctgggtctccacagaagaaggagcaattgtgggagaaatatcaccgttaccttctcttccaggacatactgatgaggatgtccaaaatgcaattgggaccctcatcggagcgtacttgggagtcggccat

SEQ ID NO: 419088 - DNA, 140 bp, Artificial Sequence
  Synthetic
atggccgactcccaagtacgctccgatgagggtcccaattgcattttggacatcctcatcagtatgtcctggaagagaaggtaacggtgatatttctcccacaattgctccttcttctgtggagacccagcatggcgtat

SEQ ID NO: 419089 - DNA, 140 bp, Artificial Sequence
  Synthetic
aggccctggctgctgatatgaatggaagcatccccaatgacaagccctttcaaaatgtaaacaagatcacatacggagcatgccccaaatatgtgaagcagaacaccctgaagttggcaagaccttttgggacagcggtg

SEQ ID NO: 419090 - DNA, 140 bp, Artificial Sequence
  Synthetic
caccgctgtcccaaaaggtcttgccaacttcagggtgttctgcttcacatatttggggcatgctccgtatgtgatcttgtttacattttgaaagggcttgtcattggggatgcttccattcatatcagcagccagggcct

SEQ ID NO: 419091 - DNA, 140 bp, Artificial Sequence
  Synthetic
aggccctggctgctgatatgcatgaagaaaacaagccaattaaagtgggcactcggtgagaacatggcaccggagaaggtggactttgaggattgcaaagatgtcaacgacctgaaacaggaccttttgggacagcggtg

SEQ ID NO: 419092 - DNA, 140 bp, Artificial Sequence
  Synthetic
caccgctgtcccaaaaggtcctgtttcaggtcgttgacatctttgcaatcctcaaagtccaccttctccggtgccatgttctcaccgagtgcccactttaattggcttgttttcttcatgcatatcagcagccagggcct

SEQ ID NO: 419093 - DNA, 140 bp, Artificial Sequence
  Synthetic
atacgccatgctgggtctccatagcaggttttatagaaaatggatgggaagggatgatagatggttggtatggcttcaggcatcaaaattccgaaggtacaggacaagcagcagatcttacgtacttgggagtcggccat

SEQ ID NO: 419094 - DNA, 140 bp, Artificial Sequence
  Synthetic
atggccgactcccaagtacgtaagatctgctgcttgtcctgtaccttcggaattttgatgcctgaagccataccaaccatctatcatcccttcccatccattttctataaaacctgctatggagacccagcatggcgtat

SEQ ID NO: 419095 - DNA, 140 bp, Artificial Sequence
  Synthetic
aggccctggctgctgatatgtggcttcaggcatcaaaattccgaaggtacaggacaagcagcagatcttaaaagcactcaggcagccatcgaccagatcaatgggaagttgaacagagtagaccttttgggacagcggtg

SEQ ID NO: 419096 - DNA, 140 bp, Artificial Sequence
  Synthetic
caccgctgtcccaaaaggtctactctgttcaacttcccattgatctggtcgatggctgcctgagtgcttttaagatctgctgcttgtcctgtaccttcggaattttgatgcctgaagccacatatcagcagccagggcct

SEQ ID NO: 419097 - DNA, 140 bp, Artificial Sequence
  Synthetic
aggccctggctgctgatatggggtcaatctgcatggcaattggaataataagtctggtgttacaaattggaaatataatctcaatatgggttagtcattcaatccaaactgaaagcaagagaccttttgggacagcggtg

SEQ ID NO: 419098 - DNA, 140 bp, Artificial Sequence
  Synthetic
caccgctgtcccaaaaggtctcttgctttcagtttggattgaatgactaacccatattgagattatatttccaatttgtaacaccagacttattattccaattgccatgcagattgaccccatatcagcagccagggcct

SEQ ID NO: 419099 - DNA, 140 bp, Artificial Sequence
  Synthetic
atacgccatgctgggtctccagtagaagggaggattcaggaccttgagaaatacgttgaagacacaaagatagatctctggtcttacaatgcagagcttcttgttgccctggagaatcagcgtacttgggagtcggccat

SEQ ID NO: 419100 - DNA, 140 bp, Artificial Sequence
  Synthetic
atggccgactcccaagtacgctgattctccagggcaacaagaagctctgcattgtaagaccagagatctatctttgtgtcttcaacgtatttctcaaggtcctgaatcctcccttctactggagacccagcatggcgtat

SEQ ID NO: 419101 - DNA, 140 bp, Artificial Sequence
  Synthetic
aggccctggctgctgatatgttgatggttgcatacatgttagagagagaacttgtacgaaaaacaagatttctcccagttgctggcggaacaagcagtatatacattgaagttttacattgaccttttgggacagcggtg

SEQ ID NO: 419102 - DNA, 140 bp, Artificial Sequence
  Synthetic
caccgctgtcccaaaaggtcaatgtaaaacttcaatgtatatactgcttgttccgccagcaactgggagaaatcttgtttttcgtacaagttctctctctaacatgtatgcaaccatcaacatatcagcagccagggcct

SEQ ID NO: 419103 - DNA, 140 bp, Artificial Sequence
  Synthetic
atacgccatgctgggtctcccaggaggcaactgagggaaaatgctgaggacatgggcaatggttgtttcaagatataccacaagtgtgacaatgcttgcatagagtcaattagaaacgggcgtacttgggagtcggccat

SEQ ID NO: 419104 - DNA, 140 bp, Artificial Sequence
  Synthetic
atggccgactcccaagtacgcccgtttctaattgactctatgcaagcattgtcacacttgtggtatatcttgaaacaaccattgcccatgtcctcagcattttccctcagttgcctcctgggagacccagcatggcgtat

SEQ ID NO: 419105 - DNA, 140 bp, Artificial Sequence
  Synthetic
aggccctggctgctgatatgagatataccacaagtgtgacaatgcttgcatagagtcaattagaaacgggacttatgatcatgacatatacagagatgaggcattgaacaaccggttccagaccttttgggacagcggtg

SEQ ID NO: 419106 - DNA, 140 bp, Artificial Sequence
  Synthetic
caccgctgtcccaaaaggtctggaaccggttgttcaatgcctcatctctgtatatgtcatgatcataagtcccgtttctaattgactctatgcaagcattgtcacacttgtggtatatctcatatcagcagccagggcct

SEQ ID NO: 419107 - DNA, 140 bp, Artificial Sequence
  Synthetic
aggccctggctgctgatatgtttcctttgccatatcatgctttttgctttgtgttgttctactggggtttattatgtgggcctgccagagaggcaacatcaggtgcaacatttgcatttggaccttttgggacagcggtg

SEQ ID NO: 419108 - DNA, 140 bp, Artificial Sequence
  Synthetic
caccgctgtcccaaaaggtccaaatgcaaatgttgcacctgatgttgcctctctggcaggcccacataataaaccccagtagaacaacacaaagcaaaaagcatgatatggcaaaggaaacatatcagcagccagggcct

SEQ ID NO: 419109 - DNA, 140 bp, Artificial Sequence
  Synthetic
atacgccatgctgggtctccgtagataatcactcaatgagtgacatcgaagccatggcgtctcaaggcaccaaacgatcatatgaacaaatggagactggtggggagcgccaggatgcaacgtacttgggagtcggccat

SEQ ID NO: 419110 - DNA, 140 bp, Artificial Sequence
  Synthetic
atggccgactcccaagtacgttgcatcctggcgctccccaccagtctccatttgttcatatgatcgtttggtgccttgagacgccatggcttcgatgtcactcattgagtgattatctacggagacccagcatggcgtat

SEQ ID NO: 419111 - DNA, 140 bp, Artificial Sequence
  Synthetic
aggccctggctgctgatatgtgtccgcaaacgatttgcagaccaagaactgggtgatgccccattccttgaccggcttcgccgagatcagaagtccctaagaggaagaggcagcactcttgaccttttgggacagcggtg

SEQ ID NO: 419112 - DNA, 140 bp, Artificial Sequence
  Synthetic
caccgctgtcccaaaaggtcaagagtgctgcctcttcctcttagggacttctgatctcggcgaagccggtcaaggaatggggcatcacccagttcttggtctgcaaatcgtttgcggacacatatcagcagccagggcct

SEQ ID NO: 419113 - DNA, 140 bp, Artificial Sequence
  Synthetic
aggccctggctgctgatatgatgaaggcaatactagtagtcctgctatatgcatttacaactgcaaatgccgacacattatgtataggctatcatgcgaacaattcaactgacaccgtaggaccttttgggacagcggtg

SEQ ID NO: 419114 - DNA, 140 bp, Artificial Sequence
  Synthetic
caccgctgtcccaaaaggtcctacggtgtcagttgaattgttcgcatgatagcctatacataatgtgtcggcatttgcagttgtaaatgcatatagcaggactactagtattgccttcatcatatcagcagccagggcct

SEQ ID NO: 419115 - DNA, 140 bp, Artificial Sequence
  Synthetic
atacgccatgctgggtctccgactggttcatgctcatgcccaagcagaaagtggcaggttccctttgcatcagaatggaccaggcaataatggataaaaacatcacattgaaagcaaactcgtacttgggagtcggccat

SEQ ID NO: 419116 - DNA, 140 bp, Artificial Sequence
  Synthetic
atggccgactcccaagtacgagtttgctttcaatgtgatgtttttatccattattgcctggtccattctgatgcaaagggaacctgccactttctgcttgggcatgagcatgaaccagtcggagacccagcatggcgtat

SEQ ID NO: 419117 - DNA, 140 bp, Artificial Sequence
  Synthetic
atacgccatgctgggtctccatggaagcaaaactgtttgtattattctgtgcattcactgcactgaaagctgacacaatttgtgtaggctaccatgctaacaattccacagacactgttgcgtacttgggagtcggccat

SEQ ID NO: 419118 - DNA, 140 bp, Artificial Sequence
  Synthetic
atggccgactcccaagtacgcaacagtgtctgtggaattgttagcatggtagcctacacaaattgtgtcagctttcagtgcagtgaatgcacagaataatacaaacagttttgcttccatggagacccagcatggcgtat

SEQ ID NO: 419119 - DNA, 140 bp, Artificial Sequence
  Synthetic
aggccctggctgctgatatggacttgaatggaatgataacacagttcgagtctctgaaactctacagagattcgcttggagaagcagtaatgaggatgggagacctccactccctccaaagaccttttgggacagcggtg

SEQ ID NO: 419120 - DNA, 140 bp, Artificial Sequence
  Synthetic
caccgctgtcccaaaaggtctttggagggagtggaggtctcccatcctcattactgcttctccaagcgaatctctgtagagtttcagagactcgaactgtgttatcattccattcaagtccatatcagcagccagggcct

SEQ ID NO: 419121 - DNA, 140 bp, Artificial Sequence
  Synthetic
aggccctggctgctgatatgaacatttgacactgtccaaataataaagctattaccatttgcagcagccccgccggagcagagtaggatgcagttctcttctctaactgtgaatgtgagggaccttttgggacagcggtg

SEQ ID NO: 419122 - DNA, 140 bp, Artificial Sequence
  Synthetic
caccgctgtcccaaaaggtccctcacattcacagttagagaagagaactgcatcctactctgctccggcggggctgctgcaaatggtaatagctttattatttggacagtgtcaaatgttcatatcagcagccagggcct

SEQ ID NO: 419123 - DNA, 140 bp, Artificial Sequence
  Synthetic
atacgccatgctgggtctcctggaccatatggcaataataaaaaaatacacatcaggaagacaagagaagaaccccgctctcagaatgaaatggatgatggcaatgaagtatccaattaccgtacttgggagtcggccat

SEQ ID NO: 419124 - DNA, 140 bp, Artificial Sequence
  Synthetic
atggccgactcccaagtacggtaattggatacttcattgccatcatccatttcattctgagagcggggttcttctcttgtcttcctgatgtgtatttttttattattgccatatggtccaggagacccagcatggcgtat

SEQ ID NO: 419125 - DNA, 140 bp, Artificial Sequence
  Synthetic
atacgccatgctgggtctccatgaatccaaatcagaagataataacgattggttctgcttctctcactattgccacaatgtgcttcattatgcaaattgccattcttgtaactactgtaacgtacttgggagtcggccat

SEQ ID NO: 419126 - DNA, 140 bp, Artificial Sequence
  Synthetic
atggccgactcccaagtacgttacagtagttacaagaatggcaatttgcataatgaagcacattgtggcaatagtgagagaagcagaaccaatcgttattatcttctgatttggattcatggagacccagcatggcgtat

SEQ ID NO: 419127 - DNA, 140 bp, Artificial Sequence
  Synthetic
aggccctggctgctgatatgtgccacaatgtgcttcattatgcaaattgccattcttgtaactactgtaacactgcatttcaagcaatatgaatgcagctccccaccaaacaaccaagtagaccttttgggacagcggtg

SEQ ID NO: 419128 - DNA, 140 bp, Artificial Sequence
  Synthetic
caccgctgtcccaaaaggtctacttggttgtttggtggggagctgcattcatattgcttgaaatgcagtgttacagtagttacaagaatggcaatttgcataatgaagcacattgtggcacatatcagcagccagggcct

SEQ ID NO: 419129 - DNA, 140 bp, Artificial Sequence
  Synthetic
atacgccatgctgggtctccggtctgtttcaagcagcctcacagaatgccatggaggcactaatggtcacaactgtagacaaattaacccaggggagacagacttttgattggacagtatcgtacttgggagtcggccat

SEQ ID NO: 419130 - DNA, 140 bp, Artificial Sequence
  Synthetic
atggccgactcccaagtacgatactgtccaatcaaaagtctgtctcccctgggttaatttgtctacagttgtgaccattagtgcctccatggcattctgtgaggctgcttgaaacagaccggagacccagcatggcgtat

SEQ ID NO: 419131 - DNA, 140 bp, Artificial Sequence
  Synthetic
atacgccatgctgggtctccacagaaattggtcgaagccgcagtgtaaaattacaggatttgcacctttttccaaggacaattcgataaggctttccgctggtggggacatttgggtgaccgtacttgggagtcggccat

SEQ ID NO: 419132 - DNA, 140 bp, Artificial Sequence
  Synthetic
atggccgactcccaagtacggtcacccaaatgtccccaccagcggaaagccttatcgaattgtccttggaaaaaggtgcaaatcctgtaattttacactgcggcttcgaccaatttctgtggagacccagcatggcgtat

SEQ ID NO: 419133 - DNA, 140 bp, Artificial Sequence
  Synthetic
aggccctggctgctgatatgtccaaggacaattcgataaggctttccgctggtggggacatttgggtgacaagagaaccttatgtgtcatgcgatcctaacaagtgctaccaatttgcccgaccttttgggacagcggtg

SEQ ID NO: 419134 - DNA, 140 bp, Artificial Sequence
  Synthetic
caccgctgtcccaaaaggtcgggcaaattggtagcacttgttaggatcgcatgacacataaggttctcttgtcacccaaatgtccccaccagcggaaagccttatcgaattgtccttggacatatcagcagccagggcct

SEQ ID NO: 419135 - DNA, 140 bp, Artificial Sequence
  Synthetic
atacgccatgctgggtctccatggagagaataaaagaactaagagatctaatgtcgcagtctcgcactcgcgagatactcactaagaccactgtggaccatatggccataatcaaaaagtcgtacttgggagtcggccat

SEQ ID NO: 419136 - DNA, 140 bp, Artificial Sequence
  Synthetic
atggccgactcccaagtacgactttttgattatggccatatggtccacagtggtcttagtgagtatctcgcgagtgcgagactgcgacattagatctcttagttcttttattctctccatggagacccagcatggcgtat

SEQ ID NO: 419137 - DNA, 140 bp, Artificial Sequence
  Synthetic
atacgccatgctgggtctccgatagaaccccttaccgaaccctattaatgaatgagttgggtattccattttatttgggaaccaagcaagtgtgcatagcatggtccagctcaagttgtccgtacttgggagtcggccat

SEQ ID NO: 419138 - DNA, 140 bp, Artificial Sequence
  Synthetic
atggccgactcccaagtacggacaacttgagctggaccatgctatgcacacttgcttggttcccaaataaaatggaatacccaactcattcattaatagggttcggtaaggggttctatcggagacccagcatggcgtat

SEQ ID NO: 419139 - DNA, 140 bp, Artificial Sequence
  Synthetic
aggccctggctgctgatatgttatttgggaaccaagcaagtgtgcatagcatggtccagctcaagttgtcacgatggaaaagcatggctgcatgtttgtataactggacatgatgaaaatgaccttttgggacagcggtg

SEQ ID NO: 419140 - DNA, 140 bp, Artificial Sequence
  Synthetic
caccgctgtcccaaaaggtcattttcatcatgtccagttatacaaacatgcagccatgcttttccatcgtgacaacttgagctggaccatgctatgcacacttgcttggttcccaaataacatatcagcagccagggcct

SEQ ID NO: 419141 - DNA, 140 bp, Artificial Sequence
  Synthetic
aggccctggctgctgatatgatgtccaacatggatattgacggtatcaacactgggacaattgacaaaacaccggaagaaataacttctggaaccagtgggacagccagaccaatcattagaccttttgggacagcggtg

SEQ ID NO: 419142 - DNA, 140 bp, Artificial Sequence
  Synthetic
caccgctgtcccaaaaggtctaatgattggtctggctgtcccactggttccagaagttatttcttccggtgttttgtcaattgtcccagtgttgataccgtcaatatccatgttggacatcatatcagcagccagggcct

SEQ ID NO: 419143 - DNA, 140 bp, Artificial Sequence
  Synthetic
aggccctggctgctgatatgatggaacttgtgcagtagtaatgactgatgggagtgcttcaggaaaagctgatactaaaatattattcattgaagaggggaaaatcattcataccagcccgaccttttgggacagcggtg

SEQ ID NO: 419144 - DNA, 140 bp, Artificial Sequence
  Synthetic
caccgctgtcccaaaaggtcgggctggtatgaatgattttcccctcttcaatgaataatattttagtatcagcttttcctgaagcactcccatcagtcattactactgcacaagttccatcatatcagcagccagggcct

SEQ ID NO: 419145 - DNA, 140 bp, Artificial Sequence
  Synthetic
atacgccatgctgggtctccatcccggtgtcagatgtgtttgcagagacaactggaaaggctccaataggcccatcgtagatattaatataaaagattatagcattgcttccagttatatcgtacttgggagtcggccat

SEQ ID NO: 419146 - DNA, 140 bp, Artificial Sequence
  Synthetic
atggccgactcccaagtacgatataactggaagcaatgctataatcttttatattaatatctacgatgggcctattggagcctttccagttgtctctgcaaacacatctgacaccgggatggagacccagcatggcgtat

SEQ ID NO: 419147 - DNA, 140 bp, Artificial Sequence
  Synthetic
atacgccatgctgggtctccggaatgcagaaccttctttctaactcaaggggccttgttgaatgacaagcattccaatggaaccgttaaagacagaagcccttatagaaccctaatgagccgtacttgggagtcggccat

SEQ ID NO: 419148 - DNA, 140 bp, Artificial Sequence
  Synthetic
atggccgactcccaagtacggctcattagggttctataagggcttctgtctttaacggttccattggaatgcttgtcattcaacaaggccccttgagttagaaagaaggttctgcattccggagacccagcatggcgtat

SEQ ID NO: 419149 - DNA, 140 bp, Artificial Sequence
  Synthetic
atacgccatgctgggtctccatggaagactttgtgcgacaatgcttcaatccaatgattgtcgagcttgcggaaaaggcaatgaaagaatatggggaagatccaaaaatcgagacgaacacgtacttgggagtcggccat

SEQ ID NO: 419150 - DNA, 140 bp, Artificial Sequence
  Synthetic
atggccgactcccaagtacgtgttcgtctcgatttttggatcttccccatattctttcattgccttttccgcaagctcgacaatcattggattgaagcattgtcgcacaaagtcttccatggagacccagcatggcgtat

SEQ ID NO: 419151 - DNA, 140 bp, Artificial Sequence
  Synthetic
atacgccatgctgggtctccggatgggcctttgatgacggaaatgatgtgtggatgggaagaacgatcaacgaaaaaatacgctcaggttatgaaaccttcaaagtcattgaaggatggtcgtacttgggagtcggccat

SEQ ID NO: 419152 - DNA, 140 bp, Artificial Sequence
  Synthetic
atggccgactcccaagtacgaccatccttcaatgactttgaaggtttcataacctgagcgtattttttcgttgatcgttcttcccatccacacatcatttccgtcatcaaaggcccatccggagacccagcatggcgtat

SEQ ID NO: 419153 - DNA, 140 bp, Artificial Sequence
  Synthetic
atacgccatgctgggtctcccgggaacaggatacaccatggacacagtcaacagaacacatcaatattcagaaaaggggaaatggacaacaaacacagagactggggcaccccaacttaacgtacttgggagtcggccat

SEQ ID NO: 419154 - DNA, 140 bp, Artificial Sequence
  Synthetic
atggccgactcccaagtacgttaagttggggtgccccagtctctgtgtttgttgtccatttccccttttctgaatattgatgtgttctgttgactgtgtccatggtgtatcctgttcccgggagacccagcatggcgtat

SEQ ID NO: 419155 - DNA, 140 bp, Artificial Sequence
  Synthetic
aggccctggctgctgatatgacaattactggagacaataccaaatggaatgagaatcagaatcctcggatgtttctggcaatgataacgtacatcacaagaaaccagcctgaatggtttagaccttttgggacagcggtg

SEQ ID NO: 419156 - DNA, 140 bp, Artificial Sequence
  Synthetic
caccgctgtcccaaaaggtctaaaccattcaggctggtttcttgtgatgtacgttatcattgccagaaacatccgaggattctgattctcattccatttggtattgtctccagtaattgtcatatcagcagccagggcct

SEQ ID NO: 419157 - DNA, 140 bp, Artificial Sequence
  Synthetic
atacgccatgctgggtctcccatcaatcggtgcttttatgtggagttgataaggggaaggaaacaagaaactgaagtctggtggacctcaaacagtattgttgtgttttgtggtacttcacgtacttgggagtcggccat

SEQ ID NO: 419158 - DNA, 140 bp, Artificial Sequence
  Synthetic
atggccgactcccaagtacgtgaagtaccacaaaacacaacaatactgtttgaggtccaccagacttcagtttcttgtttccttccccttatcaactccacataaaagcaccgattgatgggagacccagcatggcgtat

SEQ ID NO: 419159 - DNA, 140 bp, Artificial Sequence
  Synthetic
aggccctggctgctgatatgctgaagtctggtggacctcaaacagtattgttgtgttttgtggtacttcaggtacatatggaacaggctcatggcctgatggggcggatatcaaccttatgaccttttgggacagcggtg

SEQ ID NO: 419160 - DNA, 140 bp, Artificial Sequence
  Synthetic
caccgctgtcccaaaaggtcataaggttgatatccgccccatcaggccatgagcctgttccatatgtacctgaagtaccacaaaacacaacaatactgtttgaggtccaccagacttcagcatatcagcagccagggcct

SEQ ID NO: 419161 - DNA, 140 bp, Artificial Sequence
  Synthetic
aggccctggctgctgatatgatggatgtcaatccgactttacttttcttgaaagtaccagcgcaaaatgccataagtactacattcccttatactggagatcctccatacagccatgggagaccttttgggacagcggtg

SEQ ID NO: 419162 - DNA, 140 bp, Artificial Sequence
  Synthetic
caccgctgtcccaaaaggtctcccatggctgtatggaggatctccagtataagggaatgtagtacttatggcattttgcgctggtactttcaagaaaagtaaagtcggattgacatccatcatatcagcagccagggcct

SEQ ID NO: 419163 - DNA, 140 bp, Artificial Sequence
  Synthetic
atacgccatgctgggtctccgaaaatggtcacacaaagaacaatagggaagaaaaaacaaaggctgaacaagaagagctatttgataagagcactgacactgaacacaatgacaaaggatcgtacttgggagtcggccat

SEQ ID NO: 419164 - DNA, 140 bp, Artificial Sequence
  Synthetic
atggccgactcccaagtacgatcctttgtcattgtgttcagtgtcagtgctcttatcaaatagctcttcttgttcagcctttgttttttcttccctattgttctttgtgtgaccattttcggagacccagcatggcgtat

SEQ ID NO: 419165 - DNA, 140 bp, Artificial Sequence
  Synthetic
atacgccatgctgggtctccagacagattgtgtgttagaagcaatggctttccttgaagaatctcatccagggatctttgaaaattcatgccttgaaacgatggaagttgttcagcagaccgtacttgggagtcggccat

SEQ ID NO: 419166 - DNA, 140 bp, Artificial Sequence
  Synthetic
atggccgactcccaagtacggtctgctgaacaacttccatcgtttcaaggcatgaattttcaaagatccctggatgagattcttcaaggaaagccattgcttctaacacacaatctgtctggagacccagcatggcgtat

SEQ ID NO: 419167 - DNA, 140 bp, Artificial Sequence
  Synthetic
aggccctggctgctgatatgcaaatgtcaaaagaagtgaacgccaaaattgaaccattcttgaggacgacaccacgccccctcagattgcctgatgggcctctttgccatcagcggtcaagaccttttgggacagcggtg

SEQ ID NO: 419168 - DNA, 140 bp, Artificial Sequence
  Synthetic
caccgctgtcccaaaaggtcttgaccgctgatggcaaagaggcccatcaggcaatctgagggggcgtggtgtcgtcctcaagaatggttcaattttggcgttcacttcttttgacatttgcatatcagcagccagggcct

SEQ ID NO: 419169 - DNA, 140 bp, Artificial Sequence
  Synthetic
aggccctggctgctgatatgacttccagagaaagagaagagtaagggacaacatgaccaggaagatggtcacacaaaggacaatagggaagaagaagcaaaggctaaacaagaggagctagaccttttgggacagcggtg

SEQ ID NO: 419170 - DNA, 140 bp, Artificial Sequence
  Synthetic
caccgctgtcccaaaaggtctagctcctcttgtttagcctttgcttcttcttccctattgtcctttgtgtgaccatcttcctggtcatgttgtcccttactcttctctttctctggaagtcatatcagcagccagggcct

SEQ ID NO: 419171 - DNA, 140 bp, Artificial Sequence
  Synthetic
aggccctggctgctgatatgttgcgagtaagatccaatgggaatctaattgctccatggtatggacatgttctctcaggagagagccatgggagaatcctgaagactaatttgaacagcggaccttttgggacagcggtg

SEQ ID NO: 419172 - DNA, 140 bp, Artificial Sequence
  Synthetic
caccgctgtcccaaaaggtccgctgttcaaattagtcttcaggattctcccatggctctctcctgagagaacatgtccataccatggagcaattagattcccattggatcttactcgcaacatatcagcagccagggcct

SEQ ID NO: 419173 - DNA, 140 bp, Artificial Sequence
  Synthetic
aggccctggctgctgatatggggcaatggttgtttcaaaatataccacaaatgtgacaatgcctgcataggatcaatcagaaatggaacttatgaccacaatgtgtacagggatgaagcagaccttttgggacagcggtg

SEQ ID NO: 419174 - DNA, 140 bp, Artificial Sequence
  Synthetic
caccgctgtcccaaaaggtctgcttcatccctgtacacattgtggtcataagttccatttctgattgatcctatgcaggcattgtcacatttgtggtatattttgaaacaaccattgccccatatcagcagccagggcct

SEQ ID NO: 419175 - DNA, 140 bp, Artificial Sequence
  Synthetic
aggccctggctgctgatatgtgatccaaatgcactcctaaaacatcgatttgaaataattgaagggagagatcgcactatggcctggacagtagtgaacagtatctgcaacaccacaggagaccttttgggacagcggtg

SEQ ID NO: 419176 - DNA, 140 bp, Artificial Sequence
  Synthetic
caccgctgtcccaaaaggtctcctgtggtgttgcagatactgttcactactgtccaggccatagtgcgatctctcccttcaattatttcaaatcgatgttttaggagtgcatttggatcacatatcagcagccagggcct

SEQ ID NO: 419177 - DNA, 140 bp, Artificial Sequence
  Synthetic
aggccctggctgctgatatgataataacagatactatcaagagttggagaaacaacatattgaggacacaagaatctgaatgtgcctgcattaatggttcttgctttaccataatgactggaccttttgggacagcggtg

SEQ ID NO: 419178 - DNA, 140 bp, Artificial Sequence
  Synthetic
caccgctgtcccaaaaggtccagtcattatggtaaagcaagaaccattaatgcaggcacattcagattcttgtgtcctcaatatgttgtttctccaactcttgatagtatctgttattatcatatcagcagccagggcct

SEQ ID NO: 419179 - DNA, 140 bp, Artificial Sequence
  Synthetic
aggccctggctgctgatatgacaattgggtaattgcagcgttgccggatggatattaggaaacccagaatgcgaatcactgatttccaagaaatcatggtcctacattgtagaaacaccagaccttttgggacagcggtg

SEQ ID NO: 419180 - DNA, 140 bp, Artificial Sequence
  Synthetic
caccgctgtcccaaaaggtctggtgtttctacaatgtaggaccatgatttcttggaaatcagtgattcgcattctgggtttcctaatatccatccggcaacgctgcaattacccaattgtcatatcagcagccagggcct

SEQ ID NO: 419181 - DNA, 140 bp, Artificial Sequence
  Synthetic
atacgccatgctgggtctccacaattactggagacaataccaagtggaatgagaatcagaatcctcgaatgtttctggcaatgataacatacatcacaagaagccagcctgaatggtttacgtacttgggagtcggccat

SEQ ID NO: 419182 - DNA, 140 bp, Artificial Sequence
  Synthetic
atggccgactcccaagtacgtaaaccattcaggctggcttcttgtgatgtatgttatcattgccagaaacattcgaggattctgattctcattccacttggtattgtctccagtaattgtggagacccagcatggcgtat

SEQ ID NO: 419183 - DNA, 140 bp, Artificial Sequence
  Synthetic
aggccctggctgctgatatggtttctggcaatgataacatacatcacaagaagccagcctgaatggtttagaaatgtattgagtattgcccctataatgttctcaaacaaaatggcaagggaccttttgggacagcggtg

SEQ ID NO: 419184 - DNA, 140 bp, Artificial Sequence
  Synthetic
caccgctgtcccaaaaggtcccttgccattttgtttgagaacattataggggcaatactcaatacatttctaaaccattcaggctggcttcttgtgatgtatgttatcattgccagaaaccatatcagcagccagggcct

SEQ ID NO: 419185 - DNA, 140 bp, Artificial Sequence
  Synthetic
atacgccatgctgggtctccgataccggcagagatgcttgcaaacattgacctgaaatacttcaatgaatcaacaagaaagaaaatcgagagaataagacctctattaatagatggcacacgtacttgggagtcggccat

SEQ ID NO: 419186 - DNA, 140 bp, Artificial Sequence
  Synthetic
atggccgactcccaagtacgtgtgccatctattaatagaggtcttattctctcgattttctttcttgttgattcattgaagtatttcaggtcaatgtttgcaagcatctctgccggtatcggagacccagcatggcgtat

SEQ ID NO: 419187 - DNA, 140 bp, Artificial Sequence
  Synthetic
atacgccatgctgggtctccatggagagaataaaagaattaagagatctaatgtcacagtcccgcactcgcgagatactaacaaaaaccactgtggaccatatggccataatcaagaaatcgtacttgggagtcggccat

SEQ ID NO: 419188 - DNA, 140 bp, Artificial Sequence
  Synthetic
atggccgactcccaagtacgatttcttgattatggccatatggtccacagtggtttttgttagtatctcgcgagtgcgggactgtgacattagatctcttaattcttttattctctccatggagacccagcatggcgtat

SEQ ID NO: 419189 - DNA, 140 bp, Artificial Sequence
  Synthetic
aggccctggctgctgatatggaggggataccgctgtatgatgcgatcaaatgcatgaagacctttttcggctggaaagagcctaacattgtcaagccacatgaaaagggcataaaccccagaccttttgggacagcggtg

SEQ ID NO: 419190 - DNA, 140 bp, Artificial Sequence
  Synthetic
caccgctgtcccaaaaggtctggggtttatgcccttttcatgtggcttgacaatgttaggctctttccagccgaaaaaggtcttcatgcatttgatcgcatcatacagcggtatcccctccatatcagcagccagggcct

SEQ ID NO: 419191 - DNA, 140 bp, Artificial Sequence
  Synthetic
atacgccatgctgggtctccctacatactggtgggatggactccaatcctctgatgatttcgctctaatagtgaatgcaccaaaccatgaaggaatacaagcaggggtgaataggttctacgtacttgggagtcggccat

SEQ ID NO: 419192 - DNA, 140 bp, Artificial Sequence
  Synthetic
atggccgactcccaagtacgtagaacctattcacccctgcttgtattccttcatggtttggtgcattcactattagagcgaaatcatcagaggattggagtccatcccaccagtatgtagggagacccagcatggcgtat

SEQ ID NO: 419193 - DNA, 140 bp, Artificial Sequence
  Synthetic
aggccctggctgctgatatggtgaatgcaccaaaccatgaaggaatacaagcaggggtgaataggttctatagaacctgcaaactggttggaatcaatatgagcaaaaagaaatcctacagaccttttgggacagcggtg

SEQ ID NO: 419194 - DNA, 140 bp, Artificial Sequence
  Synthetic
caccgctgtcccaaaaggtctgtaggatttctttttgctcatattgattccaaccagtttgcaggttctatagaacctattcacccctgcttgtattccttcatggtttggtgcattcaccatatcagcagccagggcct

SEQ ID NO: 419195 - DNA, 140 bp, Artificial Sequence
  Synthetic
aggccctggctgctgatatgaggaaaggaccgacaacagataccgtccactatccgaaagtctacaaaacatattttgaaaaagttgaaaggttaaagcatgggacctttggccccgttcgaccttttgggacagcggtg

SEQ ID NO: 419196 - DNA, 140 bp, Artificial Sequence
  Synthetic
caccgctgtcccaaaaggtcgaacggggccaaaggtcccatgctttaacctttcaactttttcaaaatatgttttgtagactttcggatagtggacggtatctgttgtcggtcctttcctcatatcagcagccagggcct

SEQ ID NO: 419197 - DNA, 140 bp, Artificial Sequence
  Synthetic
atacgccatgctgggtctcctttgtagccaatttcagtatggagttacccagctttggggtatctgggattaatgaatcagctgacatgagcattggagttactgtgataaaaaacaatacgtacttgggagtcggccat

SEQ ID NO: 419198 - DNA, 140 bp, Artificial Sequence
  Synthetic
atggccgactcccaagtacgtattgttttttatcacagtaactccaatgctcatgtcagctgattcattaatcccagataccccaaagctgggtaactccatactgaaattggctacaaaggagacccagcatggcgtat

SEQ ID NO: 419199 - DNA, 140 bp, Artificial Sequence
  Synthetic
aggccctggctgctgatatgtaatgaatcagctgacatgagcattggagttactgtgataaaaaacaatatgataaacaatgaccttgggccagcaacagctcagatggctcttcagctagaccttttgggacagcggtg

SEQ ID NO: 419200 - DNA, 140 bp, Artificial Sequence
  Synthetic
caccgctgtcccaaaaggtctagctgaagagccatctgagctgttgctggcccaaggtcattgtttatcatattgttttttatcacagtaactccaatgctcatgtcagctgattcattacatatcagcagccagggcct

SEQ ID NO: 419201 - DNA, 140 bp, Artificial Sequence
  Synthetic
aggccctggctgctgatatgattgcttctcattgttcaggcacttagggacaacctggaacctggaaccttcgatcttggggggctatatgaagcaatcgaggagtgcctgattaatgatgaccttttgggacagcggtg

SEQ ID NO: 419202 - DNA, 140 bp, Artificial Sequence
  Synthetic
caccgctgtcccaaaaggtcatcattaatcaggcactcctcgattgcttcatatagccccccaagatcgaaggttccaggttccaggttgtccctaagtgcctgaacaatgagaagcaatcatatcagcagccagggcct

SEQ ID NO: 419203 - DNA, 140 bp, Artificial Sequence
  Synthetic
atacgccatgctgggtctccaattcaaactaggagatcattcgagctgaagaagatgtgggatcagacccgctcaaaggcaggactgttggtttcagacggaggaccaaatctgtataatcgtacttgggagtcggccat

SEQ ID NO: 419204 - DNA, 140 bp, Artificial Sequence
  Synthetic
atggccgactcccaagtacgattatacagatttggtcctccgtctgaaaccaacagtcctgcctttgagcgggtctgatcccacatcttcttcagctcgaatgatctcctagtttgaattggagacccagcatggcgtat

SEQ ID NO: 419205 - DNA, 140 bp, Artificial Sequence
  Synthetic
aggccctggctgctgatatggctcaaaggcaggactgttggtttcagacggaggaccaaatctgtataatatccgaaatctccacatcccagaagtctgcctgaagtgggaactaatggagaccttttgggacagcggtg

SEQ ID NO: 419206 - DNA, 140 bp, Artificial Sequence
  Synthetic
caccgctgtcccaaaaggtctccattagttcccacttcaggcagacttctgggatgtggagatttcggatattatacagatttggtcctccgtctgaaaccaacagtcctgcctttgagccatatcagcagccagggcct

SEQ ID NO: 419207 - DNA, 140 bp, Artificial Sequence
  Synthetic
aggccctggctgctgatatgcccgattgatggaccactacctgaggataatgaaccaagtgggtatgcacaaacagactgtgttctagaggctatggctttccttgaagaatcccacccagaccttttgggacagcggtg

SEQ ID NO: 419208 - DNA, 140 bp, Artificial Sequence
  Synthetic
caccgctgtcccaaaaggtctgggtgggattcttcaaggaaagccatagcctctagaacacagtctgtttgtgcatacccacttggttcattatcctcaggtagtggtccatcaatcgggcatatcagcagccagggcct

SEQ ID NO: 419209 - DNA, 140 bp, Artificial Sequence
  Synthetic
atacgccatgctgggtctcccatgcagacctcagtgccaaggaagcacaagatgttatcatggaggtcgttttcccaaatgaagtgggggccagaatattaacatcagagtcgcaattaacgtacttgggagtcggccat

SEQ ID NO: 419210 - DNA, 140 bp, Artificial Sequence
  Synthetic
atggccgactcccaagtacgttaattgcgactctgatgttaatattctggcccccacttcatttgggaaaacgacctccatgataacatcttgtgcttccttggcactgaggtctgcatgggagacccagcatggcgtat

SEQ ID NO: 419211 - DNA, 140 bp, Artificial Sequence
  Synthetic
  misc_feature (78)..(78): n is a, c, g, or t
aggccctggctgctgatatggaataaaagaactaagagatttgatgtcacagtctcgcactcgcgagatactgacaanaacaactgtggaccatatggccataatcaagaaatatacatcgaccttttgggacagcggtg

SEQ ID NO: 419212 - DNA, 140 bp, Artificial Sequence
  Synthetic
  misc_feature (63)..(63): n is a, c, g, or t
caccgctgtcccaaaaggtcgatgtatatttcttgattatggccatatggtccacagttgttnttgtcagtatctcgcgagtgcgagactgtgacatcaaatctcttagttcttttattccatatcagcagccagggcct

SEQ ID NO: 419213 - DNA, 140 bp, Artificial Sequence
  Synthetic
aggccctggctgctgatatggcacaatggcttggacagtggtaaacagcatctgcaataccacaggggttgagaaacccaagttccttccggatctatatgactataaagagaaccgattgaccttttgggacagcggtg

SEQ ID NO: 419214 - DNA, 140 bp, Artificial Sequence
  Synthetic
caccgctgtcccaaaaggtcaatcggttctctttatagtcatatagatccggaaggaacttgggtttctcaacccctgtggtattgcagatgctgtttaccactgtccaagccattgtgccatatcagcagccagggcct

SEQ ID NO: 419215 - DNA, 140 bp, Artificial Sequence
  Synthetic
atacgccatgctgggtctccaagatgaacagatgtaccaaaagtgctgcaatctattcgagaaattcttccctagtagttcatacaggaggccggttggaatttctagtatggtagaggccgtacttgggagtcggccat

SEQ ID NO: 419216 - DNA, 140 bp, Artificial Sequence
  Synthetic
atggccgactcccaagtacggcctctaccatactagaaattccaaccggcctcctgtatgaactactagggaagaatttctcgaatagattgcagcacttttggtacatctgttcatcttggagacccagcatggcgtat

SEQ ID NO: 419217 - DNA, 140 bp, Artificial Sequence
  Synthetic
aggccctggctgctgatatgtgtagtgaattttgtgagcatggagttttctcttactgaccctagactggagccacataaatgggagaaatactgtgtcctcgagataggggacatgctcgaccttttgggacagcggtg

SEQ ID NO: 419218 - DNA, 140 bp, Artificial Sequence
  Synthetic
caccgctgtcccaaaaggtcgagcatgtcccctatctcgaggacacagtatttctcccatttatgtggctccagtctagggtcagtaagagaaaactccatgctcacaaaattcactacacatatcagcagccagggcct

SEQ ID NO: 419219 - DNA, 140 bp, Artificial Sequence
  Synthetic
atacgccatgctgggtctcccatggtatctagggctcgcattgatgcacggattgactttgagtctggcaggattaagaaagaagagttcactgagatcatgaagacctgttccaccattcgtacttgggagtcggccat

SEQ ID NO: 419220 - DNA, 140 bp, Artificial Sequence
  Synthetic
atggccgactcccaagtacgaatggtggaacaggtcttcatgatctcagtgaactcttctttcttaatcctgccagactcaaagtcaatccgtgcatcaatgcgagccctagataccatgggagacccagcatggcgtat

SEQ ID NO: 419221 - DNA, 140 bp, Artificial Sequence
  Synthetic
atacgccatgctgggtctccaacaattgggactcatcccaactccagtgccggtctaaaggatgatcttcttgaaaatttgcaggcataccagaaacggatgggagtgcaaatgcagcgacgtacttgggagtcggccat

SEQ ID NO: 419222 - DNA, 140 bp, Artificial Sequence
  Synthetic
atggccgactcccaagtacgtcgctgcatttgcactcccatccgtttctggtatgcctgcaaattttcaagaagatcatcctttagaccggcactggagttgggatgagtcccaattgttggagacccagcatggcgtat

SEQ ID NO: 419223 - DNA, 140 bp, Artificial Sequence
  Synthetic
aggccctggctgctgatatgcctaccggtagcaggcggaacaagcagtgtgtacattgaggtactgcatttaactcaagggacctgttgggaacagatgtacactccaggcggggaagtggaccttttgggacagcggtg

SEQ ID NO: 419224 - DNA, 140 bp, Artificial Sequence
  Synthetic
caccgctgtcccaaaaggtccacttccccgcctggagtgtacatctgttcccaacaggtcccttgagttaaatgcagtacctcaatgtacacactgcttgttccgcctgctaccggtaggcatatcagcagccagggcct

SEQ ID NO: 419225 - DNA, 140 bp, Artificial Sequence
  Synthetic
atacgccatgctgggtctccggaaaagacaatgaaagaatatggagaaagtccaaaaatcgaaacgaacaaattcgccgcaatatgcacacacttagaagtctgcttcatgtattcagatcgtacttgggagtcggccat

SEQ ID NO: 419226 - DNA, 140 bp, Artificial Sequence
  Synthetic
atggccgactcccaagtacgatctgaatacatgaagcagacttctaagtgtgtgcatattgcggcgaatttgttcgtttcgatttttggactttctccatattctttcattgtcttttccggagacccagcatggcgtat

SEQ ID NO: 419227 - DNA, 140 bp, Artificial Sequence
  Synthetic
atacgccatgctgggtctcctcccaatgacggaacaggcagttgtggtccagtatcttctaatggggcatatggggtaaaagggttttcgtttagatacggtaacggtgtttggataggacgtacttgggagtcggccat

SEQ ID NO: 419228 - DNA, 140 bp, Artificial Sequence
  Synthetic
atggccgactcccaagtacgtcctatccaaacaccgttaccgtatctaaacgaaaacccttttaccccatatgccccattagaagatactggaccacaactgcctgttccgtcattgggaggagacccagcatggcgtat

SEQ ID NO: 419229 - DNA, 140 bp, Artificial Sequence
  Synthetic
aggccctggctgctgatatgagagcagggcgagaatcaaaactaggcttttcactataagacaagaaatggccagtaggagtctatgggattcctttcgtcagtccgaaagaggcgaagagaccttttgggacagcggtg

SEQ ID NO: 419230 - DNA, 140 bp, Artificial Sequence
  Synthetic
caccgctgtcccaaaaggtctcttcgcctctttcggactgacgaaaggaatcccatagactcctactggccatttcttgtcttatagtgaaaagcctagttttgattctcgccctgctctcatatcagcagccagggcct

SEQ ID NO: 419231 - DNA, 140 bp, Artificial Sequence
  Synthetic
atacgccatgctgggtctccatggaaacagtaacactgatgactatactactattagtaacaacaagccttgcagacaaaatctgtatcggccaccaatcgacaaattctacagaaactgcgtacttgggagtcggccat

SEQ ID NO: 419232 - DNA, 140 bp, Artificial Sequence
  Synthetic
atggccgactcccaagtacgcagtttctgtagaatttgtcgattggtggccgatacagattttgtctgcaaggcttgttgttactaatagtagtatagtcatcagtgttactgtttccatggagacccagcatggcgtat

SEQ ID NO: 419233 - DNA, 140 bp, Artificial Sequence
  Synthetic
atacgccatgctgggtctccttcggatttaaagttcagaatgatgtatggcttgggagaacaatatcatatagcagccgatcaggattcgaggtgatcaaggtctcaaatggttggatcacgtacttgggagtcggccat

SEQ ID NO: 419234 - DNA, 140 bp, Artificial Sequence
  Synthetic
atggccgactcccaagtacgtgatccaaccatttgagaccttgatcacctcgaatcctgatcggctgctatatgatattgttctcccaagccatacatcattctgaactttaaatccgaaggagacccagcatggcgtat

SEQ ID NO: 419235 - DNA, 140 bp, Artificial Sequence
  Synthetic
aggccctggctgctgatatgccaatctaaatgatgccacatatcagagaacgagagctctcgtgcgtaccggaatggaccccaggatgtgctctctgatgcaaggatcaactctcccgaggaccttttgggacagcggtg

SEQ ID NO: 419236 - DNA, 140 bp, Artificial Sequence
  Synthetic
caccgctgtcccaaaaggtcctcgggagagttgatccttgcatcagagagcacatcctggggtccattccggtacgcacgagagctctcgttctctgatatgtggcatcatttagattggcatatcagcagccagggcct

SEQ ID NO: 419237 - DNA, 140 bp, Artificial Sequence
  Synthetic
atacgccatgctgggtctcccagctactcagccggtgcgctttccggttgtatgggtctcatatataataggatgggaacagtaacaacagaagtggctttgggcctagtgtgtgccactcgtacttgggagtcggccat

SEQ ID NO: 419238 - DNA, 140 bp, Artificial Sequence
  Synthetic
atggccgactcccaagtacgagtggcacacactaggcccaaagccacttctgttgttactgttcccatcctattatatatgagacccatacaaccggaaagcgcaccggctgagtagctgggagacccagcatggcgtat

SEQ ID NO: 419239 - DNA, 140 bp, Artificial Sequence
  Synthetic
aggccctggctgctgatatgggaaggagtgcctgagtctatgagggaagagtaccagcaggagcgacagagtgctgtggatgttgacgatggtcattttgtcaacatagagctggagtaagaccttttgggacagcggtg

SEQ ID NO: 419240 - DNA, 140 bp, Artificial Sequence
  Synthetic
caccgctgtcccaaaaggtcttactccagctctatgttgacaaaatgaccatcgtcaacatccacagcactctgtcgctcctgctggtactcttccctcatagactcaggcactccttcccatatcagcagccagggcct

SEQ ID NO: 419241 - DNA, 140 bp, Artificial Sequence
  Synthetic
aggccctggctgctgatatgccaaagagaacacaatctggactagcgggagcagcatatccttttgtggtgtaaacagtgacactgtgggttggtcttggccagacggtgctgagttgccgaccttttgggacagcggtg

SEQ ID NO: 419242 - DNA, 140 bp, Artificial Sequence
  Synthetic
caccgctgtcccaaaaggtcggcaactcagcaccgtctggccaagaccaacccacagtgtcactgtttacaccacaaaaggatatgctgctcccgctagtccagattgtgttctctttggcatatcagcagccagggcct

SEQ ID NO: 419243 - DNA, 140 bp, Artificial Sequence
  Synthetic
aggccctggctgctgatatgtcacgctcaccgtgcccagtgagcgaggactgcagcgtagacggtttgtccaaaacgccctaaatgggaatggagacccaaacaatatggacaaggcagtgaccttttgggacagcggtg

SEQ ID NO: 419244 - DNA, 140 bp, Artificial Sequence
  Synthetic
caccgctgtcccaaaaggtcactgccttgtccatattgtttgggtctccattcccatttagggcgttttggacaaaccgtctacgctgcagtcctcgctcactgggcacggtgagcgtgacatatcagcagccagggcct

SEQ ID NO: 419245 - DNA, 140 bp, Artificial Sequence
  Synthetic
aggccctggctgctgatatgaggaattattttacagcagaagtgtcccattgtagggccactgaatacataatgaagggagtgtacataaatacggctttgcttaatgcatcatgtgcaggaccttttgggacagcggtg

SEQ ID NO: 419246 - DNA, 140 bp, Artificial Sequence
  Synthetic
caccgctgtcccaaaaggtcctgcacatgatgcattaagcaaagccgtatttatgtacactcccttcattatgtattcagtggccctacaatgggacacttctgctgtaaaataattcctcatatcagcagccagggcct

SEQ ID NO: 419247 - DNA, 140 bp, Artificial Sequence
  Synthetic
atacgccatgctgggtctcccacattacttcaatcaaaatgagtgcagcaccccattgagcaatcaagtaatgccatgtgagccaatcataatagagaggaacaaaacagagatggtgtacgtacttgggagtcggccat

SEQ ID NO: 419248 - DNA, 140 bp, Artificial Sequence
  Synthetic
atggccgactcccaagtacgtacaccatctctgttttgttcctctctattatgattggctcacatggcattacttgattgctcaatggggtgctgcactcattttgattgaagtaatgtgggagacccagcatggcgtat

SEQ ID NO: 419249 - DNA, 140 bp, Artificial Sequence
  Synthetic
atacgccatgctgggtctccgatcagaggtttcgtgtattttgtcgaaacactagcaaggagcatctgtgaaaaacttgagcaatctgggctccctgttggagggaatgagaagaaggctcgtacttgggagtcggccat

SEQ ID NO: 419250 - DNA, 140 bp, Artificial Sequence
  Synthetic
atggccgactcccaagtacgagccttcttctcattccctccaacagggagcccagattgctcaagtttttcacagatgctccttgctagtgtttcgacaaaatacacgaaacctctgatcggagacccagcatggcgtat

SEQ ID NO: 419251 - DNA, 140 bp, Artificial Sequence
  Synthetic
atacgccatgctgggtctccatagatcctttccgtctgctgcaaaacagtcaggtcctcagtctaattagatcaaatgagaatccatcacataaaagtcaattggtgtggatggcatgcccgtacttgggagtcggccat

SEQ ID NO: 419252 - DNA, 140 bp, Artificial Sequence
  Synthetic
atggccgactcccaagtacgggcatgccatccacaccaattgacttttatgtgatggattctcatttgatctaattagactgaggacctgactgttttgcagcagacggaaaggatctatggagacccagcatggcgtat

SEQ ID NO: 419253 - DNA, 140 bp, Artificial Sequence
  Synthetic
atacgccatgctgggtctccccctacatttcaagcaaaatgaatgcagcaacccatcaaataaccaagtggtgccatgtgaaccgatcctaatagagaggaacacagtgcatttgaatagcgtacttgggagtcggccat

SEQ ID NO: 419254 - DNA, 140 bp, Artificial Sequence
  Synthetic
atggccgactcccaagtacgctattcaaatgcactgtgttcctctctattaggatcggttcacatggcaccacttggttatttgatgggttgctgcattcattttgcttgaaatgtagggggagacccagcatggcgtat

SEQ ID NO: 419255 - DNA, 140 bp, Artificial Sequence
  Synthetic
atacgccatgctgggtctccaccccagctcaacccgattgatggaccactacctgaggataatgaaccaagtgggtatgcacaaacagactgtgttctagaggctatggctttccttgaacgtacttgggagtcggccat

SEQ ID NO: 419256 - DNA, 140 bp, Artificial Sequence
  Synthetic
atggccgactcccaagtacgttcaaggaaagccatagcctctagaacacagtctgtttgtgcatacccacttggttcattatcctcaggtagtggtccatcaatcgggttgagctggggtggagacccagcatggcgtat

SEQ ID NO: 419257 - DNA, 140 bp, Artificial Sequence
  Synthetic
aggccctggctgctgatatgccaattgaagtgggcacttggtgagaacatggcacctgaaaaggtggacttcgaggactgcagagatgttagcgatctaagacagtatgacagtgatgaagaccttttgggacagcggtg

SEQ ID NO: 419258 - DNA, 140 bp, Artificial Sequence
  Synthetic
caccgctgtcccaaaaggtcttcatcactgtcatactgtcttagatcgctaacatctctgcagtcctcgaagtccaccttttcaggtgccatgttctcaccaagtgcccacttcaattggcatatcagcagccagggcct

SEQ ID NO: 419259 - DNA, 140 bp, Artificial Sequence
  Synthetic
aggccctggctgctgatatgtgaatcagcagatatggcaataggaatgacaataataaagaacaatatgattaacaatggaatgggtccggcaacagcacaaacagccatacaattgttcgaccttttgggacagcggtg

SEQ ID NO: 419260 - DNA, 140 bp, Artificial Sequence
  Synthetic
caccgctgtcccaaaaggtcgaacaattgtatggctgtttgtgctgttgccggacccattccattgttaatcatattgttctttattattgtcattcctattgccatatctgctgattcacatatcagcagccagggcct

SEQ ID NO: 419261 - DNA, 140 bp, Artificial Sequence
  Synthetic
atacgccatgctgggtctccatgttgctccaattgagcacattgcgagtatgagacgaaactatttcacagcggaagtgtctcattgcagggctactgagtatataatgaaaggagtgtacgtacttgggagtcggccat

SEQ ID NO: 419262 - DNA, 140 bp, Artificial Sequence
  Synthetic
atggccgactcccaagtacgtacactcctttcattatatactcagtagccctgcaatgagacacttccgctgtgaaatagtttcgtctcatactcgcaatgtgctcaattggagcaacatggagacccagcatggcgtat

SEQ ID NO: 419263 - DNA, 140 bp, Artificial Sequence
  Synthetic
aggccctggctgctgatatgagataacaacccactttcaaagaaaaaggagagtaagagacaacatgaccaagaagatggtcacgcaaagaacaatagggaagaaaaaacagagactgaagaccttttgggacagcggtg

SEQ ID NO: 419264 - DNA, 140 bp, Artificial Sequence
  Synthetic
caccgctgtcccaaaaggtcttcagtctctgttttttcttccctattgttctttgcgtgaccatcttcttggtcatgttgtctcttactctcctttttctttgaaagtgggttgttatctcatatcagcagccagggcct

SEQ ID NO: 419265 - DNA, 140 bp, Artificial Sequence
  Synthetic
atacgccatgctgggtctccatgcagagagaggcaagttaaaaagaagggctatcgcaacacctgggatgcagattagaggtttcgtatactttgttgaaactttagctaggagcatttgcgtacttgggagtcggccat

SEQ ID NO: 419266 - DNA, 140 bp, Artificial Sequence
  Synthetic
atggccgactcccaagtacgcaaatgctcctagctaaagtttcaacaaagtatacgaaacctctaatctgcatcccaggtgttgcgatagcccttctttttaacttgcctctctctgcatggagacccagcatggcgtat

SEQ ID NO: 419267 - DNA, 140 bp, Artificial Sequence
  Synthetic
atacgccatgctgggtctccgtatgaaaatgttcccaaaacaaagatacaacacttagaagaatgttcctgctatgtggacattgatgtttactgtatatgtagggacaattggaagggtcgtacttgggagtcggccat

SEQ ID NO: 419268 - DNA, 140 bp, Artificial Sequence
  Synthetic
atggccgactcccaagtacgacccttccaattgtccctacatatacagtaaacatcaatgtccacatagcaggaacattcttctaagtgttgtatctttgttttgggaacattttcatacggagacccagcatggcgtat

SEQ ID NO: 419269 - DNA, 140 bp, Artificial Sequence
  Synthetic
atacgccatgctgggtctccgactagtgggagcagcatatccttttgtggtgtaaatagtgaaactgtgagttggtcttggccagacggtgctgagttgccattcaccattgacaagtagcgtacttgggagtcggccat

SEQ ID NO: 419270 - DNA, 140 bp, Artificial Sequence
  Synthetic
atggccgactcccaagtacgctacttgtcaatggtgaatggcaactcagcaccgtctggccaagaccaactcacagtttcactatttacaccacaaaaggatatgctgctcccactagtcggagacccagcatggcgtat

SEQ ID NO: 419271 - DNA, 140 bp, Artificial Sequence
  Synthetic
aggccctggctgctgatatggctccattgggaaggtgtgcagaacattactagcaaaatctgtattcaacagcctatatgcatctccacaactcgaggggttttcagctgaatcaagaaagaccttttgggacagcggtg

SEQ ID NO: 419272 - DNA, 140 bp, Artificial Sequence
  Synthetic
caccgctgtcccaaaaggtctttcttgattcagctgaaaacccctcgagttgtggagatgcatataggctgttgaatacagattttgctagtaatgttctgcacaccttcccaatggagccatatcagcagccagggcct

SEQ ID NO: 419273 - DNA, 140 bp, Artificial Sequence
  Synthetic
atacgccatgctgggtctcctctgtcaaagagaaggacatgaccaaagaattctttgaaaacaaatcagaaacatggccaattggagagtcccccaaaggggtggaggaaggctccatcgcgtacttgggagtcggccat

SEQ ID NO: 419274 - DNA, 140 bp, Artificial Sequence
  Synthetic
atggccgactcccaagtacgcgatggagccttcctccacccctttgggggactctccaattggccatgtttctgatttgttttcaaagaattctttggtcatgtccttctctttgacagaggagacccagcatggcgtat

SEQ ID NO: 419275 - DNA, 140 bp, Artificial Sequence
  Synthetic
aggccctggctgctgatatgcttttgaaagagcaaccgttatggcagcattcagcgggaacaatgaaggacggacatccgacatgcgaacagaagttataagaatgatggaaagtgcaaagaccttttgggacagcggtg

SEQ ID NO: 419276 - DNA, 140 bp, Artificial Sequence
  Synthetic
caccgctgtcccaaaaggtctttgcactttccatcattcttataacttctgttcgcatgtcggatgtccgtccttcattgttcccgctgaatgctgccataacggttgctctttcaaaagcatatcagcagccagggcct

SEQ ID NO: 419277 - DNA, 140 bp, Artificial Sequence
  Synthetic
atacgccatgctgggtctccaaggggcaagccggaagaaaagacgatatggacctcaagtagctccattgtgatgtgtggagtagaccatgaaattgccgactggtcgtggcacgatggacgtacttgggagtcggccat

SEQ ID NO: 419278 - DNA, 140 bp, Artificial Sequence
  Synthetic
atggccgactcccaagtacgtccatcgtgccacgaccagtcggcaatttcatggtctactccacacatcacaatggagctacttgaggtccatatcgtcttttcttccggcttgccccttggagacccagcatggcgtat

SEQ ID NO: 419279 - DNA, 140 bp, Artificial Sequence
  Synthetic
aggccctggctgctgatatgagaagtcctatataaataagacagggacatttgaattcacaagctttttttatcgctatggatttgtggctaattttagcatggagctacccagctttgggaccttttgggacagcggtg

SEQ ID NO: 419280 - DNA, 140 bp, Artificial Sequence
  Synthetic
caccgctgtcccaaaaggtcccaaagctgggtagctccatgctaaaattagccacaaatccatagcgataaaaaaagcttgtgaattcaaatgtccctgtcttatttatataggacttctcatatcagcagccagggcct

SEQ ID NO: 419281 - DNA, 140 bp, Artificial Sequence
  Synthetic
atacgccatgctgggtctccttcagcaaacaagagtggacaaactgacccaaggtcgccagacctatgattggacattgaatagaaaccagccggcagcaactgctttagccaacactatcgtacttgggagtcggccat

SEQ ID NO: 419282 - DNA, 140 bp, Artificial Sequence
  Synthetic
atggccgactcccaagtacgatagtgttggctaaagcagttgctgccggctggtttctattcaatgtccaatcataggtctggcgaccttgggtcagtttgtccactcttgtttgctgaaggagacccagcatggcgtat

SEQ ID NO: 419283 - DNA, 140 bp, Artificial Sequence
  Synthetic
atacgccatgctgggtctccacacaaagaacaatagggaagaaaaaacaaaaaatgaataagagaagttatctgataagagcactaacattgaatacaatgaccaaagatgcagagagagcgtacttgggagtcggccat

SEQ ID NO: 419284 - DNA, 140 bp, Artificial Sequence
  Synthetic
atggccgactcccaagtacgctctctctgcatctttggtcattgtattcaatgttagtgctcttatcagataacttctcttattcattttttgttttttcttccctattgttctttgtgtggagacccagcatggcgtat

SEQ ID NO: 419285 - DNA, 140 bp, Artificial Sequence
  Synthetic
atacgccatgctgggtctccgaggcaatggaggttgcaggccaggctagacagatggttcaggcaatgagaacaattgggactcatcctagttccagtgctggtctgaaagatgatcttccgtacttgggagtcggccat

SEQ ID NO: 419286 - DNA, 140 bp, Artificial Sequence
  Synthetic
atggccgactcccaagtacggaagatcatctttcagaccagcactggaactaggatgagtcccaattgttctcattgcctgaaccatctgtctagcctggcctgcaacctccattgcctcggagacccagcatggcgtat

SEQ ID NO: 419287 - DNA, 140 bp, Artificial Sequence
  Synthetic
aggccctggctgctgatatgatcaatgaccggaacttctggagaggtgaaaatggaaggagaacaagaattgcatatgaaaggatgtgcaacatcctcaaaggaaaactccaaacggcaggaccttttgggacagcggtg

SEQ ID NO: 419288 - DNA, 140 bp, Artificial Sequence
  Synthetic
caccgctgtcccaaaaggtcctgccgtttggagttttcctttgaggatgttgcacatcctttcatatgcaattcttgttctccttccattttcacctctccagaagttccggtcattgatcatatcagcagccagggcct

SEQ ID NO: 419289 - DNA, 140 bp, Artificial Sequence
  Synthetic
atacgccatgctgggtctccggggaattcttgaggatgaacagatgtaccagaagtgttgcaatctattcgagaaatttttccctagcagttcatataggagaccggttggaatttctagcgtacttgggagtcggccat

SEQ ID NO: 419290 - DNA, 140 bp, Artificial Sequence
  Synthetic
atggccgactcccaagtacgctagaaattccaaccggtctcctatatgaactgctagggaaaaatttctcgaatagattgcaacacttctggtacatctgttcatcctcaagaattccccggagacccagcatggcgtat

SEQ ID NO: 419291 - DNA, 140 bp, Artificial Sequence
  Synthetic
aggccctggctgctgatatgaaaaacttgagcaatctgggctccctgttggagggaatgagaagaaggctaaattggcgaatgtagtgagaaaaatgatgactaactcacaagacacagagaccttttgggacagcggtg

SEQ ID NO: 419292 - DNA, 140 bp, Artificial Sequence
  Synthetic
caccgctgtcccaaaaggtctctgtgtcttgtgagttagtcatcatttttctcactacattcgccaatttagccttcttctcattccctccaacagggagcccagattgctcaagtttttcatatcagcagccagggcct

SEQ ID NO: 419293 - DNA, 140 bp, Artificial Sequence
  Synthetic
aggccctggctgctgatatgttgagtctggacggatcaagaaagaagagttctctgagatcatgaagatctgttccaccattgaagaactcagacggcaaaaataatgaatttaacttgtgaccttttgggacagcggtg

SEQ ID NO: 419294 - DNA, 140 bp, Artificial Sequence
  Synthetic
caccgctgtcccaaaaggtcacaagttaaattcattatttttgccgtctgagttcttcaatggtggaacagatcttcatgatctcagagaactcttctttcttgatccgtccagactcaacatatcagcagccagggcct

SEQ ID NO: 419295 - DNA, 140 bp, Artificial Sequence
  Synthetic
atacgccatgctgggtctccaccctcggatgtttttggcgatgataacatacatcacaagaaaccaacctgaatggtttagaaatatattgagtatcgcccctataatgttctcaaacaacgtacttgggagtcggccat

SEQ ID NO: 419296 - DNA, 140 bp, Artificial Sequence
  Synthetic
atggccgactcccaagtacgttgtttgagaacattataggggcgatactcaatatatttctaaaccattcaggttggtttcttgtgatgtatgttatcatcgccaaaaacatccgagggtggagacccagcatggcgtat

SEQ ID NO: 419297 - DNA, 140 bp, Artificial Sequence
  Synthetic
aggccctggctgctgatatggaatggtttagaaatatattgagtatcgcccctataatgttctcaaacaagatggcaagattagggaaaggatacatgttcgagagtaagagcatgaaacgaccttttgggacagcggtg

SEQ ID NO: 419298 - DNA, 140 bp, Artificial Sequence
  Synthetic
caccgctgtcccaaaaggtcgtttcatgctcttactctcgaacatgtatcctttccctaatcttgccatcttgtttgagaacattataggggcgatactcaatatatttctaaaccattccatatcagcagccagggcct

SEQ ID NO: 419299 - DNA, 140 bp, Artificial Sequence
  Synthetic
aggccctggctgctgatatgtattcggatttccactttatagatgaacgaggcgagtcaataattgcagaatctggcgatccgaatgcattattgaaacaccgatttgagataattgaaggaccttttgggacagcggtg

SEQ ID NO: 419300 - DNA, 140 bp, Artificial Sequence
  Synthetic
caccgctgtcccaaaaggtccttcaattatctcaaatcggtgtttcaataatgcattcggatcgccagattctgcaattattgactcgcctcgttcatctataaagtggaaatccgaatacatatcagcagccagggcct

SEQ ID NO: 419301 - DNA, 140 bp, Artificial Sequence
  Synthetic
atacgccatgctgggtctccttcaatgaatcaacaaggaagaaaattgagaaaataagacctctcctaatagatgggactgcctcattgagtcctggaatgatgatgggcatgttcaacacgtacttgggagtcggccat

SEQ ID NO: 419302 - DNA, 140 bp, Artificial Sequence
  Synthetic
atggccgactcccaagtacgtgttgaacatgcccatcatcattccaggactcaatgaggcagtcccatctattaggagaggtcttattttctcaattttcttccttgttgattcattgaaggagacccagcatggcgtat

SEQ ID NO: 419303 - DNA, 140 bp, Artificial Sequence
  Synthetic
aggccctggctgctgatatgagatgggactgcctcattgagtcctggaatgatgatgggcatgttcaacatgctgagcacagtattaggagtctcaatcctaaatcttgggcaaaagagggaccttttgggacagcggtg

SEQ ID NO: 419304 - DNA, 140 bp, Artificial Sequence
  Synthetic
caccgctgtcccaaaaggtccctcttttgcccaagatttaggattgagactcctaatactgtgctcagcatgttgaacatgcccatcatcattccaggactcaatgaggcagtcccatctcatatcagcagccagggcct

SEQ ID NO: 419305 - DNA, 140 bp, Artificial Sequence
  Synthetic
atacgccatgctgggtctcccaggaacaggatataccatggacacggttaacagaacacatcaatattcagaaaaagggaaatggacaacaaactcagaaactggagcacctcagctcaacgtacttgggagtcggccat

SEQ ID NO: 419306 - DNA, 140 bp, Artificial Sequence
  Synthetic
atggccgactcccaagtacgttgagctgaggtgctccagtttctgagtttgttgtccatttccctttttctgaatattgatgtgttctgttaaccgtgtccatggtatatcctgttcctgggagacccagcatggcgtat

SEQ ID NO: 419307 - DNA, 140 bp, Artificial Sequence
  Synthetic
aggccctggctgctgatatgacctggaaaaagcaaacaagataaaatcagagaggacacacattcacatattctcattcactggagaggaaatggccactaaagctgactatactcttgagaccttttgggacagcggtg

SEQ ID NO: 419308 - DNA, 140 bp, Artificial Sequence
  Synthetic
caccgctgtcccaaaaggtctcaagagtatagtcagctttagtggccatttcctctccagtgaatgagaatatgtgaatgtgtgtcctctctgattttatcttgtttgctttttccaggtcatatcagcagccagggcct

SEQ ID NO: 419309 - DNA, 140 bp, Artificial Sequence
  Synthetic
aggccctggctgctgatatgcagattaccagagcctacggagtatcttagcaaacaatgggaaatttgagttcatcgcagaggaattccaatggaacacagtcaagcagaatgggaaatcgaccttttgggacagcggtg

SEQ ID NO: 419310 - DNA, 140 bp, Artificial Sequence
  Synthetic
caccgctgtcccaaaaggtcgatttcccattctgcttgactgtgttccattggaattcctctgcgatgaactcaaatttcccattgtttgctaagatactccgtaggctctggtaatctgcatatcagcagccagggcct

SEQ ID NO: 419311 - DNA, 140 bp, Artificial Sequence
  Synthetic
atacgccatgctgggtctccatggatgtcaatccgactttactcttcttgaaagtgccagcacaaaatgctataagcactacattcccatatactggagacccctctttcagccatggagcgtacttgggagtcggccat

SEQ ID NO: 419312 - DNA, 140 bp, Artificial Sequence
  Synthetic
atggccgactcccaagtacgctccatggctgaaagaggggtctccagtatatgggaatgtagtgcttatagcattttgtgctggcactttcaagaagagtaaagtcggattgacatccatggagacccagcatggcgtat

SEQ ID NO: 419313 - DNA, 140 bp, Artificial Sequence
  Synthetic
aggccctggctgctgatatgtgtaaaattgctcccttgatggtggcgtacatgctagaaagagaattggtccgtaaaacaaggtttctcccagtagccggtggaacaggcagtgtttatagaccttttgggacagcggtg

SEQ ID NO: 419314 - DNA, 140 bp, Artificial Sequence
  Synthetic
caccgctgtcccaaaaggtctataaacactgcctgttccaccggctactgggagaaaccttgttttacggaccaattctctttctagcatgtacgccaccatcaagggagcaattttacacatatcagcagccagggcct

SEQ ID NO: 419315 - DNA, 140 bp, Artificial Sequence
  Synthetic
atacgccatgctgggtctccgagcagacccgttcaaaagcaggactgttggtttcagatggaggaccaaacctatacaatattcggaatctccacattcccgaggtctgcttgaagtgggcgtacttgggagtcggccat

SEQ ID NO: 419316 - DNA, 140 bp, Artificial Sequence
  Synthetic
atggccgactcccaagtacgcccacttcaagcagacctcgggaatgtggagattccgaatattgtataggtttggtcctccatctgaaaccaacagtcctgcttttgaacgggtctgctcggagacccagcatggcgtat

SEQ ID NO: 419317 - DNA, 140 bp, Artificial Sequence
  Synthetic
aggccctggctgctgatatgtcgctccaaggggccattacaaactcaacagtcaaaagaagagcacaatcctgaatactgcagttcctataggatcctgcgttagtaagtgccacaccgagaccttttgggacagcggtg

SEQ ID NO: 419318 - DNA, 140 bp, Artificial Sequence
  Synthetic
caccgctgtcccaaaaggtctcggtgtggcacttactaacgcaggatcctataggaactgcagtattcaggattgtgctcttcttttgactgttgagtttgtaatggccccttggagcgacatatcagcagccagggcct

SEQ ID NO: 419319 - DNA, 140 bp, Artificial Sequence
  Synthetic
atacgccatgctgggtctccgagggggaaggtataccactatatgatgcaatcaaatgcatgaagacatttttcggctggaaagagcccaacattgtaaaaccacatgaaaagggcataacgtacttgggagtcggccat

SEQ ID NO: 419320 - DNA, 140 bp, Artificial Sequence
  Synthetic
atggccgactcccaagtacgttatgcccttttcatgtggttttacaatgttgggctctttccagccgaaaaatgtcttcatgcatttgattgcatcatatagtggtataccttccccctcggagacccagcatggcgtat

SEQ ID NO: 419321 - DNA, 140 bp, Artificial Sequence
  Synthetic
atacgccatgctgggtctcctttgtcagtcataaggaaattgagtctgtgaacaatgctgtagtaatgccagcccatggtccagccaaaagcatggaatatgatgctgttgcgactacaccgtacttgggagtcggccat

SEQ ID NO: 419322 - DNA, 140 bp, Artificial Sequence
  Synthetic
atggccgactcccaagtacggtgtagtcgcaacagcatcatattccatgcttttggctggaccatgggctggcattactacagcattgttcacagactcaatttccttatgactgacaaaggagacccagcatggcgtat

SEQ ID NO: 419323 - DNA, 140 bp, Artificial Sequence
  Synthetic
aggccctggctgctgatatgcaatcggggactgtcccaagtatgtcaaacaggggtctttgaaactggctacaggaatgaggaacatccctgagaaggcaaccagaggtctgtttggtgcgaccttttgggacagcggtg

SEQ ID NO: 419324 - DNA, 140 bp, Artificial Sequence
  Synthetic
caccgctgtcccaaaaggtcgcaccaaacagacctctggttgccttctcagggatgttcctcattcctgtagccagtttcaaagacccctgtttgacatacttgggacagtccccgattgcatatcagcagccagggcct

SEQ ID NO: 419325 - DNA, 140 bp, Artificial Sequence
  Synthetic
atacgccatgctgggtctccatgaatccaaatcagaagataatagcaattggctctgtttctctaaccattgcgataatatgtttcctcatgcagattgccatcttaacaacgactatgacgtacttgggagtcggccat

SEQ ID NO: 419326 - DNA, 140 bp, Artificial Sequence
  Synthetic
atggccgactcccaagtacgtcatagtcgttgttaagatggcaatctgcatgaggaaacatattatcgcaatggttagagaaacagagccaattgctattatcttctgatttggattcatggagacccagcatggcgtat

SEQ ID NO: 419327 - DNA, 140 bp, Artificial Sequence
  Synthetic
atacgccatgctgggtctccccaattgaagtgggcacttggtgagaatatggcaccagaaaaagtagactttgaggactgcaaagatgttagcgatctaaaacagtatgacagtgatgaacgtacttgggagtcggccat

SEQ ID NO: 419328 - DNA, 140 bp, Artificial Sequence
  Synthetic
atggccgactcccaagtacgttcatcactgtcatactgttttagatcgctaacatctttgcagtcctcaaagtctactttttctggtgccatattctcaccaagtgcccacttcaattggggagacccagcatggcgtat

SEQ ID NO: 419329 - DNA, 140 bp, Artificial Sequence
  Synthetic
aggccctggctgctgatatgatgggtttaggcaccagaatgcagaagggacagggacggctgctgatctcaagtcgactcaggcagctattgaccaaatcaatgggaaattaaatcgtctgaccttttgggacagcggtg

SEQ ID NO: 419330 - DNA, 140 bp, Artificial Sequence
  Synthetic
caccgctgtcccaaaaggtcagacgatttaatttcccattgatttggtcaatagctgcctgagtcgacttgagatcagcagccgtccctgtcccttctgcattctggtgcctaaacccatcatatcagcagccagggcct

SEQ ID NO: 419331 - DNA, 140 bp, Artificial Sequence
  Synthetic
aggccctggctgctgatatggcgacagagaatagtttcgaacaaataacatttatgcaagccttacaactactgcttgaagtagaacaagagataagagctttctcgtttcagcttatttgaccttttgggacagcggtg

SEQ ID NO: 419332 - DNA, 140 bp, Artificial Sequence
  Synthetic
caccgctgtcccaaaaggtcaaataagctgaaacgagaaagctcttatctcttgttctacttcaagcagtagttgtaaggcttgcataaatgttatttgttcgaaactattctctgtcgccatatcagcagccagggcct

SEQ ID NO: 419333 - DNA, 140 bp, Artificial Sequence
  Synthetic
atacgccatgctgggtctccttccagaactggggaattgaatccatcgacaatgtgatgggaatgatcggaatactgcccgacatgaccccaagcacggagatgtcgctgagagggataacgtacttgggagtcggccat

SEQ ID NO: 419334 - DNA, 140 bp, Artificial Sequence
  Synthetic
atggccgactcccaagtacgttatccctctcagcgacatctccgtgcttggggtcatgtcgggcagtattccgatcattcccatcacattgtcgatggattcaattccccagttctggaaggagacccagcatggcgtat

SEQ ID NO: 419335 - DNA, 140 bp, Artificial Sequence
  Synthetic
aggccctggctgctgatatgcccgattgatggaccactacctgaggacaatgagccaagcgggtatgctcaaacagactgcgtcctggaggcaatggctttccttgaggaatcccacccagaccttttgggacagcggtg

SEQ ID NO: 419336 - DNA, 140 bp, Artificial Sequence
  Synthetic
caccgctgtcccaaaaggtctgggtgggattcctcaaggaaagccattgcctccaggacgcagtctgtttgagcatacccgcttggctcattgtcctcaggtagtggtccatcaatcgggcatatcagcagccagggcct

SEQ ID NO: 419337 - DNA, 140 bp, Artificial Sequence
  Synthetic
aggccctggctgctgatatgaatccaacagaagagcaagccgtggatatatgcaaagcagcaatgggtttgagaatcagctcctcctttagctttggaggcttcaccttcaaaagaacaagaccttttgggacagcggtg

SEQ ID NO: 419338 - DNA, 140 bp, Artificial Sequence
  Synthetic
caccgctgtcccaaaaggtcttgttcttttgaaggtgaagcctccaaagctaaaggaggagctgattctcaaacccattgctgctttgcatatatccacggcttgctcttctgttggattcatatcagcagccagggcct

SEQ ID NO: 419339 - DNA, 140 bp, Artificial Sequence
  Synthetic
atacgccatgctgggtctccgtgagtattgaccgatttttaagggttagagatcaaagagggaacgtactattgtctcccgaagaagtcagtgaaacgcaaggaactgagaagttgacaacgtacttgggagtcggccat

SEQ ID NO: 419340 - DNA, 140 bp, Artificial Sequence
  Synthetic
atggccgactcccaagtacgttgtcaacttctcagttccttgcgtttcactgacttcttcgggagacaatagtacgttccctctttgatctctaacccttaaaaatcggtcaatactcacggagacccagcatggcgtat

SEQ ID NO: 419341 - DNA, 140 bp, Artificial Sequence
  Synthetic
aggccctggctgctgatatgattgtctcccgaagaagtcagtgaaacgcaaggaactgagaagttgacaataacttattcgtcatcaatgatgtgggagatcaatggccctgagtcagtggaccttttgggacagcggtg

SEQ ID NO: 419342 - DNA, 140 bp, Artificial Sequence
  Synthetic
caccgctgtcccaaaaggtccactgactcagggccattgatctcccacatcattgatgacgaataagttattgtcaacttctcagttccttgcgtttcactgacttcttcgggagacaatcatatcagcagccagggcct

SEQ ID NO: 419343 - DNA, 140 bp, Artificial Sequence
  Synthetic
atacgccatgctgggtctccaggtttacaaaacctactttgagaaggtcgaaagattaaagcatggaaccttcggtcccgttcactttcgaaatcaggtcaaaatacgtcgcagggttgacgtacttgggagtcggccat

SEQ ID NO: 419344 - DNA, 140 bp, Artificial Sequence
  Synthetic
atggccgactcccaagtacgtcaaccctgcgacgtattttgacctgatttcgaaagtgaacgggaccgaaggttccatgctttaatctttcgaccttctcaaagtaggttttgtaaacctggagacccagcatggcgtat

SEQ ID NO: 419345 - DNA, 140 bp, Artificial Sequence
  Synthetic
aggccctggctgctgatatgatattattcataagagaggggaaaattataaacattagcccattgtcagggagtgctcagcacgttgaggaatgctcctgttacccccggtatcctgaaggaccttttgggacagcggtg

SEQ ID NO: 419346 - DNA, 140 bp, Artificial Sequence
  Synthetic
caccgctgtcccaaaaggtccttcaggataccgggggtaacaggagcattcctcaacgtgctgagcactccctgacaatgggctaatgtttataattttcccctctcttatgaataatatcatatcagcagccagggcct

SEQ ID NO: 419347 - DNA, 140 bp, Artificial Sequence
  Synthetic
atacgccatgctgggtctcctaatggaggtcgttttcccaaacgaagtaggagccaggatattgacatcagagtcacagttaacaataacaaaagaaaagaaggaagagctccaggactgcgtacttgggagtcggccat

SEQ ID NO: 419348 - DNA, 140 bp, Artificial Sequence
  Synthetic
atggccgactcccaagtacgcagtcctggagctcttccttcttttcttttgttattgttaactgtgactctgatgtcaatatcctggctcctacttcgtttgggaaaacgacctccattaggagacccagcatggcgtat

SEQ ID NO: 419349 - DNA, 140 bp, Artificial Sequence
  Synthetic
atacgccatgctgggtctccgctcaaaggcaggactgctggtttcagatggaggaccaaatttatacaatatccggaatctccacattccggaagtctgcctgaagtgggagctaatggacgtacttgggagtcggccat

SEQ ID NO: 419350 - DNA, 140 bp, Artificial Sequence
  Synthetic
atggccgactcccaagtacgtccattagctcccacttcaggcagacttccggaatgtggagattccggatattgtataaatttggtcctccatctgaaaccagcagtcctgcctttgagcggagacccagcatggcgtat

SEQ ID NO: 419351 - DNA, 140 bp, Artificial Sequence
  Synthetic
atacgccatgctgggtctccagaatgaagtggatgatggcaatgaaatacccaattacagcagacaagagaataatggacatgattccagagaggaatgaacaaggacaaaccctctggacgtacttgggagtcggccat

SEQ ID NO: 419352 - DNA, 140 bp, Artificial Sequence
  Synthetic
atggccgactcccaagtacgtccagagggtttgtccttgttcattcctctctggaatcatgtccattattctcttgtctgctgtaattgggtatttcattgccatcatccacttcattctggagacccagcatggcgtat

SEQ ID NO: 419353 - DNA, 140 bp, Artificial Sequence
  Synthetic
aggccctggctgctgatatgggttagcgaaacacaaggaacggagaaattgacaataacctattcatcatcaatgatgtgggaaatcaatggacctgagtcagtgctcattaacacttacgaccttttgggacagcggtg

SEQ ID NO: 419354 - DNA, 140 bp, Artificial Sequence
  Synthetic
caccgctgtcccaaaaggtcgtaagtgttaatgagcactgactcaggtccattgatttcccacatcattgatgatgaataggttattgtcaatttctccgttccttgtgtttcgctaacccatatcagcagccagggcct

SEQ ID NO: 419355 - DNA, 140 bp, Artificial Sequence
  Synthetic
aggccctggctgctgatatgtgcacggattgatttcgagtctggaaggattaagaaagaagaatttgctgagatcatgaagatctgttccaccatagaagagttcagacggcaaaagtaggaccttttgggacagcggtg

SEQ ID NO: 419356 - DNA, 140 bp, Artificial Sequence
  Synthetic
caccgctgtcccaaaaggtcctacttttgccgtctgaactcttctatggtggaacagatcttcatgatctcagcaaattcttctttcttaatccttccagactcgaaatcaatccgtgcacatatcagcagccagggcct

SEQ ID NO: 419357 - DNA, 140 bp, Artificial Sequence
  Synthetic
atacgccatgctgggtctcctgacactacatttcaagcataatgaatgcaccaactcctcgaacaatcaagcagtgccatgtggaccaatcataatagaaaggaacgtaactgagatagtcgtacttgggagtcggccat

SEQ ID NO: 419358 - DNA, 140 bp, Artificial Sequence
  Synthetic
atggccgactcccaagtacgactatctcagttacgttcctttctattatgattggtccacatggcactgcttgattgttcgaggagttggtgcattcattatgcttgaaatgtagtgtcaggagacccagcatggcgtat

SEQ ID NO: 419359 - DNA, 140 bp, Artificial Sequence
  Synthetic
atacgccatgctgggtctccagcaatcatagtggcaatggtgttctcacaagaggattgcatgataaaagcagtgcgaggtgatttgaattttgtcaacagagcgaaccagcggctaaatcgtacttgggagtcggccat

SEQ ID NO: 419360 - DNA, 140 bp, Artificial Sequence
  Synthetic
atggccgactcccaagtacgatttagccgctggttcgctctgttgacaaaattcaaatcacctcgcactgcttttatcatgcaatcctcttgtgagaacaccattgccactatgattgctggagacccagcatggcgtat

SEQ ID NO: 419361 - DNA, 140 bp, Artificial Sequence
  Synthetic
atacgccatgctgggtctcctagatttcctcaaggatgtgatggaatcaatggataaggaagaaatggagataacaacacatttccagagaaagagaagagtaagagacaacatgaccaacgtacttgggagtcggccat

SEQ ID NO: 419362 - DNA, 140 bp, Artificial Sequence
  Synthetic
atggccgactcccaagtacgttggtcatgttgtctcttactcttctctttctctggaaatgtgttgttatctccatttcttccttatccattgattccatcacatccttgaggaaatctaggagacccagcatggcgtat

SEQ ID NO: 419363 - DNA, 140 bp, Artificial Sequence
  Synthetic
aggccctggctgctgatatgataacaacacatttccagagaaagagaagagtaagagacaacatgaccaagaaaatggtaacgcaaagaacaatcgggaagaaaaaacaaaggctgaacagaccttttgggacagcggtg

SEQ ID NO: 419364 - DNA, 140 bp, Artificial Sequence
  Synthetic
caccgctgtcccaaaaggtctgttcagcctttgttttttcttcccgattgttctttgcgttaccattttcttggtcatgttgtctcttactcttctctttctctggaaatgtgttgttatcatatcagcagccagggcct

SEQ ID NO: 419365 - DNA, 140 bp, Artificial Sequence
  Synthetic
aggccctggctgctgatatgtgcatatgagagaatgtgcaacatcctcaaagggaaattccaaacagcagcacaaagagcaatgatggatcaagtgcgagagagcagaaatcctggaaatgaccttttgggacagcggtg

SEQ ID NO: 419366 - DNA, 140 bp, Artificial Sequence
  Synthetic
caccgctgtcccaaaaggtcatttccaggatttctgctctctcgcacttgatccatcattgctctttgtgctgctgtttggaatttccctttgaggatgttgcacattctctcatatgcacatatcagcagccagggcct

SEQ ID NO: 419367 - DNA, 140 bp, Artificial Sequence
  Synthetic
aggccctggctgctgatatgagaacgccaaaatgctactgaaatcagagcatctgttgggagaatgattggaggaattggaagattctacatacagatgtgcactgaactccaactcagtgaccttttgggacagcggtg

SEQ ID NO: 419368 - DNA, 140 bp, Artificial Sequence
  Synthetic
caccgctgtcccaaaaggtcactgagttggagttcagtgcacatctgtatgtagaatcttccaattcctccaatcattctcccaacagatgctctgatttcagtagcattttggcgttctcatatcagcagccagggcct

SEQ ID NO: 419369 - DNA, 140 bp, Artificial Sequence
  Synthetic
atacgccatgctgggtctccctggatcggaccgtgtgatggtatcacccctggccgtaacatggtggaatagaaatggcccaacaacaagcacagtccactaccctaaggtatataaaaccgtacttgggagtcggccat

SEQ ID NO: 419370 - DNA, 140 bp, Artificial Sequence
  Synthetic
atggccgactcccaagtacggttttatataccttagggtagtggactgtgcttgttgttgggccatttctattccaccatgttacggccaggggtgataccatcacacggtccgatccagggagacccagcatggcgtat

SEQ ID NO: 419371 - DNA, 140 bp, Artificial Sequence
  Synthetic
aggccctggctgctgatatgatcctaggatgtttctggcaatgataacgtacatcacaaggaaccagccagaatggtttcgaaatgttttaagcattgcccctataatgttttcaaacaagaccttttgggacagcggtg

SEQ ID NO: 419372 - DNA, 140 bp, Artificial Sequence
  Synthetic
caccgctgtcccaaaaggtcttgtttgaaaacattataggggcaatgcttaaaacatttcgaaaccattctggctggttccttgtgatgtacgttatcattgccagaaacatcctaggatcatatcagcagccagggcct

SEQ ID NO: 419373 - DNA, 140 bp, Artificial Sequence
  Synthetic
atacgccatgctgggtctccatttatcgtcgctttaaatacggtttgaaaagagggccttctacggaaggagtgcctgagtccatgagggaagaatatcaacaggaacagcagagtgctgcgtacttgggagtcggccat

SEQ ID NO: 419374 - DNA, 140 bp, Artificial Sequence
  Synthetic
atggccgactcccaagtacgcagcactctgctgttcctgttgatattcttccctcatggactcaggcactccttccgtagaaggccctcttttcaaaccgtatttaaagcgacgataaatggagacccagcatggcgtat

SEQ ID NO: 419375 - DNA, 140 bp, Artificial Sequence
  Synthetic
atacgccatgctgggtctcctacgaacacaaataccagcagaaatgcttgcaaacattgatcttaaatacttcaacgaattgacgaaaaggaaaattgagaggataagacccctattaatcgtacttgggagtcggccat

SEQ ID NO: 419376 - DNA, 140 bp, Artificial Sequence
  Synthetic
atggccgactcccaagtacgattaataggggtcttatcctctcaattttccttttcgtcaattcgttgaagtatttaagatcaatgtttgcaagcatttctgctggtatttgtgttcgtaggagacccagcatggcgtat

SEQ ID NO: 419377 - DNA, 140 bp, Artificial Sequence
  Synthetic
atacgccatgctgggtctccaatacttgtgagaggcaattcccctgtgttcaattataacaaggcaaccaagaggctcacagtccttggaaaggatgcaggtgcattgacagaagatccacgtacttgggagtcggccat

SEQ ID NO: 419378 - DNA, 140 bp, Artificial Sequence
  Synthetic
atggccgactcccaagtacgtggatcttctgtcaatgcacctgcatcctttccaaggactgtgagcctcttggttgccttgttataattgaacacaggggaattgcctctcacaagtattggagacccagcatggcgtat

SEQ ID NO: 419379 - DNA, 140 bp, Artificial Sequence
  Synthetic
atacgccatgctgggtctcctgctgagtacagtcctaggagtttcaatcctgaatcttggacagaaaaggtacaccaaaaccacatattggtgggacgggctccaatcctctgatgatttcgtacttgggagtcggccat

SEQ ID NO: 419380 - DNA, 140 bp, Artificial Sequence
  Synthetic
atggccgactcccaagtacgaaatcatcagaggattggagcccgtcccaccaatatgtggttttggtgtaccttttctgtccaagattcaggattgaaactcctaggactgtactcagcaggagacccagcatggcgtat

SEQ ID NO: 419381 - DNA, 140 bp, Artificial Sequence
  Synthetic
aggccctggctgctgatatgtctgggcaaagaagacaaaagatatggaccagcattgagcatcaacgaattgagcaatcttgcgaaaggggagaaggctaatgtgttgatagggcaaggagaccttttgggacagcggtg

SEQ ID NO: 419382 - DNA, 140 bp, Artificial Sequence
  Synthetic
caccgctgtcccaaaaggtctccttgccctatcaacacattagccttctcccctttcgcaagattgctcaattcgttgatgctcaatgctggtccatatcttttgtcttctttgcccagacatatcagcagccagggcct

SEQ ID NO: 419383 - DNA, 140 bp, Artificial Sequence
  Synthetic
atacgccatgctgggtctcctctgaatttcgtaaacagagcaaaccaaagattaaaccccatgcatcaactcctaaggcacttccaaaaagatgcaaaagtgctgtttcagaattggggacgtacttgggagtcggccat

SEQ ID NO: 419384 - DNA, 140 bp, Artificial Sequence
  Synthetic
atggccgactcccaagtacgtccccaattctgaaacagcacttttgcatctttttggaagtgccttaggagttgatgcatggggtttaatctttggtttgctctgtttacgaaattcagaggagacccagcatggcgtat

SEQ ID NO: 419385 - DNA, 140 bp, Artificial Sequence
  Synthetic
atacgccatgctgggtctccataggttttataggacttgtaaactagttgggataaatatgagcaagaagaagtcttacataaatcggacagggacatttgaattcacgagctttttctacgtacttgggagtcggccat

SEQ ID NO: 419386 - DNA, 140 bp, Artificial Sequence
  Synthetic
atggccgactcccaagtacgtagaaaaagctcgtgaattcaaatgtccctgtccgatttatgtaagacttcttcttgctcatatttatcccaactagtttacaagtcctataaaacctatggagacccagcatggcgtat

SEQ ID NO: 419387 - DNA, 140 bp, Artificial Sequence
  Synthetic
aggccctggctgctgatatgaagtcttacataaatcggacagggacatttgaattcacgagctttttctaccgctatggattcgtagccaatttcagtatggagctgcccagttttggaggaccttttgggacagcggtg

SEQ ID NO: 419388 - DNA, 140 bp, Artificial Sequence
  Synthetic
caccgctgtcccaaaaggtcctccaaaactgggcagctccatactgaaattggctacgaatccatagcggtagaaaaagctcgtgaattcaaatgtccctgtccgatttatgtaagacttcatatcagcagccagggcct

SEQ ID NO: 419389 - DNA, 140 bp, Artificial Sequence
  Synthetic
aggccctggctgctgatatgtataaatacagccctgttgaattcatcctgtgcagccatggatgacttccaattgattccaatgataagcaagtgcagaaccaaagaaggaagacggaaggaccttttgggacagcggtg

SEQ ID NO: 419390 - DNA, 140 bp, Artificial Sequence
  Synthetic
caccgctgtcccaaaaggtccttccgtcttccttctttggttctgcacttgcttatcattggaatcaattggaagtcatccatggctgcacaggatgaattcaacagggctgtatttatacatatcagcagccagggcct

SEQ ID NO: 419391 - DNA, 140 bp, Artificial Sequence
  Synthetic
atacgccatgctgggtctcctttgtcataagggaaccattcatatcatgctcccccttggaatgcagaaccttcttcttgactcaaggggccttgctaaatgacaaacattccaatggaacgtacttgggagtcggccat

SEQ ID NO: 419392 - DNA, 140 bp, Artificial Sequence
  Synthetic
atggccgactcccaagtacgttccattggaatgtttgtcatttagcaaggccccttgagtcaagaagaaggttctgcattccaagggggagcatgatatgaatggttcccttatgacaaaggagacccagcatggcgtat

SEQ ID NO: 419393 - DNA, 140 bp, Artificial Sequence
  Synthetic
atacgccatgctgggtctccgaagttccctctccatacaactcaagatttgagtcggtcgcttggtcagcaagtgcttgtcatgatggcatcaattggctaacaattggaatttctggcccgtacttgggagtcggccat

SEQ ID NO: 419394 - DNA, 140 bp, Artificial Sequence
  Synthetic
atggccgactcccaagtacgggccagaaattccaattgttagccaattgatgccatcatgacaagcacttgctgaccaagcgaccgactcaaatcttgagttgtatggagagggaacttcggagacccagcatggcgtat

SEQ ID NO: 419395 - DNA, 140 bp, Artificial Sequence
  Synthetic
atacgccatgctgggtctcccaaccgctaattccaaatctcagataaataggcaagtcatagttgacaataataactggtctggttattctggccttttctctgttgaaggcaaaaactgcgtacttgggagtcggccat

SEQ ID NO: 419396 - DNA, 140 bp, Artificial Sequence
  Synthetic
atggccgactcccaagtacgcagtttttgccttcaacagagaaaaggccagaataaccagaccagttattattgtcaactatgacttgcctatttatctgagatttggaattagcggttgggagacccagcatggcgtat

SEQ ID NO: 419397 - DNA, 140 bp, Artificial Sequence
  Synthetic
aggccctggctgctgatatgatacaagaattggtcaaaacctcaatgtcaaattacagggtttgtccccttctccaaggacaactcaattaggctttctgcaggtggggatatttgggtggaccttttgggacagcggtg

SEQ ID NO: 419398 - DNA, 140 bp, Artificial Sequence
  Synthetic
caccgctgtcccaaaaggtccacccaaatatccccacctgcagaaagcctaattgagttgtccttggagaaggggacaaaccctgtaatttgacattgaggttttgaccaattcttgtatcatatcagcagccagggcct

SEQ ID NO: 419399 - DNA, 140 bp, Artificial Sequence
  Synthetic
atacgccatgctgggtctccactatcaagagttggagaaacaatatattgagaacacaagagtctgaatgtgcatgtgtaaatggttcttgctttaccataatgaccgatggaccaagtgcgtacttgggagtcggccat

SEQ ID NO: 419400 - DNA, 140 bp, Artificial Sequence
  Synthetic
atggccgactcccaagtacgcacttggtccatcggtcattatggtaaagcaagaaccatttacacatgcacattcagactcttgtgttctcaatatattgtttctccaactcttgatagtggagacccagcatggcgtat

SEQ ID NO: 419401 - DNA, 140 bp, Artificial Sequence
  Synthetic
aggccctggctgctgatatgtgcatgtgtaaatggttcttgctttaccataatgaccgatggaccaagtgatggacaggcctcatacaagatcttcagaatagaaaagggaaagatagtcgaccttttgggacagcggtg

SEQ ID NO: 419402 - DNA, 140 bp, Artificial Sequence
  Synthetic
caccgctgtcccaaaaggtcgactatctttcccttttctattctgaagatcttgtatgaggcctgtccatcacttggtccatcggtcattatggtaaagcaagaaccatttacacatgcacatatcagcagccagggcct

SEQ ID NO: 419403 - DNA, 140 bp, Artificial Sequence
  Synthetic
aggccctggctgctgatatgaaatggagaaaatagtgcttcttcttgcagtagtcagtattgttaaaagtgatcagatttgcattggttaccatgcaaacaactcgacagagcaggttgagaccttttgggacagcggtg

SEQ ID NO: 419404 - DNA, 140 bp, Artificial Sequence
  Synthetic
caccgctgtcccaaaaggtctcaacctgctctgtcgagttgtttgcatggtaaccaatgcaaatctgatcacttttaacaatactgactactgcaagaagaagcactattttctccatttcatatcagcagccagggcct

SEQ ID NO: 419405 - DNA, 140 bp, Artificial Sequence
  Synthetic
atacgccatgctgggtctccttatcctgattctagtgaaatcacatgtgtgtgcagggataactggcatggctcgaatcgaccgtgggtgtctttcaaccagaatctggaatatcagatacgtacttgggagtcggccat

SEQ ID NO: 419406 - DNA, 140 bp, Artificial Sequence
  Synthetic
atggccgactcccaagtacgtatctgatattccagattctggttgaaagacacccacggtcgattcgagccatgccagttatccctgcacacacatgtgatttcactagaatcaggataaggagacccagcatggcgtat

SEQ ID NO: 419407 - DNA, 140 bp, Artificial Sequence
  Synthetic
atacgccatgctgggtctccggatacatatgcagtgggattttcggagacaatccacgccctaatgataagacaggcagttgtggtccagtatcgtctaatggagcaaatggagtaaaagcgtacttgggagtcggccat

SEQ ID NO: 419408 - DNA, 140 bp, Artificial Sequence
  Synthetic
atggccgactcccaagtacgcttttactccatttgctccattagacgatactggaccacaactgcctgtcttatcattagggcgtggattgtctccgaaaatcccactgcatatgtatccggagacccagcatggcgtat

SEQ ID NO: 419409 - DNA, 140 bp, Artificial Sequence
  Synthetic
atacgccatgctgggtctccattagttcaagaaaaggttttgagatgatttgggatccaaatggatggactgggacagacaataacttctcaataaagcaagatatcgtaggaataaatgcgtacttgggagtcggccat

SEQ ID NO: 419410 - DNA, 140 bp, Artificial Sequence
  Synthetic
atggccgactcccaagtacgcatttattcctacgatatcttgctttattgagaagttattgtctgtcccagtccatccatttggatcccaaatcatctcaaaaccttttcttgaactaatggagacccagcatggcgtat

SEQ ID NO: 419411 - DNA, 140 bp, Artificial Sequence
  Synthetic
atacgccatgctgggtctccagtcccgcactcgcgagatactaacaaaaaccactgtggaccatatggccataatcaagaaatacacatcaggaagacaagagaagaatcctgccctcagcgtacttgggagtcggccat

SEQ ID NO: 419412 - DNA, 140 bp, Artificial Sequence
  Synthetic
atggccgactcccaagtacgctgagggcaggattcttctcttgtcttcctgatgtgtatttcttgattatggccatatggtccacagtggtttttgttagtatctcgcgagtgcgggactggagacccagcatggcgtat

SEQ ID NO: 419413 - DNA, 140 bp, Artificial Sequence
  Synthetic
atacgccatgctgggtctccctggattgtataagaccttgcttctgggttgaactaatcagagggcgacccaaagagaacacaatctggactagcgggagcagcatatccttttgtggtgcgtacttgggagtcggccat

SEQ ID NO: 419414 - DNA, 140 bp, Artificial Sequence
  Synthetic
atggccgactcccaagtacgcaccacaaaaggatatgctgctcccgctagtccagattgtgttctctttgggtcgccctctgattagttcaacccagaagcaaggtcttatacaatccagggagacccagcatggcgtat

SEQ ID NO: 419415 - DNA, 140 bp, Artificial Sequence
  Synthetic
atacgccatgctgggtctccagatcaaatggtctaacagctaatgagtcaggaaggctaatagatttcctaaaggatgtaatggaatcaatggataaagaggaaatagagataacaacaccgtacttgggagtcggccat

SEQ ID NO: 419416 - DNA, 140 bp, Artificial Sequence
  Synthetic
atggccgactcccaagtacggtgttgttatctctatttcctctttatccattgattccattacatcctttaggaaatctattagccttcctgactcattagctgttagaccatttgatctggagacccagcatggcgtat

SEQ ID NO: 419417 - DNA, 140 bp, Artificial Sequence
  Synthetic
atacgccatgctgggtctcccaggaacaggatacaccatggacacagtcaatagaacacatcaatactcagagaaggggagatggacaacaaatacagagactggagcaccccaactcaacgtacttgggagtcggccat

SEQ ID NO: 419418 - DNA, 140 bp, Artificial Sequence
  Synthetic
atggccgactcccaagtacgttgagttggggtgctccagtctctgtatttgttgtccatctccccttctctgagtattgatgtgttctattgactgtgtccatggtgtatcctgttcctgggagacccagcatggcgtat

SEQ ID NO: 419419 - DNA, 140 bp, Artificial Sequence
  Synthetic
aggccctggctgctgatatgctagagtatggtggacctcaaacagtatagtcgtattctgtgggacttcaggtacttatggaacaggctcatggcctgatggggcgaatatcaatttcatgaccttttgggacagcggtg

SEQ ID NO: 419420 - DNA, 140 bp, Artificial Sequence
  Synthetic
caccgctgtcccaaaaggtcatgaaattgatattcgccccatcaggccatgagcctgttccataagtacctgaagtcccacagaatacgactatactgtttgaggtccaccatactctagcatatcagcagccagggcct

SEQ ID NO: 419421 - DNA, 140 bp, Artificial Sequence
  Synthetic
atacgccatgctgggtctccaaacagactgtgtgttggaagcgatggctttccttgaagagtcccacccagggatctttgaaaactcatgtctcgaaaccatggaaattgttcagcaaaccgtacttgggagtcggccat

SEQ ID NO: 419422 - DNA, 140 bp, Artificial Sequence
  Synthetic
atggccgactcccaagtacggtttgctgaacaatttccatggtttcgagacatgagttttcaaagatccctgggtgggactcttcaaggaaagccatcgcttccaacacacagtctgtttggagacccagcatggcgtat

SEQ ID NO: 419423 - DNA, 140 bp, Artificial Sequence
  Synthetic
atacgccatgctgggtctcccaggaacagggtacaccatggacacagtcaatagaacacatcaatactcagagaaaggaaaatggacaacaaacacagaaactggagcaccccaactcaacgtacttgggagtcggccat

SEQ ID NO: 419424 - DNA, 140 bp, Artificial Sequence
  Synthetic
atggccgactcccaagtacgttgagttggggtgctccagtttctgtgtttgttgtccattttcctttctctgagtattgatgtgttctattgactgtgtccatggtgtaccctgttcctgggagacccagcatggcgtat

SEQ ID NO: 419425 - DNA, 140 bp, Artificial Sequence
  Synthetic
aggccctggctgctgatatgctgctggagatgtgtcacagcacacaaattggtgggataaggatggtggacatccttaggcaaaatccaactgaggaacaagctgtggatatatgcagaggaccttttgggacagcggtg

SEQ ID NO: 419426 - DNA, 140 bp, Artificial Sequence
  Synthetic
caccgctgtcccaaaaggtcctctgcatatatccacagcttgttcctcagttggattttgcctaaggatgtccaccatccttatcccaccaatttgtgtgctgtgacacatctccagcagcatatcagcagccagggcct

SEQ ID NO: 419427 - DNA, 140 bp, Artificial Sequence
  Synthetic
aggccctggctgctgatatgcgtgcccagtgagcgaggactgcagcgtagacgctttgttcaaaatgcccttaatgggaacggggatccaaacaacatggacagagcagtcaaactgtacgaccttttgggacagcggtg

SEQ ID NO: 419428 - DNA, 140 bp, Artificial Sequence
  Synthetic
caccgctgtcccaaaaggtcgtacagtttgactgctctgtccatgttgtttggatccccgttcccattaagggcattttgaacaaagcgtctacgctgcagtcctcgctcactgggcacgcatatcagcagccagggcct

SEQ ID NO: 419429 - DNA, 140 bp, Artificial Sequence
  Synthetic
aggccctggctgctgatatgcaacatactggtgggatggacttcaatcctccgacgattttgccctcatagtaaatgcaccaaaccatgagggaatacaagcaggagtggatagattctagaccttttgggacagcggtg

SEQ ID NO: 419430 - DNA, 140 bp, Artificial Sequence
  Synthetic
caccgctgtcccaaaaggtctagaatctatccactcctgcttgtattccctcatggtttggtgcatttactatgagggcaaaatcgtcggaggattgaagtccatcccaccagtatgttgcatatcagcagccagggcct

SEQ ID NO: 419431 - DNA, 140 bp, Artificial Sequence
  Synthetic
aggccctggctgctgatatgggcaatcattgtagcgatggtgttctcacaggaggattgtatggtaaaggcagtccgaggcgatctaaatttcgtaaacagagcaaaccaaagattaaatgaccttttgggacagcggtg

SEQ ID NO: 419432 - DNA, 140 bp, Artificial Sequence
  Synthetic
caccgctgtcccaaaaggtcatttaatctttggtttgctctgtttacgaaatttagatcgcctcggactgcctttaccatacaatcctcctgtgagaacaccatcgctacaatgattgcccatatcagcagccagggcct

SEQ ID NO: 419433 - DNA, 140 bp, Artificial Sequence
  Synthetic
atacgccatgctgggtctccttgggaaaaggttacatgttcgagagcaagagcatgaggctgcggacacaaataccagcagaaatgcttgcaaccattgatctaaagtacttcaatgaagcgtacttgggagtcggccat

SEQ ID NO: 419434 - DNA, 140 bp, Artificial Sequence
  Synthetic
atggccgactcccaagtacgcttcattgaagtactttagatcaatggttgcaagcatttctgctggtatttgtgtccgcagcctcatgctcttgctctcgaacatgtaaccttttcccaaggagacccagcatggcgtat

SEQ ID NO: 419435 - DNA, 140 bp, Artificial Sequence
  Synthetic
aggccctggctgctgatatgcccatgcatcaactcctgagacattttcaaaaggacgcaaaggtgctatttcagaattggggaattgaacccattgataatgtcatggggatgatcgggagaccttttgggacagcggtg

SEQ ID NO: 419436 - DNA, 140 bp, Artificial Sequence
  Synthetic
caccgctgtcccaaaaggtctcccgatcatccccatgacattatcaatgggttcaattccccaattctgaaatagcacctttgcgtccttttgaaaatgtctcaggagttgatgcatgggcatatcagcagccagggcct

SEQ ID NO: 419437 - DNA, 140 bp, Artificial Sequence
  Synthetic
aggccctggctgctgatatgttcatcaaagactacagatacacatatagatgccatagaggggacacacaaattcagacgagaagatcattcgagctaaagagcctgtgggatcaaacccgaccttttgggacagcggtg

SEQ ID NO: 419438 - DNA, 140 bp, Artificial Sequence
  Synthetic
caccgctgtcccaaaaggtcgggtttgatcccacaggctctttagctcgaatgatcttctcgtctgaatttgtgtgtcccctctatggcatctatatgtgtatctgtagtctttgatgaacatatcagcagccagggcct

SEQ ID NO: 419439 - DNA, 140 bp, Artificial Sequence
  Synthetic
aggccctggctgctgatatgtttgtagccaactttagcatggaactgcccagctttggagtatctgggattaacgaatcagctgatatgagcattggagttacagtgataaagaataatagaccttttgggacagcggtg

SEQ ID NO: 419440 - DNA, 140 bp, Artificial Sequence
  Synthetic
caccgctgtcccaaaaggtctattattctttatcactgtaactccaatgctcatatcagctgattcgttaatcccagatactccaaagctgggcagttccatgctaaagttggctacaaacatatcagcagccagggcct

SEQ ID NO: 419441 - DNA, 140 bp, Artificial Sequence
  Synthetic
atacgccatgctgggtctccttccagtccttggtacctaaagctgccagaggtcaatacagtggatttgtgagaacattatttcaacaaatgcgtgatgtactagggacatttgatactgcgtacttgggagtcggccat

SEQ ID NO: 419442 - DNA, 140 bp, Artificial Sequence
  Synthetic
atggccgactcccaagtacgcagtatcaaatgtccctagtacatcacgcatttgttgaaataatgttctcacaaatccactgtattgacctctggcagctttaggtaccaaggactggaaggagacccagcatggcgtat

SEQ ID NO: 419443 - DNA, 140 bp, Artificial Sequence
  Synthetic
atacgccatgctgggtctcctttatcaaggactacagatacacataccgttgtcacagaggtgacacacaaattcaaacgaggagatcatttgagctgaaaaaactatgggagcagaccccgtacttgggagtcggccat

SEQ ID NO: 419444 - DNA, 140 bp, Artificial Sequence
  Synthetic
atggccgactcccaagtacggggtctgctcccatagttttttcagctcaaatgatctcctcgtttgaatttgtgtgtcacctctgtgacaacggtatgtgtatctgtagtccttgataaaggagacccagcatggcgtat

SEQ ID NO: 419445 - DNA, 140 bp, Artificial Sequence
  Synthetic
atacgccatgctgggtctcccaatgatgtgggaaatcaatggacctgagtcagtgctcattaacacttaccaatggatcattaggaattgggaaactgtgaagatccagtggtctcaagacgtacttgggagtcggccat

SEQ ID NO: 419446 - DNA, 140 bp, Artificial Sequence
  Synthetic
atggccgactcccaagtacgtcttgagaccactggatcttcacagtttcccaattcctaatgatccattggtaagtgttaatgagcactgactcaggtccattgatttcccacatcattgggagacccagcatggcgtat

SEQ ID NO: 419447 - DNA, 140 bp, Artificial Sequence
  Synthetic
aggccctggctgctgatatgtctgaccaacactaccatagagaaggaaatatgccccaaactagcagaatacagaaattggtcaaaaccgcaatgcgaaattacaggatttgcaccttttgaccttttgggacagcggtg

SEQ ID NO: 419448 - DNA, 140 bp, Artificial Sequence
  Synthetic
caccgctgtcccaaaaggtcaaaaggtgcaaatcctgtaatttcgcattgcggttttgaccaatttctgtattctgctagtttggggcatatttccttctctatggtagtgttggtcagacatatcagcagccagggcct

SEQ ID NO: 419449 - DNA, 140 bp, Artificial Sequence
  Synthetic
atacgccatgctgggtctcctgaagactaccggggtaggctgtgtaatcctctaaacccatttgtcagtcataaggaaattgagtccgtaaataatgctgtggtaatgccggcccatggccgtacttgggagtcggccat

SEQ ID NO: 419450 - DNA, 140 bp, Artificial Sequence
  Synthetic
atggccgactcccaagtacggccatgggccggcattaccacagcattatttacggactcaatttccttatgactgacaaatgggtttagaggattacacagcctaccccggtagtcttcaggagacccagcatggcgtat

SEQ ID NO: 419451 - DNA, 140 bp, Artificial Sequence
  Synthetic
aggccctggctgctgatatgataaggaaattgagtccgtaaataatgctgtggtaatgccggcccatggcccggccaagagcatggaatatgatgctgttgctactacacattcatggatgaccttttgggacagcggtg

SEQ ID NO: 419452 - DNA, 140 bp, Artificial Sequence
  Synthetic
caccgctgtcccaaaaggtcatccatgaatgtgtagtagcaacagcatcatattccatgctcttggccgggccatgggccggcattaccacagcattatttacggactcaatttccttatcatatcagcagccagggcct

SEQ ID NO: 419453 - DNA, 140 bp, Artificial Sequence
  Synthetic
aggccctggctgctgatatgacagaaactgtggacacactaacggaaactaatgttcctgtgacacatgccaaagaattgctccacacagagcacaatggaatgctgtgtgcaacaaatcgaccttttgggacagcggtg

SEQ ID NO: 419454 - DNA, 140 bp, Artificial Sequence
  Synthetic
caccgctgtcccaaaaggtcgatttgttgcacacagcattccattgtgctctgtgtggagcaattctttggcatgtgtcacaggaacattagtttccgttagtgtgtccacagtttctgtcatatcagcagccagggcct

SEQ ID NO: 419455 - DNA, 140 bp, Artificial Sequence
  Synthetic
atacgccatgctgggtctccggggcattcaccatccatctactactactgaccaacaaagtctctatcagaatgcagatgcatatgtttttgtggggacatcaagatacagcaagaagttcgtacttgggagtcggccat

SEQ ID NO: 419456 - DNA, 140 bp, Artificial Sequence
  Synthetic
atggccgactcccaagtacgaacttcttgctgtatcttgatgtccccacaaaaacatatgcatctgcattctgatagagactttgttggtcagtagtagtagatggatggtgaatgccccggagacccagcatggcgtat

SEQ ID NO: 419457 - DNA, 140 bp, Artificial Sequence
  Synthetic
aggccctggctgctgatatgaatgcagatgcatatgtttttgtggggacatcaagatacagcaagaagttcaagccggaaatagcaataagacccaaagtgagggatcaagaagggagaagaccttttgggacagcggtg

SEQ ID NO: 419458 - DNA, 140 bp, Artificial Sequence
  Synthetic
caccgctgtcccaaaaggtcttctcccttcttgatccctcactttgggtcttattgctatttccggcttgaacttcttgctgtatcttgatgtccccacaaaaacatatgcatctgcattcatatcagcagccagggcct

SEQ ID NO: 419459 - DNA, 140 bp, Artificial Sequence
  Synthetic
atacgccatgctgggtctccgcaactggaaatctagtggtaccgagatatgcattcgcaatggaaagaaatgctggatctggtattatcatttcagatacaccagtccacgattgcaatacgtacttgggagtcggccat

SEQ ID NO: 419460 - DNA, 140 bp, Artificial Sequence
  Synthetic
atggccgactcccaagtacgtattgcaatcgtggactggtgtatctgaaatgataataccagatccagcatttctttccattgcgaatgcatatctcggtaccactagatttccagttgcggagacccagcatggcgtat

SEQ ID NO: 419461 - DNA, 140 bp, Artificial Sequence
  Synthetic
atacgccatgctgggtctcccttgttaaaagtgatcagatttgcattggttaccatgcaaacaactcgacagagcaggttgacacgataatggaaaagaacgtcactgttacacatgccccgtacttgggagtcggccat

SEQ ID NO: 419462 - DNA, 140 bp, Artificial Sequence
  Synthetic
atggccgactcccaagtacggggcatgtgtaacagtgacgttcttttccattatcgtgtcaacctgctctgtcgagttgtttgcatggtaaccaatgcaaatctgatcacttttaacaagggagacccagcatggcgtat

SEQ ID NO: 419463 - DNA, 140 bp, Artificial Sequence
  Synthetic
atacgccatgctgggtctcccaacttgtcagacacccgagggtgctataaacaccagcctcccatttcagaatatacatccgatcacaattggaaaatgtccaaagtatgtaaaaagcaccgtacttgggagtcggccat

SEQ ID NO: 419464 - DNA, 140 bp, Artificial Sequence
  Synthetic
atggccgactcccaagtacggtgctttttacatactttggacattttccaattgtgatcggatgtatattctgaaatgggaggctggtgtttatagcaccctcgggtgtctgacaagttgggagacccagcatggcgtat

SEQ ID NO: 419465 - DNA, 140 bp, Artificial Sequence
  Synthetic
atacgccatgctgggtctccataaagaaattgaatctgtcaacagcgctgtagtaatgccagctcatggtccagccaagagcatggaatatgatgctgttgcaaccacacactcatggatcgtacttgggagtcggccat

SEQ ID NO: 419466 - DNA, 140 bp, Artificial Sequence
  Synthetic
atggccgactcccaagtacgatccatgagtgtgtggttgcaacagcatcatattccatgctcttggctggaccatgagctggcattactacagcgctgttgacagattcaatttctttatggagacccagcatggcgtat

SEQ ID NO: 419467 - DNA, 140 bp, Artificial Sequence
  Synthetic
atacgccatgctgggtctccgaggcctattcggggccattgccggcttcattgaaggggggtggacagggatggtagatggatggtacggttatcaccatcaaaatgagcaggggtcaggcgtacttgggagtcggccat

SEQ ID NO: 419468 - DNA, 140 bp, Artificial Sequence
  Synthetic
atggccgactcccaagtacgcctgacccctgctcattttgatggtgataaccgtaccatccatctaccatccctgtccaccccccttcaatgaagccggcaatggccccgaataggcctcggagacccagcatggcgtat

SEQ ID NO: 419469 - DNA, 140 bp, Artificial Sequence
  Synthetic
aggccctggctgctgatatgatggtagatggatggtacggttatcaccatcaaaatgagcaggggtcaggatatgcagccgacctgaagagcacacaaaatgccattgacaagattactagaccttttgggacagcggtg

SEQ ID NO: 419470 - DNA, 140 bp, Artificial Sequence
  Synthetic
caccgctgtcccaaaaggtctagtaatcttgtcaatggcattttgtgtgctcttcaggtcggctgcatatcctgacccctgctcattttgatggtgataaccgtaccatccatctaccatcatatcagcagccagggcct

SEQ ID NO: 419471 - DNA, 140 bp, Artificial Sequence
  Synthetic
atacgccatgctgggtctccggtaaagagttcaaccacctggaaaaaagaatagagaatttaaataaaaaagttgatgatggtttcctggacatttggacttacaatgccgaactgttggcgtacttgggagtcggccat

SEQ ID NO: 419472 - DNA, 140 bp, Artificial Sequence
  Synthetic
atggccgactcccaagtacgccaacagttcggcattgtaagtccaaatgtccaggaaaccatcatcaacttttttatttaaattctctattcttttttccaggtggttgaactctttaccggagacccagcatggcgtat

SEQ ID NO: 419473 - DNA, 140 bp, Artificial Sequence
  Synthetic
aggccctggctgctgatatgagttgatgatggtttcctggacatttggacttacaatgccgaactgttggttctattggaaaatgaaagaactttggactaccacgattcaaatgtgaaggaccttttgggacagcggtg

SEQ ID NO: 419474 - DNA, 140 bp, Artificial Sequence
  Synthetic
caccgctgtcccaaaaggtccttcacatttgaatcgtggtagtccaaagttctttcattttccaatagaaccaacagttcggcattgtaagtccaaatgtccaggaaaccatcatcaactcatatcagcagccagggcct

SEQ ID NO: 419475 - DNA, 140 bp, Artificial Sequence
  Synthetic
aggccctggctgctgatatgggaaggggtaccggagtctatgagggaagagtaccggcaggaacagcagaatgctgtggatgttgacgatggtcattttgtcaacatagaattggagtaagaccttttgggacagcggtg

SEQ ID NO: 419476 - DNA, 140 bp, Artificial Sequence
  Synthetic
caccgctgtcccaaaaggtcttactccaattctatgttgacaaaatgaccatcgtcaacatccacagcattctgctgttcctgccggtactcttccctcatagactccggtaccccttcccatatcagcagccagggcct

SEQ ID NO: 419477 - DNA, 140 bp, Artificial Sequence
  Synthetic
atacgccatgctgggtctcctcaaaatgaatccaaatcagaagatagtaaccattggatcaatctgtatggtaattggagtaattagcttgatgttacagattgggaacataatatcaatcgtacttgggagtcggccat

SEQ ID NO: 419478 - DNA, 140 bp, Artificial Sequence
  Synthetic
atggccgactcccaagtacgattgatattatgttcccaatctgtaacatcaagctaattactccaattaccatacagattgatccaatggttactatcttctgatttggattcattttgaggagacccagcatggcgtat

SEQ ID NO: 419479 - DNA, 140 bp, Artificial Sequence
  Synthetic
atacgccatgctgggtctccgaacaatggcctggacagtggtgaatagtatctgcaacaccacgggagtcgagaaacccaaatttcttccggatctgtatgactacaaggaaaaccgattcgtacttgggagtcggccat

SEQ ID NO: 419480 - DNA, 140 bp, Artificial Sequence
  Synthetic
atggccgactcccaagtacgaatcggttttccttgtagtcatacagatccggaagaaatttgggtttctcgactcccgtggtgttgcagatactattcaccactgtccaggccattgttcggagacccagcatggcgtat

SEQ ID NO: 419481 - DNA, 140 bp, Artificial Sequence
  Synthetic
atacgccatgctgggtctccatgggtcagtcattcaattcaaacagggaatcagcaccaaactgaaccaatcagaaatactaattttcttactgagaacgctgtagcttcagtaacattacgtacttgggagtcggccat

SEQ ID NO: 419482 - DNA, 140 bp, Artificial Sequence
  Synthetic
atggccgactcccaagtacgtaatgttactgaagctacagcgttctcagtaagaaaattagtatttctgattggttcagtttggtgctgattccctgtttgaattgaatgactgacccatggagacccagcatggcgtat

SEQ ID NO: 419483 - DNA, 140 bp, Artificial Sequence
  Synthetic
aggccctggctgctgatatgtcagaaatactaattttcttactgagaacgctgtagcttcagtaacattagctggcaattcatctctttgccccattaaaggatgggctgtacacagtaagaccttttgggacagcggtg

SEQ ID NO: 419484 - DNA, 140 bp, Artificial Sequence
  Synthetic
caccgctgtcccaaaaggtcttactgtgtacagcccatcctttaatggggcaaagagatgaattgccagctaatgttactgaagctacagcgttctcagtaagaaaattagtatttctgacatatcagcagccagggcct

SEQ ID NO: 419485 - DNA, 140 bp, Artificial Sequence
  Synthetic
aggccctggctgctgatatgttaccagattttggcgatctattcaactgtcgccagttcattggtactggtagtctccctgggggcaatcagtttctggatgtgctctaatgggtctctagaccttttgggacagcggtg

SEQ ID NO: 419486 - DNA, 140 bp, Artificial Sequence
  Synthetic
caccgctgtcccaaaaggtctagagacccattagagcacatccagaaactgattgcccccagggagactaccagtaccaatgaactggcgacagttgaatagatcgccaaaatctggtaacatatcagcagccagggcct

SEQ ID NO: 419487 - DNA, 140 bp, Artificial Sequence
  Synthetic
aggccctggctgctgatatgtagtctccctgggggcaatcagtttctggatgtgctctaatgggtctctacagtgtagaatatgtatttaacattaggatttcagaagcatgagaaaaacgaccttttgggacagcggtg

SEQ ID NO: 419488 - DNA, 140 bp, Artificial Sequence
  Synthetic
caccgctgtcccaaaaggtcgtttttctcatgcttctgaaatcctaatgttaaatacatattctacactgtagagacccattagagcacatccagaaactgattgcccccagggagactacatatcagcagccagggcct

SEQ ID NO: 419489 - DNA, 140 bp, Artificial Sequence
  Synthetic
atacgccatgctgggtctccagccgttcatatcatgctcccatctggaatgcagaactttctttttgactcagggagctttgctgaatgacaagcactccaacgggactgtcaaagatagcgtacttgggagtcggccat

SEQ ID NO: 419490 - DNA, 140 bp, Artificial Sequence
  Synthetic
atggccgactcccaagtacgctatctttgacagtcccgttggagtgcttgtcattcagcaaagctccctgagtcaaaaagaaagttctgcattccagatgggagcatgatatgaacggctggagacccagcatggcgtat

SEQ ID NO: 419491 - DNA, 140 bp, Artificial Sequence
  Synthetic
aggccctggctgctgatatgctcaccatcggggaatgccccaaatacgtgaagtcaaacaaattggtccttgcgactgggctcagaaataatcctctaagagaaaagagaagaaaaagaggaccttttgggacagcggtg

SEQ ID NO: 419492 - DNA, 140 bp, Artificial Sequence
  Synthetic
caccgctgtcccaaaaggtcctctttttcttctcttttctcttagaggattatttctgagcccagtcgcaaggaccaatttgtttgacttcacgtatttggggcattccccgatggtgagcatatcagcagccagggcct

SEQ ID NO: 419493 - DNA, 140 bp, Artificial Sequence
  Synthetic
atacgccatgctgggtctccgagccctcacagaacgctaatgagttgccctataggtgaggctccctccccatataactcaaggtttgagtctgttgcttggtcggcaagtgcttgccatcgtacttgggagtcggccat

SEQ ID NO: 419494 - DNA, 140 bp, Artificial Sequence
  Synthetic
atggccgactcccaagtacgatggcaagcacttgccgaccaagcaacagactcaaaccttgagttatatggggagggagcctcacctatagggcaactcattagcgttctgtgagggctcggagacccagcatggcgtat

SEQ ID NO: 419495 - DNA, 140 bp, Artificial Sequence
  Synthetic
atacgccatgctgggtctccgaggacaatcacaatgggaagctgtgcctactaaagggaatagcccccctacaattgggtaattgcagcgttgccggatggatattaggaaacccagaatcgtacttgggagtcggccat

SEQ ID NO: 419496 - DNA, 140 bp, Artificial Sequence
  Synthetic
atggccgactcccaagtacgattctgggtttcctaatatccatccggcaacgctgcaattacccaattgtaggggggctattccctttagtaggcacagcttcccattgtgattgtcctcggagacccagcatggcgtat

SEQ ID NO: 419497 - DNA, 140 bp, Artificial Sequence
  Synthetic
atacgccatgctgggtctccatggattccaacactgtgtcaagctttcaggtagattgttttctttggcgggttctcatacgattagcagaccaagaactgggtgatgccccatttcttgcgtacttgggagtcggccat

SEQ ID NO: 419498 - DNA, 140 bp, Artificial Sequence
  Synthetic
atggccgactcccaagtacgcaagaaatggggcatcacccagttcttggtctgctaatcgtatgagaacccgccaaagaaaacaatctacctgaaagcttgacacagtgttggaatccatggagacccagcatggcgtat

SEQ ID NO: 419499 - DNA, 140 bp, Artificial Sequence
  Synthetic
atacgccatgctgggtctccggctcttgctttgctgttatgacagatggaccaagtaatgggcaggcatcatataagattttcaaaatagaaaaagggaaagtagttaagtcagtcgaatcgtacttgggagtcggccat

SEQ ID NO: 419500 - DNA, 140 bp, Artificial Sequence
  Synthetic
atggccgactcccaagtacgattcgactgacttaactactttccctttttctattttgaaaatcttatatgatgcctgcccattacttggtccatctgtcataacagcaaagcaagagccggagacccagcatggcgtat

SEQ ID NO: 419501 - DNA, 140 bp, Artificial Sequence
  Synthetic
aggccctggctgctgatatgatataagattttcaaaatagaaaaagggaaagtagttaagtcagtcgaattgaatgcccctaattatcactatgaggaatgctcctgttatcctgatgctgaccttttgggacagcggtg

SEQ ID NO: 419502 - DNA, 140 bp, Artificial Sequence
  Synthetic
caccgctgtcccaaaaggtcagcatcaggataacaggagcattcctcatagtgataattaggggcattcaattcgactgacttaactactttccctttttctattttgaaaatcttatatcatatcagcagccagggcct

SEQ ID NO: 419503 - DNA, 140 bp, Artificial Sequence
  Synthetic
atacgccatgctgggtctccatgggtatctttcaatcagaatttggagtatcaaataggatatatttgcagtggagttttcggtgacaatccacggccaaatgacggtacaggtagttgtcgtacttgggagtcggccat

SEQ ID NO: 419504 - DNA, 140 bp, Artificial Sequence
  Synthetic
atggccgactcccaagtacgacaactacctgtaccgtcatttggccgtggattgtcaccgaaaactccactgcaaatatatcctatttgatactccaaattctgattgaaagatacccatggagacccagcatggcgtat

SEQ ID NO: 419505 - DNA, 140 bp, Artificial Sequence
  Synthetic
atacgccatgctgggtctccggtccagtgtcctctaacggggcatatggggtaaaagggttctcatttaaatatggcaatggtgtctggatcgggaggaccaaaagcactcattccaggacgtacttgggagtcggccat

SEQ ID NO: 419506 - DNA, 140 bp, Artificial Sequence
  Synthetic
atggccgactcccaagtacgtcctggaatgagtgcttttggtcctcccgatccagacaccattgccatatttaaatgagaacccttttaccccatatgccccgttagaggacactggaccggagacccagcatggcgtat

SEQ ID NO: 419507 - DNA, 140 bp, Artificial Sequence
  Synthetic
atacgccatgctgggtctcctctaaggacaattcgattcggctttccgctggtggggacatctgggtgacaagagaaccttatgtgtcatgcgatcctgacaagtgttatcaatttgccccgtacttgggagtcggccat

SEQ ID NO: 419508 - DNA, 140 bp, Artificial Sequence
  Synthetic
atggccgactcccaagtacggggcaaattgataacacttgtcaggatcgcatgacacataaggttctcttgtcacccagatgtccccaccagcggaaagccgaatcgaattgtccttagaggagacccagcatggcgtat

SEQ ID NO: 419509 - DNA, 140 bp, Artificial Sequence
  Synthetic
aggccctggctgctgatatggaacccggggatacaataatatttgaggcaaatggaaatctaatagcgccatggtatgctttcacactgagtagaggtcttggatcaggaatcatcacctgaccttttgggacagcggtg

SEQ ID NO: 419510 - DNA, 140 bp, Artificial Sequence
  Synthetic
caccgctgtcccaaaaggtcaggtgatgattcctgatccaagacctctactcagtgtgaaagcataccatggcgctattagatttccatttgcctcaaatattattgtatccccgggttccatatcagcagccagggcct

SEQ ID NO: 419511 - DNA, 140 bp, Artificial Sequence
  Synthetic
aggccctggctgctgatatgtagcgggagttttgtccagcacccagaactgacaggattagattgcataagaccttgcttctgggttgagttaatcagagggcggcccaaagagagcacagaccttttgggacagcggtg

SEQ ID NO: 419512 - DNA, 140 bp, Artificial Sequence
  Synthetic
caccgctgtcccaaaaggtctgtgctctctttgggccgccctctgattaactcaacccagaagcaaggtcttatgcaatctaatcctgtcagttctgggtgctggacaaaactcccgctacatatcagcagccagggcct

SEQ ID NO: 419513 - DNA, 140 bp, Artificial Sequence
  Synthetic
atacgccatgctgggtctcctaccagttcatggagcaagaagtacaacctagaaactggaacccgacctggatacaatggccaaaagagttggatgaagatttactggtatctgatgcaccgtacttgggagtcggccat

SEQ ID NO: 419514 - DNA, 140 bp, Artificial Sequence
  Synthetic
atggccgactcccaagtacggtgcatcagataccagtaaatcttcatccaactcttttggccattgtatccaggtcgggttccagtttctaggttgtacttcttgctccatgaactggtaggagacccagcatggcgtat

SEQ ID NO: 419515 - DNA, 140 bp, Artificial Sequence
  Synthetic
atacgccatgctgggtctcccactacatttcacgcagagtgaatacactaactcctctacaaacaaagtagtgtcatgtgaatcaaccataatagaaaggaacataacagagatagtgcacgtacttgggagtcggccat

SEQ ID NO: 419516 - DNA, 140 bp, Artificial Sequence
  Synthetic
atggccgactcccaagtacgtgcactatctctgttatgttcctttctattatggttgattcacatgacactactttgtttgtagaggagttagtgtattcactctgcgtgaaatgtagtgggagacccagcatggcgtat

SEQ ID NO: 419517 - DNA, 140 bp, Artificial Sequence
  Synthetic
aggccctggctgctgatatgtccaaataatcaaattgctaccgtttgcagcagctccaccggaacagagtaggatgcaattttcttctctaactgtgaatgtgagagggtcagggatgaggaccttttgggacagcggtg

SEQ ID NO: 419518 - DNA, 140 bp, Artificial Sequence
  Synthetic
caccgctgtcccaaaaggtcctcatccctgaccctctcacattcacagttagagaagaaaattgcatcctactctgttccggtggagctgctgcaaacggtagcaatttgattatttggacatatcagcagccagggcct

SEQ ID NO: 419519 - DNA, 140 bp, Artificial Sequence
  Synthetic
atacgccatgctgggtctcctaaggaacatcccatccattcaatccagaggtttgtttggggccattgccggtttcattgaaggggggtggactggaatggtagatgggtggtatggttacgtacttgggagtcggccat

SEQ ID NO: 419520 - DNA, 140 bp, Artificial Sequence
  Synthetic
atggccgactcccaagtacgtaaccataccacccatctaccattccagtccaccccccttcaatgaaaccggcaatggccccaaacaaacctctggattgaatggatgggatgttccttaggagacccagcatggcgtat

SEQ ID NO: 419521 - DNA, 140 bp, Artificial Sequence
  Synthetic
atacgccatgctgggtctccaacccaacggaggaacaagccgtagacatatgcaaggcagcaatggggctgaggattagctcctctttcagctttggtgggttcaccttcaaaagaacaacgtacttgggagtcggccat

SEQ ID NO: 419522 - DNA, 140 bp, Artificial Sequence
  Synthetic
atggccgactcccaagtacgttgttcttttgaaggtgaacccaccaaagctgaaagaggagctaatcctcagccccattgctgccttgcatatgtctacggcttgttcctccgttgggttggagacccagcatggcgtat

SEQ ID NO: 419523 - DNA, 140 bp, Artificial Sequence
  Synthetic
atacgccatgctgggtctccaaaactggaggtccaatttatcgaaggagagacggaaaatgggtgagggagctgattctgtacgacaaagaggagatccggaggatttggcgccaagctacgtacttgggagtcggccat

SEQ ID NO: 419524 - DNA, 140 bp, Artificial Sequence
  Synthetic
atggccgactcccaagtacgtagcttggcgccaaatcctccggatctcctctttgtcgtacagaatcagctccctcacccattttccgtctctccttcgataaattggacctccagttttggagacccagcatggcgtat

SEQ ID NO: 419525 - DNA, 140 bp, Artificial Sequence
  Synthetic
aggccctggctgctgatatgacgatggtagggcatggctacatgtttgtgtcactggagatgataagaatgctactgctagcgttatttatgacgggatgcttactgacagtattgtttcgaccttttgggacagcggtg

SEQ ID NO: 419526 - DNA, 140 bp, Artificial Sequence
  Synthetic
caccgctgtcccaaaaggtcgaaacaatactgtcagtaagcatcccgtcataaataacgctagcagtagcattcttatcatctccagtgacacaaacatgtagccatgccctaccatcgtcatatcagcagccagggcct

SEQ ID NO: 419527 - DNA, 140 bp, Artificial Sequence
  Synthetic
aggccctggctgctgatatgaatttgctgcaatatgcacacacttagaagtatgtttcatgtattcagacttccactttattgatgaacggggcgaatcaataattgtagaatctggagagaccttttgggacagcggtg

SEQ ID NO: 419528 - DNA, 140 bp, Artificial Sequence
  Synthetic
caccgctgtcccaaaaggtctctccagattctacaattattgattcgccccgttcatcaataaagtggaagtctgaatacatgaaacatacttctaagtgtgtgcatattgcagcaaattcatatcagcagccagggcct

SEQ ID NO: 419529 - DNA, 140 bp, Artificial Sequence
  Synthetic
atacgccatgctgggtctccatggaacttgtacagtagtaatgactgatggaagtgcatcaggcatggctgacaccagaatactattcattagagaagggaagattgtccacattagtcccgtacttgggagtcggccat

SEQ ID NO: 419530 - DNA, 140 bp, Artificial Sequence
  Synthetic
atggccgactcccaagtacgggactaatgtggacaatcttcccttctctaatgaatagtattctggtgtcagccatgcctgatgcacttccatcagtcattactactgtacaagttccatggagacccagcatggcgtat

SEQ ID NO: 419531 - DNA, 140 bp, Artificial Sequence
  Synthetic
atacgccatgctgggtctccccaaacctaattccaaaatacagacaaataggcaagtcatagttgaaagaggtaacagatccggttattccggtattttctccgttgaagacaaaagctgcgtacttgggagtcggccat

SEQ ID NO: 419532 - DNA, 140 bp, Artificial Sequence
  Synthetic
atggccgactcccaagtacgcagcttttgtcttcaacggagaaaataccggaataaccggatctgttacctctttcaactatgacttgcctatttgtctgtattttggaattaggtttggggagacccagcatggcgtat

SEQ ID NO: 419533 - DNA, 140 bp, Artificial Sequence
  Synthetic
atacgccatgctgggtctccagactagagtgtggtggacttcaaatagtattattgtattctgtggcacttcaggtacttatggaacaggctcatggcctgatggtgcaaatatcaatttcgtacttgggagtcggccat

SEQ ID NO: 419534 - DNA, 140 bp, Artificial Sequence
  Synthetic
atggccgactcccaagtacgaaattgatatttgcaccatcaggccatgagcctgttccataagtacctgaagtgccacagaatacaataatactatttgaagtccaccacactctagtctggagacccagcatggcgtat

SEQ ID NO: 419535 - DNA, 140 bp, Artificial Sequence
  Synthetic
atacgccatgctgggtctccatccagaagttagatgtgtttgcagagacaattggaagggctccaatagacctgtgttatacataaatatggcagattataatattgattccaattatgtcgtacttgggagtcggccat

SEQ ID NO: 419536 - DNA, 140 bp, Artificial Sequence
  Synthetic
atggccgactcccaagtacgacataattggaatcaatattataatctgccatatttatgtataacacaggtctattggagcccttccaattgtctctgcaaacacatctaacttctggatggagacccagcatggcgtat

SEQ ID NO: 419537 - DNA, 140 bp, Artificial Sequence
  Synthetic
atacgccatgctgggtctccgtggacctcaaacagtattgttgtgttttgtggcacctcaggtacatatggaacaggctcatggcctgatggggcggatatcaatctcatgcctatataacgtacttgggagtcggccat

SEQ ID NO: 419538 - DNA, 140 bp, Artificial Sequence
  Synthetic
atggccgactcccaagtacgttatataggcatgagattgatatccgccccatcaggccatgagcctgttccatatgtacctgaggtgccacaaaacacaacaatactgtttgaggtccacggagacccagcatggcgtat

SEQ ID NO: 419539 - DNA, 140 bp, Artificial Sequence
  Synthetic
atacgccatgctgggtctccaaaggactcgcgcgcaggttatgaaacttttagggtcgttgatggttggaccgtggctaactccaagtcacagacaaataggcaagtcatagttgaaagtcgtacttgggagtcggccat

SEQ ID NO: 419540 - DNA, 140 bp, Artificial Sequence
  Synthetic
atggccgactcccaagtacgactttcaactatgacttgcctatttgtctgtgacttggagttagccacggtccaaccatcaacgaccctaaaagtttcataacctgcgcgcgagtcctttggagacccagcatggcgtat

SEQ ID NO: 419541 - DNA, 140 bp, Artificial Sequence
  Synthetic
aggccctggctgctgatatgtcaaaacagccaggtcttcagtctcattaggccaaatgaaaatccagcacataagagccaattagtgtggatggcatgccactctgcagcattcgaggacgaccttttgggacagcggtg

SEQ ID NO: 419542 - DNA, 140 bp, Artificial Sequence
  Synthetic
caccgctgtcccaaaaggtcgtcctcgaatgctgcagagtggcatgccatccacactaattggctcttatgtgctggattttcatttggcctaatgagactgaagacctggctgttttgacatatcagcagccagggcct

SEQ ID NO: 419543 - DNA, 140 bp, Artificial Sequence
  Synthetic
aggccctggctgctgatatggtgggcactcggtgaaaacatggcaccggagaaggtagactttgaagattgcaaagatgtcaacgacctgagacagtacgacagtgatgagccagagcccgaccttttgggacagcggtg

SEQ ID NO: 419544 - DNA, 140 bp, Artificial Sequence
  Synthetic
caccgctgtcccaaaaggtcgggctctggctcatcactgtcgtactgtctcaggtcgttgacatctttgcaatcttcaaagtctaccttctccggtgccatgttttcaccgagtgcccaccatatcagcagccagggcct

SEQ ID NO: 419545 - DNA, 140 bp, Artificial Sequence
  Synthetic
aggccctggctgctgatatgttgggtgatacagagtgtatactggttcaatgaatggttgggctttgaaaaggaggggagtaaagtgttggaatcagtggatgaaataatggatgaataagaccttttgggacagcggtg

SEQ ID NO: 419546 - DNA, 140 bp, Artificial Sequence
  Synthetic
caccgctgtcccaaaaggtcttattcatccattatttcatccactgattccaacactttactcccctccttttcaaagcccaaccattcattgaaccagtatacactctgtatcacccaacatatcagcagccagggcct

SEQ ID NO: 419547 - DNA, 140 bp, Artificial Sequence
  Synthetic
atacgccatgctgggtctccatggcgtctcaaggcaccaaacgatcctatgaacagatggagactggtggagaacgccagaatgccaccgagatcagggcttctgttggaagaatggttgcgtacttgggagtcggccat

SEQ ID NO: 419548 - DNA, 140 bp, Artificial Sequence
  Synthetic
atggccgactcccaagtacgcaaccattcttccaacagaagccctgatctcggtggcattctggcgttctccaccagtctccatctgttcataggatcgtttggtgccttgagacgccatggagacccagcatggcgtat

SEQ ID NO: 419549 - DNA, 140 bp, Artificial Sequence
  Synthetic
atacgccatgctgggtctccagaagcggagggaacaccaatcaacagagggcatctgcaggacagatcagcgttcagcctactttctcggtgcagagaaacctcccattcgaaagggcgacgtacttgggagtcggccat

SEQ ID NO: 419550 - DNA, 140 bp, Artificial Sequence
  Synthetic
atggccgactcccaagtacgtcgccctttcgaatgggaggtttctctgcaccgagaaagtaggctgaacgctgatctgtcctgcagatgccctctgttgattggtgttccctccgcttctggagacccagcatggcgtat

SEQ ID NO: 419551 - DNA, 140 bp, Artificial Sequence
  Synthetic
atacgccatgctgggtctccgcaagttgaaaagacgtgcaattgcaacaccagggatgcagatcagaggatttgtgtacttcgtagaagcactggcgaggagcatctgtgagaaacttgacgtacttgggagtcggccat

SEQ ID NO: 419552 - DNA, 140 bp, Artificial Sequence
  Synthetic
atggccgactcccaagtacgtcaagtttctcacagatgctcctcgccagtgcttctacgaagtacacaaatcctctgatctgcatccctggtgttgcaattgcacgtcttttcaacttgcggagacccagcatggcgtat

SEQ ID NO: 419553 - DNA, 140 bp, Artificial Sequence
  Synthetic
atacgccatgctgggtctcctctctctgcattcgatgaaaggaggaacaggtacctagaggaacaccctagtgcagggaaggacccgaagaaaaccggaggtccaatctacagaaggagacgtacttgggagtcggccat

SEQ ID NO: 419554 - DNA, 140 bp, Artificial Sequence
  Synthetic
atggccgactcccaagtacgtctccttctgtagattggacctccggttttcttcgggtccttccctgcactagggtgttcctctaggtacctgttcctcctttcatcgaatgcagagagaggagacccagcatggcgtat

SEQ ID NO: 419555 - DNA, 140 bp, Artificial Sequence
  Synthetic
atacgccatgctgggtctccatcggataccatgccaacaattccacagaaaaagttgacacaatcttggaacgaaacgtcactgtgactcatgccaaggacattcttgaaaagacacatacgtacttgggagtcggccat

SEQ ID NO: 419556 - DNA, 140 bp, Artificial Sequence
  Synthetic
atggccgactcccaagtacgtatgtgtcttttcaagaatgtccttggcatgagtcacagtgacgtttcgttccaagattgtgtcaactttttctgtggaattgttggcatggtatccgatggagacccagcatggcgtat

SEQ ID NO: 419557 - DNA, 140 bp, Artificial Sequence
  Synthetic
atacgccatgctgggtctccacatactggaaaagacacacaacgggaagctctgcgatctaaatggagtgaagcctctgattttaaaagattgtagtgtagcaggatggctcctcggaaacgtacttgggagtcggccat

SEQ ID NO: 419558 - DNA, 140 bp, Artificial Sequence
  Synthetic
atggccgactcccaagtacgtttccgaggagccatcctgctacactacaatcttttaaaatcagaggcttcactccatttagatcgcagagcttcccgttgtgtgtcttttccagtatgtggagacccagcatggcgtat

SEQ ID NO: 419559 - DNA, 140 bp, Artificial Sequence
  Synthetic
atacgccatgctgggtctccagggagtagggactatggtaatggaactaattcggatgataaagcgaggtatcaatgaccggaatttctggagaggcgataatggacgaaaaacaaggatcgtacttgggagtcggccat

SEQ ID NO: 419560 - DNA, 140 bp, Artificial Sequence
  Synthetic
atggccgactcccaagtacgatccttgtttttcgtccattatcgcctctccagaaattccggtcattgatacctcgctttatcatccgaattagttccattaccatagtccctactccctggagacccagcatggcgtat

SEQ ID NO: 419561 - DNA, 140 bp, Artificial Sequence
  Synthetic
aggccctggctgctgatatgatcaatgaccggaatttctggagaggcgataatggacgaaaaacaaggattgcatacgagagaatgtgcaacattctcaaaggaaaatttcaaacagcaggaccttttgggacagcggtg

SEQ ID NO: 419562 - DNA, 140 bp, Artificial Sequence
  Synthetic
caccgctgtcccaaaaggtcctgctgtttgaaattttcctttgagaatgttgcacattctctcgtatgcaatccttgtttttcgtccattatcgcctctccagaaattccggtcattgatcatatcagcagccagggcct

SEQ ID NO: 419563 - DNA, 140 bp, Artificial Sequence
  Synthetic
aggccctggctgctgatatggaagtgactaatgccactgagctggttcagagctcctcaacaagtggaatatgcaacagtcctcaccaaatccttgatgggaaaaattgcacactgataggaccttttgggacagcggtg

SEQ ID NO: 419564 - DNA, 140 bp, Artificial Sequence
  Synthetic
caccgctgtcccaaaaggtcctatcagtgtgcaatttttcccatcaaggatttggtgaggactgttgcatattccacttgttgaggagctctgaaccagctcagtggcattagtcacttccatatcagcagccagggcct

SEQ ID NO: 419565 - DNA, 140 bp, Artificial Sequence
  Synthetic
aggccctggctgctgatatggacctttttattgaacgaagcacagcctacagcaactgttacccttattatgtgccggattatgcctcccttaggtcactagttgcctcatccggcacccgaccttttgggacagcggtg

SEQ ID NO: 419566 - DNA, 140 bp, Artificial Sequence
  Synthetic
caccgctgtcccaaaaggtcgggtgccggatgaggcaactagtgacctaagggaggcataatccggcacataataagggtaacagttgctgtaggctgtgcttcgttcaataaaaaggtccatatcagcagccagggcct

SEQ ID NO: 419567 - DNA, 140 bp, Artificial Sequence
  Synthetic
atacgccatgctgggtctcctgtgccggattatgcctcccttaggtcactagttgcctcatccggcaccctggaatttacccaagagaacttcaattggactggagttgctcaagatggacgtacttgggagtcggccat

SEQ ID NO: 419568 - DNA, 140 bp, Artificial Sequence
  Synthetic
atggccgactcccaagtacgtccatcttgagcaactccagtccaattgaagttctcttgggtaaattccagggtgccggatgaggcaactagtgacctaagggaggcataatccggcacaggagacccagcatggcgtat

SEQ ID NO: 419569 - DNA, 140 bp, Artificial Sequence
  Synthetic
atacgccatgctgggtctccgtagatggatttgagccgaacggctgcattgagggcaagctttcccaaatgtcaaaagaagtgaacgccaaaattgaaccattcttgaggacgacaccaccgtacttgggagtcggccat

SEQ ID NO: 419570 - DNA, 140 bp, Artificial Sequence
  Synthetic
atggccgactcccaagtacggtggtgtcgtcctcaagaatggttcaattttggcgttcacttcttttgacatttgggaaagcttgccctcaatgcagccgttcggctcaaatccatctacggagacccagcatggcgtat

SEQ ID NO: 419571 - DNA, 140 bp, Artificial Sequence
  Synthetic
atacgccatgctgggtctccaccaaatgagaacccagcacataaaagtcaattgatatggatggcatgccattctgcagcatttgaagacctgagagtctcaagtttcattagagggacgcgtacttgggagtcggccat

SEQ ID NO: 419572 - DNA, 140 bp, Artificial Sequence
  Synthetic
atggccgactcccaagtacgcgtccctctaatgaaacttgagactctcaggtcttcaaatgctgcagaatggcatgccatccatatcaattgacttttatgtgctgggttctcatttggtggagacccagcatggcgtat

SEQ ID NO: 419573 - DNA, 140 bp, Artificial Sequence
  Synthetic
aggccctggctgctgatatgatttccattgggacttcaacactaaaccagagattggtaccaaaaatagccactagatccaaaataaacgggcaaagtggcaggatagatttcttctggagaccttttgggacagcggtg

SEQ ID NO: 419574 - DNA, 140 bp, Artificial Sequence
  Synthetic
caccgctgtcccaaaaggtctccagaagaaatctatcctgccactttgcccgtttattttggatctagtggctatttttggtaccaatctctggtttagtgttgaagtcccaatggaaatcatatcagcagccagggcct

SEQ ID NO: 419575 - DNA, 140 bp, Artificial Sequence
  Synthetic
atacgccatgctgggtctcccaattttaaaaccgaatgacgcaatccacttcgagagtaatggaaatttcattgctccagaatatgcatacaaaattgtcaagaagggagactccacaatcgtacttgggagtcggccat

SEQ ID NO: 419576 - DNA, 140 bp, Artificial Sequence
  Synthetic
atggccgactcccaagtacgattgtggagtctcccttcttgacaattttgtatgcatattctggagcaatgaaatttccattactctcgaagtggattgcgtcattcggttttaaaattgggagacccagcatggcgtat

SEQ ID NO: 419577 - DNA, 140 bp, Artificial Sequence
  Synthetic
atacgccatgctgggtctccggtattgggctataagaaccagaagtggaggaaccaccaaccaacagagagcatctgcaggacaaatcagtgtacagcccactttctcagtacagagaagcgtacttgggagtcggccat

SEQ ID NO: 419578 - DNA, 140 bp, Artificial Sequence
  Synthetic
atggccgactcccaagtacgcttctctgtactgagaaagtgggctgtacactgatttgtcctgcagatgctctctgttggttggtggttcctccacttctggttcttatagcccaataccggagacccagcatggcgtat

SEQ ID NO: 419579 - DNA, 140 bp, Artificial Sequence
  Synthetic
aggccctggctgctgatatggcatctgcaggacaaatcagtgtacagcccactttctcagtacagagaagtcttcccttcgaaagagcaaccattatggctgcgtttaaagggaataccggaccttttgggacagcggtg

SEQ ID NO: 419580 - DNA, 140 bp, Artificial Sequence
  Synthetic
caccgctgtcccaaaaggtccggtattccctttaaacgcagccataatggttgctctttcgaagggaagacttctctgtactgagaaagtgggctgtacactgatttgtcctgcagatgccatatcagcagccagggcct

SEQ ID NO: 419581 - DNA, 140 bp, Artificial Sequence
  Synthetic
atacgccatgctgggtctccaatacacgatagaatccctcatcgaacccttttgatgaatgagttaggtgttccatttcatttgggaaccaaacaggtatgcatagcatggtctagctcacgtacttgggagtcggccat

SEQ ID NO: 419582 - DNA, 140 bp, Artificial Sequence
  Synthetic
atggccgactcccaagtacgtgagctagaccatgctatgcatacctgtttggttcccaaatgaaatggaacacctaactcattcatcaaaagggttcgatgagggattctatcgtgtattggagacccagcatggcgtat

SEQ ID NO: 419583 - DNA, 140 bp, Artificial Sequence
  Synthetic
aggccctggctgctgatatgaagtgtacctgaatggtcctatatagtggaaaaggaaaacccggtgaatggtctgtgctatccaggcagtttcaatgagtatgaagaattgaaacatctcgaccttttgggacagcggtg

SEQ ID NO: 419584 - DNA, 140 bp, Artificial Sequence
  Synthetic
caccgctgtcccaaaaggtcgagatgtttcaattcttcatactcattgaaactgcctggatagcacagaccattcaccgggttttccttttccactatataggaccattcaggtacacttcatatcagcagccagggcct

SEQ ID NO: 419585 - DNA, 140 bp, Artificial Sequence
  Synthetic
atacgccatgctgggtctccagacggattcctagatgtctggacttataatgctgaacttctggttctcatggagaatgagagaactctagacttccatgactcaaatgtcaagaaccttcgtacttgggagtcggccat

SEQ ID NO: 419586 - DNA, 140 bp, Artificial Sequence
  Synthetic
atggccgactcccaagtacgaaggttcttgacatttgagtcatggaagtctagagttctctcattctccatgagaaccagaagttcagcattataagtccagacatctaggaatccgtctggagacccagcatggcgtat

SEQ ID NO: 419587 - DNA, 140 bp, Artificial Sequence
  Synthetic
atacgccatgctgggtctccatggatgtcaatccgactttacttttcttgaaagttccagcgcaaaatgccataagcaccacattcccgtatactggagatcctccatacagccatggaacgtacttgggagtcggccat

SEQ ID NO: 419588 - DNA, 140 bp, Artificial Sequence
  Synthetic
atggccgactcccaagtacgttccatggctgtatggaggatctccagtatacgggaatgtggtgcttatggcattttgcgctggaactttcaagaaaagtaaagtcggattgacatccatggagacccagcatggcgtat

SEQ ID NO: 419589 - DNA, 140 bp, Artificial Sequence
  Synthetic
atacgccatgctgggtctccaaatgagaacatggaagcaatggactccaacactcttgaactgagaagtagatattgggctataagaaccagaagcggaggtaacaccaaccaacagaggcgtacttgggagtcggccat

SEQ ID NO: 419590 - DNA, 140 bp, Artificial Sequence
  Synthetic
atggccgactcccaagtacgcctctgttggttggtgttacctccgcttctggttcttatagcccaatatctacttctcagttcaagagtgttggagtccattgcttccatgttctcatttggagacccagcatggcgtat

SEQ ID NO: 419591 - DNA, 140 bp, Artificial Sequence
  Synthetic
atacgccatgctgggtctcctgaaatcataaaaatgatggaaaatgccaaaccagaagatgtgtctttccaggggcggggagtcttcgagttatcggacgaaaaggcaacgaacccgatccgtacttgggagtcggccat

SEQ ID NO: 419592 - DNA, 140 bp, Artificial Sequence
  Synthetic
atggccgactcccaagtacggatcgggttcgttgccttttcgtccgataactcgaagactccccgcccctggaaagacacatcttctggtttggcattttccatcatttttatgatttcaggagacccagcatggcgtat

SEQ ID NO: 419593 - DNA, 140 bp, Artificial Sequence
  Synthetic
aggccctggctgctgatatgagcctcgacatcgaaacagccactcttgtcggaaaacaaattgttgagtggattttgaaagaggaatccagcgatacacttaagatgaccattgcatctggaccttttgggacagcggtg

SEQ ID NO: 419594 - DNA, 140 bp, Artificial Sequence
  Synthetic
caccgctgtcccaaaaggtccagatgcaatggtcatcttaagtgtatcgctggattcctctttcaaaatccactcaacaatttgttttccgacaagagtggctgtttcgatgtcgaggctcatatcagcagccagggcct

SEQ ID NO: 419595 - DNA, 140 bp, Artificial Sequence
  Synthetic
aggccctggctgctgatatgttgagataattgaaggaagagaccgaatcatggcctggacagtggtgaacagtatatgtaacacaacaggggtagagaagcctaaatttcttcctgatttgaccttttgggacagcggtg

SEQ ID NO: 419596 - DNA, 140 bp, Artificial Sequence
  Synthetic
caccgctgtcccaaaaggtcaaatcaggaagaaatttaggcttctctacccctgttgtgttacatatactgttcaccactgtccaggccatgattcggtctcttccttcaattatctcaacatatcagcagccagggcct

SEQ ID NO: 419597 - DNA, 140 bp, Artificial Sequence
  Synthetic
atacgccatgctgggtctcccagagttgctagtattacttgaaaaccagaaaacactcgatgaacatgacgcaaatgtgaacaatctatataacaaagtgaaaagggccctgggctcaaacgtacttgggagtcggccat

SEQ ID NO: 419598 - DNA, 140 bp, Artificial Sequence
  Synthetic
atggccgactcccaagtacgtttgagcccagggcccttttcactttgttatatagattgttcacatttgcgtcatgttcatcgagtgttttctggttttcaagtaatactagcaactctgggagacccagcatggcgtat

SEQ ID NO: 419599 - DNA, 140 bp, Artificial Sequence
  Synthetic
atacgccatgctgggtctccatgaatccaaatcaaaagataataacacttggctctgtttctatcatcattgccacaatatgcttccttatgcaaactgccatcctggtgactactgtaacgtacttgggagtcggccat

SEQ ID NO: 419600 - DNA, 140 bp, Artificial Sequence
  Synthetic
atggccgactcccaagtacgttacagtagtcaccaggatggcagtttgcataaggaagcatattgtggcaatgatgatagaaacagagccaagtgttattatcttttgatttggattcatggagacccagcatggcgtat

SEQ ID NO: 419601 - DNA, 140 bp, Artificial Sequence
  Synthetic
atacgccatgctgggtctccactgagggagaatgctgaagaggatgggactggatgctttgagatattccataagtgtgatgatcagtgcatggagagcataaggaacaacacctatgaccgtacttgggagtcggccat

SEQ ID NO: 419602 - DNA, 140 bp, Artificial Sequence
  Synthetic
atggccgactcccaagtacggtcataggtgttgttccttatgctctccatgcactgatcatcacacttatggaatatctcaaagcatccagtcccatcctcttcagcattctccctcagtggagacccagcatggcgtat

SEQ ID NO: 419603 - DNA, 140 bp, Artificial Sequence
  Synthetic
atacgccatgctgggtctccccgaacaatggcctggacagtggtaaacagcatctgcaacaccacaggggtcgagaagcctaaatttctcccggatctgtatgactataaggaaaaccggcgtacttgggagtcggccat

SEQ ID NO: 419604 - DNA, 140 bp, Artificial Sequence
  Synthetic
atggccgactcccaagtacgccggttttccttatagtcatacagatccgggagaaatttaggcttctcgacccctgtggtgttgcagatgctgtttaccactgtccaggccattgttcggggagacccagcatggcgtat

SEQ ID NO: 419605 - DNA, 140 bp, Artificial Sequence
  Synthetic
atacgccatgctgggtctccacacatcaggaaggcaagagaagaaccccgcactcagaatgaagtggatgatggcaatgagatacccaattacagcagacaagagaataatggacatgatcgtacttgggagtcggccat

SEQ ID NO: 419606 - DNA, 140 bp, Artificial Sequence
  Synthetic
atggccgactcccaagtacgatcatgtccattattctcttgtctgctgtaattgggtatctcattgccatcatccacttcattctgagtgcggggttcttctcttgccttcctgatgtgtggagacccagcatggcgtat

SEQ ID NO: 419607 - DNA, 140 bp, Artificial Sequence
  Synthetic
atacgccatgctgggtctccattgtcgcctgaagaagtcagcgagacacaagggacagagaagctgacaataacttattcgtcatcaatgatgtgggagataaatggtcctgaatcggttcgtacttgggagtcggccat

SEQ ID NO: 419608 - DNA, 140 bp, Artificial Sequence
  Synthetic
atggccgactcccaagtacgaaccgattcaggaccatttatctcccacatcattgatgacgaataagttattgtcagcttctctgtcccttgtgtctcgctgacttcttcaggcgacaatggagacccagcatggcgtat

SEQ ID NO: 419609 - DNA, 140 bp, Artificial Sequence
  Synthetic
atacgccatgctgggtctccgctgataatctggggggtacaccatcccaatgacgatacagaacaaaggacactgtaccagaatgtgggaacatatgtttccgttggaacatcaacattgcgtacttgggagtcggccat

SEQ ID NO: 419610 - DNA, 140 bp, Artificial Sequence
  Synthetic
atggccgactcccaagtacgcaatgttgatgttccaacggaaacatatgttcccacattctggtacagtgtcctttgttctgtatcgtcattgggatggtgtaccccccagattatcagcggagacccagcatggcgtat

SEQ ID NO: 419611 - DNA, 140 bp, Artificial Sequence
  Synthetic
aggccctggctgctgatatgaagtgggcgcttggtgagaatatggcaccagaaaaagtggactttgaagattgcaaggacattggcgatctaaagcagtatgatagtgatgagccagagcgaccttttgggacagcggtg

SEQ ID NO: 419612 - DNA, 140 bp, Artificial Sequence
  Synthetic
caccgctgtcccaaaaggtcgctctggctcatcactatcatactgctttagatcgccaatgtccttgcaatcttcaaagtccactttttctggtgccatattctcaccaagcgcccacttcatatcagcagccagggcct

SEQ ID NO: 419613 - DNA, 140 bp, Artificial Sequence
  Synthetic
atacgccatgctgggtctccagatggggtaaagctggaatcaacaaggatttaccagattttggcgatctattcaactgtcgccagttcattggtactggtagtctccctgggggcaatccgtacttgggagtcggccat

SEQ ID NO: 419614 - DNA, 140 bp, Artificial Sequence
  Synthetic
atggccgactcccaagtacggattgcccccagggagactaccagtaccaatgaactggcgacagttgaatagatcgccaaaatctggtaaatccttgttgattccagctttaccccatctggagacccagcatggcgtat

SEQ ID NO: 419615 - DNA, 140 bp, Artificial Sequence
  Synthetic
aggccctggctgctgatatgccagatcactggcaagctggatccagagcgaattcaataaggcatgtgaattgactgactcaagctggatagaacttgatgaaataggagaagatgttgcgaccttttgggacagcggtg

SEQ ID NO: 419616 - DNA, 140 bp, Artificial Sequence
  Synthetic
caccgctgtcccaaaaggtcgcaacatcttctcctatttcatcaagttctatccagcttgagtcagtcaattcacatgccttattgaattcgctctggatccagcttgccagtgatctggcatatcagcagccagggcct

SEQ ID NO: 419617 - DNA, 140 bp, Artificial Sequence
  Synthetic
atacgccatgctgggtctcctccgattgaacacattgcaagtatgaggaggaactattttacggcagaagtgtcccactgcagggccactgaatacataatgaaaggagtctacataaatcgtacttgggagtcggccat

SEQ ID NO: 419618 - DNA, 140 bp, Artificial Sequence
  Synthetic
atggccgactcccaagtacgatttatgtagactcctttcattatgtattcagtggccctgcagtgggacacttctgccgtaaaatagttcctcctcatacttgcaatgtgttcaatcggaggagacccagcatggcgtat

SEQ ID NO: 419619 - DNA, 140 bp, Artificial Sequence
  Synthetic
atacgccatgctgggtctcctgtcccactgcagggccactgaatacataatgaaaggagtctacataaatacagctctgctcaatgcatcttgtgcagccatggacgacttccagctgatcgtacttgggagtcggccat

SEQ ID NO: 419620 - DNA, 140 bp, Artificial Sequence
  Synthetic
atggccgactcccaagtacgatcagctggaagtcgtccatggctgcacaagatgcattgagcagagctgtatttatgtagactcctttcattatgtattcagtggccctgcagtgggacaggagacccagcatggcgtat

SEQ ID NO: 419621 - DNA, 140 bp, Artificial Sequence
  Synthetic
atacgccatgctgggtctcccagaacctgtaaactggttggaatcaatatgagcaaaaagaaatcttacataaatagaacaggaacatttgaattcacaagctttttctaccgctatgggcgtacttgggagtcggccat

SEQ ID NO: 419622 - DNA, 140 bp, Artificial Sequence
  Synthetic
atggccgactcccaagtacgcccatagcggtagaaaaagcttgtgaattcaaatgttcctgttctatttatgtaagatttctttttgctcatattgattccaaccagtttacaggttctgggagacccagcatggcgtat

SEQ ID NO: 419623 - DNA, 140 bp, Artificial Sequence
  Synthetic
aggccctggctgctgatatggcatcttggttcaactccttcctcacacatgcactgaagtagttgtggcaatgctactatttgctatccatactgtccaaaaaagtaccttgtttctactgaccttttgggacagcggtg

SEQ ID NO: 419624 - DNA, 140 bp, Artificial Sequence
  Synthetic
caccgctgtcccaaaaggtcagtagaaacaaggtacttttttggacagtatggatagcaaatagtagcattgccacaactacttcagtgcatgtgtgaggaaggagttgaaccaagatgccatatcagcagccagggcct

SEQ ID NO: 419625 - DNA, 140 bp, Artificial Sequence
  Synthetic
atacgccatgctgggtctcctaaattttgagagcactggtaatttaattgcaccagaatatggattcaaaatatcaaagagaggaagctcaggaattatgaagacagagaaaacacttgacgtacttgggagtcggccat

SEQ ID NO: 419626 - DNA, 140 bp, Artificial Sequence
  Synthetic
atggccgactcccaagtacgtcaagtgttttctctgtcttcataattcctgagcttcctctctttgatattttgaatccatattctggtgcaattaaattaccagtgctctcaaaatttaggagacccagcatggcgtat

SEQ ID NO: 419627 - DNA, 140 bp, Artificial Sequence
  Synthetic
aggccctggctgctgatatgaagcagcagaccttaaaagcactcaagccgccattgaccaaatcaatggaaaactgaatcgggtaatcgagaaaacaaatgaaaagtttcatcagattgagaccttttgggacagcggtg

SEQ ID NO: 419628 - DNA, 140 bp, Artificial Sequence
  Synthetic
caccgctgtcccaaaaggtctcaatctgatgaaacttttcatttgttttctcgattacccgattcagttttccattgatttggtcaatggcggcttgagtgcttttaaggtctgctgcttcatatcagcagccagggcct

SEQ ID NO: 419629 - DNA, 140 bp, Artificial Sequence
  Synthetic
aggccctggctgctgatatgcttctgtcaaagaaaaggacatgactaaagagttttttgaaaacaaatcggaaacatggccaattggagaatcccccaggggagtagaggaaggctctatgaccttttgggacagcggtg

SEQ ID NO: 419630 - DNA, 140 bp, Artificial Sequence
  Synthetic
caccgctgtcccaaaaggtcatagagccttcctctactcccctgggggattctccaattggccatgtttccgatttgttttcaaaaaactctttagtcatgtccttttctttgacagaagcatatcagcagccagggcct

SEQ ID NO: 419631 - DNA, 140 bp, Artificial Sequence
  Synthetic
atacgccatgctgggtctccgaaacatggccaattggagaatcccccaggggagtagaggaaggctctattggaaaagtatgtagaaccttgctggcaaagtctgtattcaacagcctgtcgtacttgggagtcggccat

SEQ ID NO: 419632 - DNA, 140 bp, Artificial Sequence
  Synthetic
atggccgactcccaagtacgacaggctgttgaatacagactttgccagcaaggttctacatacttttccaatagagccttcctctactcccctgggggattctccaattggccatgtttcggagacccagcatggcgtat

SEQ ID NO: 419633 - DNA, 140 bp, Artificial Sequence
  Synthetic
atacgccatgctgggtctccagcaaaagcagggtagataatcactcacccgagtgacatcaacatcatggcgtctcaaggcaccaaacgatcttatgaacaaatggagactggtggagaacgtacttgggagtcggccat

SEQ ID NO: 419634 - DNA, 140 bp, Artificial Sequence
  Synthetic
atggccgactcccaagtacgttctccaccagtctccatttgttcataagatcgtttggtgccttgagacgccatgatgttgatgtcactcgggtgagtgattatctaccctgcttttgctggagacccagcatggcgtat

SEQ ID NO: 419635 - DNA, 140 bp, Artificial Sequence
  Synthetic
atacgccatgctgggtctccctcattgttcaggcacttagggacaacctggaacctgggaccttcgatcttggggggctatatgaagcaattgaggagtgcctgattaatgatccctgggcgtacttgggagtcggccat

SEQ ID NO: 419636 - DNA, 140 bp, Artificial Sequence
  Synthetic
atggccgactcccaagtacgcccagggatcattaatcaggcactcctcaattgcttcatatagccccccaagatcgaaggtcccaggttccaggttgtccctaagtgcctgaacaatgagggagacccagcatggcgtat

SEQ ID NO: 419637 - DNA, 140 bp, Artificial Sequence
  Synthetic
atacgccatgctgggtctccatggatgtccatccgactttacttttcttgaaagtgccagcacaaaatgctataagcactccattcccatatactggagcccccccatacagccatggaccgtacttgggagtcggccat

SEQ ID NO: 419638 - DNA, 140 bp, Artificial Sequence
  Synthetic
atggccgactcccaagtacggtccatggctgtatgggggggctccagtatatgggaatggagtgcttatagcattttgtgctggcactttcaagaaaagtaaagtcggatggacatccatggagacccagcatggcgtat

SEQ ID NO: 419639 - DNA, 140 bp, Artificial Sequence
  Synthetic
atacgccatgctgggtctccttccaggtagactgctttctttggcatgtccgcaaacgatttgcagaccaagaaatgggtgatgccccatttctagaccggcttcgccgagatcagaagtcgtacttgggagtcggccat

SEQ ID NO: 419640 - DNA, 140 bp, Artificial Sequence
  Synthetic
atggccgactcccaagtacgacttctgatctcggcgaagccggtctagaaatggggcatcacccatttcttggtctgcaaatcgtttgcggacatgccaaagaaagcagtctacctggaaggagacccagcatggcgtat

SEQ ID NO: 419641 - DNA, 140 bp, Artificial Sequence
  Synthetic
aggccctggctgctgatatgtggaccatatggccataatcaagaaatacacatcaggaaggcaagaaaagaaccctgccctcagaatgaaatggatgatggcaatgaaatacccaatcacgaccttttgggacagcggtg

SEQ ID NO: 419642 - DNA, 140 bp, Artificial Sequence
  Synthetic
caccgctgtcccaaaaggtcgtgattgggtatttcattgccatcatccatttcattctgagggcagggttcttttcttgccttcctgatgtgtatttcttgattatggccatatggtccacatatcagcagccagggcct

SEQ ID NO: 419643 - DNA, 140 bp, Artificial Sequence
  Synthetic
aggccctggctgctgatatgatgatcaaatacaagacatttgggcttacaatgcagaattgctagtactgctcgaaaaccagaaaacactcgatgaacatgatgcaaatgtaaataatctgaccttttgggacagcggtg

SEQ ID NO: 419644 - DNA, 140 bp, Artificial Sequence
  Synthetic
caccgctgtcccaaaaggtcagattatttacatttgcatcatgttcatcgagtgttttctggttttcgagcagtactagcaattctgcattgtaagcccaaatgtcttgtatttgatcatcatatcagcagccagggcct

SEQ ID NO: 419645 - DNA, 140 bp, Artificial Sequence
  Synthetic
atacgccatgctgggtctccatgcagagagaggcaaattaaaaaggagggctatcgcaacacctgggatgcaaatcagagggttcgtgtattttgttgagactttagctagaagcatttgcgtacttgggagtcggccat

SEQ ID NO: 419646 - DNA, 140 bp, Artificial Sequence
  Synthetic
atggccgactcccaagtacgcaaatgcttctagctaaagtctcaacaaaatacacgaaccctctgatttgcatcccaggtgttgcgatagccctcctttttaatttgcctctctctgcatggagacccagcatggcgtat

SEQ ID NO: 419647 - DNA, 140 bp, Artificial Sequence
  Synthetic
atacgccatgctgggtctccatgggcacttggtgaaaatatggcaccagagaaggtagactttgagtattgcaaggatgttagagatctaaaacagtatgacagtgatgaaccagagtctcgtacttgggagtcggccat

SEQ ID NO: 419648 - DNA, 140 bp, Artificial Sequence
  Synthetic
atggccgactcccaagtacgagactctggttcatcactgtcatactgttttagatctctaacatccttgcaatactcaaagtctaccttctctggtgccatattttcaccaagtgcccatggagacccagcatggcgtat

SEQ ID NO: 419649 - DNA, 140 bp, Artificial Sequence
  Synthetic
aggccctggctgctgatatgccaaattggcaaatgttgtaagaaagatgatgactaattcacaagacacagagctttctttcacaatcactggggacaacactaaatggaatgaaaaccagaccttttgggacagcggtg

SEQ ID NO: 419650 - DNA, 140 bp, Artificial Sequence
  Synthetic
caccgctgtcccaaaaggtctggttttcattccatttagtgttgtccccagtgattgtgaaagaaagctctgtgtcttgtgaattagtcatcatctttcttacaacatttgccaatttggcatatcagcagccagggcct

SEQ ID NO: 419651 - DNA, 140 bp, Artificial Sequence
  Synthetic
atacgccatgctgggtctccaccaataaccaatagagtagtaaatgaaaaaggagaaagtttcgacatgctttacggtctggcggttaaaggacaatctcatctgaggggagatactgatcgtacttgggagtcggccat

SEQ ID NO: 419652 - DNA, 140 bp, Artificial Sequence
  Synthetic
atggccgactcccaagtacgatcagtatctcccctcagatgagattgtcctttaaccgccagaccgtaaagcatgtcgaaactttctcctttttcatttactactctattggttattggtggagacccagcatggcgtat

SEQ ID NO: 419653 - DNA, 140 bp, Artificial Sequence
  Synthetic
atacgccatgctgggtctccgcaataattgtggccatggtgttttcacaagaggattgcatgatcaaggcagttcgaggtgatttgaactttgtcaacagagcaaaccagcggctaaacccgtacttgggagtcggccat

SEQ ID NO: 419654 - DNA, 140 bp, Artificial Sequence
  Synthetic
atggccgactcccaagtacgggtttagccgctggtttgctctgttgacaaagttcaaatcacctcgaactgccttgatcatgcaatcctcttgtgaaaacaccatggccacaattattgcggagacccagcatggcgtat

SEQ ID NO: 419655 - DNA, 140 bp, Artificial Sequence
  Synthetic
atacgccatgctgggtctccgggggctatatgaggcaattgaggagtgcctgattaatgatccctgggttttgcttaatgcatcttggttcaactccttcctcacacatgcactgaaatacgtacttgggagtcggccat

SEQ ID NO: 419656 - DNA, 140 bp, Artificial Sequence
  Synthetic
atggccgactcccaagtacgtatttcagtgcatgtgtgaggaaggagttgaaccaagatgcattaagcaaaacccagggatcattaatcaggcactcctcaattgcctcatatagcccccggagacccagcatggcgtat

SEQ ID NO: 419657 - DNA, 140 bp, Artificial Sequence
  Synthetic
atacgccatgctgggtctcccgctctcatagtaaatgcaccaaaccatgaggggatacaggccggagtagacaggttctatagaacctgtaagctggttgggatcaatatgagtaaaaagcgtacttgggagtcggccat

SEQ ID NO: 419658 - DNA, 140 bp, Artificial Sequence
  Synthetic
atggccgactcccaagtacgctttttactcatattgatcccaaccagcttacaggttctatagaacctgtctactccggcctgtatcccctcatggtttggtgcatttactatgagagcgggagacccagcatggcgtat

SEQ ID NO: 419659 - DNA, 140 bp, Artificial Sequence
  Synthetic
aggccctggctgctgatatgatggagagaataaaggaattaagagatttgatttcccagtttggcactcgcgagatactgacaaaaaccacagtggaccacatggccataattaagaaatgaccttttgggacagcggtg

SEQ ID NO: 419660 - DNA, 140 bp, Artificial Sequence
  Synthetic
caccgctgtcccaaaaggtcatttcttaattatggccatgtggtccactgtggtttttgtcagtatctcgcgagtgccaaactgggaaatcaaatctcttaattcctttattctctccatcatatcagcagccagggcct

SEQ ID NO: 419661 - DNA, 140 bp, Artificial Sequence
  Synthetic
aggccctggctgctgatatgccaaccaatggcttatgctacccaggagatttccaagactatgaagaacttaaacatctcttaagcagtacaacccattttgaaaaaatacagatattccgaccttttgggacagcggtg

SEQ ID NO: 419662 - DNA, 140 bp, Artificial Sequence
  Synthetic
caccgctgtcccaaaaggtcggaatatctgtattttttcaaaatgggttgtactgcttaagagatgtttaagttcttcatagtcttggaaatctcctgggtagcataagccattggttggcatatcagcagccagggcct

SEQ ID NO: 419663 - DNA, 140 bp, Artificial Sequence
  Synthetic
atacgccatgctgggtctcccgaaagcttttttctcagaaaaatgagacttgacaacgccacttggggccgaataacttttggcccagttgaaagagtgagaaaaagggtactgctaaaccgtacttgggagtcggccat

SEQ ID NO: 419664 - DNA, 140 bp, Artificial Sequence
  Synthetic
atggccgactcccaagtacggtttagcagtaccctttttctcactctttcaactgggccaaaagttattcggccccaagtggcgttgtcaagtctcatttttctgagaaaaaagctttcgggagacccagcatggcgtat

SEQ ID NO: 419665 - DNA, 140 bp, Artificial Sequence
  Synthetic
aggccctggctgctgatatgtataagtactacattcccttatactggagatcctccatacagccatgggacaggaacagggtacaccatggacacagtcaatagaacacatcaatactcagaccttttgggacagcggtg

SEQ ID NO: 419666 - DNA, 140 bp, Artificial Sequence
  Synthetic
caccgctgtcccaaaaggtctgagtattgatgtgttctattgactgtgtccatggtgtaccctgttcctgtcccatggctgtatggaggatctccagtataagggaatgtagtacttatacatatcagcagccagggcct

SEQ ID NO: 419667 - DNA, 140 bp, Artificial Sequence
  Synthetic
aggccctggctgctgatatgaattcagacaaggaggtcattcgagctgaagaagctgtgggaacaaacccgttcaaaggcaggactactggtctcagatggagggccaaatctatacaatgaccttttgggacagcggtg

SEQ ID NO: 419668 - DNA, 140 bp, Artificial Sequence
  Synthetic
caccgctgtcccaaaaggtcattgtatagatttggccctccatctgagaccagtagtcctgcctttgaacgggtttgttcccacagcttcttcagctcgaatgacctccttgtctgaattcatatcagcagccagggcct

SEQ ID NO: 419669 - DNA, 140 bp, Artificial Sequence
  Synthetic
aggccctggctgctgatatgagagctaaggtcactttttagttctgctaggtcttatcaaaggatccagattttcccagacacaatctggaatgtgtcttacagtgggacaagcaaagcagaccttttgggacagcggtg

SEQ ID NO: 419670 - DNA, 140 bp, Artificial Sequence
  Synthetic
caccgctgtcccaaaaggtctgctttgcttgtcccactgtaagacacattccagattgtgtctgggaaaatctggatcctttgataagacctagcagaactaaaaagtgaccttagctctcatatcagcagccagggcct

SEQ ID NO: 419671 - DNA, 140 bp, Artificial Sequence
  Synthetic
atacgccatgctgggtctccaatccaaacgaaaagatcattcgagctaaaaaaactatgggagcaaacccattcaaagacaggactactggtttcagatggaggaccaaatttgtacaaccgtacttgggagtcggccat

SEQ ID NO: 419672 - DNA, 140 bp, Artificial Sequence
  Synthetic
atggccgactcccaagtacggttgtacaaatttggtcctccatctgaaaccagtagtcctgtctttgaatgggtttgctcccatagtttttttagctcgaatgatcttttcgtttggattggagacccagcatggcgtat

SEQ ID NO: 419673 - DNA, 140 bp, Artificial Sequence
  Synthetic
atacgccatgctgggtctcctatggagagaataaaagaactaagagatctaatgtcacagtctcgcactcgcgagatactaaccaaaaccactgttgaccacatggccataatcaaaaagcgtacttgggagtcggccat

SEQ ID NO: 419674 - DNA, 140 bp, Artificial Sequence
  Synthetic
atggccgactcccaagtacgctttttgattatggccatgtggtcaacagtggttttggttagtatctcgcgagtgcgagactgtgacattagatctcttagttcttttattctctccataggagacccagcatggcgtat

SEQ ID NO: 419675 - DNA, 140 bp, Artificial Sequence
  Synthetic
atacgccatgctgggtctccgattctacaggacctgcaagttagtgggaatcaacatgagcaaaaagaagtcctatataaataagacagggacatttgaattcactagctttttttatcgcgtacttgggagtcggccat

SEQ ID NO: 419676 - DNA, 140 bp, Artificial Sequence
  Synthetic
atggccgactcccaagtacgcgataaaaaaagctagtgaattcaaatgtccctgtcttatttatataggacttctttttgctcatgttgattcccactaacttgcaggtcctgtagaatcggagacccagcatggcgtat

SEQ ID NO: 419677 - DNA, 140 bp, Artificial Sequence
  Synthetic
aggccctggctgctgatatgcaaggttcaggatatgcagcagacaaagaatccactcaaaaggcaattgacgggataactaacaaggtaaattctgtgattgaaaagatgaacactcagtgaccttttgggacagcggtg

SEQ ID NO: 419678 - DNA, 140 bp, Artificial Sequence
  Synthetic
caccgctgtcccaaaaggtcactgagtgttcatcttttcaatcacagaatttaccttgttagttatcccgtcaattgccttttgagtggattctttgtctgctgcatatcctgaaccttgcatatcagcagccagggcct

SEQ ID NO: 419679 - DNA, 140 bp, Artificial Sequence
  Synthetic
aggccctggctgctgatatgttaaactggaatctgaggggacttacaaaatacttaccatttattcgactgtcgcctcatctcttgtacttgcaatggggtttgctgccttcttattctggaccttttgggacagcggtg

SEQ ID NO: 419680 - DNA, 140 bp, Artificial Sequence
  Synthetic
caccgctgtcccaaaaggtccagaataagaaggcagcaaaccccattgcaagtacaagagatgaggcgacagtcgaataaatggtaagtattttgtaagtcccctcagattccagtttaacatatcagcagccagggcct

SEQ ID NO: 419681 - DNA, 140 bp, Artificial Sequence
  Synthetic
atacgccatgctgggtctccgcagtctcgcactcgcgagatactcactaagaccactgtggaccatatggccataatcaaaaagtacacgtcaggaaggcaggagaagaaccccgcactccgtacttgggagtcggccat

SEQ ID NO: 419682 - DNA, 140 bp, Artificial Sequence
  Synthetic
atggccgactcccaagtacggagtgcggggttcttctcctgccttcctgacgtgtactttttgattatggccatatggtccacagtggtcttagtgagtatctcgcgagtgcgagactgcggagacccagcatggcgtat

SEQ ID NO: 419683 - DNA, 140 bp, Artificial Sequence
  Synthetic
aggccctggctgctgatatgccataatcaaaaagtacacgtcaggaaggcaggagaagaaccccgcactcagaatgaagtggatgatggcaatgaaatacccaattacagcagacaggaggaccttttgggacagcggtg

SEQ ID NO: 419684 - DNA, 140 bp, Artificial Sequence
  Synthetic
caccgctgtcccaaaaggtcctcctgtctgctgtaattgggtatttcattgccatcatccacttcattctgagtgcggggttcttctcctgccttcctgacgtgtactttttgattatggcatatcagcagccagggcct

SEQ ID NO: 419685 - DNA, 140 bp, Artificial Sequence
  Synthetic
  misc_feature (88)..(88): n is a, c, g, or t
  misc_feature (96)..(96): n is a, c, g, or t
  misc_feature (101)..(101): n is a, c, g, or t
  misc_feature (118)..(118): n is a, c, g, or t
aggccctggctgctgatatgacggaaacgggactctagcatacttactgacagtcagacagcgaccaaaaggattcggatggccatcnattaatgngatgnaggtcgctagatggtcnacgaccttttgggacagcggtg

SEQ ID NO: 419686 - DNA, 140 bp, Artificial Sequence
  Synthetic
  misc_feature (23)..(23): n is a, c, g, or t
  misc_feature (40)..(40): n is a, c, g, or t
  misc_feature (45)..(45): n is a, c, g, or t
  misc_feature (53)..(53): n is a, c, g, or t
caccgctgtcccaaaaggtcgtngaccatctagcgacctncatcncattaatngatggccatccgaatccttttggtcgctgtctgactgtcagtaagtatgctagagtcccgtttccgtcatatcagcagccagggcct

SEQ ID NO: 419687 - DNA, 140 bp, Artificial Sequence
  Synthetic
atacgccatgctgggtctccagtgaaaaggaaaaggtatagtgctttatccaatgacatttcacaaggaattaagagacaaagaatgacagttgagtctatggggtgggccttgagctaacgtacttgggagtcggccat

SEQ ID NO: 419688 - DNA, 140 bp, Artificial Sequence
  Synthetic
atggccgactcccaagtacgttagctcaaggcccaccccatagactcaactgtcattctttgtctcttaattccttgtgaaatgtcattggataaagcactataccttttccttttcactggagacccagcatggcgtat

SEQ ID NO: 419689 - DNA, 140 bp, Artificial Sequence
  Synthetic
aggccctggctgctgatatgtaaatcagaaacgtggccaattggggaatcacctaagggggtggaggaaagctctattgggaaggtgtgtagaacattactagcaaaatctgtattcaacgaccttttgggacagcggtg

SEQ ID NO: 419690 - DNA, 140 bp, Artificial Sequence
  Synthetic
caccgctgtcccaaaaggtcgttgaatacagattttgctagtaatgttctacacaccttcccaatagagctttcctccacccccttaggtgattccccaattggccacgtttctgatttacatatcagcagccagggcct

SEQ ID NO: 419691 - DNA, 140 bp, Artificial Sequence
  Synthetic
aggccctggctgctgatatgagtggatcgtcagtcaaaagggaagaagaagtgcttacgggcaaccttcaaacattgaaaataagagtacatgaggggtatgaagagttcacaatggttggaccttttgggacagcggtg

SEQ ID NO: 419692 - DNA, 140 bp, Artificial Sequence
  Synthetic
caccgctgtcccaaaaggtccaaccattgtgaactcttcatacccctcatgtactcttattttcaatgtttgaaggttgcccgtaagcacttcttcttcccttttgactgacgatccactcatatcagcagccagggcct

SEQ ID NO: 419693 - DNA, 140 bp, Artificial Sequence
  Synthetic
atacgccatgctgggtctccctcttgaggcacttccaaaaggatgcaaaagtgctcttccaaaattggggaattgaacccattgacaacgtgatgggaatgatcggaatattgcctgacacgtacttgggagtcggccat

SEQ ID NO: 419694 - DNA, 140 bp, Artificial Sequence
  Synthetic
atggccgactcccaagtacgtgtcaggcaatattccgatcattcccatcacgttgtcaatgggttcaattccccaattttggaagagcacttttgcatccttttggaagtgcctcaagagggagacccagcatggcgtat

SEQ ID NO: 419695 - DNA, 140 bp, Artificial Sequence
  Synthetic
aggccctggctgctgatatggcaaggagacgtggtgttggtaatgaaacggaaacgggactctagcatacttactgacagccagacagcgaccaaaagaattcggatggccatcaattaagaccttttgggacagcggtg

SEQ ID NO: 419696 - DNA, 140 bp, Artificial Sequence
  Synthetic
caccgctgtcccaaaaggtcttaattgatggccatccgaattcttttggtcgctgtctggctgtcagtaagtatgctagagtcccgtttccgtttcattaccaacaccacgtctccttgccatatcagcagccagggcct

SEQ ID NO: 419697 - DNA, 140 bp, Artificial Sequence
  Synthetic
atacgccatgctgggtctccggagtagatgaatactccagtacagagcgggtagtagtaagcatcgaccgatttttaagagttcgagaccaacgggggaacgtactattgtcacccgaagcgtacttgggagtcggccat

SEQ ID NO: 419698 - DNA, 140 bp, Artificial Sequence
  Synthetic
atggccgactcccaagtacgcttcgggtgacaatagtacgttcccccgttggtctcgaactcttaaaaatcggtcgatgcttactactacccgctctgtactggagtattcatctactccggagacccagcatggcgtat

SEQ ID NO: 419699 - DNA, 140 bp, Artificial Sequence
  Synthetic
atacgccatgctgggtctccgacatccttagacagaacccaacggaggaacaagccgtagacatatgcaaggcagcaatggggctgaggattagctcctctttcagctttggtggattcacgtacttgggagtcggccat

SEQ ID NO: 419700 - DNA, 140 bp, Artificial Sequence
  Synthetic
atggccgactcccaagtacgtgaatccaccaaagctgaaagaggagctaatcctcagccccattgctgccttgcatatgtctacggcttgttcctccgttgggttctgtctaaggatgtcggagacccagcatggcgtat

SEQ ID NO: 419701 - DNA, 140 bp, Artificial Sequence
  Synthetic
atacgccatgctgggtctccccagctaaaagcatggaatatgacgctgttgcaaccacgcattcttggattccaaaaaggaatcgttccattctcaataccagccaaaggggaattcttgcgtacttgggagtcggccat

SEQ ID NO: 419702 - DNA, 140 bp, Artificial Sequence
  Synthetic
atggccgactcccaagtacgcaagaattcccctttggctggtattgagaatggaacgattcctttttggaatccaagaatgcgtggttgcaacagcgtcatattccatgcttttagctggggagacccagcatggcgtat

SEQ ID NO: 419703 - DNA, 140 bp, Artificial Sequence
  Synthetic
atacgccatgctgggtctcctcaatgatgtgggagatcaatggtcctgagtcggtgttggtcaatacttatcagtggataatcagaaactgggaaactgtaaaaattcaatggtcacaggcgtacttgggagtcggccat

SEQ ID NO: 419704 - DNA, 140 bp, Artificial Sequence
  Synthetic
atggccgactcccaagtacgcctgtgaccattgaatttttacagtttcccagtttctgattatccactgataagtattgaccaacaccgactcaggaccattgatctcccacatcattgaggagacccagcatggcgtat

SEQ ID NO: 419705 - DNA, 140 bp, Artificial Sequence
  Synthetic
atacgccatgctgggtctccgtccctaaggcagccagaggtcaatacagtgggttcgtgaggacactattccagcaaatgcgagatgtgcttggaacatttgacactgttcagataataacgtacttgggagtcggccat

SEQ ID NO: 419706 - DNA, 140 bp, Artificial Sequence
  Synthetic
atggccgactcccaagtacgttattatctgaacagtgtcaaatgttccaagcacatctcgcatttgctggaatagtgtcctcacgaacccactgtattgacctctggctgccttagggacggagacccagcatggcgtat

SEQ ID NO: 419707 - DNA, 140 bp, Artificial Sequence
  Synthetic
atacgccatgctgggtctccaccggctccgccgagatcagaagtccctaagaggaagaggcaacactcttggtctggacatcgaaacagctactcgtgtggggaagcagatagtggagcgcgtacttgggagtcggccat

SEQ ID NO: 419708 - DNA, 140 bp, Artificial Sequence
  Synthetic
atggccgactcccaagtacgcgctccactatctgcttccccacacgagtagctgtttcgatgtccagaccaagagtgttgcctcttcctcttagggacttctgatctcggcggagccggtggagacccagcatggcgtat

SEQ ID NO: 419709 - DNA, 140 bp, Artificial Sequence
  Synthetic
aggccctggctgctgatatgtaaatgggcaaagtggcagaatgagtttttattggacaattttaaagccaagagataccattaactttgagactaatggaaattttatccctccagagtagaccttttgggacagcggtg

SEQ ID NO: 419710 - DNA, 140 bp, Artificial Sequence
  Synthetic
caccgctgtcccaaaaggtctactctggagggataaaatttccattagtctcaaagttaatggtatctcttggctttaaaattgtccaataaaaactcattctgccactttgcccatttacatatcagcagccagggcct

SEQ ID NO: 419711 - DNA, 140 bp, Artificial Sequence
  Synthetic
atacgccatgctgggtctcctcaatggtcacaggatcccacgatgttatacaacaaaatggaatttgaaccattccagtctcttgtccctaaggcaaccagaagtcgttacagtggatttcgtacttgggagtcggccat

SEQ ID NO: 419712 - DNA, 140 bp, Artificial Sequence
  Synthetic
atggccgactcccaagtacgaaatccactgtaacgacttctggttgccttagggacaagagactggaatggttcaaattccattttgttgtataacatcgtgggatcctgtgaccattgaggagacccagcatggcgtat

SEQ ID NO: 419713 - DNA, 140 bp, Artificial Sequence
  Synthetic
atacgccatgctgggtctcccaaacgcatcaaatgttcaggctgtgaaccgttctgcagcaaaaggggtgacacttcttctcccagaaccggagtggacatacccgcgtttatcttgccccgtacttgggagtcggccat

SEQ ID NO: 419714 - DNA, 140 bp, Artificial Sequence
  Synthetic
atggccgactcccaagtacggggcaagataaacgcgggtatgtccactccggttctgggagaagaagtgtcaccccttttgctgcagaacggttcacagcctgaacatttgatgcgtttgggagacccagcatggcgtat

SEQ ID NO: 419715 - DNA, 140 bp, Artificial Sequence
  Synthetic
aggccctggctgctgatatgcttcccaaatgaagtgggtgctagaatactgacttcagagtcgcagttgacaataacaaaagagaaaaaagaagagcttcaagattgtaagattgctcctgaccttttgggacagcggtg

SEQ ID NO: 419716 - DNA, 140 bp, Artificial Sequence
  Synthetic
caccgctgtcccaaaaggtcaggagcaatcttacaatcttgaagctcttcttttttctcttttgttattgtcaactgcgactctgaagtcagtattctagcacccacttcatttgggaagcatatcagcagccagggcct

SEQ ID NO: 419717 - DNA, 140 bp, Artificial Sequence
  Synthetic
atacgccatgctgggtctccacacagtcatacatgagaaaataggagaccaccaaacagtgacccatccaacaataacgacccctgcgataccgaactgcagtgacactataataacatacgtacttgggagtcggccat

SEQ ID NO: 419718 - DNA, 140 bp, Artificial Sequence
  Synthetic
atggccgactcccaagtacgtatgttattatagtgtcactgcagttcggtatcgcaggggtcgttattgttggatgggtcactgtttggtggtctcctattttctcatgtatgactgtgtggagacccagcatggcgtat

SEQ ID NO: 419719 - DNA, 140 bp, Artificial Sequence
  Synthetic
aggccctggctgctgatatgaatgaaacggaaacgggactctagcatacttactgacagccagacagcgaccaaaaggattcggatggccatcaattagtgtcgaattgtttaaaaacgagaccttttgggacagcggtg

SEQ ID NO: 419720 - DNA, 140 bp, Artificial Sequence
  Synthetic
caccgctgtcccaaaaggtctcgtttttaaacaattcgacactaattgatggccatccgaatccttttggtcgctgtctggctgtcagtaagtatgctagagtcccgtttccgtttcattcatatcagcagccagggcct

SEQ ID NO: 419721 - DNA, 140 bp, Artificial Sequence
  Synthetic
atacgccatgctgggtctccaaaggcctttcaagtctccactaccgctgtgccccttcagaggattcttcccttttcacaaggacaatgcaatacgactgggtgagaacaaagacgtcatcgtacttgggagtcggccat

SEQ ID NO: 419722 - DNA, 140 bp, Artificial Sequence
  Synthetic
atggccgactcccaagtacgatgacgtctttgttctcacccagtcgtattgcattgtccttgtgaaaagggaagaatcctctgaaggggcacagcggtagtggagacttgaaaggcctttggagacccagcatggcgtat

SEQ ID NO: 419723 - DNA, 140 bp, Artificial Sequence
  Synthetic
atacgccatgctgggtctccaagaagagtctaagctgaacaggaacgaaatcaaaggggtgaaattgagcaatatgggggtctatcaaatacttgctatatacgctacagttgcaggctccgtacttgggagtcggccat

SEQ ID NO: 419724 - DNA, 140 bp, Artificial Sequence
  Synthetic
atggccgactcccaagtacggagcctgcaactgtagcgtatatagcaagtatttgatagacccccatattgctcaatttcacccctttgatttcgttcctgttcagcttagactcttcttggagacccagcatggcgtat

SEQ ID NO: 419725 - DNA, 140 bp, Artificial Sequence
  Synthetic
aggccctggctgctgatatgtgttcacgctcaccgtgcccagtgagcgaggactgcagcgtagacgctttgtccaaaatgccctaaatgggaatggggacccaaacaacatggatagagcgaccttttgggacagcggtg

SEQ ID NO: 419726 - DNA, 140 bp, Artificial Sequence
  Synthetic
caccgctgtcccaaaaggtcgctctatccatgttgtttgggtccccattcccatttagggcattttggacaaagcgtctacgctgcagtcctcgctcactgggcacggtgagcgtgaacacatatcagcagccagggcct

SEQ ID NO: 419727 - DNA, 140 bp, Artificial Sequence
  Synthetic
atacgccatgctgggtctcctactagcaataacaggaagcaatgcggacaaaatctgcattggctaccaatcaacaaactccacggaaactgtagacacgctaaccgaaaacaatgttcccgtacttgggagtcggccat

SEQ ID NO: 419728 - DNA, 140 bp, Artificial Sequence
  Synthetic
atggccgactcccaagtacgggaacattgttttcggttagcgtgtctacagtttccgtggagtttgttgattggtagccaatgcagattttgtccgcattgcttcctgttattgctagtaggagacccagcatggcgtat

SEQ ID NO: 419729 - DNA, 140 bp, Artificial Sequence
  Synthetic
aggccctggctgctgatatggctatgtggacattgatgtttactgtatatgtagggacaattggaagggttctaacagaccttggatgagaatcaacaatgaaactatactggaaacagggaccttttgggacagcggtg

SEQ ID NO: 419730 - DNA, 140 bp, Artificial Sequence
  Synthetic
caccgctgtcccaaaaggtccctgtttccagtatagtttcattgttgattctcatccaaggtctgttagaacccttccaattgtccctacatatacagtaaacatcaatgtccacatagccatatcagcagccagggcct

SEQ ID NO: 419731 - DNA, 140 bp, Artificial Sequence
  Synthetic
atacgccatgctgggtctcccattggcatgaagagtctcaaacttgcagttggtctgaggaatgtgccttctagatctagtagaggactattcggggccatagcaggatttatagagggacgtacttgggagtcggccat

SEQ ID NO: 419732 - DNA, 140 bp, Artificial Sequence
  Synthetic
atggccgactcccaagtacgtccctctataaatcctgctatggccccgaatagtcctctactagatctagaaggcacattcctcagaccaactgcaagtttgagactcttcatgccaatgggagacccagcatggcgtat

SEQ ID NO: 419733 - DNA, 140 bp, Artificial Sequence
  Synthetic
atacgccatgctgggtctcccaacaatgtcatgtgactccccaagcaatgtcaatggaggacccggagtgaaggggtttggtttcaaagccggcaatgatgtatggttaggtagaacagtcgtacttgggagtcggccat

SEQ ID NO: 419734 - DNA, 140 bp, Artificial Sequence
  Synthetic
atggccgactcccaagtacgactgttctacctaaccatacatcattgccggctttgaaaccaaaccccttcactccgggtcctccattgacattgcttggggagtcacatgacattgttgggagacccagcatggcgtat

SEQ ID NO: 419735 - DNA, 140 bp, Artificial Sequence
  Synthetic
aggccctggctgctgatatgtgtgggacactgtcacaggtgttgacatggctctgtaatggaggaatggttaagtctgttctaaaccctttgttcctattttgtttgaacaattgtccttgaccttttgggacagcggtg

SEQ ID NO: 419736 - DNA, 140 bp, Artificial Sequence
  Synthetic
caccgctgtcccaaaaggtcaaggacaattgttcaaacaaaataggaacaaagggtttagaacagacttaaccattcctccattacagagccatgtcaacacctgtgacagtgtcccacacatatcagcagccagggcct

SEQ ID NO: 419737 - DNA, 140 bp, Artificial Sequence
  Synthetic
atacgccatgctgggtctccggatcaactctcccaaccatgccaaatcaattacacagacactggtgtccaacaatgactggtcgggctattcaggtagtttcattgtcaaaaccaaggacgtacttgggagtcggccat

SEQ ID NO: 419738 - DNA, 140 bp, Artificial Sequence
  Synthetic
atggccgactcccaagtacgtccttggttttgacaatgaaactacctgaatagcccgaccagtcattgttggacaccagtgtctgtgtaattgatttggcatggttgggagagttgatccggagacccagcatggcgtat

SEQ ID NO: 419739 - DNA, 140 bp, Artificial Sequence
  Synthetic
atacgccatgctgggtctccatgaatacaaatcaaagaataataaccattgggacagtttgcatgatagttggaataatcagtctattgttacagataggaaacatagtctcgttatggacgtacttgggagtcggccat

SEQ ID NO: 419740 - DNA, 140 bp, Artificial Sequence
  Synthetic
atggccgactcccaagtacgtccataacgagactatgtttcctatctgtaacaatagactgattattccaactatcatgcaaactgtcccaatggttattattctttgatttgtattcatggagacccagcatggcgtat

SEQ ID NO: 419741 - DNA, 140 bp, Artificial Sequence
  Synthetic
atacgccatgctgggtctccttagccatccaattcagaccggatgggaaaatcacactgagatgtgcaaccaaagtgtcattacatatgtaaataacacatgggtgaaccgaacttatgtcgtacttgggagtcggccat

SEQ ID NO: 419742 - DNA, 140 bp, Artificial Sequence
  Synthetic
atggccgactcccaagtacgacataagttcggttcacccatgtgttatttacatatgtaatgacactttggttgcacatctcagtgtgattttcccatccggtctgaattggatggctaaggagacccagcatggcgtat

SEQ ID NO: 419743 - DNA, 140 bp, Artificial Sequence
  Synthetic
aggccctggctgctgatatgcaaagtgtcattacatatgtaaataacacatgggtgaaccgaacttatgtgaacattagcaatatcaaaattgctactatacaggatgtgacttcgattagaccttttgggacagcggtg

SEQ ID NO: 419744 - DNA, 140 bp, Artificial Sequence
  Synthetic
caccgctgtcccaaaaggtctaatcgaagtcacatcctgtatagtagcaattttgatattgctaatgttcacataagttcggttcacccatgtgttatttacatatgtaatgacactttgcatatcagcagccagggcct

SEQ ID NO: 419745 - DNA, 140 bp, Artificial Sequence
  Synthetic
atacgccatgctgggtctccgagcctatgtggatggattcgaaccgaacggctgcattgagggcaagctttctcaaatgtccaaagaagtgaatgcccaaattgaaccttttctgaagaccgtacttgggagtcggccat

SEQ ID NO: 419746 - DNA, 140 bp, Artificial Sequence
  Synthetic
atggccgactcccaagtacggtcttcagaaaaggttcaatttgggcattcacttctttggacatttgagaaagcttgccctcaatgcagccgttcggttcgaatccatccacataggctcggagacccagcatggcgtat

SEQ ID NO: 419747 - DNA, 140 bp, Artificial Sequence
  Synthetic
aggccctggctgctgatatgagcaaagacaatagcataaggattggttctaaaggggacatttttgtcataagagaaccattcatttcatgctctcaattggaatgcagaaccttttttcgaccttttgggacagcggtg

SEQ ID NO: 419748 - DNA, 140 bp, Artificial Sequence
  Synthetic
caccgctgtcccaaaaggtcgaaaaaaggttctgcattccaattgagagcatgaaatgaatggttctcttatgacaaaaatgtcccctttagaaccaatccttatgctattgtctttgctcatatcagcagccagggcct

SEQ ID NO: 419749 - DNA, 140 bp, Artificial Sequence
  Synthetic
atacgccatgctgggtctccaagagaaccattcatttcatgctctcaattggaatgcagaaccttttttctgacccaaggcgctttgctgaatgacaaacattctaatggaaccgtcaagcgtacttgggagtcggccat

SEQ ID NO: 419750 - DNA, 140 bp, Artificial Sequence
  Synthetic
atggccgactcccaagtacgcttgacggttccattagaatgtttgtcattcagcaaagcgccttgggtcagaaaaaaggttctgcattccaattgagagcatgaaatgaatggttctcttggagacccagcatggcgtat

SEQ ID NO: 419751 - DNA, 140 bp, Artificial Sequence
  Synthetic
atacgccatgctgggtctcctgccacagcacacaaattggagggataaggatggtagacattcttcggcaaaatccaacagaggaacaagccgtggacatatgcaaggcagcaatgggctcgtacttgggagtcggccat

SEQ ID NO: 419752 - DNA, 140 bp, Artificial Sequence
  Synthetic
atggccgactcccaagtacgagcccattgctgccttgcatatgtccacggcttgttcctctgttggattttgccgaagaatgtctaccatccttatccctccaatttgtgtgctgtggcaggagacccagcatggcgtat

SEQ ID NO: 419753 - DNA, 140 bp, Artificial Sequence
  Synthetic
atacgccatgctgggtctccgggcaattctccagtgttcaattacaataaggccaccaagaggcttacagttctcggaaaagatgcaggtgcattgaccgaagatccagatgaaggcacgcgtacttgggagtcggccat

SEQ ID NO: 419754 - DNA, 140 bp, Artificial Sequence
  Synthetic
atggccgactcccaagtacgcgtgccttcatctggatcttcggtcaatgcacctgcatcttttccgagaactgtaagcctcttggtggccttattgtaattgaacactggagaattgcccggagacccagcatggcgtat

SEQ ID NO: 419755 - DNA, 140 bp, Artificial Sequence
  Synthetic
atacgccatgctgggtctccgccatgatgggatgggatggctaacaatcgggatctctggtccagataatggagcagtagctgttttaaaatacaacggtataataacagatacaataaacgtacttgggagtcggccat

SEQ ID NO: 419756 - DNA, 140 bp, Artificial Sequence
  Synthetic
atggccgactcccaagtacgtttattgtatctgttattataccgttgtattttaaaacagctactgctccattatctggaccagagatcccgattgttagccatcccatcccatcatggcggagacccagcatggcgtat

SEQ ID NO: 419757 - DNA, 140 bp, Artificial Sequence
  Synthetic
aggccctggctgctgatatgggactaatctatggcaacccgtcttgtgatctaccgctggaagggagagagtggtcctacattgtcgaaagaccatcagctgttaatggagtgtgctaccgaccttttgggacagcggtg

SEQ ID NO: 419758 - DNA, 140 bp, Artificial Sequence
  Synthetic
caccgctgtcccaaaaggtcggtagcacactccattaacagctgatggtctttcgacaatgtaggaccactctctcccttccagcggtagatcacaagacgggttgccatagattagtcccatatcagcagccagggcct

SEQ ID NO: 419759 - DNA, 140 bp, Artificial Sequence
  Synthetic
atacgccatgctgggtctccaagttggagaaacaaaatattaagaacacaagagtcggaatgtgtttgtatgaacggttcttgttttactgtattaactgatggcccaagcaatgggcaacgtacttgggagtcggccat

SEQ ID NO: 419760 - DNA, 140 bp, Artificial Sequence
  Synthetic
atggccgactcccaagtacgttgcccattgcttgggccatcagttaatacagtaaaacaagaaccgttcatacaaacacattccgactcttgtgttcttaatattttgtttctccaacttggagacccagcatggcgtat

SEQ ID NO: 419761 - DNA, 140 bp, Artificial Sequence
  Synthetic
atacgccatgctgggtctcctcctgaaagaaacgaacacgggcaaatactttggagtaagacaaatgatgctggatcagatagggtgatggtgtcacctctagccgtaacttggtggaatcgtacttgggagtcggccat

SEQ ID NO: 419762 - DNA, 140 bp, Artificial Sequence
  Synthetic
atggccgactcccaagtacgattccaccaagttacggctagaggtgacaccatcaccctatctgatccagcatcatttgtcttactccaaagtatttgcccgtgttcgtttctttcaggaggagacccagcatggcgtat

SEQ ID NO: 419763 - DNA, 140 bp, Artificial Sequence
  Synthetic
atacgccatgctgggtctccgcctcgtacaaaatatttaaagtggaaaaaggaaaaataattaagtcaattgagctggatgcccccaattaccactatgaggaatgctcatgttatcctgcgtacttgggagtcggccat

SEQ ID NO: 419764 - DNA, 140 bp, Artificial Sequence
  Synthetic
atggccgactcccaagtacgcaggataacatgagcattcctcatagtggtaattgggggcatccagctcaattgacttaattatttttcctttttccactttaaatattttgtacgaggcggagacccagcatggcgtat

SEQ ID NO: 419765 - DNA, 140 bp, Artificial Sequence
  Synthetic
atacgccatgctgggtctcctaattcctcagaaaatggctggtcagtacagtggatttgcaagagcagtgctcaaacaaatgagagaccaggaggttatgaaaactgaccagttcataaacgtacttgggagtcggccat

SEQ ID NO: 419766 - DNA, 140 bp, Artificial Sequence
  Synthetic
atggccgactcccaagtacgtttatgaactggtcagttttcataacctcctggtctctcatttgtttgagcactgctcttgcaaatccactgtactgaccagccattttctgaggaattaggagacccagcatggcgtat

SEQ ID NO: 419767 - DNA, 140 bp, Artificial Sequence
  Synthetic
atacgccatgctgggtctccatacaggcaaagtaatgtgtgtttgcagagacaattggcatgcctcgaaccggccatgggtctctttcaatcagaatcttgactatcaaataggatacatcgtacttgggagtcggccat

SEQ ID NO: 419768 - DNA, 140 bp, Artificial Sequence
  Synthetic
atggccgactcccaagtacgatgtatcctatttgatagtcaagattctgattgaaagagacccatggccggttcgaggcatgccaattgtctctgcaaacacacattactttgcctgtatggagacccagcatggcgtat

SEQ ID NO: 419769 - DNA, 140 bp, Artificial Sequence
  Synthetic
atacgccatgctgggtctccattgtggcccagtactttctaatggagcaaatggagtgaaaggattctcatatagatatggtaatggtgtttggataggaagaaccaagagtatcaactccgtacttgggagtcggccat

SEQ ID NO: 419770 - DNA, 140 bp, Artificial Sequence
  Synthetic
atggccgactcccaagtacggagttgatactcttggttcttcctatccaaacaccattaccatatctatatgagaatcctttcactccatttgctccattagaaagtactgggccacaatggagacccagcatggcgtat

SEQ ID NO: 419771 - DNA, 140 bp, Artificial Sequence
  Synthetic
atacgccatgctgggtctcctttcgagcaaataacattcatgcaagcattacaactattgcttgaagtggagcaagagataaggactttctcgtttcagcttatttaatgataaaaaacacgtacttgggagtcggccat

SEQ ID NO: 419772 - DNA, 140 bp, Artificial Sequence
  Synthetic
atggccgactcccaagtacgtgttttttatcattaaataagctgaaacgagaaagtccttatctcttgctccacttcaagcaatagttgtaatgcttgcatgaatgttatttgctcgaaaggagacccagcatggcgtat

SEQ ID NO: 419773 - DNA, 140 bp, Artificial Sequence
  Synthetic
atacgccatgctgggtctcccataaggccttgtttctgggtggaattaatcagagggcaacccaaggaaagcacaatctgggctagcggaagcagcatctctttctgtggcgtaaatggtcgtacttgggagtcggccat

SEQ ID NO: 419774 - DNA, 140 bp, Artificial Sequence
  Synthetic
atggccgactcccaagtacgaccatttacgccacagaaagagatgctgcttccgctagcccagattgtgctttccttgggttgccctctgattaattccacccagaaacaaggccttatgggagacccagcatggcgtat

SEQ ID NO: 419775 - DNA, 140 bp, Artificial Sequence
  Synthetic
atacgccatgctgggtctcccatgtttttgtcataagggaaccatttgtttcttgctctccaacagagtgcaggacgttcttccttactcaaggttccctactcaatgacaaacattctacgtacttgggagtcggccat

SEQ ID NO: 419776 - DNA, 140 bp, Artificial Sequence
  Synthetic
atggccgactcccaagtacgtagaatgtttgtcattgagtagggaaccttgagtaaggaagaacgtcctgcactctgttggagagcaagaaacaaatggttcccttatgacaaaaacatgggagacccagcatggcgtat

SEQ ID NO: 419777 - DNA, 140 bp, Artificial Sequence
  Synthetic
aggccctggctgctgatatgggctagcggaagcagcatctctttctgtggcgtaaatggtgaaaccgcaagctggtcatggccagacggagctgatctgccattcaccattgacaagtaggaccttttgggacagcggtg

SEQ ID NO: 419778 - DNA, 140 bp, Artificial Sequence
  Synthetic
caccgctgtcccaaaaggtcctacttgtcaatggtgaatggcagatcagctccgtctggccatgaccagcttgcggtttcaccatttacgccacagaaagagatgctgcttccgctagcccatatcagcagccagggcct

SEQ ID NO: 419779 - DNA, 140 bp, Artificial Sequence
  Synthetic
aggccctggctgctgatatggaaatgtcctaagcattgcccctataatgttctcaaacaagatggcgagattagggaaaggatacatgttcgaaagtaaaagcatgaaattacggacacagaccttttgggacagcggtg

SEQ ID NO: 419780 - DNA, 140 bp, Artificial Sequence
  Synthetic
caccgctgtcccaaaaggtctgtgtccgtaatttcatgcttttactttcgaacatgtatcctttccctaatctcgccatcttgtttgagaacattataggggcaatgcttaggacatttccatatcagcagccagggcct

SEQ ID NO: 419781 - DNA, 140 bp, Artificial Sequence
  Synthetic
aggccctggctgctgatatgaatgaggagaaaattccaaaaacaaagaacatgaagaagacaagccaattgaagtgggcacttggtgagaacatggcaccagagaaagtggactttgaaggaccttttgggacagcggtg

SEQ ID NO: 419782 - DNA, 140 bp, Artificial Sequence
  Synthetic
caccgctgtcccaaaaggtccttcaaagtccactttctctggtgccatgttctcaccaagtgcccacttcaattggcttgtcttcttcatgttctttgtttttggaattttctcctcattcatatcagcagccagggcct

SEQ ID NO: 419783 - DNA, 140 bp, Artificial Sequence
  Synthetic
aggccctggctgctgatatgatcatgcacctgcattcaaggtgaatgttattgggtaatgacggatggaccagcaaacaggcaagcacaatatagagcattcaaagctaaacaggggaaggaccttttgggacagcggtg

SEQ ID NO: 419784 - DNA, 140 bp, Artificial Sequence
  Synthetic
caccgctgtcccaaaaggtccttcccctgtttagctttgaatgctctatattgtgcttgcctgtttgctggtccatccgtcattacccaataacattcaccttgaatgcaggtgcatgatcatatcagcagccagggcct

SEQ ID NO: 419785 - DNA, 140 bp, Artificial Sequence
  Synthetic
atacgccatgctgggtctccggatacaaaatgaacactcaaattttggcactcattgcttgtatgctgattggagctagaggagacaaaatatgtctcgggcaccacgctgtggcaaatgcgtacttgggagtcggccat

SEQ ID NO: 419786 - DNA, 140 bp, Artificial Sequence
  Synthetic
atggccgactcccaagtacgcatttgccacagcgtggtgcccgagacatattttgtctcctctagctccaatcagcatacaagcaatgagtgccaaaatttgagtgttcattttgtatccggagacccagcatggcgtat

SEQ ID NO: 419787 - DNA, 140 bp, Artificial Sequence
  Synthetic
aggccctggctgctgatatgttacagtggaacaagcaaagcatgttcagattcattctacagaagcatgaggtggttgactcaaaagaacaacaattaccctgttcaagacgcccaatacgaccttttgggacagcggtg

SEQ ID NO: 419788 - DNA, 140 bp, Artificial Sequence
  Synthetic
caccgctgtcccaaaaggtcgtattgggcgtcttgaacagggtaattgttgttcttttgagtcaaccacctcatgcttctgtagaatgaatctgaacatgctttgcttgttccactgtaacatatcagcagccagggcct

SEQ ID NO: 419789 - DNA, 140 bp, Artificial Sequence
  Synthetic
aggccctggctgctgatatgtctggctcttggccaagattactcagagaacaacaacagcactgcaacactgtgcttggggcatcatgcagtaccgaatgggacaatagtgaagacaatagaccttttgggacagcggtg

SEQ ID NO: 419790 - DNA, 140 bp, Artificial Sequence
  Synthetic
caccgctgtcccaaaaggtctattgtcttcactattgtcccattcggtactgcatgatgccccaagcacagtgttgcagtgctgttgttgttctctgagtaatcttggccaagagccagacatatcagcagccagggcct

SEQ ID NO: 419791 - DNA, 140 bp, Artificial Sequence
  Synthetic
atacgccatgctgggtctccatcactgaggcagatccttcgagggtcaggaggaattgataaggagtcaatgggtttcacctatagtggaataagaaccaatggggcgacaagtgcttgccgtacttgggagtcggccat

SEQ ID NO: 419792 - DNA, 140 bp, Artificial Sequence
  Synthetic
atggccgactcccaagtacggcaagcacttgtcgccccattggttcttattccactataggtgaaacccattgactccttatcaattcctcctgaccctcgaaggatctgcctcagtgatggagacccagcatggcgtat

SEQ ID NO: 419793 - DNA, 140 bp, Artificial Sequence
  Synthetic
atacgccatgctgggtctccggtggttgactcaaaagaacaacaattaccctgttcaagacgcccaatacacaaataatagaggaaagaacatccttttcatgtggggcataaatcaccccgtacttgggagtcggccat

SEQ ID NO: 419794 - DNA, 140 bp, Artificial Sequence
  Synthetic
atggccgactcccaagtacggggtgatttatgccccacatgaaaaggatgttctttcctctattatttgtgtattgggcgtcttgaacagggtaattgttgttcttttgagtcaaccaccggagacccagcatggcgtat

SEQ ID NO: 419795 - DNA, 140 bp, Artificial Sequence
  Synthetic
atacgccatgctgggtctccttcagacaatgcggcttttccccaaatgactaagtcgtacagaaatcccaggaacaaaccagctctgataatttggggagtgcatcactctggatcggctcgtacttgggagtcggccat

SEQ ID NO: 419796 - DNA, 140 bp, Artificial Sequence
  Synthetic
atggccgactcccaagtacgagccgatccagagtgatgcactccccaaattatcagagctggtttgttcctgggatttctgtacgacttagtcatttggggaaaagccgcattgtctgaaggagacccagcatggcgtat

SEQ ID NO: 419797 - DNA, 140 bp, Artificial Sequence
  Synthetic
atacgccatgctgggtctccgagtgcatcactcctaatggaagcatccccaatgacaggccttttcaaaatgtaaacaagatcacttacggagcatgtcctaagtatgtcaaacagagcacgtacttgggagtcggccat

SEQ ID NO: 419798 - DNA, 140 bp, Artificial Sequence
  Synthetic
atggccgactcccaagtacgtgctctgtttgacatacttaggacatgctccgtaagtgatcttgtttacattttgaaaaggcctgtcattggggatgcttccattaggagtgatgcactcggagacccagcatggcgtat

SEQ ID NO: 419799 - DNA, 140 bp, Artificial Sequence
  Synthetic
aggccctggctgctgatatgagcgaaagcaggagtttaaaatgaatccaaatcagaaaataataaccattgggtcggtatccctaggattggtagtccttaatattctcctacatatagcgaccttttgggacagcggtg

SEQ ID NO: 419800 - DNA, 140 bp, Artificial Sequence
  Synthetic
caccgctgtcccaaaaggtcgctatatgtaggagaatattaaggactaccaatcctagggataccgacccaatggttattattttctgatttggattcattttaaactcctgctttcgctcatatcagcagccagggcct

SEQ ID NO: 419801 - DNA, 140 bp, Artificial Sequence
  Synthetic
aggccctggctgctgatatgagaacgccagaatgccactgagatcagagcatctgttggaaggatggttggcggaattgggaggttctacatacagatgtgcactgaactcaaactcagcgaccttttgggacagcggtg

SEQ ID NO: 419802 - DNA, 140 bp, Artificial Sequence
  Synthetic
caccgctgtcccaaaaggtcgctgagtttgagttcagtgcacatctgtatgtagaacctcccaattccgccaaccatccttccaacagatgctctgatctcagtggcattctggcgttctcatatcagcagccagggcct

SEQ ID NO: 419803 - DNA, 140 bp, Artificial Sequence
  Synthetic
atacgccatgctgggtctccatggaagactttgtgcgacaatgcttcaatccaatgattgtcgagcttgcggaaaaggcaatgaaagaatatggggaagatccgaaaatcgaaacgaacacgtacttgggagtcggccat

SEQ ID NO: 419804 - DNA, 140 bp, Artificial Sequence
  Synthetic
atggccgactcccaagtacgtgttcgtttcgattttcggatcttccccatattctttcattgccttttccgcaagctcgacaatcattggattgaagcattgtcgcacaaagtcttccatggagacccagcatggcgtat

SEQ ID NO: 419805 - DNA, 140 bp, Artificial Sequence
  Synthetic
atacgccatgctgggtctccgggtcggtatccctaggattggtagtccttaatattctcctacatatagctagcatcacaataacagtgttggttctccctggaaatgtgaataatgggacgtacttgggagtcggccat

SEQ ID NO: 419806 - DNA, 140 bp, Artificial Sequence
  Synthetic
atggccgactcccaagtacgtcccattattcacatttccagggagaaccaacactgttattgtgatgctagctatatgtaggagaatattaaggactaccaatcctagggataccgacccggagacccagcatggcgtat

SEQ ID NO: 419807 - DNA, 140 bp, Artificial Sequence
  Synthetic
atacgccatgctgggtctccggagtagatgaatactccagtacagagagggtagtagtgagcatcgaccgatttttaagagttcgggaccaacgggggaatatactgttgtcacccgaagcgtacttgggagtcggccat

SEQ ID NO: 419808 - DNA, 140 bp, Artificial Sequence
  Synthetic
atggccgactcccaagtacgcttcgggtgacaacagtatattcccccgttggtcccgaactcttaaaaatcggtcgatgctcactactaccctctctgtactggagtattcatctactccggagacccagcatggcgtat

SEQ ID NO: 419809 - DNA, 140 bp, Artificial Sequence
  Synthetic
atacgccatgctgggtctccagcgaaagcaggagttcaaaatgaatccaaatcaaaagataataaccattgggtcaatctgcatggtaattggaataataagtctggtgctacaaattggcgtacttgggagtcggccat

SEQ ID NO: 419810 - DNA, 140 bp, Artificial Sequence
  Synthetic
atggccgactcccaagtacgccaatttgtagcaccagacttattattccaattaccatgcagattgacccaatggttattatcttttgatttggattcattttgaactcctgctttcgctggagacccagcatggcgtat

SEQ ID NO: 419811 - DNA, 140 bp, Artificial Sequence
  Synthetic
aggccctggctgctgatatgaagaacaatatgataaacaatgatcttggaccagcaacagctcaaatggctcttcagttattcatcaaggactacagatacacatatcgatgccacaggggaccttttgggacagcggtg

SEQ ID NO: 419812 - DNA, 140 bp, Artificial Sequence
  Synthetic
caccgctgtcccaaaaggtcccctgtggcatcgatatgtgtatctgtagtccttgatgaataactgaagagccatttgagctgttgctggtccaagatcattgtttatcatattgttcttcatatcagcagccagggcct

SEQ ID NO: 419813 - DNA, 140 bp, Artificial Sequence
  Synthetic
aggccctggctgctgatatgaagtgcttgtcatgatggcattagttggttaacaatcggaatttctggcccagacaatgaggctgttgctgtattgaaatacaatggtataataacagacgaccttttgggacagcggtg

SEQ ID NO: 419814 - DNA, 140 bp, Artificial Sequence
  Synthetic
caccgctgtcccaaaaggtcgtctgttattataccattgtatttcaatacagcaacagcctcattgtctgggccagaaattccgattgttaaccaactaatgccatcatgacaagcacttcatatcagcagccagggcct

SEQ ID NO: 419815 - DNA, 140 bp, Artificial Sequence
  Synthetic
aggccctggctgctgatatgatttttaagagttcgggaccaacgggggaatatactgttgtcacccgaagaagtcagcgagacacaaggaacagagaaattgacaatcacttattcgtcagaccttttgggacagcggtg

SEQ ID NO: 419816 - DNA, 140 bp, Artificial Sequence
  Synthetic
caccgctgtcccaaaaggtctgacgaataagtgattgtcaatttctctgttccttgtgtctcgctgacttcttcgggtgacaacagtatattcccccgttggtcccgaactcttaaaaatcatatcagcagccagggcct

SEQ ID NO: 419817 - DNA, 140 bp, Artificial Sequence
  Synthetic
aggccctggctgctgatatgggcactcaaaatgactattgcctctgtgcctgcttcacgctacctaactgacatgactcttgaagagatgtcaagagactggttcatgctcatgcccaaggaccttttgggacagcggtg

SEQ ID NO: 419818 - DNA, 140 bp, Artificial Sequence
  Synthetic
caccgctgtcccaaaaggtccttgggcatgagcatgaaccagtctcttgacatctcttcaagagtcatgtcagttaggtagcgtgaagcaggcacagaggcaatagtcattttgagtgcccatatcagcagccagggcct

SEQ ID NO: 419819 - DNA, 140 bp, Artificial Sequence
  Synthetic
atacgccatgctgggtctcccaaaaagtggcaggctccctctgtatcagaatggaccaggcgattatggataagaacatcacattgaaagcaaacttcagtgtgatcttcgataggctggcgtacttgggagtcggccat

SEQ ID NO: 419820 - DNA, 140 bp, Artificial Sequence
  Synthetic
atggccgactcccaagtacgccagcctatcgaagatcacactgaagtttgctttcaatgtgatgttcttatccataatcgcctggtccattctgatacagagggagcctgccactttttgggagacccagcatggcgtat

SEQ ID NO: 419821 - DNA, 140 bp, Artificial Sequence
  Synthetic
aggccctggctgctgatatgttcatacccaaagatcaacaaatcctacactaacaataaagagaaggaagttctcgtgctatgggccattcaccatccatctaccagtgccgaccaacaagaccttttgggacagcggtg

SEQ ID NO: 419822 - DNA, 140 bp, Artificial Sequence
  Synthetic
caccgctgtcccaaaaggtcttgttggtcggcactggtagatggatggtgaatggcccatagcacgagaacttccttctctttattgttagtgtaggatttgttgatctttgggtatgaacatatcagcagccagggcct

SEQ ID NO: 419823 - DNA, 140 bp, Artificial Sequence
  Synthetic
aggccctggctgctgatatgccctttttccaaggacaactctattcgactttctgctggtggggacatttgggtaacaagagaaccttatgtgtcatgtgataccagtaagtgttaccaagaccttttgggacagcggtg

SEQ ID NO: 419824 - DNA, 140 bp, Artificial Sequence
  Synthetic
caccgctgtcccaaaaggtcttggtaacacttactggtatcacatgacacataaggttctcttgttacccaaatgtccccaccagcagaaagtcgaatagagttgtccttggaaaaagggcatatcagcagccagggcct

SEQ ID NO: 419825 - DNA, 140 bp, Artificial Sequence
  Synthetic
atacgccatgctgggtctcccagcaggaagttcgagccagaaatagcaacaagacctaaggtgagagaccaagcagggagaatgaactattactggacactagtagagcctggagacaagcgtacttgggagtcggccat

SEQ ID NO: 419826 - DNA, 140 bp, Artificial Sequence
  Synthetic
atggccgactcccaagtacgcttgtctccaggctctactagtgtccagtaatagttcattctccctgcttggtctctcaccttaggtcttgttgctatttctggctcgaacttcctgctgggagacccagcatggcgtat

SEQ ID NO: 419827 - DNA, 140 bp, Artificial Sequence
  Synthetic
aggccctggctgctgatatgaagcagggagaatgaactattactggacactagtagagcctggagacaagataacattcgaagcaactggaaatctagtggcaccgagatatgccttcgcgaccttttgggacagcggtg

SEQ ID NO: 419828 - DNA, 140 bp, Artificial Sequence
  Synthetic
caccgctgtcccaaaaggtcgcgaaggcatatctcggtgccactagatttccagttgcttcgaatgttatcttgtctccaggctctactagtgtccagtaatagttcattctccctgcttcatatcagcagccagggcct

SEQ ID NO: 419829 - DNA, 140 bp, Artificial Sequence
  Synthetic
atacgccatgctgggtctccacgattgtgatacgacttgtcagacacccaatggtgctataaacaccagcctcccatttcaaaatatacatccagtcacaattggagaatgtccaaagtacgtacttgggagtcggccat

SEQ ID NO: 419830 - DNA, 140 bp, Artificial Sequence
  Synthetic
atggccgactcccaagtacgtactttggacattctccaattgtgactggatgtatattttgaaatgggaggctggtgtttatagcaccattgggtgtctgacaagtcgtatcacaatcgtggagacccagcatggcgtat

SEQ ID NO: 419831 - DNA, 140 bp, Artificial Sequence
  Synthetic
atacgccatgctgggtctccaatcaatgcagcaaatggaagcaattgttgaacaagaatcatcgatacaaggatatgacatgaccaaagcttgtttcaagggagacagagtaaatagccccgtacttgggagtcggccat

SEQ ID NO: 419832 - DNA, 140 bp, Artificial Sequence
  Synthetic
atggccgactcccaagtacggggctatttactctgtctcccttgaaacaagctttggtcatgtcatatccttgtatcgatgattcttgttcaacaattgcttccatttgctgcattgattggagacccagcatggcgtat

SEQ ID NO: 419833 - DNA, 140 bp, Artificial Sequence
  Synthetic
aggccctggctgctgatatggcagggatcaggatatgcagccgacctgaagagcacacagaacgccattgacgggatcactaacaaggtaaactctgttattgaaaagatgaacacacaagaccttttgggacagcggtg

SEQ ID NO: 419834 - DNA, 140 bp, Artificial Sequence
  Synthetic
caccgctgtcccaaaaggtcttgtgtgttcatcttttcaataacagagtttaccttgttagtgatcccgtcaatggcgttctgtgtgctcttcaggtcggctgcatatcctgatccctgccatatcagcagccagggcct

SEQ ID NO: 419835 - DNA, 140 bp, Artificial Sequence
  Synthetic
aggccctggctgctgatatggcatctgcaggacaaatcagtgtacagcccactttctcagtacagagaaatcttcccttcgaaagagcgaccattatggcagcgttcaaagggaatactggaccttttgggacagcggtg

SEQ ID NO: 419836 - DNA, 140 bp, Artificial Sequence
  Synthetic
caccgctgtcccaaaaggtccagtattccctttgaacgctgccataatggtcgctctttcgaagggaagatttctctgtactgagaaagtgggctgtacactgatttgtcctgcagatgccatatcagcagccagggcct

SEQ ID NO: 419837 - DNA, 140 bp, Artificial Sequence
  Synthetic
aggccctggctgctgatatgtggagagggctaacccagccaacgacctctgttacccagggaccctcaatgactatgaggaactgaaacacctattgagcagaataaatcattttgagaagaccttttgggacagcggtg

SEQ ID NO: 419838 - DNA, 140 bp, Artificial Sequence
  Synthetic
caccgctgtcccaaaaggtcttctcaaaatgatttattctgctcaataggtgtttcagttcctcatagtcattgagggtccctgggtaacagaggtcgttggctgggttagccctctccacatatcagcagccagggcct

SEQ ID NO: 419839 - DNA, 140 bp, Artificial Sequence
  Synthetic
aggccctggctgctgatatgtgccaaggaaattggaaatggctgctttgaattttaccacaaatgtgatgacatgtgcatggaaagcgtcaaaaatggaacttatgattaccctaaatacgaccttttgggacagcggtg

SEQ ID NO: 419840 - DNA, 140 bp, Artificial Sequence
  Synthetic
caccgctgtcccaaaaggtcgtatttagggtaatcataagttccatttttgacgctttccatgcacatgtcatcacatttgtggtaaaattcaaagcagccatttccaatttccttggcacatatcagcagccagggcct

SEQ ID NO: 419841 - DNA, 140 bp, Artificial Sequence
  Synthetic
atacgccatgctgggtctccaagaggtggtttgaacactacattgccatttcacaacgtgagcaagtacgcattcggaaattgcccaaagtatattggagtaaatagtctcaaactggcacgtacttgggagtcggccat

SEQ ID NO: 419842 - DNA, 140 bp, Artificial Sequence
  Synthetic
atggccgactcccaagtacgtgccagtttgagactatttactccaatatactttgggcaatttccgaatgcgtacttgctcacgttgtgaaatggcaatgtagtgttcaaaccacctcttggagacccagcatggcgtat

SEQ ID NO: 419843 - DNA, 140 bp, Artificial Sequence
  Synthetic
aggccctggctgctgatatgcattggtactggtagtctccctgggggcaatcagtttctggatgtgctctaatgggtcgctacagtgcagaatatgtatttaacattaggatttcagaaagaccttttgggacagcggtg

SEQ ID NO: 419844 - DNA, 140 bp, Artificial Sequence
  Synthetic
caccgctgtcccaaaaggtctttctgaaatcctaatgttaaatacatattctgcactgtagcgacccattagagcacatccagaaactgattgcccccagggagactaccagtaccaatgcatatcagcagccagggcct

SEQ ID NO: 419845 - DNA, 140 bp, Artificial Sequence
  Synthetic
atacgccatgctgggtctccagcgaaagcagggtgacaaagacataatggactccaatactgtgtcaagctttcaggtagactgtttcctttggcacatccgcaaacggtttgcagacaacgtacttgggagtcggccat

SEQ ID NO: 419846 - DNA, 140 bp, Artificial Sequence
  Synthetic
atggccgactcccaagtacgttgtctgcaaaccgtttgcggatgtgccaaaggaaacagtctacctgaaagcttgacacagtattggagtccattatgtctttgtcaccctgctttcgctggagacccagcatggcgtat

SEQ ID NO: 419847 - DNA, 140 bp, Artificial Sequence
  Synthetic
aggccctggctgctgatatgcaatgagtcagctgacatgagcatcggtgttacagtgataaagaacaatatgataaacaatgaccttggaccagcaacagctcagatggctctccagctagaccttttgggacagcggtg

SEQ ID NO: 419848 - DNA, 140 bp, Artificial Sequence
  Synthetic
caccgctgtcccaaaaggtctagctggagagccatctgagctgttgctggtccaaggtcattgtttatcatattgttctttatcactgtaacaccgatgctcatgtcagctgactcattgcatatcagcagccagggcct

SEQ ID NO: 419849 - DNA, 140 bp, Artificial Sequence
  Synthetic
aggccctggctgctgatatgttttcccaaatgaagtgggagcgaggatactaacatcggagtcacaactggcgataacaaaagaaaagaaggaagaacttcaggactgcaagattgccccgaccttttgggacagcggtg

SEQ ID NO: 419850 - DNA, 140 bp, Artificial Sequence
  Synthetic
caccgctgtcccaaaaggtcggggcaatcttgcagtcctgaagttcttccttcttttcttttgttatcgccagttgtgactccgatgttagtatcctcgctcccacttcatttgggaaaacatatcagcagccagggcct

SEQ ID NO: 419851 - DNA, 140 bp, Artificial Sequence
  Synthetic
aggccctggctgctgatatgcttgttgggaaacaaattgtggagtggattttaaaagaggaatccagcgagacacttaagatgaccattgcatctatacctacctcgcgctatctagctggaccttttgggacagcggtg

SEQ ID NO: 419852 - DNA, 140 bp, Artificial Sequence
  Synthetic
caccgctgtcccaaaaggtccagctagatagcgcgaggtaggtatagatgcaatggtcatcttaagtgtctcgctggattcctcttttaaaatccactccacaatttgtttcccaacaagcatatcagcagccagggcct

SEQ ID NO: 419853 - DNA, 140 bp, Artificial Sequence
  Synthetic
aggccctggctgctgatatgtcctcccagtggcgggtgggacaagcagtgtctacattgaggtgctgcatttaacccaggggacatgctgggagcaaatgtacaccccaggaggggaagtgaccttttgggacagcggtg

SEQ ID NO: 419854 - DNA, 140 bp, Artificial Sequence
  Synthetic
caccgctgtcccaaaaggtcacttcccctcctggggtgtacatttgctcccagcatgtcccctgggttaaatgcagcacctcaatgtagacactgcttgtcccacccgccactgggaggacatatcagcagccagggcct

SEQ ID NO: 419855 - DNA, 140 bp, Artificial Sequence
  Synthetic
atacgccatgctgggtctcccaaaagataataggccctctttgtgttcgaatagaccaggcgatcattgaaaagaacatcatactgaaagcgaacttcagtgtgatctttaaccgattagcgtacttgggagtcggccat

SEQ ID NO: 419856 - DNA, 140 bp, Artificial Sequence
  Synthetic
atggccgactcccaagtacgctaatcggttaaagatcacactgaagttcgctttcagtatgatgttcttttcaatgatcgcctggtctattcgaacacaaagagggcctattatcttttgggagacccagcatggcgtat

SEQ ID NO: 419857 - DNA, 140 bp, Artificial Sequence
  Synthetic
aggccctggctgctgatatgacgtggtgttggtaatgaaacgaaaacgggactctagtatacttactgacagccagacagcgaccaaaagaattcggatggccatcaattaatactgaatgaccttttgggacagcggtg

SEQ ID NO: 419858 - DNA, 140 bp, Artificial Sequence
  Synthetic
caccgctgtcccaaaaggtcattcagtattaattgatggccatccgaattcttttggtcgctgtctggctgtcagtaagtatactagagtcccgttttcgtttcattaccaacaccacgtcatatcagcagccagggcct

SEQ ID NO: 419859 - DNA, 140 bp, Artificial Sequence
  Synthetic
atacgccatgctgggtctcctagaaatgcaactgctagttttatttatgatggggtacttgttgacagtatcggttcatggtctcagaatatcctcagaactcaggagtcagagtgcgttcgtacttgggagtcggccat

SEQ ID NO: 419860 - DNA, 140 bp, Artificial Sequence
  Synthetic
atggccgactcccaagtacgaacgcactctgactcctgagttctgaggatattctgagaccatgaaccgatactgtcaacaagtaccccatcataaataaaactagcagttgcatttctaggagacccagcatggcgtat

SEQ ID NO: 419861 - DNA, 140 bp, Artificial Sequence
  Synthetic
aggccctggctgctgatatgatgaatacaaatcaaagaataataaccattgggacagtttgtatgatagttggtataatcagtttattgttacagataggaaacatagtctcgttatggagaccttttgggacagcggtg

SEQ ID NO: 419862 - DNA, 140 bp, Artificial Sequence
  Synthetic
caccgctgtcccaaaaggtctccataacgagactatgtttcctatctgtaacaataaactgattataccaactatcatacaaactgtcccaatggttattattctttgatttgtattcatcatatcagcagccagggcct

SEQ ID NO: 419863 - DNA, 140 bp, Artificial Sequence
  Synthetic
atacgccatgctgggtctccatggatgtcaacccgactttacttttcttgaaagtgccagtgcaaaatgccataagtaccacgttcccttatactggagaccctccatacagccatggaacgtacttgggagtcggccat

SEQ ID NO: 419864 - DNA, 140 bp, Artificial Sequence
  Synthetic
atggccgactcccaagtacgttccatggctgtatggagggtctccagtataagggaacgtggtacttatggcattttgcactggcactttcaagaaaagtaaagtcgggttgacatccatggagacccagcatggcgtat

SEQ ID NO: 419865 - DNA, 140 bp, Artificial Sequence
  Synthetic
aggccctggctgctgatatgcaaaagaagtaaacgctaggattgagccattcctgaaaacaacaccacgccctctcaaattgcctgaggggcccccttgctcccagcggtcaaaattcttgaccttttgggacagcggtg

SEQ ID NO: 419866 - DNA, 140 bp, Artificial Sequence
  Synthetic
caccgctgtcccaaaaggtcaagaattttgaccgctgggagcaagggggcccctcaggcaatttgagagggcgtggtgttgttttcaggaatggctcaatcctagcgtttacttcttttgcatatcagcagccagggcct

SEQ ID NO: 419867 - DNA, 140 bp, Artificial Sequence
  Synthetic
aggccctggctgctgatatggcaaattgaaaaggcgggcaattgcaacacccggaatgcagatcaggggatttgtgtactttgttgagacattagcgaggagcatctgtgagaaacttgagaccttttgggacagcggtg

SEQ ID NO: 419868 - DNA, 140 bp, Artificial Sequence
  Synthetic
caccgctgtcccaaaaggtctcaagtttctcacagatgctcctcgctaatgtctcaacaaagtacacaaatcccctgatctgcattccgggtgttgcaattgcccgccttttcaatttgccatatcagcagccagggcct

SEQ ID NO: 419869 - DNA, 140 bp, Artificial Sequence
  Synthetic
aggccctggctgctgatatgatttttaagagtccgggaccagcggggaaatgtgttattgtcgcctgaagaggtcagcgagacacaagggacagagaagctgacaataacttattcgtcagaccttttgggacagcggtg

SEQ ID NO: 419870 - DNA, 140 bp, Artificial Sequence
  Synthetic
caccgctgtcccaaaaggtctgacgaataagttattgtcagcttctctgtcccttgtgtctcgctgacctcttcaggcgacaataacacatttccccgctggtcccggactcttaaaaatcatatcagcagccagggcct

SEQ ID NO: 419871 - DNA, 140 bp, Artificial Sequence
  Synthetic
aggccctggctgctgatatggttcaaaggcgggactgctggtttcagatgggggaccaaacctatacaacatccggaatctccacattccggaggtctgcttgaagtgggaactaatggagaccttttgggacagcggtg

SEQ ID NO: 419872 - DNA, 140 bp, Artificial Sequence
  Synthetic
caccgctgtcccaaaaggtctccattagttcccacttcaagcagacctccggaatgtggagattccggatgttgtataggtttggtcccccatctgaaaccagcagtcccgcctttgaaccatatcagcagccagggcct

SEQ ID NO: 419873 - DNA, 140 bp, Artificial Sequence
  Synthetic
aggccctggctgctgatatgaaaaagagcaacggccatcttaaggaaagcaaccagaaggttgattcagctgatagtaagtggaagagacgaacagtcaattgctgaagcaatcatagttgaccttttgggacagcggtg

SEQ ID NO: 419874 - DNA, 140 bp, Artificial Sequence
  Synthetic
caccgctgtcccaaaaggtcaactatgattgcttcagcaattgactgttcgtctcttccacttactatcagctgaatcaaccttctggttgctttccttaagatggccgttgctctttttcatatcagcagccagggcct

SEQ ID NO: 419875 - DNA, 140 bp, Artificial Sequence
  Synthetic
aggccctggctgctgatatgggctgggcctttgatgatggagatgacgtgtggatgggaagaacgatcaacgagaagttacgcttaggctatgaaaccttcaaagtcatcaaagggtggtgaccttttgggacagcggtg

SEQ ID NO: 419876 - DNA, 140 bp, Artificial Sequence
  Synthetic
caccgctgtcccaaaaggtcaccaccctttgatgactttgaaggtttcatagcctaagcgtaacttctcgttgatcgttcttcccatccacacgtcatctccatcatcaaaggcccagcccatatcagcagccagggcct

SEQ ID NO: 419877 - DNA, 140 bp, Artificial Sequence
  Synthetic
aggccctggctgctgatatgatgttgtgaggaagatgatgactaattcacaagatacagagctctccttcacaattactggagacaacaccaaatggaatgagaatcaaaacccccggatgaccttttgggacagcggtg

SEQ ID NO: 419878 - DNA, 140 bp, Artificial Sequence
  Synthetic
caccgctgtcccaaaaggtcatccgggggttttgattctcattccatttggtgttgtctccagtaattgtgaaggagagctctgtatcttgtgaattagtcatcatcttcctcacaacatcatatcagcagccagggcct

SEQ ID NO: 419879 - DNA, 140 bp, Artificial Sequence
  Synthetic
atacgccatgctgggtctccaaaaatcttagtttaataaaaaggactggggaggtcataatgggagccaatgatgtaagtgaattagaatcacaagcacagctaatgataacatatgatacgtacttgggagtcggccat

SEQ ID NO: 419880 - DNA, 140 bp, Artificial Sequence
  Synthetic
atggccgactcccaagtacgtatcatatgttatcattagctgtgcttgtgattctaattcacttacatcattggctcccattatgacctccccagtcctttttattaaactaagatttttggagacccagcatggcgtat

SEQ ID NO: 419881 - DNA, 140 bp, Artificial Sequence
  Synthetic
aggccctggctgctgatatgtccaatgataagcaaatgtaggacaaaagaaggaagacgaaaaacaaacctgtatgggttcatcataaaagggaggtctcatttgaggaatgatactgatgaccttttgggacagcggtg

SEQ ID NO: 419882 - DNA, 140 bp, Artificial Sequence
  Synthetic
caccgctgtcccaaaaggtcatcagtatcattcctcaaatgagacctcccttttatgatgaacccatacaggtttgtttttcgtcttccttcttttgtcctacatttgcttatcattggacatatcagcagccagggcct

SEQ ID NO: 419883 - DNA, 140 bp, Artificial Sequence
  Synthetic
atacgccatgctgggtctcctgtatgggttcatcataaaagggaggtctcatttgaggaatgatactgatgtggtaaactttgtgagcatggaattttctctcactgatccgaggctagacgtacttgggagtcggccat

SEQ ID NO: 419884 - DNA, 140 bp, Artificial Sequence
  Synthetic
atggccgactcccaagtacgtctagcctcggatcagtgagagaaaattccatgctcacaaagtttaccacatcagtatcattcctcaaatgagacctcccttttatgatgaacccatacaggagacccagcatggcgtat

SEQ ID NO: 419885 - DNA, 140 bp, Artificial Sequence
  Synthetic
aggccctggctgctgatatgagacaagagatatggcccagcattgagcatcaatgaactgagcaaccttgcaaaaggagagaaggctaatgtgttaatcgggcaaggagacgtagtgttggaccttttgggacagcggtg

SEQ ID NO: 419886 - DNA, 140 bp, Artificial Sequence
  Synthetic
caccgctgtcccaaaaggtccaacactacgtctccttgcccgattaacacattagccttctctccttttgcaaggttgctcagttcattgatgctcaatgctgggccatatctcttgtctcatatcagcagccagggcct

SEQ ID NO: 419887 - DNA, 140 bp, Artificial Sequence
  Synthetic
aggccctggctgctgatatgttgggtgatacagagtgcatactggttcaatgaatggttgggctttgaaaaggaggggagtaaggtattagaatcagtagatgaaataatggatgaataagaccttttgggacagcggtg

SEQ ID NO: 419888 - DNA, 140 bp, Artificial Sequence
  Synthetic
caccgctgtcccaaaaggtcttattcatccattatttcatctactgattctaataccttactcccctccttttcaaagcccaaccattcattgaaccagtatgcactctgtatcacccaacatatcagcagccagggcct

SEQ ID NO: 419889 - DNA, 140 bp, Artificial Sequence
  Synthetic
atacgccatgctgggtctcccttctgtcaaagaaaaggatatgactagagaattctttgagaacaagtcggagacatggccaattggagaatcccccagaggagttgaggaaggctctatcgtacttgggagtcggccat

SEQ ID NO: 419890 - DNA, 140 bp, Artificial Sequence
  Synthetic
atggccgactcccaagtacgatagagccttcctcaactcctctgggggattctccaattggccatgtctccgacttgttctcaaagaattctctagtcatatccttttctttgacagaagggagacccagcatggcgtat

SEQ ID NO: 419891 - DNA, 140 bp, Artificial Sequence
  Synthetic
aggccctggctgctgatatgtaatgagtcagctgacatgagcattggtgttacagtaataaagaacaatatgataaacaacgatcttggaccagcaacagctcagatggcccttcagctagaccttttgggacagcggtg

SEQ ID NO: 419892 - DNA, 140 bp, Artificial Sequence
  Synthetic
caccgctgtcccaaaaggtctagctgaagggccatctgagctgttgctggtccaagatcgttgtttatcatattgttctttattactgtaacaccaatgctcatgtcagctgactcattacatatcagcagccagggcct

SEQ ID NO: 419893 - DNA, 140 bp, Artificial Sequence
  Synthetic
aggccctggctgctgatatgtttaaattttgtaaacagagcaaatcaaagactaaatcccatgcatcaactcttgagacacttccagaaggatgcaaaagtgctgtttcaaaattggggagaccttttgggacagcggtg

SEQ ID NO: 419894 - DNA, 140 bp, Artificial Sequence
  Synthetic
caccgctgtcccaaaaggtctccccaattttgaaacagcacttttgcatccttctggaagtgtctcaagagttgatgcatgggatttagtctttgatttgctctgtttacaaaatttaaacatatcagcagccagggcct

SEQ ID NO: 419895 - DNA, 140 bp, Artificial Sequence
  Synthetic
aggccctggctgctgatatgcagaagcatgagatggctgactcataagagcaattcttaccccgttcaagacgctcaatacactaacaatgagggaaagaacattctcttcatgtggggcgaccttttgggacagcggtg

SEQ ID NO: 419896 - DNA, 140 bp, Artificial Sequence
  Synthetic
caccgctgtcccaaaaggtcgccccacatgaagagaatgttctttccctcattgttagtgtattgagcgtcttgaacggggtaagaattgctcttatgagtcagccatctcatgcttctgcatatcagcagccagggcct

SEQ ID NO: 419897 - DNA, 140 bp, Artificial Sequence
  Synthetic
atacgccatgctgggtctccattgcaatgaaacagtcatcagggaatacaatgaaacagtaaggattgagaaggtaacacaatggcacaataccaatgtcattgagtatatagaaaaacccgtacttgggagtcggccat

SEQ ID NO: 419898 - DNA, 140 bp, Artificial Sequence
  Synthetic
atggccgactcccaagtacgggtttttctatatactcaatgacattggtattgtgccattgtgttaccttctcaatccttactgtttcattgtattccctgatgactgtttcattgcaatggagacccagcatggcgtat

SEQ ID NO: 419899 - DNA, 140 bp, Artificial Sequence
  Synthetic
aggccctggctgctgatatgccctgaaagaaatgagcaaggtcagactctttggagcaaaacgaatgatgctggatcagacagagtgacggtatcacctctggctgtgacgtggtggaacgaccttttgggacagcggtg

SEQ ID NO: 419900 - DNA, 140 bp, Artificial Sequence
  Synthetic
caccgctgtcccaaaaggtcgttccaccacgtcacagccagaggtgataccgtcactctgtctgatccagcatcattcgttttgctccaaagagtctgaccttgctcatttctttcagggcatatcagcagccagggcct

SEQ ID NO: 419901 - DNA, 140 bp, Artificial Sequence
  Synthetic
aggccctggctgctgatatgacgaattgacttcgaatctggaaggattaagaaagaagagtttgctgagatcatgaagatctgttccaccattgaagagctcagacggcaaaaataatgagaccttttgggacagcggtg

SEQ ID NO: 419902 - DNA, 140 bp, Artificial Sequence
  Synthetic
caccgctgtcccaaaaggtctcattatttttgccgtctgagctcttcaatggtggaacagatcttcatgatctcagcaaactcttctttcttaatccttccagattcgaagtcaattcgtcatatcagcagccagggcct

SEQ ID NO: 419903 - DNA, 140 bp, Artificial Sequence
  Synthetic
atacgccatgctgggtctccatgaatccaaatcagaagattataaccattggatcaatttgtatgataatcggaacagtcagcttgattgtacaaattggaaacataatctcaatatgggcgtacttgggagtcggccat

SEQ ID NO: 419904 - DNA, 140 bp, Artificial Sequence
  Synthetic
atggccgactcccaagtacgcccatattgagattatgtttccaatttgtacaatcaagctgactgttccgattatcatacaaattgatccaatggttataatcttctgatttggattcatggagacccagcatggcgtat

SEQ ID NO: 419905 - DNA, 140 bp, Artificial Sequence
  Synthetic
aggccctggctgctgatatgtgacaaagaagaaataaggagagtttggcgccaagcaaacaatggtgaagatgcaacagctggccttactcatatcatgatttggcattccaatctgaatgaccttttgggacagcggtg

SEQ ID NO: 419906 - DNA, 140 bp, Artificial Sequence
  Synthetic
caccgctgtcccaaaaggtcattcagattggaatgccaaatcatgatatgagtaaggccagctgttgcatcttcaccattgtttgcttggcgccaaactctccttatttcttctttgtcacatatcagcagccagggcct

SEQ ID NO: 419907 - DNA, 140 bp, Artificial Sequence
  Synthetic
atacgccatgctgggtctccggaatgtcctgagcattgcacccataatgttctcaaacaagatggcaagactagggaaagggtatatgttcgaaagtaagagcatgaagcttcgaacacacgtacttgggagtcggccat

SEQ ID NO: 419908 - DNA, 140 bp, Artificial Sequence
  Synthetic
atggccgactcccaagtacgtgtgttcgaagcttcatgctcttactttcgaacatataccctttccctagtcttgccatcttgtttgagaacattatgggtgcaatgctcaggacattccggagacccagcatggcgtat

SEQ ID NO: 419909 - DNA, 140 bp, Artificial Sequence
  Synthetic
atacgccatgctgggtctccttgggaaagggatacatgtttgagagcaggagcatgaaactacgcacacaaataccagcagaaatgcttgcaagcattgacctaaaatacttcaatgaatcgtacttgggagtcggccat

SEQ ID NO: 419910 - DNA, 140 bp, Artificial Sequence
  Synthetic
atggccgactcccaagtacgattcattgaagtattttaggtcaatgcttgcaagcatttctgctggtatttgtgtgcgtagtttcatgctcctgctctcaaacatgtatccctttcccaaggagacccagcatggcgtat

SEQ ID NO: 419911 - DNA, 140 bp, Artificial Sequence
  Synthetic
atacgccatgctgggtctccagtaaaggggtgggcctttgacaatggagatgatgtttggatgggaagaacaatcagtaaagattctcgatcaggctatgagacctttagggtcattgatcgtacttgggagtcggccat

SEQ ID NO: 419912 - DNA, 140 bp, Artificial Sequence
  Synthetic
atggccgactcccaagtacgatcaatgaccctaaaggtctcatagcctgatcgagaatctttactgattgttcttcccatccaaacatcatctccattgtcaaaggcccacccctttactggagacccagcatggcgtat

SEQ ID NO: 419913 - DNA, 140 bp, Artificial Sequence
  Synthetic
aggccctggctgctgatatgcagtgataggaccaagaccccttgtaaacggacagcaggggagaattgactattattggtcagtattaaaaccaggccaaacattgcgagtgagatccaagaccttttgggacagcggtg

SEQ ID NO: 419914 - DNA, 140 bp, Artificial Sequence
  Synthetic
caccgctgtcccaaaaggtcttggatctcactcgcaatgtttggcctggttttaatactgaccaataatagtcaattctcccctgctgtccgtttacaaggggtcttggtcctatcactgcatatcagcagccagggcct

SEQ ID NO: 419915 - DNA, 140 bp, Artificial Sequence
  Synthetic
atacgccatgctgggtctccacattgaaaataagagtgcacgaaggatatgaggaattcacaatggtcgggagaagagcaacagccattctaaggaaagcaaccagaagactgattcaatcgtacttgggagtcggccat

SEQ ID NO: 419916 - DNA, 140 bp, Artificial Sequence
  Synthetic
atggccgactcccaagtacgattgaatcagtcttctggttgctttccttagaatggctgttgctcttctcccgaccattgtgaattcctcatatccttcgtgcactcttattttcaatgtggagacccagcatggcgtat

SEQ ID NO: 419917 - DNA, 140 bp, Artificial Sequence
  Synthetic
atacgccatgctgggtctccgattcaaacaaggaggtcatttgagctaaagaagttgtgggaacaaacccgctcaaaggcaggactgctggtctcagatggaggaccaaatctatacaatcgtacttgggagtcggccat

SEQ ID NO: 419918 - DNA, 140 bp, Artificial Sequence
  Synthetic
atggccgactcccaagtacgattgtatagatttggtcctccatctgagaccagcagtcctgcctttgagcgggtttgttcccacaacttctttagctcaaatgacctccttgtttgaatcggagacccagcatggcgtat

SEQ ID NO: 419919 - DNA, 140 bp, Artificial Sequence
  Synthetic
atacgccatgctgggtctccaaagaagtgaacgctaggatcgagccgttcttgaagacaacaccacgccctcttaaattacctgatgggctcccttgctctcagcggtctaaattcctgccgtacttgggagtcggccat

SEQ ID NO: 419920 - DNA, 140 bp, Artificial Sequence
  Synthetic
atggccgactcccaagtacggcaggaatttagaccgctgagagcaagggagcccatcaggtaatttaagagggcgtggtgttgtcttcaagaacggctcgatcctagcgttcacttctttggagacccagcatggcgtat

SEQ ID NO: 419921 - DNA, 140 bp, Artificial Sequence
  Synthetic
aggccctggctgctgatatgcaggaatgagaaatgtaccagagaaacaaactagaggcatatttggcgcaatcgcgggtttcatagaaaatggttgggagggaatggttgatggttggtagaccttttgggacagcggtg

SEQ ID NO: 419922 - DNA, 140 bp, Artificial Sequence
  Synthetic
caccgctgtcccaaaaggtctaccaaccatcaaccattccctcccaaccattttctatgaaacccgcgattgcgccaaatatgcctctagtttgtttctctggtacatttctcattcctgcatatcagcagccagggcct

SEQ ID NO: 419923 - DNA, 140 bp, Artificial Sequence
  Synthetic
atacgccatgctgggtctccatccaagatggaagcaaaactatttgtattattctgtgcgttcacttcactgaaagctgacaccatttgtgtaggctaccatgctaacaattccacagaccgtacttgggagtcggccat

SEQ ID NO: 419924 - DNA, 140 bp, Artificial Sequence
  Synthetic
atggccgactcccaagtacggtctgtggaattgttagcatggtagcctacacaaatggtgtcagctttcagtgaagtgaacgcacagaataatacaaatagttttgcttccatcttggatggagacccagcatggcgtat

SEQ ID NO: 419925 - DNA, 140 bp, Artificial Sequence
  Synthetic
aggccctggctgctgatatgatgaatgcagatcagaagatcataccaattggctctgtttctttcatcattgccacaatatgtttccttatgcaaatagggatcctagtaactacggtaagaccttttgggacagcggtg

SEQ ID NO: 419926 - DNA, 140 bp, Artificial Sequence
  Synthetic
caccgctgtcccaaaaggtcttaccgtagttactaggatccctatttgcataaggaaacatattgtggcaatgatgaaagaaacagagccaattggtatgatcttctgatctgcattcatcatatcagcagccagggcct

SEQ ID NO: 419927 - DNA, 140 bp, Artificial Sequence
  Synthetic
aggccctggctgctgatatgtctggctctcagccaagattactcagaaaacaacaacagcactgcaacactgtgcttagggcaccatgcggtaccgaatggaacgatagtgaagacaattgaccttttgggacagcggtg

SEQ ID NO: 419928 - DNA, 140 bp, Artificial Sequence
  Synthetic
caccgctgtcccaaaaggtcaattgtcttcactatcgttccattcggtaccgcatggtgccctaagcacagtgttgcagtgctgttgttgttttctgagtaatcttggctgagagccagacatatcagcagccagggcct

SEQ ID NO: 419929 - DNA, 140 bp, Artificial Sequence
  Synthetic
aggccctggctgctgatatggtggacttcgaacagtattgttgtgttctgtggcacttctggcacctatggttcaggctcatggcctgatggagcagacatcaatttcatgcctgtataagaccttttgggacagcggtg

SEQ ID NO: 419930 - DNA, 140 bp, Artificial Sequence
  Synthetic
caccgctgtcccaaaaggtcttatacaggcatgaaattgatgtctgctccatcaggccatgagcctgaaccataggtgccagaagtgccacagaacacaacaatactgttcgaagtccaccatatcagcagccagggcct

SEQ ID NO: 419931 - DNA, 140 bp, Artificial Sequence
  Synthetic
atacgccatgctgggtctccaaccaaaagaatggggatgggactatatgtaaagtatgatggagacccatggactgacagtgaagcccttgctcttagtggagtaatggtttcaatggaacgtacttgggagtcggccat

SEQ ID NO: 419932 - DNA, 140 bp, Artificial Sequence
  Synthetic
atggccgactcccaagtacgttccattgaaaccattactccactaagagcaagggcttcactgtcagtccatgggtctccatcatactttacatatagtcccatccccattcttttggttggagacccagcatggcgtat

SEQ ID NO: 419933 - DNA, 140 bp, Artificial Sequence
  Synthetic
aggccctggctgctgatatgcgagatactgacaaaaaccactgtggaccatatggccataataaagaaatacacgtcaggaagacaggagaagaaccctgccctcaggatgaaatggatggaccttttgggacagcggtg

SEQ ID NO: 419934 - DNA, 140 bp, Artificial Sequence
  Synthetic
caccgctgtcccaaaaggtccatccatttcatcctgagggcagggttcttctcctgtcttcctgacgtgtatttctttattatggccatatggtccacagtggtttttgtcagtatctcgcatatcagcagccagggcct

SEQ ID NO: 419935 - DNA, 140 bp, Artificial Sequence
  Synthetic
aggccctggctgctgatatggcaatctggactccctgttggaggaaatgagaagaaagccaaattggcaaatgttgtgaggaagatgatgacaaactcacaagatacagagctctcctttgaccttttgggacagcggtg

SEQ ID NO: 419936 - DNA, 140 bp, Artificial Sequence
  Synthetic
caccgctgtcccaaaaggtcaaaggagagctctgtatcttgtgagtttgtcatcatcttcctcacaacatttgccaatttggctttcttctcatttcctccaacagggagtccagattgccatatcagcagccagggcct

SEQ ID NO: 419937 - DNA, 140 bp, Artificial Sequence
  Synthetic
aggccctggctgctgatatgatggcgtctcaaggcaccaaacgatcttatgaacagatggaaactggtggagaacgccaaaatactactgaaatcagagcatctgttgggagaatggttggaccttttgggacagcggtg

SEQ ID NO: 419938 - DNA, 140 bp, Artificial Sequence
  Synthetic
caccgctgtcccaaaaggtccaaccattctcccaacagatgctctgatttcagtagtattttggcgttctccaccagtttccatctgttcataagatcgtttggtgccttgagacgccatcatatcagcagccagggcct

SEQ ID NO: 419939 - DNA, 140 bp, Artificial Sequence
  Synthetic
aggccctggctgctgatatgtagtgtactgaacttattgataggactctcaaatgtcggattgaatgtatctctacatctaaaagaagcaggacccaaacaggaagagaatttgacatgcgaccttttgggacagcggtg

SEQ ID NO: 419940 - DNA, 140 bp, Artificial Sequence
  Synthetic
caccgctgtcccaaaaggtcgcatgtcaaattctcttcctgtttgggtcctgcttcttttagatgtagagatacattcaatccgacatttgagagtcctatcaataagttcagtacactacatatcagcagccagggcct

SEQ ID NO: 419941 - DNA, 140 bp, Artificial Sequence
  Synthetic
atacgccatgctgggtctccctctacatctaaaagaagcaggacccaaacaggaagagaatttgacatgcatgactaccaaagaaactgaattgggaacaccaagctatctgctgttgaacgtacttgggagtcggccat

SEQ ID NO: 419942 - DNA, 140 bp, Artificial Sequence
  Synthetic
atggccgactcccaagtacgttcaacagcagatagcttggtgttcccaattcagtttctttggtagtcatgcatgtcaaattctcttcctgtttgggtcctgcttcttttagatgtagagggagacccagcatggcgtat

SEQ ID NO: 419943 - DNA, 140 bp, Artificial Sequence
  Synthetic
aggccctggctgctgatatgactttcgaaatcaggttaaaatacgccgcagggttgacataaacccgggccatgcagatctcagtgccaaagaagcacaggatgtcatcatggaggtcgtgaccttttgggacagcggtg

SEQ ID NO: 419944 - DNA, 140 bp, Artificial Sequence
  Synthetic
caccgctgtcccaaaaggtcacgacctccatgatgacatcctgtgcttctttggcactgagatctgcatggcccgggtttatgtcaaccctgcggcgtattttaacctgatttcgaaagtcatatcagcagccagggcct

SEQ ID NO: 419945 - DNA, 140 bp, Artificial Sequence
  Synthetic
atacgccatgctgggtctcccagtaagatttggggaaagtgagcaaatcattattaccagagaaccatacgtatcatgtgacccaaatggatgcaaaatgtatgccttgcatcaagggaccgtacttgggagtcggccat

SEQ ID NO: 419946 - DNA, 140 bp, Artificial Sequence
  Synthetic
atggccgactcccaagtacggtcccttgatgcaaggcatacattttgcatccatttgggtcacatgatacgtatggttctctggtaataatgatttgctcactttccccaaatcttactgggagacccagcatggcgtat

SEQ ID NO: 419947 - DNA, 140 bp, Artificial Sequence
  Synthetic
aggccctggctgctgatatggtatcatgtgacccaaatggatgcaaaatgtatgccttgcatcaagggactaccattaggaacaaacattcaaacggaacaattcacgacagaacagcctgaccttttgggacagcggtg

SEQ ID NO: 419948 - DNA, 140 bp, Artificial Sequence
  Synthetic
caccgctgtcccaaaaggtcaggctgttctgtcgtgaattgttccgtttgaatgtttgttcctaatggtagtcccttgatgcaaggcatacattttgcatccatttgggtcacatgataccatatcagcagccagggcct

SEQ ID NO: 419949 - DNA, 140 bp, Artificial Sequence
  Synthetic
atacgccatgctgggtctccagtgattttatatgtgttggatggtcaagcacaacttgccatgatggaattggcagaatgactatctgtatacaagggaataatgacaatgctacagcaacgtacttgggagtcggccat

SEQ ID NO: 419950 - DNA, 140 bp, Artificial Sequence
  Synthetic
atggccgactcccaagtacgttgctgtagcattgtcattattcccttgtatacagatagtcattctgccaattccatcatggcaagttgtgcttgaccatccaacacatataaaatcactggagacccagcatggcgtat

SEQ ID NO: 419951 - DNA, 140 bp, Artificial Sequence
  Synthetic
aggccctggctgctgatatgtggcagaatgactatctgtatacaagggaataatgacaatgctacagcaacggtttattataacagaaggctgaccactaccattaagacctgggctagagaccttttgggacagcggtg

SEQ ID NO: 419952 - DNA, 140 bp, Artificial Sequence
  Synthetic
caccgctgtcccaaaaggtctctagcccaggtcttaatggtagtggtcagccttctgttataataaaccgttgctgtagcattgtcattattcccttgtatacagatagtcattctgccacatatcagcagccagggcct

SEQ ID NO: 419953 - DNA, 140 bp, Artificial Sequence
  Synthetic
atacgccatgctgggtctcctgcagttgtaatgaccgatgggtcggctagtagtcaagcccatacaaaagtaatgtatttccacaaggggttggtagttaaggaggaggcattgaagggacgtacttgggagtcggccat

SEQ ID NO: 419954 - DNA, 140 bp, Artificial Sequence
  Synthetic
atggccgactcccaagtacgtcccttcaatgcctcctccttaactaccaaccccttgtggaaatacattacttttgtatgggcttgactactagccgacccatcggtcattacaactgcaggagacccagcatggcgtat

SEQ ID NO: 419955 - DNA, 140 bp, Artificial Sequence
  Synthetic
aggccctggctgctgatatgtaatgtatttccacaaggggttggtagttaaggaggaggcattgaagggatcggccaaacatattgaggagtgctcctgttacgggcacaatcaaaaggtgaccttttgggacagcggtg

SEQ ID NO: 419956 - DNA, 140 bp, Artificial Sequence
  Synthetic
caccgctgtcccaaaaggtcaccttttgattgtgcccgtaacaggagcactcctcaatatgtttggccgatcccttcaatgcctcctccttaactaccaaccccttgtggaaatacattacatatcagcagccagggcct

SEQ ID NO: 419957 - DNA, 140 bp, Artificial Sequence
  Synthetic
atacgccatgctgggtctcccagcaaatgcgtgatgtgctggggacatttgataccgcacaaataataaagctgttaccatttgcagcagctccaccagagcagagtaggatgcaattctcgtacttgggagtcggccat

SEQ ID NO: 419958 - DNA, 140 bp, Artificial Sequence
  Synthetic
atggccgactcccaagtacgagaattgcatcctactctgctctggtggagctgctgcaaatggtaacagctttattatttgtgcggtatcaaatgtccccagcacatcacgcatttgctgggagacccagcatggcgtat

SEQ ID NO: 419959 - DNA, 140 bp, Artificial Sequence
  Synthetic
atacgccatgctgggtctccaaattgacatgaacacattggaacacacaagtagatatgtgtgcaccggaattctcaccgatactagcagacccggggacaaacctactggtgattgttccgtacttgggagtcggccat

SEQ ID NO: 419960 - DNA, 140 bp, Artificial Sequence
  Synthetic
atggccgactcccaagtacggaacaatcaccagtaggtttgtccccgggtctgctagtatcggtgagaattccggtgcacacatatctacttgtgtgttccaatgtgttcatgtcaatttggagacccagcatggcgtat

SEQ ID NO: 419961 - DNA, 140 bp, Artificial Sequence
  Synthetic
aggccctggctgctgatatgattctcaccgatactagcagacccggggacaaacctactggtgattgttccaatccaataactggaagtcctggcgctccgggagtgaagggatttggatgaccttttgggacagcggtg

SEQ ID NO: 419962 - DNA, 140 bp, Artificial Sequence
  Synthetic
caccgctgtcccaaaaggtcatccaaatcccttcactcccggagcgccaggacttccagttattggattggaacaatcaccagtaggtttgtccccgggtctgctagtatcggtgagaatcatatcagcagccagggcct

SEQ ID NO: 419963 - DNA, 140 bp, Artificial Sequence
  Synthetic
aggccctggctgctgatatgctcagtgtcatcatttgaaagatttgagatattccccaagacaagttcatggcccaatcatgacacgaacagaggtgtgacggcagcatgtcctcatgctgaccttttgggacagcggtg

SEQ ID NO: 419964 - DNA, 140 bp, Artificial Sequence
  Synthetic
caccgctgtcccaaaaggtcagcatgaggacatgctgccgtcacacctctgttcgtgtcatgattgggccatgaacttgtcttggggaatatctcaaatctttcaaatgatgacactgagcatatcagcagccagggcct

SEQ ID NO: 419965 - DNA, 140 bp, Artificial Sequence
  Synthetic
atacgccatgctgggtctccagaagtggatttgaaatgctgaaaatacctaacgcaggtattgatcccaattctagaatagctgagcggcaggaaattgtcgacaacagcaattggtcagcgtacttgggagtcggccat

SEQ ID NO: 419966 - DNA, 140 bp, Artificial Sequence
  Synthetic
atggccgactcccaagtacgctgaccaattgctgttgtcgacaatttcctgccgctcagctattctagaattgggatcaatacctgcgttaggtattttcagcatttcaaatccacttctggagacccagcatggcgtat

SEQ ID NO: 419967 - DNA, 140 bp, Artificial Sequence
  Synthetic
atacgccatgctgggtctcccaggaacagggtacaccatggacacagtcaatagaacacatcaatattcagagaaagggaaatggacaacaaacacagagactggggcacctcaactcaacgtacttgggagtcggccat

SEQ ID NO: 419968 - DNA, 140 bp, Artificial Sequence
  Synthetic
atggccgactcccaagtacgttgagttgaggtgccccagtctctgtgtttgttgtccatttccctttctctgaatattgatgtgttctattgactgtgtccatggtgtaccctgttcctgggagacccagcatggcgtat

SEQ ID NO: 419969 - DNA, 140 bp, Artificial Sequence
  Synthetic
atacgccatgctgggtctccaatccatgtttctacgtagagttaattagagggagacccgaagaggctaaatatgtgtggtggacaagtaacagtctaattgccctatgtggaagcccatcgtacttgggagtcggccat

SEQ ID NO: 419970 - DNA, 140 bp, Artificial Sequence
  Synthetic
atggccgactcccaagtacgatgggcttccacatagggcaattagactgttacttgtccaccacacatatttagcctcttcgggtctccctctaattaactctacgtagaaacatggattggagacccagcatggcgtat

SEQ ID NO: 419971 - DNA, 140 bp, Artificial Sequence
  Synthetic
aggccctggctgctgatatgatatgtgtggtggacaagtaacagtctaattgccctatgtggaagcccattcccagttgggtccggttccttccccgatggggcacagatccaatactttgaccttttgggacagcggtg

SEQ ID NO: 419972 - DNA, 140 bp, Artificial Sequence
  Synthetic
caccgctgtcccaaaaggtcaaagtattggatctgtgccccatcggggaaggaaccggacccaactgggaatgggcttccacatagggcaattagactgttacttgtccaccacacatatcatatcagcagccagggcct

SEQ ID NO: 419973 - DNA, 140 bp, Artificial Sequence
  Synthetic
atacgccatgctgggtctccatggcgtctcaaggcaccaaacgatcctatgaacagatggaaactggtggagaacgccagaatgccaccgagatcagggcatccgtcggaagaatggtcacgtacttgggagtcggccat

SEQ ID NO: 419974 - DNA, 140 bp, Artificial Sequence
  Synthetic
atggccgactcccaagtacgtgaccattcttccgacggatgccctgatctcggtggcattctggcgttctccaccagtttccatctgttcataggatcgtttggtgccttgagacgccatggagacccagcatggcgtat

SEQ ID NO: 419975 - DNA, 140 bp, Artificial Sequence
  Synthetic
atacgccatgctgggtctccgacattcttagacagaacccgactgaagaacaagctgtggatatatgcaaggctgcaatgggattgagaatcagctcatccttcagctttggtggctttacgtacttgggagtcggccat

SEQ ID NO: 419976 - DNA, 140 bp, Artificial Sequence
  Synthetic
atggccgactcccaagtacgtaaagccaccaaagctgaaggatgagctgattctcaatcccattgcagccttgcatatatccacagcttgttcttcagtcgggttctgtctaagaatgtcggagacccagcatggcgtat

SEQ ID NO: 419977 - DNA, 140 bp, Artificial Sequence
  Synthetic
atacgccatgctgggtctccatgaatccaaatcaaaggataatagcgattgggtcagtgaacacagtattatccacaatagcactgctaattgggataggcaacttagctttcaatgcagcgtacttgggagtcggccat

SEQ ID NO: 419978 - DNA, 140 bp, Artificial Sequence
  Synthetic
atggccgactcccaagtacgctgcattgaaagctaagttgcctatcccaattagcagtgctattgtggataatactgtgttcactgacccaatcgctattatcctttgatttggattcatggagacccagcatggcgtat

SEQ ID NO: 419979 - DNA, 140 bp, Artificial Sequence
  Synthetic
atacgccatgctgggtctccctactttgaaaaggtcgaaaggttgaaacatggaaccttcggtcctgttcactttcgaaatcaggttaaaatacgccgcagggttgacataaacccgggccgtacttgggagtcggccat

SEQ ID NO: 419980 - DNA, 140 bp, Artificial Sequence
  Synthetic
atggccgactcccaagtacggcccgggtttatgtcaaccctgcggcgtattttaacctgatttcgaaagtgaacaggaccgaaggttccatgtttcaacctttcgaccttttcaaagtagggagacccagcatggcgtat

SEQ ID NO: 419981 - DNA, 140 bp, Artificial Sequence
  Synthetic
aggccctggctgctgatatgggcaactctccagtgtttaactacaataaggcaacaaaaaggctaacggtcctcggaaaggacgcaggtgcactaacagaagacccagatgagggaacatgaccttttgggacagcggtg

SEQ ID NO: 419982 - DNA, 140 bp, Artificial Sequence
  Synthetic
caccgctgtcccaaaaggtcatgttccctcatctgggtcttctgttagtgcacctgcgtcctttccgaggaccgttagcctttttgttgccttattgtagttaaacactggagagttgcccatatcagcagccagggcct

SEQ ID NO: 419983 - DNA, 140 bp, Artificial Sequence
  Synthetic
aggccctggctgctgatatgttgcgacaatatgtttactcattcagattgccatcttagcaacgactatgacactacatttcaagcagaacgagtacacaaacacctcgaaaaatcaagtgaccttttgggacagcggtg

SEQ ID NO: 419984 - DNA, 140 bp, Artificial Sequence
  Synthetic
caccgctgtcccaaaaggtcacttgatttttcgaggtgtttgtgtactcgttctgcttgaaatgtagtgtcatagtcgttgctaagatggcaatctgaatgagtaaacatattgtcgcaacatatcagcagccagggcct

SEQ ID NO: 419985 - DNA, 140 bp, Artificial Sequence
  Synthetic
atacgccatgctgggtctcccttctcaaaaactgaggcaaataggccaaaaatgaacaatgctaccttcaactatacaaacgttaaccctatttctcacatcagggggagtgttattatccgtacttgggagtcggccat

SEQ ID NO: 419986 - DNA, 140 bp, Artificial Sequence
  Synthetic
atggccgactcccaagtacggataataacactccccctgatgtgagaaatagggttaacgtttgtatagttgaaggtagcattgttcatttttggcctatttgcctcagtttttgagaagggagacccagcatggcgtat

SEQ ID NO: 419987 - DNA, 140 bp, Artificial Sequence
  Synthetic
atacgccatgctgggtctccagggaatagggacgatggtgatggaactgattcggatgataaaacgagggatcaacgaccggaatttctggagaggtgaaaatggaagaaggacaaggatcgtacttgggagtcggccat

SEQ ID NO: 419988 - DNA, 140 bp, Artificial Sequence
  Synthetic
atggccgactcccaagtacgatccttgtccttcttccattttcacctctccagaaattccggtcgttgatccctcgttttatcatccgaatcagttccatcaccatcgtccctattccctggagacccagcatggcgtat

SEQ ID NO: 419989 - DNA, 140 bp, Artificial Sequence
  Synthetic
atacgccatgctgggtctcccagctccataatagctgacatggttgtatcattatcattattagaaacattgtatgaaatgaaggatgtggttgaagtgtacagcaggcagtgcttgtgacgtacttgggagtcggccat

SEQ ID NO: 419990 - DNA, 140 bp, Artificial Sequence
  Synthetic
atggccgactcccaagtacgtcacaagcactgcctgctgtacacttcaaccacatccttcatttcatacaatgtttctaataatgataatgatacaaccatgtcagctattatggagctgggagacccagcatggcgtat

SEQ ID NO: 419991 - DNA, 140 bp, Artificial Sequence
  Synthetic
aggccctggctgctgatatgcacaaagggcaatgatggatcaagtgcgagagagcagaaatcctgggaatgctgaaatagaagatcttatttttctggcaaggtctgcactcatcctgaggaccttttgggacagcggtg

SEQ ID NO: 419992 - DNA, 140 bp, Artificial Sequence
  Synthetic
caccgctgtcccaaaaggtcctcaggatgagtgcagaccttgccagaaaaataagatcttctatttcagcattcccaggatttctgctctctcgcacttgatccatcattgccctttgtgcatatcagcagccagggcct

SEQ ID NO: 419993 - DNA, 140 bp, Artificial Sequence
  Synthetic
aggccctggctgctgatatggtgattgctattgggtgatgactgacggtccagccaataggcaggcacagtatagaatattcaaagcaaatcaaggcaagatagttggccaaacggatgtgaccttttgggacagcggtg

SEQ ID NO: 419994 - DNA, 140 bp, Artificial Sequence
  Synthetic
caccgctgtcccaaaaggtcacatccgtttggccaactatcttgccttgatttgctttgaatattctatactgtgcctgcctattggctggaccgtcagtcatcacccaatagcaatcaccatatcagcagccagggcct

SEQ ID NO: 419995 - DNA, 140 bp, Artificial Sequence
  Synthetic
atacgccatgctgggtctccgagccagagcctagatcgctggcaagctggatccagagtgaattcaataaggcatgtgaattgaccgactcaagctggatagaacttgatgaaataggagcgtacttgggagtcggccat

SEQ ID NO: 419996 - DNA, 140 bp, Artificial Sequence
  Synthetic
atggccgactcccaagtacgctcctatttcatcaagttctatccagcttgagtcggtcaattcacatgccttattgaattcactctggatccagcttgccagcgatctaggctctggctcggagacccagcatggcgtat

SEQ ID NO: 419997 - DNA, 140 bp, Artificial Sequence
  Synthetic
aggccctggctgctgatatgatagatcctttccgtctgcttcaaaacagccaggtctttagtctcattagaccaaatgagaacccagcacataagagccaattagtgtggatggcatgccgaccttttgggacagcggtg

SEQ ID NO: 419998 - DNA, 140 bp, Artificial Sequence
  Synthetic
caccgctgtcccaaaaggtcggcatgccatccacactaattggctcttatgtgctgggttctcatttggtctaatgagactaaagacctggctgttttgaagcagacggaaaggatctatcatatcagcagccagggcct

SEQ ID NO: 419999 - DNA, 140 bp, Artificial Sequence
  Synthetic
aggccctggctgctgatatgctggagtggaatctgcagtactaagagggtttctaattctagggaaggaaaacaagagatatggaccagcattgagtatcaatgaactgagcaatcttgtgaccttttgggacagcggtg

SEQ ID NO: 420000 - DNA, 140 bp, Artificial Sequence
  Synthetic
caccgctgtcccaaaaggtcacaagattgctcagttcattgatactcaatgctggtccatatctcttgttttccttccctagaattagaaaccctcttagtactgcagattccactccagcatatcagcagccagggcct

SEQ ID NO: 420001 - DNA, 140 bp, Artificial Sequence
  Synthetic
aggccctggctgctgatatgaacgaggagaaaattccaaaaacgaagaacatgaagaaaacaagccaattgaaatgggcacttggtgaaaatatggcaccagagaaagtggactttgaaggaccttttgggacagcggtg

SEQ ID NO: 420002 - DNA, 140 bp, Artificial Sequence
  Synthetic
caccgctgtcccaaaaggtccttcaaagtccactttctctggtgccatattttcaccaagtgcccatttcaattggcttgttttcttcatgttcttcgtttttggaattttctcctcgttcatatcagcagccagggcct

SEQ ID NO: 420003 - DNA, 140 bp, Artificial Sequence
  Synthetic
aggccctggctgctgatatgaaggaagagaccgaacgatggcatggactgtagtgaatagtatctgcaacaccacaggagtcaagaagcctaaatttcttccagatttatatgattacaagaccttttgggacagcggtg

SEQ ID NO: 420004 - DNA, 140 bp, Artificial Sequence
  Synthetic
caccgctgtcccaaaaggtcttgtaatcatataaatctggaagaaatttaggcttcttgactcctgtggtgttgcagatactattcactacagtccatgccatcgttcggtctcttccttcatatcagcagccagggcct

SEQ ID NO: 420005 - DNA, 140 bp, Artificial Sequence
  Synthetic
aggccctggctgctgatatgcagcatttgacgagaggagaaacaaatatctggaagagcatcccagtgctgggaaagaccctaagaagactggaggcccaatatacaggaggagagatgggaccttttgggacagcggtg

SEQ ID NO: 420006 - DNA, 140 bp, Artificial Sequence
  Synthetic
caccgctgtcccaaaaggtcccatctctcctcctgtatattgggcctccagtcttcttagggtctttcccagcactgggatgctcttccagatatttgtttctcctctcgtcaaatgctgcatatcagcagccagggcct

SEQ ID NO: 420007 - DNA, 140 bp, Artificial Sequence
  Synthetic
aggccctggctgctgatatgactacctagaaaaagccaacaagataaaatctgaaaagactcatattcacattttctcttttactggagaggaaatggccaccaaagcggattacactctgaccttttgggacagcggtg

SEQ ID NO: 420008 - DNA, 140 bp, Artificial Sequence
  Synthetic
caccgctgtcccaaaaggtcagagtgtaatccgctttggtggccatttcctctccagtaaaagagaaaatgtgaatatgagtcttttcagattttatcttgttggctttttctaggtagtcatatcagcagccagggcct

SEQ ID NO: 420009 - DNA, 140 bp, Artificial Sequence
  Synthetic
atacgccatgctgggtctccattttctcttttactggagaggaaatggccaccaaagcggattacactcttgatgaagaaagcagggcacgaataaaaactaggctgttcactataagaccgtacttgggagtcggccat

SEQ ID NO: 420010 - DNA, 140 bp, Artificial Sequence
  Synthetic
atggccgactcccaagtacggtcttatagtgaacagcctagtttttattcgtgccctgctttcttcatcaagagtgtaatccgctttggtggccatttcctctccagtaaaagagaaaatggagacccagcatggcgtat

SEQ ID NO: 420011 - DNA, 140 bp, Artificial Sequence
  Synthetic
aggccctggctgctgatatggagcctatgtggatggattcgaaccgaacggctgcattgagggcaagctttctcagatgtcaaaagaagtgaatgcgcggattgagccatttgtgaaaacgaccttttgggacagcggtg

SEQ ID NO: 420012 - DNA, 140 bp, Artificial Sequence
  Synthetic
caccgctgtcccaaaaggtcgttttcacaaatggctcaatccgcgcattcacttcttttgacatctgagaaagcttgccctcaatgcagccgttcggttcgaatccatccacataggctccatatcagcagccagggcct

SEQ ID NO: 420013 - DNA, 140 bp, Artificial Sequence
  Synthetic
aggccctggctgctgatatgctaaattcttactaatggatgccctcaagctaagtattgaggacccaagccatgaaggggaaggaatacccctgtatgatgcaatcaagtgcatgaagacgaccttttgggacagcggtg

SEQ ID NO: 420014 - DNA, 140 bp, Artificial Sequence
  Synthetic
caccgctgtcccaaaaggtcgtcttcatgcacttgattgcatcatacaggggtattccttccccttcatggcttgggtcctcaatacttagcttgagggcatccattagtaagaatttagcatatcagcagccagggcct

SEQ ID NO: 420015 - DNA, 140 bp, Artificial Sequence
  Synthetic
atacgccatgctgggtctcccatgaaggggaaggaatacccctgtatgatgcaatcaagtgcatgaagacattctttggatggaaagagccaaacattgtcaaaccacatgaaaaaggaacgtacttgggagtcggccat

SEQ ID NO: 420016 - DNA, 140 bp, Artificial Sequence
  Synthetic
atggccgactcccaagtacgttcctttttcatgtggtttgacaatgtttggctctttccatccaaagaatgtcttcatgcacttgattgcatcatacaggggtattccttccccttcatgggagacccagcatggcgtat

SEQ ID NO: 420017 - DNA, 140 bp, Artificial Sequence
  Synthetic
aggccctggctgctgatatggacattgaaaatgaggagaaaatccccaaaacaaaaaacatgaaaaaaacaagccaattgaagtgggcacttggtgagaacatggcgccagaaaaggtaggaccttttgggacagcggtg

SEQ ID NO: 420018 - DNA, 140 bp, Artificial Sequence
  Synthetic
caccgctgtcccaaaaggtcctaccttttctggcgccatgttctcaccaagtgcccacttcaattggcttgtttttttcatgttttttgttttggggattttctcctcattttcaatgtccatatcagcagccagggcct

SEQ ID NO: 420019 - DNA, 140 bp, Artificial Sequence
  Synthetic
atacgccatgctgggtctccaagccaattgaagtgggcacttggtgagaacatggcgccagaaaaggtagactttgaagactgcaaagatatcaatgacctaaaacaatatgacagtgatcgtacttgggagtcggccat

SEQ ID NO: 420020 - DNA, 140 bp, Artificial Sequence
  Synthetic
atggccgactcccaagtacgatcactgtcatattgttttaggtcattgatatctttgcagtcttcaaagtctaccttttctggcgccatgttctcaccaagtgcccacttcaattggcttggagacccagcatggcgtat

SEQ ID NO: 420021 - DNA, 140 bp, Artificial Sequence
  Synthetic
atacgccatgctgggtctccatggatgctttgaattgtaccataaatgtgatgatcaatgtatggaaacgattagaaacgggacctatgacaaacaaaaataccaagaggagtcaaaattcgtacttgggagtcggccat

SEQ ID NO: 420022 - DNA, 140 bp, Artificial Sequence
  Synthetic
atggccgactcccaagtacgaattttgactcctcttggtatttttgtttgtcataggtcccgtttctaatcgtttccatacattgatcatcacatttatggtacaattcaaagcatccatggagacccagcatggcgtat

SEQ ID NO: 420023 - DNA, 140 bp, Artificial Sequence
  Synthetic
aggccctggctgctgatatgggcatgtgaactaaccgattcaagctggatagaacttgatgaaataggggaagatgttgcccctattgaacacattgcaagtatgagaaggaactatttcgaccttttgggacagcggtg

SEQ ID NO: 420024 - DNA, 140 bp, Artificial Sequence
  Synthetic
caccgctgtcccaaaaggtcgaaatagttccttctcatacttgcaatgtgttcaataggggcaacatcttcccctatttcatcaagttctatccagcttgaatcggttagttcacatgcccatatcagcagccagggcct

SEQ ID NO: 420025 - DNA, 140 bp, Artificial Sequence
  Synthetic
atacgccatgctgggtctccaagatgttgcccctattgaacacattgcaagtatgagaaggaactatttcacagcggaagtgtctcactgcagggctactgaatacatcatgaaaggagtcgtacttgggagtcggccat

SEQ ID NO: 420026 - DNA, 140 bp, Artificial Sequence
  Synthetic
atggccgactcccaagtacgactcctttcatgatgtattcagtagccctgcagtgagacacttccgctgtgaaatagttccttctcatacttgcaatgtgttcaataggggcaacatcttggagacccagcatggcgtat

SEQ ID NO: 420027 - DNA, 140 bp, Artificial Sequence
  Synthetic
aggccctggctgctgatatgtccaattgattccaatgataagcaaatgccgaaccaaagaaggtagacggaaaacaaatctgtatggattcattgtaaaagggaggtctcatcttaggaagaccttttgggacagcggtg

SEQ ID NO: 420028 - DNA, 140 bp, Artificial Sequence
  Synthetic
caccgctgtcccaaaaggtcttcctaagatgagacctcccttttacaatgaatccatacagatttgttttccgtctaccttctttggttcggcatttgcttatcattggaatcaattggacatatcagcagccagggcct

SEQ ID NO: 420029 - DNA, 140 bp, Artificial Sequence
  Synthetic
atacgccatgctgggtctccaaaacaaatctgtatggattcattgtaaaagggaggtctcatcttaggaatgatacagatgtggtaaactttgtgagcatggagttttctcttacggacccgtacttgggagtcggccat

SEQ ID NO: 420030 - DNA, 140 bp, Artificial Sequence
  Synthetic
atggccgactcccaagtacgggtccgtaagagaaaactccatgctcacaaagtttaccacatctgtatcattcctaagatgagacctcccttttacaatgaatccatacagatttgttttggagacccagcatggcgtat

SEQ ID NO: 420031 - DNA, 140 bp, Artificial Sequence
  Synthetic
aggccctggctgctgatatgaatacagaaattggtcaaagccgcaatgtgacattacaggatttgcacctttttctaaggacaattcgattaggctttccgctggtggggacatctgggtgaccttttgggacagcggtg

SEQ ID NO: 420032 - DNA, 140 bp, Artificial Sequence
  Synthetic
caccgctgtcccaaaaggtcacccagatgtccccaccagcggaaagcctaatcgaattgtccttagaaaaaggtgcaaatcctgtaatgtcacattgcggctttgaccaatttctgtattcatatcagcagccagggcct

SEQ ID NO: 420033 - DNA, 140 bp, Artificial Sequence
  Synthetic
aggccctggctgctgatatggacatgcttctacggactgcaataggccaggtgtcaagacccatgttcctatacgtaagaaccaatgggacctcaaaaatcaagatgaagtggggtatgggaccttttgggacagcggtg

SEQ ID NO: 420034 - DNA, 140 bp, Artificial Sequence
  Synthetic
caccgctgtcccaaaaggtcccataccccacttcatcttgatttttgaggtcccattggttcttacgtataggaacatgggtcttgacacctggcctattgcagtccgtagaagcatgtccatatcagcagccagggcct

SEQ ID NO: 420035 - DNA, 140 bp, Artificial Sequence
  Synthetic
atacgccatgctgggtctccatacgtaagaaccaatgggacctcaaaaatcaagatgaagtggggtatggaaatgagacgctgccttctccaatctctacaacaaatcgagagtatgattcgtacttgggagtcggccat

SEQ ID NO: 420036 - DNA, 140 bp, Artificial Sequence
  Synthetic
atggccgactcccaagtacgaatcatactctcgatttgttgtagagattggagaaggcagcgtctcatttccataccccacttcatcttgatttttgaggtcccattggttcttacgtatggagacccagcatggcgtat

SEQ ID NO: 420037 - DNA, 140 bp, Artificial Sequence
  Synthetic
aggccctggctgctgatatgaaacaaatcggagacatggccaattggagagtcacccaagggagtggaggaaggctccatcgggaaagtgtgcagaaccttgttagcaaaatctgttttcgaccttttgggacagcggtg

SEQ ID NO: 420038 - DNA, 140 bp, Artificial Sequence
  Synthetic
caccgctgtcccaaaaggtcgaaaacagattttgctaacaaggttctgcacactttcccgatggagccttcctccactcccttgggtgactctccaattggccatgtctccgatttgtttcatatcagcagccagggcct

SEQ ID NO: 420039 - DNA, 140 bp, Artificial Sequence
  Synthetic
atacgccatgctgggtctccaaggctccatcgggaaagtgtgcagaaccttgttagcaaaatctgttttcaacagtctctatgcatctccacaacttgagggattttcagctgaatctagcgtacttgggagtcggccat

SEQ ID NO: 420040 - DNA, 140 bp, Artificial Sequence
  Synthetic
atggccgactcccaagtacgctagattcagctgaaaatccctcaagttgtggagatgcatagagactgttgaaaacagattttgctaacaaggttctgcacactttcccgatggagccttggagacccagcatggcgtat

SEQ ID NO: 420041 - DNA, 140 bp, Artificial Sequence
  Synthetic
atacgccatgctgggtctccagatagccagttcacggggtcatgcactagccccatgggaaaccaggggtatggagttaaaggattcgggttcaggcagggcaatgatgtatggatgggacgtacttgggagtcggccat

SEQ ID NO: 420042 - DNA, 140 bp, Artificial Sequence
  Synthetic
atggccgactcccaagtacgtcccatccatacatcattgccctgcctgaacccgaatcctttaactccatacccctggtttcccatggggctagtgcatgaccccgtgaactggctatctggagacccagcatggcgtat

SEQ ID NO: 420043 - DNA, 140 bp, Artificial Sequence
  Synthetic
atacgccatgctgggtctccagatcctcaccatttattcgactgtcgcctcatctcttatgcttgcaatggggtttgctgcctttctattctgggccatgtcaaacggatcttgcagatgcgtacttgggagtcggccat

SEQ ID NO: 420044 - DNA, 140 bp, Artificial Sequence
  Synthetic
atggccgactcccaagtacgcatctgcaagatccgtttgacatggcccagaatagaaaggcagcaaaccccattgcaagcataagagatgaggcgacagtcgaataaatggtgaggatctggagacccagcatggcgtat

SEQ ID NO: 420045 - DNA, 140 bp, Artificial Sequence
  Synthetic
atacgccatgctgggtctccatggatgtcaatccgactctactattcctaaaggtaccagcgcaaaatgctataagtaccactttcccttatactggtgatcccccatacagccatggaacgtacttgggagtcggccat

SEQ ID NO: 420046 - DNA, 140 bp, Artificial Sequence
  Synthetic
atggccgactcccaagtacgttccatggctgtatgggggatcaccagtataagggaaagtggtacttatagcattttgcgctggtacctttaggaatagtagagtcggattgacatccatggagacccagcatggcgtat

SEQ ID NO: 420047 - DNA, 140 bp, Artificial Sequence
  Synthetic
aggccctggctgctgatatgtataagtaccactttcccttatactggtgatcccccatacagccatggaacaggaacagggtataccatggacactgtcaataggacgcatcagtactcagaccttttgggacagcggtg

SEQ ID NO: 420048 - DNA, 140 bp, Artificial Sequence
  Synthetic
caccgctgtcccaaaaggtctgagtactgatgcgtcctattgacagtgtccatggtataccctgttcctgttccatggctgtatgggggatcaccagtataagggaaagtggtacttatacatatcagcagccagggcct

SEQ ID NO: 420049 - DNA, 140 bp, Artificial Sequence
  Synthetic
atacgccatgctgggtctccttaactagcaaaatgggaataataccactgatgactatactgctattagtaacaacaaacaatgcagataaaatatgcattggccatcaatcaacaaattcgtacttgggagtcggccat

SEQ ID NO: 420050 - DNA, 140 bp, Artificial Sequence
  Synthetic
atggccgactcccaagtacgaatttgttgattgatggccaatgcatattttatctgcattgtttgttgttactaatagcagtatagtcatcagtggtattattcccattttgctagttaaggagacccagcatggcgtat

SEQ ID NO: 420051 - DNA, 140 bp, Artificial Sequence
  Synthetic
aggccctggctgctgatatgaccggcttcgccgagatcagaaatccttgagaggaagaagcagcactcttggtctggacatcagaactgctactcgtgaaggaaagcatatagtggaacggaccttttgggacagcggtg

SEQ ID NO: 420052 - DNA, 140 bp, Artificial Sequence
  Synthetic
caccgctgtcccaaaaggtccgttccactatatgctttccttcacgagtagcagttctgatgtccagaccaagagtgctgcttcttcctctcaaggatttctgatctcggcgaagccggtcatatcagcagccagggcct

SEQ ID NO: 420053 - DNA, 140 bp, Artificial Sequence
  Synthetic
atacgccatgctgggtctccaaacagattgtgtcttagaggcaatggctttccttgaagaatcccacccagggatctttgaaacctcatgtattgaaacgatggaagttgttcagcaaaccgtacttgggagtcggccat

SEQ ID NO: 420054 - DNA, 140 bp, Artificial Sequence
  Synthetic
atggccgactcccaagtacggtttgctgaacaacttccatcgtttcaatacatgaggtttcaaagatccctgggtgggattcttcaaggaaagccattgcctctaagacacaatctgtttggagacccagcatggcgtat

SEQ ID NO: 420055 - DNA, 140 bp, Artificial Sequence
  Synthetic
aggccctggctgctgatatggggatctttgaaacctcatgtattgaaacgatggaagttgttcagcaaacacgagtggacaaactgacccaaggtcgacaaacatatgattggacattgagaccttttgggacagcggtg

SEQ ID NO: 420056 - DNA, 140 bp, Artificial Sequence
  Synthetic
caccgctgtcccaaaaggtctcaatgtccaatcatatgtttgtcgaccttgggtcagtttgtccactcgtgtttgctgaacaacttccatcgtttcaatacatgaggtttcaaagatccccatatcagcagccagggcct

SEQ ID NO: 420057 - DNA, 140 bp, Artificial Sequence
  Synthetic
aggccctggctgctgatatgtagaatggaccaagcagtagtggacaaaaccatcacattgaaagcaaatttcagtgtgattttcaatcggattgaagccctaatactacttagagcttttgaccttttgggacagcggtg

SEQ ID NO: 420058 - DNA, 140 bp, Artificial Sequence
  Synthetic
caccgctgtcccaaaaggtcaaaagctctaagtagtattagggcttcaatccgattgaaaatcacactgaaatttgctttcaatgtgatggttttgtccactactgcttggtccattctacatatcagcagccagggcct

SEQ ID NO: 420059 - DNA, 140 bp, Artificial Sequence
  Synthetic
atacgccatgctgggtctccagatcgaatggtctagctgctaatgaatcagggaggctaatagacttcctcaaagacgtgatggaatcaatggataaagaagaaatggaaataacaacaccgtacttgggagtcggccat

SEQ ID NO: 420060 - DNA, 140 bp, Artificial Sequence
  Synthetic
atggccgactcccaagtacggtgttgttatttccatttcttctttatccattgattccatcacgtctttgaggaagtctattagcctccctgattcattagcagctagaccattcgatctggagacccagcatggcgtat

SEQ ID NO: 420061 - DNA, 140 bp, Artificial Sequence
  Synthetic
aggccctggctgctgatatgcaaagacgtgatggaatcaatggataaagaagaaatggaaataacaacacatttccaaagaaaaaggagagttagagacaacatgaccaagaaaatgatcgaccttttgggacagcggtg

SEQ ID NO: 420062 - DNA, 140 bp, Artificial Sequence
  Synthetic
caccgctgtcccaaaaggtcgatcattttcttggtcatgttgtctctaactctcctttttctttggaaatgtgttgttatttccatttcttctttatccattgattccatcacgtctttgcatatcagcagccagggcct

SEQ ID NO: 420063 - DNA, 140 bp, Artificial Sequence
  Synthetic
atacgccatgctgggtctcctctaatacgagcattgacattgaacacaatgactaaagatgcggaaagaggcaaattgaagaggcgggcaattgcgacacccgggatgcagatcagaggtcgtacttgggagtcggccat

SEQ ID NO: 420064 - DNA, 140 bp, Artificial Sequence
  Synthetic
atggccgactcccaagtacgacctctgatctgcatcccgggtgtcgcaattgcccgcctcttcaatttgcctctttccgcatctttagtcattgtgttcaatgtcaatgctcgtattagaggagacccagcatggcgtat

SEQ ID NO: 420065 - DNA, 140 bp, Artificial Sequence
  Synthetic
aggccctggctgctgatatggtagaaacgggaaatggagagaacagctaagccagaagttcgaagaaataagatggttgattgaagaagtacgacatagattaaaaatcacggagaataggaccttttgggacagcggtg

SEQ ID NO: 420066 - DNA, 140 bp, Artificial Sequence
  Synthetic
caccgctgtcccaaaaggtcctattctccgtgatttttaatctatgtcgtacttcttcaatcaaccatcttatttcttcgaacttctggcttagctgttctctccatttcccgtttctaccatatcagcagccagggcct

SEQ ID NO: 420067 - DNA, 140 bp, Artificial Sequence
  Synthetic
atacgccatgctgggtctccacagtcaggactcccggttgggggaaatgagaaaaaggctaaattggcaaatgttgtaagaaaaatgatgactaattctcaagacacggaagtctctttccgtacttgggagtcggccat

SEQ ID NO: 420068 - DNA, 140 bp, Artificial Sequence
  Synthetic
atggccgactcccaagtacggaaagagacttccgtgtcttgagaattagtcatcatttttcttacaacatttgccaatttagcctttttctcatttcccccaaccgggagtcctgactgtggagacccagcatggcgtat

SEQ ID NO: 420069 - DNA, 140 bp, Artificial Sequence
  Synthetic
atacgccatgctgggtctcccgagcaatgatggatcaggtgagggaaagccggaatcctgggaatgctgaaattgaagatctcatcttccttgcacggtctgctctcattctgaggggatcgtacttgggagtcggccat

SEQ ID NO: 420070 - DNA, 140 bp, Artificial Sequence
  Synthetic
atggccgactcccaagtacgatcccctcagaatgagagcagaccgtgcaaggaagatgagatcttcaatttcagcattcccaggattccggctttccctcacctgatccatcattgctcgggagacccagcatggcgtat

SEQ ID NO: 420071 - DNA, 140 bp, Artificial Sequence
  Synthetic
aggccctggctgctgatatgttccactttattgatgaacggggcgaatcaataattgtagaatctggcgatccgaacgcattattgaaacacagatttgagataattgaagggagagaccgaccttttgggacagcggtg

SEQ ID NO: 420072 - DNA, 140 bp, Artificial Sequence
  Synthetic
caccgctgtcccaaaaggtcggtctctcccttcaattatctcaaatctgtgtttcaataatgcgttcggatcgccagattctacaattattgattcgccccgttcatcaataaagtggaacatatcagcagccagggcct

SEQ ID NO: 420073 - DNA, 140 bp, Artificial Sequence
  Synthetic
aggccctggctgctgatatggaaatgtcttgagtattgcccctataatgttctcaaacaaaatggcaagacttgggaagggatatatgttcgaaagtaagagcatgaagctacgaacacagaccttttgggacagcggtg

SEQ ID NO: 420074 - DNA, 140 bp, Artificial Sequence
  Synthetic
caccgctgtcccaaaaggtctgtgttcgtagcttcatgctcttactttcgaacatatatcccttcccaagtcttgccattttgtttgagaacattataggggcaatactcaagacatttccatatcagcagccagggcct

SEQ ID NO: 420075 - DNA, 140 bp, Artificial Sequence
  Synthetic
atacgccatgctgggtctcccaacaaggaagaaaatagagaacataagacccctcctaatagatggcacagcatcattgagtccaggaatgatgatgggcatgttcaacatgttgagtaccgtacttgggagtcggccat

SEQ ID NO: 420076 - DNA, 140 bp, Artificial Sequence
  Synthetic
atggccgactcccaagtacggtactcaacatgttgaacatgcccatcatcattcctggactcaatgatgctgtgccatctattaggaggggtcttatgttctctattttcttccttgttgggagacccagcatggcgtat

SEQ ID NO: 420077 - DNA, 140 bp, Artificial Sequence
  Synthetic
aggccctggctgctgatatggcatcattgagtccaggaatgatgatgggcatgttcaacatgttgagtacagtgttaggagtttcaatcttgaatcttgggcagaagagatacaccaagagaccttttgggacagcggtg

SEQ ID NO: 420078 - DNA, 140 bp, Artificial Sequence
  Synthetic
caccgctgtcccaaaaggtctcttggtgtatctcttctgcccaagattcaagattgaaactcctaacactgtactcaacatgttgaacatgcccatcatcattcctggactcaatgatgccatatcagcagccagggcct

SEQ ID NO: 420079 - DNA, 140 bp, Artificial Sequence
  Synthetic
atacgccatgctgggtctccaaaaggcagttgacaaaataacatccaaggtgaacaatatagtcgacaagatgaacaagcaatatgaaataattgatcatgaattcagtgaggttgaaaccgtacttgggagtcggccat

SEQ ID NO: 420080 - DNA, 140 bp, Artificial Sequence
  Synthetic
atggccgactcccaagtacggtttcaacctcactgaattcatgatcaattatttcatattgcttgttcatcttgtcgactatattgttcaccttggatgttattttgtcaactgccttttggagacccagcatggcgtat

SEQ ID NO: 420081 - DNA, 140 bp, Artificial Sequence
  Synthetic
aggccctggctgctgatatgtactgatccaaaatggaagattttgtgcgacaatgcttcaatccgatgattgtcgagcttgcggaaaaggcaatgaaagaatatggggaagacccgaaaagaccttttgggacagcggtg

SEQ ID NO: 420082 - DNA, 140 bp, Artificial Sequence
  Synthetic
caccgctgtcccaaaaggtcttttcgggtcttccccatattctttcattgccttttccgcaagctcgacaatcatcggattgaagcattgtcgcacaaaatcttccattttggatcagtacatatcagcagccagggcct

SEQ ID NO: 420083 - DNA, 140 bp, Artificial Sequence
  Synthetic
atacgccatgctgggtctcctgcagggcaaatcagcgtacagcccaccttctctgtgcagagaaacctcccattcgagagagcaaccattatggcggcatttacaggaaatactgagggtcgtacttgggagtcggccat

SEQ ID NO: 420084 - DNA, 140 bp, Artificial Sequence
  Synthetic
atggccgactcccaagtacgaccctcagtatttcctgtaaatgccgccataatggttgctctctcgaatgggaggtttctctgcacagagaaggtgggctgtacgctgatttgccctgcaggagacccagcatggcgtat

SEQ ID NO: 420085 - DNA, 140 bp, Artificial Sequence
  Synthetic
atacgccatgctgggtctccatggattcgaaccgaacggctgcattgagggcaagctttctcaaatgtcaaaagaagtgaacgccagaattgagccatttctgaagacaacaccacgccccgtacttgggagtcggccat

SEQ ID NO: 420086 - DNA, 140 bp, Artificial Sequence
  Synthetic
atggccgactcccaagtacggggcgtggtgttgtcttcagaaatggctcaattctggcgttcacttcttttgacatttgagaaagcttgccctcaatgcagccgttcggttcgaatccatggagacccagcatggcgtat

SEQ ID NO: 420087 - DNA, 140 bp, Artificial Sequence
  Synthetic
aggccctggctgctgatatgagcaaaagcaggtactgattcaaaatggaggactttgtgcgacaatgcttcaatccaatgatcgtcgagcttgcggaaaggacaatgaaagaatatgggggaccttttgggacagcggtg

SEQ ID NO: 420088 - DNA, 140 bp, Artificial Sequence
  Synthetic
caccgctgtcccaaaaggtcccccatattctttcattgtcctttccgcaagctcgacgatcattggattgaagcattgtcgcacaaagtcctccattttgaatcagtacctgcttttgctcatatcagcagccagggcct

SEQ ID NO: 420089 - DNA, 140 bp, Artificial Sequence
  Synthetic
aggccctggctgctgatatgtgatggatgccctcaaattaagcatcgaagacccgagccatgagggagaaggcataccactatatgatgcaatcaaatgtatgaagacatttttcggcttgaccttttgggacagcggtg

SEQ ID NO: 420090 - DNA, 140 bp, Artificial Sequence
  Synthetic
caccgctgtcccaaaaggtcaagccgaaaaatgtcttcatacatttgattgcatcatatagtggtatgccttctccctcatggctcgggtcttcgatgcttaatttgagggcatccatcacatatcagcagccagggcct

SEQ ID NO: 420091 - DNA, 140 bp, Artificial Sequence
  Synthetic
atacgccatgctgggtctccggcataccactatatgatgcaatcaaatgtatgaagacatttttcggcttgaaagagcccaacattgtaaaaccacatgaaaagggcataaaccccaattcgtacttgggagtcggccat

SEQ ID NO: 420092 - DNA, 140 bp, Artificial Sequence
  Synthetic
atggccgactcccaagtacgaattggggtttatgcccttttcatgtggttttacaatgttgggctctttcaagccgaaaaatgtcttcatacatttgattgcatcatatagtggtatgccggagacccagcatggcgtat

SEQ ID NO: 420093 - DNA, 140 bp, Artificial Sequence
  Synthetic
atacgccatgctgggtctccgaggctccctccccatataactcaaggtttgagtctgttgcttggtcagcaagtgcttgtcatgatggcattagttggttaacaatcggaatttctggcccgtacttgggagtcggccat

SEQ ID NO: 420094 - DNA, 140 bp, Artificial Sequence
  Synthetic
atggccgactcccaagtacgggccagaaattccgattgttaaccaactaatgccatcatgacaagcacttgctgaccaagcaacagactcaaaccttgagttatatggggagggagcctcggagacccagcatggcgtat

SEQ ID NO: 420095 - DNA, 140 bp, Artificial Sequence
  Synthetic
atacgccatgctgggtctccgctcaaaggcagggctgttggtttcagatggaggaccaaacctatataacatcagaaacctccacattcccgaagtctgtttgaagtgggagctaatggacgtacttgggagtcggccat

SEQ ID NO: 420096 - DNA, 140 bp, Artificial Sequence
  Synthetic
atggccgactcccaagtacgtccattagctcccacttcaaacagacttcgggaatgtggaggtttctgatgttatataggtttggtcctccatctgaaaccaacagccctgcctttgagcggagacccagcatggcgtat

SEQ ID NO: 420097 - DNA, 140 bp, Artificial Sequence
  Synthetic
aggccctggctgctgatatgatcagaaacctccacattcccgaagtctgtttgaagtgggagctaatggatgaggattatcaaggcaggctgtgcaaccctatgaaccctttcataagtcgaccttttgggacagcggtg

SEQ ID NO: 420098 - DNA, 140 bp, Artificial Sequence
  Synthetic
caccgctgtcccaaaaggtcgacttatgaaagggttcatagggttgcacagcctgccttgataatcctcatccattagctcccacttcaaacagacttcgggaatgtggaggtttctgatcatatcagcagccagggcct

SEQ ID NO: 420099 - DNA, 140 bp, Artificial Sequence
  Synthetic
atacgccatgctgggtctccccagccaaaagcatggaatacgacgctgttgcaactacacattcctggattcccaagaggaatcgttccattctcaataccagccaaagggggatacttgcgtacttgggagtcggccat

SEQ ID NO: 420100 - DNA, 140 bp, Artificial Sequence
  Synthetic
atggccgactcccaagtacgcaagtatccccctttggctggtattgagaatggaacgattcctcttgggaatccaggaatgtgtagttgcaacagcgtcgtattccatgcttttggctggggagacccagcatggcgtat

SEQ ID NO: 420101 - DNA, 140 bp, Artificial Sequence
  Synthetic
atacgccatgctgggtctccaggatgaacagatgtatcaaaaatgctgcaatctattcgaaaaattcttccctagcagttcgtacaggaggccagttggaatctccagcatggtagaggccgtacttgggagtcggccat

SEQ ID NO: 420102 - DNA, 140 bp, Artificial Sequence
  Synthetic
atggccgactcccaagtacggcctctaccatgctggagattccaactggcctcctgtacgaactgctagggaagaatttttcgaatagattgcagcatttttgatacatctgttcatcctggagacccagcatggcgtat

SEQ ID NO: 420103 - DNA, 140 bp, Artificial Sequence
  Synthetic
aggccctggctgctgatatgaggaatgggccgacaacaagtacagtccattatccaaaagtttacaaaacatattttgagaggatggagaggttgaaacatggaaccttcggtcccgttcgaccttttgggacagcggtg

SEQ ID NO: 420104 - DNA, 140 bp, Artificial Sequence
  Synthetic
caccgctgtcccaaaaggtcgaacgggaccgaaggttccatgtttcaacctctccatcctctcaaaatatgttttgtaaacttttggataatggactgtacttgttgtcggcccattcctcatatcagcagccagggcct

SEQ ID NO: 420105 - DNA, 140 bp, Artificial Sequence
  Synthetic
aggccctggctgctgatatgcaatgataagcaagtgcagaaccaaagaaggaagacggaagacaaatctatatggattcattataaaaggaagatcccatttgaggaatgacactgatgtgaccttttgggacagcggtg

SEQ ID NO: 420106 - DNA, 140 bp, Artificial Sequence
  Synthetic
caccgctgtcccaaaaggtcacatcagtgtcattcctcaaatgggatcttccttttataatgaatccatatagatttgtcttccgtcttccttctttggttctgcacttgcttatcattgcatatcagcagccagggcct

SEQ ID NO: 420107 - DNA, 140 bp, Artificial Sequence
  Synthetic
aggccctggctgctgatatgctgcacactaatagatgctctattgggagaccctcagtgtgatggcttccaaaataagaaatgggacctttttgttgaacgaagcaaagcctacagcaacgaccttttgggacagcggtg

SEQ ID NO: 420108 - DNA, 140 bp, Artificial Sequence
  Synthetic
caccgctgtcccaaaaggtcgttgctgtaggctttgcttcgttcaacaaaaaggtcccatttcttattttggaagccatcacactgagggtctcccaatagagcatctattagtgtgcagcatatcagcagccagggcct

SEQ ID NO: 420109 - DNA, 140 bp, Artificial Sequence
  Synthetic
atacgccatgctgggtctcctttgctgagatcatgaagatctgttccgccattgaagagctcagacggcaaaaataatgaatttggcttgttcttcatgaaaaaatgccttgtttctactcgtacttgggagtcggccat

SEQ ID NO: 420110 - DNA, 140 bp, Artificial Sequence
  Synthetic
atggccgactcccaagtacgagtagaaacaaggcattttttcatgaagaacaagccaaattcattatttttgccgtctgagctcttcaatggcggaacagatcttcatgatctcagcaaaggagacccagcatggcgtat

SEQ ID NO: 420111 - DNA, 140 bp, Artificial Sequence
  Synthetic
atacgccatgctgggtctccaaatgcaattggggtcctcatcggaggacttgaatggaatgataacacagttcgagtctctgaaactctacagagattcgcttggagaagcagtaatgagcgtacttgggagtcggccat

SEQ ID NO: 420112 - DNA, 140 bp, Artificial Sequence
  Synthetic
atggccgactcccaagtacgctcattactgcttctccaagcgaatctctgtagagtttcagagactcgaactgtgttatcattccattcaagtcctccgatgaggaccccaattgcatttggagacccagcatggcgtat

SEQ ID NO: 420113 - DNA, 140 bp, Artificial Sequence
  Synthetic
atacgccatgctgggtctccgcaaaacaaacgatgctggctcagaccgagtgatggtatcacctctggctgtgacatggtggaataggaatggaccaacaactagtacagttcattatcccgtacttgggagtcggccat

SEQ ID NO: 420114 - DNA, 140 bp, Artificial Sequence
  Synthetic
atggccgactcccaagtacgggataatgaactgtactagttgttggtccattcctattccaccatgtcacagccagaggtgataccatcactcggtctgagccagcatcgtttgttttgcggagacccagcatggcgtat

SEQ ID NO: 420115 - DNA, 140 bp, Artificial Sequence
  Synthetic
atacgccatgctgggtctccttaatggttgcgtacatgttggaaagagaactggtccgcaagactcgatttctaccggtagcaggaggaacgagcagtgtttatattgaagtattgcattcgtacttgggagtcggccat

SEQ ID NO: 420116 - DNA, 140 bp, Artificial Sequence
  Synthetic
atggccgactcccaagtacgaatgcaatacttcaatataaacactgctcgttcctcctgctaccggtagaaatcgagtcttgcggaccagttctctttccaacatgtacgcaaccattaaggagacccagcatggcgtat

SEQ ID NO: 420117 - DNA, 140 bp, Artificial Sequence
  Synthetic
atacgccatgctgggtctcctaagcatctattggacaatagtaaaaccgggagacatacttttgattaacagcacagggaatctaattgctcctaggggttacttcaaaatacaaagtggcgtacttgggagtcggccat

SEQ ID NO: 420118 - DNA, 140 bp, Artificial Sequence
  Synthetic
atggccgactcccaagtacgccactttgtattttgaagtaacccctaggagcaattagattccctgtgctgttaatcaaaagtatgtctcccggttttactattgtccaatagatgcttaggagacccagcatggcgtat

SEQ ID NO: 420119 - DNA, 140 bp, Artificial Sequence
  Synthetic
aggccctggctgctgatatgtataagtaccacattcccttatactggagatcccccatacagccatggaaccggaacaggatacaccatggacactgtcaatagaacacaccaatactcagaccttttgggacagcggtg

SEQ ID NO: 420120 - DNA, 140 bp, Artificial Sequence
  Synthetic
caccgctgtcccaaaaggtctgagtattggtgtgttctattgacagtgtccatggtgtatcctgttccggttccatggctgtatgggggatctccagtataagggaatgtggtacttatacatatcagcagccagggcct

SEQ ID NO: 420121 - DNA, 140 bp, Artificial Sequence
  Synthetic
atacgccatgctgggtctccccggaacaggatacaccatggacactgtcaatagaacacaccaatactcagagaaagggaagtggacaacaaacacagagactggagcacctcaactcaacgtacttgggagtcggccat

SEQ ID NO: 420122 - DNA, 140 bp, Artificial Sequence
  Synthetic
atggccgactcccaagtacgttgagttgaggtgctccagtctctgtgtttgttgtccacttccctttctctgagtattggtgtgttctattgacagtgtccatggtgtatcctgttccggggagacccagcatggcgtat

SEQ ID NO: 420123 - DNA, 140 bp, Artificial Sequence
  Synthetic
atacgccatgctgggtctcctagaagagcaaccgtttcagcggatccattagcatcacttctcgaaatgtgccatagcactcaaattggcggaataaggatggtagacatccttagacaacgtacttgggagtcggccat

SEQ ID NO: 420124 - DNA, 140 bp, Artificial Sequence
  Synthetic
atggccgactcccaagtacgttgtctaaggatgtctaccatccttattccgccaatttgagtgctatggcacatttcgagaagtgatgctaatggatccgctgaaacggttgctcttctaggagacccagcatggcgtat

SEQ ID NO: 420125 - DNA, 140 bp, Artificial Sequence
  Synthetic
atacgccatgctgggtctcctgcatgtgtaaatggttcttgctttaccgtaatgacagacgggccaagtaatggacaggcgtcatacaagatcttcaagatagaaaaagggaaagtagttcgtacttgggagtcggccat

SEQ ID NO: 420126 - DNA, 140 bp, Artificial Sequence
  Synthetic
atggccgactcccaagtacgaactactttccctttttctatcttgaagatcttgtatgacgcctgtccattacttggcccgtctgtcattacggtaaagcaagaaccatttacacatgcaggagacccagcatggcgtat

SEQ ID NO: 420127 - DNA, 140 bp, Artificial Sequence
  Synthetic
atacgccatgctgggtctccaaacagattgtgttttggaagctatggctttccttgaggagtcccacccagggatctttgacaattcatgtcttgaaacaatggaagttgttcagcaaaccgtacttgggagtcggccat

SEQ ID NO: 420128 - DNA, 140 bp, Artificial Sequence
  Synthetic
atggccgactcccaagtacggtttgctgaacaacttccattgtttcaagacatgaattgtcaaagatccctgggtgggactcctcaaggaaagccatagcttccaaaacacaatctgtttggagacccagcatggcgtat

SEQ ID NO: 420129 - DNA, 140 bp, Artificial Sequence
  Synthetic
aggccctggctgctgatatggggatctttgacaattcatgtcttgaaacaatggaagttgttcagcaaacaagagtggacaaactgactcaaggacgccagacctatgactggacactgagaccttttgggacagcggtg

SEQ ID NO: 420130 - DNA, 140 bp, Artificial Sequence
  Synthetic
caccgctgtcccaaaaggtctcagtgtccagtcataggtctggcgtccttgagtcagtttgtccactcttgtttgctgaacaacttccattgtttcaagacatgaattgtcaaagatccccatatcagcagccagggcct

SEQ ID NO: 420131 - DNA, 140 bp, Artificial Sequence
  Synthetic
atacgccatgctgggtctccgtgggtcatctaccaaaagagaagaagaagtgctcacgggtaacctccaaacattgaaaatacgagtacatgaagggtatgaggaattcacgatggttggcgtacttgggagtcggccat

SEQ ID NO: 420132 - DNA, 140 bp, Artificial Sequence
  Synthetic
atggccgactcccaagtacgccaaccatcgtgaattcctcatacccttcatgtactcgtattttcaatgtttggaggttacccgtgagcacttcttcttctcttttggtagatgacccacggagacccagcatggcgtat

SEQ ID NO: 420133 - DNA, 140 bp, Artificial Sequence
  Synthetic
aggccctggctgctgatatgttgacctgaaatacttcaacaaatcaacaagagagaaaatcgagaaaataagacctctactgatagatggcacagcctcattgagtcctggaatgatgatgaccttttgggacagcggtg

SEQ ID NO: 420134 - DNA, 140 bp, Artificial Sequence
  Synthetic
caccgctgtcccaaaaggtcatcatcattccaggactcaatgaggctgtgccatctatcagtagaggtcttattttctcgattttctctcttgttgatttgttgaagtatttcaggtcaacatatcagcagccagggcct

SEQ ID NO: 420135 - DNA, 140 bp, Artificial Sequence
  Synthetic
atacgccatgctgggtctccaggtcgaacggcctaacagccaatgaatcggggaggttaatagatttcctcaaggatgtaatggaatcaatggacaaagaagaaatagaaataacaacaccgtacttgggagtcggccat

SEQ ID NO: 420136 - DNA, 140 bp, Artificial Sequence
  Synthetic
atggccgactcccaagtacggtgttgttatttctatttcttctttgtccattgattccattacatccttgaggaaatctattaacctccccgattcattggctgttaggccgttcgacctggagacccagcatggcgtat

SEQ ID NO: 420137 - DNA, 140 bp, Artificial Sequence
  Synthetic
aggccctggctgctgatatgcaaggatgtaatggaatcaatggacaaagaagaaatagaaataacaacacatttccagagaaagagaagagtaagggacaacatgaccaagaaaatgatcgaccttttgggacagcggtg

SEQ ID NO: 420138 - DNA, 140 bp, Artificial Sequence
  Synthetic
caccgctgtcccaaaaggtcgatcattttcttggtcatgttgtcccttactcttctctttctctggaaatgtgttgttatttctatttcttctttgtccattgattccattacatccttgcatatcagcagccagggcct

SEQ ID NO: 420139 - DNA, 140 bp, Artificial Sequence
  Synthetic
atacgccatgctgggtctcccctcgatatcctggtgtcagatgtgtctgcagagacaactggaaaggctccaatcggcccatcgtagatataaacataaaggatcatagcattgtttccacgtacttgggagtcggccat

SEQ ID NO: 420140 - DNA, 140 bp, Artificial Sequence
  Synthetic
atggccgactcccaagtacgtggaaacaatgctatgatcctttatgtttatatctacgatgggccgattggagcctttccagttgtctctgcagacacatctgacaccaggatatcgaggggagacccagcatggcgtat

SEQ ID NO: 420141 - DNA, 140 bp, Artificial Sequence
  Synthetic
atacgccatgctgggtctccttcagcaaacaagagtggataaactgacccaaggccgccagacctatgactggacattgaatagaaatcagccggctgctactgcattggccaacactatcgtacttgggagtcggccat

SEQ ID NO: 420142 - DNA, 140 bp, Artificial Sequence
  Synthetic
atggccgactcccaagtacgatagtgttggccaatgcagtagcagccggctgatttctattcaatgtccagtcataggtctggcggccttgggtcagtttatccactcttgtttgctgaaggagacccagcatggcgtat

SEQ ID NO: 420143 - DNA, 140 bp, Artificial Sequence
  Synthetic
atacgccatgctgggtctccattaagaatggatgcacgattagattatgaatcagggagaatgtcaaaggatgattttgagaaagcaatggctcaccttggtgagattgggtacatataacgtacttgggagtcggccat

SEQ ID NO: 420144 - DNA, 140 bp, Artificial Sequence
  Synthetic
atggccgactcccaagtacgttatatgtacccaatctcaccaaggtgagccattgctttctcaaaatcatcctttgacattctccctgattcataatctaatcgtgcatccattcttaatggagacccagcatggcgtat

SEQ ID NO: 420145 - DNA, 140 bp, Artificial Sequence
  Synthetic
atacgccatgctgggtctccgacccccaacacagagatgtcactgagaggaataagggtcagtaaaatgggggtagatgagtattccagcactgagagagtggttgtaagcatcgatcgccgtacttgggagtcggccat

SEQ ID NO: 420146 - DNA, 140 bp, Artificial Sequence
  Synthetic
atggccgactcccaagtacggcgatcgatgcttacaaccactctctcagtgctggaatactcatctacccccattttactgacccttattcctctcagtgacatctctgtgttgggggtcggagacccagcatggcgtat

SEQ ID NO: 420147 - DNA, 140 bp, Artificial Sequence
  Synthetic
aggccctggctgctgatatggggtagatgagtattccagcactgagagagtggttgtaagcatcgatcgcttcttgagagttcgagaccagcgggggaatgttctcttgtctcctgaggagaccttttgggacagcggtg

SEQ ID NO: 420148 - DNA, 140 bp, Artificial Sequence
  Synthetic
caccgctgtcccaaaaggtctcctcaggagacaagagaacattcccccgctggtctcgaactctcaagaagcgatcgatgcttacaaccactctctcagtgctggaatactcatctaccccatatcagcagccagggcct

SEQ ID NO: 420149 - DNA, 140 bp, Artificial Sequence
  Synthetic
atacgccatgctgggtctccatgtcgtaagaaagatgatgactaattcacaagatacagagctctcctttacaatcactggggacaataccaaatggaatgagaatcagaatcctcgtgtcgtacttgggagtcggccat

SEQ ID NO: 420150 - DNA, 140 bp, Artificial Sequence
  Synthetic
atggccgactcccaagtacgacacgaggattctgattctcattccatttggtattgtccccagtgattgtaaaggagagctctgtatcttgtgaattagtcatcatctttcttacgacatggagacccagcatggcgtat

SEQ ID NO: 420151 - DNA, 140 bp, Artificial Sequence
  Synthetic
aggccctggctgctgatatgtgttttttgctttgtgttgctttgttggggttcatcatgtgggcctgccaaaaaggcaacattaggtgcaacatttgcatttgagtgcattaattaaaaagaccttttgggacagcggtg

SEQ ID NO: 420152 - DNA, 140 bp, Artificial Sequence
  Synthetic
caccgctgtcccaaaaggtctttttaattaatgcactcaaatgcaaatgttgcacctaatgttgcctttttggcaggcccacatgatgaaccccaacaaagcaacacaaagcaaaaaacacatatcagcagccagggcct

SEQ ID NO: 420153 - DNA, 140 bp, Artificial Sequence
  Synthetic
atacgccatgctgggtctccatggattccaacactgtgtcaagtttccaggtagattgctttctttggcatatccggaaacaagttgtagaccaagaactgagtgatgccccattccttgcgtacttgggagtcggccat

SEQ ID NO: 420154 - DNA, 140 bp, Artificial Sequence
  Synthetic
atggccgactcccaagtacgcaaggaatggggcatcactcagttcttggtctacaacttgtttccggatatgccaaagaaagcaatctacctggaaacttgacacagtgttggaatccatggagacccagcatggcgtat

SEQ ID NO: 420155 - DNA, 140 bp, Artificial Sequence
  Synthetic
aggccctggctgctgatatgaagttcacatatactacctagaaaaagcaaataagataaaatcagagaggacacatattcacatattctcattcactggagaggaaatggccaccaaagcgaccttttgggacagcggtg

SEQ ID NO: 420156 - DNA, 140 bp, Artificial Sequence
  Synthetic
caccgctgtcccaaaaggtcgctttggtggccatttcctctccagtgaatgagaatatgtgaatatgtgtcctctctgattttatcttatttgctttttctaggtagtatatgtgaacttcatatcagcagccagggcct

SEQ ID NO: 420157 - DNA, 140 bp, Artificial Sequence
  Synthetic
atacgccatgctgggtctccttagggaaagggtacatgtttgagagtaaaagcatgaagctgcggacgcaaataccagcagaaatgcttgcaaatattgacctgaaatacttcaacgaatcgtacttgggagtcggccat

SEQ ID NO: 420158 - DNA, 140 bp, Artificial Sequence
  Synthetic
atggccgactcccaagtacgattcgttgaagtatttcaggtcaatatttgcaagcatttctgctggtatttgcgtccgcagcttcatgcttttactctcaaacatgtaccctttccctaaggagacccagcatggcgtat

SEQ ID NO: 420159 - DNA, 140 bp, Artificial Sequence
  Synthetic
aggccctggctgctgatatgaataccagcagaaatgcttgcaaatattgacctgaaatacttcaacgaatcaacaaagaagaaaatcgagaaaataaggcctctcttaatagatggcacagaccttttgggacagcggtg

SEQ ID NO: 420160 - DNA, 140 bp, Artificial Sequence
  Synthetic
caccgctgtcccaaaaggtctgtgccatctattaagagaggccttattttctcgattttcttctttgttgattcgttgaagtatttcaggtcaatatttgcaagcatttctgctggtattcatatcagcagccagggcct

SEQ ID NO: 420161 - DNA, 140 bp, Artificial Sequence
  Synthetic
atacgccatgctgggtctcccagcagatgcgtgacgtactggggacatttgacactgtccaaataataaagctattaccatttgcagcagccccgccggagcagagtaggatgcagttctcgtacttgggagtcggccat

SEQ ID NO: 420162 - DNA, 140 bp, Artificial Sequence
  Synthetic
atggccgactcccaagtacgagaactgcatcctactctgctccggcggggctgctgcaaatggtaatagctttattatttggacagtgtcaaatgtccccagtacgtcacgcatctgctgggagacccagcatggcgtat

SEQ ID NO: 420163 - DNA, 140 bp, Artificial Sequence
  Synthetic
atacgccatgctgggtctccagtcttaggagtctcagttctgaatcttggacagaagaagtacaccaaaaccacatactggtgggacggactccagtcctctgatgatttcgctctcatacgtacttgggagtcggccat

SEQ ID NO: 420164 - DNA, 140 bp, Artificial Sequence
  Synthetic
atggccgactcccaagtacgtatgagagcgaaatcatcagaggactggagtccgtcccaccagtatgtggttttggtgtacttcttctgtccaagattcagaactgagactcctaagactggagacccagcatggcgtat

SEQ ID NO: 420165 - DNA, 140 bp, Artificial Sequence
  Synthetic
aggccctggctgctgatatgccacatactggtgggacggactccagtcctctgatgatttcgctctcatagtgaatgccccgaatcatgagggaatacaagcaggagtgaatagattctagaccttttgggacagcggtg

SEQ ID NO: 420166 - DNA, 140 bp, Artificial Sequence
  Synthetic
caccgctgtcccaaaaggtctagaatctattcactcctgcttgtattccctcatgattcggggcattcactatgagagcgaaatcatcagaggactggagtccgtcccaccagtatgtggcatatcagcagccagggcct

SEQ ID NO: 420167 - DNA, 140 bp, Artificial Sequence
  Synthetic
atacgccatgctgggtctcctttcttgtgaacttcaagtaccagtaaaagaactgaaaatcaaaatgtccaacatggatattgacggtatcaacactgggacaattgacaaaacaccggacgtacttgggagtcggccat

SEQ ID NO: 420168 - DNA, 140 bp, Artificial Sequence
  Synthetic
atggccgactcccaagtacgtccggtgttttgtcaattgtcccagtgttgataccgtcaatatccatgttggacattttgattttcagttcttttactggtacttgaagttcacaagaaaggagacccagcatggcgtat

SEQ ID NO: 420169 - DNA, 140 bp, Artificial Sequence
  Synthetic
atacgccatgctgggtctcccgggagtggaatctgcagtattaagagggtttctaattctaggcaaagaggacaaaagatacggcccagcattgagcatcaatgaactgagcaaccttgccgtacttgggagtcggccat

SEQ ID NO: 420170 - DNA, 140 bp, Artificial Sequence
  Synthetic
atggccgactcccaagtacggcaaggttgctcagttcattgatgctcaatgctgggccgtatcttttgtcctctttgcctagaattagaaaccctcttaatactgcagattccactcccgggagacccagcatggcgtat

SEQ ID NO: 420171 - DNA, 140 bp, Artificial Sequence
  Synthetic
atacgccatgctgggtctcctaaatcggacaggaacatttgagtttacaagctttttctaccgctatgggtttgtggccaatttcagtatggagctgcccagctttggagtgtctggggtcgtacttgggagtcggccat

SEQ ID NO: 420172 - DNA, 140 bp, Artificial Sequence
  Synthetic
atggccgactcccaagtacgaccccagacactccaaagctgggcagctccatactgaaattggccacaaacccatagcggtagaaaaagcttgtaaactcaaatgttcctgtccgatttaggagacccagcatggcgtat

SEQ ID NO: 420173 - DNA, 140 bp, Artificial Sequence
  Synthetic
aggccctggctgctgatatgtttgtggccaatttcagtatggagctgcccagctttggagtgtctggggttaacgaatcggctgacatgagcattggagttacagtgataaagaataatagaccttttgggacagcggtg

SEQ ID NO: 420174 - DNA, 140 bp, Artificial Sequence
  Synthetic
caccgctgtcccaaaaggtctattattctttatcactgtaactccaatgctcatgtcagccgattcgttaaccccagacactccaaagctgggcagctccatactgaaattggccacaaacatatcagcagccagggcct

SEQ ID NO: 420175 - DNA, 140 bp, Artificial Sequence
  Synthetic
aggccctggctgctgatatgatggaagactttgtgcgacaatgcttcaatccaatgatcgtcgagcttgcggaaaaggcaatgaaagaatatggggaagattcgaaaatcgaaaccaacagaccttttgggacagcggtg

SEQ ID NO: 420176 - DNA, 140 bp, Artificial Sequence
  Synthetic
caccgctgtcccaaaaggtctgttggtttcgattttcgaatcttccccatattctttcattgccttttccgcaagctcgacgatcattggattgaagcattgtcgcacaaagtcttccatcatatcagcagccagggcct

SEQ ID NO: 420177 - DNA, 140 bp, Artificial Sequence
  Synthetic
atacgccatgctgggtctccatgagtcttctaaccgaggtcgaaacgtacgttctctctatcatcccgtcaggccccctcaaagccgagatagcacaaaaacttgaagatgtttttgcagcgtacttgggagtcggccat

SEQ ID NO: 420178 - DNA, 140 bp, Artificial Sequence
  Synthetic
atggccgactcccaagtacgctgcaaaaacatcttcaagtttttgtgctatctcggctttgagggggcctgacgggatgatagagagaacgtacgtttcgacctcggttagaagactcatggagacccagcatggcgtat

SEQ ID NO: 420179 - DNA, 140 bp, Artificial Sequence
  Synthetic
atacgccatgctgggtctcctttatcaaggactatagatacacatatcggtgccacaggggtgatacacaaattcaaacaaggagatcatttgagataaagaagttgtgggagcagaccccgtacttgggagtcggccat

SEQ ID NO: 420180 - DNA, 140 bp, Artificial Sequence
  Synthetic
atggccgactcccaagtacggggtctgctcccacaacttctttatctcaaatgatctccttgtttgaatttgtgtatcacccctgtggcaccgatatgtgtatctatagtccttgataaaggagacccagcatggcgtat

SEQ ID NO: 420181 - DNA, 140 bp, Artificial Sequence
  Synthetic
aggccctggctgctgatatgttccatttcattgacgaacagggtgaatcaatcattgtagaatctggtgatccaaatgcattgctgaagcaccgatttgagataattgaaggaagagacagaccttttgggacagcggtg

SEQ ID NO: 420182 - DNA, 140 bp, Artificial Sequence
  Synthetic
caccgctgtcccaaaaggtctgtctcttccttcaattatctcaaatcggtgcttcagcaatgcatttggatcaccagattctacaatgattgattcaccctgttcgtcaatgaaatggaacatatcagcagccagggcct

SEQ ID NO: 420183 - DNA, 140 bp, Artificial Sequence
  Synthetic
atacgccatgctgggtctcctccaaatgcattgctgaagcaccgatttgagataattgaaggaagagacaggactatggcctggacagtagtgaacagtatctgcaacaccacaggggtacgtacttgggagtcggccat

SEQ ID NO: 420184 - DNA, 140 bp, Artificial Sequence
  Synthetic
atggccgactcccaagtacgtacccctgtggtgttgcagatactgttcactactgtccaggccatagtcctgtctcttccttcaattatctcaaatcggtgcttcagcaatgcatttggaggagacccagcatggcgtat

SEQ ID NO: 420185 - DNA, 140 bp, Artificial Sequence
  Synthetic
atacgccatgctgggtctcccgtgcccagcgagcgaggactgcagcgtagacgctttgtccaaaatgccctaaatgggaacggagacccaaacaacatggacagagcggtaaagctttaccgtacttgggagtcggccat

SEQ ID NO: 420186 - DNA, 140 bp, Artificial Sequence
  Synthetic
atggccgactcccaagtacggtaaagctttaccgctctgtccatgttgtttgggtctccgttcccatttagggcattttggacaaagcgtctacgctgcagtcctcgctcgctgggcacgggagacccagcatggcgtat

SEQ ID NO: 420187 - DNA, 140 bp, Artificial Sequence
  Synthetic
atacgccatgctgggtctcccgaagattaccagggtaggctgtgtaatcctctgaatccgtttgtcagccataaggaaattgagtccttaaacaatgctgtagtaatgccagcccatggtcgtacttgggagtcggccat

SEQ ID NO: 420188 - DNA, 140 bp, Artificial Sequence
  Synthetic
atggccgactcccaagtacgaccatgggctggcattactacagcattgtttaaggactcaatttccttatggctgacaaacggattcagaggattacacagcctaccctggtaatcttcgggagacccagcatggcgtat

SEQ ID NO: 420189 - DNA, 140 bp, Artificial Sequence
  Synthetic
atacgccatgctgggtctcccgttgaaattggagtgacacgaagggaggtccacatatactacctagagaaagccaacaaaataaaatccgagaagacacacattcatattttttcattccgtacttgggagtcggccat

SEQ ID NO: 420190 - DNA, 140 bp, Artificial Sequence
  Synthetic
atggccgactcccaagtacggaatgaaaaaatatgaatgtgtgtcttctcggattttattttgttggctttctctaggtagtatatgtggacctcccttcgtgtcactccaatttcaacgggagacccagcatggcgtat

SEQ ID NO: 420191 - DNA, 140 bp, Artificial Sequence
  Synthetic
atacgccatgctgggtctccccctaaaagaaaccgttccattctcaataccagtcaaagaggaattcttgaggatgaacaaatgtaccaaaagtgctgcaatctattcgagaaattcttccgtacttgggagtcggccat

SEQ ID NO: 420192 - DNA, 140 bp, Artificial Sequence
  Synthetic
atggccgactcccaagtacggaagaatttctcgaatagattgcagcacttttggtacatttgttcatcctcaagaattcctctttgactggtattgagaatggaacggtttcttttagggggagacccagcatggcgtat

SEQ ID NO: 420193 - DNA, 140 bp, Artificial Sequence
  Synthetic
aggccctggctgctgatatgtcgaaccatggcctggacagtggtgaatagtatctgcaacaccacaggagtagagaagcctaaatttcttccggatctgtatgattacaaggagaaccgagaccttttgggacagcggtg

SEQ ID NO: 420194 - DNA, 140 bp, Artificial Sequence
  Synthetic
caccgctgtcccaaaaggtctcggttctccttgtaatcatacagatccggaagaaatttaggcttctctactcctgtggtgttgcagatactattcaccactgtccaggccatggttcgacatatcagcagccagggcct

SEQ ID NO: 420195 - DNA, 140 bp, Artificial Sequence
  Synthetic
aggccctggctgctgatatgtggaattgctagcttgatattacaaattgggaacataatctcaatatggattagccattcaattcaaattgggaaccaaaaccagaccgaaacatgcaatgaccttttgggacagcggtg

SEQ ID NO: 420196 - DNA, 140 bp, Artificial Sequence
  Synthetic
caccgctgtcccaaaaggtcattgcatgtttcggtctggttttggttcccaatttgaattgaatggctaatccatattgagattatgttcccaatttgtaatatcaagctagcaattccacatatcagcagccagggcct

SEQ ID NO: 420197 - DNA, 140 bp, Artificial Sequence
  Synthetic
aggccctggctgctgatatgcatggtgtctagggcccgaattgatgcacgaattgatttcgagtctggaaggattaagaaagaagagtttgctgagatcatgaagatctgttccaccattgaccttttgggacagcggtg

SEQ ID NO: 420198 - DNA, 140 bp, Artificial Sequence
  Synthetic
caccgctgtcccaaaaggtcaatggtggaacagatcttcatgatctcagcaaactcttctttcttaatccttccagactcgaaatcaattcgtgcatcaattcgggccctagacaccatgcatatcagcagccagggcct

SEQ ID NO: 420199 - DNA, 140 bp, Artificial Sequence
  Synthetic
aggccctggctgctgatatgtgcacgaattgatttcgagtctggaaggattaagaaagaagagtttgctgagatcatgaagatctgttccaccattgaagagctcagacggcaaaaataggaccttttgggacagcggtg

SEQ ID NO: 420200 - DNA, 140 bp, Artificial Sequence
  Synthetic
caccgctgtcccaaaaggtcctatttttgccgtctgagctcttcaatggtggaacagatcttcatgatctcagcaaactcttctttcttaatccttccagactcgaaatcaattcgtgcacatatcagcagccagggcct

SEQ ID NO: 420201 - DNA, 140 bp, Artificial Sequence
  Synthetic
  misc_feature (30)..(30): n is a, c, g, or t
aggccctggctgctgatatgatggagagantaaaagaattaagagacctaatgtcgcagtcccgcactcgcgagatactaacaagaaccactgtggaccatatggccataatcaagaagtgaccttttgggacagcggtg

SEQ ID NO: 420202 - DNA, 140 bp, Artificial Sequence
  Synthetic
  misc_feature (111)..(111): n is a, c, g, or t
caccgctgtcccaaaaggtcacttcttgattatggccatatggtccacagtggttcttgttagtatctcgcgagtgcgggactgcgacattaggtctcttaattcttttantctctccatcatatcagcagccagggcct

SEQ ID NO: 420203 - DNA, 140 bp, Artificial Sequence
  Synthetic
atacgccatgctgggtctccactaattccagaagtggctttgaaatgatttgggatccgaatgggtggaccgaaactgacagtagcttttcagtgaagcaagatatcatagctataactgcgtacttgggagtcggccat

SEQ ID NO: 420204 - DNA, 140 bp, Artificial Sequence
  Synthetic
atggccgactcccaagtacgcagttatagctatgatatcttgcttcactgaaaagctactgtcagtttcggtccacccattcggatcccaaatcatttcaaagccacttctggaattagtggagacccagcatggcgtat

SEQ ID NO: 420205 - DNA, 140 bp, Artificial Sequence
  Synthetic
aggccctggctgctgatatggacaggggtacctgagtctatgagggaagaataccggcaggaacagcagaatgctgtggatgttgacgacggtcattttgtcaacatagagttggagtaagaccttttgggacagcggtg

SEQ ID NO: 420206 - DNA, 140 bp, Artificial Sequence
  Synthetic
caccgctgtcccaaaaggtcttactccaactctatgttgacaaaatgaccgtcgtcaacatccacagcattctgctgttcctgccggtattcttccctcatagactcaggtacccctgtccatatcagcagccagggcct

SEQ ID NO: 420207 - DNA, 140 bp, Artificial Sequence
  Synthetic
aggccctggctgctgatatgagaaatgggccaacgacaagtacagtccattacccaaaggtttacaaaacatactttgagaaggttgaaaggttaaaacatggaaccttcggtcctgtccgaccttttgggacagcggtg

SEQ ID NO: 420208 - DNA, 140 bp, Artificial Sequence
  Synthetic
caccgctgtcccaaaaggtcggacaggaccgaaggttccatgttttaacctttcaaccttctcaaagtatgttttgtaaacctttgggtaatggactgtacttgtcgttggcccatttctcatatcagcagccagggcct

SEQ ID NO: 420209 - DNA, 140 bp, Artificial Sequence
  Synthetic
atacgccatgctgggtctccttattcatggcaaagttgagaacagtaacggtggaattgcaccaaccaccacacctcatctgatccacaattgcagcgatactgtcataacaaacaacaacgtacttgggagtcggccat

SEQ ID NO: 420210 - DNA, 140 bp, Artificial Sequence
  Synthetic
atggccgactcccaagtacgttgttgtttgttatgacagtatcgctgcaattgtggatcagatgaggtgtggtggttggtgcaattccaccgttactgttctcaactttgccatgaataaggagacccagcatggcgtat

SEQ ID NO: 420211 - DNA, 140 bp, Artificial Sequence
  Synthetic
aggccctggctgctgatatgcagaacctgcaagctggtcggaatcaacatgagcaaaaagaagtcctacataaacaggacaggaacatttgaattcacaagttttttctaccgctatggagaccttttgggacagcggtg

SEQ ID NO: 420212 - DNA, 140 bp, Artificial Sequence
  Synthetic
caccgctgtcccaaaaggtctccatagcggtagaaaaaacttgtgaattcaaatgttcctgtcctgtttatgtaggacttctttttgctcatgttgattccgaccagcttgcaggttctgcatatcagcagccagggcct

SEQ ID NO: 420213 - DNA, 140 bp, Artificial Sequence
  Synthetic
aggccctggctgctgatatgcacgcagatctcagtgctaaggaggcacaagatgtcatcatggaggtcgttttcccaaatgaagtgggagctagaatattgacatcagagtctcaattgagaccttttgggacagcggtg

SEQ ID NO: 420214 - DNA, 140 bp, Artificial Sequence
  Synthetic
caccgctgtcccaaaaggtctcaattgagactctgatgtcaatattctagctcccacttcatttgggaaaacgacctccatgatgacatcttgtgcctccttagcactgagatctgcgtgcatatcagcagccagggcct

SEQ ID NO: 420215 - DNA, 140 bp, Artificial Sequence
  Synthetic
aggccctggctgctgatatgttacctcctggcttggaagcaagtgctagcggagctccaagacattgagaatgaagagaagatcccaaagacaaagaacatgaagaaaacaagccaactggaccttttgggacagcggtg

SEQ ID NO: 420216 - DNA, 140 bp, Artificial Sequence
  Synthetic
caccgctgtcccaaaaggtccagttggcttgttttcttcatgttctttgtctttgggatcttctcttcattctcaatgtcttggagctccgctagcacttgcttccaagccaggaggtaacatatcagcagccagggcct

SEQ ID NO: 420217 - DNA, 140 bp, Artificial Sequence
  Synthetic
aggccctggctgctgatatgcacaaggacaatgctctgaggctggctgagaacaaagatgtattggtgacaagagaaccctacatcagctgtgacaatgagggttgttggtcctttgcacgaccttttgggacagcggtg

SEQ ID NO: 420218 - DNA, 140 bp, Artificial Sequence
  Synthetic
caccgctgtcccaaaaggtcgtgcaaaggaccaacaaccctcattgtcacagctgatgtagggttctcttgtcaccaatacatctttgttctcagccagcctcagagcattgtccttgtgcatatcagcagccagggcct

SEQ ID NO: 420219 - DNA, 140 bp, Artificial Sequence
  Synthetic
aggccctggctgctgatatggcaaaaccagattcctaccggtggcaggcggaacaagcagtgtgtacattgaggtattgcatttgactcaaggaacctgctgggaacagatgtacactccgaccttttgggacagcggtg

SEQ ID NO: 420220 - DNA, 140 bp, Artificial Sequence
  Synthetic
caccgctgtcccaaaaggtcggagtgtacatctgttcccagcaggttccttgagtcaaatgcaatacctcaatgtacacactgcttgttccgcctgccaccggtaggaatctggttttgccatatcagcagccagggcct

SEQ ID NO: 420221 - DNA, 140 bp, Artificial Sequence
  Synthetic
atacgccatgctgggtctccgaggtattgcatttgactcaaggaacctgctgggaacagatgtacactccaggtggagaggttagaaatgacgatgttgaccagagtttgatcatcgctgcgtacttgggagtcggccat

SEQ ID NO: 420222 - DNA, 140 bp, Artificial Sequence
  Synthetic
atggccgactcccaagtacgcagcgatgatcaaactctggtcaacatcgtcatttctaacctctccacctggagtgtacatctgttcccagcaggttccttgagtcaaatgcaatacctcggagacccagcatggcgtat

SEQ ID NO: 420223 - DNA, 140 bp, Artificial Sequence
  Synthetic
atacgccatgctgggtctccgacagaactccatacagatccctaatcaaattcccaatcgggacagctcctgtgctcggaaactacaaagaaatgtgtgctgcatggtccagtagcagctcgtacttgggagtcggccat

SEQ ID NO: 420224 - DNA, 140 bp, Artificial Sequence
  Synthetic
atggccgactcccaagtacgagctgctactggaccatgcagcacacatttctttgtagtttccgagcacaggagctgtcccgattgggaatttgattagggatctgtatggagttctgtcggagacccagcatggcgtat

SEQ ID NO: 420225 - DNA, 140 bp, Artificial Sequence
  Synthetic
atacgccatgctgggtctccttgaccgattcaagctggatagaacttgatgagataggggaagatgttgccccgatcgaacacattgcaagcatgaggagaaactactttacagcagaagcgtacttgggagtcggccat

SEQ ID NO: 420226 - DNA, 140 bp, Artificial Sequence
  Synthetic
atggccgactcccaagtacgcttctgctgtaaagtagtttctcctcatgcttgcaatgtgttcgatcggggcaacatcttcccctatctcatcaagttctatccagcttgaatcggtcaaggagacccagcatggcgtat

SEQ ID NO: 420227 - DNA, 140 bp, Artificial Sequence
  Synthetic
aggccctggctgctgatatgtagaagagcgacagtatcagcggacccattggcatcactactggaaatgtgccacagcacaaaaattggtggtataaggatggtggacatccttaggcaagaccttttgggacagcggtg

SEQ ID NO: 420228 - DNA, 140 bp, Artificial Sequence
  Synthetic
caccgctgtcccaaaaggtcttgcctaaggatgtccaccatccttataccaccaatttttgtgctgtggcacatttccagtagtgatgccaatgggtccgctgatactgtcgctcttctacatatcagcagccagggcct

SEQ ID NO: 420229 - DNA, 140 bp, Artificial Sequence
  Synthetic
atacgccatgctgggtctccatgaatccaaatcagaaactattcgcattatccggagtggcaatagcgcttagtgtactgaacttattgataggactctcaaatgtcggattgaatgtatcgtacttgggagtcggccat

SEQ ID NO: 420230 - DNA, 140 bp, Artificial Sequence
  Synthetic
atggccgactcccaagtacgatacattcaatccgacatttgagagtcctatcaataagttcagtacactaagcgctattgccactccggataatgcgaatagtttctgatttggattcatggagacccagcatggcgtat

SEQ ID NO: 420231 - DNA, 140 bp, Artificial Sequence
  Synthetic
aggccctggctgctgatatgacagccttgctcaatgcatcttgtgcagccatggatgacttccaattgatcccaatgataagcaaatgtaggaccaaagaagggagacggaaaacaaatcgaccttttgggacagcggtg

SEQ ID NO: 420232 - DNA, 140 bp, Artificial Sequence
  Synthetic
caccgctgtcccaaaaggtcgatttgttttccgtctcccttctttggtcctacatttgcttatcattgggatcaattggaagtcatccatggctgcacaagatgcattgagcaaggctgtcatatcagcagccagggcct

SEQ ID NO: 420233 - DNA, 140 bp, Artificial Sequence
  Synthetic
atacgccatgctgggtctcccccaatgataagcaaatgtaggaccaaagaagggagacggaaaacaaatctgtatggattcattataaaaggaaggtctcatttgagaaatgataccgaccgtacttgggagtcggccat

SEQ ID NO: 420234 - DNA, 140 bp, Artificial Sequence
  Synthetic
atggccgactcccaagtacggtcggtatcatttctcaaatgagaccttccttttataatgaatccatacagatttgttttccgtctcccttctttggtcctacatttgcttatcattgggggagacccagcatggcgtat

SEQ ID NO: 420235 - DNA, 140 bp, Artificial Sequence
  Synthetic
aggccctggctgctgatatggtggatcatccgtcaagaaggaagaggaagtgctcacaggcaaccttcaaacattgaaaataagaatacatgaagggtatgaggaattcacaatggttgggaccttttgggacagcggtg

SEQ ID NO: 420236 - DNA, 140 bp, Artificial Sequence
  Synthetic
caccgctgtcccaaaaggtcccaaccattgtgaattcctcatacccttcatgtattcttattttcaatgtttgaaggttgcctgtgagcacttcctcttccttcttgacggatgatccaccatatcagcagccagggcct

SEQ ID NO: 420237 - DNA, 140 bp, Artificial Sequence
  Synthetic
atacgccatgctgggtctccttaaactgcatgagaccgtgtttctgggttgagctaatcagaggacagcccagagagaatacagtttggactagcggaagcagtatatccttttgtggtgcgtacttgggagtcggccat

SEQ ID NO: 420238 - DNA, 140 bp, Artificial Sequence
  Synthetic
atggccgactcccaagtacgcaccacaaaaggatatactgcttccgctagtccaaactgtattctctctgggctgtcctctgattagctcaacccagaaacacggtctcatgcagtttaaggagacccagcatggcgtat

SEQ ID NO: 420239 - DNA, 140 bp, Artificial Sequence
  Synthetic
atacgccatgctgggtctcccagatgtagacatctactgtgtgtgcagagacaactggaaaggttccaacaggccgtgggtccgcatgaacaatgaaactatattggaaactggatatatcgtacttgggagtcggccat

SEQ ID NO: 420240 - DNA, 140 bp, Artificial Sequence
  Synthetic
atggccgactcccaagtacgatatatccagtttccaatatagtttcattgttcatgcggacccacggcctgttggaacctttccagttgtctctgcacacacagtagatgtctacatctgggagacccagcatggcgtat

SEQ ID NO: 420241 - DNA, 140 bp, Artificial Sequence
  Synthetic
aggccctggctgctgatatgaggccgtgggtccgcatgaacaatgaaactatattggaaactggatatatatgcagcaaattccattcggacacacctcgacctagtgatccatctacaggaccttttgggacagcggtg

SEQ ID NO: 420242 - DNA, 140 bp, Artificial Sequence
  Synthetic
caccgctgtcccaaaaggtcctgtagatggatcactaggtcgaggtgtgtccgaatggaatttgctgcatatatatccagtttccaatatagtttcattgttcatgcggacccacggcctcatatcagcagccagggcct

SEQ ID NO: 420243 - DNA, 140 bp, Artificial Sequence
  Synthetic
atacgccatgctgggtctccgctatggtgttctcacaggaggattgcatgataaaagcagtccgaggcgatctgaatttcgtaaacagagcaaaccaaagattaaaccccatgcatcaaccgtacttgggagtcggccat

SEQ ID NO: 420244 - DNA, 140 bp, Artificial Sequence
  Synthetic
atggccgactcccaagtacggttgatgcatggggtttaatctttggtttgctctgtttacgaaattcagatcgcctcggactgcttttatcatgcaatcctcctgtgagaacaccatagcggagacccagcatggcgtat

SEQ ID NO: 420245 - DNA, 140 bp, Artificial Sequence
  Synthetic
atacgccatgctgggtctcccttccgtcaaagagaaagacatgaccaaggaattctttgaaaacaaatcagaaacatggccaattggagagtcacccaaaggagtggaagaaggttctatcgtacttgggagtcggccat

SEQ ID NO: 420246 - DNA, 140 bp, Artificial Sequence
  Synthetic
atggccgactcccaagtacgatagaaccttcttccactcctttgggtgactctccaattggccatgtttctgatttgttttcaaagaattccttggtcatgtctttctctttgacggaagggagacccagcatggcgtat

SEQ ID NO: 420247 - DNA, 140 bp, Artificial Sequence
  Synthetic
atacgccatgctgggtctccataaagagatagagtctgtgaacaatgctgtggtgatgccagctcatggccctgccaagagcatggaatatgatgctgtagctactacgcactcatggatcgtacttgggagtcggccat

SEQ ID NO: 420248 - DNA, 140 bp, Artificial Sequence
  Synthetic
atggccgactcccaagtacgatccatgagtgcgtagtagctacagcatcatattccatgctcttggcagggccatgagctggcatcaccacagcattgttcacagactctatctctttatggagacccagcatggcgtat

SEQ ID NO: 420249 - DNA, 140 bp, Artificial Sequence
  Synthetic
aggccctggctgctgatatgtttaataagagctttgacactaaacaaaatgacaaaagatgcagaaagaagaaagagaaagaggcgagcaattgcaacaccgccaatgcaaattagaggagaccttttgggacagcggtg

SEQ ID NO: 420250 - DNA, 140 bp, Artificial Sequence
  Synthetic
caccgctgtcccaaaaggtctcctctaatttgcattggcggtgttgcaattgctcgcctctttctctttcttctttctgcatcttttgtcattttgtttagtgtcaaagctcttattaaacatatcagcagccagggcct

SEQ ID NO: 420251 - DNA, 140 bp, Artificial Sequence
  Synthetic
atacgccatgctgggtctccgagtagatgaatactccagcactgagagagtggttgtaagtattgaccggttcttaagggttcgagatcagcgggggaacgtactcttatctcccgaagacgtacttgggagtcggccat

SEQ ID NO: 420252 - DNA, 140 bp, Artificial Sequence
  Synthetic
atggccgactcccaagtacgtcttcgggagataagagtacgttcccccgctgatctcgaacccttaagaaccggtcaatacttacaaccactctctcagtgctggagtattcatctactcggagacccagcatggcgtat

SEQ ID NO: 420253 - DNA, 140 bp, Artificial Sequence
  Synthetic
atacgccatgctgggtctcctcaaccttgcttttatgttgagctcacacggggagtgccaaacaaaaatgaggatgtgtcttggaccagcaacagtatagttactttctgtggactagaccgtacttgggagtcggccat

SEQ ID NO: 420254 - DNA, 140 bp, Artificial Sequence
  Synthetic
atggccgactcccaagtacggtctagtccacagaaagtaactatactgttgctggtccaagacacatcctcatttttgtttggcactccccgtgtgagctcaacataaaagcaaggttgaggagacccagcatggcgtat

SEQ ID NO: 420255 - DNA, 140 bp, Artificial Sequence
  Synthetic
aggccctggctgctgatatgaggatgtgtcttggaccagcaacagtatagttactttctgtggactagacaatgaacctggatcgggcaattggcctgatggtgccaacattgggtttatgaccttttgggacagcggtg

SEQ ID NO: 420256 - DNA, 140 bp, Artificial Sequence
  Synthetic
caccgctgtcccaaaaggtcataaacccaatgttggcaccatcaggccaattgcccgatccaggttcattgtctagtccacagaaagtaactatactgttgctggtccaagacacatcctcatatcagcagccagggcct

SEQ ID NO: 420257 - DNA, 140 bp, Artificial Sequence
  Synthetic
aggccctggctgctgatatgcaatgatgtgggaaatcaatggtcctgagtcagtgattgttaacacctatcaatggatcatcagaaattgggagactgtgaaaattcaatggtctcaagagaccttttgggacagcggtg

SEQ ID NO: 420258 - DNA, 140 bp, Artificial Sequence
  Synthetic
caccgctgtcccaaaaggtctcttgagaccattgaattttcacagtctcccaatttctgatgatccattgataggtgttaacaatcactgactcaggaccattgatttcccacatcattgcatatcagcagccagggcct

SEQ ID NO: 420259 - DNA, 140 bp, Artificial Sequence
  Synthetic
aggccctggctgctgatatgatggcgtctcaaggcaccaaacgatcttatgagcagatggaaactggtggtgaacgccagaatgccactgaaattcgggcatctgtcgggaggatggttggaccttttgggacagcggtg

SEQ ID NO: 420260 - DNA, 140 bp, Artificial Sequence
  Synthetic
caccgctgtcccaaaaggtccaaccatcctcccgacagatgcccgaatttcagtggcattctggcgttcaccaccagtttccatctgctcataagatcgtttggtgccttgagacgccatcatatcagcagccagggcct

SEQ ID NO: 420261 - DNA, 140 bp, Artificial Sequence
  Synthetic
aggccctggctgctgatatgttccaatccttggtacccaaagctgtcagaggtcaatacagtgggtttgtgagaaccctattccaacaaatgcgtgacgtactagggacatttgatactggaccttttgggacagcggtg

SEQ ID NO: 420262 - DNA, 140 bp, Artificial Sequence
  Synthetic
caccgctgtcccaaaaggtccagtatcaaatgtccctagtacgtcacgcatttgttggaatagggttctcacaaacccactgtattgacctctgacagctttgggtaccaaggattggaacatatcagcagccagggcct

SEQ ID NO: 420263 - DNA, 140 bp, Artificial Sequence
  Synthetic
aggccctggctgctgatatgtgttgaatgtgactatgccaaataatgacaactttgacaagttgtatgtctggggagttcaccacccaagcacaaaccaagagcaaaccaacctatatgtgaccttttgggacagcggtg

SEQ ID NO: 420264 - DNA, 140 bp, Artificial Sequence
  Synthetic
caccgctgtcccaaaaggtcacatataggttggtttgctcttggtttgtgcttgggtggtgaactccccagacatacaacttgtcaaagttgtcattatttggcatagtcacattcaacacatatcagcagccagggcct

SEQ ID NO: 420265 - DNA, 140 bp, Artificial Sequence
  Synthetic
atacgccatgctgggtctccggcaattcccctgtgttcaactataacaaggcaaccaagagactcacagttcttggaaaggatgcaggtgccttgacagaagatccagatgagggaacagcgtacttgggagtcggccat

SEQ ID NO: 420266 - DNA, 140 bp, Artificial Sequence
  Synthetic
atggccgactcccaagtacgctgttccctcatctggatcttctgtcaaggcacctgcatcctttccaagaactgtgagtctcttggttgccttgttatagttgaacacaggggaattgccggagacccagcatggcgtat

SEQ ID NO: 420267 - DNA, 140 bp, Artificial Sequence
  Synthetic
aggccctggctgctgatatgcttctctgactgtgaatgtaagaggctcaggaatgagaatactcataaggggcaactcccctgcgttcaactacaataaagcgaccaaaaggcttaccgtgaccttttgggacagcggtg

SEQ ID NO: 420268 - DNA, 140 bp, Artificial Sequence
  Synthetic
caccgctgtcccaaaaggtcacggtaagccttttggtcgctttattgtagttgaacgcaggggagttgccccttatgagtattctcattcctgagcctcttacattcacagtcagagaagcatatcagcagccagggcct

SEQ ID NO: 420269 - DNA, 140 bp, Artificial Sequence
  Synthetic
aggccctggctgctgatatggaaggaaaatgggtaagagaattggtcctgtatgacaaggaagaaataagaagaatatggagacaagcaaacaatggagaagattctactgctggcctcagaccttttgggacagcggtg

SEQ ID NO: 420270 - DNA, 140 bp, Artificial Sequence
  Synthetic
caccgctgtcccaaaaggtctgaggccagcagtagaatcttctccattgtttgcttgtctccatattcttcttatttcttccttgtcatacaggaccaattctcttacccattttccttccatatcagcagccagggcct

SEQ ID NO: 420271 - DNA, 140 bp, Artificial Sequence
  Synthetic
aggccctggctgctgatatgtgtgccggattatgcctcccttaggtcactaattgcctcatctggcaccctgaaatttacccaggaaagcttcaattggactggagttgctcaagatggagaccttttgggacagcggtg

SEQ ID NO: 420272 - DNA, 140 bp, Artificial Sequence
  Synthetic
caccgctgtcccaaaaggtctccatcttgagcaactccagtccaattgaagctttcctgggtaaatttcagggtgccagatgaggcaattagtgacctaagggaggcataatccggcacacatatcagcagccagggcct

SEQ ID NO: 420273 - DNA, 140 bp, Artificial Sequence
  Synthetic
atacgccatgctgggtctccactcgagcccttgtacgcaccggaatggacccccggatgtgctccctcatgcagggatcgacactcccaagaaggtctggagcggctggtgcagccgtaacgtacttgggagtcggccat

SEQ ID NO: 420274 - DNA, 140 bp, Artificial Sequence
  Synthetic
atggccgactcccaagtacgttacggctgcaccagccgctccagaccttcttgggagtgtcgatccctgcatgagggagcacatccgggggtccattccggtgcgtacaagggctcgagtggagacccagcatggcgtat

SEQ ID NO: 420275 - DNA, 140 bp, Artificial Sequence
  Synthetic
aggccctggctgctgatatggccagacttatgattggacattaaacagaaatcaaccggcagcaactgcattggccaacaccatagaagtctttagatcgaatgacctaacagctaacgagaccttttgggacagcggtg

SEQ ID NO: 420276 - DNA, 140 bp, Artificial Sequence
  Synthetic
caccgctgtcccaaaaggtctcgttagctgttaggtcattcgatctaaagacttctatggtgttggccaatgcagttgctgccggttgatttctgtttaatgtccaatcataagtctggccatatcagcagccagggcct

SEQ ID NO: 420277 - DNA, 140 bp, Artificial Sequence
  Synthetic
atacgccatgctgggtctccttcgtgtactttgttgagactctagctagaagcatttgcgagaaacttgaacaatccgggctcccagtagggggcaatgaaaagaaagccaaattggcaacgtacttgggagtcggccat

SEQ ID NO: 420278 - DNA, 140 bp, Artificial Sequence
  Synthetic
atggccgactcccaagtacgttgccaatttggctttcttttcattgccccctactgggagcccggattgttcaagtttctcgcaaatgcttctagctagagtctcaacaaagtacacgaaggagacccagcatggcgtat

SEQ ID NO: 420279 - DNA, 140 bp, Artificial Sequence
  Synthetic
atacgccatgctgggtctccgacagaagcccctatcgaaccctgatgagctgtcccattggtgaagtcccttccccatacaattcaagatttgaatcagttgcttggtcagcaagtgcttcgtacttgggagtcggccat

SEQ ID NO: 420280 - DNA, 140 bp, Artificial Sequence
  Synthetic
atggccgactcccaagtacgaagcacttgctgaccaagcaactgattcaaatcttgaattgtatggggaagggacttcaccaatgggacagctcatcagggttcgataggggcttctgtcggagacccagcatggcgtat

SEQ ID NO: 420281 - DNA, 140 bp, Artificial Sequence
  Synthetic
atacgccatgctgggtctcctgcttatgagagaatgtgcaacatccttaaagggaagttccaaacagcagcacaacgagcaatgatggatcaggtcagggaaagccgtagtcctggaaatcgtacttgggagtcggccat

SEQ ID NO: 420282 - DNA, 140 bp, Artificial Sequence
  Synthetic
atggccgactcccaagtacgatttccaggactacggctttccctgacctgatccatcattgctcgttgtgctgctgtttggaacttccctttaaggatgttgcacattctctcataagcaggagacccagcatggcgtat

SEQ ID NO: 420283 - DNA, 140 bp, Artificial Sequence
  Synthetic
aggccctggctgctgatatgcacaacgagcaatgatggatcaggtcagggaaagccgtagtcctggaaatgctgaaattgaagacctcatctttttggccaggtctgcactcattctgaggaccttttgggacagcggtg

SEQ ID NO: 420284 - DNA, 140 bp, Artificial Sequence
  Synthetic
caccgctgtcccaaaaggtcctcagaatgagtgcagacctggccaaaaagatgaggtcttcaatttcagcatttccaggactacggctttccctgacctgatccatcattgctcgttgtgcatatcagcagccagggcct

SEQ ID NO: 420285 - DNA, 140 bp, Artificial Sequence
  Synthetic
atacgccatgctgggtctccaatccaaacgaaaagatcatttgagctaaaaaggctatgggatcagacccattcaaaaacaggactactgatttcagatggaggaccaaatctatacaatcgtacttgggagtcggccat

SEQ ID NO: 420286 - DNA, 140 bp, Artificial Sequence
  Synthetic
atggccgactcccaagtacgattgtatagatttggtcctccatctgaaatcagtagtcctgtttttgaatgggtctgatcccatagcctttttagctcaaatgatcttttcgtttggattggagacccagcatggcgtat

SEQ ID NO: 420287 - DNA, 140 bp, Artificial Sequence
  Synthetic
atacgccatgctgggtctccattgcaatgaaacagtcattagggaatacaatgaaacagtaagggttgagaaggtaacacaatggcacaataccaacgtcattgagtatatagaaagacccgtacttgggagtcggccat

SEQ ID NO: 420288 - DNA, 140 bp, Artificial Sequence
  Synthetic
atggccgactcccaagtacgggtctttctatatactcaatgacgttggtattgtgccattgtgttaccttctcaacccttactgtttcattgtattccctaatgactgtttcattgcaatggagacccagcatggcgtat

SEQ ID NO: 420289 - DNA, 140 bp, Artificial Sequence
  Synthetic
aggccctggctgctgatatgttccccatacaattcaagatttgaatcagttgcttggtcagcaagtgcttgccatgatggcaccagctggctgacaattggaatttctggcccagacaatgaccttttgggacagcggtg

SEQ ID NO: 420290 - DNA, 140 bp, Artificial Sequence
  Synthetic
caccgctgtcccaaaaggtcattgtctgggccagaaattccaattgtcagccagctggtgccatcatggcaagcacttgctgaccaagcaactgattcaaatcttgaattgtatggggaacatatcagcagccagggcct

SEQ ID NO: 420291 - DNA, 140 bp, Artificial Sequence
  Synthetic
atacgccatgctgggtctcctaatcccgaacattggatccaggccttgggtcagaggccaatcagggaggataagcatctactggacaatagtgaagccgggagatgtactagtaattaacgtacttgggagtcggccat

SEQ ID NO: 420292 - DNA, 140 bp, Artificial Sequence
  Synthetic
atggccgactcccaagtacgttaattactagtacatctcccggcttcactattgtccagtagatgcttatcctccctgattggcctctgacccaaggcctggatccaatgttcgggattaggagacccagcatggcgtat

SEQ ID NO: 420293 - DNA, 140 bp, Artificial Sequence
  Synthetic
atacgccatgctgggtctccggttttgggagtctcgatactgaatcttggacaaaagaaatacaccaggacaacatactggtgggacggactccaatcctccgacgattttgccctcatacgtacttgggagtcggccat

SEQ ID NO: 420294 - DNA, 140 bp, Artificial Sequence
  Synthetic
atggccgactcccaagtacgtatgagggcaaaatcgtcggaggattggagtccgtcccaccagtatgttgtcctggtgtatttcttttgtccaagattcagtatcgagactcccaaaaccggagacccagcatggcgtat

SEQ ID NO: 420295 - DNA, 140 bp, Artificial Sequence
  Synthetic
atacgccatgctgggtctccatgaatccaagtcaaaagataataacaattggctctgtctcactaatcattgcaacagtatgtttcctcatgcaaattgccatcctggcaatgaccataacgtacttgggagtcggccat

SEQ ID NO: 420296 - DNA, 140 bp, Artificial Sequence
  Synthetic
atggccgactcccaagtacgttatggtcattgccaggatggcaatttgcatgaggaaacatactgttgcaatgattagtgagacagagccaattgttattatcttttgacttggattcatggagacccagcatggcgtat

SEQ ID NO: 420297 - DNA, 140 bp, Artificial Sequence
  Synthetic
atacgccatgctgggtctccactgatgtaatcaattcctgggcaggagatattttaagaactcaggaatcatcatgcacttgcattcaaggtgaatgttattgggtaatgacggatggaccgtacttgggagtcggccat

SEQ ID NO: 420298 - DNA, 140 bp, Artificial Sequence
  Synthetic
atggccgactcccaagtacggtccatccgtcattacccaataacattcaccttgaatgcaagtgcatgatgattcctgagttcttaaaatatctcctgcccaggaattgattacatcagtggagacccagcatggcgtat

SEQ ID NO: 420299 - DNA, 140 bp, Artificial Sequence
  Synthetic
atacgccatgctgggtctccggacattgtcaaaacagcagaaatgatggtcaaggtgctctaccttctcatcatagtgttgggcagatactcaaaagcagacaaaatatgcataggataccgtacttgggagtcggccat

SEQ ID NO: 420300 - DNA, 140 bp, Artificial Sequence
  Synthetic
atggccgactcccaagtacggtatcctatgcatattttgtctgcttttgagtatctgcccaacactatgatgagaaggtagagcaccttgaccatcatttctgctgttttgacaatgtccggagacccagcatggcgtat

SEQ ID NO: 420301 - DNA, 140 bp, Artificial Sequence
  Synthetic
aggccctggctgctgatatgaatggaagcattcccaatgacaaaccttttcaaaatgtaaacaggatcacatatggggcctgtcccagatatgttaagcaaaacactctgaaattggcaagaccttttgggacagcggtg

SEQ ID NO: 420302 - DNA, 140 bp, Artificial Sequence
  Synthetic
caccgctgtcccaaaaggtcttgccaatttcagagtgttttgcttaacatatctgggacaggccccatatgtgatcctgtttacattttgaaaaggtttgtcattgggaatgcttccattcatatcagcagccagggcct

SEQ ID NO: 420303 - DNA, 140 bp, Artificial Sequence
  Synthetic
aggccctggctgctgatatgactgctcattgaatgggatcagcccggtccatcttggtgactgcagttttgagggatggattgtagggaatccctcctgtgccaccaacatcaacataaggaccttttgggacagcggtg

SEQ ID NO: 420304 - DNA, 140 bp, Artificial Sequence
  Synthetic
caccgctgtcccaaaaggtccttatgttgatgttggtggcacaggagggattccctacaatccatccctcaaaactgcagtcaccaagatggaccgggctgatcccattcaatgagcagtcatatcagcagccagggcct

SEQ ID NO: 420305 - DNA, 140 bp, Artificial Sequence
  Synthetic
atacgccatgctgggtctccgaaacacctattgagcagaataaactattttgagagaattaaaatcatccccaaaagtcattggtccaatcataatacctcaggggtgagctcagcttgccgtacttgggagtcggccat

SEQ ID NO: 420306 - DNA, 140 bp, Artificial Sequence
  Synthetic
atggccgactcccaagtacggcaagctgagctcacccctgaggtattatgattggaccaatgacttttggggatgattttaattctctcaaaatagtttattctgctcaataggtgtttcggagacccagcatggcgtat

SEQ ID NO: 420307 - DNA, 140 bp, Artificial Sequence
  Synthetic
atacgccatgctgggtctccgagttgggaaaacaatatattgagaacacaagagtctgaatgtgcatgcttgaatggctcttgctttactgtaatgactgatggaccaagtaatgggcagcgtacttgggagtcggccat

SEQ ID NO: 420308 - DNA, 140 bp, Artificial Sequence
  Synthetic
atggccgactcccaagtacgctgcccattacttggtccatcagtcattacagtaaagcaagagccattcaagcatgcacattcagactcttgtgttctcaatatattgttttcccaactcggagacccagcatggcgtat

SEQ ID NO: 420309 - DNA, 140 bp, Artificial Sequence
  Synthetic
atacgccatgctgggtctcctaccacagttgcatgctcccactctggagccaacagtttttatcggaatttactatggatagtaaaaaaaggagactcctatcctaaactcagcaagtcacgtacttgggagtcggccat

SEQ ID NO: 420310 - DNA, 140 bp, Artificial Sequence
  Synthetic
atggccgactcccaagtacgtgacttgctgagtttaggataggagtctcctttttttactatccatagtaaattccgataaaaactgttggctccagagtgggagcatgcaactgtggtaggagacccagcatggcgtat

SEQ ID NO: 420311 - DNA, 140 bp, Artificial Sequence
  Synthetic
atacgccatgctgggtctccctcttaagacacttccaaaaggatgcaaaagtgcttttccaaaactggggaattgaacccattgacaatgtgatgggaatgatcgggatattgcccgacacgtacttgggagtcggccat

SEQ ID NO: 420312 - DNA, 140 bp, Artificial Sequence
  Synthetic
atggccgactcccaagtacgtgtcgggcaatatcccgatcattcccatcacattgtcaatgggttcaattccccagttttggaaaagcacttttgcatccttttggaagtgtcttaagagggagacccagcatggcgtat

SEQ ID NO: 420313 - DNA, 140 bp, Artificial Sequence
  Synthetic
atacgccatgctgggtctccgcggaattgggaggttctacatacagatgtgcactgaactcaaactcagcgactatgaaggaaggctaattcagaacagcataacaatcgaaagaatggtcgtacttgggagtcggccat

SEQ ID NO: 420314 - DNA, 140 bp, Artificial Sequence
  Synthetic
atggccgactcccaagtacgaccattctttcgattgttatgctgttctgaattagccttccttcatagtcgctgagtttgagttcagtgcacatctgtatgtagaacctcccaattccgcggagacccagcatggcgtat

SEQ ID NO: 420315 - DNA, 140 bp, Artificial Sequence
  Synthetic
aggccctggctgctgatatggggaatccaccatccagattcggaagcaacagccacaaaactatatgtcaacaaaaacccctacacattggtatcgacaaaagagtggagcaaacgctatgaccttttgggacagcggtg

SEQ ID NO: 420316 - DNA, 140 bp, Artificial Sequence
  Synthetic
caccgctgtcccaaaaggtcatagcgtttgctccactcttttgtcgataccaatgtgtaggggtttttgttgacatatagttttgtggctgttgcttccgaatctggatggtggattccccatatcagcagccagggcct

SEQ ID NO: 420317 - DNA, 140 bp, Artificial Sequence
  Synthetic
aggccctggctgctgatatgtgaatggctcttgctttactgtaatgactgatggaccaagtaatgggcaggcctcatacaagatcttcaaaatagaaaaggggaaagtagtcaaatcagtgaccttttgggacagcggtg

SEQ ID NO: 420318 - DNA, 140 bp, Artificial Sequence
  Synthetic
caccgctgtcccaaaaggtcactgatttgactactttccccttttctattttgaagatcttgtatgaggcctgcccattacttggtccatcagtcattacagtaaagcaagagccattcacatatcagcagccagggcct

SEQ ID NO: 420319 - DNA, 140 bp, Artificial Sequence
  Synthetic
atacgccatgctgggtctccgtgctgggaaggacccgaagaagactggaggtccgatttatcgaaggagagatgggaaatgggtgagagaactgatcctgtatgacaaagaggagataagcgtacttgggagtcggccat

SEQ ID NO: 420320 - DNA, 140 bp, Artificial Sequence
  Synthetic
atggccgactcccaagtacgcttatctcctctttgtcatacaggatcagttctctcacccatttcccatctctccttcgataaatcggacctccagtcttcttcgggtccttcccagcacggagacccagcatggcgtat

SEQ ID NO: 420321 - DNA, 140 bp, Artificial Sequence
  Synthetic
atacgccatgctgggtctccgggaaagatcccaagaaaactggaggtccaatctacaggaggagagatggaaaatggatgagagaactgatcctatatgacaaagaagagatcagaagaacgtacttgggagtcggccat

SEQ ID NO: 420322 - DNA, 140 bp, Artificial Sequence
  Synthetic
atggccgactcccaagtacgttcttctgatctcttctttgtcatataggatcagttctctcatccattttccatctctcctcctgtagattggacctccagttttcttgggatctttcccggagacccagcatggcgtat

SEQ ID NO: 420323 - DNA, 140 bp, Artificial Sequence
  Synthetic
atacgccatgctgggtctccctggatcggaccgtgtgatggtatcacccctggccgtaacatggtggaataggaatggcccaacaacaagcacagttcactaccctaaggtatacaaaaccgtacttgggagtcggccat

SEQ ID NO: 420324 - DNA, 140 bp, Artificial Sequence
  Synthetic
atggccgactcccaagtacggttttgtataccttagggtagtgaactgtgcttgttgttgggccattcctattccaccatgttacggccaggggtgataccatcacacggtccgatccagggagacccagcatggcgtat

SEQ ID NO: 420325 - DNA, 140 bp, Artificial Sequence
  Synthetic
atacgccatgctgggtctccacaagagcactcgtgcgtactggaatggatccccgaatgtgctccctcatgcaagggtcaactctcccaaggagatctggagctgctggtgcagcggtgacgtacttgggagtcggccat

SEQ ID NO: 420326 - DNA, 140 bp, Artificial Sequence
  Synthetic
atggccgactcccaagtacgtcaccgctgcaccagcagctccagatctccttgggagagttgacccttgcatgagggagcacattcggggatccattccagtacgcacgagtgctcttgtggagacccagcatggcgtat

SEQ ID NO: 420327 - DNA, 140 bp, Artificial Sequence
  Synthetic
aggccctggctgctgatatgcaagatctgtattgggtaccacgccaacaattcaacaacacaagtggatacactacttgagaagaatgtaactgtcacacattcagttgaattactagaggaccttttgggacagcggtg

SEQ ID NO: 420328 - DNA, 140 bp, Artificial Sequence
  Synthetic
caccgctgtcccaaaaggtcctctagtaattcaactgaatgtgtgacagttacattcttctcaagtagtgtatccacttgtgttgttgaattgttggcgtggtacccaatacagatcttgcatatcagcagccagggcct

SEQ ID NO: 420329 - DNA, 140 bp, Artificial Sequence
  Synthetic
aggccctggctgctgatatgccatagcactgagcatcctcaacctactaataggaatatccaatgtgggactgaatgtctcactacacttaaagggaagcaatgaccaagataaaaattggaccttttgggacagcggtg

SEQ ID NO: 420330 - DNA, 140 bp, Artificial Sequence
  Synthetic
caccgctgtcccaaaaggtccaatttttatcttggtcattgcttccctttaagtgtagtgagacattcagtcccacattggatattcctattagtaggttgaggatgctcagtgctatggcatatcagcagccagggcct

SEQ ID NO: 420331 - DNA, 140 bp, Artificial Sequence
  Synthetic
atacgccatgctgggtctccctgaatgtctcactacacttaaagggaagcaatgaccaagataaaaattggacatgcacgagtgtaacacagaacaatacgactttaattgaaaacacatcgtacttgggagtcggccat

SEQ ID NO: 420332 - DNA, 140 bp, Artificial Sequence
  Synthetic
atggccgactcccaagtacgatgtgttttcaattaaagtcgtattgttctgtgttacactcgtgcatgtccaatttttatcttggtcattgcttccctttaagtgtagtgagacattcagggagacccagcatggcgtat

SEQ ID NO: 420333 - DNA, 140 bp, Artificial Sequence
  Synthetic
atacgccatgctgggtctcccacaaagagcaatgatggatcaggtgcgagaaagcagaaatcctggaaatgctgaaattgaggatctcatcttccttgcacgatctgcactcattctgagcgtacttgggagtcggccat

SEQ ID NO: 420334 - DNA, 140 bp, Artificial Sequence
  Synthetic
atggccgactcccaagtacgctcagaatgagtgcagatcgtgcaaggaagatgagatcctcaatttcagcatttccaggatttctgctttctcgcacctgatccatcattgctctttgtgggagacccagcatggcgtat

SEQ ID NO: 420335 - DNA, 140 bp, Artificial Sequence
  Synthetic
atacgccatgctgggtctccaattatctaatgctgaacaagagcttatgcaaagttgaaggatgggtagtggtggccaaggacaatgccataagattcggtgaaagtgaacaaataatagcgtacttgggagtcggccat

SEQ ID NO: 420336 - DNA, 140 bp, Artificial Sequence
  Synthetic
atggccgactcccaagtacgctattatttgttcactttcaccgaatcttatggcattgtccttggccaccactacccatccttcaactttgcataagctcttgttcagcattagataattggagacccagcatggcgtat

SEQ ID NO: 420337 - DNA, 140 bp, Artificial Sequence
  Synthetic
aggccctggctgctgatatgggtggccaaggacaatgccataagattcggtgaaagtgaacaaataatagtgacaagagagccgtatgtatcatgtgatccattaggatgtaaaatgtacgaccttttgggacagcggtg

SEQ ID NO: 420338 - DNA, 140 bp, Artificial Sequence
  Synthetic
caccgctgtcccaaaaggtcgtacattttacatcctaatggatcacatgatacatacggctctcttgtcactattatttgttcactttcaccgaatcttatggcattgtccttggccacccatatcagcagccagggcct

SEQ ID NO: 420339 - DNA, 140 bp, Artificial Sequence
  Synthetic
atacgccatgctgggtctccccgtggccagtggatacgactttgagagggaagggtactctctagttggaatagatcctttccgtctgcttcaaaacagccaggtattcagtctcattagcgtacttgggagtcggccat

SEQ ID NO: 420340 - DNA, 140 bp, Artificial Sequence
  Synthetic
atggccgactcccaagtacgctaatgagactgaatacctggctgttttgaagcagacggaaaggatctattccaactagagagtacccttccctctcaaagtcgtatccactggccacggggagacccagcatggcgtat

SEQ ID NO: 420341 - DNA, 140 bp, Artificial Sequence
  Synthetic
atacgccatgctgggtctccccaattaaagtgggcacttggtgagaatatggcaccagaaaaagtagactttgaggactgcaaagatgttagcgatctaaaacagtatgacagtgatgaacgtacttgggagtcggccat

SEQ ID NO: 420342 - DNA, 140 bp, Artificial Sequence
  Synthetic
atggccgactcccaagtacgttcatcactgtcatactgttttagatcgctaacatctttgcagtcctcaaagtctactttttctggtgccatattctcaccaagtgcccactttaattggggagacccagcatggcgtat

SEQ ID NO: 420343 - DNA, 140 bp, Artificial Sequence
  Synthetic
atacgccatgctgggtctccacacgacaggactgctttcagaggcttgatatcaactcctttggggagcccccctgtagtcagcaatagtgactttctttgtgtaggatggtcaagcacccgtacttgggagtcggccat

SEQ ID NO: 420344 - DNA, 140 bp, Artificial Sequence
  Synthetic
atggccgactcccaagtacgggtgcttgaccatcctacacaaagaaagtcactattgctgactacaggggggctccccaaaggagttgatatcaagcctctgaaagcagtcctgtcgtgtggagacccagcatggcgtat

SEQ ID NO: 420345 - DNA, 140 bp, Artificial Sequence
  Synthetic
atacgccatgctgggtctccattctgcagcattcgaagatctgagagtctcaagcttcatcagaggaacaagagtactaccaagaggacaactatccaccagaggagttcaaattgcgtccgtacttgggagtcggccat

SEQ ID NO: 420346 - DNA, 140 bp, Artificial Sequence
  Synthetic
atggccgactcccaagtacggacgcaatttgaactcctctggtggatagttgtcctcttggtagtactcttgttcctctgatgaagcttgagactctcagatcttcgaatgctgcagaatggagacccagcatggcgtat

SEQ ID NO: 420347 - DNA, 140 bp, Artificial Sequence
  Synthetic
aggccctggctgctgatatggactccaagcacagagatgtcactgaggggggtaagaattagtaagatgggggtagatgaatattccagcactgagagagtggttgtgagcattgaccgcgaccttttgggacagcggtg

SEQ ID NO: 420348 - DNA, 140 bp, Artificial Sequence
  Synthetic
caccgctgtcccaaaaggtcgcggtcaatgctcacaaccactctctcagtgctggaatattcatctacccccatcttactaattcttacccccctcagtgacatctctgtgcttggagtccatatcagcagccagggcct

SEQ ID NO: 420349 - DNA, 140 bp, Artificial Sequence
  Synthetic
atacgccatgctgggtctcctaaaaacatgggcaggaaacatccttaggacgcaagagtcggaatgtgtatgccacaatggaacatgtgtagtaataatgaccgatggatcggcaagcagcgtacttgggagtcggccat

SEQ ID NO: 420350 - DNA, 140 bp, Artificial Sequence
  Synthetic
atggccgactcccaagtacgctgcttgccgatccatcggtcattattactacacatgttccattgtggcatacacattccgactcttgcgtcctaaggatgtttcctgcccatgtttttaggagacccagcatggcgtat

SEQ ID NO: 420351 - DNA, 140 bp, Artificial Sequence
  Synthetic
aggccctggctgctgatatgtgccacaatggaacatgtgtagtaataatgaccgatggatcggcaagcagccaggcatatacaaaagttctgtatttccacaaaggactagtaataaaaggaccttttgggacagcggtg

SEQ ID NO: 420352 - DNA, 140 bp, Artificial Sequence
  Synthetic
caccgctgtcccaaaaggtccttttattactagtcctttgtggaaatacagaacttttgtatatgcctggctgcttgccgatccatcggtcattattactacacatgttccattgtggcacatatcagcagccagggcct

SEQ ID NO: 420353 - DNA, 140 bp, Artificial Sequence
  Synthetic
aggccctggctgctgatatgggctaaccaaatctgatgggaatgcatacccactccaaaacctgacaaagatcaacaatggggactatgcaaggctctacatatggggagttcaccatccgaccttttgggacagcggtg

SEQ ID NO: 420354 - DNA, 140 bp, Artificial Sequence
  Synthetic
caccgctgtcccaaaaggtcggatggtgaactccccatatgtagagccttgcatagtccccattgttgatctttgtcaggttttggagtgggtatgcattcccatcagatttggttagcccatatcagcagccagggcct

SEQ ID NO: 420355 - DNA, 140 bp, Artificial Sequence
  Synthetic
atacgccatgctgggtctccatcaacaatggggactatgcaaggctctacatatggggagttcaccatccttcaactgacacagagcaaaccaacttgtataagaacaaccctggaagagcgtacttgggagtcggccat

SEQ ID NO: 420356 - DNA, 140 bp, Artificial Sequence
  Synthetic
atggccgactcccaagtacgctcttccagggttgttcttatacaagttggtttgctctgtgtcagttgaaggatggtgaactccccatatgtagagccttgcatagtccccattgttgatggagacccagcatggcgtat

SEQ ID NO: 420357 - DNA, 140 bp, Artificial Sequence
  Synthetic
atacgccatgctgggtctccgggcacaattcgaaggtgacttgtgtatgcagggacaactggcaaggagccaatagaccagtgattgaaatagacatgaatgccatggagcatacaagtccgtacttgggagtcggccat

SEQ ID NO: 420358 - DNA, 140 bp, Artificial Sequence
  Synthetic
atggccgactcccaagtacggacttgtatgctccatggcattcatgtctatttcaatcactggtctattggctccttgccagttgtccctgcatacacaagtcaccttcgaattgtgcccggagacccagcatggcgtat

SEQ ID NO: 420359 - DNA, 140 bp, Artificial Sequence
  Synthetic
aggccctggctgctgatatgcaatagaccagtgattgaaatagacatgaatgccatggagcatacaagtcaatatctatgtacaggagttctcactgacacgagcagaccatcagataaagaccttttgggacagcggtg

SEQ ID NO: 420360 - DNA, 140 bp, Artificial Sequence
  Synthetic
caccgctgtcccaaaaggtctttatctgatggtctgctcgtgtcagtgagaactcctgtacatagatattgacttgtatgctccatggcattcatgtctatttcaatcactggtctattgcatatcagcagccagggcct

SEQ ID NO: 420361 - DNA, 140 bp, Artificial Sequence
  Synthetic
atacgccatgctgggtctcccacctgcctcccgctacatgactgacatgtctccagaggagatgtcaagagaatggtttatgcttatgcccaaatggaaatttgctgggcccctccgcatcgtacttgggagtcggccat

SEQ ID NO: 420362 - DNA, 140 bp, Artificial Sequence
  Synthetic
atggccgactcccaagtacgatgcggaggggcccagcaaatttccatttgggcataagcataaaccattctcttgacatctcctctggagacatgtcagtcatgtagcgggaggcaggtgggagacccagcatggcgtat

SEQ ID NO: 420363 - DNA, 140 bp, Artificial Sequence
  Synthetic
atacgccatgctgggtctccggtcaaaggatttggcttcctggatagtagcaatacatggttgggccgcacgataagtcctcgttccaggagtggttttgagatgttgaagatacccaatcgtacttgggagtcggccat

SEQ ID NO: 420364 - DNA, 140 bp, Artificial Sequence
  Synthetic
atggccgactcccaagtacgattgggtatcttcaacatctcaaaaccactcctggaacgaggacttatcgtgcggcccaaccatgtattgctactatccaggaagccaaatcctttgaccggagacccagcatggcgtat

SEQ ID NO: 420365 - DNA, 140 bp, Artificial Sequence
  Synthetic
aggccctggctgctgatatgcgataagtcctcgttccaggagtggttttgagatgttgaagatacccaatgctgagacagacccaaattctaaaatcaccgagaggcaagaaatagttgagaccttttgggacagcggtg

SEQ ID NO: 420366 - DNA, 140 bp, Artificial Sequence
  Synthetic
caccgctgtcccaaaaggtctcaactatttcttgcctctcggtgattttagaatttgggtctgtctcagcattgggtatcttcaacatctcaaaaccactcctggaacgaggacttatcgcatatcagcagccagggcct

SEQ ID NO: 420367 - DNA, 140 bp, Artificial Sequence
  Synthetic
atacgccatgctgggtctccacttattgcttggtgatcaaagttggtcatacatagtggaaagacctaatgctcaaaatgggatttgctacccaggagctctgaatgaattagaagaactcgtacttgggagtcggccat

SEQ ID NO: 420368 - DNA, 140 bp, Artificial Sequence
  Synthetic
atggccgactcccaagtacgagttcttctaattcattcagagctcctgggtagcaaatcccattttgagcattaggtctttccactatgtatgaccaactttgatcaccaagcaataagtggagacccagcatggcgtat

SEQ ID NO: 420369 - DNA, 140 bp, Artificial Sequence
  Synthetic
atacgccatgctgggtctccaaggcagtgagtgctacaatccctgtttttatattgaattaataagaggaaggcctgaagaagccaagtatgtttggtggacgagcaacagtttagttgccgtacttgggagtcggccat

SEQ ID NO: 420370 - DNA, 140 bp, Artificial Sequence
  Synthetic
atggccgactcccaagtacggcaactaaactgttgctcgtccaccaaacatacttggcttcttcaggccttcctcttattaattcaatataaaaacagggattgtagcactcactgccttggagacccagcatggcgtat

SEQ ID NO: 420371 - DNA, 140 bp, Artificial Sequence
  Synthetic
aggccctggctgctgatatgatgggttcaggcatcagaatgcagaaggaacagggacggctgcagatctcaagtcgactcaggcagctattgatcaaatcaatggaaaattgaatcgcctgaccttttgggacagcggtg

SEQ ID NO: 420372 - DNA, 140 bp, Artificial Sequence
  Synthetic
caccgctgtcccaaaaggtcaggcgattcaattttccattgatttgatcaatagctgcctgagtcgacttgagatctgcagccgtccctgttccttctgcattctgatgcctgaacccatcatatcagcagccagggcct

SEQ ID NO: 420373 - DNA, 140 bp, Artificial Sequence
  Synthetic
atacgccatgctgggtctcctcaggaacaaaaactggagagaacaattgggtcagaagtttgaagaaataagatggctgattgaagaagtgagacatagattgaagataacagagaacagcgtacttgggagtcggccat

SEQ ID NO: 420374 - DNA, 140 bp, Artificial Sequence
  Synthetic
atggccgactcccaagtacgctgttctctgttatcttcaatctatgtctcacttcttcaatcagccatcttatttcttcaaacttctgacccaattgttctctccagtttttgttcctgaggagacccagcatggcgtat

SEQ ID NO: 420375 - DNA, 140 bp, Artificial Sequence
  Synthetic
aggccctggctgctgatatgtagcttcggggcatcatgtttcatacttctagccattgtaatgggccttgtcttcatatgtgtaaagaatggaaacatgcggtgcactatttgtatataagaccttttgggacagcggtg

SEQ ID NO: 420376 - DNA, 140 bp, Artificial Sequence
  Synthetic
caccgctgtcccaaaaggtcttatatacaaatagtgcaccgcatgtttccattctttacacatatgaagacaaggcccattacaatggctagaagtatgaaacatgatgccccgaagctacatatcagcagccagggcct

SEQ ID NO: 420377 - DNA, 140 bp, Artificial Sequence
  Synthetic
atacgccatgctgggtctccaagattcgagagggcagaataataaaagaaatatttccaacaggaagagtaaaacatactgaggaatgcacatgcggatttgccagcaacaaaaccatagcgtacttgggagtcggccat

SEQ ID NO: 420378 - DNA, 140 bp, Artificial Sequence
  Synthetic
atggccgactcccaagtacgctatggttttgttgctggcaaatccgcatgtgcattcctcagtatgttttactcttcctgttggaaatatttcttttattattctgccctctcgaatcttggagacccagcatggcgtat

SEQ ID NO: 420379 - DNA, 140 bp, Artificial Sequence
  Synthetic
aggccctggctgctgatatgacctcctagcttggaagcaggtactggcagaacttcaggatattgagaatgaagagaaaatcccaaagacaaagaacatgaagaaaacaagtcaattgaagaccttttgggacagcggtg

SEQ ID NO: 420380 - DNA, 140 bp, Artificial Sequence
  Synthetic
caccgctgtcccaaaaggtcttcaattgacttgttttcttcatgttctttgtctttgggattttctcttcattctcaatatcctgaagttctgccagtacctgcttccaagctaggaggtcatatcagcagccagggcct

SEQ ID NO: 420381 - DNA, 140 bp, Artificial Sequence
  Synthetic
aggccctggctgctgatatgcctaaaggttccagcgcaaaatgccataagcaccacattcccttatactggagatcctccatacagccatggaacaggaacaggatacaccatggacacagaccttttgggacagcggtg

SEQ ID NO: 420382 - DNA, 140 bp, Artificial Sequence
  Synthetic
caccgctgtcccaaaaggtctgtgtccatggtgtatcctgttcctgttccatggctgtatggaggatctccagtataagggaatgtggtgcttatggcattttgcgctggaacctttaggcatatcagcagccagggcct

SEQ ID NO: 420383 - DNA, 140 bp, Artificial Sequence
  Synthetic
aggccctggctgctgatatgagagactggggcaccccagctcaatccgattgatggaccactacctgaagataatgaaccaagtggatatgcacaaacagactgtgtcctggaggccatggaccttttgggacagcggtg

SEQ ID NO: 420384 - DNA, 140 bp, Artificial Sequence
  Synthetic
caccgctgtcccaaaaggtccatggcctccaggacacagtctgtttgtgcatatccacttggttcattatcttcaggtagtggtccatcaatcggattgagctggggtgccccagtctctcatatcagcagccagggcct

SEQ ID NO: 420385 - DNA, 140 bp, Artificial Sequence
  Synthetic
aggccctggctgctgatatgataatgaaccaagtggatatgcacaaacagactgtgtcctggaggccatggctttccttgaagaatcccacccagggatatttgagaattcatgccttgagaccttttgggacagcggtg

SEQ ID NO: 420386 - DNA, 140 bp, Artificial Sequence
  Synthetic
caccgctgtcccaaaaggtctcaaggcatgaattctcaaatatccctgggtgggattcttcaaggaaagccatggcctccaggacacagtctgtttgtgcatatccacttggttcattatcatatcagcagccagggcct

SEQ ID NO: 420387 - DNA, 140 bp, Artificial Sequence
  Synthetic
atacgccatgctgggtctccagcgaaagcagggtgacaaaaacataatggattccaacacgataacctcgtttcaggtagattgctatctatggcatgtccgcaaacgatttgcagaccacgtacttgggagtcggccat

SEQ ID NO: 420388 - DNA, 140 bp, Artificial Sequence
  Synthetic
atggccgactcccaagtacgtggtctgcaaatcgtttgcggacatgccatagatagcaatctacctgaaacgaggttatcgtgttggaatccattatgtttttgtcaccctgctttcgctggagacccagcatggcgtat

SEQ ID NO: 420389 - DNA, 140 bp, Artificial Sequence
  Synthetic
atacgccatgctgggtctccccaattaaaaaataatgccaaagaaataggaaatggatgttttgagttctatcataagtgtaacgatgaatgcatggagagtgtgaaaaatggaacttatcgtacttgggagtcggccat

SEQ ID NO: 420390 - DNA, 140 bp, Artificial Sequence
  Synthetic
atggccgactcccaagtacgataagttccatttttcacactctccatgcattcatcgttacacttatgatagaactcaaaacatccatttcctatttctttggcattattttttaattggggagacccagcatggcgtat

SEQ ID NO: 420391 - DNA, 140 bp, Artificial Sequence
  Synthetic
atacgccatgctgggtctccaagaggaaatagagataacaacacactttcaaagaaaaaggagagtaagggataacatgaccaagaagatggtcacacaaagaacaatagggaagaaaaacgtacttgggagtcggccat

SEQ ID NO: 420392 - DNA, 140 bp, Artificial Sequence
  Synthetic
atggccgactcccaagtacgtttttcttccctattgttctttgtgtgaccatcttcttggtcatgttatcccttactctcctttttctttgaaagtgtgttgttatctctatttcctcttggagacccagcatggcgtat

SEQ ID NO: 420393 - DNA, 140 bp, Artificial Sequence
  Synthetic
aggccctggctgctgatatgaattgaagatctcatctttctcgcacgatctgctctcatcctgaggggatcagtggctcataagtcctgcctgcctgcttgtgtgtatggacttgctgtagaccttttgggacagcggtg

SEQ ID NO: 420394 - DNA, 140 bp, Artificial Sequence
  Synthetic
caccgctgtcccaaaaggtctacagcaagtccatacacacaagcaggcaggcaggacttatgagccactgatcccctcaggatgagagcagatcgtgcgagaaagatgagatcttcaattcatatcagcagccagggcct

SEQ ID NO: 420395 - DNA, 140 bp, Artificial Sequence
  Synthetic
aggccctggctgctgatatgaagctattcaactggtgcacttgccagttgcatgggcctcatatacaacaggatgggaacagtgaccacagaagctgcttttggtctagtgtgtgccactgaccttttgggacagcggtg

SEQ ID NO: 420396 - DNA, 140 bp, Artificial Sequence
  Synthetic
caccgctgtcccaaaaggtcagtggcacacactagaccaaaagcagcttctgtggtcactgttcccatcctgttgtatatgaggcccatgcaactggcaagtgcaccagttgaatagcttcatatcagcagccagggcct

SEQ ID NO: 420397 - DNA, 140 bp, Artificial Sequence
  Synthetic
aggccctggctgctgatatgacgaaaatccagcacataaaagtcagctggtatggatggcatgccactctgcggcatttgaagatctgagagtgtcaagcttcatcagaggaacaagagtgaccttttgggacagcggtg

SEQ ID NO: 420398 - DNA, 140 bp, Artificial Sequence
  Synthetic
caccgctgtcccaaaaggtcactcttgttcctctgatgaagcttgacactctcagatcttcaaatgccgcagagtggcatgccatccataccagctgacttttatgtgctggattttcgtcatatcagcagccagggcct

SEQ ID NO: 420399 - DNA, 140 bp, Artificial Sequence
  Synthetic
aggccctggctgctgatatgctacggcaaaggctatggaacagatggctggatcgagtgaacaggcagcggaggccatggaggttgccaatcagactaggcagatggtacatgcaatgaggaccttttgggacagcggtg

SEQ ID NO: 420400 - DNA, 140 bp, Artificial Sequence
  Synthetic
caccgctgtcccaaaaggtcctcattgcatgtaccatctgcctagtctgattggcaacctccatggcctccgctgcctgttcactcgatccagccatctgttccatagcctttgccgtagcatatcagcagccagggcct

SEQ ID NO: 420401 - DNA, 140 bp, Artificial Sequence
  Synthetic
aggccctggctgctgatatgatagatcccgaaatgatgacccacacaagcaaatacttgtgttcaaaaatcttaaccgacacaagtcgtcctaatgaccccaccaatgggaactgcgttggaccttttgggacagcggtg

SEQ ID NO: 420402 - DNA, 140 bp, Artificial Sequence
  Synthetic
caccgctgtcccaaaaggtccaacgcagttcccattggtggggtcattaggacgacttgtgtcggttaagatttttgaacacaagtatttgcttgtgtgggtcatcatttcgggatctatcatatcagcagccagggcct

SEQ ID NO: 420403 - DNA, 140 bp, Artificial Sequence
  Synthetic
aggccctggctgctgatatgttcttgatcgtcttttcttcaaatgcatttatcgtcgctttaaatacggtttgaaaagagggccttctacggaaggaatgcctgagtctatgagggaagagaccttttgggacagcggtg

SEQ ID NO: 420404 - DNA, 140 bp, Artificial Sequence
  Synthetic
caccgctgtcccaaaaggtctcttccctcatagactcaggcattccttccgtagaaggccctcttttcaaaccgtatttaaagcgacgataaatgcatttgaagaaaagacgatcaagaacatatcagcagccagggcct

SEQ ID NO: 420405 - DNA, 140 bp, Artificial Sequence
  Synthetic
atacgccatgctgggtctcctgggctataagaacaagaagcggaggaaatactaaccaacagagagcatctgcagggcaaatcagcgtacagcccacattctctgtgcagagaaacctcccgtacttgggagtcggccat

SEQ ID NO: 420406 - DNA, 140 bp, Artificial Sequence
  Synthetic
atggccgactcccaagtacgggaggtttctctgcacagagaatgtgggctgtacgctgatttgccctgcagatgctctctgttggttagtatttcctccgcttcttgttcttatagcccaggagacccagcatggcgtat

SEQ ID NO: 420407 - DNA, 140 bp, Artificial Sequence
  Synthetic
aggccctggctgctgatatgacatgagcaaaaagaagtcctatataaataagactgggacatttgaattcacaagctttttttatcgctatgggtttgtagctaattttagcatggagctgaccttttgggacagcggtg

SEQ ID NO: 420408 - DNA, 140 bp, Artificial Sequence
  Synthetic
caccgctgtcccaaaaggtcagctccatgctaaaattagctacaaacccatagcgataaaaaaagcttgtgaattcaaatgtcccagtcttatttatataggacttctttttgctcatgtcatatcagcagccagggcct

SEQ ID NO: 420409 - DNA, 140 bp, Artificial Sequence
  Synthetic
aggccctggctgctgatatgaagcagggagaatgaactattactggacactagtagagcctggagacaagataacattcgaagcaactggaaatctagtggtaccgagatatgctttcgcgaccttttgggacagcggtg

SEQ ID NO: 420410 - DNA, 140 bp, Artificial Sequence
  Synthetic
caccgctgtcccaaaaggtcgcgaaagcatatctcggtaccactagatttccagttgcttcgaatgttatcttgtctccaggctctactagtgtccagtaatagttcattctccctgcttcatatcagcagccagggcct

SEQ ID NO: 420411 - DNA, 140 bp, Artificial Sequence
  Synthetic
atacgccatgctgggtctccagaacttcagacatgagaactgagatcataaggatgatggaaaatgccagacctgaagatgtgtctttccaggggcggggagtcttcgagctctcggacgcgtacttgggagtcggccat

SEQ ID NO: 420412 - DNA, 140 bp, Artificial Sequence
  Synthetic
atggccgactcccaagtacgcgtccgagagctcgaagactccccgcccctggaaagacacatcttcaggtctggcattttccatcatccttatgatctcagttctcatgtctgaagttctggagacccagcatggcgtat

SEQ ID NO: 420413 - DNA, 140 bp, Artificial Sequence
  Synthetic
atacgccatgctgggtctccaaaatgattgcaatcattgtaatagcgatattggcagcagccggaagatcagacaagatctgcattggatatcatgccaataattcaacaacacaagtggcgtacttgggagtcggccat

SEQ ID NO: 420414 - DNA, 140 bp, Artificial Sequence
  Synthetic
atggccgactcccaagtacgccacttgtgttgttgaattattggcatgatatccaatgcagatcttgtctgatcttccggctgctgccaatatcgctattacaatgattgcaatcattttggagacccagcatggcgtat

SEQ ID NO: 420415 - DNA, 140 bp, Artificial Sequence
  Synthetic
aggccctggctgctgatatgatgaatccaaatcaaaagataataacaattggctctgtttctctcatcattgccacaatatgtttccttatgcaaattgctatcctagtaactactgtaagaccttttgggacagcggtg

SEQ ID NO: 420416 - DNA, 140 bp, Artificial Sequence
  Synthetic
caccgctgtcccaaaaggtcttacagtagttactaggatagcaatttgcataaggaaacatattgtggcaatgatgagagaaacagagccaattgttattatcttttgatttggattcatcatatcagcagccagggcct

SEQ ID NO: 420417 - DNA, 140 bp, Artificial Sequence
  Synthetic
aggccctggctgctgatatgcaacaaatgcgtgatgtactgggaacgtttgatacggtccagataataaagctgttaccatttgcagcagccccaccggagcaaagcagaatgcagttttgaccttttgggacagcggtg

SEQ ID NO: 420418 - DNA, 140 bp, Artificial Sequence
  Synthetic
caccgctgtcccaaaaggtcaaaactgcattctgctttgctccggtggggctgctgcaaatggtaacagctttattatctggaccgtatcaaacgttcccagtacatcacgcatttgttgcatatcagcagccagggcct

SEQ ID NO: 420419 - DNA, 140 bp, Artificial Sequence
  Synthetic
aggccctggctgctgatatgatagaaactggtcaaagccgcaatgtaacattacaggatttgcacctttttctaaggacaattcaattcggctttctgctggtggggacatctgggtgacgaccttttgggacagcggtg

SEQ ID NO: 420420 - DNA, 140 bp, Artificial Sequence
  Synthetic
caccgctgtcccaaaaggtcgtcacccagatgtccccaccagcagaaagccgaattgaattgtccttagaaaaaggtgcaaatcctgtaatgttacattgcggctttgaccagtttctatcatatcagcagccagggcct

SEQ ID NO: 420421 - DNA, 140 bp, Artificial Sequence
  Synthetic
aggccctggctgctgatatgaagagaaccttatgtgtcatgcgatcctgacaagtgttatcaatttgcccttgggcagggaacaacattaaacaacggacattcaaataacactgtacatgaccttttgggacagcggtg

SEQ ID NO: 420422 - DNA, 140 bp, Artificial Sequence
  Synthetic
caccgctgtcccaaaaggtcatgtacagtgttatttgaatgtccgttgtttaatgttgttccctgcccaagggcaaattgataacacttgtcaggatcgcatgacacataaggttctcttcatatcagcagccagggcct

SEQ ID NO: 420423 - DNA, 140 bp, Artificial Sequence
  Synthetic
aggccctggctgctgatatggataggaccccttatcgaaccctattgatgaatgaattgggtgttccatttcatttaggaaccaggcaagtgtgcatggcatggtccagctcaagttgtcgaccttttgggacagcggtg

SEQ ID NO: 420424 - DNA, 140 bp, Artificial Sequence
  Synthetic
caccgctgtcccaaaaggtcgacaacttgagctggaccatgccatgcacacttgcctggttcctaaatgaaatggaacacccaattcattcatcaatagggttcgataaggggtcctatccatatcagcagccagggcct

SEQ ID NO: 420425 - DNA, 140 bp, Artificial Sequence
  Synthetic
aggccctggctgctgatatggacactatccgtagtaagtctgctaataggattggccaacctgggactgaacattgggcttcatttcaaggtaggagacacaccagaaacaggaccccctgaccttttgggacagcggtg

SEQ ID NO: 420426 - DNA, 140 bp, Artificial Sequence
  Synthetic
caccgctgtcccaaaaggtcagggggtcctgtttctggtgtgtctcctaccttgaaatgaagcccaatgttcagtcccaggttggccaatcctattagcagacttactacggatagtgtccatatcagcagccagggcct

SEQ ID NO: 420427 - DNA, 140 bp, Artificial Sequence
  Synthetic
aggccctggctgctgatatgcaatgataagcaaatgtaggaccaaagaaggaagacggaaaacaaacctgtatgggttcatcataaaaggaaggtctcatttgagaaatgatactgatgtgaccttttgggacagcggtg

SEQ ID NO: 420428 - DNA, 140 bp, Artificial Sequence
  Synthetic
caccgctgtcccaaaaggtcacatcagtatcatttctcaaatgagaccttccttttatgatgaacccatacaggtttgttttccgtcttccttctttggtcctacatttgcttatcattgcatatcagcagccagggcct

SEQ ID NO: 420429 - DNA, 140 bp, Artificial Sequence
  Synthetic
atacgccatgctgggtctccagtaccaatgagacaaactccacaaccacaataatcaactacaacacccaaaacaacttcacaaatgtgaccaatattgtgttaattaaagaagaaaacacgtacttgggagtcggccat

SEQ ID NO: 420430 - DNA, 140 bp, Artificial Sequence
  Synthetic
atggccgactcccaagtacgtgttttcttctttaattaacacaatattggtcacatttgtgaagttgttttgggtgttgtagttgattattgtggttgtggagtttgtctcattggtactggagacccagcatggcgtat

SEQ ID NO: 420431 - DNA, 140 bp, Artificial Sequence
  Synthetic
aggccctggctgctgatatgatggtccaaaaatatactcagaacccaggagtcggaatgcgtctgtatcaatggaacctgtacagtagtaatgactgatgggagcgcttcaggaaaagctgaccttttgggacagcggtg

SEQ ID NO: 420432 - DNA, 140 bp, Artificial Sequence
  Synthetic
caccgctgtcccaaaaggtcagcttttcctgaagcgctcccatcagtcattactactgtacaggttccattgatacagacgcattccgactcctgggttctgagtatatttttggaccatcatatcagcagccagggcct

SEQ ID NO: 420433 - DNA, 140 bp, Artificial Sequence
  Synthetic
atacgccatgctgggtctccattctatctaaggacaatgcgatcagaataggggaggatgcccacatccttgtcacaagagaaccatatctctcatgtggaccacatgagtgcagaatgtcgtacttgggagtcggccat

SEQ ID NO: 420434 - DNA, 140 bp, Artificial Sequence
  Synthetic
atggccgactcccaagtacgacattctgcactcatgtggtccacatgagagatatggttctcttgtgacaaggatgtgggcatcctcccctattctgatcgcattgtccttagatagaatggagacccagcatggcgtat

SEQ ID NO: 420435 - DNA, 140 bp, Artificial Sequence
  Synthetic
atacgccatgctgggtctccttgccctcagccaaggtaccacactaaggggtcggcatgcaaatgggactatacatgatagaagcccatttagggcattaataagttgggaaatggggcacgtacttgggagtcggccat

SEQ ID NO: 420436 - DNA, 140 bp, Artificial Sequence
  Synthetic
atggccgactcccaagtacgtgccccatttcccaacttattaatgccctaaatgggcttctatcatgtatagtcccatttgcatgccgaccccttagtgtggtaccttggctgagggcaaggagacccagcatggcgtat

SEQ ID NO: 420437 - DNA, 140 bp, Artificial Sequence
  Synthetic
aggccctggctgctgatatggtagttattgcctagatcctaacaatgagaaaggtggtcatggggtaaaaggctgggcctttgatgatggaaatgacgtgtggatgggaaggacaataaagaccttttgggacagcggtg

SEQ ID NO: 420438 - DNA, 140 bp, Artificial Sequence
  Synthetic
caccgctgtcccaaaaggtctttattgtccttcccatccacacgtcatttccatcatcaaaggcccagccttttaccccatgaccacctttctcattgttaggatctaggcaataactaccatatcagcagccagggcct

SEQ ID NO: 420439 - DNA, 140 bp, Artificial Sequence
  Synthetic
aggccctggctgctgatatggacctgctgtgaacggccaaaggagcagaattgattattactggtctgtcttgagaccaggggaaaccttaaatgtggagtccaatggaaatctaattgcgaccttttgggacagcggtg

SEQ ID NO: 420440 - DNA, 140 bp, Artificial Sequence
  Synthetic
caccgctgtcccaaaaggtcgcaattagatttccattggactccacatttaaggtttcccctggtctcaagacagaccagtaataatcaattctgctcctttggccgttcacagcaggtccatatcagcagccagggcct

SEQ ID NO: 420441 - DNA, 140 bp, Artificial Sequence
  Synthetic
atacgccatgctgggtctcctggatgtctggacgtacaatgctgaattgctagttcttcttgaaaacgaaagaacactagacctgcatgatgcgaatgtgaaaaatctatatgaaaaagtcgtacttgggagtcggccat

SEQ ID NO: 420442 - DNA, 140 bp, Artificial Sequence
  Synthetic
atggccgactcccaagtacgactttttcatatagatttttcacattcgcatcatgcaggtctagtgttctttcgttttcaagaagaactagcaattcagcattgtacgtccagacatccaggagacccagcatggcgtat

SEQ ID NO: 420443 - DNA, 140 bp, Artificial Sequence
  Synthetic
atacgccatgctgggtctcctatgccataatggaatatgccctgtggtgatgacggatggcccagccaataacagagcagagacaaaaataatttatttcaaggagggaaaagtacagaacgtacttgggagtcggccat

SEQ ID NO: 420444 - DNA, 140 bp, Artificial Sequence
  Synthetic
atggccgactcccaagtacgttctgtacttttccctccttgaaataaattatttttgtctctgctctgttattggctgggccatccgtcatcaccacagggcatattccattatggcataggagacccagcatggcgtat

SEQ ID NO: 420445 - DNA, 140 bp, Artificial Sequence
  Synthetic
atacgccatgctgggtctccaattctggcataaatgtgacaatgagtgcatagagtctgtcaaaaatggtacctatgactatcccaaataccaggacgagagcaaattgaacagacaggacgtacttgggagtcggccat

SEQ ID NO: 420446 - DNA, 140 bp, Artificial Sequence
  Synthetic
atggccgactcccaagtacgtcctgtctgttcaatttgctctcgtcctggtatttgggatagtcataggtaccatttttgacagactctatgcactcattgtcacatttatgccagaattggagacccagcatggcgtat

SEQ ID NO: 420447 - DNA, 140 bp, Artificial Sequence
  Synthetic
aggccctggctgctgatatggcaaatagaccagtaatcaccataaacccaaaaacgatgactcatacgagcaaatacttgtgttcaaagatcctaactgacacaagtcggcctaatgatcgaccttttgggacagcggtg

SEQ ID NO: 420448 - DNA, 140 bp, Artificial Sequence
  Synthetic
caccgctgtcccaaaaggtcgatcattaggccgacttgtgtcagttaggatctttgaacacaagtatttgctcgtatgagtcatcgtttttgggtttatggtgattactggtctatttgccatatcagcagccagggcct

SEQ ID NO: 420449 - DNA, 140 bp, Artificial Sequence
  Synthetic
aggccctggctgctgatatgatggcgtctcaaggcaccaaacgatcatatgaacaaatggagactggtggggagcgccaggatgccacagaaatcagagcatctgtcggaagaatgattggaccttttgggacagcggtg

SEQ ID NO: 420450 - DNA, 140 bp, Artificial Sequence
  Synthetic
caccgctgtcccaaaaggtccaatcattcttccgacagatgctctgatttctgtggcatcctggcgctccccaccagtctccatttgttcatatgatcgtttggtgccttgagacgccatcatatcagcagccagggcct

SEQ ID NO: 420451 - DNA, 140 bp, Artificial Sequence
  Synthetic
aggccctggctgctgatatgccggaagcgggaactgtgatgcaccgataacaggagggagcccagatcctggcgtaaagggatttgcattcttagatggagggaattcctggttgggaaggaccttttgggacagcggtg

SEQ ID NO: 420452 - DNA, 140 bp, Artificial Sequence
  Synthetic
caccgctgtcccaaaaggtccttcccaaccaggaattccctccatctaagaatgcaaatccctttacgccaggatctgggctccctcctgttatcggtgcatcacagttcccgcttccggcatatcagcagccagggcct

SEQ ID NO: 420453 - DNA, 140 bp, Artificial Sequence
  Synthetic
aggccctggctgctgatatgatgcggaaacagacaatcaatccggtccagttgcacatcagataatagtgaacaatcaaaactggtcaggatactcaggagcgttcatcgattattgggcgaccttttgggacagcggtg

SEQ ID NO: 420454 - DNA, 140 bp, Artificial Sequence
  Synthetic
caccgctgtcccaaaaggtcgcccaataatcgatgaacgctcctgagtatcctgaccagttttgattgttcactattatctgatgtgcaactggaccggattgattgtctgtttccgcatcatatcagcagccagggcct

SEQ ID NO: 420455 - DNA, 140 bp, Artificial Sequence
  Synthetic
atacgccatgctgggtctccggccaaaagagagtagtgtattgtggacgtccaatagtatagtagcactctgtggatccaaggagcgattgggatcttggtcatggcatgatggggctgacgtacttgggagtcggccat

SEQ ID NO: 420456 - DNA, 140 bp, Artificial Sequence
  Synthetic
atggccgactcccaagtacgtcagccccatcatgccatgaccaagatcccaatcgctccttggatccacagagtgctactatactattggacgtccacaatacactactctcttttggccggagacccagcatggcgtat

SEQ ID NO: 420457 - DNA, 140 bp, Artificial Sequence
  Synthetic
aggccctggctgctgatatgagtagcactctgtggatccaaggagcgattgggatcttggtcatggcatgatggggctgaaatcatctactttaagtagaaaagattttagaaaaaacacgaccttttgggacagcggtg

SEQ ID NO: 420458 - DNA, 140 bp, Artificial Sequence
  Synthetic
caccgctgtcccaaaaggtcgtgttttttctaaaatcttttctacttaaagtagatgatttcagccccatcatgccatgaccaagatcccaatcgctccttggatccacagagtgctactcatatcagcagccagggcct

SEQ ID NO: 420459 - DNA, 140 bp, Artificial Sequence
  Synthetic
aggccctggctgctgatatggatgggagacctccactccctccaaagcagaaacggaaaatggcgagaacaattgagtcagaagtttgaagaaataaggtggctgattgaagaagtgcgagaccttttgggacagcggtg

SEQ ID NO: 420460 - DNA, 140 bp, Artificial Sequence
  Synthetic
caccgctgtcccaaaaggtctcgcacttcttcaatcagccaccttatttcttcaaacttctgactcaattgttctcgccattttccgtttctgctttggagggagtggaggtctcccatccatatcagcagccagggcct

SEQ ID NO: 420461 - DNA, 140 bp, Artificial Sequence
  Synthetic
aggccctggctgctgatatgaatcaaaggcagggttattagtatctgatggaggaccaaatttatacaatatccggaatcttcacattcctgaagtctgcttaaaatgggagctaatggagaccttttgggacagcggtg

SEQ ID NO: 420462 - DNA, 140 bp, Artificial Sequence
  Synthetic
caccgctgtcccaaaaggtctccattagctcccattttaagcagacttcaggaatgtgaagattccggatattgtataaatttggtcctccatcagatactaataaccctgcctttgattcatatcagcagccagggcct

SEQ ID NO: 420463 - DNA, 140 bp, Artificial Sequence
  Synthetic
aggccctggctgctgatatgaggctgattcagttgatagtaagtggaagagacgaacaatcaatcgctgaagcaatcatcgtagccatggtgttctcacaggaggattgcatgataaagggaccttttgggacagcggtg

SEQ ID NO: 420464 - DNA, 140 bp, Artificial Sequence
  Synthetic
caccgctgtcccaaaaggtccctttatcatgcaatcctcctgtgagaacaccatggctacgatgattgcttcagcgattgattgttcgtctcttccacttactatcaactgaatcagcctcatatcagcagccagggcct

SEQ ID NO: 420465 - DNA, 140 bp, Artificial Sequence
  Synthetic
atacgccatgctgggtctcctgcatatgagagaatgtgcaatattcttaaaggaaaatttcagacagcagcccagagggcaatgatggatcaagtgagagaaagtcgaaacccaggaaatcgtacttgggagtcggccat

SEQ ID NO: 420466 - DNA, 140 bp, Artificial Sequence
  Synthetic
atggccgactcccaagtacgatttcctgggtttcgactttctctcacttgatccatcattgccctctgggctgctgtctgaaattttcctttaagaatattgcacattctctcatatgcaggagacccagcatggcgtat

SEQ ID NO: 420467 - DNA, 140 bp, Artificial Sequence
  Synthetic
aggccctggctgctgatatgcccagagggcaatgatggatcaagtgagagaaagtcgaaacccaggaaatgctgagattgaagatctcattttcctggcacggtcagcacttattctaaggaccttttgggacagcggtg

SEQ ID NO: 420468 - DNA, 140 bp, Artificial Sequence
  Synthetic
caccgctgtcccaaaaggtccttagaataagtgctgaccgtgccaggaaaatgagatcttcaatctcagcatttcctgggtttcgactttctctcacttgatccatcattgccctctgggcatatcagcagccagggcct

SEQ ID NO: 420469 - DNA, 140 bp, Artificial Sequence
  Synthetic
atacgccatgctgggtctccaagaaaactggaggtccgatctacaggaggagagatgggaaatgggtgagagaattgatcctatatgacaaagaagaaatcagaagaatttggcgtcaagcgtacttgggagtcggccat

SEQ ID NO: 420470 - DNA, 140 bp, Artificial Sequence
  Synthetic
atggccgactcccaagtacgcttgacgccaaattcttctgatttcttctttgtcatataggatcaattctctcacccatttcccatctctcctcctgtagatcggacctccagttttcttggagacccagcatggcgtat

SEQ ID NO: 420471 - DNA, 140 bp, Artificial Sequence
  Synthetic
aggccctggctgctgatatggggatcagttgcacataagtcttgcctgcctgcttgtgtgtatgggcttgcagtggcaagtggacatgactttgaaagggaaggatactcactggttggggaccttttgggacagcggtg

SEQ ID NO: 420472 - DNA, 140 bp, Artificial Sequence
  Synthetic
caccgctgtcccaaaaggtccccaaccagtgagtatccttccctttcaaagtcatgtccacttgccactgcaagcccatacacacaagcaggcaggcaagacttatgtgcaactgatccccatatcagcagccagggcct

SEQ ID NO: 420473 - DNA, 140 bp, Artificial Sequence
  Synthetic
atacgccatgctgggtctcctcgctccaaggggccattacaaactcaacagtcaaaagaagagcacaatcctgaatactgcagttcctataggatcctgtgttagtaagtgccacactgacgtacttgggagtcggccat

SEQ ID NO: 420474 - DNA, 140 bp, Artificial Sequence
  Synthetic
atggccgactcccaagtacgtcagtgtggcacttactaacacaggatcctataggaactgcagtattcaggattgtgctcttcttttgactgttgagtttgtaatggccccttggagcgaggagacccagcatggcgtat

SEQ ID NO: 420475 - DNA, 140 bp, Artificial Sequence
  Synthetic
aggccctggctgctgatatgttcctttgccatgtcatgctttttgctttgtgctatttggatgggattcataatatgggcctgccagaaaggcaacattaggtgcaacatttgcatctgagaccttttgggacagcggtg

SEQ ID NO: 420476 - DNA, 140 bp, Artificial Sequence
  Synthetic
caccgctgtcccaaaaggtctcagatgcaaatgttgcacctaatgttgcctttctggcaggcccatattatgaatcccatccaaatagcacaaagcaaaaagcatgacatggcaaaggaacatatcagcagccagggcct

SEQ ID NO: 420477 - DNA, 140 bp, Artificial Sequence
  Synthetic
aggccctggctgctgatatgtaagtacagttttaggagtctcgatactgaatcttggacaaaagaaatacaccaagacaacatactggtgggatgggctccaatcctcagacgattttgcgaccttttgggacagcggtg

SEQ ID NO: 420478 - DNA, 140 bp, Artificial Sequence
  Synthetic
caccgctgtcccaaaaggtcgcaaaatcgtctgaggattggagcccatcccaccagtatgttgtcttggtgtatttcttttgtccaagattcagtatcgagactcctaaaactgtacttacatatcagcagccagggcct

SEQ ID NO: 420479 - DNA, 140 bp, Artificial Sequence
  Synthetic
aggccctggctgctgatatggcaacatcctcaaggggaaattccaaacagcagcacaacgagcaatgatggaccaagtgagagaaagccggaatcctgggaatgctgaaattgaagatctgaccttttgggacagcggtg

SEQ ID NO: 420480 - DNA, 140 bp, Artificial Sequence
  Synthetic
caccgctgtcccaaaaggtcagatcttcaatttcagcattcccaggattccggctttctctcacttggtccatcattgctcgttgtgctgctgtttggaatttccccttgaggatgttgccatatcagcagccagggcct

SEQ ID NO: 420481 - DNA, 140 bp, Artificial Sequence
  Synthetic
atacgccatgctgggtctccatggattcaaacactgtgtcaagctttcaggtagactgctttctttggcatgtccgcaaactgtttgcggactgggggcttggcgatgccccattcctcgcgtacttgggagtcggccat

SEQ ID NO: 420482 - DNA, 140 bp, Artificial Sequence
  Synthetic
atggccgactcccaagtacgcgaggaatggggcatcgccaagcccccagtccgcaaacagtttgcggacatgccaaagaaagcagtctacctgaaagcttgacacagtgtttgaatccatggagacccagcatggcgtat

SEQ ID NO: 420483 - DNA, 140 bp, Artificial Sequence
  Synthetic
aggccctggctgctgatatgagtcctgcctgcctgcttgtgtgtatggacttgcagtggccagtggatacgactttgaaagggagggatactccctagtcggaattgatcctttccgtctgaccttttgggacagcggtg

SEQ ID NO: 420484 - DNA, 140 bp, Artificial Sequence
  Synthetic
caccgctgtcccaaaaggtcagacggaaaggatcaattccgactagggagtatccctccctttcaaagtcgtatccactggccactgcaagtccatacacacaagcaggcaggcaggactcatatcagcagccagggcct

SEQ ID NO: 420485 - DNA, 140 bp, Artificial Sequence
  Synthetic
aggccctggctgctgatatgcaataacaaaagaaaagaaagaagagctccaggattgtaaaattgctcccttgatggtggcatacatgctagaaagagagttggttcgtaagacgaggttgaccttttgggacagcggtg

SEQ ID NO: 420486 - DNA, 140 bp, Artificial Sequence
  Synthetic
caccgctgtcccaaaaggtcaacctcgtcttacgaaccaactctctttctagcatgtatgccaccatcaagggagcaattttacaatcctggagctcttctttcttttcttttgttattgcatatcagcagccagggcct

SEQ ID NO: 420487 - DNA, 140 bp, Artificial Sequence
  Synthetic
atacgccatgctgggtctccttgatggtggcatacatgctagaaagagagttggttcgtaagacgaggtttctcccggtggctggtggaacaagcagtgtttatattgaagtgctgcactcgtacttgggagtcggccat

SEQ ID NO: 420488 - DNA, 140 bp, Artificial Sequence
  Synthetic
atggccgactcccaagtacgagtgcagcacttcaatataaacactgcttgttccaccagccaccgggagaaacctcgtcttacgaaccaactctctttctagcatgtatgccaccatcaaggagacccagcatggcgtat

SEQ ID NO: 420489 - DNA, 140 bp, Artificial Sequence
  Synthetic
atacgccatgctgggtctcccgcataaaagccaactggtatggatggcatgccactctgctgcatttgaagatctgagagtatcaagcttcatcagaggaacaagagtagtcccgagaggcgtacttgggagtcggccat

SEQ ID NO: 420490 - DNA, 140 bp, Artificial Sequence
  Synthetic
atggccgactcccaagtacgcctctcgggactactcttgttcctctgatgaagcttgatactctcagatcttcaaatgcagcagagtggcatgccatccataccagttggcttttatgcgggagacccagcatggcgtat

SEQ ID NO: 420491 - DNA, 140 bp, Artificial Sequence
  Synthetic
atacgccatgctgggtctccaaaacttcccggaagtgacaacagcatggcaacgctgtgcctgggacaccatgcagtgccaaacggaacattagtgaaaacaatcacggatgaccaaattcgtacttgggagtcggccat

SEQ ID NO: 420492 - DNA, 140 bp, Artificial Sequence
  Synthetic
atggccgactcccaagtacgaatttggtcatccgtgattgttttcactaatgttccgtttggcactgcatggtgtcccaggcacagcgttgccatgctgttgtcacttccgggaagttttggagacccagcatggcgtat

SEQ ID NO: 420493 - DNA, 140 bp, Artificial Sequence
  Synthetic
aggccctggctgctgatatgcaatggactccagtactcttgaactgaggagcagatactgggctataaggacaagaagcggagggaatactaatcagcagagagcatctgcgggacaaatgaccttttgggacagcggtg

SEQ ID NO: 420494 - DNA, 140 bp, Artificial Sequence
  Synthetic
caccgctgtcccaaaaggtcatttgtcccgcagatgctctctgctgattagtattccctccgcttcttgtccttatagcccagtatctgctcctcagttcaagagtactggagtccattgcatatcagcagccagggcct

SEQ ID NO: 420495 - DNA, 140 bp, Artificial Sequence
  Synthetic
atacgccatgctgggtctccacaagaagcggagggaatactaatcagcagagagcatctgcgggacaaatcagcgttcagcccacattctctgtgcagagaaacctcccgttcgagagagcgtacttgggagtcggccat

SEQ ID NO: 420496 - DNA, 140 bp, Artificial Sequence
  Synthetic
atggccgactcccaagtacgctctctcgaacgggaggtttctctgcacagagaatgtgggctgaacgctgatttgtcccgcagatgctctctgctgattagtattccctccgcttcttgtggagacccagcatggcgtat

SEQ ID NO: 420497 - DNA, 140 bp, Artificial Sequence
  Synthetic
atacgccatgctgggtctcccagtggatcattaggaattgggaaactgtgaaaattcaatggtcccaagatcccacaataatatacaataaaatggaatttgagcctttccagtccttagcgtacttgggagtcggccat

SEQ ID NO: 420498 - DNA, 140 bp, Artificial Sequence
  Synthetic
atggccgactcccaagtacgctaaggactggaaaggctcaaattccattttattgtatattattgtgggatcttgggaccattgaattttcacagtttcccaattcctaatgatccactgggagacccagcatggcgtat

SEQ ID NO: 420499 - DNA, 140 bp, Artificial Sequence
  Synthetic
aggccctggctgctgatatgtaactcaagggacttgttgggaacagatgtacactccaggaggagaagtgagaaatgatgatgtcgaccagagtttgatcattgctgccagaaatattgtgaccttttgggacagcggtg

SEQ ID NO: 420500 - DNA, 140 bp, Artificial Sequence
  Synthetic
caccgctgtcccaaaaggtcacaatatttctggcagcaatgatcaaactctggtcgacatcatcatttctcacttctcctcctggagtgtacatctgttcccaacaagtcccttgagttacatatcagcagccagggcct

SEQ ID NO: 420501 - DNA, 140 bp, Artificial Sequence
  Synthetic
aggccctggctgctgatatgtgccaaacaatgacaaatttgacaaattgtacatttggggggttcaccacccgggtacggacaaggaccaaaccaacctatatgtccaagcatcagggaggaccttttgggacagcggtg

SEQ ID NO: 420502 - DNA, 140 bp, Artificial Sequence
  Synthetic
caccgctgtcccaaaaggtcctccctgatgcttggacatataggttggtttggtccttgtccgtacccgggtggtgaaccccccaaatgtacaatttgtcaaatttgtcattgtttggcacatatcagcagccagggcct

SEQ ID NO: 420503 - DNA, 140 bp, Artificial Sequence
  Synthetic
atacgccatgctgggtctccggtctagaccctgggtaaggggtgtctccagcataataagcatctattggacgatagtaaaaccgggagacatacttttgattaacagcacagggaatctcgtacttgggagtcggccat

SEQ ID NO: 420504 - DNA, 140 bp, Artificial Sequence
  Synthetic
atggccgactcccaagtacgagattccctgtgctgttaatcaaaagtatgtctcccggttttactatcgtccaatagatgcttattatgctggagacaccccttacccagggtctagaccggagacccagcatggcgtat

SEQ ID NO: 420505 - DNA, 140 bp, Artificial Sequence
  Synthetic
aggccctggctgctgatatgaattgcccctcggggttacttcaaaatacaaagtgggaaaagctcaataatgagatcagatgcacacattgatgaatgcaattctgaatgcattactccagaccttttgggacagcggtg

SEQ ID NO: 420506 - DNA, 140 bp, Artificial Sequence
  Synthetic
caccgctgtcccaaaaggtctggagtaatgcattcagaattgcattcatcaatgtgtgcatctgatctcattattgagcttttcccactttgtattttgaagtaaccccgaggggcaattcatatcagcagccagggcct

SEQ ID NO: 420507 - DNA, 140 bp, Artificial Sequence
  Synthetic
aggccctggctgctgatatgatatggagcctgtcccagatatgttaagcaaaacaccctgaaattggcaacaggaatgcggaatgtaccagagaaacaaactagaggcatattcggcgcagaccttttgggacagcggtg

SEQ ID NO: 420508 - DNA, 140 bp, Artificial Sequence
  Synthetic
caccgctgtcccaaaaggtctgcgccgaatatgcctctagtttgtttctctggtacattccgcattcctgttgccaatttcagggtgttttgcttaacatatctgggacaggctccatatcatatcagcagccagggcct

SEQ ID NO: 420509 - DNA, 140 bp, Artificial Sequence
  Synthetic
atacgccatgctgggtctcccaggaatgcggaatgtaccagagaaacaaactagaggcatattcggcgcaattgcaggtttcatagaaaatggttgggagggaatggtagacggttggtacgtacttgggagtcggccat

SEQ ID NO: 420510 - DNA, 140 bp, Artificial Sequence
  Synthetic
atggccgactcccaagtacgtaccaaccgtctaccattccctcccaaccattttctatgaaacctgcaattgcgccgaatatgcctctagtttgtttctctggtacattccgcattcctgggagacccagcatggcgtat

SEQ ID NO: 420511 - DNA, 140 bp, Artificial Sequence
  Synthetic
aggccctggctgctgatatgattgcaggtttcatagaaaatggttgggagggaatggtagacggttggtacggtttcaggcatcagaattctgaaggcacaggacaagcagcagatcttagaccttttgggacagcggtg

SEQ ID NO: 420512 - DNA, 140 bp, Artificial Sequence
  Synthetic
caccgctgtcccaaaaggtctaagatctgctgcttgtcctgtgccttcagaattctgatgcctgaaaccgtaccaaccgtctaccattccctcccaaccattttctatgaaacctgcaatcatatcagcagccagggcct

SEQ ID NO: 420513 - DNA, 140 bp, Artificial Sequence
  Synthetic
atacgccatgctgggtctccagaatccagtgacccaaatgcactcctaaaacacagatttgaaataattgagggaagagatcgcacaatggcttggacagtggtaaacagcatctgcaaccgtacttgggagtcggccat

SEQ ID NO: 420514 - DNA, 140 bp, Artificial Sequence
  Synthetic
atggccgactcccaagtacggttgcagatgctgtttaccactgtccaagccattgtgcgatctcttccctcaattatttcaaatctgtgttttaggagtgcatttgggtcactggattctggagacccagcatggcgtat

SEQ ID NO: 420515 - DNA, 140 bp, Artificial Sequence
  Synthetic
atacgccatgctgggtctccactacaggggttgaaaagcccaagttccttccggatctatatgactataaggagaaccgattcattgaaataggtgtaacaagaagggaagttcacatatcgtacttgggagtcggccat

SEQ ID NO: 420516 - DNA, 140 bp, Artificial Sequence
  Synthetic
atggccgactcccaagtacgatatgtgaacttcccttcttgttacacctatttcaatgaatcggttctccttatagtcatatagatccggaaggaacttgggcttttcaacccctgtagtggagacccagcatggcgtat

SEQ ID NO: 420517 - DNA, 140 bp, Artificial Sequence
  Synthetic
atacgccatgctgggtctcctagatctctggtcttacaacgctgagcttcttgttgccctggagaaccaacatacaattgatttaaccgactcagagatgagcaaactgttcgaaagaaccgtacttgggagtcggccat

SEQ ID NO: 420518 - DNA, 140 bp, Artificial Sequence
  Synthetic
atggccgactcccaagtacggttctttcgaacagtttgctcatctctgagtcggttaaatcaattgtatgttggttctccagggcaacaagaagctcagcgttgtaagaccagagatctaggagacccagcatggcgtat

SEQ ID NO: 420519 - DNA, 140 bp, Artificial Sequence
  Synthetic
atacgccatgctgggtctccaaatataccacaaatgtgacaatacctgcataggatcaatcagaaatggaacttatgaccatgatatatacagaaacgaggcattaaacaatcggttccacgtacttgggagtcggccat

SEQ ID NO: 420520 - DNA, 140 bp, Artificial Sequence
  Synthetic
atggccgactcccaagtacgtggaaccgattgtttaatgcctcgtttctgtatatatcatggtcataagttccatttctgattgatcctatgcaggtattgtcacatttgtggtatatttggagacccagcatggcgtat

SEQ ID NO: 420521 - DNA, 140 bp, Artificial Sequence
  Synthetic
atacgccatgctgggtctccccttgagagaagaattggcaatctgaataagagaatggaagatgggtttctggatgtttggacttacaatgctgagttgttggttcttcttgaaaatgaacgtacttgggagtcggccat

SEQ ID NO: 420522 - DNA, 140 bp, Artificial Sequence
  Synthetic
atggccgactcccaagtacgttcattttcaagaagaaccaacaactcagcattgtaagtccaaacatccagaaacccatcttccattctcttattcagattgccaattcttctctcaaggggagacccagcatggcgtat

SEQ ID NO: 420523 - DNA, 140 bp, Artificial Sequence
  Synthetic
aggccctggctgctgatatgtttcctttgccatatcatgctttttgctttgtgttgttctgctggggttcattatgtgggcctgccaaaaaggcaacattaggtgcaacatttgcatttggaccttttgggacagcggtg

SEQ ID NO: 420524 - DNA, 140 bp, Artificial Sequence
  Synthetic
caccgctgtcccaaaaggtccaaatgcaaatgttgcacctaatgttgcctttttggcaggcccacataatgaaccccagcagaacaacacaaagcaaaaagcatgatatggcaaaggaaacatatcagcagccagggcct

SEQ ID NO: 420525 - DNA, 140 bp, Artificial Sequence
  Synthetic
aggccctggctgctgatatgggattaagaaggaagagttctctgagatcatgaagatctgttccaccattgaagaactcagacggcaaaaataatgaatttagcttgtccttcatgaaaagaccttttgggacagcggtg

SEQ ID NO: 420526 - DNA, 140 bp, Artificial Sequence
  Synthetic
caccgctgtcccaaaaggtcttttcatgaaggacaagctaaattcattatttttgccgtctgagttcttcaatggtggaacagatcttcatgatctcagagaactcttccttcttaatcccatatcagcagccagggcct

SEQ ID NO: 420527 - DNA, 140 bp, Artificial Sequence
  Synthetic
aggccctggctgctgatatgggcctcgatatcgaaactgccactcttgttgggaaacaaattgtggagtggattttgagagaggaatccagcgagacacttaagatgaccattgcatctggaccttttgggacagcggtg

SEQ ID NO: 420528 - DNA, 140 bp, Artificial Sequence
  Synthetic
caccgctgtcccaaaaggtccagatgcaatggtcatcttaagtgtctcgctggattcctctctcaaaatccactccacaatttgtttcccaacaagagtggcagtttcgatatcgaggcccatatcagcagccagggcct

SEQ ID NO: 420529 - DNA, 140 bp, Artificial Sequence
  Synthetic
aggccctggctgctgatatgattaatgatccctgggttttgctcaatgcgtcttggttcaactccttcctgacacatgcattaaaatagttatggcagtgctactgtttgttatccgtacgaccttttgggacagcggtg

SEQ ID NO: 420530 - DNA, 140 bp, Artificial Sequence
  Synthetic
caccgctgtcccaaaaggtcgtacggataacaaacagtagcactgccataactattttaatgcatgtgtcaggaaggagttgaaccaagacgcattgagcaaaacccagggatcattaatcatatcagcagccagggcct

SEQ ID NO: 420531 - DNA, 140 bp, Artificial Sequence
  Synthetic
aggccctggctgctgatatgaagtcagttaaaatgggcacttggtgaaaacatggcacctgagaaggtggattttgaagattgcaaagatatcggtgatttaaaacagtatgatagtgatgaccttttgggacagcggtg

SEQ ID NO: 420532 - DNA, 140 bp, Artificial Sequence
  Synthetic
caccgctgtcccaaaaggtcatcactatcatactgttttaaatcaccgatatctttgcaatcttcaaaatccaccttctcaggtgccatgttttcaccaagtgcccattttaactgacttcatatcagcagccagggcct

SEQ ID NO: 420533 - DNA, 140 bp, Artificial Sequence
  Synthetic
atacgccatgctgggtctcctcagtgtgatctttaaccgattagagactttgatactactaagggctttcactgaggagggagcaatcgttggagaaatttcaccattaccttctcttcccgtacttgggagtcggccat

SEQ ID NO: 420534 - DNA, 140 bp, Artificial Sequence
  Synthetic
atggccgactcccaagtacgggaagagaaggtaatggtgaaatttctccaacgattgctccctcctcagtgaaagcccttagtagtatcaaagtctctaatcggttaaagatcacactgaggagacccagcatggcgtat

SEQ ID NO: 420535 - DNA, 140 bp, Artificial Sequence
  Synthetic
atacgccatgctgggtctccacagcagaagtgtctcattgcagggccacggaatacataatgaaaggagtgtatataaacacagccttactcaatgcatcttgtgcagcaatggatgattcgtacttgggagtcggccat

SEQ ID NO: 420536 - DNA, 140 bp, Artificial Sequence
  Synthetic
atggccgactcccaagtacgaatcatccattgctgcacaagatgcattgagtaaggctgtgtttatatacactcctttcattatgtattccgtggccctgcaatgagacacttctgctgtggagacccagcatggcgtat

SEQ ID NO: 420537 - DNA, 140 bp, Artificial Sequence
  Synthetic
aggccctggctgctgatatggtatataaacacagccttactcaatgcatcttgtgcagcaatggatgattttcagttaatcccaatgataagcaaatgcagaacgaaagagggaaggcgggaccttttgggacagcggtg

SEQ ID NO: 420538 - DNA, 140 bp, Artificial Sequence
  Synthetic
caccgctgtcccaaaaggtcccgccttccctctttcgttctgcatttgcttatcattgggattaactgaaaatcatccattgctgcacaagatgcattgagtaaggctgtgtttatataccatatcagcagccagggcct

SEQ ID NO: 420539 - DNA, 140 bp, Artificial Sequence
  Synthetic
atacgccatgctgggtctcccgacactgatgtggtaaactttgtgagtatggaattttctctcactgacccgaggctggagccacataagtgggagaagtattgcgttcttgaaataggacgtacttgggagtcggccat

SEQ ID NO: 420540 - DNA, 140 bp, Artificial Sequence
  Synthetic
atggccgactcccaagtacgtcctatttcaagaacgcaatacttctcccacttatgtggctccagcctcgggtcagtgagagaaaattccatactcacaaagtttaccacatcagtgtcgggagacccagcatggcgtat

SEQ ID NO: 420541 - DNA, 140 bp, Artificial Sequence
  Synthetic
atacgccatgctgggtctccgtatgtgagaaccaatggaacctcaaaaatcaaaatgaaatggggtatggaaatgaggcgttgccttcttcagtctcttcaacagattgagagcatgatccgtacttgggagtcggccat

SEQ ID NO: 420542 - DNA, 140 bp, Artificial Sequence
  Synthetic
atggccgactcccaagtacggatcatgctctcaatctgttgaagagactgaagaaggcaacgcctcatttccataccccatttcattttgatttttgaggttccattggttctcacatacggagacccagcatggcgtat

SEQ ID NO: 420543 - DNA, 140 bp, Artificial Sequence
  Synthetic
atacgccatgctgggtctccgaagcggaatcttctgttaaagagaaggacatgaccaaagaattttttgaaaacaagtctgaagtatggcccattggggaatcgcccaacggggtggaagcgtacttgggagtcggccat

SEQ ID NO: 420544 - DNA, 140 bp, Artificial Sequence
  Synthetic
atggccgactcccaagtacgcttccaccccgttgggcgattccccaatgggccatacttcagacttgttttcaaaaaattctttggtcatgtccttctctttaacagaagattccgcttcggagacccagcatggcgtat

SEQ ID NO: 420545 - DNA, 140 bp, Artificial Sequence
  Synthetic
atacgccatgctgggtctccaatagcctgtatgcatcttcacaactagaaggattttcagctgaatcaagaaagttacttctaattgttcaggcacttagggacaacctggaacctgggacgtacttgggagtcggccat

SEQ ID NO: 420546 - DNA, 140 bp, Artificial Sequence
  Synthetic
atggccgactcccaagtacgtcccaggttccaggttgtccctaagtgcctgaacaattagaagtaactttcttgattcagctgaaaatccttctagttgtgaagatgcatacaggctattggagacccagcatggcgtat

SEQ ID NO: 420547 - DNA, 140 bp, Artificial Sequence
  Synthetic
aggccctggctgctgatatgcaggacctgcaagttagtaggaatcaacatgagcaaaaagaagtcctatataaataagactgggacatttgaattcacaagctttttttatcgctatggggaccttttgggacagcggtg

SEQ ID NO: 420548 - DNA, 140 bp, Artificial Sequence
  Synthetic
caccgctgtcccaaaaggtccccatagcgataaaaaaagcttgtgaattcaaatgtcccagtcttatttatataggacttctttttgctcatgttgattcctactaacttgcaggtcctgcatatcagcagccagggcct

SEQ ID NO: 420549 - DNA, 140 bp, Artificial Sequence
  Synthetic
aggccctggctgctgatatggatccctgggttttgcttaatgcatcttggttcaactccttccttatgcatgcactgaaataattatagcaatgctactacttgctatccatactgtccagaccttttgggacagcggtg

SEQ ID NO: 420550 - DNA, 140 bp, Artificial Sequence
  Synthetic
caccgctgtcccaaaaggtctggacagtatggatagcaagtagtagcattgctataattatttcagtgcatgcataaggaaggagttgaaccaagatgcattaagcaaaacccagggatccatatcagcagccagggcct

SEQ ID NO: 420551 - DNA, 140 bp, Artificial Sequence
  Synthetic
aggccctggctgctgatatgtgccagcacaaaatgctataagcactacattcccttatactggagatcccccatatagtcatggaactgggacaggatacaccatggacaccgtcaacaggaccttttgggacagcggtg

SEQ ID NO: 420552 - DNA, 140 bp, Artificial Sequence
  Synthetic
caccgctgtcccaaaaggtcctgttgacggtgtccatggtgtatcctgtcccagttccatgactatatgggggatctccagtataagggaatgtagtgcttatagcattttgtgctggcacatatcagcagccagggcct

SEQ ID NO: 420553 - DNA, 140 bp, Artificial Sequence
  Synthetic
atacgccatgctgggtctcctcctaaatctgaccaagcccctatgtgaggtaaactcatggcacatcttgtcgaaagacaatgcaataagaataggagaggatgctcatatactagtcaccgtacttgggagtcggccat

SEQ ID NO: 420554 - DNA, 140 bp, Artificial Sequence
  Synthetic
atggccgactcccaagtacggtgactagtatatgagcatcctctcctattcttattgcattgtctttcgacaagatgtgccatgagtttacctcacataggggcttggtcagatttaggaggagacccagcatggcgtat

SEQ ID NO: 420555 - DNA, 140 bp, Artificial Sequence
  Synthetic
aggccctggctgctgatatgccaagcgggtatgctcaaacagattgtgtcctggaggcaatggcttttcttgaggaatcccatccagggatttttgaaaactcttgtcttgaaacgatgggaccttttgggacagcggtg

SEQ ID NO: 420556 - DNA, 140 bp, Artificial Sequence
  Synthetic
caccgctgtcccaaaaggtcccatcgtttcaagacaagagttttcaaaaatccctggatgggattcctcaagaaaagccattgcctccaggacacaatctgtttgagcatacccgcttggcatatcagcagccagggcct

SEQ ID NO: 420557 - DNA, 140 bp, Artificial Sequence
  Synthetic
atacgccatgctgggtctcctgaggaatcccatccagggatttttgaaaactcttgtcttgaaacgatggaagttgtccaacaaacaagagtggacaaactgactcaaggtcgtcagactcgtacttgggagtcggccat

SEQ ID NO: 420558 - DNA, 140 bp, Artificial Sequence
  Synthetic
atggccgactcccaagtacgagtctgacgaccttgagtcagtttgtccactcttgtttgttggacaacttccatcgtttcaagacaagagttttcaaaaatccctggatgggattcctcaggagacccagcatggcgtat

SEQ ID NO: 420559 - DNA, 140 bp, Artificial Sequence
  Synthetic
aggccctggctgctgatatgatccacaatagcactgctaattgggataggcaacttagctttcaatgcagttattcatggcaaagttgagaacagtaacggtggaattgcaccaaccaccgaccttttgggacagcggtg

SEQ ID NO: 420560 - DNA, 140 bp, Artificial Sequence
  Synthetic
caccgctgtcccaaaaggtcggtggttggtgcaattccaccgttactgttctcaactttgccatgaataactgcattgaaagctaagttgcctatcccaattagcagtgctattgtggatcatatcagcagccagggcct

SEQ ID NO: 420561 - DNA, 140 bp, Artificial Sequence
  Synthetic
aggccctggctgctgatatgtctgttcaacatgagttcagtgaaattgaagagagaataaaccagttgtcaaaacatgtggacgattctgttattgacatatggtcatacaacgcacagcgaccttttgggacagcggtg

SEQ ID NO: 420562 - DNA, 140 bp, Artificial Sequence
  Synthetic
caccgctgtcccaaaaggtcgctgtgcgttgtatgaccatatgtcaataacagaatcgtccacatgttttgacaactggtttattctctcttcaatttcactgaactcatgttgaacagacatatcagcagccagggcct

SEQ ID NO: 420563 - DNA, 140 bp, Artificial Sequence
  Synthetic
atacgccatgctgggtctcccacaatagaagtcttcaggacgaacagtctaacagccaatgaatcgggaagattaatagatttccttaaggatgtgatggaatcaatggataaagaagatcgtacttgggagtcggccat

SEQ ID NO: 420564 - DNA, 140 bp, Artificial Sequence
  Synthetic
atggccgactcccaagtacgatcttctttatccattgattccatcacatccttaaggaaatctattaatcttcccgattcattggctgttagactgttcgtcctgaagacttctattgtgggagacccagcatggcgtat

SEQ ID NO: 420565 - DNA, 140 bp, Artificial Sequence
  Synthetic
aggccctggctgctgatatggattaatagatttccttaaggatgtgatggaatcaatggataaagaagatatggaaataacaacacatttccaaaggaaaagaagaataagggacaacatgaccttttgggacagcggtg

SEQ ID NO: 420566 - DNA, 140 bp, Artificial Sequence
  Synthetic
caccgctgtcccaaaaggtcatgttgtcccttattcttcttttcctttggaaatgtgttgttatttccatatcttctttatccattgattccatcacatccttaaggaaatctattaatccatatcagcagccagggcct

SEQ ID NO: 420567 - DNA, 140 bp, Artificial Sequence
  Synthetic
atacgccatgctgggtctccgttcgaaaccttcatgaaaaggtcagacgaatgctgaaggacaatgccaaagatgaagggaacggttgtttcaccttctatcacaagtgtgataatgagtcgtacttgggagtcggccat

SEQ ID NO: 420568 - DNA, 140 bp, Artificial Sequence
  Synthetic
atggccgactcccaagtacgactcattatcacacttgtgatagaaggtgaaacaaccgttcccttcatctttggcattgtccttcagcattcgtctgaccttttcatgaaggtttcgaacggagacccagcatggcgtat

SEQ ID NO: 420569 - DNA, 140 bp, Artificial Sequence
  Synthetic
aggccctggctgctgatatgtgaacaagaggaattatctaataagagcattgacattaaacacaatgacaaaggatgcagaaagaggcaaattgaaaaggcgtgcaattgcaacaccagggaccttttgggacagcggtg

SEQ ID NO: 420570 - DNA, 140 bp, Artificial Sequence
  Synthetic
caccgctgtcccaaaaggtccctggtgttgcaattgcacgccttttcaatttgcctctttctgcatcctttgtcattgtgtttaatgtcaatgctcttattagataattcctcttgttcacatatcagcagccagggcct

SEQ ID NO: 420571 - DNA, 140 bp, Artificial Sequence
  Synthetic
atacgccatgctgggtctcctggcaacgtctacaaaatactgtcaatttacagctgcattgcaagcagtcttgtgttagcagcaatcattatggggttcatcctctgggcgtgtagcaatcgtacttgggagtcggccat

SEQ ID NO: 420572 - DNA, 140 bp, Artificial Sequence
  Synthetic
atggccgactcccaagtacgattgctacacgcccagaggatgaaccccataatgattgctgctaacacaagactgcttgcaatgcagctgtaaattgacagtattttgtagacgttgccaggagacccagcatggcgtat

SEQ ID NO: 420573 - DNA, 140 bp, Artificial Sequence
  Synthetic
atacgccatgctgggtctcctgtgggacactgtcacaggtgttgacatggctctgtaatggaggaatggttaagtctgttctaaaccctttgttcctgttttgtttgaacaattgtccttcgtacttgggagtcggccat

SEQ ID NO: 420574 - DNA, 140 bp, Artificial Sequence
  Synthetic
atggccgactcccaagtacgaaggacaattgttcaaacaaaacaggaacaaagggtttagaacagacttaaccattcctccattacagagccatgtcaacacctgtgacagtgtcccacaggagacccagcatggcgtat

SEQ ID NO: 420575 - DNA, 140 bp, Artificial Sequence
  Synthetic
aggccctggctgctgatatgatcaaaaccccaggatgtttctggcgatgataacatacatcacaagaaatcagcctgaatggttcagaaatgtcttaagcatcgcacctataatgttctcgaccttttgggacagcggtg

SEQ ID NO: 420576 - DNA, 140 bp, Artificial Sequence
  Synthetic
caccgctgtcccaaaaggtcgagaacattataggtgcgatgcttaagacatttctgaaccattcaggctgatttcttgtgatgtatgttatcatcgccagaaacatcctggggttttgatcatatcagcagccagggcct

SEQ ID NO: 420577 - DNA, 140 bp, Artificial Sequence
  Synthetic
atacgccatgctgggtctcctgataaacaatgaccttgggccagcaacagcccaaatggctcttcaactgttcatcaaggactacaggtacacatatcggtgtcacagaggagacacacacgtacttgggagtcggccat

SEQ ID NO: 420578 - DNA, 140 bp, Artificial Sequence
  Synthetic
atggccgactcccaagtacgtgtgtgtctcctctgtgacaccgatatgtgtacctgtagtccttgatgaacagttgaagagccatttgggctgttgctggcccaaggtcattgtttatcaggagacccagcatggcgtat

SEQ ID NO: 420579 - DNA, 140 bp, Artificial Sequence
  Synthetic
atacgccatgctgggtctcctgaagctacgaacacaaataccagcagaaatgctcgcagaaattgacttgaaatacttcaatgaatcaacaagagaaaagatcgagaagataaggccactcgtacttgggagtcggccat

SEQ ID NO: 420580 - DNA, 140 bp, Artificial Sequence
  Synthetic
atggccgactcccaagtacgagtggccttatcttctcgatcttttctcttgttgattcattgaagtatttcaagtcaatttctgcgagcatttctgctggtatttgtgttcgtagcttcaggagacccagcatggcgtat

SEQ ID NO: 420581 - DNA, 140 bp, Artificial Sequence
  Synthetic
aggccctggctgctgatatgaaatacttcaatgaatcaacaagagaaaagatcgagaagataaggccactactcatcgatggcactgcctcgctaagtcctggaatgatgatgggcatgtgaccttttgggacagcggtg

SEQ ID NO: 420582 - DNA, 140 bp, Artificial Sequence
  Synthetic
caccgctgtcccaaaaggtcacatgcccatcatcattccaggacttagcgaggcagtgccatcgatgagtagtggccttatcttctcgatcttttctcttgttgattcattgaagtatttcatatcagcagccagggcct

SEQ ID NO: 420583 - DNA, 140 bp, Artificial Sequence
  Synthetic
atacgccatgctgggtctccgagagagtggtcgtgagtattgatcgtttcttgagggtccgagaccagaggggaaacgtactcctgtctcctgaagaggttagtgaaacacagggaacagcgtacttgggagtcggccat

SEQ ID NO: 420584 - DNA, 140 bp, Artificial Sequence
  Synthetic
atggccgactcccaagtacgctgttccctgtgtttcactaacctcttcaggagacaggagtacgtttcccctctggtctcggaccctcaagaaacgatcaatactcacgaccactctctcggagacccagcatggcgtat

SEQ ID NO: 420585 - DNA, 140 bp, Artificial Sequence
  Synthetic
atacgccatgctgggtctccaagaggtacactaaaaccaccttctggtgggatggactccaatcttctgatgactttgccctcatagtgaatgcacctaatcatgaaggaatacaagctgcgtacttgggagtcggccat

SEQ ID NO: 420586 - DNA, 140 bp, Artificial Sequence
  Synthetic
atggccgactcccaagtacgcagcttgtattccttcatgattaggtgcattcactatgagggcaaagtcatcagaagattggagtccatcccaccagaaggtggttttagtgtacctcttggagacccagcatggcgtat

SEQ ID NO: 420587 - DNA, 140 bp, Artificial Sequence
  Synthetic
atacgccatgctgggtctccccctaaaaggaaccgctccatcctcaatacaagccaaaggggaatccttgaagacgaacaaatgtaccaaaaatgctgcaatctgttcgagaaattcttccgtacttgggagtcggccat

SEQ ID NO: 420588 - DNA, 140 bp, Artificial Sequence
  Synthetic
atggccgactcccaagtacggaagaatttctcgaacagattgcagcatttttggtacatttgttcgtcttcaaggattcccctttggcttgtattgaggatggagcggttccttttagggggagacccagcatggcgtat

SEQ ID NO: 420589 - DNA, 140 bp, Artificial Sequence
  Synthetic
atacgccatgctgggtctccaacatattaaccaaaactgagaacagcttcgagcagataacgttcttgcaggcattgcaactcttacttgaagttgagagtgagataaggacattttcttcgtacttgggagtcggccat

SEQ ID NO: 420590 - DNA, 140 bp, Artificial Sequence
  Synthetic
atggccgactcccaagtacgaagaaaatgtccttatctcactctcaacttcaagtaagagttgcaatgcctgcaagaacgttatctgctcgaagctgttctcagttttggttaatatgttggagacccagcatggcgtat

SEQ ID NO: 420591 - DNA, 140 bp, Artificial Sequence
  Synthetic
aggccctggctgctgatatgacaggagtcgataagcctaaatttctcccagatttgtatgactacaaagagaaccgattcattgaaattggagtgacacgaagggaagttcacatatactgaccttttgggacagcggtg

SEQ ID NO: 420592 - DNA, 140 bp, Artificial Sequence
  Synthetic
caccgctgtcccaaaaggtcagtatatgtgaacttcccttcgtgtcactccaatttcaatgaatcggttctctttgtagtcatacaaatctgggagaaatttaggcttatcgactcctgtcatatcagcagccagggcct

SEQ ID NO: 420593 - DNA, 140 bp, Artificial Sequence
  Synthetic
atacgccatgctgggtctcctgtcgagcttgcggaaaaggcaatgaaagaatatggggaagacccgaaaattgagaccaacaagttcgctgcaatatgcacccatttagaagtatgtttccgtacttgggagtcggccat

SEQ ID NO: 420594 - DNA, 140 bp, Artificial Sequence
  Synthetic
atggccgactcccaagtacggaaacatacttctaaatgggtgcatattgcagcgaacttgttggtctcaattttcgggtcttccccatattctttcattgccttttccgcaagctcgacaggagacccagcatggcgtat

SEQ ID NO: 420595 - DNA, 140 bp, Artificial Sequence
  Synthetic
atacgccatgctgggtctccgaccgattcaagctgggtagaacttgatgaaataggggaagatgttgctccaatcgaacacattgcaagcatgagacggaactattttacagcagaggtgcgtacttgggagtcggccat

SEQ ID NO: 420596 - DNA, 140 bp, Artificial Sequence
  Synthetic
atggccgactcccaagtacgcacctctgctgtaaaatagttccgtctcatgcttgcaatgtgttcgattggagcaacatcttcccctatttcatcaagttctacccagcttgaatcggtcggagacccagcatggcgtat

SEQ ID NO: 420597 - DNA, 140 bp, Artificial Sequence
  Synthetic
atacgccatgctgggtctccgtgataaagaacaacatgataaacaatgatctcgggccagcgacagctcaaatggctcttcagctattcattaaggactacaggtatacataccgatgcccgtacttgggagtcggccat

SEQ ID NO: 420598 - DNA, 140 bp, Artificial Sequence
  Synthetic
atggccgactcccaagtacgggcatcggtatgtatacctgtagtccttaatgaatagctgaagagccatttgagctgtcgctggcccgagatcattgtttatcatgttgttctttatcacggagacccagcatggcgtat

SEQ ID NO: 420599 - DNA, 140 bp, Artificial Sequence
  Synthetic
atacgccatgctgggtctcctgccagctccacgctatctaactgacatgactcttgaagaaatgtcaagagattggttaatgctcattcccaaacagaaaataacagggtccctatgcatcgtacttgggagtcggccat

SEQ ID NO: 420600 - DNA, 140 bp, Artificial Sequence
  Synthetic
atggccgactcccaagtacgatgcatagggaccctgttattttctgtttgggaatgagcattaaccaatctcttgacatttcttcaagagtcatgtcagttagatagcgtggagctggcaggagacccagcatggcgtat

SEQ ID NO: 420601 - DNA, 140 bp, Artificial Sequence
  Synthetic
atacgccatgctgggtctccacagaggtgacacgcaaatccaaacgaaaagatcattcgagctaaaaaaactatgggagcaaacccattcaaaagcaggactacttgtttcagatgggggcgtacttgggagtcggccat

SEQ ID NO: 420602 - DNA, 140 bp, Artificial Sequence
  Synthetic
atggccgactcccaagtacgcccccatctgaaacaagtagtcctgcttttgaatgggtttgctcccatagtttttttagctcgaatgatcttttcgtttggatttgcgtgtcacctctgtggagacccagcatggcgtat

SEQ ID NO: 420603 - DNA, 140 bp, Artificial Sequence
  Synthetic
aggccctggctgctgatatgttgagaccaacaagttcgctgcaatatgcacccatttagaagtatgtttcatgtattcggatttccactttattgacgagaggggtgactcagtaattgtgaccttttgggacagcggtg

SEQ ID NO: 420604 - DNA, 140 bp, Artificial Sequence
  Synthetic
caccgctgtcccaaaaggtcacaattactgagtcacccctctcgtcaataaagtggaaatccgaatacatgaaacatacttctaaatgggtgcatattgcagcgaacttgttggtctcaacatatcagcagccagggcct

SEQ ID NO: 420605 - DNA, 140 bp, Artificial Sequence
  Synthetic
atacgccatgctgggtctccaatgggagctaatggatgtagattatcggggaagactgtgtaatcctctgaatccgtttgtcaaccataaaggaattgagtctgtaaacagtgccgtggtcgtacttgggagtcggccat

SEQ ID NO: 420606 - DNA, 140 bp, Artificial Sequence
  Synthetic
atggccgactcccaagtacgaccacggcactgtttacagactcaattcctttatggttgacaaacggattcagaggattacacagtcttccccgataatctacatccattagctcccattggagacccagcatggcgtat

SEQ ID NO: 420607 - DNA, 140 bp, Artificial Sequence
  Synthetic
atacgccatgctgggtctcccaaatgtcaaaagaagtgaatgccagaattgagccatttctgaagacaacaccacgccccctcagattgcctgatgggcctccctgctctcagcggtcgacgtacttgggagtcggccat

SEQ ID NO: 420608 - DNA, 140 bp, Artificial Sequence
  Synthetic
atggccgactcccaagtacgtcgaccgctgagagcagggaggcccatcaggcaatctgagggggcgtggtgttgtcttcagaaatggctcaattctggcattcacttcttttgacatttgggagacccagcatggcgtat

SEQ ID NO: 420609 - DNA, 140 bp, Artificial Sequence
  Synthetic
atacgccatgctgggtctccctacacattcttggattccaaaaaggaatcgttccattctcaatactagccaaaggggaattcttgaggatgagcaaatgtatcagaagtgctgcaatctcgtacttgggagtcggccat

SEQ ID NO: 420610 - DNA, 140 bp, Artificial Sequence
  Synthetic
atggccgactcccaagtacgagattgcagcacttctgatacatttgctcatcctcaagaattcccctttggctagtattgagaatggaacgattcctttttggaatccaagaatgtgtagggagacccagcatggcgtat

SEQ ID NO: 420611 - DNA, 140 bp, Artificial Sequence
  Synthetic
aggccctggctgctgatatggagggggaaggtataccgctatacgatgcaatcaaatgcatgaagacatttttcggctggaaagaacccaacatcgtgaaaccacatgaaaagggcataagaccttttgggacagcggtg

SEQ ID NO: 420612 - DNA, 140 bp, Artificial Sequence
  Synthetic
caccgctgtcccaaaaggtcttatgcccttttcatgtggtttcacgatgttgggttctttccagccgaaaaatgtcttcatgcatttgattgcatcgtatagcggtataccttccccctccatatcagcagccagggcct

SEQ ID NO: 420613 - DNA, 140 bp, Artificial Sequence
  Synthetic
aggccctggctgctgatatgatggattccaacactgtgtcaagctttcaggtagactgctttctttggcatgtccgcaaacgatttgcagaccaagaaatgggtgatgccccattcctaggaccttttgggacagcggtg

SEQ ID NO: 420614 - DNA, 140 bp, Artificial Sequence
  Synthetic
caccgctgtcccaaaaggtcctaggaatggggcatcacccatttcttggtctgcaaatcgtttgcggacatgccaaagaaagcagtctacctgaaagcttgacacagtgttggaatccatcatatcagcagccagggcct

SEQ ID NO: 420615 - DNA, 140 bp, Artificial Sequence
  Synthetic
aggccctggctgctgatatgattgaaaacgaggagagaatcccaaaaacaaagaacatgaagaaaacaagtcaattaaagtgggcacttggtgagaacatggcaccagagaaagtagactgaccttttgggacagcggtg

SEQ ID NO: 420616 - DNA, 140 bp, Artificial Sequence
  Synthetic
caccgctgtcccaaaaggtcagtctactttctctggtgccatgttctcaccaagtgcccactttaattgacttgttttcttcatgttctttgtttttgggattctctcctcgttttcaatcatatcagcagccagggcct

SEQ ID NO: 420617 - DNA, 140 bp, Artificial Sequence
  Synthetic
aggccctggctgctgatatgctagccctttgagattagtagacggccaaacttgtgacattgtcaatggtgctctgggaagcccgggctgtgatcacttgaatggtgcagaatgggatgtgaccttttgggacagcggtg

SEQ ID NO: 420618 - DNA, 140 bp, Artificial Sequence
  Synthetic
caccgctgtcccaaaaggtcacatcccattctgcaccattcaagtgatcacagcccgggcttcccagagcaccattgacaatgtcacaagtttggccgtctactaatctcaaagggctagcatatcagcagccagggcct

SEQ ID NO: 420619 - DNA, 140 bp, Artificial Sequence
  Synthetic
atacgccatgctgggtctccataattctattaatcatgaagactgtcattgttctgagttggcttttctgtctggttttcagccaaaatccttcagagaacaacaataacactgcaacaccgtacttgggagtcggccat

SEQ ID NO: 420620 - DNA, 140 bp, Artificial Sequence
  Synthetic
atggccgactcccaagtacggtgttgcagtgttattgttgttctctgaaggattttggctgaaaaccagacagaaaagccaactcagaacaatgacagtcttcatgattaatagaattatggagacccagcatggcgtat

SEQ ID NO: 420621 - DNA, 140 bp, Artificial Sequence
  Synthetic
atacgccatgctgggtctccatcatgggcaggaaatattctcagaacccaagagtcagaatgtgtatgccataaagggatctgtccagtagtcatgacggatggcccagcaaacaacagacgtacttgggagtcggccat

SEQ ID NO: 420622 - DNA, 140 bp, Artificial Sequence
  Synthetic
atggccgactcccaagtacgtctgttgtttgctgggccatccgtcatgactactggacagatccctttatggcatacacattctgactcttgggttctgagaatatttcctgcccatgatggagacccagcatggcgtat

SEQ ID NO: 420623 - DNA, 140 bp, Artificial Sequence
  Synthetic
aggccctggctgctgatatgaaatactttggagtaagacaaatgatgctggatcagatagggtgatggtatcacccctagccgtaacttggtggaatagaaaaggaccaacaacagacacgaccttttgggacagcggtg

SEQ ID NO: 420624 - DNA, 140 bp, Artificial Sequence
  Synthetic
caccgctgtcccaaaaggtcgtgtctgttgttggtccttttctattccaccaagttacggctaggggtgataccatcaccctatctgatccagcatcatttgtcttactccaaagtatttcatatcagcagccagggcct

SEQ ID NO: 420625 - DNA, 140 bp, Artificial Sequence
  Synthetic
aggccctggctgctgatatgacggatgatcaaattgaagtaactaatgcaactgagctggttcagagttcctcaacagggaaaatatgcaacaaccctcacagaattctcgatggaagaggaccttttgggacagcggtg

SEQ ID NO: 420626 - DNA, 140 bp, Artificial Sequence
  Synthetic
caccgctgtcccaaaaggtcctcttccatcgagaattctgtgagggttgttgcatattttccctgttgaggaactctgaaccagctcagttgcattagttacttcaatttgatcatccgtcatatcagcagccagggcct

SEQ ID NO: 420627 - DNA, 140 bp, Artificial Sequence
  Synthetic
atacgccatgctgggtctcccaggatgaaacatgggatctttatgtagagcgcagcaatgcattcagcaactgctacccatatgacgtgccagactatgcgtctctcaggtctctagtggcgtacttgggagtcggccat

SEQ ID NO: 420628 - DNA, 140 bp, Artificial Sequence
  Synthetic
atggccgactcccaagtacgccactagagacctgagagacgcatagtctggcacgtcatatgggtagcagttgctgaatgcattgctgcgctctacataaagatcccatgtttcatcctgggagacccagcatggcgtat

SEQ ID NO: 420629 - DNA, 140 bp, Artificial Sequence
  Synthetic
atacgccatgctgggtctccatgctcctacggactgcaataggccaagtgtcaaggcccatgttcctgtatgtgagaaccaatgggacttccaagatcaaaatgaaatggggcatggagacgtacttgggagtcggccat

SEQ ID NO: 420630 - DNA, 140 bp, Artificial Sequence
  Synthetic
atggccgactcccaagtacgtctccatgccccatttcattttgatcttggaagtcccattggttctcacatacaggaacatgggccttgacacttggcctattgcagtccgtaggagcatggagacccagcatggcgtat

SEQ ID NO: 420631 - DNA, 140 bp, Artificial Sequence
  Synthetic
atacgccatgctgggtctcccctcatcaggaaccctagagttcatcactgagggttttacatggacgggagtcacacaaaatggagggagtggtgcttgtaaaagagggcctgccaatggcgtacttgggagtcggccat

SEQ ID NO: 420632 - DNA, 140 bp, Artificial Sequence
  Synthetic
atggccgactcccaagtacgccattggcaggccctcttttacaagcaccactccctccattttgtgtgactcccgtccatgtaaaaccctcagtgatgaactctagggttcctgatgaggggagacccagcatggcgtat

SEQ ID NO: 420633 - DNA, 140 bp, Artificial Sequence
  Synthetic
atacgccatgctgggtctccataggagacatgctcctacggactgcaataggccaagtatcaaggcccatgttcctgtatgtgagaaccaatgggacatccaagatcaagatgaaatgggcgtacttgggagtcggccat

SEQ ID NO: 420634 - DNA, 140 bp, Artificial Sequence
  Synthetic
atggccgactcccaagtacgcccatttcatcttgatcttggatgtcccattggttctcacatacaggaacatgggccttgatacttggcctattgcagtccgtaggagcatgtctcctatggagacccagcatggcgtat

SEQ ID NO: 420635 - DNA, 140 bp, Artificial Sequence
  Synthetic
aggccctggctgctgatatgggatacatatgtagtggggttttcggagacagtccacgccctaatgatgggacaggcagttgtggtccggtgtcctctaatggggcatttggtgtgaaaggaccttttgggacagcggtg

SEQ ID NO: 420636 - DNA, 140 bp, Artificial Sequence
  Synthetic
caccgctgtcccaaaaggtcctttcacaccaaatgccccattagaggacaccggaccacaactgcctgtcccatcattagggcgtggactgtctccgaaaaccccactacatatgtatcccatatcagcagccagggcct

SEQ ID NO: 420637 - DNA, 140 bp, Artificial Sequence
  Synthetic
atacgccatgctgggtctcccagatgtacactccaggtggagaagtgaagaatgatgatgtagaccagagtttgatcattgctgccagaaacattgttagaagagcaatagtgtcagcagcgtacttgggagtcggccat

SEQ ID NO: 420638 - DNA, 140 bp, Artificial Sequence
  Synthetic
atggccgactcccaagtacgctgctgacactattgctcttctaacaatgtttctggcagcaatgatcaaactctggtctacatcatcattcttcacttctccacctggagtgtacatctgggagacccagcatggcgtat

SEQ ID NO: 420639 - DNA, 140 bp, Artificial Sequence
  Synthetic
atacgccatgctgggtctcctttgatcattgctgccagaaacattgttagaagagcaatagtgtcagcagatccactggcatcactattggagatgtgtcacggcacacaaattggtggacgtacttgggagtcggccat

SEQ ID NO: 420640 - DNA, 140 bp, Artificial Sequence
  Synthetic
atggccgactcccaagtacgtccaccaatttgtgtgccgtgacacatctccaatagtgatgccagtggatctgctgacactattgctcttctaacaatgtttctggcagcaatgatcaaaggagacccagcatggcgtat

SEQ ID NO: 420641 - DNA, 140 bp, Artificial Sequence
  Synthetic
atacgccatgctgggtctccagatatatgcaaagcagcaatgggtttgagaatcagctcctcttttagctttggaggtttcactttcaaaagaacaagtggatcatctgtcaaaagggaacgtacttgggagtcggccat

SEQ ID NO: 420642 - DNA, 140 bp, Artificial Sequence
  Synthetic
atggccgactcccaagtacgttcccttttgacagatgatccacttgttcttttgaaagtgaaacctccaaagctaaaagaggagctgattctcaaacccattgctgctttgcatatatctggagacccagcatggcgtat

SEQ ID NO: 420643 - DNA, 140 bp, Artificial Sequence
  Synthetic
atacgccatgctgggtctcctgtaaacaaaattacctatggagcatgtcccaaatatgtcaagcagagcactctaaaattggcaactggaatgcggaatgtacctgagaaacagaccaggcgtacttgggagtcggccat

SEQ ID NO: 420644 - DNA, 140 bp, Artificial Sequence
  Synthetic
atggccgactcccaagtacgcctggtctgtttctcaggtacattccgcattccagttgccaattttagagtgctctgcttgacatatttgggacatgctccataggtaattttgtttacaggagacccagcatggcgtat

SEQ ID NO: 420645 - DNA, 140 bp, Artificial Sequence
  Synthetic
aggccctggctgctgatatggggatatgaggaatttacaatggtcggaagaagagcaacagctatcttaaggaaagcaactagaaggctgattcagttgatagtgagtggaagagacgaagaccttttgggacagcggtg

SEQ ID NO: 420646 - DNA, 140 bp, Artificial Sequence
  Synthetic
caccgctgtcccaaaaggtcttcgtctcttccactcactatcaactgaatcagccttctagttgctttccttaagatagctgttgctcttcttccgaccattgtaaattcctcatatccccatatcagcagccagggcct

SEQ ID NO: 420647 - DNA, 140 bp, Artificial Sequence
  Synthetic
aggccctggctgctgatatgcccaacttaacccaattgatggaccactgcctgaggacaatgagccgagtggatatgcacagacggactgtgtacttgaagcaatggctttccttgaagagaccttttgggacagcggtg

SEQ ID NO: 420648 - DNA, 140 bp, Artificial Sequence
  Synthetic
caccgctgtcccaaaaggtctcttcaaggaaagccattgcttcaagtacacagtccgtctgtgcatatccactcggctcattgtcctcaggcagtggtccatcaattgggttaagttgggcatatcagcagccagggcct

SEQ ID NO: 420649 - DNA, 140 bp, Artificial Sequence
  Synthetic
aggccctggctgctgatatgtagtatggtaaaggctgtccgaggtgatctaaattttgtaaacagagcaaaccagaggctgaatcccatgcatcaactcctaagacacttccagaaggatgaccttttgggacagcggtg

SEQ ID NO: 420650 - DNA, 140 bp, Artificial Sequence
  Synthetic
caccgctgtcccaaaaggtcatccttctggaagtgtcttaggagttgatgcatgggattcagcctctggtttgctctgtttacaaaatttagatcacctcggacagcctttaccatactacatatcagcagccagggcct

SEQ ID NO: 420651 - DNA, 140 bp, Artificial Sequence
  Synthetic
atacgccatgctgggtctccaccagaggctgaatcccatgcatcaactcctaagacacttccagaaggatgcaaaagtgctatttcaaaattggggaattgaacctattgataatatcatcgtacttgggagtcggccat

SEQ ID NO: 420652 - DNA, 140 bp, Artificial Sequence
  Synthetic
atggccgactcccaagtacgatgatattatcaataggttcaattccccaattttgaaatagcacttttgcatccttctggaagtgtcttaggagttgatgcatgggattcagcctctggtggagacccagcatggcgtat

SEQ ID NO: 420653 - DNA, 140 bp, Artificial Sequence
  Synthetic
atacgccatgctgggtctcctccaacaaacaagagtggacaaattgacccaaggcagacagacctacgattggacattaaacaggaatcagccggccgcaactgcattagctaatactatcgtacttgggagtcggccat

SEQ ID NO: 420654 - DNA, 140 bp, Artificial Sequence
  Synthetic
atggccgactcccaagtacgatagtattagctaatgcagttgcggccggctgattcctgtttaatgtccaatcgtaggtctgtctgccttgggtcaatttgtccactcttgtttgttggaggagacccagcatggcgtat

SEQ ID NO: 420655 - DNA, 140 bp, Artificial Sequence
  Synthetic
atacgccatgctgggtctccgcaatccgggctcccaggtggagggaaagagaagaaggctaaattggcaaatgtagggagaaagatgatgactaactcaaaagagaccgagctctcctttcgtacttgggagtcggccat

SEQ ID NO: 420656 - DNA, 140 bp, Artificial Sequence
  Synthetic
atggccgactcccaagtacgaaaggagagctcggtctcttttgagttagtcatcatctttctccctacatttgccaatttagccttcttctctttccctccacctgggagcccggattgcggagacccagcatggcgtat

SEQ ID NO: 420657 - DNA, 140 bp, Artificial Sequence
  Synthetic
atacgccatgctgggtctccacaacaacaggagacaaaaccaaatggaacgagaaccacaatcctcgtatatttctggcaaggacaacatacaccacaaggaaccaacctgaatggttcacgtacttgggagtcggccat

SEQ ID NO: 420658 - DNA, 140 bp, Artificial Sequence
  Synthetic
atggccgactcccaagtacgtgaaccattcaggttggttccttgtggtgtatgttgtccttgccagaaatatacgaggattgtggttctcgttccatttggttttgtctcctgttgttgtggagacccagcatggcgtat

SEQ ID NO: 420659 - DNA, 140 bp, Artificial Sequence
  Synthetic
atacgccatgctgggtctccggaatggctgtttcaagatataccacaaatgtgataatgcctgcatagagtcaattaggaatgggacctatgatcacgacatatacagggatgaagcactcgtacttgggagtcggccat

SEQ ID NO: 420660 - DNA, 140 bp, Artificial Sequence
  Synthetic
atggccgactcccaagtacgagtgcttcatccctgtatatgtcgtgatcataggtcccattcctaattgactctatgcaggcattatcacatttgtggtatatcttgaaacagccattccggagacccagcatggcgtat

SEQ ID NO: 420661 - DNA, 140 bp, Artificial Sequence
  Synthetic
atacgccatgctgggtctccagaaattgacaataacctattcatcatcaatgatgtgggagatcaatggacctgaatcagtgctcgttaacacgtatcaatggataattagaaattgggacgtacttgggagtcggccat

SEQ ID NO: 420662 - DNA, 140 bp, Artificial Sequence
  Synthetic
atggccgactcccaagtacgtcccaatttctaattatccattgatacgtgttaacgagcactgattcaggtccattgatctcccacatcattgatgatgaataggttattgtcaatttctggagacccagcatggcgtat

SEQ ID NO: 420663 - DNA, 140 bp, Artificial Sequence
  Synthetic
atacgccatgctgggtctcccctgaatcagtgctcgttaacacgtatcaatggataattagaaattgggaaactgtaaagatccaatggtcccaagaccccacaatgctatacaacaagacgtacttgggagtcggccat

SEQ ID NO: 420664 - DNA, 140 bp, Artificial Sequence
  Synthetic
atggccgactcccaagtacgtcttgttgtatagcattgtggggtcttgggaccattggatctttacagtttcccaatttctaattatccattgatacgtgttaacgagcactgattcaggggagacccagcatggcgtat

SEQ ID NO: 420665 - DNA, 140 bp, Artificial Sequence
  Synthetic
aggccctggctgctgatatgtgaagactatcagggcaggctttgtaaccctcccaacccatttgccacccataaggaaattgagtctgtaaacaatgctgaagtgatgccagctcatggcgaccttttgggacagcggtg

SEQ ID NO: 420666 - DNA, 140 bp, Artificial Sequence
  Synthetic
caccgctgtcccaaaaggtcgccatgagctggcatcacttcagcattgtttacagactcaatttccttatgggtggcaaatgggttgggagggttacaaagcctgccctgatagtcttcacatatcagcagccagggcct

SEQ ID NO: 420667 - DNA, 140 bp, Artificial Sequence
  Synthetic
aggccctggctgctgatatgtacagcgggtttgtgagaacattattccagcagatgcgcgatgtactggggacatttgatactgcccaaataataaagctactgccatttgcagcagcccgaccttttgggacagcggtg

SEQ ID NO: 420668 - DNA, 140 bp, Artificial Sequence
  Synthetic
caccgctgtcccaaaaggtcgggctgctgcaaatggcagtagctttattatttgggcagtatcaaatgtccccagtacatcgcgcatctgctggaataatgttctcacaaacccgctgtacatatcagcagccagggcct

SEQ ID NO: 420669 - DNA, 140 bp, Artificial Sequence
  Synthetic
atacgccatgctgggtctccgacatttgatactgcccaaataataaagctactgccatttgcagcagccccaccagagcagagtaggatgcaattctcttctctaactgtaaatgtgagacgtacttgggagtcggccat

SEQ ID NO: 420670 - DNA, 140 bp, Artificial Sequence
  Synthetic
atggccgactcccaagtacgtctcacatttacagttagagaagagaattgcatcctactctgctctggtggggctgctgcaaatggcagtagctttattatttgggcagtatcaaatgtcggagacccagcatggcgtat

SEQ ID NO: 420671 - DNA, 140 bp, Artificial Sequence
  Synthetic
aggccctggctgctgatatggctctctttcacaatcaccggagacaacaccaaatggaatgaaaatcagaaccctagaatgtttttggcaatgataacatatataacaagaaaccaacctgaccttttgggacagcggtg

SEQ ID NO: 420672 - DNA, 140 bp, Artificial Sequence
  Synthetic
caccgctgtcccaaaaggtcaggttggtttcttgttatatatgttatcattgccaaaaacattctagggttctgattttcattccatttggtgttgtctccggtgattgtgaaagagagccatatcagcagccagggcct

SEQ ID NO: 420673 - DNA, 140 bp, Artificial Sequence
  Synthetic
aggccctggctgctgatatgattggacattaaacagaaatcaaccggcagcaactgcattagccaacaccatagaagtctttagatcgaacggattgacagctaatgaatcaggaagactgaccttttgggacagcggtg

SEQ ID NO: 420674 - DNA, 140 bp, Artificial Sequence
  Synthetic
caccgctgtcccaaaaggtcagtcttcctgattcattagctgtcaatccgttcgatctaaagacttctatggtgttggctaatgcagttgctgccggttgatttctgtttaatgtccaatcatatcagcagccagggcct

SEQ ID NO: 420675 - DNA, 140 bp, Artificial Sequence
  Synthetic
atacgccatgctgggtctcctgacagaagatccagatgagggaaaggctggaatagaatctgcagtgctgagagggttcctaattatagggaaggaaaacaaaagatatgggccagcattcgtacttgggagtcggccat

SEQ ID NO: 420676 - DNA, 140 bp, Artificial Sequence
  Synthetic
atggccgactcccaagtacgaatgctggcccatatcttttgttttccttccctataattaggaaccctctcagcactgcagattctattccagcctttccctcatctggatcttctgtcaggagacccagcatggcgtat

SEQ ID NO: 420677 - DNA, 140 bp, Artificial Sequence
  Synthetic
aggccctggctgctgatatgagtcctaggagtatcaatcctgaatcttggacagaagaggtataccaaaaccatatattggtgggacgggctccaatcctctgatgatttcgctctcattgaccttttgggacagcggtg

SEQ ID NO: 420678 - DNA, 140 bp, Artificial Sequence
  Synthetic
caccgctgtcccaaaaggtcaatgagagcgaaatcatcagaggattggagcccgtcccaccaatatatggttttggtatacctcttctgtccaagattcaggattgatactcctaggactcatatcagcagccagggcct

SEQ ID NO: 420679 - DNA, 140 bp, Artificial Sequence
  Synthetic
aggccctggctgctgatatgatggagagaataaaggaattaagaataaagggactaagagatttgatgtcgcagtcttgcactcgcgagatattgacaaaaaccacagtggaccacatgggaccttttgggacagcggtg

SEQ ID NO: 420680 - DNA, 140 bp, Artificial Sequence
  Synthetic
caccgctgtcccaaaaggtcccatgtggtccactgtggtttttgtcaatatctcgcgagtgcaagactgcgacatcaaatctcttagtccctttattcttaattcctttattctctccatcatatcagcagccagggcct

SEQ ID NO: 420681 - DNA, 140 bp, Artificial Sequence
  Synthetic
atacgccatgctgggtctccaggatgaaatggatgatggcgatgaaatatccgatcactgctgacaaaaggacaatggaaatgatccctgaaaggaatgaacaaggccaaactctatggacgtacttgggagtcggccat

SEQ ID NO: 420682 - DNA, 140 bp, Artificial Sequence
  Synthetic
atggccgactcccaagtacgtccatagagtttggccttgttcattcctttcagggatcatttccattgtccttttgtcagcagtgatcggatatttcatcgccatcatccatttcatcctggagacccagcatggcgtat

SEQ ID NO: 420683 - DNA, 140 bp, Artificial Sequence
  Synthetic
aggccctggctgctgatatgaaccacactggacaacaaacattcaaatggcacaatacatgatagaatccctcaccggacccttttgatgaatgaattgggtgttccgtttcacttgggagaccttttgggacagcggtg

SEQ ID NO: 420684 - DNA, 140 bp, Artificial Sequence
  Synthetic
caccgctgtcccaaaaggtctcccaagtgaaacggaacacccaattcattcatcaaaagggtccggtgagggattctatcatgtattgtgccatttgaatgtttgttgtccagtgtggttcatatcagcagccagggcct

SEQ ID NO: 420685 - DNA, 140 bp, Artificial Sequence
  Synthetic
atacgccatgctgggtctccccacatattggtgggacggactccaatcctcagatgacttcgccctcatagtgaatgcaccgaatcatgagggaatacaggcaggagtggataggttctacgtacttgggagtcggccat

SEQ ID NO: 420686 - DNA, 140 bp, Artificial Sequence
  Synthetic
atggccgactcccaagtacgtagaacctatccactcctgcctgtattccctcatgattcggtgcattcactatgagggcgaagtcatctgaggattggagtccgtcccaccaatatgtggggagacccagcatggcgtat

SEQ ID NO: 420687 - DNA, 140 bp, Artificial Sequence
  Synthetic
atacgccatgctgggtctcccatggatagggcagtcaaattatacaagaagctaaaaagagaaataacattccatggggccaaagaagtgtcactaagctactcaactggtgctcttgcccgtacttgggagtcggccat

SEQ ID NO: 420688 - DNA, 140 bp, Artificial Sequence
  Synthetic
atggccgactcccaagtacgggcaagagcaccagttgagtagcttagtgacacttctttggccccatggaatgttatttctctttttagcttcttgtataatttgactgccctatccatgggagacccagcatggcgtat

SEQ ID NO: 420689 - DNA, 140 bp, Artificial Sequence
  Synthetic
atacgccatgctgggtctcccatgctaagtacggttttaggagtctcgatactgaatcttggacaaaagaaatacaccaagacaacatactggtgggatgggctccaatcctccgacgatcgtacttgggagtcggccat

SEQ ID NO: 420690 - DNA, 140 bp, Artificial Sequence
  Synthetic
atggccgactcccaagtacgatcgtcggaggattggagcccatcccaccagtatgttgtcttggtgtatttcttttgtccaagattcagtatcgagactcctaaaaccgtacttagcatgggagacccagcatggcgtat

SEQ ID NO: 420691 - DNA, 140 bp, Artificial Sequence
  Synthetic
aggccctggctgctgatatgtgcttttggcctagtgtgtgccacttgtgagcaaatcgctgactcacagcatcggtcacacagacaaatggctactaccaccaacccactaatcagacatgaccttttgggacagcggtg

SEQ ID NO: 420692 - DNA, 140 bp, Artificial Sequence
  Synthetic
caccgctgtcccaaaaggtcatgtctgattagtgggttggtggtagtagccatttgtctgtgtgaccgatgctgtgagtcagcgatttgctcacaagtggcacacactaggccaaaagcacatatcagcagccagggcct

SEQ ID NO: 420693 - DNA, 140 bp, Artificial Sequence
  Synthetic
atacgccatgctgggtctccggctggatcgagtgaacaggcagcagaggccatggaggttgccaatcagactagacagatggtgcatgcaatgagaacaattgggacacatcccagctcccgtacttgggagtcggccat

SEQ ID NO: 420694 - DNA, 140 bp, Artificial Sequence
  Synthetic
atggccgactcccaagtacgggagctgggatgtgtcccaattgttctcattgcatgcaccatctgtctagtctgattggcaacctccatggcctctgctgcctgttcactcgatccagccggagacccagcatggcgtat

SEQ ID NO: 420695 - DNA, 140 bp, Artificial Sequence
  Synthetic
atacgccatgctgggtctccacggatgggagtgcaaatacagcggttcaagtgatgtcatcgccaatgcagcaaacatcattggaatattgcacctgatattgtggattcttgatcgtctcgtacttgggagtcggccat

SEQ ID NO: 420696 - DNA, 140 bp, Artificial Sequence
  Synthetic
atggccgactcccaagtacgagacgatcaagaatccacaatatcaggtgcaatattccaatgatgtttgctgcattggcgatgacatcacttgaaccgctgtatttgcactcccatccgtggagacccagcatggcgtat

SEQ ID NO: 420697 - DNA, 140 bp, Artificial Sequence
  Synthetic
aggccctggctgctgatatgcttctacggaaggagtgcctgagtccatgagggaagaatatcaacaggaacagcagagtgctgtggatgttgacgatggtcattttgtcaacatagagctgaccttttgggacagcggtg

SEQ ID NO: 420698 - DNA, 140 bp, Artificial Sequence
  Synthetic
caccgctgtcccaaaaggtcagctctatgttgacaaaatgaccatcgtcaacatccacagcactctgctgttcctgttgatattcttccctcatggactcaggcactccttccgtagaagcatatcagcagccagggcct

SEQ ID NO: 420699 - DNA, 140 bp, Artificial Sequence
  Synthetic
atacgccatgctgggtctcccatgcagatcttagtgctaaagaagcacaagatgtcatcatggaggtcgtattcccaaacgaagttggagccagaatattgacatcagagtcacagttaacgtacttgggagtcggccat

SEQ ID NO: 420700 - DNA, 140 bp, Artificial Sequence
  Synthetic
atggccgactcccaagtacgttaactgtgactctgatgtcaatattctggctccaacttcgtttgggaatacgacctccatgatgacatcttgtgcttctttagcactaagatctgcatgggagacccagcatggcgtat

SEQ ID NO: 420701 - DNA, 140 bp, Artificial Sequence
  Synthetic
aggccctggctgctgatatggttctgtttctctcactattacaacaatgtgccttttcatgcagattaccatcctaataactactataacattgcatttcaagcaatatgaatgcgattcgaccttttgggacagcggtg

SEQ ID NO: 420702 - DNA, 140 bp, Artificial Sequence
  Synthetic
caccgctgtcccaaaaggtcgaatcgcattcatattgcttgaaatgcaatgttatagtagttattaggatggtaatctgcatgaaaaggcacattgttgtaatagtgagagaaacagaaccatatcagcagccagggcct

SEQ ID NO: 420703 - DNA, 140 bp, Artificial Sequence
  Synthetic
aggccctggctgctgatatgatcctaataactactataacattgcatttcaagcaatatgaatgcgattctcctgcaaacaaccaagtaataccgtgtgaaccaataataatagaaaagagaccttttgggacagcggtg

SEQ ID NO: 420704 - DNA, 140 bp, Artificial Sequence
  Synthetic
caccgctgtcccaaaaggtctcttttctattattattggttcacacggtattacttggttgtttgcaggagaatcgcattcatattgcttgaaatgcaatgttatagtagttattaggatcatatcagcagccagggcct

SEQ ID NO: 420705 - DNA, 140 bp, Artificial Sequence
  Synthetic
atacgccatgctgggtctcctgcccaaaattaggggaatacaggaattggtcaaaaccacaatgcaagatcacaggatttgcacctttttccaaggacaattcaattcggctctctgcagcgtacttgggagtcggccat

SEQ ID NO: 420706 - DNA, 140 bp, Artificial Sequence
  Synthetic
atggccgactcccaagtacgctgcagagagccgaattgaattgtccttggaaaaaggtgcaaatcctgtgatcttgcattgtggttttgaccaattcctgtattcccctaattttgggcaggagacccagcatggcgtat

SEQ ID NO: 420707 - DNA, 140 bp, Artificial Sequence
  Synthetic
atacgccatgctgggtctccaacatggtggaacagaaacggaccaacggcaagtacggtccactatcccaaagtctacaaaacttactttgaaaaagttgagagattgaaacatggaacacgtacttgggagtcggccat

SEQ ID NO: 420708 - DNA, 140 bp, Artificial Sequence
  Synthetic
atggccgactcccaagtacgtgttccatgtttcaatctctcaactttttcaaagtaagttttgtagactttgggatagtggaccgtacttgccgttggtccgtttctgttccaccatgttggagacccagcatggcgtat

SEQ ID NO: 420709 - DNA, 140 bp, Artificial Sequence
  Synthetic
atacgccatgctgggtctcccacaaatcctggtcatgcagatctcagtgctaaagaggcacaggacgtcatcatggaagttgtattcccaaatgaagtgggggctagaatactaacatcacgtacttgggagtcggccat

SEQ ID NO: 420710 - DNA, 140 bp, Artificial Sequence
  Synthetic
atggccgactcccaagtacgtgatgttagtattctagcccccacttcatttgggaatacaacttccatgatgacgtcctgtgcctctttagcactgagatctgcatgaccaggatttgtgggagacccagcatggcgtat

SEQ ID NO: 420711 - DNA, 140 bp, Artificial Sequence
  Synthetic
aggccctggctgctgatatgatgaattaggtgttccatttcatttgggaaccagacaagtatgtatagcatggtccagttcaagttgtcacgatggaaaagcttggttgcatgtttgtgtgaccttttgggacagcggtg

SEQ ID NO: 420712 - DNA, 140 bp, Artificial Sequence
  Synthetic
caccgctgtcccaaaaggtcacacaaacatgcaaccaagcttttccatcgtgacaacttgaactggaccatgctatacatacttgtctggttcccaaatgaaatggaacacctaattcatcatatcagcagccagggcct

SEQ ID NO: 420713 - DNA, 140 bp, Artificial Sequence
  Synthetic
atacgccatgctgggtctccgagtcacaactgacaataacaaaggaaaagaaggaggagcttcaggactgcaaaattgctcccctaatggttgcatacatgttggaaagagaactggtcccgtacttgggagtcggccat

SEQ ID NO: 420714 - DNA, 140 bp, Artificial Sequence
  Synthetic
atggccgactcccaagtacgggaccagttctctttccaacatgtatgcaaccattaggggagcaattttgcagtcctgaagctcctccttcttttcctttgttattgtcagttgtgactcggagacccagcatggcgtat

SEQ ID NO: 420715 - DNA, 140 bp, Artificial Sequence
  Synthetic
atacgccatgctgggtctccaatatcctcagaactcaggagtcagagtgcgtttgcatcaatgggacttgtacagtagtaatgactgatggaagcgcatcagggaaagcagagactagaacgtacttgggagtcggccat

SEQ ID NO: 420716 - DNA, 140 bp, Artificial Sequence
  Synthetic
atggccgactcccaagtacgttctagtctctgctttccctgatgcgcttccatcagtcattactactgtacaagtcccattgatgcaaacgcactctgactcctgagttctgaggatattggagacccagcatggcgtat

SEQ ID NO: 420717 - DNA, 140 bp, Artificial Sequence
  Synthetic
atacgccatgctgggtctccagtgtacaaaacttatttcgacaaagtcgaaaggttaaaacatggaacctttggccctgttcattttagaaatcaagtcaagatacgcagaagagtagaccgtacttgggagtcggccat

SEQ ID NO: 420718 - DNA, 140 bp, Artificial Sequence
  Synthetic
atggccgactcccaagtacggtctactcttctgcgtatcttgacttgatttctaaaatgaacagggccaaaggttccatgttttaacctttcgactttgtcgaaataagttttgtacactggagacccagcatggcgtat

SEQ ID NO: 420719 - DNA, 140 bp, Artificial Sequence
  Synthetic
atacgccatgctgggtctccgaagtcttgcatttgactcaaggaacctgctgggaacaaatgtacactccaggaggggaagtgagaaatgatgatgttgaccagagtttaatcattgctgcgtacttgggagtcggccat

SEQ ID NO: 420720 - DNA, 140 bp, Artificial Sequence
  Synthetic
atggccgactcccaagtacgcagcaatgattaaactctggtcaacatcatcatttctcacttcccctcctggagtgtacatttgttcccagcaggttccttgagtcaaatgcaagacttcggagacccagcatggcgtat

SEQ ID NO: 420721 - DNA, 140 bp, Artificial Sequence
  Synthetic
aggccctggctgctgatatgaggaggggaagtgagaaatgatgatgttgaccagagtttaatcattgctgcaagaaatatagttagaagagcaacagtttcagcagatccattagcatcagaccttttgggacagcggtg

SEQ ID NO: 420722 - DNA, 140 bp, Artificial Sequence
  Synthetic
caccgctgtcccaaaaggtctgatgctaatggatctgctgaaactgttgctcttctaactatatttcttgcagcaatgattaaactctggtcaacatcatcatttctcacttcccctcctcatatcagcagccagggcct

SEQ ID NO: 420723 - DNA, 140 bp, Artificial Sequence
  Synthetic
aggccctggctgctgatatgaggagagtagtgtactgtggacttcaaatagcattgtagctctctgtggatccaaagagcgactgggatcatggtcctggcatgatggtgctgaaatcatgaccttttgggacagcggtg

SEQ ID NO: 420724 - DNA, 140 bp, Artificial Sequence
  Synthetic
caccgctgtcccaaaaggtcatgatttcagcaccatcatgccaggaccatgatcccagtcgctctttggatccacagagagctacaatgctatttgaagtccacagtacactactctcctcatatcagcagccagggcct

SEQ ID NO: 420725 - DNA, 140 bp, Artificial Sequence
  Synthetic
atacgccatgctgggtctcctgttcctgttaccctcgataccctgatgtcagatgtatttgcagggacaactggaaaggttcaaataggcccatcgtggacataagaatgaaagattatacgtacttgggagtcggccat

SEQ ID NO: 420726 - DNA, 140 bp, Artificial Sequence
  Synthetic
atggccgactcccaagtacgtataatctttcattcttatgtccacgatgggcctatttgaacctttccagttgtccctgcaaatacatctgacatcagggtatcgagggtaacaggaacaggagacccagcatggcgtat

SEQ ID NO: 420727 - DNA, 140 bp, Artificial Sequence
  Synthetic
atacgccatgctgggtctccaaaatttctcccttgatggttgcatacatgttagagagagaacttgtacgaaaaacaagatttctcccagtttctggaggaacaagcagtatatacattgcgtacttgggagtcggccat

SEQ ID NO: 420728 - DNA, 140 bp, Artificial Sequence
  Synthetic
atggccgactcccaagtacgcaatgtatatactgcttgttcctccagaaactgggagaaatcttgtttttcgtacaagttctctctctaacatgtatgcaaccatcaagggagaaattttggagacccagcatggcgtat

SEQ ID NO: 420729 - DNA, 140 bp, Artificial Sequence
  Synthetic
aggccctggctgctgatatgcagcgatgggcctgaggatcagttcgtcgttcagctttggaggattcacttttaaaaggacaagtgggtcatctatcaaaagagaagaagaagtgctcacgaccttttgggacagcggtg

SEQ ID NO: 420730 - DNA, 140 bp, Artificial Sequence
  Synthetic
caccgctgtcccaaaaggtcgtgagcacttcttcttctcttttgatagatgacccacttgtccttttaaaagtgaatcctccaaagctgaacgacgaactgatcctcaggcccatcgctgcatatcagcagccagggcct

SEQ ID NO: 420731 - DNA, 140 bp, Artificial Sequence
  Synthetic
atacgccatgctgggtctccaggaaatcatggggtgaaaggttgggcttttgacgatggaaatgacacatggatgggaagaactatcagcaaggactcacgcttaggttacgaaaccttccgtacttgggagtcggccat

SEQ ID NO: 420732 - DNA, 140 bp, Artificial Sequence
  Synthetic
atggccgactcccaagtacggaaggtttcgtaacctaagcgtgagtccttgctgatagttcttcccatccatgtgtcatttccatcgtcaaaagcccaacctttcaccccatgatttcctggagacccagcatggcgtat

SEQ ID NO: 420733 - DNA, 140 bp, Artificial Sequence
  Synthetic
atacgccatgctgggtctcctcacgatggttgggcgaagagcaactgccatattaaggaaagcaaccagaaggctgattcagttaatagtgagtgggagggatgaacaatccattgctgacgtacttgggagtcggccat

SEQ ID NO: 420734 - DNA, 140 bp, Artificial Sequence
  Synthetic
atggccgactcccaagtacgtcagcaatggattgttcatccctcccactcactattaactgaatcagccttctggttgctttccttaatatggcagttgctcttcgcccaaccatcgtgaggagacccagcatggcgtat

SEQ ID NO: 420735 - DNA, 140 bp, Artificial Sequence
  Synthetic
aggccctggctgctgatatgaggctgattcagttaatagtgagtgggagggatgaacaatccattgctgaagccataattgtagcaatggtgttttcacaagaagattgcatgataaaaggaccttttgggacagcggtg

SEQ ID NO: 420736 - DNA, 140 bp, Artificial Sequence
  Synthetic
caccgctgtcccaaaaggtccttttatcatgcaatcttcttgtgaaaacaccattgctacaattatggcttcagcaatggattgttcatccctcccactcactattaactgaatcagcctcatatcagcagccagggcct

SEQ ID NO: 420737 - DNA, 140 bp, Artificial Sequence
  Synthetic
aggccctggctgctgatatgattcttagacagaacccaactgaagaacaagctgtggatatatgcaaggctgcaatgggattgagaatcagctcgtcattcagctttggtggatttacatgaccttttgggacagcggtg

SEQ ID NO: 420738 - DNA, 140 bp, Artificial Sequence
  Synthetic
caccgctgtcccaaaaggtcatgtaaatccaccaaagctgaatgacgagctgattctcaatcccattgcagccttgcatatatccacagcttgttcttcagttgggttctgtctaagaatcatatcagcagccagggcct

SEQ ID NO: 420739 - DNA, 140 bp, Artificial Sequence
  Synthetic
atacgccatgctgggtctccctgttgaggggaaaggttgcattaataggtgcttttatgtggaactaataagaggaaggaggcaggaaactagagtgtggtggacttcgaacagtattgtcgtacttgggagtcggccat

SEQ ID NO: 420740 - DNA, 140 bp, Artificial Sequence
  Synthetic
atggccgactcccaagtacgacaatactgttcgaagtccaccacactctagtttcctgcctccttcctcttattagttccacataaaagcacctattaatgcaacctttcccctcaacagggagacccagcatggcgtat

SEQ ID NO: 420741 - DNA, 140 bp, Artificial Sequence
  Synthetic
atacgccatgctgggtctcctgtgttctgtggcacttctggcacctatggttcaggctcatggcctgatggagcagacatcaatttcatgcctgtataagctttcgcaatttcagaaaaacgtacttgggagtcggccat

SEQ ID NO: 420742 - DNA, 140 bp, Artificial Sequence
  Synthetic
atggccgactcccaagtacgtttttctgaaattgcgaaagcttatacaggcatgaaattgatgtctgctccatcaggccatgagcctgaaccataggtgccagaagtgccacagaacacaggagacccagcatggcgtat

SEQ ID NO: 420743 - DNA, 140 bp, Artificial Sequence
  Synthetic
aggccctggctgctgatatggttagcaaaatgggggtagatgaatactctagcactgagagagtggttgtgagcatagatcgtttcctaagggttcgagaccagcgggggaatgtgctccgaccttttgggacagcggtg

SEQ ID NO: 420744 - DNA, 140 bp, Artificial Sequence
  Synthetic
caccgctgtcccaaaaggtcggagcacattcccccgctggtctcgaacccttaggaaacgatctatgctcacaaccactctctcagtgctagagtattcatctacccccattttgctaaccatatcagcagccagggcct

SEQ ID NO: 420745 - DNA, 140 bp, Artificial Sequence
  Synthetic
aggccctggctgctgatatggcaataatcgtggccatggtgttttcacaagaggattgcatgataaaagcagttagaggtgacctgaatttcgtcaacagagcaaatcagcggttaaaccgaccttttgggacagcggtg

SEQ ID NO: 420746 - DNA, 140 bp, Artificial Sequence
  Synthetic
caccgctgtcccaaaaggtcggtttaaccgctgatttgctctgttgacgaaattcaggtcacctctaactgcttttatcatgcaatcctcttgtgaaaacaccatggccacgattattgccatatcagcagccagggcct

SEQ ID NO: 420747 - DNA, 140 bp, Artificial Sequence
  Synthetic
atacgccatgctgggtctccacgtattcatcgtcgatgatgtgggagatcaacggtccggagtcagttctagtcaacacctatcaatggatcatcagaaattgggaagttgtaaagattccgtacttgggagtcggccat

SEQ ID NO: 420748 - DNA, 140 bp, Artificial Sequence
  Synthetic
atggccgactcccaagtacggaatctttacaacttcccaatttctgatgatccattgataggtgttgactagaactgactccggaccgttgatctcccacatcatcgacgatgaatacgtggagacccagcatggcgtat

SEQ ID NO: 420749 - DNA, 140 bp, Artificial Sequence
  Synthetic
atacgccatgctgggtctcctgaagggaggctgatccaaaatagtataacgatagagagaatggtcctctctgcatttgacgagaggagaaacaaatacttggaagaacatcccagtgcacgtacttgggagtcggccat

SEQ ID NO: 420750 - DNA, 140 bp, Artificial Sequence
  Synthetic
atggccgactcccaagtacgtgcactgggatgttcttccaagtatttgtttctcctctcgtcaaatgcagagaggaccattctctctatcgttatactattttggatcagcctcccttcaggagacccagcatggcgtat

SEQ ID NO: 420751 - DNA, 140 bp, Artificial Sequence
  Synthetic
aggccctggctgctgatatgctgcatttgacgagaggagaaacaaatacttggaagaacatcccagtgcagggaaagatccaaagaaaactggaggtccaatttacaaaaagagggatgggaccttttgggacagcggtg

SEQ ID NO: 420752 - DNA, 140 bp, Artificial Sequence
  Synthetic
caccgctgtcccaaaaggtcccatccctctttttgtaaattggacctccagttttctttggatctttccctgcactgggatgttcttccaagtatttgtttctcctctcgtcaaatgcagcatatcagcagccagggcct

SEQ ID NO: 420753 - DNA, 140 bp, Artificial Sequence
  Synthetic
atacgccatgctgggtctccaagaacattgtttcaacagatgcgcgatgtgttggggacctttgacactgtccaaataatcaaattgctaccgtttgcagcagctccaccggaacagagtcgtacttgggagtcggccat

SEQ ID NO: 420754 - DNA, 140 bp, Artificial Sequence
  Synthetic
atggccgactcccaagtacgactctgttccggtggagctgctgcaaacggtagcaatttgattatttggacagtgtcaaaggtccccaacacatcgcgcatctgttgaaacaatgttcttggagacccagcatggcgtat

SEQ ID NO: 420755 - DNA, 140 bp, Artificial Sequence
  Synthetic
atacgccatgctgggtctcctttggcgccaagcaaacaatggtgaagacgctactgctggtctcactcacttgatgatttggcattccaacctgaatgatgccacatatcagagaacaagcgtacttgggagtcggccat

SEQ ID NO: 420756 - DNA, 140 bp, Artificial Sequence
  Synthetic
atggccgactcccaagtacgcttgttctctgatatgtggcatcattcaggttggaatgccaaatcatcaagtgagtgagaccagcagtagcgtcttcaccattgtttgcttggcgccaaaggagacccagcatggcgtat

SEQ ID NO: 420757 - DNA, 140 bp, Artificial Sequence
  Synthetic
aggccctggctgctgatatgttgatgatttggcattccaacctgaatgatgccacatatcagagaacaagagccttagtgcgtactgggatggatcccagaatgtgctccctgatgcaaggaccttttgggacagcggtg

SEQ ID NO: 420758 - DNA, 140 bp, Artificial Sequence
  Synthetic
caccgctgtcccaaaaggtccttgcatcagggagcacattctgggatccatcccagtacgcactaaggctcttgttctctgatatgtggcatcattcaggttggaatgccaaatcatcaacatatcagcagccagggcct

SEQ ID NO: 420759 - DNA, 140 bp, Artificial Sequence
  Synthetic
  misc_feature (105)..(105): n is a, c, g, or t
atacgccatgctgggtctccttctagagaggaatgtcactgtgactcacgctcaagacattcttgagaagacccacaatggaaaattatgcaaactaaatggaanccctccacttgaattcgtacttgggagtcggccat

SEQ ID NO: 420760 - DNA, 140 bp, Artificial Sequence
  Synthetic
  misc_feature (36)..(36): n is a, c, g, or t
atggccgactcccaagtacgaattcaagtggagggnttccatttagtttgcataattttccattgtgggtcttctcaagaatgtcttgagcgtgagtcacagtgacattcctctctagaaggagacccagcatggcgtat

SEQ ID NO: 420761 - DNA, 140 bp, Artificial Sequence
  Synthetic
atacgccatgctgggtctcctctaggtaaagaagacaaaagatacgggccagcattgagcatcaatgaactgagcaatcttgcgaaaggagaaaaagctaatgtgctaatagggcaaggacgtacttgggagtcggccat

SEQ ID NO: 420762 - DNA, 140 bp, Artificial Sequence
  Synthetic
atggccgactcccaagtacgtccttgccctattagcacattagctttttctcctttcgcaagattgctcagttcattgatgctcaatgctggcccgtatcttttgtcttctttacctagaggagacccagcatggcgtat

SEQ ID NO: 420763 - DNA, 140 bp, Artificial Sequence
  Synthetic
atacgccatgctgggtctcccgagcaatgatggaccaggtgcgagaaagcagaaatccaggaaatgctgagattgaagatctcatctttttggcacgatctgcactcattctgagaggatcgtacttgggagtcggccat

SEQ ID NO: 420764 - DNA, 140 bp, Artificial Sequence
  Synthetic
atggccgactcccaagtacgatcctctcagaatgagtgcagatcgtgccaaaaagatgagatcttcaatctcagcatttcctggatttctgctttctcgcacctggtccatcattgctcgggagacccagcatggcgtat

SEQ ID NO: 420765 - DNA, 140 bp, Artificial Sequence
  Synthetic
atacgccatgctgggtctccatgaaagcacatccggagtggaatctgccgtcttgagagggtttctcattataggtaaagaagacagaagatacggaccagcattaagcatcaacgaactcgtacttgggagtcggccat

SEQ ID NO: 420766 - DNA, 140 bp, Artificial Sequence
  Synthetic
atggccgactcccaagtacgagttcgttgatgcttaatgctggtccgtatcttctgtcttctttacctataatgagaaaccctctcaagacggcagattccactccggatgtgctttcatggagacccagcatggcgtat

SEQ ID NO: 420767 - DNA, 140 bp, Artificial Sequence
  Synthetic
atacgccatgctgggtctcctccttttcgtctgcttcagaacagtcaggtgttcagcctcattagaccgaatgaaaatccagtccataagagtcagttggtatggatggcatgccattctcgtacttgggagtcggccat

SEQ ID NO: 420768 - DNA, 140 bp, Artificial Sequence
  Synthetic
atggccgactcccaagtacgagaatggcatgccatccataccaactgactcttatggactggattttcattcggtctaatgaggctgaacacctgactgttctgaagcagacgaaaaggaggagacccagcatggcgtat

SEQ ID NO: 420769 - DNA, 140 bp, Artificial Sequence
  Synthetic
atacgccatgctgggtctccagcgaaagcaggggttataccatagacaaccgaactaaagaaaatgaccatcacttttctcatcctcctgttcacagtagtgaaaggagaccaaatatgtcgtacttgggagtcggccat

SEQ ID NO: 420770 - DNA, 140 bp, Artificial Sequence
  Synthetic
atggccgactcccaagtacgacatatttggtctcctttcactactgtgaacaggaggatgagaaaagtgatggtcattttctttagttcggttgtctatggtataacccctgctttcgctggagacccagcatggcgtat

SEQ ID NO: 420771 - DNA, 140 bp, Artificial Sequence
  Synthetic
atacgccatgctgggtctccgcagcatttgaagatctgagggtgtcaagttttatcagaggggcaaaagtgattccaagaggaaaattgtccaccagaggagttcaaattgcttcaaatgcgtacttgggagtcggccat

SEQ ID NO: 420772 - DNA, 140 bp, Artificial Sequence
  Synthetic
atggccgactcccaagtacgcatttgaagcaatttgaactcctctggtggacaattttcctcttggaatcacttttgcccctctgataaaacttgacaccctcagatcttcaaatgctgcggagacccagcatggcgtat

SEQ ID NO: 420773 - DNA, 140 bp, Artificial Sequence
  Synthetic
aggccctggctgctgatatgcagaacgccctaaatgggaatggagacccaaacaacatggacagagcagtaaagctttacagaaagctgaagagagagataacattccacggagctaagggaccttttgggacagcggtg

SEQ ID NO: 420774 - DNA, 140 bp, Artificial Sequence
  Synthetic
caccgctgtcccaaaaggtcccttagctccgtggaatgttatctctctcttcagctttctgtaaagctttactgctctgtccatgttgtttgggtctccattcccatttagggcgttctgcatatcagcagccagggcct

SEQ ID NO: 420775 - DNA, 140 bp, Artificial Sequence
  Synthetic
atacgccatgctgggtctcctgggctataagaaccaggagcggaggaaacaccaatcaacaaagagcatctgcagggcaaatcagtgtacagcctactttctcagtacagagaaatcttccgtacttgggagtcggccat

SEQ ID NO: 420776 - DNA, 140 bp, Artificial Sequence
  Synthetic
atggccgactcccaagtacggaagatttctctgtactgagaaagtaggctgtacactgatttgccctgcagatgctctttgttgattggtgtttcctccgctcctggttcttatagcccaggagacccagcatggcgtat

SEQ ID NO: 420777 - DNA, 140 bp, Artificial Sequence
  Synthetic
atacgccatgctgggtctccatctacaataggatggggacagtgaccacagaagtggctttcggtctagtgtgtgccacttgtgagcagattgctgactctcagcatcgatcccacaggccgtacttgggagtcggccat

SEQ ID NO: 420778 - DNA, 140 bp, Artificial Sequence
  Synthetic
atggccgactcccaagtacggcctgtgggatcgatgctgagagtcagcaatctgctcacaagtggcacacactagaccgaaagccacttctgtggtcactgtccccatcctattgtagatggagacccagcatggcgtat

SEQ ID NO: 420779 - DNA, 140 bp, Artificial Sequence
  Synthetic
aggccctggctgctgatatggtgtgccacttgtgagcagattgctgactctcagcatcgatcccacaggcagatggtgaccacaaccaatccactaatcagacacgaaaatagaatggtggaccttttgggacagcggtg

SEQ ID NO: 420780 - DNA, 140 bp, Artificial Sequence
  Synthetic
caccgctgtcccaaaaggtccaccattctattttcgtgtctgattagtggattggttgtggtcaccatctgcctgtgggatcgatgctgagagtcagcaatctgctcacaagtggcacaccatatcagcagccagggcct

SEQ ID NO: 420781 - DNA, 140 bp, Artificial Sequence
  Synthetic
aggccctggctgctgatatgggttcattgaaattggagtaacacggagggaagtccacatatattacctagagaaagccaacaaaataaaatctgagaagacacacattcacatcttttcgaccttttgggacagcggtg

SEQ ID NO: 420782 - DNA, 140 bp, Artificial Sequence
  Synthetic
caccgctgtcccaaaaggtcgaaaagatgtgaatgtgtgtcttctcagattttattttgttggctttctctaggtaatatatgtggacttccctccgtgttactccaatttcaatgaacccatatcagcagccagggcct

SEQ ID NO: 420783 - DNA, 140 bp, Artificial Sequence
  Synthetic
atacgccatgctgggtctccagcaaaagcaggggaaaatttcatcaactatgaaaactgtcattgctttaagctacgtcttttgtctggtttttggccaagattttccaggaaagggcaacgtacttgggagtcggccat

SEQ ID NO: 420784 - DNA, 140 bp, Artificial Sequence
  Synthetic
atggccgactcccaagtacgttgccctttcctggaaaatcttggccaaaaaccagacaaaagacgtagcttaaagcaatgacagttttcatagttgatgaaattttcccctgcttttgctggagacccagcatggcgtat

SEQ ID NO: 420785 - DNA, 140 bp, Artificial Sequence
  Synthetic
atacgccatgctgggtctccagctacgtcttttgtctggtttttggccaagattttccaggaaagggcaacaacacagcaacactgtgcctaggacatcatgcagtgccaaatggaacaccgtacttgggagtcggccat

SEQ ID NO: 420786 - DNA, 140 bp, Artificial Sequence
  Synthetic
atggccgactcccaagtacggtgttccatttggcactgcatgatgtcctaggcacagtgttgctgtgttgttgccctttcctggaaaatcttggccaaaaaccagacaaaagacgtagctggagacccagcatggcgtat

SEQ ID NO: 420787 - DNA, 140 bp, Artificial Sequence
  Synthetic
aggccctggctgctgatatgcaacacagcaacactgtgcctaggacatcatgcagtgccaaatggaacactagtgaaaacaatcacagatgatcaaatcgaagtaaccaatgccacagaggaccttttgggacagcggtg

SEQ ID NO: 420788 - DNA, 140 bp, Artificial Sequence
  Synthetic
caccgctgtcccaaaaggtcctctgtggcattggttacttcgatttgatcatctgtgattgttttcactagtgttccatttggcactgcatgatgtcctaggcacagtgttgctgtgttgcatatcagcagccagggcct

SEQ ID NO: 420789 - DNA, 140 bp, Artificial Sequence
  Synthetic
atacgccatgctgggtctccctggtccaaaatttctcaatgggtaaaatatgcaagaatcctcatcgaattcttgatggggcaaattgcacactgatagactctctattgggggaccctccgtacttgggagtcggccat

SEQ ID NO: 420790 - DNA, 140 bp, Artificial Sequence
  Synthetic
atggccgactcccaagtacggagggtcccccaatagagagtctatcagtgtgcaatttgccccatcaagaattcgatgaggattcttgcatattttacccattgagaaattttggaccagggagacccagcatggcgtat

SEQ ID NO: 420791 - DNA, 140 bp, Artificial Sequence
  Synthetic
atacgccatgctgggtctccgaaatgaatccaaatcagaggataatagcgattgggtcagtaaacacagtattatctaccatagcactgctgattgggataggcaatttggctttcaatgcgtacttgggagtcggccat

SEQ ID NO: 420792 - DNA, 140 bp, Artificial Sequence
  Synthetic
atggccgactcccaagtacgcattgaaagccaaattgcctatcccaatcagcagtgctatggtagataatactgtgtttactgacccaatcgctattatcctctgatttggattcatttcggagacccagcatggcgtat

SEQ ID NO: 420793 - DNA, 140 bp, Artificial Sequence
  Synthetic
aggccctggctgctgatatgattatctaccatagcactgctgattgggataggcaatttggctttcaatgcagttattcatggcaaagttgaagaccataaaggtgaaatttcaccaaacgaccttttgggacagcggtg

SEQ ID NO: 420794 - DNA, 140 bp, Artificial Sequence
  Synthetic
caccgctgtcccaaaaggtcgtttggtgaaatttcacctttatggtcttcaactttgccatgaataactgcattgaaagccaaattgcctatcccaatcagcagtgctatggtagataatcatatcagcagccagggcct

SEQ ID NO: 420795 - DNA, 140 bp, Artificial Sequence
  Synthetic
atacgccatgctgggtctccagagctttcagcaactgttacccttatgatgtgccggagtatacctctcttaggtcactaattgcctcatcaggcaccttggaatttaccaatgaaaattcgtacttgggagtcggccat

SEQ ID NO: 420796 - DNA, 140 bp, Artificial Sequence
  Synthetic
atggccgactcccaagtacgaattttcattggtaaattccaaggtgcctgatgaggcaattagtgacctaagagaggtatactccggcacatcataagggtaacagttgctgaaagctctggagacccagcatggcgtat

SEQ ID NO: 420797 - DNA, 140 bp, Artificial Sequence
  Synthetic
aggccctggctgctgatatgtaggtcactaattgcctcatcaggcaccttggaatttaccaatgaaaatttcaattggactggagttacccaaaatgggggaagcagtgcttgcaagagggaccttttgggacagcggtg

SEQ ID NO: 420798 - DNA, 140 bp, Artificial Sequence
  Synthetic
caccgctgtcccaaaaggtccctcttgcaagcactgcttcccccattttgggtaactccagtccaattgaaattttcattggtaaattccaaggtgcctgatgaggcaattagtgacctacatatcagcagccagggcct

SEQ ID NO: 420799 - DNA, 140 bp, Artificial Sequence
  Synthetic
aggccctggctgctgatatgtcacgctcaccgtgcccagtgagcgaggactgcagcgtagacgctttgtccaaaatgccctaaatgggaatggggacccgaacaacatggatagagcagtgaccttttgggacagcggtg

SEQ ID NO: 420800 - DNA, 140 bp, Artificial Sequence
  Synthetic
caccgctgtcccaaaaggtcactgctctatccatgttgttcgggtccccattcccatttagggcattttggacaaagcgtctacgctgcagtcctcgctcactgggcacggtgagcgtgacatatcagcagccagggcct

SEQ ID NO: 420801 - DNA, 140 bp, Artificial Sequence
  Synthetic
atacgccatgctgggtctccaaacacatatccaatgctaaatgttactatgccaaacagtgatgatttcgacaaattgtacatttggggagttcatcatccgagcaccgatagagaacagcgtacttgggagtcggccat

SEQ ID NO: 420802 - DNA, 140 bp, Artificial Sequence
  Synthetic
atggccgactcccaagtacgctgttctctatcggtgctcggatgatgaactccccaaatgtacaatttgtcgaaatcatcactgtttggcatagtaacatttagcattggatatgtgtttggagacccagcatggcgtat

SEQ ID NO: 420803 - DNA, 140 bp, Artificial Sequence
  Synthetic
aggccctggctgctgatatgacaaattgtacatttggggagttcatcatccgagcaccgatagagaacagaccaacctgtatattcaagcatcagggaaaataatagtatccacaaagaggaccttttgggacagcggtg

SEQ ID NO: 420804 - DNA, 140 bp, Artificial Sequence
  Synthetic
caccgctgtcccaaaaggtcctctttgtggatactattattttccctgatgcttgaatatacaggttggtctgttctctatcggtgctcggatgatgaactccccaaatgtacaatttgtcatatcagcagccagggcct

SEQ ID NO: 420805 - DNA, 140 bp, Artificial Sequence
  Synthetic
atacgccatgctgggtctcctgtatcaatggaacttgtacagtagtaatgactgatgggagtgcttcaggaaaagctgatactaaaatactattcattgaggaggggaaaatcgttcatacgtacttgggagtcggccat

SEQ ID NO: 420806 - DNA, 140 bp, Artificial Sequence
  Synthetic
atggccgactcccaagtacgtatgaacgattttcccctcctcaatgaatagtattttagtatcagcttttcctgaagcactcccatcagtcattactactgtacaagttccattgatacaggagacccagcatggcgtat

SEQ ID NO: 420807 - DNA, 140 bp, Artificial Sequence
  Synthetic
atacgccatgctgggtctccaaggacagaactccatacagatccctaatcagattcccaattggaacagctcccgttcttgggaactacagggaaatgtgcatcgcatggtccagcagcacgtacttgggagtcggccat

SEQ ID NO: 420808 - DNA, 140 bp, Artificial Sequence
  Synthetic
atggccgactcccaagtacgtgctgctggaccatgcgatgcacatttccctgtagttcccaagaacgggagctgttccaattgggaatctgattagggatctgtatggagttctgtccttggagacccagcatggcgtat

SEQ ID NO: 420809 - DNA, 140 bp, Artificial Sequence
  Synthetic
atacgccatgctgggtctccgtttgtctagtaggataagcatctactggacaatagttaaaccaggagacatcctgataatcaacagcaatggaaacctaattgctcctcggggttacttcgtacttgggagtcggccat

SEQ ID NO: 420810 - DNA, 140 bp, Artificial Sequence
  Synthetic
atggccgactcccaagtacgaagtaaccccgaggagcaattaggtttccattgctgttgattatcaggatgtctcctggtttaactattgtccagtagatgcttatcctactagacaaacggagacccagcatggcgtat

SEQ ID NO: 420811 - DNA, 140 bp, Artificial Sequence
  Synthetic
aggccctggctgctgatatgatcctgataatcaacagcaatggaaacctaattgctcctcggggttacttcaaaatacagactgggaaaagttcagtaatgaaatcagatgcacctattggaccttttgggacagcggtg

SEQ ID NO: 420812 - DNA, 140 bp, Artificial Sequence
  Synthetic
caccgctgtcccaaaaggtccaataggtgcatctgatttcattactgaacttttcccagtctgtattttgaagtaaccccgaggagcaattaggtttccattgctgttgattatcaggatcatatcagcagccagggcct

SEQ ID NO: 420813 - DNA, 140 bp, Artificial Sequence
  Synthetic
atacgccatgctgggtctccgccagtggatacgactttgagagagagggatattccctagtcggaatcgatcctttccgtctgcttcaaaacagtcaagtcttcagtcttatcagaccaacgtacttgggagtcggccat

SEQ ID NO: 420814 - DNA, 140 bp, Artificial Sequence
  Synthetic
atggccgactcccaagtacgttggtctgataagactgaagacttgactgttttgaagcagacggaaaggatcgattccgactagggaatatccctctctctcaaagtcgtatccactggcggagacccagcatggcgtat

SEQ ID NO: 420815 - DNA, 140 bp, Artificial Sequence
  Synthetic
atacgccatgctgggtctccaaaccctttcaaaacgtaaacaggattacatatggggcatgcccccattacatcaagcaaagcactctgaagttagcaacaggaatgcggaatataccagcgtacttgggagtcggccat

SEQ ID NO: 420816 - DNA, 140 bp, Artificial Sequence
  Synthetic
atggccgactcccaagtacgctggtatattccgcattcctgttgctaacttcagagtgctttgcttgatgtaatgggggcatgccccatatgtaatcctgtttacgttttgaaagggtttggagacccagcatggcgtat

SEQ ID NO: 420817 - DNA, 140 bp, Artificial Sequence
  Synthetic
aggccctggctgctgatatgcatcaagcaaagcactctgaagttagcaacaggaatgcggaatataccagaaagacaaaccagaggtatattcggcgcaatagcagggttcatagagaatgaccttttgggacagcggtg

SEQ ID NO: 420818 - DNA, 140 bp, Artificial Sequence
  Synthetic
caccgctgtcccaaaaggtcattctctatgaaccctgctattgcgccgaatatacctctggtttgtctttctggtatattccgcattcctgttgctaacttcagagtgctttgcttgatgcatatcagcagccagggcct

SEQ ID NO: 420819 - DNA, 140 bp, Artificial Sequence
  Synthetic
atacgccatgctgggtctccacacagatgttgatatatactgcatttgtagagacaactggaaaggctcaaacaggccatgggttcgcatgaacaatgaaactatattggaaactggatacgtacttgggagtcggccat

SEQ ID NO: 420820 - DNA, 140 bp, Artificial Sequence
  Synthetic
atggccgactcccaagtacgtatccagtttccaatatagtttcattgttcatgcgaacccatggcctgtttgagcctttccagttgtctctacaaatgcagtatatatcaacatctgtgtggagacccagcatggcgtat

SEQ ID NO: 420821 - DNA, 140 bp, Artificial Sequence
  Synthetic
atacgccatgctgggtctcctgagggcataggacaggcagcagatcttaaaagtacccaagcagctatcaaccaaatcaatggaaaactgaatagagtaatcgagaagacaaacgagaaacgtacttgggagtcggccat

SEQ ID NO: 420822 - DNA, 140 bp, Artificial Sequence
  Synthetic
atggccgactcccaagtacgtttctcgtttgtcttctcgattactctattcagttttccattgatttggttgatagctgcttgggtacttttaagatctgctgcctgtcctatgccctcaggagacccagcatggcgtat

SEQ ID NO: 420823 - DNA, 140 bp, Artificial Sequence
  Synthetic
aggccctggctgctgatatgaccaaatcaatggaaaactgaatagagtaatcgagaagacaaacgagaaattccatcaaatcgaaaaggagttctcagaagtagaaggaaggatacaagagaccttttgggacagcggtg

SEQ ID NO: 420824 - DNA, 140 bp, Artificial Sequence
  Synthetic
caccgctgtcccaaaaggtctcttgtatccttccttctacttctgagaactccttttcgatttgatggaatttctcgtttgtcttctcgattactctattcagttttccattgatttggtcatatcagcagccagggcct

SEQ ID NO: 420825 - DNA, 140 bp, Artificial Sequence
  Synthetic
atacgccatgctgggtctccggattcggatttaaagtccaaaatgatgtatggctcgggagaacaatatcatatagtagccgatcaggatttgaagtaatcaaagtttcaaatggctggacgtacttgggagtcggccat

SEQ ID NO: 420826 - DNA, 140 bp, Artificial Sequence
  Synthetic
atggccgactcccaagtacgtccagccatttgaaactttgattacttcaaatcctgatcggctactatatgatattgttctcccgagccatacatcattttggactttaaatccgaatccggagacccagcatggcgtat

SEQ ID NO: 420827 - DNA, 140 bp, Artificial Sequence
  Synthetic
atacgccatgctgggtctcccggaacttcttgtcgcactagagaatcaacacacaattgacctgactgactcagaaatgaacaaactctttgaaaaaacaaggaaacaactaagggaaaacgtacttgggagtcggccat

SEQ ID NO: 420828 - DNA, 140 bp, Artificial Sequence
  Synthetic
atggccgactcccaagtacgttttcccttagttgtttccttgttttttcaaagagtttgttcatttctgagtcagtcaggtcaattgtgtgttgattctctagtgcgacaagaagttccgggagacccagcatggcgtat

SEQ ID NO: 420829 - DNA, 140 bp, Artificial Sequence
  Synthetic
aggccctggctgctgatatgtcagaaatgaacaaactctttgaaaaaacaaggaaacaactaagggaaaatgctgaggacatgggaaatggttgcttcaaaatataccacaaatgtgacagaccttttgggacagcggtg

SEQ ID NO: 420830 - DNA, 140 bp, Artificial Sequence
  Synthetic
caccgctgtcccaaaaggtctgtcacatttgtggtatattttgaagcaaccatttcccatgtcctcagcattttcccttagttgtttccttgttttttcaaagagtttgttcatttctgacatatcagcagccagggcct

SEQ ID NO: 420831 - DNA, 140 bp, Artificial Sequence
  Synthetic
aggccctggctgctgatatgatagagactcccaagtatctggctgatttgtttgattataagaccaagagatttatagaagttggaataacaaaaggattggctgatgattacttttggagaccttttgggacagcggtg

SEQ ID NO: 420832 - DNA, 140 bp, Artificial Sequence
  Synthetic
caccgctgtcccaaaaggtctccaaaagtaatcatcagccaatccttttgttattccaacttctataaatctcttggtcttataatcaaacaaatcagccagatacttgggagtctctatcatatcagcagccagggcct

SEQ ID NO: 420833 - DNA, 140 bp, Artificial Sequence
  Synthetic
atacgccatgctgggtctccgtgggcctcaaacagtattgttgtattttgtggcacttcaggcacctatggaacaggctcatggcctgatggggcgaacatcaatttcatgcctatataacgtacttgggagtcggccat

SEQ ID NO: 420834 - DNA, 140 bp, Artificial Sequence
  Synthetic
atggccgactcccaagtacgttatataggcatgaaattgatgttcgccccatcaggccatgagcctgttccataggtgcctgaagtgccacaaaatacaacaatactgtttgaggcccacggagacccagcatggcgtat

SEQ ID NO: 420835 - DNA, 140 bp, Artificial Sequence
  Synthetic
atacgccatgctgggtctccagagacgaagcagtaaacaatcgattccaaatcaaaagtgttgagctgaagtcaggatacaaagactggatcctgtggatttcctttgccatatcatgctcgtacttgggagtcggccat

SEQ ID NO: 420836 - DNA, 140 bp, Artificial Sequence
  Synthetic
atggccgactcccaagtacgagcatgatatggcaaaggaaatccacaggatccagtctttgtatcctgacttcagctcaacacttttgatttggaatcgattgtttactgcttcgtctctggagacccagcatggcgtat

SEQ ID NO: 420837 - DNA, 140 bp, Artificial Sequence
  Synthetic
atacgccatgctgggtctccgaagcaataatcgtggccatggtgttttcacaagaagattgcatgataaaagcagttagaggtgacctgaatttcgtcaacagagcaaatcagcggttgacgtacttgggagtcggccat

SEQ ID NO: 420838 - DNA, 140 bp, Artificial Sequence
  Synthetic
atggccgactcccaagtacgtcaaccgctgatttgctctgttgacgaaattcaggtcacctctaactgcttttatcatgcaatcttcttgtgaaaacaccatggccacgattattgcttcggagacccagcatggcgtat

SEQ ID NO: 420839 - DNA, 140 bp, Artificial Sequence
  Synthetic
aggccctggctgctgatatggataatcactcactgagtgacatccacatcatggcgtctcaaggcaccaaacgatcttatgagcagatggaaactggtggtgaacgccagaatgccactggaccttttgggacagcggtg

SEQ ID NO: 420840 - DNA, 140 bp, Artificial Sequence
  Synthetic
caccgctgtcccaaaaggtccagtggcattctggcgttcaccaccagtttccatctgctcataagatcgtttggtgccttgagacgccatgatgtggatgtcactcagtgagtgattatccatatcagcagccagggcct

SEQ ID NO: 420841 - DNA, 140 bp, Artificial Sequence
  Synthetic
atacgccatgctgggtctccagattcgggcatctgtcggaaggatggttggaggaatcggaagattctacatacagatgtgcactgaactcaaactgagtgacaatgaaggaaggctgatcgtacttgggagtcggccat

SEQ ID NO: 420842 - DNA, 140 bp, Artificial Sequence
  Synthetic
atggccgactcccaagtacgatcagccttccttcattgtcactcagtttgagttcagtgcacatctgtatgtagaatcttccgattcctccaaccatccttccgacagatgcccgaatctggagacccagcatggcgtat

SEQ ID NO: 420843 - DNA, 140 bp, Artificial Sequence
  Synthetic
atacgccatgctgggtctccatggcgtcccaaggcaccaaacgatcttatgaacagatggaaactggtggggaacgccagaatgccaccgagatcagagcatccgttggaagaatggttgcgtacttgggagtcggccat

SEQ ID NO: 420844 - DNA, 140 bp, Artificial Sequence
  Synthetic
atggccgactcccaagtacgcaaccattcttccaacggatgctctgatctcggtggcattctggcgttccccaccagtttccatctgttcataagatcgtttggtgccttgggacgccatggagacccagcatggcgtat

SEQ ID NO: 420845 - DNA, 140 bp, Artificial Sequence
  Synthetic
aggccctggctgctgatatgggggcttggcgatgccccatttctcgataggcttcgccgagaccagaagtccctaagagggagaggcagcacccttggcctggaaatcgaaccagctactgaccttttgggacagcggtg

SEQ ID NO: 420846 - DNA, 140 bp, Artificial Sequence
  Synthetic
caccgctgtcccaaaaggtcagtagctggttcgatttccaggccaagggtgctgcctctccctcttagggacttctggtctcggcgaagcctatcgagaaatggggcatcgccaagcccccatatcagcagccagggcct

SEQ ID NO: 420847 - DNA, 140 bp, Artificial Sequence
  Synthetic
atacgccatgctgggtctccggaggaacaggtacttggaggagcatcccagcgctgggagggaccccaagaaaactggtggaccaatttacagaaggagagaggggaaatgggtgagagacgtacttgggagtcggccat

SEQ ID NO: 420848 - DNA, 140 bp, Artificial Sequence
  Synthetic
atggccgactcccaagtacgtctctcacccatttcccctctctccttctgtaaattggtccaccagttttcttggggtccctcccagcgctgggatgctcctccaagtacctgttcctccggagacccagcatggcgtat

SEQ ID NO: 420849 - DNA, 140 bp, Artificial Sequence
  Synthetic
aggccctggctgctgatatgaaaactggtggaccaatttacagaaggagagaggggaaatgggtgagagaattggtcctatatgacaaggaagaaataagaagaatctggcgacaggcaagaccttttgggacagcggtg

SEQ ID NO: 420850 - DNA, 140 bp, Artificial Sequence
  Synthetic
caccgctgtcccaaaaggtcttgcctgtcgccagattcttcttatttcttccttgtcatataggaccaattctctcacccatttcccctctctccttctgtaaattggtccaccagttttcatatcagcagccagggcct

SEQ ID NO: 420851 - DNA, 140 bp, Artificial Sequence
  Synthetic
atacgccatgctgggtctccggcgcttaaaataacgatcgcttctgtgcctgcttcacgatatctaactgacatgactcttgaagagatgtcaagggactggttcatgctcatgcccaagcgtacttgggagtcggccat

SEQ ID NO: 420852 - DNA, 140 bp, Artificial Sequence
  Synthetic
atggccgactcccaagtacgcttgggcatgagcatgaaccagtcccttgacatctcttcaagagtcatgtcagttagatatcgtgaagcaggcacagaagcgatcgttattttaagcgccggagacccagcatggcgtat

SEQ ID NO: 420853 - DNA, 140 bp, Artificial Sequence
  Synthetic
atacgccatgctgggtctcctctaatttgaatgacgccacatatcagaggactagagccctagtgcgcaccgggatggaccccaggatgtgctccctcatgcagggatcgacactcccaacgtacttgggagtcggccat

SEQ ID NO: 420854 - DNA, 140 bp, Artificial Sequence
  Synthetic
atggccgactcccaagtacgttgggagtgtcgatccctgcatgagggagcacatcctggggtccatcccggtgcgcactagggctctagtcctctgatatgtggcgtcattcaaattagaggagacccagcatggcgtat

SEQ ID NO: 420855 - DNA, 140 bp, Artificial Sequence
  Synthetic
aggccctggctgctgatatggtaaactcttttagcaggacagaattgataagccccagcaaatggggggctgttctggatggagtcactgcttcatgtctcgacagaggggcaagcagttgaccttttgggacagcggtg

SEQ ID NO: 420856 - DNA, 140 bp, Artificial Sequence
  Synthetic
caccgctgtcccaaaaggtcaactgcttgcccctctgtcgagacatgaagcagtgactccatccagaacagccccccatttgctggggcttatcaattctgtcctgctaaaagagtttaccatatcagcagccagggcct

SEQ ID NO: 420857 - DNA, 140 bp, Artificial Sequence
  Synthetic
atacgccatgctgggtctccgaaggtctggagcggccggtgcagctgtaaaaggggttgggacaatggtgatggagctcatcagaatgataaaaagaggggttaatgaccgtaacttctgcgtacttgggagtcggccat

SEQ ID NO: 420858 - DNA, 140 bp, Artificial Sequence
  Synthetic
atggccgactcccaagtacgcagaagttacggtcattaacccctctttttatcattctgatgagctccatcaccattgtcccaaccccttttacagctgcaccggccgctccagaccttcggagacccagcatggcgtat

SEQ ID NO: 420859 - DNA, 140 bp, Artificial Sequence
  Synthetic
atacgccatgctgggtctccgaaatctcaccattaccttctcttccaggacatactaacgaggatgtcaaaaatgcaattgggatcctcatcaaaggacttgagtggaatgataacacagcgtacttgggagtcggccat

SEQ ID NO: 420860 - DNA, 140 bp, Artificial Sequence
  Synthetic
atggccgactcccaagtacgctgtgttatcattccactcaagtcctttgatgaggatcccaattgcatttttgacatcctcgttagtatgtcctggaagagaaggtaatggtgagatttcggagacccagcatggcgtat

SEQ ID NO: 420861 - DNA, 140 bp, Artificial Sequence
  Synthetic
aggccctggctgctgatatgaaatgcaattgggatcctcatcaaaggacttgagtggaatgataacacagttcgagtctctgaggctctacagagattctcttggagaagcactaatgaggaccttttgggacagcggtg

SEQ ID NO: 420862 - DNA, 140 bp, Artificial Sequence
  Synthetic
caccgctgtcccaaaaggtcctcattagtgcttctccaagagaatctctgtagagcctcagagactcgaactgtgttatcattccactcaagtcctttgatgaggatcccaattgcatttcatatcagcagccagggcct

SEQ ID NO: 420863 - DNA, 140 bp, Artificial Sequence
  Synthetic
atacgccatgctgggtctccacatccttaaagggaaattccaaacagcagcacaacgagctatgatggatcaggtcagagagagccgtaatcctggaaatgctgaaattgaagacctcatcgtacttgggagtcggccat

SEQ ID NO: 420864 - DNA, 140 bp, Artificial Sequence
  Synthetic
atggccgactcccaagtacgatgaggtcttcaatttcagcatttccaggattacggctctctctgacctgatccatcatagctcgttgtgctgctgtttggaatttccctttaaggatgtggagacccagcatggcgtat

SEQ ID NO: 420865 - DNA, 140 bp, Artificial Sequence
  Synthetic
aggccctggctgctgatatgcaggtcagagagagccgtaatcctggaaatgctgaaattgaagacctcatctttttggccaggtctgcccttattctgaggggagcagtagctcataaatgaccttttgggacagcggtg

SEQ ID NO: 420866 - DNA, 140 bp, Artificial Sequence
  Synthetic
caccgctgtcccaaaaggtcatttatgagctactgctcccctcagaataagggcagacctggccaaaaagatgaggtcttcaatttcagcatttccaggattacggctctctctgacctgcatatcagcagccagggcct

SEQ ID NO: 420867 - DNA, 140 bp, Artificial Sequence
  Synthetic
atacgccatgctgggtctccaattgggccagaagtttgaagaaataagatggctaattgaggaaatgcgacacagattaaaaataacagagaatagctttgaacaaataacatttatgcacgtacttgggagtcggccat

SEQ ID NO: 420868 - DNA, 140 bp, Artificial Sequence
  Synthetic
atggccgactcccaagtacgtgcataaatgttatttgttcaaagctattctctgttatttttaatctgtgtcgcatttcctcaattagccatcttatttcttcaaacttctggcccaattggagacccagcatggcgtat

SEQ ID NO: 420869 - DNA, 140 bp, Artificial Sequence
  Synthetic
atacgccatgctgggtctccttcgaaagggagggatattcccttgttgggatagaccctttccgtctgctccagaacagccaagtgttcagtctaatccgacccaatgaaaatcctgcaccgtacttgggagtcggccat

SEQ ID NO: 420870 - DNA, 140 bp, Artificial Sequence
  Synthetic
atggccgactcccaagtacggtgcaggattttcattgggtcggattagactgaacacttggctgttctggagcagacggaaagggtctatcccaacaagggaatatccctccctttcgaaggagacccagcatggcgtat

SEQ ID NO: 420871 - DNA, 140 bp, Artificial Sequence
  Synthetic
aggccctggctgctgatatgccagaacagccaagtgttcagtctaatccgacccaatgaaaatcctgcacacaagagccaattggtatggatggcatgtcattctgctgcatttgaggatgaccttttgggacagcggtg

SEQ ID NO: 420872 - DNA, 140 bp, Artificial Sequence
  Synthetic
caccgctgtcccaaaaggtcatcctcaaatgcagcagaatgacatgccatccataccaattggctcttgtgtgcaggattttcattgggtcggattagactgaacacttggctgttctggcatatcagcagccagggcct

SEQ ID NO: 420873 - DNA, 140 bp, Artificial Sequence
  Synthetic
atacgccatgctgggtctccactatccacaagaggtgttcaaattgcgtccaacgagaacatggaaactatgagttccagcacccttgaattaaggagcaaatactgggcaataaggactcgtacttgggagtcggccat

SEQ ID NO: 420874 - DNA, 140 bp, Artificial Sequence
  Synthetic
atggccgactcccaagtacgagtccttattgcccagtatttgctccttaattcaagggtgctggaactcatagtttccatgttctcgttggacgcaatttgaacacctcttgtggatagtggagacccagcatggcgtat

SEQ ID NO: 420875 - DNA, 140 bp, Artificial Sequence
  Synthetic
atacgccatgctgggtctcctgtacaacctactttttcagtacaaagaaacctcccttttgaaagagcaacaatcatggctgcattcacaggaaatgcagaaggaagaacatccgatatgcgtacttgggagtcggccat

SEQ ID NO: 420876 - DNA, 140 bp, Artificial Sequence
  Synthetic
atggccgactcccaagtacgcatatcggatgttcttccttctgcatttcctgtgaatgcagccatgattgttgctctttcaaaagggaggtttctttgtactgaaaaagtaggttgtacaggagacccagcatggcgtat

SEQ ID NO: 420877 - DNA, 140 bp, Artificial Sequence
  Synthetic
atacgccatgctgggtctccaggactgagatcatacggatgatggaaagtgcaagaccagaagatgtgtctttccaggggcggggagtcttcgagctctcagacgaaaaggccacgaacccgtacttgggagtcggccat

SEQ ID NO: 420878 - DNA, 140 bp, Artificial Sequence
  Synthetic
atggccgactcccaagtacgggttcgtggccttttcgtctgagagctcgaagactccccgcccctggaaagacacatcttctggtcttgcactttccatcatccgtatgatctcagtcctggagacccagcatggcgtat

SEQ ID NO: 420879 - DNA, 140 bp, Artificial Sequence
  Synthetic
aggccctggctgctgatatgtttccaggggcggggagtcttcgagctctcagacgaaaaggccacgaacccgatcgtgccttcctttgacatgagtaaagaaggatcttatttctttggagaccttttgggacagcggtg

SEQ ID NO: 420880 - DNA, 140 bp, Artificial Sequence
  Synthetic
caccgctgtcccaaaaggtctccaaagaaataagatccttctttactcatgtcaaaggaaggcacgatcgggttcgtggccttttcgtctgagagctcgaagactccccgcccctggaaacatatcagcagccagggcct

SEQ ID NO: 420881 - DNA, 140 bp, Artificial Sequence
  Synthetic
atacgccatgctgggtctcctctgaaattggcaacaggaatgagaaatgtaccagagaaacaaactagaggcatatttggcgcaatagcgggtttcatagaaaatggttgggagggaatgcgtacttgggagtcggccat

SEQ ID NO: 420882 - DNA, 140 bp, Artificial Sequence
  Synthetic
atggccgactcccaagtacgcattccctcccaaccattttctatgaaacccgctattgcgccaaatatgcctctagtttgtttctctggtacatttctcattcctgttgccaatttcagaggagacccagcatggcgtat

SEQ ID NO: 420883 - DNA, 140 bp, Artificial Sequence
  Synthetic
atacgccatgctgggtctccatattgtcaaaacagcagaaatggtggtcaaagtgctctaccttttcatcatagtgttgggcagatactcaaaagcagacaaaatatgcataggatacctcgtacttgggagtcggccat

SEQ ID NO: 420884 - DNA, 140 bp, Artificial Sequence
  Synthetic
atggccgactcccaagtacgaggtatcctatgcatattttgtctgcttttgagtatctgcccaacactatgatgaaaaggtagagcactttgaccaccatttctgctgttttgacaatatggagacccagcatggcgtat

SEQ ID NO: 420885 - DNA, 140 bp, Artificial Sequence
  Synthetic
aggccctggctgctgatatgatagtgttgggcagatactcaaaagcagacaaaatatgcataggatacctgagcaataactcaacagataaagtagatacactgactgaaaatggagttcgaccttttgggacagcggtg

SEQ ID NO: 420886 - DNA, 140 bp, Artificial Sequence
  Synthetic
caccgctgtcccaaaaggtcgaactccattttcagtcagtgtatctactttatctgttgagttattgctcaggtatcctatgcatattttgtctgcttttgagtatctgcccaacactatcatatcagcagccagggcct

SEQ ID NO: 420887 - DNA, 140 bp, Artificial Sequence
  Synthetic
atacgccatgctgggtctcctgaggacactaaaatagatctctggtcatacaacgcggagcttcttgttgccctggagaaccaacacacaattgatctaactgactcagaaatgaacaaacgtacttgggagtcggccat

SEQ ID NO: 420888 - DNA, 140 bp, Artificial Sequence
  Synthetic
atggccgactcccaagtacgtttgttcatttctgagtcagttagatcaattgtgtgttggttctccagggcaacaagaagctccgcgttgtatgaccagagatctattttagtgtcctcaggagacccagcatggcgtat

SEQ ID NO: 420889 - DNA, 140 bp, Artificial Sequence
  Synthetic
atacgccatgctgggtctccctgtgaccagctcagtggaccttgtagaaacaaaccatactggaacatactgctcattgaatgggatcagcccggttcatcttggtgactgcagttttgacgtacttgggagtcggccat

SEQ ID NO: 420890 - DNA, 140 bp, Artificial Sequence
  Synthetic
atggccgactcccaagtacgtcaaaactgcagtcaccaagatgaaccgggctgatcccattcaatgagcagtatgttccagtatggtttgtttctacaaggtccactgagctggtcacagggagacccagcatggcgtat

SEQ ID NO: 420891 - DNA, 140 bp, Artificial Sequence
  Synthetic
aggccctggctgctgatatgtgctcattgaatgggatcagcccggttcatcttggtgactgcagttttgagggatggattgtagggaacccctcctgtgctaccaatatcaacataagaggaccttttgggacagcggtg

SEQ ID NO: 420892 - DNA, 140 bp, Artificial Sequence
  Synthetic
caccgctgtcccaaaaggtcctcttatgttgatattggtagcacaggaggggttccctacaatccatccctcaaaactgcagtcaccaagatgaaccgggctgatcccattcaatgagcacatatcagcagccagggcct

SEQ ID NO: 420893 - DNA, 140 bp, Artificial Sequence
  Synthetic
atacgccatgctgggtctccccaggagagttggacaacaatggtgagctgcggcatcttttcagtggagtaaactcttttagcaggacagaattgataagtcccagcaaatggggggatgcgtacttgggagtcggccat

SEQ ID NO: 420894 - DNA, 140 bp, Artificial Sequence
  Synthetic
atggccgactcccaagtacgcatccccccatttgctgggacttatcaattctgtcctgctaaaagagtttactccactgaaaagatgccgcagctcaccattgttgtccaactctcctggggagacccagcatggcgtat

SEQ ID NO: 420895 - DNA, 140 bp, Artificial Sequence
  Synthetic
aggccctggctgctgatatgaaactcttttagcaggacagaattgataagtcccagcaaatggggggatgtcctggatggagtcactgcttcatgtctcgacagaggagcaagcagttttgaccttttgggacagcggtg

SEQ ID NO: 420896 - DNA, 140 bp, Artificial Sequence
  Synthetic
caccgctgtcccaaaaggtcaaaactgcttgctcctctgtcgagacatgaagcagtgactccatccaggacatccccccatttgctgggacttatcaattctgtcctgctaaaagagtttcatatcagcagccagggcct

SEQ ID NO: 420897 - DNA, 140 bp, Artificial Sequence
  Synthetic
atacgccatgctgggtctccaagaggggattataacaacacaacaggacgagatgttttggtgatttggggaatccaccacccagattcggaagctacagccacaaaactatatgtcaaccgtacttgggagtcggccat

SEQ ID NO: 420898 - DNA, 140 bp, Artificial Sequence
  Synthetic
atggccgactcccaagtacggttgacatatagttttgtggctgtagcttccgaatctgggtggtggattccccaaatcaccaaaacatctcgtcctgttgtgttgttataatcccctcttggagacccagcatggcgtat

SEQ ID NO: 420899 - DNA, 140 bp, Artificial Sequence
  Synthetic
atacgccatgctgggtctccgctcgaaatcgggaccagaataggtgacggacaaaaaagttggatgaaaatatattggcacctcatgcgcccaggcgaaaggataacatttgagagcaatcgtacttgggagtcggccat

SEQ ID NO: 420900 - DNA, 140 bp, Artificial Sequence
  Synthetic
atggccgactcccaagtacgattgctctcaaatgttatcctttcgcctgggcgcatgaggtgccaatatattttcatccaacttttttgtccgtcacctattctggtcccgatttcgagcggagacccagcatggcgtat

SEQ ID NO: 420901 - DNA, 140 bp, Artificial Sequence
  Synthetic
aggccctggctgctgatatgtatattggcacctcatgcgcccaggcgaaaggataacatttgagagcaatgggggccttctagcacccagatacggatatatcattgagaagtatggttcgaccttttgggacagcggtg

SEQ ID NO: 420902 - DNA, 140 bp, Artificial Sequence
  Synthetic
caccgctgtcccaaaaggtcgaaccatacttctcaatgatatatccgtatctgggtgctagaaggcccccattgctctcaaatgttatcctttcgcctgggcgcatgaggtgccaatatacatatcagcagccagggcct

SEQ ID NO: 420903 - DNA, 140 bp, Artificial Sequence
  Synthetic
atacgccatgctgggtctccgttgaaagcgaatttcaatgtgatttttgaccgactagagactatagtattgctaagggctttcaccgaagagggagcaattgttggcgaaatctcaccacgtacttgggagtcggccat

SEQ ID NO: 420904 - DNA, 140 bp, Artificial Sequence
  Synthetic
atggccgactcccaagtacgtggtgagatttcgccaacaattgctccctcttcggtgaaagcccttagcaatactatagtctctagtcggtcaaaaatcacattgaaattcgctttcaacggagacccagcatggcgtat

SEQ ID NO: 420905 - DNA, 140 bp, Artificial Sequence
  Synthetic
atacgccatgctgggtctcccatggtatctagggccccaattgatgcacggattgacttccactctcgaaggattaaaaaagaagagttcgcggagatcatgaagatctgttccaccattcgtacttgggagtcggccat

SEQ ID NO: 420906 - DNA, 140 bp, Artificial Sequence
  Synthetic
atggccgactcccaagtacgaatggtggaacagatcttcatgatctccgcgaactcttcttttttaatccttcgagagtggaagtcaatccgtgcatcaattggggccctagataccatgggagacccagcatggcgtat

SEQ ID NO: 420907 - DNA, 140 bp, Artificial Sequence
  Synthetic
atacgccatgctgggtctccgccaaacttccgtaggtggaataaacaccaacaaaactttccagaacatagacaggaatgccctgggagaatgtccgaagtacataaagtctgggcaattcgtacttgggagtcggccat

SEQ ID NO: 420908 - DNA, 140 bp, Artificial Sequence
  Synthetic
atggccgactcccaagtacgaattgcccagactttatgtacttcggacattctcccagggcattcctgtctatgttctggaaagttttgttggtgtttattccacctacggaagtttggcggagacccagcatggcgtat

SEQ ID NO: 420909 - DNA, 140 bp, Artificial Sequence
  Synthetic
aggccctggctgctgatatggacaggaatgccctgggagaatgtccgaagtacataaagtctgggcaattaaaacttgctactggcctgagaaatgtcccatccattaatgagaaaggtcgaccttttgggacagcggtg

SEQ ID NO: 420910 - DNA, 140 bp, Artificial Sequence
  Synthetic
caccgctgtcccaaaaggtcgacctttctcattaatggatgggacatttctcaggccagtagcaagttttaattgcccagactttatgtacttcggacattctcccagggcattcctgtccatatcagcagccagggcct

SEQ ID NO: 420911 - DNA, 140 bp, Artificial Sequence
  Synthetic
atacgccatgctgggtctccaatggatggtatggtttccagcatcagaatgaacaagggactggcattgctgcagataaagcttccacccagaaagcaataaatgaaataacaacgaaaacgtacttgggagtcggccat

SEQ ID NO: 420912 - DNA, 140 bp, Artificial Sequence
  Synthetic
atggccgactcccaagtacgttttcgttgttatttcatttattgctttctgggtggaagctttatctgcagcaatgccagtcccttgttcattctgatgctggaaaccataccatccattggagacccagcatggcgtat

SEQ ID NO: 420913 - DNA, 140 bp, Artificial Sequence
  Synthetic
aggccctggctgctgatatgaaaatggaagattttgtgcgacaatgcttcaatccaatgatcgtcgagcttgcggaaaaggcaatgaaggaatatggggaagatccaaaaatcgagacaagaccttttgggacagcggtg

SEQ ID NO: 420914 - DNA, 140 bp, Artificial Sequence
  Synthetic
caccgctgtcccaaaaggtcttgtctcgatttttggatcttccccatattccttcattgccttttccgcaagctcgacgatcattggattgaagcattgtcgcacaaaatcttccattttcatatcagcagccagggcct

SEQ ID NO: 420915 - DNA, 140 bp, Artificial Sequence
  Synthetic
aggccctggctgctgatatggatttccacttcattgatgaacgaggtgagtcgataatcgtggaatctggcgatccaaatgcactcctaaaacaccgatttgaaataattgaagggagaggaccttttgggacagcggtg

SEQ ID NO: 420916 - DNA, 140 bp, Artificial Sequence
  Synthetic
caccgctgtcccaaaaggtcctctcccttcaattatttcaaatcggtgttttaggagtgcatttggatcgccagattccacgattatcgactcacctcgttcatcaatgaagtggaaatccatatcagcagccagggcct

SEQ ID NO: 420917 - DNA, 140 bp, Artificial Sequence
  Synthetic
aggccctggctgctgatatgttgaaaatggtagaacattagacttgcatgatgcaaatgtcagaaacttacatgatcaggtcaaaagggtattgaaggacaatgcaattgacgaaggaaagaccttttgggacagcggtg

SEQ ID NO: 420918 - DNA, 140 bp, Artificial Sequence
  Synthetic
caccgctgtcccaaaaggtctttccttcgtcaattgcattgtccttcaatacccttttgacctgatcatgtaagtttctgacatttgcatcatgcaagtctaatgttctaccattttcaacatatcagcagccagggcct

SEQ ID NO: 420919 - DNA, 140 bp, Artificial Sequence
  Synthetic
aggccctggctgctgatatgaccgcactatggcctggacagtagtgaacagtatttgcaacaccacaggagtcgaaaaacccaagtttctcccggatttatacgattacaaagagaatcggaccttttgggacagcggtg

SEQ ID NO: 420920 - DNA, 140 bp, Artificial Sequence
  Synthetic
caccgctgtcccaaaaggtccgattctctttgtaatcgtataaatccgggagaaacttgggtttttcgactcctgtggtgttgcaaatactgttcactactgtccaggccatagtgcggtcatatcagcagccagggcct

SEQ ID NO: 420921 - DNA, 140 bp, Artificial Sequence
  Synthetic
atacgccatgctgggtctccttagaaatggcacatacaatcatgaagattacaaggaagaatcacaactgaacagacaggaaattgaggggataaaactgaagactgaagacaatgtttacgtacttgggagtcggccat

SEQ ID NO: 420922 - DNA, 140 bp, Artificial Sequence
  Synthetic
atggccgactcccaagtacgtaaacattgtcttcagtcttcagttttatcccctcaatttcctgtctgttcagttgtgattcttccttgtaatcttcatgattgtatgtgccatttctaaggagacccagcatggcgtat

SEQ ID NO: 420923 - DNA, 140 bp, Artificial Sequence
  Synthetic
atacgccatgctgggtctcctaaaatactatcgatttatagctgcattgcaagcagtactgtgctggtaggtctcatacttgcatttatattatgggcatgcagcagtggcaattgccgtcgtacttgggagtcggccat

SEQ ID NO: 420924 - DNA, 140 bp, Artificial Sequence
  Synthetic
atggccgactcccaagtacgacggcaattgccactgctgcatgcccataatataaatgcaagtatgagacctaccagcacagtactgcttgcaatgcagctataaatcgatagtattttaggagacccagcatggcgtat

SEQ ID NO: 420925 - DNA, 140 bp, Artificial Sequence
  Synthetic
atacgccatgctgggtctccatggatccaaatactgtgtcaagctttcaggtagactgcttcctttggcatgtccgcaaacgatttgcagactgtggaatttgtgatgccccatttcttgcgtacttgggagtcggccat

SEQ ID NO: 420926 - DNA, 140 bp, Artificial Sequence
  Synthetic
atggccgactcccaagtacgcaagaaatggggcatcacaaattccacagtctgcaaatcgtttgcggacatgccaaaggaagcagtctacctgaaagcttgacacagtatttggatccatggagacccagcatggcgtat

SEQ ID NO: 420927 - DNA, 140 bp, Artificial Sequence
  Synthetic
atacgccatgctgggtctccacaaaaacataatggattcaaacaccgtgtcaagctttcaggtagactgctttctttggcatgtccgcaaacgatttgcagaccaagatatgggtgatgccgtacttgggagtcggccat

SEQ ID NO: 420928 - DNA, 140 bp, Artificial Sequence
  Synthetic
atggccgactcccaagtacggcatcacccatatcttggtctgcaaatcgtttgcggacatgccaaagaaagcagtctacctgaaagcttgacacggtgtttgaatccattatgtttttgtggagacccagcatggcgtat

SEQ ID NO: 420929 - DNA, 140 bp, Artificial Sequence
  Synthetic
aggccctggctgctgatatgcagagagaatacagtttggactagcggaagcagtatatccttttgtggtgtaaatagtgacactgtgggttggtcttggccagacggtgctgagttgccagaccttttgggacagcggtg

SEQ ID NO: 420930 - DNA, 140 bp, Artificial Sequence
  Synthetic
caccgctgtcccaaaaggtctggcaactcagcaccgtctggccaagaccaacccacagtgtcactatttacaccacaaaaggatatactgcttccgctagtccaaactgtattctctctgcatatcagcagccagggcct

SEQ ID NO: 420931 - DNA, 140 bp, Artificial Sequence
  Synthetic
atacgccatgctgggtctcccccatttctagatcggcttcgccgagaccaaaaatccctgaaagggagaagcagcactcttggtatcgacattgaggcagctactcgctctgggaagcagcgtacttgggagtcggccat

SEQ ID NO: 420932 - DNA, 140 bp, Artificial Sequence
  Synthetic
atggccgactcccaagtacgctgcttcccagagcgagtagctgcctcaatgtcgataccaagagtgctgcttctccctttcagggatttttggtctcggcgaagccgatctagaaatgggggagacccagcatggcgtat

SEQ ID NO: 420933 - DNA, 140 bp, Artificial Sequence
  Synthetic
atacgccatgctgggtctcctggatggattcgaaccgaacggctgcattgagggcaagctttctcaaatgtccaaagaagtaaatgcaagaattgaaccatttctgaagacaacaccacgcgtacttgggagtcggccat

SEQ ID NO: 420934 - DNA, 140 bp, Artificial Sequence
  Synthetic
atggccgactcccaagtacgcgtggtgttgtcttcagaaatggttcaattcttgcatttacttctttggacatttgagaaagcttgccctcaatgcagccgttcggttcgaatccatccaggagacccagcatggcgtat

SEQ ID NO: 420935 - DNA, 140 bp, Artificial Sequence
  Synthetic
atacgccatgctgggtctcctccaaagaagtaaatgcaagaattgaaccatttctgaagacaacaccacgccctctgagattaccggaagggcctccttgctctcagcggtcgaaatttccgtacttgggagtcggccat

SEQ ID NO: 420936 - DNA, 140 bp, Artificial Sequence
  Synthetic
atggccgactcccaagtacggaaatttcgaccgctgagagcaaggaggcccttccggtaatctcagagggcgtggtgttgtcttcagaaatggttcaattcttgcatttacttctttggaggagacccagcatggcgtat

SEQ ID NO: 420937 - DNA, 140 bp, Artificial Sequence
  Synthetic
aggccctggctgctgatatgtgtccgcaaacgatttgcagactgtggaatttgtgatgccccatttcttgataggcttcgccgagatcaaaagtccctaaggggaagaggcaacactcttgaccttttgggacagcggtg

SEQ ID NO: 420938 - DNA, 140 bp, Artificial Sequence
  Synthetic
caccgctgtcccaaaaggtcaagagtgttgcctcttccccttagggacttttgatctcggcgaagcctatcaagaaatggggcatcacaaattccacagtctgcaaatcgtttgcggacacatatcagcagccagggcct

SEQ ID NO: 420939 - DNA, 140 bp, Artificial Sequence
  Synthetic
atacgccatgctgggtctccaaatgtcaagggattggtttatgcttatgcccaaacagaagtttgctggtcccctctgcatcaaaatggatcaggcaatcatagacaaagacatcacactcgtacttgggagtcggccat

SEQ ID NO: 420940 - DNA, 140 bp, Artificial Sequence
  Synthetic
atggccgactcccaagtacgagtgtgatgtctttgtctatgattgcctgatccattttgatgcagaggggaccagcaaacttctgtttgggcataagcataaaccaatcccttgacatttggagacccagcatggcgtat

SEQ ID NO: 420941 - DNA, 140 bp, Artificial Sequence
  Synthetic
aggccctggctgctgatatgcccctctgcatcaaaatggatcaggcaatcatagacaaagacatcacactgaaggcaaatttcagtgtaatattcaaccgattggaaactctcgtgctgcgaccttttgggacagcggtg

SEQ ID NO: 420942 - DNA, 140 bp, Artificial Sequence
  Synthetic
caccgctgtcccaaaaggtcgcagcacgagagtttccaatcggttgaatattacactgaaatttgccttcagtgtgatgtctttgtctatgattgcctgatccattttgatgcagaggggcatatcagcagccagggcct

SEQ ID NO: 420943 - DNA, 140 bp, Artificial Sequence
  Synthetic
atacgccatgctgggtctccccttctcttccaggacatactagcgaggatgtcaaaaatgcaattggagtcctcatcgggggacttgaatggaatgataacacagttcgaatctctgaaacgtacttgggagtcggccat

SEQ ID NO: 420944 - DNA, 140 bp, Artificial Sequence
  Synthetic
atggccgactcccaagtacgtttcagagattcgaactgtgttatcattccattcaagtcccccgatgaggactccaattgcatttttgacatcctcgctagtatgtcctggaagagaaggggagacccagcatggcgtat

SEQ ID NO: 420945 - DNA, 140 bp, Artificial Sequence
  Synthetic
aggccctggctgctgatatgagcaacaggaatgacactatccgtagtaagtctgctaatagggttggccaacttggggctgaacattgggcttcatttcaaagtaggagacacaccggaagaccttttgggacagcggtg

SEQ ID NO: 420946 - DNA, 140 bp, Artificial Sequence
  Synthetic
caccgctgtcccaaaaggtcttccggtgtgtctcctactttgaaatgaagcccaatgttcagccccaagttggccaaccctattagcagacttactacggatagtgtcattcctgttgctcatatcagcagccagggcct

SEQ ID NO: 420947 - DNA, 140 bp, Artificial Sequence
  Synthetic
atacgccatgctgggtctccttcgctccagagcagaaacagaaactggcgagaacaattgagtcagaagtttgaagaaatgagatggttgattgaagaagtgagacacaagttgaagacacgtacttgggagtcggccat

SEQ ID NO: 420948 - DNA, 140 bp, Artificial Sequence
  Synthetic
atggccgactcccaagtacgtgtcttcaacttgtgtctcacttcttcaatcaaccatctcatttcttcaaacttctgactcaattgttctcgccagtttctgtttctgctctggagcgaaggagacccagcatggcgtat

SEQ ID NO: 420949 - DNA, 140 bp, Artificial Sequence
  Synthetic
aggccctggctgctgatatggtgggtcatctatcaaaagggaggaggaagtgctcacaggcaatctccagacattgaaaataatggtacaggaaggatatgaggagttcacaatggttgggaccttttgggacagcggtg

SEQ ID NO: 420950 - DNA, 140 bp, Artificial Sequence
  Synthetic
caccgctgtcccaaaaggtcccaaccattgtgaactcctcatatccttcctgtaccattattttcaatgtctggagattgcctgtgagcacttcctcctcccttttgatagatgacccaccatatcagcagccagggcct

SEQ ID NO: 420951 - DNA, 140 bp, Artificial Sequence
  Synthetic
atacgccatgctgggtctccacagagagtagttttgaacagataacattcatgcaagcattacaactattgcttgaagtggagcaagagataagaactttctcgtttcagcttatttaatcgtacttgggagtcggccat

SEQ ID NO: 420952 - DNA, 140 bp, Artificial Sequence
  Synthetic
atggccgactcccaagtacgattaaataagctgaaacgagaaagttcttatctcttgctccacttcaagcaatagttgtaatgcttgcatgaatgttatctgttcaaaactactctctgtggagacccagcatggcgtat

SEQ ID NO: 420953 - DNA, 140 bp, Artificial Sequence
  Synthetic
aggccctggctgctgatatgagtaatggtttcaatggaagaacctggttggtactcctttggcttcgaaataaaagacaagaaatgtgatgtcccctgtattgggatagagatggtacatgaccttttgggacagcggtg

SEQ ID NO: 420954 - DNA, 140 bp, Artificial Sequence
  Synthetic
caccgctgtcccaaaaggtcatgtaccatctctatcccaatacaggggacatcacatttcttgtcttttatttcgaagccaaaggagtaccaaccaggttcttccattgaaaccattactcatatcagcagccagggcct

SEQ ID NO: 420955 - DNA, 140 bp, Artificial Sequence
  Synthetic
atacgccatgctgggtctcctcccaatgataagcaaatgcagaaccaaagaagggcggcgaaagacaaatctgtatgggttcataataaagggaagatctcatttgaggaatgatactgacgtacttgggagtcggccat

SEQ ID NO: 420956 - DNA, 140 bp, Artificial Sequence
  Synthetic
atggccgactcccaagtacgtcagtatcattcctcaaatgagatcttccctttattatgaacccatacagatttgtctttcgccgcccttctttggttctgcatttgcttatcattgggaggagacccagcatggcgtat

SEQ ID NO: 420957 - DNA, 140 bp, Artificial Sequence
  Synthetic
atacgccatgctgggtctccccaagcaatgctgtgtgaaccaacaataatagaaagaaacacaacagagattgtgtatttgaccaacaccaccatagagaaagaaatatgccccaaactacgtacttgggagtcggccat

SEQ ID NO: 420958 - DNA, 140 bp, Artificial Sequence
  Synthetic
atggccgactcccaagtacgtagtttggggcatatttctttctctatggtggtgttggtcaaatacacaatctctgttgtgtttctttctattattgttggttcacacagcattgcttggggagacccagcatggcgtat

SEQ ID NO: 420959 - DNA, 140 bp, Artificial Sequence
  Synthetic
atacgccatgctgggtctccggaaaacctgaataaaaagatggaggacggattcctagatgtgtggacatacaatgctgagcttctagttctaatggaaaatgaaagaacacttgacttccgtacttgggagtcggccat

SEQ ID NO: 420960 - DNA, 140 bp, Artificial Sequence
  Synthetic
atggccgactcccaagtacggaagtcaagtgttctttcattttccattagaactagaagctcagcattgtatgtccacacatctaggaatccgtcctccatctttttattcaggttttccggagacccagcatggcgtat

SEQ ID NO: 420961 - DNA, 140 bp, Artificial Sequence
  Synthetic
atacgccatgctgggtctcctcctctgtcaaagagaaagacatgaccaaagaattcttcgaaaacaaatcagagacatggcccattggggaatcacccaaaggagtagaagaaggttccacgtacttgggagtcggccat

SEQ ID NO: 420962 - DNA, 140 bp, Artificial Sequence
  Synthetic
atggccgactcccaagtacgtggaaccttcttctactcctttgggtgattccccaatgggccatgtctctgatttgttttcgaagaattctttggtcatgtctttctctttgacagaggaggagacccagcatggcgtat

SEQ ID NO: 420963 - DNA, 140 bp, Artificial Sequence
  Synthetic
aggccctggctgctgatatgagagacatggcccattggggaatcacccaaaggagtagaagaaggttccattggaaaggtatgcaggactctgctggcaaaatctgtgttcaacagcttggaccttttgggacagcggtg

SEQ ID NO: 420964 - DNA, 140 bp, Artificial Sequence
  Synthetic
caccgctgtcccaaaaggtccaagctgttgaacacagattttgccagcagagtcctgcatacctttccaatggaaccttcttctactcctttgggtgattccccaatgggccatgtctctcatatcagcagccagggcct

SEQ ID NO: 420965 - DNA, 140 bp, Artificial Sequence
  Synthetic
aggccctggctgctgatatgtatgcatctccacaacttgagggattttcagctgagtcgagaaagctgctcctcattgttcaggcacttagggacaacctggaacctggtaccttcgatcgaccttttgggacagcggtg

SEQ ID NO: 420966 - DNA, 140 bp, Artificial Sequence
  Synthetic
caccgctgtcccaaaaggtcgatcgaaggtaccaggttccaggttgtccctaagtgcctgaacaatgaggagcagctttctcgactcagctgaaaatccctcaagttgtggagatgcatacatatcagcagccagggcct

SEQ ID NO: 420967 - DNA, 140 bp, Artificial Sequence
  Synthetic
atacgccatgctgggtctcctgcggaaaaggcaatgaaggaatatggggaagatccaaaaatcgagacaaacaaatttgctgcaatatgcacacacttagaagtatgtttcatgtattcacgtacttgggagtcggccat

SEQ ID NO: 420968 - DNA, 140 bp, Artificial Sequence
  Synthetic
atggccgactcccaagtacgtgaatacatgaaacatacttctaagtgtgtgcatattgcagcaaatttgtttgtctcgatttttggatcttccccatattccttcattgccttttccgcaggagacccagcatggcgtat

SEQ ID NO: 420969 - DNA, 140 bp, Artificial Sequence
  Synthetic
aggccctggctgctgatatgacagccatggaacaggaacaggatacaccatggacacagtcaacagaacacaccaatattcggaaaacgggaaatggacgacaaacacagagactggggcgaccttttgggacagcggtg

SEQ ID NO: 420970 - DNA, 140 bp, Artificial Sequence
  Synthetic
caccgctgtcccaaaaggtcgccccagtctctgtgtttgtcgtccatttcccgttttccgaatattggtgtgttctgttgactgtgtccatggtgtatcctgttcctgttccatggctgtcatatcagcagccagggcct

SEQ ID NO: 420971 - DNA, 140 bp, Artificial Sequence
  Synthetic
aggccctggctgctgatatgtatagaaacacagacacggctgaacacctcataatatggggaattcatcacccttctagcactcaagagaagaatgacctatatgggacacaatcactgtgaccttttgggacagcggtg

SEQ ID NO: 420972 - DNA, 140 bp, Artificial Sequence
  Synthetic
caccgctgtcccaaaaggtcacagtgattgtgtcccatataggtcattcttctcttgagtgctagaagggtgatgaattccccatattatgaggtgttcagccgtgtctgtgtttctatacatatcagcagccagggcct

SEQ ID NO: 420973 - DNA, 140 bp, Artificial Sequence
  Synthetic
atacgccatgctgggtctccagatggttgattgaagaagtacgacatagattaaaaattacggagaatagctttgagcaaataacttttatgcaagccttacaactattgcttgaagtggcgtacttgggagtcggccat

SEQ ID NO: 420974 - DNA, 140 bp, Artificial Sequence
  Synthetic
atggccgactcccaagtacgccacttcaagcaatagttgtaaggcttgcataaaagttatttgctcaaagctattctccgtaatttttaatctatgtcgtacttcttcaatcaaccatctggagacccagcatggcgtat

SEQ ID NO: 420975 - DNA, 140 bp, Artificial Sequence
  Synthetic
aggccctggctgctgatatgatggaaagaataaaagaactaagagacctaatgtcgcagtcccgcactcgcgagatactgacaaaaaccacagtggaccatatggcaataatcaaaaaatgaccttttgggacagcggtg

SEQ ID NO: 420976 - DNA, 140 bp, Artificial Sequence
  Synthetic
caccgctgtcccaaaaggtcattttttgattattgccatatggtccactgtggtttttgtcagtatctcgcgagtgcgggactgcgacattaggtctcttagttcttttattctttccatcatatcagcagccagggcct

SEQ ID NO: 420977 - DNA, 140 bp, Artificial Sequence
  Synthetic
aggccctggctgctgatatgttggacaaaagaaatacaccaggacaacatactggtgggacggactccaatcctccgacgattttgccctcatagtaaacgcaccaaatcatgagggaatgaccttttgggacagcggtg

SEQ ID NO: 420978 - DNA, 140 bp, Artificial Sequence
  Synthetic
caccgctgtcccaaaaggtcattccctcatgatttggtgcgtttactatgagggcaaaatcgtcggaggattggagtccgtcccaccagtatgttgtcctggtgtatttcttttgtccaacatatcagcagccagggcct

SEQ ID NO: 420979 - DNA, 140 bp, Artificial Sequence
  Synthetic
aggccctggctgctgatatgagataacaacacactttcaaagaaaaaggagagtaagagacaacatgaccaagaagatggtcacacaaagaacaatagggaagaaaaaacaaagaatgaagaccttttgggacagcggtg

SEQ ID NO: 420980 - DNA, 140 bp, Artificial Sequence
  Synthetic
caccgctgtcccaaaaggtcttcattctttgttttttcttccctattgttctttgtgtgaccatcttcttggtcatgttgtctcttactctcctttttctttgaaagtgtgttgttatctcatatcagcagccagggcct

SEQ ID NO: 420981 - DNA, 140 bp, Artificial Sequence
  Synthetic
atacgccatgctgggtctcccaaggatgtgatggaatcaatggataaagaggaaatggaaataacaacgcatttccaaaggaaaagaagagtgagggacaacatgaccaagaaaatggtccgtacttgggagtcggccat

SEQ ID NO: 420982 - DNA, 140 bp, Artificial Sequence
  Synthetic
atggccgactcccaagtacggaccattttcttggtcatgttgtccctcactcttcttttcctttggaaatgcgttgttatttccatttcctctttatccattgattccatcacatccttgggagacccagcatggcgtat

SEQ ID NO: 420983 - DNA, 140 bp, Artificial Sequence
  Synthetic
atacgccatgctgggtctccgagggaataccgctgtatgatgcgatcaaatgcatgaagaccttttttggctggaaagagcctaacattgtcaagccacatgaaaagggcataaaccctacgtacttgggagtcggccat

SEQ ID NO: 420984 - DNA, 140 bp, Artificial Sequence
  Synthetic
atggccgactcccaagtacgtagggtttatgcccttttcatgtggcttgacaatgttaggctctttccagccaaaaaaggtcttcatgcatttgatcgcatcatacagcggtattccctcggagacccagcatggcgtat

SEQ ID NO: 420985 - DNA, 140 bp, Artificial Sequence
  Synthetic
atacgccatgctgggtctccacacaaagaacaataggaaagaagaagcagaggctaaacaaaaggagctatctaataagagcattgacactgaacacaatgacaaaagacgccgaaagagcgtacttgggagtcggccat

SEQ ID NO: 420986 - DNA, 140 bp, Artificial Sequence
  Synthetic
atggccgactcccaagtacgctctttcggcgtcttttgtcattgtgttcagtgtcaatgctcttattagatagctccttttgtttagcctctgcttcttctttcctattgttctttgtgtggagacccagcatggcgtat

SEQ ID NO: 420987 - DNA, 140 bp, Artificial Sequence
  Synthetic
aggccctggctgctgatatgacaatctggactcccagttggaggcaatgaaaagaaggctaaactggcaaatgttgtgagaaaaatgatgactaattcacaagacacagaactctctttcgaccttttgggacagcggtg

SEQ ID NO: 420988 - DNA, 140 bp, Artificial Sequence
  Synthetic
caccgctgtcccaaaaggtcgaaagagagttctgtgtcttgtgaattagtcatcatttttctcacaacatttgccagtttagccttcttttcattgcctccaactgggagtccagattgtcatatcagcagccagggcct

SEQ ID NO: 420989 - DNA, 140 bp, Artificial Sequence
  Synthetic
atacgccatgctgggtctccccgagtggttcagaaacatactgagcatggcaccaataatgttctcaaacaaaatggcaagactaggaaaagggtacatgttcgagagtaaaaaaatgaacgtacttgggagtcggccat

SEQ ID NO: 420990 - DNA, 140 bp, Artificial Sequence
  Synthetic
atggccgactcccaagtacgttcatttttttactctcgaacatgtacccttttcctagtcttgccattttgtttgagaacattattggtgccatgctcagtatgtttctgaaccactcggggagacccagcatggcgtat

SEQ ID NO: 420991 - DNA, 140 bp, Artificial Sequence
  Synthetic
aggccctggctgctgatatgacaatcactggagacaacaccaaatggaatgaaaatcagaaccctaggatgtttctggcaatgataacatatataacaagaaaccaacctgaatggtttagaccttttgggacagcggtg

SEQ ID NO: 420992 - DNA, 140 bp, Artificial Sequence
  Synthetic
caccgctgtcccaaaaggtctaaaccattcaggttggtttcttgttatatatgttatcattgccagaaacatcctagggttctgattttcattccatttggtgttgtctccagtgattgtcatatcagcagccagggcct

SEQ ID NO: 420993 - DNA, 140 bp, Artificial Sequence
  Synthetic
atacgccatgctgggtctccggagcaagacctcaggtcaatggacaaagcggcagaattgattttcactggacgctagtacggccaggtgataatatcaccttctcacacaatgggggtccgtacttgggagtcggccat

SEQ ID NO: 420994 - DNA, 140 bp, Artificial Sequence
  Synthetic
atggccgactcccaagtacggacccccattgtgtgagaaggtgatattatcacctggccgtactagcgtccagtgaaaatcaattctgccgctttgtccattgacctgaggtcttgctccggagacccagcatggcgtat

SEQ ID NO: 420995 - DNA, 140 bp, Artificial Sequence
  Synthetic
aggccctggctgctgatatgatcaaatgagaatccagcacataaaagtcaattggtgtggatggcatgtcattctgcagcatttgaagatctgagagtctcaagtttcatcagagggacagaccttttgggacagcggtg

SEQ ID NO: 420996 - DNA, 140 bp, Artificial Sequence
  Synthetic
caccgctgtcccaaaaggtctgtccctctgatgaaacttgagactctcagatcttcaaatgctgcagaatgacatgccatccacaccaattgacttttatgtgctggattctcatttgatcatatcagcagccagggcct

SEQ ID NO: 420997 - DNA, 140 bp, Artificial Sequence
  Synthetic
aggccctggctgctgatatgaatacaccaggacaacatactggtgggatggactccaatcctccgacgattttgccctcatagtaaatgcaccaaatcatgagggaatacaggcaggagtgaccttttgggacagcggtg

SEQ ID NO: 420998 - DNA, 140 bp, Artificial Sequence
  Synthetic
caccgctgtcccaaaaggtcactcctgcctgtattccctcatgatttggtgcatttactatgagggcaaaatcgtcggaggattggagtccatcccaccagtatgttgtcctggtgtattcatatcagcagccagggcct

SEQ ID NO: 420999 - DNA, 140 bp, Artificial Sequence
  Synthetic
atacgccatgctgggtctccaaagaagtgaatgcccaaattgaaccattcttgaagaccacaccacggcttctcagattacctgatggacctccttgctttcagagatcaaagttcttgccgtacttgggagtcggccat

SEQ ID NO: 421000 - DNA, 140 bp, Artificial Sequence
  Synthetic
atggccgactcccaagtacggcaagaactttgatctctgaaagcaaggaggtccatcaggtaatctgagaagccgtggtgtggtcttcaagaatggttcaatttgggcattcacttctttggagacccagcatggcgtat

SEQ ID NO: 421001 - DNA, 140 bp, Artificial Sequence
  Synthetic
aggccctggctgctgatatgcaacatactggtgggacggactccaatcctctgatgactttgctctcatagtgaatgctccgaatcatgaggggatacaagcaggagtagacagattctagaccttttgggacagcggtg

SEQ ID NO: 421002 - DNA, 140 bp, Artificial Sequence
  Synthetic
caccgctgtcccaaaaggtctagaatctgtctactcctgcttgtatcccctcatgattcggagcattcactatgagagcaaagtcatcagaggattggagtccgtcccaccagtatgttgcatatcagcagccagggcct

SEQ ID NO: 421003 - DNA, 140 bp, Artificial Sequence
  Synthetic
aggccctggctgctgatatgtagaacctgcaagctggtcggaatcaacatgagcaaaaagaagtcctacataaacaggacaggaacatttgaattcacaagttttttctatcgctatggagaccttttgggacagcggtg

SEQ ID NO: 421004 - DNA, 140 bp, Artificial Sequence
  Synthetic
caccgctgtcccaaaaggtctccatagcgatagaaaaaacttgtgaattcaaatgttcctgtcctgtttatgtaggacttctttttgctcatgttgattccgaccagcttgcaggttctacatatcagcagccagggcct

SEQ ID NO: 421005 - DNA, 140 bp, Artificial Sequence
  Synthetic
atacgccatgctgggtctccatggatgtcaatccgactctacttttcctaaaagttccagcgcaaaatgccataagcaccacattcccttatactggagatcctccatacagccatggaacgtacttgggagtcggccat

SEQ ID NO: 421006 - DNA, 140 bp, Artificial Sequence
  Synthetic
atggccgactcccaagtacgttccatggctgtatggaggatctccagtataagggaatgtggtgcttatggcattttgcgctggaacttttaggaaaagtagagtcggattgacatccatggagacccagcatggcgtat

SEQ ID NO: 421007 - DNA, 140 bp, Artificial Sequence
  Synthetic
aggccctggctgctgatatgtaatgaatctgcagacatgagcattggagtaacagtgataaagaacaacatgataaacaatgatcttggaccagcaacagctcaaatggctcttcagctggaccttttgggacagcggtg

SEQ ID NO: 421008 - DNA, 140 bp, Artificial Sequence
  Synthetic
caccgctgtcccaaaaggtccagctgaagagccatttgagctgttgctggtccaagatcattgtttatcatgttgttctttatcactgttactccaatgctcatgtctgcagattcattacatatcagcagccagggcct

SEQ ID NO: 421009 - DNA, 140 bp, Artificial Sequence
  Synthetic
aggccctggctgctgatatgagatctctagcaagctgggttcaaaatgaattcaacaaagcatgtgaattgacagactcaagctggatagaacttgacgaggtaggagaagatgttgcccgaccttttgggacagcggtg

SEQ ID NO: 421010 - DNA, 140 bp, Artificial Sequence
  Synthetic
caccgctgtcccaaaaggtcgggcaacatcttctcctacctcgtcaagttctatccagcttgagtctgtcaattcacatgctttgttgaattcattttgaacccagcttgctagagatctcatatcagcagccagggcct

SEQ ID NO: 421011 - DNA, 140 bp, Artificial Sequence
  Synthetic
aggccctggctgctgatatggctcaaaagcaggactgctggtctcagatggaggaccaaacctatataatatccggaatctccacattccggaagtttgcttgaaatgggaactgatggagaccttttgggacagcggtg

SEQ ID NO: 421012 - DNA, 140 bp, Artificial Sequence
  Synthetic
caccgctgtcccaaaaggtctccatcagttcccatttcaagcaaacttccggaatgtggagattccggatattatataggtttggtcctccatctgagaccagcagtcctgcttttgagccatatcagcagccagggcct

SEQ ID NO: 421013 - DNA, 140 bp, Artificial Sequence
  Synthetic
aggccctggctgctgatatgtcctgaaagaaatgaacaagggcaaacactttggagtaagacaaatgatgctggatcagatagggtgatggtatcacccctagcagtaacttggtggaatgaccttttgggacagcggtg

SEQ ID NO: 421014 - DNA, 140 bp, Artificial Sequence
  Synthetic
caccgctgtcccaaaaggtcattccaccaagttactgctaggggtgataccatcaccctatctgatccagcatcatttgtcttactccaaagtgtttgcccttgttcatttctttcaggacatatcagcagccagggcct

SEQ ID NO: 421015 - DNA, 140 bp, Artificial Sequence
  Synthetic
atacgccatgctgggtctccatgaatccaaatcagaagataataatcattagttcgatctgtatgacaaatggaattgctagcttgatattacaaattgggaacataatctcaatatggacgtacttgggagtcggccat

SEQ ID NO: 421016 - DNA, 140 bp, Artificial Sequence
  Synthetic
atggccgactcccaagtacgtccatattgagattatgttcccaatttgtaatatcaagctagcaattccatttgtcatacagatcgaactaatgattattatcttctgatttggattcatggagacccagcatggcgtat

SEQ ID NO: 421017 - DNA, 140 bp, Artificial Sequence
  Synthetic
aggccctggctgctgatatgtaggaatggaccaacaacaagtacaattcactacccaaaggtatataaaacttatttcgaaaaagttgaaaggttgaaacacgggacctttggccctgtagaccttttgggacagcggtg

SEQ ID NO: 421018 - DNA, 140 bp, Artificial Sequence
  Synthetic
caccgctgtcccaaaaggtctacagggccaaaggtcccgtgtttcaacctttcaactttttcgaaataagttttatatacctttgggtagtgaattgtacttgttgttggtccattcctacatatcagcagccagggcct

SEQ ID NO: 421019 - DNA, 140 bp, Artificial Sequence
  Synthetic
atacgccatgctgggtctccagatggctaattgaagaagtgcgacacagattaaaattaacagaaaatagcttcgagcagataacattcatgcaagcattacaactactgcttgaagtagcgtacttgggagtcggccat

SEQ ID NO: 421020 - DNA, 140 bp, Artificial Sequence
  Synthetic
atggccgactcccaagtacgctacttcaagcagtagttgtaatgcttgcatgaatgttatctgctcgaagctattttctgttaattttaatctgtgtcgcacttcttcaattagccatctggagacccagcatggcgtat

SEQ ID NO: 421021 - DNA, 140 bp, Artificial Sequence
  Synthetic
atacgccatgctgggtctccatggcgtctcaaggcaccaaacgatcatatgaacaaatggaaactggtggggaacgccaggatgccacagaaatcagagcatctgtcgggaaaatgattgcgtacttgggagtcggccat

SEQ ID NO: 421022 - DNA, 140 bp, Artificial Sequence
  Synthetic
atggccgactcccaagtacgcaatcattttcccgacagatgctctgatttctgtggcatcctggcgttccccaccagtttccatttgttcatatgatcgtttggtgccttgagacgccatggagacccagcatggcgtat

SEQ ID NO: 421023 - DNA, 140 bp, Artificial Sequence
  Synthetic
atacgccatgctgggtctcccccaattgatggaccactacctgaagataatgaaccaagtggatatgcacaaacagactgtgtcctggaggccatggctttccttgaagaatcccacccacgtacttgggagtcggccat

SEQ ID NO: 421024 - DNA, 140 bp, Artificial Sequence
  Synthetic
atggccgactcccaagtacgtgggtgggattcttcaaggaaagccatggcctccaggacacagtctgtttgtgcatatccacttggttcattatcttcaggtagtggtccatcaattgggggagacccagcatggcgtat

SEQ ID NO: 421025 - DNA, 140 bp, Artificial Sequence
  Synthetic
atacgccatgctgggtctcctctgatggttgcatacatgctagaaagagagttggtccgcaagacgaggtttctcccagtggctggtggaacaagcagtgcctacattgaggtgctgcatcgtacttgggagtcggccat

SEQ ID NO: 421026 - DNA, 140 bp, Artificial Sequence
  Synthetic
atggccgactcccaagtacgatgcagcacctcaatgtaggcactgcttgttccaccagccactgggagaaacctcgtcttgcggaccaactctctttctagcatgtatgcaaccatcagaggagacccagcatggcgtat

SEQ ID NO: 421027 - DNA, 140 bp, Artificial Sequence
  Synthetic
atacgccatgctgggtctccgaagagaaaatcccaaagacaaagaacatgaagaaaacaagtcaattgaagtgggcactcggtgaaaatatggcaccggaaaaagtggactttgaggattcgtacttgggagtcggccat

SEQ ID NO: 421028 - DNA, 140 bp, Artificial Sequence
  Synthetic
atggccgactcccaagtacgaatcctcaaagtccactttttccggtgccatattttcaccgagtgcccacttcaattgacttgttttcttcatgttctttgtctttgggattttctcttcggagacccagcatggcgtat

SEQ ID NO: 421029 - DNA, 140 bp, Artificial Sequence
  Synthetic
atacgccatgctgggtctcctgaggattagctcatctttcagctttggtggattcacttttaaaagaacaagtggatcgtcagtcaaaagagaagaagaagtgcttacgggcaaccttcacgtacttgggagtcggccat

SEQ ID NO: 421030 - DNA, 140 bp, Artificial Sequence
  Synthetic
atggccgactcccaagtacgtgaaggttgcccgtaagcacttcttcttctcttttgactgacgatccacttgttcttttaaaagtgaatccaccaaagctgaaagatgagctaatcctcaggagacccagcatggcgtat

SEQ ID NO: 421031 - DNA, 140 bp, Artificial Sequence
  Synthetic
aggccctggctgctgatatgctaatagtaagtggaagggacgagcaatcaattgccgaagcaataattgtggccatggtattctcacaagaggactgcatgattaaggcagttcgaggtggaccttttgggacagcggtg

SEQ ID NO: 421032 - DNA, 140 bp, Artificial Sequence
  Synthetic
caccgctgtcccaaaaggtccacctcgaactgccttaatcatgcagtcctcttgtgagaataccatggccacaattattgcttcggcaattgattgctcgtcccttccacttactattagcatatcagcagccagggcct

SEQ ID NO: 421033 - DNA, 140 bp, Artificial Sequence
  Synthetic
atacgccatgctgggtctcccgaagactatcagggaaggctttgtaaccccctgaatccgtttgtcagccacaaagagatagagtctgtaaacaatgctgtggtgatgccagctcatggccgtacttgggagtcggccat

SEQ ID NO: 421034 - DNA, 140 bp, Artificial Sequence
  Synthetic
atggccgactcccaagtacggccatgagctggcatcaccacagcattgtttacagactctatctctttgtggctgacaaacggattcagggggttacaaagccttccctgatagtcttcgggagacccagcatggcgtat

SEQ ID NO: 421035 - DNA, 140 bp, Artificial Sequence
  Synthetic
aggccctggctgctgatatgtccgattgatgggccattgcctgaagacaatgagccgagtgggtatgcacaaacggattgtgtattggaagcaatggctttccttgaagaatctcaccccgaccttttgggacagcggtg

SEQ ID NO: 421036 - DNA, 140 bp, Artificial Sequence
  Synthetic
caccgctgtcccaaaaggtcggggtgagattcttcaaggaaagccattgcttccaatacacaatccgtttgtgcatacccactcggctcattgtcttcaggcaatggcccatcaatcggacatatcagcagccagggcct

SEQ ID NO: 421037 - DNA, 140 bp, Artificial Sequence
  Synthetic
aggccctggctgctgatatgaaatgagaatgtggaaaccatggattccaatactttagagctgagaagcagatactgggccataaggaccagaagtggaggaaataccaatcaacaaaaagaccttttgggacagcggtg

SEQ ID NO: 421038 - DNA, 140 bp, Artificial Sequence
  Synthetic
caccgctgtcccaaaaggtctttttgttgattggtatttcctccacttctggtccttatggcccagtatctgcttctcagctctaaagtattggaatccatggtttccacattctcatttcatatcagcagccagggcct

SEQ ID NO: 421039 - DNA, 140 bp, Artificial Sequence
  Synthetic
aggccctggctgctgatatggatactgggccataaggaccagaagtggaggaaataccaatcaacaaaaagcatccgctggccagatcagtgtgcaacctacattctcagtgcaacggaagaccttttgggacagcggtg

SEQ ID NO: 421040 - DNA, 140 bp, Artificial Sequence
  Synthetic
caccgctgtcccaaaaggtcttccgttgcactgagaatgtaggttgcacactgatctggccagcggatgctttttgttgattggtatttcctccacttctggtccttatggcccagtatccatatcagcagccagggcct

SEQ ID NO: 421041 - DNA, 140 bp, Artificial Sequence
  Synthetic
aggccctggctgctgatatggttcaacacttcccagaaggtctggggccgcaggtgctgcagtaaaaggagttggaacaatagcaatggaactaatcagaatgatcaaacgtgggatcaagaccttttgggacagcggtg

SEQ ID NO: 421042 - DNA, 140 bp, Artificial Sequence
  Synthetic
caccgctgtcccaaaaggtcttgatcccacgtttgatcattctgattagttccattgctattgttccaactccttttactgcagcacctgcggccccagaccttctgggaagtgttgaaccatatcagcagccagggcct

SEQ ID NO: 421043 - DNA, 140 bp, Artificial Sequence
  Synthetic
atacgccatgctgggtctccatcccacaatgttgtataacaaaatggagttcgagccgttccagtctctggtccctaaggcagccagaggtcaatacagtgggttcgtaaggacattattcgtacttgggagtcggccat

SEQ ID NO: 421044 - DNA, 140 bp, Artificial Sequence
  Synthetic
atggccgactcccaagtacgaataatgtccttacgaacccactgtattgacctctggctgccttagggaccagagactggaacggctcgaactccattttgttatacaacattgtgggatggagacccagcatggcgtat

SEQ ID NO: 421045 - DNA, 140 bp, Artificial Sequence
  Synthetic
aggccctggctgctgatatggccggctcagaccgagtgatggtatcacctctggctgtgacatggtggaataggaatggaccaacaactagtaccgttcattatccaaaggtatataaaagaccttttgggacagcggtg

SEQ ID NO: 421046 - DNA, 140 bp, Artificial Sequence
  Synthetic
caccgctgtcccaaaaggtcttttatatacctttggataatgaacggtactagttgttggtccattcctattccaccatgtcacagccagaggtgataccatcactcggtctgagccggccatatcagcagccagggcct

SEQ ID NO: 421047 - DNA, 140 bp, Artificial Sequence
  Synthetic
aggccctggctgctgatatgaactcctcccctttgctgctgccccaccggaacaaagtaggatgcagttctcctccctgactgtgaatgtgagaggatcaggaatgagaatactggtaaggaccttttgggacagcggtg

SEQ ID NO: 421048 - DNA, 140 bp, Artificial Sequence
  Synthetic
caccgctgtcccaaaaggtccttaccagtattctcattcctgatcctctcacattcacagtcagggaggagaactgcatcctactttgttccggtggggcagcagcaaaggggaggagttcatatcagcagccagggcct

SEQ ID NO: 421049 - DNA, 140 bp, Artificial Sequence
  Synthetic
atacgccatgctgggtctcccgtatttcgaaaaagtcgaaaggttaaaacacgggacctttggccctgttcatttcagaaatcaagttaaaataagacggagggttgatataaaccctggcgtacttgggagtcggccat

SEQ ID NO: 421050 - DNA, 140 bp, Artificial Sequence
  Synthetic
atggccgactcccaagtacgccagggtttatatcaaccctccgtcttattttaacttgatttctgaaatgaacagggccaaaggtcccgtgttttaacctttcgactttttcgaaatacgggagacccagcatggcgtat

SEQ ID NO: 421051 - DNA, 140 bp, Artificial Sequence
  Synthetic
aggccctggctgctgatatgtgagaggagtgagaattagtaaaatgggagtggatgaatattccagcactgaaagagtagttgtaagcattgaccgctttttaagggttcgagatcagcggaccttttgggacagcggtg

SEQ ID NO: 421052 - DNA, 140 bp, Artificial Sequence
  Synthetic
caccgctgtcccaaaaggtccgctgatctcgaacccttaaaaagcggtcaatgcttacaactactctttcagtgctggaatattcatccactcccattttactaattctcactcctctcacatatcagcagccagggcct

SEQ ID NO: 421053 - DNA, 140 bp, Artificial Sequence
  Synthetic
atacgccatgctgggtctccttttcccaaatgaagtgggagcgagaatactaacatcggagtcacaactgatgataacaaaagaaaagaaggaagaactccaggactgcaagattgcccccgtacttgggagtcggccat

SEQ ID NO: 421054 - DNA, 140 bp, Artificial Sequence
  Synthetic
atggccgactcccaagtacgggggcaatcttgcagtcctggagttcttccttcttttcttttgttatcatcagttgtgactccgatgttagtattctcgctcccacttcatttgggaaaaggagacccagcatggcgtat

SEQ ID NO: 421055 - DNA, 140 bp, Artificial Sequence
  Synthetic
aggccctggctgctgatatggtgagatcgaacatcagatcggtaacgtcatcaattggactaaggattcaataactgacatctggacttaccaggccgagctattggtagcaatggagaagaccttttgggacagcggtg

SEQ ID NO: 421056 - DNA, 140 bp, Artificial Sequence
  Synthetic
caccgctgtcccaaaaggtcttctccattgctaccaatagctcggcctggtaagtccagatgtcagttattgaatccttagtccaattgatgacgttaccgatctgatgttcgatctcaccatatcagcagccagggcct

SEQ ID NO: 421057 - DNA, 140 bp, Artificial Sequence
  Synthetic
atacgccatgctgggtctcctcctcccagtagctggtggaacaagcagtgtttacattgaggtgctacatctgacccagggaacatgctgggaacaaatgtacacaccaggaggggaagtcgtacttgggagtcggccat

SEQ ID NO: 421058 - DNA, 140 bp, Artificial Sequence
  Synthetic
atggccgactcccaagtacgacttcccctcctggtgtgtacatttgttcccagcatgttccctgggtcagatgtagcacctcaatgtaaacactgcttgttccaccagctactgggaggaggagacccagcatggcgtat

SEQ ID NO: 421059 - DNA, 140 bp, Artificial Sequence
  Synthetic
aggccctggctgctgatatgatgtcaaaggatgattttgagaaagcaatggctcaccttggtgagattgggtacatataagcttcgaagatgtttatggggttattggtcatcattgaatgaccttttgggacagcggtg

SEQ ID NO: 421060 - DNA, 140 bp, Artificial Sequence
  Synthetic
caccgctgtcccaaaaggtcattcaatgatgaccaataaccccataaacatcttcgaagcttatatgtacccaatctcaccaaggtgagccattgctttctcaaaatcatcctttgacatcatatcagcagccagggcct

SEQ ID NO: 421061 - DNA, 140 bp, Artificial Sequence
  Synthetic
aggccctggctgctgatatgtgttcacgctcaccgtgcccagtgagcgaggactgcagcgtagacgctttgtccaaaatgcccttaatgggaatggggatccaaacaacatggacagagcgaccttttgggacagcggtg

SEQ ID NO: 421062 - DNA, 140 bp, Artificial Sequence
  Synthetic
caccgctgtcccaaaaggtcgctctgtccatgttgtttggatccccattcccattaagggcattttggacaaagcgtctacgctgcagtcctcgctcactgggcacggtgagcgtgaacacatatcagcagccagggcct

SEQ ID NO: 421063 - DNA, 140 bp, Artificial Sequence
  Synthetic
atacgccatgctgggtctccaagaggtggcactcagttattcaactggtgcacttgccagctgcatgggcctcatatacaacaggatggggactgtgaccactgaagtggcatttggcctcgtacttgggagtcggccat

SEQ ID NO: 421064 - DNA, 140 bp, Artificial Sequence
  Synthetic
atggccgactcccaagtacgaggccaaatgccacttcagtggtcacagtccccatcctgttgtatatgaggcccatgcagctggcaagtgcaccagttgaataactgagtgccacctcttggagacccagcatggcgtat

SEQ ID NO: 421065 - DNA, 140 bp, Artificial Sequence
  Synthetic
aggccctggctgctgatatgaacattaaaaatacgagtacacgaggggtatgaagagttcacaatggttgggaggagagcaacagccattctcaggaaggcaaccagaagattgatccaggaccttttgggacagcggtg

SEQ ID NO: 421066 - DNA, 140 bp, Artificial Sequence
  Synthetic
caccgctgtcccaaaaggtcctggatcaatcttctggttgccttcctgagaatggctgttgctctcctcccaaccattgtgaactcttcatacccctcgtgtactcgtatttttaatgttcatatcagcagccagggcct

SEQ ID NO: 421067 - DNA, 140 bp, Artificial Sequence
  Synthetic
aggccctggctgctgatatgatgaatccaaatcagaagataataaccattggttcgatctgtatgacaattggaatagccagcttgatattacaaattggaaacataatatcaatatggagaccttttgggacagcggtg

SEQ ID NO: 421068 - DNA, 140 bp, Artificial Sequence
  Synthetic
caccgctgtcccaaaaggtctccatattgatattatgtttccaatttgtaatatcaagctggctattccaattgtcatacagatcgaaccaatggttattatcttctgatttggattcatcatatcagcagccagggcct

SEQ ID NO: 421069 - DNA, 140 bp, Artificial Sequence
  Synthetic
aggccctggctgctgatatgagatggctgattgaagaagtgcgacatagattgaagattacagagaacagcttcgaacagataacgtttatgcaagccttacaactattgcttgaagtaggaccttttgggacagcggtg

SEQ ID NO: 421070 - DNA, 140 bp, Artificial Sequence
  Synthetic
caccgctgtcccaaaaggtcctacttcaagcaatagttgtaaggcttgcataaacgttatctgttcgaagctgttctctgtaatcttcaatctatgtcgcacttcttcaatcagccatctcatatcagcagccagggcct

SEQ ID NO: 421071 - DNA, 140 bp, Artificial Sequence
  Synthetic
aggccctggctgctgatatgatttgaactttgtcaacagagcaaaccagcggctaaacccaatgcaccaactcttgagacacttccaaaaggatgcaaaagtgcttttccaaaactgggggaccttttgggacagcggtg

SEQ ID NO: 421072 - DNA, 140 bp, Artificial Sequence
  Synthetic
caccgctgtcccaaaaggtcccccagttttggaaaagcacttttgcatccttttggaagtgtctcaagagttggtgcattgggtttagccgctggtttgctctgttgacaaagttcaaatcatatcagcagccagggcct

SEQ ID NO: 421073 - DNA, 140 bp, Artificial Sequence
  Synthetic
atacgccatgctgggtctccagcgaaagcaggagtttaaaatgaatccaaatcagaaaataataaccattgggtcagtgtccttaggattggtagtcatcaatattatcctacatatagtcgtacttgggagtcggccat

SEQ ID NO: 421074 - DNA, 140 bp, Artificial Sequence
  Synthetic
atggccgactcccaagtacgactatatgtaggataatattgatgactaccaatcctaaggacactgacccaatggttattattttctgatttggattcattttaaactcctgctttcgctggagacccagcatggcgtat

SEQ ID NO: 421075 - DNA, 140 bp, Artificial Sequence
  Synthetic
atacgccatgctgggtctcctagtattacagtaacattgttagttctccctgggaatggaaataatgggagctgcaatgaaacaatcattagggaatacaatgaaacagtacggattgagcgtacttgggagtcggccat

SEQ ID NO: 421076 - DNA, 140 bp, Artificial Sequence
  Synthetic
atggccgactcccaagtacgctcaatccgtactgtttcattgtattccctaatgattgtttcattgcagctcccattatttccattcccagggagaactaacaatgttactgtaatactaggagacccagcatggcgtat

SEQ ID NO: 421077 - DNA, 140 bp, Artificial Sequence
  Synthetic
atacgccatgctgggtctccattcttgaggatgaacagatgtaccagaagtgctgcaacttgttcgagaaatttttccctagtagttcatataggagaccgattggaatttctagcatggcgtacttgggagtcggccat

SEQ ID NO: 421078 - DNA, 140 bp, Artificial Sequence
  Synthetic
atggccgactcccaagtacgccatgctagaaattccaatcggtctcctatatgaactactagggaaaaatttctcgaacaagttgcagcacttctggtacatctgttcatcctcaagaatggagacccagcatggcgtat

SEQ ID NO: 421079 - DNA, 140 bp, Artificial Sequence
  Synthetic
atacgccatgctgggtctccttagccattcaattcaaattgggaaccaaaaccagaccgaaacatgcaatcaaagcgttattatttacgaaaacaacacctgggtaaatcagacatatgtcgtacttgggagtcggccat

SEQ ID NO: 421080 - DNA, 140 bp, Artificial Sequence
  Synthetic
atggccgactcccaagtacgacatatgtctgatttacccaggtgttgttttcgtaaataataacgctttgattgcatgtttcggtctggttttggttcccaatttgaattgaatggctaaggagacccagcatggcgtat

SEQ ID NO: 421081 - DNA, 140 bp, Artificial Sequence
  Synthetic
aggccctggctgctgatatgtcaatgatgtgggagatcaacggtcctgaatctgttttggtcaatacttatcagtggatcatcaggaattgggagactgtgaaaattcaatggtcacagggaccttttgggacagcggtg

SEQ ID NO: 421082 - DNA, 140 bp, Artificial Sequence
  Synthetic
caccgctgtcccaaaaggtccctgtgaccattgaattttcacagtctcccaattcctgatgatccactgataagtattgaccaaaacagattcaggaccgttgatctcccacatcattgacatatcagcagccagggcct

SEQ ID NO: 421083 - DNA, 140 bp, Artificial Sequence
  Synthetic
aggccctggctgctgatatggccacagcacacaaattgggggaataaggatggtggacatccttaggcagaatccaacggaggaacaagctgtggacatatgcaaggcagcaatgggactgaccttttgggacagcggtg

SEQ ID NO: 421084 - DNA, 140 bp, Artificial Sequence
  Synthetic
caccgctgtcccaaaaggtcagtcccattgctgccttgcatatgtccacagcttgttcctccgttggattctgcctaaggatgtccaccatccttattcccccaatttgtgtgctgtggccatatcagcagccagggcct

SEQ ID NO: 421085 - DNA, 140 bp, Artificial Sequence
  Synthetic
aggccctggctgctgatatgccagcagatgcgggatgtgcttggaactttcgacactgttcagataataaaacttctcccctttgctgctgctccaccagaacaaagtaggatgcagttcgaccttttgggacagcggtg

SEQ ID NO: 421086 - DNA, 140 bp, Artificial Sequence
  Synthetic
caccgctgtcccaaaaggtcgaactgcatcctactttgttctggtggagcagcagcaaaggggagaagttttattatctgaacagtgtcgaaagttccaagcacatcccgcatctgctggcatatcagcagccagggcct

SEQ ID NO: 421087 - DNA, 140 bp, Artificial Sequence
  Synthetic
atacgccatgctgggtctccaatctagtgaaatcatatgtgtgtgtagagataattggcatggctcaaatcggccgtgggtgtcatttaatcagaatctggaatatcaaataggatacatcgtacttgggagtcggccat

SEQ ID NO: 421088 - DNA, 140 bp, Artificial Sequence
  Synthetic
atggccgactcccaagtacgatgtatcctatttgatattccagattctgattaaatgacacccacggccgatttgagccatgccaattatctctacacacacatatgatttcactagattggagacccagcatggcgtat

SEQ ID NO: 421089 - DNA, 140 bp, Artificial Sequence
  Synthetic
aggccctggctgctgatatggttgtggtccagtatttcctaatggggcaaatggggtaaaaggattttcatttaaatacggcaatggtgtttggatagggagaactaaaagcactagttcgaccttttgggacagcggtg

SEQ ID NO: 421090 - DNA, 140 bp, Artificial Sequence
  Synthetic
caccgctgtcccaaaaggtcgaactagtgcttttagttctccctatccaaacaccattgccgtatttaaatgaaaatccttttaccccatttgccccattaggaaatactggaccacaaccatatcagcagccagggcct

SEQ ID NO: 421091 - DNA, 140 bp, Artificial Sequence
  Synthetic
aggccctggctgctgatatgccagccaatggcctgtgctatccgggaaagttcaactattatgaagaactgaagcatttcatgagcagcacaaaccatttagagaaaattcagatatttcgaccttttgggacagcggtg

SEQ ID NO: 421092 - DNA, 140 bp, Artificial Sequence
  Synthetic
caccgctgtcccaaaaggtcgaaatatctgaattttctctaaatggtttgtgctgctcatgaaatgcttcagttcttcataatagttgaactttcccggatagcacaggccattggctggcatatcagcagccagggcct

SEQ ID NO: 421093 - DNA, 140 bp, Artificial Sequence
  Synthetic
aggccctggctgctgatatgatgataaattctcagtaaagcaagatatcataggaataactgattggtcaggatacagtgggagttttgttcaacacccggaactgaccggactggactggaccttttgggacagcggtg

SEQ ID NO: 421094 - DNA, 140 bp, Artificial Sequence
  Synthetic
caccgctgtcccaaaaggtccagtccagtccggtcagttccgggtgttgaacaaaactcccactgtatcctgaccaatcagttattcctatgatatcttgctttactgagaatttatcatcatatcagcagccagggcct

SEQ ID NO: 421095 - DNA, 140 bp, Artificial Sequence
  Synthetic
atacgccatgctgggtctccatcctctgaatccgtttgtcagtcataaggaaattgagtcggtgaacaatgccgtagtgatgccagcccatggtccagcaaagagcatggagtatgatgccgtacttgggagtcggccat

SEQ ID NO: 421096 - DNA, 140 bp, Artificial Sequence
  Synthetic
atggccgactcccaagtacggcatcatactccatgctctttgctggaccatgggctggcatcactacggcattgttcaccgactcaatttccttatgactgacaaacggattcagaggatggagacccagcatggcgtat

SEQ ID NO: 421097 - DNA, 140 bp, Artificial Sequence
  Synthetic
aggccctggctgctgatatgtcttgaggcatttccaaaaagatgcaaaagtgctttttcagaactggggaattgagcccatcgacagtgtgatgggaatgatcggggtattgcctgatatgaccttttgggacagcggtg

SEQ ID NO: 421098 - DNA, 140 bp, Artificial Sequence
  Synthetic
caccgctgtcccaaaaggtcatatcaggcaataccccgatcattcccatcacactgtcgatgggctcaattccccagttctgaaaaagcacttttgcatctttttggaaatgcctcaagacatatcagcagccagggcct

SEQ ID NO: 421099 - DNA, 140 bp, Artificial Sequence
  Synthetic
aggccctggctgctgatatgagtcaaactgtacaggaagcttaaaagggaaataacattccatggggcaaaagaggtggcactcagttattcaactggtgcacttgccagctgcatgggcgaccttttgggacagcggtg

SEQ ID NO: 421100 - DNA, 140 bp, Artificial Sequence
  Synthetic
caccgctgtcccaaaaggtcgcccatgcagctggcaagtgcaccagttgaataactgagtgccacctcttttgccccatggaatgttatttcccttttaagcttcctgtacagtttgactcatatcagcagccagggcct

SEQ ID NO: 421101 - DNA, 140 bp, Artificial Sequence
  Synthetic
aggccctggctgctgatatgctcatatacaacaggatggggactgtgaccactgaagtggcatttggcctggtgtgtgccacgtgtgagcagattgctgattcccagcatcggtctcacagaccttttgggacagcggtg

SEQ ID NO: 421102 - DNA, 140 bp, Artificial Sequence
  Synthetic
caccgctgtcccaaaaggtctgtgagaccgatgctgggaatcagcaatctgctcacacgtggcacacaccaggccaaatgccacttcagtggtcacagtccccatcctgttgtatatgagcatatcagcagccagggcct

SEQ ID NO: 421103 - DNA, 140 bp, Artificial Sequence
  Synthetic
aggccctggctgctgatatgtcatggaagttgtattcccaaatgaagtgggggctagaatactaacatcagagtcacaactgacaataacaaaggaaaagaaggaggagcttcaggactggaccttttgggacagcggtg

SEQ ID NO: 421104 - DNA, 140 bp, Artificial Sequence
  Synthetic
caccgctgtcccaaaaggtccagtcctgaagctcctccttcttttcctttgttattgtcagttgtgactctgatgttagtattctagcccccacttcatttgggaatacaacttccatgacatatcagcagccagggcct

SEQ ID NO: 421105 - DNA, 140 bp, Artificial Sequence
  Synthetic
atacgccatgctgggtctccgtgaatgcacctaatcatgaagggatacaagcaggagtggacagattttacaggacctgcaaattagttggaatcaatatgagtaaaaagaaatcttacacgtacttgggagtcggccat

SEQ ID NO: 421106 - DNA, 140 bp, Artificial Sequence
  Synthetic
atggccgactcccaagtacgtgtaagatttctttttactcatattgattccaactaatttgcaggtcctgtaaaatctgtccactcctgcttgtatcccttcatgattaggtgcattcacggagacccagcatggcgtat

SEQ ID NO: 421107 - DNA, 140 bp, Artificial Sequence
  Synthetic
atacgccatgctgggtctccagtgaaaatgaatccaaatcagaagataataacaatcggctctgtctctctgaccatcgcaacagtatgtttcctcatgcagattgccatcttagcaacgcgtacttgggagtcggccat

SEQ ID NO: 421108 - DNA, 140 bp, Artificial Sequence
  Synthetic
atggccgactcccaagtacgcgttgctaagatggcaatctgcatgaggaaacatactgttgcgatggtcagagagacagagccgattgttattatcttctgatttggattcattttcactggagacccagcatggcgtat

SEQ ID NO: 421109 - DNA, 140 bp, Artificial Sequence
  Synthetic
aggccctggctgctgatatgtgaccatcgcaacagtatgtttcctcatgcagattgccatcttagcaacgaccgtgacactgcatttcaagcaaaatgaatgcagcattcccccgaacaagaccttttgggacagcggtg

SEQ ID NO: 421110 - DNA, 140 bp, Artificial Sequence
  Synthetic
caccgctgtcccaaaaggtcttgttcgggggaatgctgcattcattttgcttgaaatgcagtgtcacggtcgttgctaagatggcaatctgcatgaggaaacatactgttgcgatggtcacatatcagcagccagggcct

SEQ ID NO: 421111 - DNA, 140 bp, Artificial Sequence
  Synthetic
atacgccatgctgggtctccaccgtgacactgcatttcaagcaaaatgaatgcagcattcccccgaacaatcaagtggtgccatgtgaaccaatcataatagaaaagaacataacagagacgtacttgggagtcggccat

SEQ ID NO: 421112 - DNA, 140 bp, Artificial Sequence
  Synthetic
atggccgactcccaagtacgtctctgttatgttcttttctattatgattggttcacatggcaccacttgattgttcgggggaatgctgcattcattttgcttgaaatgcagtgtcacggtggagacccagcatggcgtat

SEQ ID NO: 421113 - DNA, 140 bp, Artificial Sequence
  Synthetic
aggccctggctgctgatatgaaaatggatgagagaactgatcctatatgacaaagaagagatcagaaggatttggcgtcaggcgaacaatggagaagacgcaactgctggtctcacccatgaccttttgggacagcggtg

SEQ ID NO: 421114 - DNA, 140 bp, Artificial Sequence
  Synthetic
caccgctgtcccaaaaggtcatgggtgagaccagcagttgcgtcttctccattgttcgcctgacgccaaatccttctgatctcttctttgtcatataggatcagttctctcatccattttcatatcagcagccagggcct

SEQ ID NO: 421115 - DNA, 140 bp, Artificial Sequence
  Synthetic
atacgccatgctgggtctccaggaaactaaaaagggaaataacattccatggggccaaggaagtagcgctcagttactctgctggtgcacttgccagttgcatgggcctcatatacaacacgtacttgggagtcggccat

SEQ ID NO: 421116 - DNA, 140 bp, Artificial Sequence
  Synthetic
atggccgactcccaagtacgtgttgtatatgaggcccatgcaactggcaagtgcaccagcagagtaactgagcgctacttccttggccccatggaatgttatttccctttttagtttcctggagacccagcatggcgtat

SEQ ID NO: 421117 - DNA, 140 bp, Artificial Sequence
  Synthetic
aggccctggctgctgatatgttgatgatttggcattccaatctgaatgatgccacatatcagagaacaagggcacttgtgcgtactgggatggatcccaggatgtgctctctgatgcaaggaccttttgggacagcggtg

SEQ ID NO: 421118 - DNA, 140 bp, Artificial Sequence
  Synthetic
caccgctgtcccaaaaggtccttgcatcagagagcacatcctgggatccatcccagtacgcacaagtgcccttgttctctgatatgtggcatcattcagattggaatgccaaatcatcaacatatcagcagccagggcct

SEQ ID NO: 421119 - DNA, 140 bp, Artificial Sequence
  Synthetic
atacgccatgctgggtctccgcaatctggcctccctgtcggagggaatgagaagaaagctaaattggcaaatgttgtgaggaagatgatgactaattcacaagatacagagctctccttccgtacttgggagtcggccat

SEQ ID NO: 421120 - DNA, 140 bp, Artificial Sequence
  Synthetic
atggccgactcccaagtacggaaggagagctctgtatcttgtgaattagtcatcatcttcctcacaacatttgccaatttagctttcttctcattccctccgacagggaggccagattgcggagacccagcatggcgtat

SEQ ID NO: 421121 - DNA, 140 bp, Artificial Sequence
  Synthetic
atacgccatgctgggtctcctttgcacttggccaagggaccacgctgaacaacaaacactcaaatggcacaatacatgatagaatcccacatcgaactcttttaatgaatgaattgggtgcgtacttgggagtcggccat

SEQ ID NO: 421122 - DNA, 140 bp, Artificial Sequence
  Synthetic
atggccgactcccaagtacgcacccaattcattcattaaaagagttcgatgtgggattctatcatgtattgtgccatttgagtgtttgttgttcagcgtggtcccttggccaagtgcaaaggagacccagcatggcgtat

SEQ ID NO: 421123 - DNA, 140 bp, Artificial Sequence
  Synthetic
aggccctggctgctgatatgaatacatgatagaatcccacatcgaactcttttaatgaatgaattgggtgttccgtttcatttgggaaccagacaagtatgcatagcatggtccagctcagaccttttgggacagcggtg

SEQ ID NO: 421124 - DNA, 140 bp, Artificial Sequence
  Synthetic
caccgctgtcccaaaaggtctgagctggaccatgctatgcatacttgtctggttcccaaatgaaacggaacacccaattcattcattaaaagagttcgatgtgggattctatcatgtattcatatcagcagccagggcct

SEQ ID NO: 421125 - DNA, 140 bp, Artificial Sequence
  Synthetic
atacgccatgctgggtctccttccgtttcatttgggaaccagacaagtatgcatagcatggtccagctcaagctgtcatgatgggaaagcatggctgcatgtctgtgtcactggggatgacgtacttgggagtcggccat

SEQ ID NO: 421126 - DNA, 140 bp, Artificial Sequence
  Synthetic
atggccgactcccaagtacgtcatccccagtgacacagacatgcagccatgctttcccatcatgacagcttgagctggaccatgctatgcatacttgtctggttcccaaatgaaacggaaggagacccagcatggcgtat

SEQ ID NO: 421127 - DNA, 140 bp, Artificial Sequence
  Synthetic
atacgccatgctgggtctccaacaattgggactcaccctaattctagcaccggtctaaaagatgatcttcttgaaaatttacaggcctatcagaaacggatgggagtgcaaatgcaacgacgtacttgggagtcggccat

SEQ ID NO: 421128 - DNA, 140 bp, Artificial Sequence
  Synthetic
atggccgactcccaagtacgtcgttgcatttgcactcccatccgtttctgataggcctgtaaattttcaagaagatcatcttttagaccggtgctagaattagggtgagtcccaattgttggagacccagcatggcgtat

SEQ ID NO: 421129 - DNA, 140 bp, Artificial Sequence
  Synthetic
aggccctggctgctgatatgttgaaaatttacaggcctatcagaaacggatgggagtgcaaatgcaacgattcaagtgatactctcattgatgtcgcaagcatcattgggattttgcaccgaccttttgggacagcggtg

SEQ ID NO: 421130 - DNA, 140 bp, Artificial Sequence
  Synthetic
caccgctgtcccaaaaggtcggtgcaaaatcccaatgatgcttgcgacatcaatgagagtatcacttgaatcgttgcatttgcactcccatccgtttctgataggcctgtaaattttcaacatatcagcagccagggcct

SEQ ID NO: 421131 - DNA, 140 bp, Artificial Sequence
  Synthetic
atacgccatgctgggtctccttggttcatggtctcaaaacatcctcagaactcaagagtcagaatgtgtttgcatcaatggaacttgtacagtggtaatgactgatggaagtgcatcaggcgtacttgggagtcggccat

SEQ ID NO: 421132 - DNA, 140 bp, Artificial Sequence
  Synthetic
atggccgactcccaagtacgcctgatgcacttccatcagtcattaccactgtacaagttccattgatgcaaacacattctgactcttgagttctgaggatgttttgagaccatgaaccaaggagacccagcatggcgtat

SEQ ID NO: 421133 - DNA, 140 bp, Artificial Sequence
  Synthetic
aggccctggctgctgatatgtgcatcaatggaacttgtacagtggtaatgactgatggaagtgcatcaggaagggctgatactagaatactattcattaaggaagggaaaattattcatagaccttttgggacagcggtg

SEQ ID NO: 421134 - DNA, 140 bp, Artificial Sequence
  Synthetic
caccgctgtcccaaaaggtctatgaataattttcccttccttaatgaatagtattctagtatcagcccttcctgatgcacttccatcagtcattaccactgtacaagttccattgatgcacatatcagcagccagggcct

SEQ ID NO: 421135 - DNA, 140 bp, Artificial Sequence
  Synthetic
atacgccatgctgggtctccacgaaaatccagcacataaaagtcaactggtttggatggcatgccactctgctgcatttgaagatctgagggtatcaagcttcatcagaggaacaagagtcgtacttgggagtcggccat

SEQ ID NO: 421136 - DNA, 140 bp, Artificial Sequence
  Synthetic
atggccgactcccaagtacgactcttgttcctctgatgaagcttgataccctcagatcttcaaatgcagcagagtggcatgccatccaaaccagttgacttttatgtgctggattttcgtggagacccagcatggcgtat

SEQ ID NO: 421137 - DNA, 140 bp, Artificial Sequence
  Synthetic
atacgccatgctgggtctccccccgatatccagatgttagatgtgtttgcagagataactggaagggctctaatagacccgttatagatataagtatggcagattacagcattgattccacgtacttgggagtcggccat

SEQ ID NO: 421138 - DNA, 140 bp, Artificial Sequence
  Synthetic
atggccgactcccaagtacgtggaatcaatgctgtaatctgccatacttatatctataacgggtctattagagcccttccagttatctctgcaaacacatctaacatctggatatcggggggagacccagcatggcgtat

SEQ ID NO: 421139 - DNA, 140 bp, Artificial Sequence
  Synthetic
aggccctggctgctgatatggtattttgtggtacttctggtacttatggaacaggctcatggcctgatggggcgaatatcaacttcatgcctgtataagctttcgcaattttagaaaaaagaccttttgggacagcggtg

SEQ ID NO: 421140 - DNA, 140 bp, Artificial Sequence
  Synthetic
caccgctgtcccaaaaggtcttttttctaaaattgcgaaagcttatacaggcatgaagttgatattcgccccatcaggccatgagcctgttccataagtaccagaagtaccacaaaataccatatcagcagccagggcct

SEQ ID NO: 421141 - DNA, 140 bp, Artificial Sequence
  Synthetic
aggccctggctgctgatatgtgccacaatatgcttccttatgcaaactgccatcctggtgactactgtaacattgcatttcaagcagcaggattgcaactcctctccaaacaaccaggtagaccttttgggacagcggtg

SEQ ID NO: 421142 - DNA, 140 bp, Artificial Sequence
  Synthetic
caccgctgtcccaaaaggtctacctggttgtttggagaggagttgcaatcctgctgcttgaaatgcaatgttacagtagtcaccaggatggcagtttgcataaggaagcatattgtggcacatatcagcagccagggcct

SEQ ID NO: 421143 - DNA, 140 bp, Artificial Sequence
  Synthetic
atacgccatgctgggtctccggtgaaagggtgggcatttgacaatgggaatgatgtttggatggggagaacaatcagcaaagattcgcgctcaggttatgagaccttcagggtcactggtcgtacttgggagtcggccat

SEQ ID NO: 421144 - DNA, 140 bp, Artificial Sequence
  Synthetic
atggccgactcccaagtacgaccagtgaccctgaaggtctcataacctgagcgcgaatctttgctgattgttctccccatccaaacatcattcccattgtcaaatgcccaccctttcaccggagacccagcatggcgtat

SEQ ID NO: 421145 - DNA, 140 bp, Artificial Sequence
  Synthetic
aggccctggctgctgatatgcaatcagcaaagattcgcgctcaggttatgagaccttcagggtcactggtggttggaccacggctaattccaaatcacaggtcaatagacaagtcatagtgaccttttgggacagcggtg

SEQ ID NO: 421146 - DNA, 140 bp, Artificial Sequence
  Synthetic
caccgctgtcccaaaaggtcactatgacttgtctattgacctgtgatttggaattagccgtggtccaaccaccagtgaccctgaaggtctcataacctgagcgcgaatctttgctgattgcatatcagcagccagggcct

SEQ ID NO: 421147 - DNA, 140 bp, Artificial Sequence
  Synthetic
aggccctggctgctgatatgacctgaagatgtgtctttccaggggcggggagtcttcgagctctcggacgaaaaggcaacgaacccgatcgtgccttcctttgacatgagtaatgaaggagaccttttgggacagcggtg

SEQ ID NO: 421148 - DNA, 140 bp, Artificial Sequence
  Synthetic
caccgctgtcccaaaaggtctccttcattactcatgtcaaaggaaggcacgatcgggttcgttgccttttcgtccgagagctcgaagactccccgcccctggaaagacacatcttcaggtcatatcagcagccagggcct

SEQ ID NO: 421149 - DNA, 140 bp, Artificial Sequence
  Synthetic
atacgccatgctgggtctccaaagctgcatcaataggtgtttttatgtggagttaataagagggaggccacaggagaccagggtatggtggacttcaaatagcatagtcgtattttgtggcgtacttgggagtcggccat

SEQ ID NO: 421150 - DNA, 140 bp, Artificial Sequence
  Synthetic
atggccgactcccaagtacgccacaaaatacgactatgctatttgaagtccaccataccctggtctcctgtggcctccctcttattaactccacataaaaacacctattgatgcagctttggagacccagcatggcgtat

SEQ ID NO: 421151 - DNA, 140 bp, Artificial Sequence
  Synthetic
atacgccatgctgggtctccggaaacaatgctatcaatcacgattctgtttctgctcatagcagagagctcctctcagaattacacagggaatcctgtgatatgcctgggacatcatgcccgtacttgggagtcggccat

SEQ ID NO: 421152 - DNA, 140 bp, Artificial Sequence
  Synthetic
atggccgactcccaagtacgggcatgatgtcccaggcatatcacaggattccctgtgtaattctgagaggagctctctgctatgagcagaaacagaatcgtgattgatagcattgtttccggagacccagcatggcgtat

SEQ ID NO: 421153 - DNA, 140 bp, Artificial Sequence
  Synthetic
aggccctggctgctgatatgcctctcagaattacacagggaatcctgtgatatgcctgggacatcatgccgtatccaatgggacaatggtgaaaaccctgactgatgaccaagtagaagtgaccttttgggacagcggtg

SEQ ID NO: 421154 - DNA, 140 bp, Artificial Sequence
  Synthetic
caccgctgtcccaaaaggtcacttctacttggtcatcagtcagggttttcaccattgtcccattggatacggcatgatgtcccaggcatatcacaggattccctgtgtaattctgagaggcatatcagcagccagggcct

SEQ ID NO: 421155 - DNA, 140 bp, Artificial Sequence
  Synthetic
atacgccatgctgggtctccgtatccaatgggacaatggtgaaaaccctgactgatgaccaagtagaagttgtcactgcccaagaattagtggagtcgcaacatctaccagagctatgcccgtacttgggagtcggccat

SEQ ID NO: 421156 - DNA, 140 bp, Artificial Sequence
  Synthetic
atggccgactcccaagtacgggcatagctctggtagatgttgcgactccactaattcttgggcagtgacaacttctacttggtcatcagtcagggttttcaccattgtcccattggatacggagacccagcatggcgtat

SEQ ID NO: 421157 - DNA, 140 bp, Artificial Sequence
  Synthetic
atacgccatgctgggtctccgccttgggaagtccaggctgtgatcacttgaatggcgcggaatgggatgtcttcatagagcgacccaatgctgtggacacttgttatccatttgatgtgccgtacttgggagtcggccat

SEQ ID NO: 421158 - DNA, 140 bp, Artificial Sequence
  Synthetic
atggccgactcccaagtacggcacatcaaatggataacaagtgtccacagcattgggtcgctctatgaagacatcccattccgcgccattcaagtgatcacagcctggacttcccaaggcggagacccagcatggcgtat

SEQ ID NO: 421159 - DNA, 140 bp, Artificial Sequence
  Synthetic
atacgccatgctgggtctcccagcatttgatgagagaagaaacaaatatctggaagaacaccccagtgctgggaaagaccctaagaaaactggaggtccaatctacaggaggagagatggcgtacttgggagtcggccat

SEQ ID NO: 421160 - DNA, 140 bp, Artificial Sequence
  Synthetic
atggccgactcccaagtacgccatctctcctcctgtagattggacctccagttttcttagggtctttcccagcactggggtgttcttccagatatttgtttcttctctcatcaaatgctgggagacccagcatggcgtat

SEQ ID NO: 421161 - DNA, 140 bp, Artificial Sequence
  Synthetic
atacgccatgctgggtctccgaagtggatgagagaattgatcctatatgacaaagaggagatcagaaggatttggcgtcaggcgaacaatggagaagacgcaactgctggtctcacccatcgtacttgggagtcggccat

SEQ ID NO: 421162 - DNA, 140 bp, Artificial Sequence
  Synthetic
atggccgactcccaagtacgatgggtgagaccagcagttgcgtcttctccattgttcgcctgacgccaaatccttctgatctcctctttgtcatataggatcaattctctcatccacttcggagacccagcatggcgtat

SEQ ID NO: 421163 - DNA, 140 bp, Artificial Sequence
  Synthetic
atacgccatgctgggtctcccggggcatgcaaaagagcaaatgtgaatgattttttcaacagactgaactggctaaccaaatccgatgggaatgcgtacccacttcaaaatctgacaaagcgtacttgggagtcggccat

SEQ ID NO: 421164 - DNA, 140 bp, Artificial Sequence
  Synthetic
atggccgactcccaagtacgctttgtcagattttgaagtgggtacgcattcccatcggatttggttagccagttcagtctgttgaaaaaatcattcacatttgctcttttgcatgccccgggagacccagcatggcgtat

SEQ ID NO: 421165 - DNA, 140 bp, Artificial Sequence
  Synthetic
atacgccatgctgggtctccttgatgatctggcactccaatctgaatgatgccacctaccagagaacaagagcacttgtgcgtactgggatggatcccaggatgtgttctctgatgcaagcgtacttgggagtcggccat

SEQ ID NO: 421166 - DNA, 140 bp, Artificial Sequence
  Synthetic
atggccgactcccaagtacgcttgcatcagagaacacatcctgggatccatcccagtacgcacaagtgctcttgttctctggtaggtggcatcattcagattggagtgccagatcatcaaggagacccagcatggcgtat

SEQ ID NO: 421167 - DNA, 140 bp, Artificial Sequence
  Synthetic
aggccctggctgctgatatgagcacttgtgcgtactgggatggatcccaggatgtgttctctgatgcaaggctcaactcttccgaggaggtccggagctgctggagcagcggtaaaaggagaccttttgggacagcggtg

SEQ ID NO: 421168 - DNA, 140 bp, Artificial Sequence
  Synthetic
caccgctgtcccaaaaggtctccttttaccgctgctccagcagctccggacctcctcggaagagttgagccttgcatcagagaacacatcctgggatccatcccagtacgcacaagtgctcatatcagcagccagggcct

SEQ ID NO: 421169 - DNA, 140 bp, Artificial Sequence
  Synthetic
atacgccatgctgggtctcctgactgtttccaccaaaaccagtcaaacaagtgtggtaccaaatatcggcagtagaccatgggtgagaggccaaagtggcaggattagcttctattggaccgtacttgggagtcggccat

SEQ ID NO: 421170 - DNA, 140 bp, Artificial Sequence
  Synthetic
atggccgactcccaagtacggtccaatagaagctaatcctgccactttggcctctcacccatggtctactgccgatatttggtaccacacttgtttgactggttttggtggaaacagtcaggagacccagcatggcgtat

SEQ ID NO: 421171 - DNA, 140 bp, Artificial Sequence
  Synthetic
atacgccatgctgggtctcctgatcggaatttctggagaggcgaaaatgggcgaagaacaagaattgcttatgaaagaatgtgcaacatcctcaaagggaaattccaaacagcagcacaacgtacttgggagtcggccat

SEQ ID NO: 421172 - DNA, 140 bp, Artificial Sequence
  Synthetic
atggccgactcccaagtacgttgtgctgctgtttggaatttccctttgaggatgttgcacattctttcataagcaattcttgttcttcgcccattttcgcctctccagaaattccgatcaggagacccagcatggcgtat

SEQ ID NO: 421173 - DNA, 140 bp, Artificial Sequence
  Synthetic
aggccctggctgctgatatgcgagcaatgatggaccaggtgagggaaagccgaaatcctgggaacgctgaaattgaagatctcatctttcttgcacggtctgctctcatcctgagggggtgaccttttgggacagcggtg

SEQ ID NO: 421174 - DNA, 140 bp, Artificial Sequence
  Synthetic
caccgctgtcccaaaaggtcaccccctcaggatgagagcagaccgtgcaagaaagatgagatcttcaatttcagcgttcccaggatttcggctttccctcacctggtccatcattgctcgcatatcagcagccagggcct

SEQ ID NO: 421175 - DNA, 140 bp, Artificial Sequence
  Synthetic
atacgccatgctgggtctccctgaatactgcaattcccataggatcttgcgtcagtaaatgtcacacagacaggggttcaatctccacaactaaaccctttcagaacatctcgagaatatcgtacttgggagtcggccat

SEQ ID NO: 421176 - DNA, 140 bp, Artificial Sequence
  Synthetic
atggccgactcccaagtacgatattctcgagatgttctgaaagggtttagttgtggagattgaacccctgtctgtgtgacatttactgacgcaagatcctatgggaattgcagtattcagggagacccagcatggcgtat

SEQ ID NO: 421177 - DNA, 140 bp, Artificial Sequence
  Synthetic
aggccctggctgctgatatgcaggggttcaatctccacaactaaaccctttcagaacatctcgagaatatcaatcggggactgccccaagtatgtcaaacagggatccttaaaactagctgaccttttgggacagcggtg

SEQ ID NO: 421178 - DNA, 140 bp, Artificial Sequence
  Synthetic
caccgctgtcccaaaaggtcagctagttttaaggatccctgtttgacatacttggggcagtccccgattgatattctcgagatgttctgaaagggtttagttgtggagattgaacccctgcatatcagcagccagggcct

SEQ ID NO: 421179 - DNA, 140 bp, Artificial Sequence
  Synthetic
atacgccatgctgggtctccgccagtggatacgactttgaacgagagggatactccctagtcggaatcgatcctttccgcctgctccaaaacagtcaagtcttcagcctgatcagaccaacgtacttgggagtcggccat

SEQ ID NO: 421180 - DNA, 140 bp, Artificial Sequence
  Synthetic
atggccgactcccaagtacgttggtctgatcaggctgaagacttgactgttttggagcaggcggaaaggatcgattccgactagggagtatccctctcgttcaaagtcgtatccactggcggagacccagcatggcgtat

SEQ ID NO: 421181 - DNA, 140 bp, Artificial Sequence
  Synthetic
atacgccatgctgggtctccaattgctggcttcatagaaaatggctggcaaggtctaattgatggttggtacgggtttaggcaccagaatgctgaaggaacaggaacagctgctgatctccgtacttgggagtcggccat

SEQ ID NO: 421182 - DNA, 140 bp, Artificial Sequence
  Synthetic
atggccgactcccaagtacggagatcagcagctgttcctgttccttcagcattctggtgcctaaacccgtaccaaccatcaattagaccttgccagccattttctatgaagccagcaattggagacccagcatggcgtat

SEQ ID NO: 421183 - DNA, 140 bp, Artificial Sequence
  Synthetic
atacgccatgctgggtctccaactgagttatggtaactgtgataccaaatgtcagaccccagtgggtgctataaattccagtatgcctttccataatgtccatccccttaccattggggacgtacttgggagtcggccat

SEQ ID NO: 421184 - DNA, 140 bp, Artificial Sequence
  Synthetic
atggccgactcccaagtacgtccccaatggtaaggggatggacattatggaaaggcatactggaatttatagcacccactggggtctgacatttggtatcacagttaccataactcagttggagacccagcatggcgtat

SEQ ID NO: 421185 - DNA, 140 bp, Artificial Sequence
  Synthetic
atacgccatgctgggtctccaagtggaggggagaattcaagacttggagagatatgttgaagacacaaagattgacctgtggtcttacaatgctgaattattggtggcattggaaaatcacgtacttgggagtcggccat

SEQ ID NO: 421186 - DNA, 140 bp, Artificial Sequence
  Synthetic
atggccgactcccaagtacgtgattttccaatgccaccaataattcagcattgtaagaccacaggtcaatctttgtgtcttcaacatatctctccaagtcttgaattctcccctccacttggagacccagcatggcgtat

SEQ ID NO: 421187 - DNA, 140 bp, Artificial Sequence
  Synthetic
atacgccatgctgggtctccttagacgccaactacgagagaatgcagaggacaaaggaaacgggtgttttgaaattttccatcagtgtgacaatagttgcatcgaaagcataagaaatggcgtacttgggagtcggccat

SEQ ID NO: 421188 - DNA, 140 bp, Artificial Sequence
  Synthetic
atggccgactcccaagtacgccatttcttatgctttcgatgcaactattgtcacactgatggaaaatttcaaaacacccgtttcctttgtcctctgcattctctcgtagttggcgtctaaggagacccagcatggcgtat

SEQ ID NO: 421189 - DNA, 140 bp, Artificial Sequence
  Synthetic
aggccctggctgctgatatggaaattttccatcagtgtgacaatagttgcatcgaaagcataagaaatgggacatatgaccatgatatttatagagacgaagcaatcaacaacagattccgaccttttgggacagcggtg

SEQ ID NO: 421190 - DNA, 140 bp, Artificial Sequence
  Synthetic
caccgctgtcccaaaaggtcggaatctgttgttgattgcttcgtctctataaatatcatggtcatatgtcccatttcttatgctttcgatgcaactattgtcacactgatggaaaatttccatatcagcagccagggcct

SEQ ID NO: 421191 - DNA, 140 bp, Artificial Sequence
  Synthetic
atacgccatgctgggtctcccagagctgctagtattgcttgaaaaccagaaaacactagatgagcatgacgcaaacgtgaacaatctatacaacaaagtgaaaagggccctgggctcaaacgtacttgggagtcggccat

SEQ ID NO: 421192 - DNA, 140 bp, Artificial Sequence
  Synthetic
atggccgactcccaagtacgtttgagcccagggcccttttcactttgttgtatagattgttcacgtttgcgtcatgctcatctagtgttttctggttttcaagcaatactagcagctctgggagacccagcatggcgtat

SEQ ID NO: 421193 - DNA, 140 bp, Artificial Sequence
  Synthetic
aggccctggctgctgatatggaaaatttcagacagctgcccagagggcaatgatggatcaagtgagagaaagtcgaaacccaggaaacgctgagattgaagatctcattttcctggcacggaccttttgggacagcggtg

SEQ ID NO: 421194 - DNA, 140 bp, Artificial Sequence
  Synthetic
caccgctgtcccaaaaggtccgtgccaggaaaatgagatcttcaatctcagcgtttcctgggtttcgactttctctcacttgatccatcattgccctctgggcagctgtctgaaattttccatatcagcagccagggcct

SEQ ID NO: 421195 - DNA, 140 bp, Artificial Sequence
  Synthetic
aggccctggctgctgatatgtttcaggtagactgctttctttggcatgtccgcaaacgatttgcagaccaagaactgggtgatgccccattccttgaccggcttcgccgagatcagaagtgaccttttgggacagcggtg

SEQ ID NO: 421196 - DNA, 140 bp, Artificial Sequence
  Synthetic
caccgctgtcccaaaaggtcacttctgatctcggcgaagccggtcaaggaatggggcatcacccagttcttggtctgcaaatcgtttgcggacatgccaaagaaagcagtctacctgaaacatatcagcagccagggcct

SEQ ID NO: 421197 - DNA, 140 bp, Artificial Sequence
  Synthetic
aggccctggctgctgatatggcaggtgcagcagtgaaggggatagggacaatggtgatggaactgattcggatgataaaacgagggatcaacgaccggaatttctggagaggcgaaaatggaccttttgggacagcggtg

SEQ ID NO: 421198 - DNA, 140 bp, Artificial Sequence
  Synthetic
caccgctgtcccaaaaggtccattttcgcctctccagaaattccggtcgttgatccctcgttttatcatccgaatcagttccatcaccattgtccctatccccttcactgctgcacctgccatatcagcagccagggcct

SEQ ID NO: 421199 - DNA, 140 bp, Artificial Sequence
  Synthetic
atacgccatgctgggtctcctttatagaaggaggatggcaaggaatggtagatggatggtatggataccatcatagcaatgagcaaggtagcggatatgctgcggataaagaatctacaccgtacttgggagtcggccat

SEQ ID NO: 421200 - DNA, 140 bp, Artificial Sequence
  Synthetic
atggccgactcccaagtacggtgtagattctttatccgcagcatatccgctaccttgctcattgctatgatggtatccataccatccatctaccattccttgccatcctccttctataaaggagacccagcatggcgtat

SEQ ID NO: 421201 - DNA, 140 bp, Artificial Sequence
  Synthetic
atacgccatgctgggtctccatgattgcaatcgttgttatagcgatattggcatcggccggaaaatcagacaagatctgtattgggtaccacgccaacaattcaacaacacaagtggatacgtacttgggagtcggccat

SEQ ID NO: 421202 - DNA, 140 bp, Artificial Sequence
  Synthetic
atggccgactcccaagtacgtatccacttgtgttgttgaattgttggcgtggtacccaatacagatcttgtctgattttccggccgatgccaatatcgctataacaacgattgcaatcatggagacccagcatggcgtat

SEQ ID NO: 421203 - DNA, 140 bp, Artificial Sequence
  Synthetic
atacgccatgctgggtctccatggatacttttattacaagaaacttccagactacaataatacaaaaggccaaaaacacaatggcagaatttagtgaagatcctgaattacaaccagcaacgtacttgggagtcggccat

SEQ ID NO: 421204 - DNA, 140 bp, Artificial Sequence
  Synthetic
atggccgactcccaagtacgttgctggttgtaattcaggatcttcactaaattctgccattgtgtttttggccttttgtattattgtagtctggaagtttcttgtaataaaagtatccatggagacccagcatggcgtat

SEQ ID NO: 421205 - DNA, 140 bp, Artificial Sequence
  Synthetic
atacgccatgctgggtctccataccagccaaaggggaattcttgaggatgaacagatgtatcagaagtgctgcaatctatttgagaagttcttccctagtagttcatataggaggccagtcgtacttgggagtcggccat

SEQ ID NO: 421206 - DNA, 140 bp, Artificial Sequence
  Synthetic
atggccgactcccaagtacgactggcctcctatatgaactactagggaagaacttctcaaatagattgcagcacttctgatacatctgttcatcctcaagaattcccctttggctggtatggagacccagcatggcgtat

SEQ ID NO: 421207 - DNA, 140 bp, Artificial Sequence
  Synthetic
atacgccatgctgggtctccatggaagattttgtgcgacaatgcttcaacccgatgattgtcgaacttgcagaaaaagcaatgaaagagtatggggaggatctgaaaattgaaaccaacacgtacttgggagtcggccat

SEQ ID NO: 421208 - DNA, 140 bp, Artificial Sequence
  Synthetic
atggccgactcccaagtacgtgttggtttcaattttcagatcctccccatactctttcattgctttttctgcaagttcgacaatcatcgggttgaagcattgtcgcacaaaatcttccatggagacccagcatggcgtat

SEQ ID NO: 421209 - DNA, 140 bp, Artificial Sequence
  Synthetic
atacgccatgctgggtctcctgcgagcagattgctgatgctcaacatcgttctcacagacagatggcagctactaccaacccactaatcaggcatgagaacagaatggtgctggccagcacgtacttgggagtcggccat

SEQ ID NO: 421210 - DNA, 140 bp, Artificial Sequence
  Synthetic
atggccgactcccaagtacgtgctggccagcaccattctgttctcatgcctgattagtgggttggtagtagctgccatctgtctgtgagaacgatgttgagcatcagcaatctgctcgcaggagacccagcatggcgtat

SEQ ID NO: 421211 - DNA, 140 bp, Artificial Sequence
  Synthetic
atacgccatgctgggtctccgtttctggcaatgataacgtacatcacaaggaaccagccaaaatggtttcgaaacgtcttaagcattgcccctataatgttctcaaataagatggcgagacgtacttgggagtcggccat

SEQ ID NO: 421212 - DNA, 140 bp, Artificial Sequence
  Synthetic
atggccgactcccaagtacgtctcgccatcttatttgagaacattataggggcaatgcttaagacgtttcgaaaccattttggctggttccttgtgatgtacgttatcattgccagaaacggagacccagcatggcgtat

SEQ ID NO: 421213 - DNA, 140 bp, Artificial Sequence
  Synthetic
aggccctggctgctgatatggctagcaataaaaccatagaatgtgcctgtagagataacagttacacagcaaaaagaccctttgtcaaattaaacgtggagactgatacagcagaaataagaccttttgggacagcggtg

SEQ ID NO: 421214 - DNA, 140 bp, Artificial Sequence
  Synthetic
caccgctgtcccaaaaggtcttatttctgctgtatcagtctccacgtttaatttgacaaagggtctttttgctgtgtaactgttatctctacaggcacattctatggttttattgctagccatatcagcagccagggcct

SEQ ID NO: 421215 - DNA, 140 bp, Artificial Sequence
  Synthetic
aggccctggctgctgatatgctggaaaggttcaaataggcccatcgtggacataagaatgaaagattatagcattggttccagttatttgtgctcaggacttgttggcgacacacccagggaccttttgggacagcggtg

SEQ ID NO: 421216 - DNA, 140 bp, Artificial Sequence
  Synthetic
caccgctgtcccaaaaggtccctgggtgtgtcgccaacaagtcctgagcacaaataactggaaccaatgctataatctttcattcttatgtccacgatgggcctatttgaacctttccagcatatcagcagccagggcct

SEQ ID NO: 421217 - DNA, 140 bp, Artificial Sequence
  Synthetic
atacgccatgctgggtctcccatcgaaattggagtgacaaggagagaagtccacatatattaccttgaaaaggccaataagattaaatctgagaacacacacattcacattttttcattccgtacttgggagtcggccat

SEQ ID NO: 421218 - DNA, 140 bp, Artificial Sequence
  Synthetic
atggccgactcccaagtacggaatgaaaaaatgtgaatgtgtgtgttctcagatttaatcttattggccttttcaaggtaatatatgtggacttctctccttgtcactccaatttcgatgggagacccagcatggcgtat

SEQ ID NO: 421219 - DNA, 140 bp, Artificial Sequence
  Synthetic
aggccctggctgctgatatgagggagagtgctaagcagactcacagaacttcaagctgaattaagtctgaaaaacttatggcaagttctcataggagaagaagatgttgaaaagggaattgaccttttgggacagcggtg

SEQ ID NO: 421220 - DNA, 140 bp, Artificial Sequence
  Synthetic
caccgctgtcccaaaaggtcaattcccttttcaacatcttcttctcctatgagaacttgccataagtttttcagacttaattcagcttgaagttctgtgagtctgcttagcactctccctcatatcagcagccagggcct

SEQ ID NO: 421221 - DNA, 140 bp, Artificial Sequence
  Synthetic
atacgccatgctgggtctccagggagttgggacgatggtaatggaactgattcggatgataaagcggggtatcaatgatcggaacttctggagaggcgagaatggacgaagaacaagaatcgtacttgggagtcggccat

SEQ ID NO: 421222 - DNA, 140 bp, Artificial Sequence
  Synthetic
atggccgactcccaagtacgattcttgttcttcgtccattctcgcctctccagaagttccgatcattgataccccgctttatcatccgaatcagttccattaccatcgtcccaactccctggagacccagcatggcgtat

SEQ ID NO: 421223 - DNA, 140 bp, Artificial Sequence
  Synthetic
atacgccatgctgggtctccgactttaaacttggacaaacaatatctagactaagggatatatctgttcctgctggtttctccaattttgaaggaatgaggagctacatagacaatatagcgtacttgggagtcggccat

SEQ ID NO: 421224 - DNA, 140 bp, Artificial Sequence
  Synthetic
atggccgactcccaagtacgctatattgtctatgtagctcctcattccttcaaaattggagaaaccagcaggaacagatatatcccttagtctagatattgtttgtccaagtttaaagtcggagacccagcatggcgtat

SEQ ID NO: 421225 - DNA, 140 bp, Artificial Sequence
  Synthetic
aggccctggctgctgatatgggtctagaccctgggtaaggggtgtctccagcataataagcatccattggacaatagtaaaatcgggcgacatacttttgattaacagcacagggaatctgaccttttgggacagcggtg

SEQ ID NO: 421226 - DNA, 140 bp, Artificial Sequence
  Synthetic
caccgctgtcccaaaaggtcagattccctgtgctgttaatcaaaagtatgtcgcccgattttactattgtccaatggatgcttattatgctggagacaccccttacccagggtctagacccatatcagcagccagggcct

SEQ ID NO: 421227 - DNA, 140 bp, Artificial Sequence
  Synthetic
atacgccatgctgggtctccacaatagtaaaatcgggcgacatacttttgattaacagcacagggaatctaattgcccctcggggttacttcaaagtacaaagtgggaaaggctcaataacgtacttgggagtcggccat

SEQ ID NO: 421228 - DNA, 140 bp, Artificial Sequence
  Synthetic
atggccgactcccaagtacgttattgagcctttcccactttgtactttgaagtaaccccgaggggcaattagattccctgtgctgttaatcaaaagtatgtcgcccgattttactattgtggagacccagcatggcgtat

SEQ ID NO: 421229 - DNA, 140 bp, Artificial Sequence
  Synthetic
aggccctggctgctgatatgagtaaagataatagtgtaagaatcggttccaaaggggatgtgtttgtcataagagagcctttcatctcatgctctcacttggaatgtagaaccttcttctgaccttttgggacagcggtg

SEQ ID NO: 421230 - DNA, 140 bp, Artificial Sequence
  Synthetic
caccgctgtcccaaaaggtcagaagaaggttctacattccaagtgagagcatgagatgaaaggctctcttatgacaaacacatcccctttggaaccgattcttacactattatctttactcatatcagcagccagggcct

SEQ ID NO: 421231 - DNA, 140 bp, Artificial Sequence
  Synthetic
atacgccatgctgggtctcctgataaacaatgaccttgggccagccacagctcagatggctcttcagttattcatcaaggactatagatacacataccgatgccacagaggggatacgcacgtacttgggagtcggccat

SEQ ID NO: 421232 - DNA, 140 bp, Artificial Sequence
  Synthetic
atggccgactcccaagtacgtgcgtatcccctctgtggcatcggtatgtgtatctatagtccttgatgaataactgaagagccatctgagctgtggctggcccaaggtcattgtttatcaggagacccagcatggcgtat

SEQ ID NO: 421233 - DNA, 140 bp, Artificial Sequence
  Synthetic
atacgccatgctgggtctccggatcagactgacccaatattaataatgaaaagtgaaaaagctaacgaaaatttcctatggaagctttggagagactgtgtaaatacaataagtaatgagcgtacttgggagtcggccat

SEQ ID NO: 421234 - DNA, 140 bp, Artificial Sequence
  Synthetic
atggccgactcccaagtacgctcattacttattgtatttacacagtctctccaaagcttccataggaaattttcgttagctttttcacttttcattattaatattgggtcagtctgatccggagacccagcatggcgtat

SEQ ID NO: 421235 - DNA, 140 bp, Artificial Sequence
  Synthetic
aggccctggctgctgatatgcctattagtctccctgggggcaatcagcttctggatgtgttctaatgggtcattgcaatgcagaatatgcatttaagacttgaatttcagaatgtaccgggaccttttgggacagcggtg

SEQ ID NO: 421236 - DNA, 140 bp, Artificial Sequence
  Synthetic
caccgctgtcccaaaaggtcccggtacattctgaaattcaagtcttaaatgcatattctgcattgcaatgacccattagaacacatccagaagctgattgcccccagggagactaataggcatatcagcagccagggcct

SEQ ID NO: 421237 - DNA, 140 bp, Artificial Sequence
  Synthetic
atacgccatgctgggtctcctagatctctggtcttacaacgcggagcttcttgttgccctggagaaccaacatacaattgatttaactgattcagaaatgaacaaactgttcgaaaaaaccgtacttgggagtcggccat

SEQ ID NO: 421238 - DNA, 140 bp, Artificial Sequence
  Synthetic
atggccgactcccaagtacggttttttcgaacagtttgttcatttctgaatcagttaaatcaattgtatgttggttctccagggcaacaagaagctccgcgttgtaagaccagagatctaggagacccagcatggcgtat

SEQ ID NO: 421239 - DNA, 140 bp, Artificial Sequence
  Synthetic
atacgccatgctgggtctccacggatgaccaaattgaggtgaccaatgccaccgaattggtccagagctcctcaacagggaaaatatgcaacaacccacacagaatccttgatgggagggcgtacttgggagtcggccat

SEQ ID NO: 421240 - DNA, 140 bp, Artificial Sequence
  Synthetic
atggccgactcccaagtacgccctcccatcaaggattctgtgtgggttgttgcatattttccctgttgaggagctctggaccaattcggtggcattggtcacctcaatttggtcatccgtggagacccagcatggcgtat

SEQ ID NO: 421241 - DNA, 140 bp, Artificial Sequence
  Synthetic
aggccctggctgctgatatgacctatgaccatgatgtatacagagatgaggcattaaacaatcggttccagatcaaaggtgttcaactgaagtcaggatacaaagattggatcccatggagaccttttgggacagcggtg

SEQ ID NO: 421242 - DNA, 140 bp, Artificial Sequence
  Synthetic
caccgctgtcccaaaaggtctccatgggatccaatctttgtatcctgacttcagttgaacacctttgatctggaaccgattgtttaatgcctcatctctgtatacatcatggtcataggtcatatcagcagccagggcct

SEQ ID NO: 421243 - DNA, 140 bp, Artificial Sequence
  Synthetic
aggccctggctgctgatatgtttcctttgccatatcatgcttcttgctttgtgtttttctgctggggttcattatgtgggcctgccaaaaaggcaacattaaatgcaacatttgcatttggaccttttgggacagcggtg

SEQ ID NO: 421244 - DNA, 140 bp, Artificial Sequence
  Synthetic
caccgctgtcccaaaaggtccaaatgcaaatgttgcatttaatgttgcctttttggcaggcccacataatgaaccccagcagaaaaacacaaagcaagaagcatgatatggcaaaggaaacatatcagcagccagggcct

SEQ ID NO: 421245 - DNA, 140 bp, Artificial Sequence
  Synthetic
aggccctggctgctgatatgaaatctgtgtacctatattgcagagtgaatggcacaaataagatccaaatgaaatggggaatggaagctagaagatgtctgcttcaatcaatgcaacaaagaccttttgggacagcggtg

SEQ ID NO: 421246 - DNA, 140 bp, Artificial Sequence
  Synthetic
caccgctgtcccaaaaggtctttgttgcattgattgaagcagacatcttctagcttccattccccatttcatttggatcttatttgtgccattcactctgcaatataggtacacagatttcatatcagcagccagggcct

SEQ ID NO: 421247 - DNA, 140 bp, Artificial Sequence
  Synthetic
atacgccatgctgggtctccttaatggtggcttacatgttggagagagaactggttcgcaaaacaagatttctaccagtagctggagggacaagcagcgtgtatatcgaagtgttgcattcgtacttgggagtcggccat

SEQ ID NO: 421248 - DNA, 140 bp, Artificial Sequence
  Synthetic
atggccgactcccaagtacgaatgcaacacttcgatatacacgctgcttgtccctccagctactggtagaaatcttgttttgcgaaccagttctctctccaacatgtaagccaccattaaggagacccagcatggcgtat

SEQ ID NO: 421249 - DNA, 140 bp, Artificial Sequence
  Synthetic
aggccctggctgctgatatgcagaattgacttcgagtctggaaggattaagaaagaggagttctctgagatcatgaggatctgttccaccattgaagaactcagacggcaaaaataatgagaccttttgggacagcggtg

SEQ ID NO: 421250 - DNA, 140 bp, Artificial Sequence
  Synthetic
caccgctgtcccaaaaggtctcattatttttgccgtctgagttcttcaatggtggaacagatcctcatgatctcagagaactcctctttcttaatccttccagactcgaagtcaattctgcatatcagcagccagggcct

SEQ ID NO: 421251 - DNA, 140 bp, Artificial Sequence
  Synthetic
atacgccatgctgggtctccgattttgaaagaggaatccagcgatacacttaagatgaccattgcatctgtacctacttcgcgctacttagctgacatgaccctcgaggaaatgtcacgacgtacttgggagtcggccat

SEQ ID NO: 421252 - DNA, 140 bp, Artificial Sequence
  Synthetic
atggccgactcccaagtacgtcgtgacatttcctcgagggtcatgtcagctaagtagcgcgaagtaggtacagatgcaatggtcatcttaagtgtatcgctggattcctctttcaaaatcggagacccagcatggcgtat

SEQ ID NO: 421253 - DNA, 140 bp, Artificial Sequence
  Synthetic
aggccctggctgctgatatggagtaatatttactaaatgtttgatgcactatgtatttggaaatgcccagttggagggattcagtgccgagtctaggagacttctactgttgattcaagcgaccttttgggacagcggtg

SEQ ID NO: 421254 - DNA, 140 bp, Artificial Sequence
  Synthetic
caccgctgtcccaaaaggtcgcttgaatcaacagtagaagtctcctagactcggcactgaatccctccaactgggcatttccaaatacatagtgcatcaaacatttagtaaatattactccatatcagcagccagggcct

SEQ ID NO: 421255 - DNA, 140 bp, Artificial Sequence
  Synthetic
atacgccatgctgggtctccgaaaagtctgtaggactctattggctaagtcagtattcaatagcctgtatgcatcaccacaattggaaggattttcagcggagtcaagaaaactgctcctcgtacttgggagtcggccat

SEQ ID NO: 421256 - DNA, 140 bp, Artificial Sequence
  Synthetic
atggccgactcccaagtacgaggagcagttttcttgactccgctgaaaatccttccaattgtggtgatgcatacaggctattgaatactgacttagccaatagagtcctacagacttttcggagacccagcatggcgtat

SEQ ID NO: 421257 - DNA, 140 bp, Artificial Sequence
  Synthetic
atacgccatgctgggtctccctggaatagaagaatgtatcagtaacaacccttgggtaatacagagtgcatactggttcaatgaatggttgggttttgaaaaggaggggagtaaagtattcgtacttgggagtcggccat

SEQ ID NO: 421258 - DNA, 140 bp, Artificial Sequence
  Synthetic
atggccgactcccaagtacgaatactttactcccctccttttcaaaacccaaccattcattgaaccagtatgcactctgtattacccaagggttgttactgatacattcttctattccagggagacccagcatggcgtat

SEQ ID NO: 421259 - DNA, 140 bp, Artificial Sequence
  Synthetic
aggccctggctgctgatatgttgggtaatacagagtgcatactggttcaatgaatggttgggttttgaaaaggaggggagtaaagtattagagtcagtagatgaaataatggatgaataagaccttttgggacagcggtg

SEQ ID NO: 421260 - DNA, 140 bp, Artificial Sequence
  Synthetic
caccgctgtcccaaaaggtcttattcatccattatttcatctactgactctaatactttactcccctccttttcaaaacccaaccattcattgaaccagtatgcactctgtattacccaacatatcagcagccagggcct

SEQ ID NO: 421261 - DNA, 140 bp, Artificial Sequence
  Synthetic
atacgccatgctgggtctccatgacattggctaaaattgaattgttaaaacaactgttaagggacaatgaagccaaaacagtactgaaacaaacaacagtagatcaatataacataataacgtacttgggagtcggccat

SEQ ID NO: 421262 - DNA, 140 bp, Artificial Sequence
  Synthetic
atggccgactcccaagtacgttattatgttatattgatctactgttgtttgtttcagtactgttttggcttcattgtcccttaacagttgttttaacaattcaattttagccaatgtcatggagacccagcatggcgtat

SEQ ID NO: 421263 - DNA, 140 bp, Artificial Sequence
  Synthetic
aggccctggctgctgatatgagccaaaacagtactgaaacaaacaacagtagatcaatataacataataagaaaattcaatacatcaagaattgaaaagaacccttcattaagaatgaaggaccttttgggacagcggtg

SEQ ID NO: 421264 - DNA, 140 bp, Artificial Sequence
  Synthetic
caccgctgtcccaaaaggtccttcattcttaatgaagggttcttttcaattcttgatgtattgaattttcttattatgttatattgatctactgttgtttgtttcagtactgttttggctcatatcagcagccagggcct

SEQ ID NO: 421265 - DNA, 140 bp, Artificial Sequence
  Synthetic
aggccctggctgctgatatgaaacagaatccccttggaatacaagggaatacaacttaaaacaaatgctgaagacataggaaccaaaggccaaatgtgctcaatagcagcagttacctgggaccttttgggacagcggtg

SEQ ID NO: 421266 - DNA, 140 bp, Artificial Sequence
  Synthetic
caccgctgtcccaaaaggtcccaggtaactgctgctattgagcacatttggcctttggttcctatgtcttcagcatttgttttaagttgtattcccttgtattccaaggggattctgtttcatatcagcagccagggcct

SEQ ID NO: 421267 - DNA, 140 bp, Artificial Sequence
  Synthetic
atacgccatgctgggtctcccgaaagcttttttctcagaaagatgagacttgacaatgccacttggggccgaataacttttggcccagttgaaagagtaagaaaaagggtactgctaaaccgtacttgggagtcggccat

SEQ ID NO: 421268 - DNA, 140 bp, Artificial Sequence
  Synthetic
atggccgactcccaagtacggtttagcagtaccctttttcttactctttcaactgggccaaaagttattcggccccaagtggcattgtcaagtctcatctttctgagaaaaaagctttcgggagacccagcatggcgtat

SEQ ID NO: 421269 - DNA, 140 bp, Artificial Sequence
  Synthetic
atacgccatgctgggtctccaatattgttccctaaagaagcaggaataccaagagaatctacttggatacatagggaactgataaaagaaaaaagagaaaaattgaaaggaacgatgatacgtacttgggagtcggccat

SEQ ID NO: 421270 - DNA, 140 bp, Artificial Sequence
  Synthetic
atggccgactcccaagtacgtatcatcgttcctttcaatttttctcttttttcttttatcagttccctatgtatccaagtagattctcttggtattcctgcttctttagggaacaatattggagacccagcatggcgtat

SEQ ID NO: 421271 - DNA, 140 bp, Artificial Sequence
  Synthetic
atacgccatgctgggtctccaaggttcctgcccgtggcaggagcaacatcagctgagttcatagaaatgctacactgcttacaaggtgaaaattggaggcaaatatatcacccgggagggcgtacttgggagtcggccat

SEQ ID NO: 421272 - DNA, 140 bp, Artificial Sequence
  Synthetic
atggccgactcccaagtacgccctcccgggtgatatatttgcctccaattttcaccttgtaagcagtgtagcatttctatgaactcagctgatgttgctcctgccacgggcaggaaccttggagacccagcatggcgtat

SEQ ID NO: 421273 - DNA, 140 bp, Artificial Sequence
  Synthetic
atacgccatgctgggtctccgataatcagaagatcaatagtcgcatcaaacccattggagctagctgtagaaattgcaaataagaccgtgatagatactgagcctttaaaatcatgtctgcgtacttgggagtcggccat

SEQ ID NO: 421274 - DNA, 140 bp, Artificial Sequence
  Synthetic
atggccgactcccaagtacgcagacatgattttaaaggctcagtatctatcacggtcttatttgcaatttctacagctagctccaatgggtttgatgcgactattgatcttctgattatcggagacccagcatggcgtat

SEQ ID NO: 421275 - DNA, 140 bp, Artificial Sequence
  Synthetic
aggccctggctgctgatatgaaattgcaaataagaccgtgatagatactgagcctttaaaatcatgtctgacagccatagacggaggtgatgtcgcctgtgacataataagagctgcattgaccttttgggacagcggtg

SEQ ID NO: 421276 - DNA, 140 bp, Artificial Sequence
  Synthetic
caccgctgtcccaaaaggtcaatgcagctcttattatgtcacaggcgacatcacctccgtctatggctgtcagacatgattttaaaggctcagtatctatcacggtcttatttgcaatttcatatcagcagccagggcct

SEQ ID NO: 421277 - DNA, 140 bp, Artificial Sequence
  Synthetic
atacgccatgctgggtctccgaatatcaggaagaggattcaaaaatgatgaagaaatattaatcgggaacggaacaatacagaagattggaatatgggacggagaagaggagttccatgtcgtacttgggagtcggccat

SEQ ID NO: 421278 - DNA, 140 bp, Artificial Sequence
  Synthetic
atggccgactcccaagtacgacatggaactcctcttctccgtcccatattccaatcttctgtattgttccgttcccgattaatatttcttcatcatttttgaatcctcttcctgatattcggagacccagcatggcgtat

SEQ ID NO: 421279 - DNA, 140 bp, Artificial Sequence
  Synthetic
aggccctggctgctgatatgggaacaatacagaagattggaatatgggacggagaagaggagttccatgtgagatgtggtgaatgcaggggaatattaaaaaagagcaaaatgagaatgggaccttttgggacagcggtg

SEQ ID NO: 421280 - DNA, 140 bp, Artificial Sequence
  Synthetic
caccgctgtcccaaaaggtcccattctcattttgctcttttttaatattcccctgcattcaccacatctcacatggaactcctcttctccgtcccatattccaatcttctgtattgttcccatatcagcagccagggcct

SEQ ID NO: 421281 - DNA, 140 bp, Artificial Sequence
  Synthetic
atacgccatgctgggtctccattttgtgcatggtattttcccaagacactaggatgttccaaggagtgaggggtgaaataaattttcttaatagagcaggccaacttttatctccaatgtcgtacttgggagtcggccat

SEQ ID NO: 421282 - DNA, 140 bp, Artificial Sequence
  Synthetic
atggccgactcccaagtacgacattggagataaaagttggcctgctctattaagaaaatttatttcacccctcactccttggaacatcctagtgtcttgggaaaataccatgcacaaaatggagacccagcatggcgtat

SEQ ID NO: 421283 - DNA, 140 bp, Artificial Sequence
  Synthetic
aggccctggctgctgatatggggtgaaataaattttcttaatagagcaggccaacttttatctccaatgtatcaactccaaagatattttttgagtagaagtaacgatctctttgatcaagaccttttgggacagcggtg

SEQ ID NO: 421284 - DNA, 140 bp, Artificial Sequence
  Synthetic
caccgctgtcccaaaaggtcttgatcaaagagatcgttacttctactcaaaaaatatctttggagttgatacattggagataaaagttggcctgctctattaagaaaatttatttcaccccatatcagcagccagggcct

SEQ ID NO: 421285 - DNA, 140 bp, Artificial Sequence
  Synthetic
atacgccatgctgggtctccatgagtcttctaactgaggtcgaaacgtacgttctctctatcatcccgtcaggccccctcaaagccgagatagcgcagaaacttgaggatgtctttgcagcgtacttgggagtcggccat

SEQ ID NO: 421286 - DNA, 140 bp, Artificial Sequence
  Synthetic
atggccgactcccaagtacgctgcaaagacatcctcaagtttctgcgctatctcggctttgagggggcctgacgggatgatagagagaacgtacgtttcgacctcagttagaagactcatggagacccagcatggcgtat

SEQ ID NO: 421287 - DNA, 140 bp, Artificial Sequence
  Synthetic
atacgccatgctgggtctccactaatgaatgcatctgactacactttgaaaggagttgtagtaacaaaaaatgtaattgatgattttagttctactgaaacagaaaaagtatctataacacgtacttgggagtcggccat

SEQ ID NO: 421288 - DNA, 140 bp, Artificial Sequence
  Synthetic
atggccgactcccaagtacgtgttatagatactttttctgtttcagtagaactaaaatcatcaattacattttttgttactacaactcctttcaaagtgtagtcagatgcattcattagtggagacccagcatggcgtat

SEQ ID NO: 421289 - DNA, 140 bp, Artificial Sequence
  Synthetic
aggccctggctgctgatatgttgaaataatcgaagggagagaccgaacaatggcctggacagtggtgaatagtatctgcaacaccacgggagtcgaaaaacccaaatttctcccggatctgaccttttgggacagcggtg

SEQ ID NO: 421290 - DNA, 140 bp, Artificial Sequence
  Synthetic
caccgctgtcccaaaaggtcagatccgggagaaatttgggtttttcgactcccgtggtgttgcagatactattcaccactgtccaggccattgttcggtctctcccttcgattatttcaacatatcagcagccagggcct

SEQ ID NO: 421291 - DNA, 140 bp, Artificial Sequence
  Synthetic
atacgccatgctgggtctcctatcaatgggtgctgaaaaatttggtaacactaaaggctcagtttcttctagggaaagaagacatgttccaatgggatgcatttgaagcatttgaaagcacgtacttgggagtcggccat

SEQ ID NO: 421292 - DNA, 140 bp, Artificial Sequence
  Synthetic
atggccgactcccaagtacgtgctttcaaatgcttcaaatgcatcccattggaacatgtcttctttccctagaagaaactgagcctttagtgttaccaaatttttcagcacccattgataggagacccagcatggcgtat

SEQ ID NO: 421293 - DNA, 140 bp, Artificial Sequence
  Synthetic
atacgccatgctgggtctccctcaaacaaatgagagaccaagaggtcatgaaaactgaccagttcataaagttgttgcccttttgtttctcaccaccaaagttaaggagtaatggggagccgtacttgggagtcggccat

SEQ ID NO: 421294 - DNA, 140 bp, Artificial Sequence
  Synthetic
atggccgactcccaagtacggctccccattactccttaactttggtggtgagaaacaaaagggcaacaactttatgaactggtcagttttcatgacctcttggtctctcatttgtttgagggagacccagcatggcgtat

SEQ ID NO: 421295 - DNA, 140 bp, Artificial Sequence
  Synthetic
atacgccatgctgggtctccgaagtaaggaaagggtctcctctattctcttacaatccacaaacagaagtcctaactatatgcggcagaatgatgtcattaaaagggaaaattgaagatgcgtacttgggagtcggccat

SEQ ID NO: 421296 - DNA, 140 bp, Artificial Sequence
  Synthetic
atggccgactcccaagtacgcatcttcaattttcccttttaatgacatcattctgccgcatatagttaggacttctgtttgtggattgtaagagaatagaggagaccctttccttacttcggagacccagcatggcgtat

SEQ ID NO: 421297 - DNA, 140 bp, Artificial Sequence
  Synthetic
atacgccatgctgggtctccataaagaaattgagtctgtaaacaatgctgtagtaatgccagcccatggtccggccaaaagtatggaatatgatgccgttgcaactacacactcctggatcgtacttgggagtcggccat

SEQ ID NO: 421298 - DNA, 140 bp, Artificial Sequence
  Synthetic
atggccgactcccaagtacgatccaggagtgtgtagttgcaacggcatcatattccatacttttggccggaccatgggctggcattactacagcattgtttacagactcaatttctttatggagacccagcatggcgtat

SEQ ID NO: 421299 - DNA, 140 bp, Artificial Sequence
  Synthetic
atacgccatgctgggtctccagtggcaagtatgacccagatcttggagatttcaaaaccattgaagaacttgaaaagttgaaaccaggggagaaagcaaacatcttactttatcaaggaacgtacttgggagtcggccat

SEQ ID NO: 421300 - DNA, 140 bp, Artificial Sequence
  Synthetic
atggccgactcccaagtacgttccttgataaagtaagatgtttgctttctcccctggtttcaacttttcaagttcttcaatggttttgaaatctccaagatctgggtcatacttgccactggagacccagcatggcgtat

SEQ ID NO: 421301 - DNA, 140 bp, Artificial Sequence
  Synthetic
atacgccatgctgggtctccagcccgttaaagtagttaaaaggaaaagatatagtgctttatccaatgacatttcacaaggaattaagaggcaaagaatgacagttgagtccatggggtgcgtacttgggagtcggccat

SEQ ID NO: 421302 - DNA, 140 bp, Artificial Sequence
  Synthetic
atggccgactcccaagtacgcaccccatggactcaactgtcattctttgcctcttaattccttgtgaaatgtcattggataaagcactatatcttttccttttaactactttaacgggctggagacccagcatggcgtat

SEQ ID NO: 421303 - DNA, 140 bp, Artificial Sequence
  Synthetic
atacgccatgctgggtctccaactgatggatgaagattaccagggtagactttgtaatcccctgaacccctttgtcagtcataaggaaattgagtccgtaaacaatgctgtagtgatgcccgtacttgggagtcggccat

SEQ ID NO: 421304 - DNA, 140 bp, Artificial Sequence
  Synthetic
atggccgactcccaagtacgggcatcactacagcattgtttacggactcaatttccttatgactgacaaaggggttcaggggattacaaagtctaccctggtaatcttcatccatcagttggagacccagcatggcgtat

SEQ ID NO: 421305 - DNA, 140 bp, Artificial Sequence
  Synthetic
atacgccatgctgggtctccatgaatataaatccttattttctattcatagatgtacccatacaggcagcaatttcaacaacattcccatacaccggtgttcccccttattcccatggaacgtacttgggagtcggccat

SEQ ID NO: 421306 - DNA, 140 bp, Artificial Sequence
  Synthetic
atggccgactcccaagtacgttccatgggaataagggggaacaccggtgtatgggaatgttgttgaaattgctgcctgtatgggtacatctatgaatagaaaataaggatttatattcatggagacccagcatggcgtat

SEQ ID NO: 421307 - DNA, 140 bp, Artificial Sequence
  Synthetic
atacgccatgctgggtctcctccaacaaatgggccattacctgaagacaatgagccaagtgcctatgcacaattagattgcgttctggaggctttggatagaatggatgaggaacatccacgtacttgggagtcggccat

SEQ ID NO: 421308 - DNA, 140 bp, Artificial Sequence
  Synthetic
atggccgactcccaagtacgtggatgttcctcatccattctatccaaagcctccagaacgcaatctaattgtgcataggcacttggctcattgtcttcaggtaatggcccatttgttggaggagacccagcatggcgtat

SEQ ID NO: 421309 - DNA, 140 bp, Artificial Sequence
  Synthetic
atacgccatgctgggtctccatttcagagctccgctgccattgtgccctttcagagggttcttcccgtttcacaaggacaatgctctgaggctggctgagaacaaagatgtattggtgaccgtacttgggagtcggccat

SEQ ID NO: 421310 - DNA, 140 bp, Artificial Sequence
  Synthetic
atggccgactcccaagtacggtcaccaatacatctttgttctcagccagcctcagagcattgtccttgtgaaacgggaagaaccctctgaaagggcacaatggcagcggagctctgaaatggagacccagcatggcgtat

SEQ ID NO: 421311 - DNA, 140 bp, Artificial Sequence
  Synthetic
aggccctggctgctgatatgaactcaaggtttgagtctgttgcttggtcagcaagtgcttgccatgatggcaccagttggttgacaattggaatttctggaccagacaatggggctgtgggaccttttgggacagcggtg

SEQ ID NO: 421312 - DNA, 140 bp, Artificial Sequence
  Synthetic
caccgctgtcccaaaaggtcccacagccccattgtctggtccagaaattccaattgtcaaccaactggtgccatcatggcaagcacttgctgaccaagcaacagactcaaaccttgagttcatatcagcagccagggcct

SEQ ID NO: 421313 - DNA, 140 bp, Artificial Sequence
  Synthetic
atacgccatgctgggtctccccaagatatcattgattcattagacaagcctgaaatgaccttcttctcagtaaagaatataaagaaaaaattgcctgcaaaaaacagaaagggtttcctccgtacttgggagtcggccat

SEQ ID NO: 421314 - DNA, 140 bp, Artificial Sequence
  Synthetic
atggccgactcccaagtacggaggaaaccctttctgttttttgcaggcaattttttctttatattctttactgagaagaaggtcatttcaggcttgtctaatgaatcaatgatatcttggggagacccagcatggcgtat

SEQ ID NO: 421315 - DNA, 140 bp, Artificial Sequence
  Synthetic
aggccctggctgctgatatgtaaagaatataaagaaaaaattgcctgcaaaaaacagaaagggtttcctcataaagagaataccaatgaaagtaaaagacaggatatccagagtggaatagaccttttgggacagcggtg

SEQ ID NO: 421316 - DNA, 140 bp, Artificial Sequence
  Synthetic
caccgctgtcccaaaaggtctattccactctggatatcctgtcttttactttcattggtattctctttatgaggaaaccctttctgttttttgcaggcaattttttctttatattctttacatatcagcagccagggcct

SEQ ID NO: 421317 - DNA, 140 bp, Artificial Sequence
  Synthetic
atacgccatgctgggtctccatggatgtcaatccgactttacttttcttaaaagtgccagctcaaaatgctataagtaccacattcccttatactggagatcccccatacagccatggaacgtacttgggagtcggccat

SEQ ID NO: 421318 - DNA, 140 bp, Artificial Sequence
  Synthetic
atggccgactcccaagtacgttccatggctgtatgggggatctccagtataagggaatgtggtacttatagcattttgagctggcacttttaagaaaagtaaagtcggattgacatccatggagacccagcatggcgtat

SEQ ID NO: 421319 - DNA, 140 bp, Artificial Sequence
  Synthetic
atacgccatgctgggtctcctctctttgcatcaaaatggaccaggcaataatggataaaaacatcatattgaaagcaaatttcagtgtaatttttaaccggctggaagctctaatactaccgtacttgggagtcggccat

SEQ ID NO: 421320 - DNA, 140 bp, Artificial Sequence
  Synthetic
atggccgactcccaagtacggtagtattagagcttccagccggttaaaaattacactgaaatttgctttcaatatgatgtttttatccattattgcctggtccattttgatgcaaagagaggagacccagcatggcgtat

SEQ ID NO: 421321 - DNA, 140 bp, Artificial Sequence
  Synthetic
aggccctggctgctgatatgaggaatgacgatgttgaccaaagcctaattattgcggccaggaacatagtaagaagagccgcagtatcagcagatccactagcatctttattggagatgtgaccttttgggacagcggtg

SEQ ID NO: 421322 - DNA, 140 bp, Artificial Sequence
  Synthetic
caccgctgtcccaaaaggtcacatctccaataaagatgctagtggatctgctgatactgcggctcttcttactatgttcctggccgcaataattaggctttggtcaacatcgtcattcctcatatcagcagccagggcct

SEQ ID NO: 421323 - DNA, 140 bp, Artificial Sequence
  Synthetic
aggccctggctgctgatatgtatctttcaatcagaatttggagtatcaaataggatatatatgcagtggagttttcggagacaatccacgccccaatgatggaacaggtagttgtggcccgaccttttgggacagcggtg

SEQ ID NO: 421324 - DNA, 140 bp, Artificial Sequence
  Synthetic
caccgctgtcccaaaaggtcgggccacaactacctgttccatcattggggcgtggattgtctccgaaaactccactgcatatatatcctatttgatactccaaattctgattgaaagatacatatcagcagccagggcct

SEQ ID NO: 421325 - DNA, 140 bp, Artificial Sequence
  Synthetic
atacgccatgctgggtctccacagtaacaggagacaatactaaatggaatgaatgcttaaatccacgaatctttttggctatgactgaaagaataaccagagacagcccaatttggttcccgtacttgggagtcggccat

SEQ ID NO: 421326 - DNA, 140 bp, Artificial Sequence
  Synthetic
atggccgactcccaagtacgggaaccaaattgggctgtctctggttattctttcagtcatagccaaaaagattcgtggatttaagcattcattccatttagtattgtctcctgttactgtggagacccagcatggcgtat

SEQ ID NO: 421327 - DNA, 140 bp, Artificial Sequence
  Synthetic
aggccctggctgctgatatgctttttggctatgactgaaagaataaccagagacagcccaatttggttccgggatttttgtagtatagcaccggtcttgttctccaacaaaatagccagagaccttttgggacagcggtg

SEQ ID NO: 421328 - DNA, 140 bp, Artificial Sequence
  Synthetic
caccgctgtcccaaaaggtctctggctattttgttggagaacaagaccggtgctatactacaaaaatcccggaaccaaattgggctgtctctggttattctttcagtcatagccaaaaagcatatcagcagccagggcct

SEQ ID NO: 421329 - DNA, 140 bp, Artificial Sequence
  Synthetic
atacgccatgctgggtctccaataccttgtcctgatctgttcagcataccattagaaagatataatgaagaaacaagggcgaaattaaaaaggctgaaaccattcttcaatgaagaaggacgtacttgggagtcggccat

SEQ ID NO: 421330 - DNA, 140 bp, Artificial Sequence
  Synthetic
atggccgactcccaagtacgtccttcttcattgaagaatggtttcagcctttttaatttcgcccttgtttcttcattatatctttctaatggtatgctgaacagatcaggacaaggtattggagacccagcatggcgtat

SEQ ID NO: 421331 - DNA, 140 bp, Artificial Sequence
  Synthetic
atacgccatgctgggtctccacagcatctttgtcgcctgggatgatgatgggaatgtttaatatgctatctaccgtgttgggagtagcagcactaggcatcaaaaacattggaaacaaggcgtacttgggagtcggccat

SEQ ID NO: 421332 - DNA, 140 bp, Artificial Sequence
  Synthetic
atggccgactcccaagtacgccttgtttccaatgtttttgatgcctagtgctgctactcccaacacggtagatagcatattaaacattcccatcatcatcccaggcgacaaagatgctgtggagacccagcatggcgtat

SEQ ID NO: 421333 - DNA, 140 bp, Artificial Sequence
  Synthetic
aggccctggctgctgatatgagaacctggttggtattcctttggcttcgaaataaaagataagaaatgtgatgtcccctgtattgggatagaaatggtacatgatggtgggaaaacgactgaccttttgggacagcggtg

SEQ ID NO: 421334 - DNA, 140 bp, Artificial Sequence
  Synthetic
caccgctgtcccaaaaggtcagtcgttttcccaccatcatgtaccatttctatcccaatacaggggacatcacatttcttatcttttatttcgaagccaaaggaataccaaccaggttctcatatcagcagccagggcct

SEQ ID NO: 421335 - DNA, 140 bp, Artificial Sequence
  Synthetic
aggccctggctgctgatatgaacatgtaaattattgggaataaacatgagcaaaaagaaaagttactgtaacgaaactggaatgtttgaatttacaagcatgttctatagagatggatttgaccttttgggacagcggtg

SEQ ID NO: 421336 - DNA, 140 bp, Artificial Sequence
  Synthetic
caccgctgtcccaaaaggtcaaatccatctctatagaacatgcttgtaaattcaaacattccagtttcgttacagtaacttttctttttgctcatgtttattcccaataatttacatgttcatatcagcagccagggcct

SEQ ID NO: 421337 - DNA, 140 bp, Artificial Sequence
  Synthetic
atacgccatgctgggtctccgaggatttggcgtcaagcgaacaatggagaggacgcaactgctggtcttacccacctgatgatatggcattccaatctgaatgatgccacatatcagagacgtacttgggagtcggccat

SEQ ID NO: 421338 - DNA, 140 bp, Artificial Sequence
  Synthetic
atggccgactcccaagtacgtctctgatatgtggcatcattcagattggaatgccatatcatcaggtgggtaagaccagcagttgcgtcctctccattgttcgcttgacgccaaatcctcggagacccagcatggcgtat

SEQ ID NO: 421339 - DNA, 140 bp, Artificial Sequence
  Synthetic
atacgccatgctgggtctcctttttgagagttcgagaccaacgtgggaatgtattattatctcctgaggaggtcagtgaaacacagggaactgagagactgacaataacttattcatcgtcgtacttgggagtcggccat

SEQ ID NO: 421340 - DNA, 140 bp, Artificial Sequence
  Synthetic
atggccgactcccaagtacgacgatgaataagttattgtcagtctctcagttccctgtgtttcactgacctcctcaggagataataatacattcccacgttggtctcgaactctcaaaaaggagacccagcatggcgtat

SEQ ID NO: 421341 - DNA, 140 bp, Artificial Sequence
  Synthetic
atacgccatgctgggtctccggaaggaaaaagaatgaaaattataaaagagctatgggaaaacactaaaggaagagatggtctgttagtagcagatggtgggcccaacatttacaatttgcgtacttgggagtcggccat

SEQ ID NO: 421342 - DNA, 140 bp, Artificial Sequence
  Synthetic
atggccgactcccaagtacgcaaattgtaaatgttgggcccaccatctgctactaacagaccatctcttcctttagtgttttcccatagctcttttataattttcattctttttccttccggagacccagcatggcgtat

SEQ ID NO: 421343 - DNA, 140 bp, Artificial Sequence
  Synthetic
aggccctggctgctgatatggccatagcactcaaattggcggaataaggatggtagacatccttagacaaaacccaacagaagaacaggcagtggacatttgtaaggcagcaatgggcctgaccttttgggacagcggtg

SEQ ID NO: 421344 - DNA, 140 bp, Artificial Sequence
  Synthetic
caccgctgtcccaaaaggtcaggcccattgctgccttacaaatgtccactgcctgttcttctgttgggttttgtctaaggatgtctaccatccttattccgccaatttgagtgctatggccatatcagcagccagggcct

SEQ ID NO: 421345 - DNA, 140 bp, Artificial Sequence
  Synthetic
atacgccatgctgggtctccatgaagaccatcattgctttgagctacattctatgtctagtttttgctcaagaacttcctggaaatgacgacagcacggcaacgctgtgccttgggcacccgtacttgggagtcggccat

SEQ ID NO: 421346 - DNA, 140 bp, Artificial Sequence
  Synthetic
atggccgactcccaagtacgggtgcccaaggcacagcgttgccgtgctgtcgtcatttccaggaagttcttgagcaaaaactagacatagaatgtagctcaaagcaatgatggtcttcatggagacccagcatggcgtat

SEQ ID NO: 421347 - DNA, 140 bp, Artificial Sequence
  Synthetic
atacgccatgctgggtctcccaaaaggaacagatctatactaaatactgatcagaggaacatgattcttgaagaacaatgctatgctaaatgttgcaatctttttgaggcctgttttaaccgtacttgggagtcggccat

SEQ ID NO: 421348 - DNA, 140 bp, Artificial Sequence
  Synthetic
atggccgactcccaagtacggttaaaacaggcctcaaaaagattgcaacatttagcatagcattgttcttcaagaatcatgttcctctgatcagtatttagtatagatctgttccttttgggagacccagcatggcgtat

SEQ ID NO: 421349 - DNA, 140 bp, Artificial Sequence
  Synthetic
aggccctggctgctgatatgggcccatagattgagaatggatgcacgactggattatgaatcaggaagaatgtcaaaggatgattttgaaaaagcaatggctcaccttggtgagattggggaccttttgggacagcggtg

SEQ ID NO: 421350 - DNA, 140 bp, Artificial Sequence
  Synthetic
caccgctgtcccaaaaggtccccaatctcaccaaggtgagccattgctttttcaaaatcatcctttgacattcttcctgattcataatccagtcgtgcatccattctcaatctatgggcccatatcagcagccagggcct

SEQ ID NO: 421351 - DNA, 140 bp, Artificial Sequence
  Synthetic
aggccctggctgctgatatggtgacatggtggaataggaatggaccaacaacaagtacagtccactacccaaaggtatacaaaacttatttcgaaaaagttgaaaggttgaaacacgggagaccttttgggacagcggtg

SEQ ID NO: 421352 - DNA, 140 bp, Artificial Sequence
  Synthetic
caccgctgtcccaaaaggtctcccgtgtttcaacctttcaactttttcgaaataagttttgtatacctttgggtagtggactgtacttgttgttggtccattcctattccaccatgtcaccatatcagcagccagggcct

SEQ ID NO: 421353 - DNA, 140 bp, Artificial Sequence
  Synthetic
atacgccatgctgggtctccatgtcgctgtttggagacacaattgcctacctgctttcattgacagaagatggagaaggcaaagcagaactagcggaaaaattacactgttggttcggtgcgtacttgggagtcggccat

SEQ ID NO: 421354 - DNA, 140 bp, Artificial Sequence
  Synthetic
atggccgactcccaagtacgcaccgaaccaacagtgtaatttttccgctagttctgctttgccttctccatcttctgtcaatgaaagcaggtaggcaattgtgtctccaaacagcgacatggagacccagcatggcgtat

SEQ ID NO: 421355 - DNA, 140 bp, Artificial Sequence
  Synthetic
aggccctggctgctgatatggatttgaatggaatgataacacagttcaaatctctgaaactctacagagattcgcttggagaagcagtaatgaggatgggggatctccattcccttcaaagaccttttgggacagcggtg

SEQ ID NO: 421356 - DNA, 140 bp, Artificial Sequence
  Synthetic
caccgctgtcccaaaaggtctttgaagggaatggagatcccccatcctcattactgcttctccaagcgaatctctgtagagtttcagagatttgaactgtgttatcattccattcaaatccatatcagcagccagggcct

SEQ ID NO: 421357 - DNA, 140 bp, Artificial Sequence
  Synthetic
atacgccatgctgggtctccaaaacccaaagaccaggaaagaaaaagaagattcatcacagagcccttatcgggaatgggaacaacagcaacaaaaaagaagggcctgattctggctgagcgtacttgggagtcggccat

SEQ ID NO: 421358 - DNA, 140 bp, Artificial Sequence
  Synthetic
atggccgactcccaagtacgctcagccagaatcaggcccttcttttttgttgctgttgttcccattcccgataagggctctgtgatgaatcttctttttctttcctggtctttgggttttggagacccagcatggcgtat

SEQ ID NO: 421359 - DNA, 140 bp, Artificial Sequence
  Synthetic
atacgccatgctgggtctccatggagaaaatagtgcttctttttgcagcaattagccttgttaaaagcgatcatatttgcattggttatcatgcaaataactcgacaaagcaggttgacacgtacttgggagtcggccat

SEQ ID NO: 421360 - DNA, 140 bp, Artificial Sequence
  Synthetic
atggccgactcccaagtacgtgtcaacctgctttgtcgagttatttgcatgataaccaatgcaaatatgatcgcttttaacaaggctaattgctgcaaaaagaagcactattttctccatggagacccagcatggcgtat

SEQ ID NO: 421361 - DNA, 140 bp, Artificial Sequence
  Synthetic
atacgccatgctgggtctccaggccatgaaagctcagcgctactatattgtctcatggtcatgtacctgaatcctggaaattattcaatgcaagtaaaactaggaacgctctgtgctttgcgtacttgggagtcggccat

SEQ ID NO: 421362 - DNA, 140 bp, Artificial Sequence
  Synthetic
atggccgactcccaagtacgcaaagcacagagcgttcctagttttacttgcattgaataatttccaggattcaggtacatgaccatgagacaatatagtagcgctgagctttcatggcctggagacccagcatggcgtat

SEQ ID NO: 421363 - DNA, 140 bp, Artificial Sequence
  Synthetic
atacgccatgctgggtctcctgttcataccagggaaattcctccttcttcagaaatgtggtatggcttatcaaaaaggacaatgcatacccaacaataaagaaaagctacaataataccacgtacttgggagtcggccat

SEQ ID NO: 421364 - DNA, 140 bp, Artificial Sequence
  Synthetic
atggccgactcccaagtacgtggtattattgtagcttttctttattgttgggtatgcattgtcctttttgataagccataccacatttctgaagaaggaggaatttccctggtatgaacaggagacccagcatggcgtat

SEQ ID NO: 421365 - DNA, 140 bp, Artificial Sequence
  Synthetic
aggccctggctgctgatatgttgaaccattccagattctttcaatttgttcttttattttatcagctctccatttcatggcttggacaataggacatttaaatcaaataaaaagaggagtgaccttttgggacagcggtg

SEQ ID NO: 421366 - DNA, 140 bp, Artificial Sequence
  Synthetic
caccgctgtcccaaaaggtcactcctctttttatttgatttaaatgtcctattgtccaagccatgaaatggagagctgataaaataaaagaacaaattgaaagaatctggaatggttcaacatatcagcagccagggcct

SEQ ID NO: 421367 - DNA, 140 bp, Artificial Sequence
  Synthetic
atacgccatgctgggtctccaaaagctgactataacatattcatcgtccatgatgtgggagatcaatggtccggaatcagtgctagttaacacatatcaatggatcattagaaattgggacgtacttgggagtcggccat

SEQ ID NO: 421368 - DNA, 140 bp, Artificial Sequence
  Synthetic
atggccgactcccaagtacgtcccaatttctaatgatccattgatatgtgttaactagcactgattccggaccattgatctcccacatcatggacgatgaatatgttatagtcagcttttggagacccagcatggcgtat

SEQ ID NO: 421369 - DNA, 140 bp, Artificial Sequence
  Synthetic
atacgccatgctgggtctccgcaatgaaggaagtactctctgacaacatggaagtattgagtgaccacatagtaattgaggggctttctgctgaagagataataaaaatgggtgaaacagcgtacttgggagtcggccat

SEQ ID NO: 421370 - DNA, 140 bp, Artificial Sequence
  Synthetic
atggccgactcccaagtacgctgtttcacccatttttattatctcttcagcagaaagcccctcaattactatgtggtcactcaatacttccatgttgtcagagagtacttccttcattgcggagacccagcatggcgtat

SEQ ID NO: 421371 - DNA, 140 bp, Artificial Sequence
  Synthetic
aggccctggctgctgatatggggtgaaacagttttggaggtagaagaattgcattaaattcaattttactgtacttcttactatgcatttaagcaaattgtaaccaatgtcagcaaataagaccttttgggacagcggtg

SEQ ID NO: 421372 - DNA, 140 bp, Artificial Sequence
  Synthetic
caccgctgtcccaaaaggtcttatttgctgacattggttacaatttgcttaaatgcatagtaagaagtacagtaaaattgaatttaatgcaattcttctacctccaaaactgtttcaccccatatcagcagccagggcct

SEQ ID NO: 421373 - DNA, 140 bp, Artificial Sequence
  Synthetic
atacgccatgctgggtctccatgaacaatgctaccctcaactatacaaacgttaaccctatttctcacatcagggggagtattattatcactatatgtgtcagcttcattgtcatacttacgtacttgggagtcggccat

SEQ ID NO: 421374 - DNA, 140 bp, Artificial Sequence
  Synthetic
atggccgactcccaagtacgtaagtatgacaatgaagctgacacatatagtgataataatactccccctgatgtgagaaatagggttaacgtttgtatagttgagggtagcattgttcatggagacccagcatggcgtat

SEQ ID NO: 421375 - DNA, 140 bp, Artificial Sequence
  Synthetic
atacgccatgctgggtctcctacagagaacagcttcgaacaaataacgtttatgcaagccttacaactattgcttgaagtggagcaagagataagaactttctcgtttcagcttatttaacgtacttgggagtcggccat

SEQ ID NO: 421376 - DNA, 140 bp, Artificial Sequence
  Synthetic
atggccgactcccaagtacgttaaataagctgaaacgagaaagttcttatctcttgctccacttcaagcaatagttgtaaggcttgcataaacgttatttgttcgaagctgttctctgtaggagacccagcatggcgtat

SEQ ID NO: 421377 - DNA, 140 bp, Artificial Sequence
  Synthetic
aggccctggctgctgatatggttctgcaacaaaaggggtgacacttcttctcccagaaccggagtggacatacccacgtttatcttgcccgggctcaacctttcagaaagcactcctaatgaccttttgggacagcggtg

SEQ ID NO: 421378 - DNA, 140 bp, Artificial Sequence
  Synthetic
caccgctgtcccaaaaggtcattaggagtgctttctgaaaggttgagcccgggcaagataaacgtgggtatgtccactccggttctgggagaagaagtgtcaccccttttgttgcagaaccatatcagcagccagggcct

SEQ ID NO: 421379 - DNA, 140 bp, Artificial Sequence
  Synthetic
atacgccatgctgggtctcctagccctcatagattcggagaaaccaaaggaaactcagctcccttgataataagggaaccttttattgcttgtggaccaaaggaatgcaaacactttgctcgtacttgggagtcggccat

SEQ ID NO: 421380 - DNA, 140 bp, Artificial Sequence
  Synthetic
atggccgactcccaagtacgagcaaagtgtttgcattcctttggtccacaagcaataaaaggttcccttattatcaagggagctgagtttcctttggtttctccgaatctatgagggctaggagacccagcatggcgtat

SEQ ID NO: 421381 - DNA, 140 bp, Artificial Sequence
  Synthetic
aggccctggctgctgatatgaggaatgatgatgtcgaccaaagtttgatcatcgctgccagaaacattgttaggagagcaacagtatcggcagatccactggcatcactactggaaatgtgaccttttgggacagcggtg

SEQ ID NO: 421382 - DNA, 140 bp, Artificial Sequence
  Synthetic
caccgctgtcccaaaaggtcacatttccagtagtgatgccagtggatctgccgatactgttgctctcctaacaatgtttctggcagcgatgatcaaactttggtcgacatcatcattcctcatatcagcagccagggcct

SEQ ID NO: 421383 - DNA, 140 bp, Artificial Sequence
  Synthetic
atacgccatgctgggtctcccttagagaggagaatagagaatttgaacaagaagatggaagacggattcctagatgtctggacttataatgctgagcttctggttctcatggaaaatgagcgtacttgggagtcggccat

SEQ ID NO: 421384 - DNA, 140 bp, Artificial Sequence
  Synthetic
atggccgactcccaagtacgctcattttccatgagaaccagaagctcagcattataagtccagacatctaggaatccgtcttccatcttcttgttcaaattctctattctcctctctaagggagacccagcatggcgtat

SEQ ID NO: 421385 - DNA, 140 bp, Artificial Sequence
  Synthetic
atacgccatgctgggtctccagacagaaacaagctgaggcatctaatttcagtcaaattgggcaaaatcccaacagtagaaaactccattttccacatggcagcatggagcgggtccgcacgtacttgggagtcggccat

SEQ ID NO: 421386 - DNA, 140 bp, Artificial Sequence
  Synthetic
atggccgactcccaagtacgtgcggacccgctccatgctgccatgtggaaaatggagttttctactgttgggattttgcccaatttgactgaaattagatgcctcagcttgtttctgtctggagacccagcatggcgtat

SEQ ID NO: 421387 - DNA, 140 bp, Artificial Sequence
  Synthetic
aggccctggctgctgatatgaagtgggcacttggtgagaacatggcaccagaaaaagtggactttgaggattgcaaggatgttggcgatctaaaacagtatgatagcgatgagccagagcgaccttttgggacagcggtg

SEQ ID NO: 421388 - DNA, 140 bp, Artificial Sequence
  Synthetic
caccgctgtcccaaaaggtcgctctggctcatcgctatcatactgttttagatcgccaacatccttgcaatcctcaaagtccactttttctggtgccatgttctcaccaagtgcccacttcatatcagcagccagggcct

SEQ ID NO: 421389 - DNA, 140 bp, Artificial Sequence
  Synthetic
atacgccatgctgggtctcctaatgcattgctcaaaataaaatatggggaagcatatactgacacataccattcctatgcaaacaacatcctaagaacacaagaaagtgcctgcaattgccgtacttgggagtcggccat

SEQ ID NO: 421390 - DNA, 140 bp, Artificial Sequence
  Synthetic
atggccgactcccaagtacggcaattgcaggcactttcttgtgttcttaggatgttgtttgcataggaatggtatgtgtcagtatatgcttccccatattttattttgagcaatgcattaggagacccagcatggcgtat

SEQ ID NO: 421391 - DNA, 140 bp, Artificial Sequence
  Synthetic
aggccctggctgctgatatgattcctatgcaaacaacatcctaagaacacaagaaagtgcctgcaattgcatcggaggaaattgttatcttatgataactgatggctcagcttcaggtgtgaccttttgggacagcggtg

SEQ ID NO: 421392 - DNA, 140 bp, Artificial Sequence
  Synthetic
caccgctgtcccaaaaggtcacacctgaagctgagccatcagttatcataagataacaatttcctccgatgcaattgcaggcactttcttgtgttcttaggatgttgtttgcataggaatcatatcagcagccagggcct

SEQ ID NO: 421393 - DNA, 140 bp, Artificial Sequence
  Synthetic
atacgccatgctgggtctccaataagtggagtaaagttggaatcaataggaatttaccaaatattgtcaatttattcaacagtggcgagttccctagcactggcaatcatgatggctggtcgtacttgggagtcggccat

SEQ ID NO: 421394 - DNA, 140 bp, Artificial Sequence
  Synthetic
atggccgactcccaagtacgaccagccatcatgattgccagtgctagggaactcgccactgttgaataaattgacaatatttggtaaattcctattgattccaactttactccacttattggagacccagcatggcgtat

SEQ ID NO: 421395 - DNA, 140 bp, Artificial Sequence
  Synthetic
atacgccatgctgggtctcctttattcaacagtggcgagttccctagcactggcaatcatgatggctggtctatctttatggatgtgttccaacgggtcgttacagtgcagaatttgcatcgtacttgggagtcggccat

SEQ ID NO: 421396 - DNA, 140 bp, Artificial Sequence
  Synthetic
atggccgactcccaagtacgatgcaaattctgcactgtaacgacccgttggaacacatccataaagatagaccagccatcatgattgccagtgctagggaactcgccactgttgaataaaggagacccagcatggcgtat

SEQ ID NO: 421397 - DNA, 140 bp, Artificial Sequence
  Synthetic
atacgccatgctgggtctcctatttccaacaggaagaacacaacatactgaagaatgcacatgcggatttgctagcaataaaaccatagaatgtgcctgtagagataacagttacacagccgtacttgggagtcggccat

SEQ ID NO: 421398 - DNA, 140 bp, Artificial Sequence
  Synthetic
atggccgactcccaagtacggctgtgtaactgttatctctacaggcacattctatggttttattgctagcaaatccgcatgtgcattcttcagtatgttgtgttcttcctgttggaaataggagacccagcatggcgtat

SEQ ID NO: 421399 - DNA, 140 bp, Artificial Sequence
  Synthetic
atacgccatgctgggtctcccaagatgaaacatgggacctttatgtagagcgcagtaatgccttcagcaactgctacccatatgatgtgccagactatgcatctctcagatctctagtggcgtacttgggagtcggccat

SEQ ID NO: 421400 - DNA, 140 bp, Artificial Sequence
  Synthetic
atggccgactcccaagtacgccactagagatctgagagatgcatagtctggcacatcatatgggtagcagttgctgaaggcattactgcgctctacataaaggtcccatgtttcatcttgggagacccagcatggcgtat

SEQ ID NO: 421401 - DNA, 140 bp, Artificial Sequence
  Synthetic
atacgccatgctgggtctccagcataacagggccttgtgaatctaatggaggcaaagggagtggaggcatcaagggaggatttgtccatcaaagaatggcatccaagattgcaaggtggtcgtacttgggagtcggccat

SEQ ID NO: 421402 - DNA, 140 bp, Artificial Sequence
  Synthetic
atggccgactcccaagtacgaccaccttgcaatcttggatgccattctttgatggacaaatcctcccttgatgcctccactccctttgcctccattagattcacaaggccctgttatgctggagacccagcatggcgtat

SEQ ID NO: 421403 - DNA, 140 bp, Artificial Sequence
  Synthetic
aggccctggctgctgatatgcaagggaggatttgtccatcaaagaatggcatccaagattgcaaggtggtactctcgaacgatgtctaaaactgaaaggaaggggatggggctgtatgtcgaccttttgggacagcggtg

SEQ ID NO: 421404 - DNA, 140 bp, Artificial Sequence
  Synthetic
caccgctgtcccaaaaggtcgacatacagccccatccccttcctttcagttttagacatcgttcgagagtaccaccttgcaatcttggatgccattctttgatggacaaatcctcccttgcatatcagcagccagggcct

SEQ ID NO: 421405 - DNA, 140 bp, Artificial Sequence
  Synthetic
aggccctggctgctgatatgatgcccaagcagaaagtggtgggttccctttgcatcaaaatggaccaggcaatgatggataaaaccgtcatattgaaagcaaacttcagtgtgatttttggaccttttgggacagcggtg

SEQ ID NO: 421406 - DNA, 140 bp, Artificial Sequence
  Synthetic
caccgctgtcccaaaaggtccaaaaatcacactgaagtttgctttcaatatgacggttttatccatcattgcctggtccattttgatgcaaagggaacccaccactttctgcttgggcatcatatcagcagccagggcct

SEQ ID NO: 421407 - DNA, 140 bp, Artificial Sequence
  Synthetic
atacgccatgctgggtctcccttaataagagcattgacattgaacacaatgacaaaagatgcagaaagaggcaaattgaagaggcgggcaattgcaactcccgggatgcagatcagaggacgtacttgggagtcggccat

SEQ ID NO: 421408 - DNA, 140 bp, Artificial Sequence
  Synthetic
atggccgactcccaagtacgtcctctgatctgcatcccgggagttgcaattgcccgcctcttcaatttgcctctttctgcatcttttgtcattgtgttcaatgtcaatgctcttattaagggagacccagcatggcgtat

SEQ ID NO: 421409 - DNA, 140 bp, Artificial Sequence
  Synthetic
atacgccatgctgggtctccgatggtggaaaagagacttggcactcagcagctacagccatttactgtttaatgggctcaggacagctgctgtgggacactgtcacaggtgttaatatgacgtacttgggagtcggccat

SEQ ID NO: 421410 - DNA, 140 bp, Artificial Sequence
  Synthetic
atggccgactcccaagtacgtcatattaacacctgtgacagtgtcccacagcagctgtcctgagcccattaaacagtaaatggctgtagctgctgagtgccaagtctcttttccaccatcggagacccagcatggcgtat

SEQ ID NO: 421411 - DNA, 140 bp, Artificial Sequence
  Synthetic
aggccctggctgctgatatgaccggaagaaataacttctggaaccagtgggacaaccagaccaatcattagaccagcaacccttgccccaccaagcaacaaacgaacccgtaacccatccgaccttttgggacagcggtg

SEQ ID NO: 421412 - DNA, 140 bp, Artificial Sequence
  Synthetic
caccgctgtcccaaaaggtcggatgggttacgggttcgtttgttgcttggtggggcaagggttgctggtctaatgattggtctggttgtcccactggttccagaagttatttcttccggtcatatcagcagccagggcct

SEQ ID NO: 421413 - DNA, 140 bp, Artificial Sequence
  Synthetic
aggccctggctgctgatatgatgaagactatcattgctttgagctacattctatgtctggttttcgctcaaaaacttcctggaaatgacaatagcacggcaacgctgtgccttgggcaccgaccttttgggacagcggtg

SEQ ID NO: 421414 - DNA, 140 bp, Artificial Sequence
  Synthetic
caccgctgtcccaaaaggtcggtgcccaaggcacagcgttgccgtgctattgtcatttccaggaagtttttgagcgaaaaccagacatagaatgtagctcaaagcaatgatagtcttcatcatatcagcagccagggcct

SEQ ID NO: 421415 - DNA, 140 bp, Artificial Sequence
  Synthetic
atacgccatgctgggtctccaaagaaacagaccccgacagagataaagaagagcgtctacaacatggtggtgaaactgggcgaattctataaccagatgatggtcaaagctggactcaatcgtacttgggagtcggccat

SEQ ID NO: 421416 - DNA, 140 bp, Artificial Sequence
  Synthetic
atggccgactcccaagtacgattgagtccagctttgaccatcatctggttatagaattcgcccagtttcaccaccatgttgtagacgctcttctttatctctgtcggggtctgtttctttggagacccagcatggcgtat

SEQ ID NO: 421417 - DNA, 140 bp, Artificial Sequence
  Synthetic
atacgccatgctgggtctcctctattggctgccactgatgacaagaaaaccgagttccagaagaaaaagaatgccagagatgtcaaagaagggaaagaagaaatagatcacaacaaaacacgtacttgggagtcggccat

SEQ ID NO: 421418 - DNA, 140 bp, Artificial Sequence
  Synthetic
atggccgactcccaagtacgtgttttgttgtgatctatttcttctttcccttctttgacatctctggcattctttttcttctggaactcggttttcttgtcatcagtggcagccaatagaggagacccagcatggcgtat

SEQ ID NO: 421419 - DNA, 140 bp, Artificial Sequence
  Synthetic
aggccctggctgctgatatgatgccagagatgtcaaagaagggaaagaagaaatagatcacaacaaaacaggaggcaccttttacaagatggtaagagatgataaaaccatctacttcaggaccttttgggacagcggtg

SEQ ID NO: 421420 - DNA, 140 bp, Artificial Sequence
  Synthetic
caccgctgtcccaaaaggtcctgaagtagatggttttatcatctcttaccatcttgtaaaaggtgcctcctgttttgttgtgatctatttcttctttcccttctttgacatctctggcatcatatcagcagccagggcct

SEQ ID NO: 421421 - DNA, 140 bp, Artificial Sequence
  Synthetic
atacgccatgctgggtctccccaccatggggagtgatggcttcagtggactaaaccacataatgattgggcattcacagatgaatgatgtctgtttccaaagatcaaaggcactaaaaagcgtacttgggagtcggccat

SEQ ID NO: 421422 - DNA, 140 bp, Artificial Sequence
  Synthetic
atggccgactcccaagtacgctttttagtgcctttgatctttggaaacagacatcattcatctgtgaatgcccaatcattatgtggtttagtccactgaagccatcactccccatggtggggagacccagcatggcgtat

SEQ ID NO: 421423 - DNA, 140 bp, Artificial Sequence
  Synthetic
atacgccatgctgggtctccaatgtgtatgcagagacaattggaagggggcaaatagaccaataatcactatagatcccgaaatgatgacccacacaagcaaatacttgtgttcaaaaatcgtacttgggagtcggccat

SEQ ID NO: 421424 - DNA, 140 bp, Artificial Sequence
  Synthetic
atggccgactcccaagtacgatttttgaacacaagtatttgcttgtgtgggtcatcatttcgggatctatagtgattattggtctatttgcccccttccaattgtctctgcatacacattggagacccagcatggcgtat

SEQ ID NO: 421425 - DNA, 140 bp, Artificial Sequence
  Synthetic
aggccctggctgctgatatggtggctgaagccattcgatttataggaagagcaatggcagacagagggctattgagagacatcaaagccaagactgcctatgaaaagattcttctgaatcgaccttttgggacagcggtg

SEQ ID NO: 421426 - DNA, 140 bp, Artificial Sequence
  Synthetic
caccgctgtcccaaaaggtcgattcagaagaatcttttcataggcagtcttggctttgatgtctctcaatagccctctgtctgccattgctcttcctataaatcgaatggcttcagccaccatatcagcagccagggcct

SEQ ID NO: 421427 - DNA, 140 bp, Artificial Sequence
  Synthetic
aggccctggctgctgatatgcaagtgcgagagagcagaaatcctgggaatgctgaaattgaagatctcatctttctggcacggtctgcactcatcctgagaggatcagtggcccataagtgaccttttgggacagcggtg

SEQ ID NO: 421428 - DNA, 140 bp, Artificial Sequence
  Synthetic
caccgctgtcccaaaaggtcacttatgggccactgatcctctcaggatgagtgcagaccgtgccagaaagatgagatcttcaatttcagcattcccaggatttctgctctctcgcacttgcatatcagcagccagggcct

SEQ ID NO: 421429 - DNA, 140 bp, Artificial Sequence
  Synthetic
atacgccatgctgggtctcctgagatcagatgcacccattggcaaatgcaagtctgaatgcatcactccaaatggaagcattcccaatgacaaaccattccaaaatgtaaacaggatcaccgtacttgggagtcggccat

SEQ ID NO: 421430 - DNA, 140 bp, Artificial Sequence
  Synthetic
atggccgactcccaagtacggtgatcctgtttacattttggaatggtttgtcattgggaatgcttccatttggagtgatgcattcagacttgcatttgccaatgggtgcatctgatctcaggagacccagcatggcgtat

SEQ ID NO: 421431 - DNA, 140 bp, Artificial Sequence
  Synthetic
atacgccatgctgggtctccttcccataagcatttacgccaaaatacctcaactagggttcaatgttgaagagtactctatggttgggtacgaagccatggctctttacaatatggcaaccgtacttgggagtcggccat

SEQ ID NO: 421432 - DNA, 140 bp, Artificial Sequence
  Synthetic
atggccgactcccaagtacggttgccatattgtaaagagccatggcttcgtacccaaccatagagtactcttcaacattgaaccctagttgaggtattttggcgtaaatgcttatgggaaggagacccagcatggcgtat

SEQ ID NO: 421433 - DNA, 140 bp, Artificial Sequence
  Synthetic
atacgccatgctgggtctcctattcttcatgtcttgcttcggagctgcctatgaagacctgagagttttgtctgcattaacaggcacagaattcaagcctagatcagcattaaaatgcaacgtacttgggagtcggccat

SEQ ID NO: 421434 - DNA, 140 bp, Artificial Sequence
  Synthetic
atggccgactcccaagtacgttgcattttaatgctgatctaggcttgaattctgtgcctgttaatgcagacaaaactctcaggtcttcataggcagctccgaagcaagacatgaagaataggagacccagcatggcgtat

SEQ ID NO: 421435 - DNA, 140 bp, Artificial Sequence
  Synthetic
aggccctggctgctgatatgacaatcactggggacaataccaaatggaatgagaatcagaatcctcgtgtgtttctggcaatggtaacatacatcacaagaaaccaacctgaatggttcagaccttttgggacagcggtg

SEQ ID NO: 421436 - DNA, 140 bp, Artificial Sequence
  Synthetic
caccgctgtcccaaaaggtctgaaccattcaggttggtttcttgtgatgtatgttaccattgccagaaacacacgaggattctgattctcattccatttggtattgtccccagtgattgtcatatcagcagccagggcct

SEQ ID NO: 421437 - DNA, 140 bp, Artificial Sequence
  Synthetic
aggccctggctgctgatatgtgtgatgtgtggagttgattatgaagtcgccgattggtcgtggcacgatggagctattcttccttttgacatcgataagatgtgatttacgaaaaaaactgaccttttgggacagcggtg

SEQ ID NO: 421438 - DNA, 140 bp, Artificial Sequence
  Synthetic
caccgctgtcccaaaaggtcagtttttttcgtaaatcacatcttatcgatgtcaaaaggaagaatagctccatcgtgccacgaccaatcggcgacttcataatcaactccacacatcacacatatcagcagccagggcct

SEQ ID NO: 421439 - DNA, 140 bp, Artificial Sequence
  Synthetic
atacgccatgctgggtctcctgatgtcaatgaatattgagggacgtgatgcagatgtcaaaggaaatctactcaagatgatgaatgactcaatggctaagaaaaccagtggaaatgctttcgtacttgggagtcggccat

SEQ ID NO: 421440 - DNA, 140 bp, Artificial Sequence
  Synthetic
atggccgactcccaagtacgaaagcatttccactggttttcttagccattgagtcattcatcatcttgagtagatttcctttgacatctgcatcacgtccctcaatattcattgacatcaggagacccagcatggcgtat

SEQ ID NO: 421441 - DNA, 140 bp, Artificial Sequence
  Synthetic
aggccctggctgctgatatgttctcccagtggctggtggaacaagcagtgtctacattgaggtgctgcatttgacccaggggacatgctgggagcagatgtacactccaggaggagaagtgaccttttgggacagcggtg

SEQ ID NO: 421442 - DNA, 140 bp, Artificial Sequence
  Synthetic
caccgctgtcccaaaaggtcacttctcctcctggagtgtacatctgctcccagcatgtcccctgggtcaaatgcagcacctcaatgtagacactgcttgttccaccagccactgggagaacatatcagcagccagggcct

SEQ ID NO: 421443 - DNA, 140 bp, Artificial Sequence
  Synthetic
atacgccatgctgggtctccaaacaaaaccaatcccattgaaattccaattaagcagaccatccccagtttcttctttgggagggacacagcagaggattatgatgacctcgattattaacgtacttgggagtcggccat

SEQ ID NO: 421444 - DNA, 140 bp, Artificial Sequence
  Synthetic
atggccgactcccaagtacgttaataatcgaggtcatcataatcctctgctgtgtccctcccaaagaagaaactggggatggtctgcttaattggaatttcaatgggattggttttgtttggagacccagcatggcgtat

SEQ ID NO: 421445 - DNA, 140 bp, Artificial Sequence
  Synthetic
aggccctggctgctgatatgatgaaggcaataattgtactactcatggtagtaacatccaatgcagatcgaatctgcactgggataacatcttcaaactcacctcatgtggtcaaaacaggaccttttgggacagcggtg

SEQ ID NO: 421446 - DNA, 140 bp, Artificial Sequence
  Synthetic
caccgctgtcccaaaaggtcctgttttgaccacatgaggtgagtttgaagatgttatcccagtgcagattcgatctgcattggatgttactaccatgagtagtacaattattgccttcatcatatcagcagccagggcct

SEQ ID NO: 421447 - DNA, 140 bp, Artificial Sequence
  Synthetic
atacgccatgctgggtctccgcaaagatgttagtgatctaaagcagtatgacagtgaagaaccagagtctagatcgttggcaagctggatccagagtgagttcaacaaggcatgcgaattcgtacttgggagtcggccat

SEQ ID NO: 421448 - DNA, 140 bp, Artificial Sequence
  Synthetic
atggccgactcccaagtacgaattcgcatgccttgttgaactcactctggatccagcttgccaacgatctagactctggttcttcactgtcatactgctttagatcactaacatctttgcggagacccagcatggcgtat

SEQ ID NO: 421449 - DNA, 140 bp, Artificial Sequence
  Synthetic
atacgccatgctgggtctccccaacaaaatcttattttgcaaatctcaaaggaacaaggaccagagggaaactatgcccggactgtctcaactgtacagatctggatgtggccttgggcacgtacttgggagtcggccat

SEQ ID NO: 421450 - DNA, 140 bp, Artificial Sequence
  Synthetic
atggccgactcccaagtacgtgcccaaggccacatccagatctgtacagttgagacagtccgggcatagtttccctctggtccttgttcctttgagatttgcaaaataagattttgttggggagacccagcatggcgtat

SEQ ID NO: 421451 - DNA, 140 bp, Artificial Sequence
  Synthetic
atacgccatgctgggtctccctagacggggagaattcatggcttggaaggacaattagcaaagattccagatcaggctacgaaatgttaaaggtcccaaatgcagaaaccgacactcaatcgtacttgggagtcggccat

SEQ ID NO: 421452 - DNA, 140 bp, Artificial Sequence
  Synthetic
atggccgactcccaagtacgattgagtgtcggtttctgcatttgggacctttaacatttcgtagcctgatctggaatctttgctaattgtccttccaagccatgaattctccccgtctagggagacccagcatggcgtat

SEQ ID NO: 421453 - DNA, 140 bp, Artificial Sequence
  Synthetic
atacgccatgctgggtctccaaaaatcaggcaactacccaatcttctcagaggatatgaaaagatcaggttatcaacccaaaacgttatcgatgcagaaaaagcaccaggaggaccctaccgtacttgggagtcggccat

SEQ ID NO: 421454 - DNA, 140 bp, Artificial Sequence
  Synthetic
atggccgactcccaagtacggtagggtcctcctggtgctttttctgcatcgataacgttttgggttgataacctgatcttttcatatcctctgagaagattgggtagttgcctgatttttggagacccagcatggcgtat

SEQ ID NO: 421455 - DNA, 140 bp, Artificial Sequence
  Synthetic
atacgccatgctgggtctccagacttggaacctcaggatcttgccctaacgctaccagtaaaatcggatttttcgcaacaatggcttgggctgtcccaaaggacaactacaaaaatgcaacgtacttgggagtcggccat

SEQ ID NO: 421456 - DNA, 140 bp, Artificial Sequence
  Synthetic
atggccgactcccaagtacgttgcatttttgtagttgtcctttgggacagcccaagccattgttgcgaaaaatccgattttactggtagcgttagggcaagatcctgaggttccaagtctggagacccagcatggcgtat

SEQ ID NO: 421457 - DNA, 140 bp, Artificial Sequence
  Synthetic
aggccctggctgctgatatgatcaggctacgaaatgttaaaggtcccaaatgcagaaaccgacactcaatcagggccaacctcataccagctgattgtcaacaaccaaaattggtcaggggaccttttgggacagcggtg

SEQ ID NO: 421458 - DNA, 140 bp, Artificial Sequence
  Synthetic
caccgctgtcccaaaaggtcccctgaccaattttggttgttgacaatcagctggtatgaggttggccctgattgagtgtcggtttctgcatttgggacctttaacatttcgtagcctgatcatatcagcagccagggcct

SEQ ID NO: 421459 - DNA, 140 bp, Artificial Sequence
  Synthetic
atacgccatgctgggtctcccaaattactgtttgggggttccattcagataacaaaacccaaatgaagagcctctatggagactcaaatcctcaaaagttcacctcatctgctaatggagcgtacttgggagtcggccat

SEQ ID NO: 421460 - DNA, 140 bp, Artificial Sequence
  Synthetic
atggccgactcccaagtacgctccattagcagatgaggtgaacttttgaggatttgagtctccatagaggctcttcatttgggttttgttatctgaatggaacccccaaacagtaatttgggagacccagcatggcgtat

SEQ ID NO: 421461 - DNA, 140 bp, Artificial Sequence
  Synthetic
aggccctggctgctgatatgcctctatggagactcaaatcctcaaaagttcacctcatctgctaatggagtaaccacacattatgtttctcagattggcgacttcccagatcaaacagaagaccttttgggacagcggtg

SEQ ID NO: 421462 - DNA, 140 bp, Artificial Sequence
  Synthetic
caccgctgtcccaaaaggtcttctgtttgatctgggaagtcgccaatctgagaaacataatgtgtggttactccattagcagatgaggtgaacttttgaggatttgagtctccatagaggcatatcagcagccagggcct

SEQ ID NO: 421463 - DNA, 140 bp, Artificial Sequence
  Synthetic
aggccctggctgctgatatgccagagtctagatcgctagcaagctggatccagagtgaattcaacaaggcatgcgaattgacagattcgagttggattgaacttgatgaaataggggagggaccttttgggacagcggtg

SEQ ID NO: 421464 - DNA, 140 bp, Artificial Sequence
  Synthetic
caccgctgtcccaaaaggtccctcccctatttcatcaagttcaatccaactcgaatctgtcaattcgcatgccttgttgaattcactctggatccagcttgctagcgatctagactctggcatatcagcagccagggcct

SEQ ID NO: 421465 - DNA, 140 bp, Artificial Sequence
  Synthetic
atacgccatgctgggtctccatgaatccaaatcaaaagataataacaatcggttctgtttctctcactattacaacaatgtgcctcttcatgcagattgccatcctaataactactataacgtacttgggagtcggccat

SEQ ID NO: 421466 - DNA, 140 bp, Artificial Sequence
  Synthetic
atggccgactcccaagtacgttatagtagttattaggatggcaatctgcatgaagaggcacattgttgtaatagtgagagaaacagaaccgattgttattatcttttgatttggattcatggagacccagcatggcgtat

SEQ ID NO: 421467 - DNA, 140 bp, Artificial Sequence
  Synthetic
atacgccatgctgggtctccttgcccttaattggtgaagcagattgccttcatgaagaatacggtggattaaacaaaagcaagccttactacacaggaaaacatgcaaaagccataggaacgtacttgggagtcggccat

SEQ ID NO: 421468 - DNA, 140 bp, Artificial Sequence
  Synthetic
atggccgactcccaagtacgttcctatggcttttgcatgttttcctgtgtagtaaggcttgcttttgtttaatccaccgtattcttcatgaaggcaatctgcttcaccaattaagggcaaggagacccagcatggcgtat

SEQ ID NO: 421469 - DNA, 140 bp, Artificial Sequence
  Synthetic
aggccctggctgctgatatggaaaaattcttccctagtagttcatacaggagaccagttggaatttccagcatggtggaggccatggtatccagggcccgaattgacgcacggattgactgaccttttgggacagcggtg

SEQ ID NO: 421470 - DNA, 140 bp, Artificial Sequence
  Synthetic
caccgctgtcccaaaaggtcagtcaatccgtgcgtcaattcgggccctggataccatggcctccaccatgctggaaattccaactggtctcctgtatgaactactagggaagaatttttccatatcagcagccagggcct

SEQ ID NO: 421471 - DNA, 140 bp, Artificial Sequence
  Synthetic
aggccctggctgctgatatggtgttttgtggcacctcaggtacatatggaacaggctcatggcctgatggggcggacctcaatctcatgcctatataagctttcgcaattttagaaaaaagaccttttgggacagcggtg

SEQ ID NO: 421472 - DNA, 140 bp, Artificial Sequence
  Synthetic
caccgctgtcccaaaaggtcttttttctaaaattgcgaaagcttatataggcatgagattgaggtccgccccatcaggccatgagcctgttccatatgtacctgaggtgccacaaaacaccatatcagcagccagggcct

SEQ ID NO: 421473 - DNA, 140 bp, Artificial Sequence
  Synthetic
atacgccatgctgggtctcctatagacctcctgcaaaactattgaaggaaaggggtttcttcggagctattgctggtttcctagaaggaggatgggaaggaatgattgcaggttggcacgcgtacttgggagtcggccat

SEQ ID NO: 421474 - DNA, 140 bp, Artificial Sequence
  Synthetic
atggccgactcccaagtacgcgtgccaacctgcaatcattccttcccatcctccttctaggaaaccagcaatagctccgaagaaacccctttccttcaatagttttgcaggaggtctataggagacccagcatggcgtat

SEQ ID NO: 421475 - DNA, 140 bp, Artificial Sequence
  Synthetic
aggccctggctgctgatatgtgctggtttcctagaaggaggatgggaaggaatgattgcaggttggcacggatacacatctcacggagcacatggagtggcagtggcggcagaccttaaggaccttttgggacagcggtg

SEQ ID NO: 421476 - DNA, 140 bp, Artificial Sequence
  Synthetic
caccgctgtcccaaaaggtccttaaggtctgccgccactgccactccatgtgctccgtgagatgtgtatccgtgccaacctgcaatcattccttcccatcctccttctaggaaaccagcacatatcagcagccagggcct

SEQ ID NO: 421477 - DNA, 140 bp, Artificial Sequence
  Synthetic
atacgccatgctgggtctcctgagctagaagtaaagaaccttcaaagactaagtggtgccatggatgaactccacaacgaaatactcgagctggatgagaaagtggatgatctcagagctcgtacttgggagtcggccat

SEQ ID NO: 421478 - DNA, 140 bp, Artificial Sequence
  Synthetic
atggccgactcccaagtacgagctctgagatcatccactttctcatccagctcgagtatttcgttgtggagttcatccatggcaccacttagtctttgaaggttctttacttctagctcaggagacccagcatggcgtat

SEQ ID NO: 421479 - DNA, 140 bp, Artificial Sequence
  Synthetic
aggccctggctgctgatatgtccacaacgaaatactcgagctggatgagaaagtggatgatctcagagctgacactataagctcacaaatagaacttgcagtcttgctttccaacgaagggaccttttgggacagcggtg

SEQ ID NO: 421480 - DNA, 140 bp, Artificial Sequence
  Synthetic
caccgctgtcccaaaaggtcccttcgttggaaagcaagactgcaagttctatttgtgagcttatagtgtcagctctgagatcatccactttctcatccagctcgagtatttcgttgtggacatatcagcagccagggcct

SEQ ID NO: 421481 - DNA, 140 bp, Artificial Sequence
  Synthetic
atacgccatgctgggtctccttgtttttatgtggagctaatcagagggagacccaaagagagtgatgtactgtggacttccaatagcatggtagctctctgtggatccagggagcgattgcgtacttgggagtcggccat

SEQ ID NO: 421482 - DNA, 140 bp, Artificial Sequence
  Synthetic
atggccgactcccaagtacgcaatcgctccctggatccacagagagctaccatgctattggaagtccacagtacatcactctctttgggtctccctctgattagctccacataaaaacaaggagacccagcatggcgtat

SEQ ID NO: 421483 - DNA, 140 bp, Artificial Sequence
  Synthetic
atacgccatgctgggtctccagaaaatgctgggtccctctgctgtagacataggaaacggatgcttcgaaaccaaacacaaatgcaaccagacctgcttagacaggatagctgctggcaccgtacttgggagtcggccat

SEQ ID NO: 421484 - DNA, 140 bp, Artificial Sequence
  Synthetic
atggccgactcccaagtacggtgccagcagctatcctgtctaagcaggtctggttgcatttgtgtttggtttcgaagcatccgtttcctatgtctacagcagagggacccagcattttctggagacccagcatggcgtat

SEQ ID NO: 421485 - DNA, 140 bp, Artificial Sequence
  Synthetic
aggccctggctgctgatatgaccaaacacaaatgcaaccagacctgcttagacaggatagctgctggcacctttaatgcaggagaattttccctccccacttttgattcattgaacattagaccttttgggacagcggtg

SEQ ID NO: 421486 - DNA, 140 bp, Artificial Sequence
  Synthetic
caccgctgtcccaaaaggtctaatgttcaatgaatcaaaagtggggagggaaaattctcctgcattaaaggtgccagcagctatcctgtctaagcaggtctggttgcatttgtgtttggtcatatcagcagccagggcct

SEQ ID NO: 421487 - DNA, 140 bp, Artificial Sequence
  Synthetic
atacgccatgctgggtctcctgggtgaatcaaacataccttaacataagtaataccaatttaattgcagaacagactgtagctccagtaacactagcaggcaattcctctctctgtcccacgtacttgggagtcggccat

SEQ ID NO: 421488 - DNA, 140 bp, Artificial Sequence
  Synthetic
atggccgactcccaagtacgtgggacagagagaggaattgcctgctagtgttactggagctacagtctgttctgcaattaaattggtattacttatgttaaggtatgtttgattcacccaggagacccagcatggcgtat

SEQ ID NO: 421489 - DNA, 140 bp, Artificial Sequence
  Synthetic
aggccctggctgctgatatgacagactgtagctccagtaacactagcaggcaattcctctctctgtcccatcagtggatgggctatatacagcaaggataatggtataagaataggttccgaccttttgggacagcggtg

SEQ ID NO: 421490 - DNA, 140 bp, Artificial Sequence
  Synthetic
caccgctgtcccaaaaggtcggaacctattcttataccattatccttgctgtatatagcccatccactgatgggacagagagaggaattgcctgctagtgttactggagctacagtctgtcatatcagcagccagggcct

SEQ ID NO: 421491 - DNA, 140 bp, Artificial Sequence
  Synthetic
aggccctggctgctgatatgatagaaatcagccggctgctactgcattggccaacactatagaggtattcagatcgaatggcctgacagccaatgaatcaggaaggttgatcgatttcctgaccttttgggacagcggtg

SEQ ID NO: 421492 - DNA, 140 bp, Artificial Sequence
  Synthetic
caccgctgtcccaaaaggtcaggaaatcgatcaaccttcctgattcattggctgtcaggccattcgatctgaatacctctatagtgttggccaatgcagtagcagccggctgatttctatcatatcagcagccagggcct

SEQ ID NO: 421493 - DNA, 140 bp, Artificial Sequence
  Synthetic
aggccctggctgctgatatgattccaatggaaccgttaaagacagaagcccttatagaaccctaatgagctgtcctgttggtgaagctccctctccatacaattcaaggtttgagtctgtgaccttttgggacagcggtg

SEQ ID NO: 421494 - DNA, 140 bp, Artificial Sequence
  Synthetic
caccgctgtcccaaaaggtcacagactcaaaccttgaattgtatggagagggagcttcaccaacaggacagctcattagggttctataagggcttctgtctttaacggttccattggaatcatatcagcagccagggcct

SEQ ID NO: 421495 - DNA, 140 bp, Artificial Sequence
  Synthetic
atacgccatgctgggtctccgtatttccggcccagacaatggggcagtggctgtattgaagtacaatggcataataacagatactatcaagagttggagaaacaacatattgaggacacacgtacttgggagtcggccat

SEQ ID NO: 421496 - DNA, 140 bp, Artificial Sequence
  Synthetic
atggccgactcccaagtacgtgtgtcctcaatatgttgtttctccaactcttgatagtatctgttattatgccattgtacttcaatacagccactgccccattgtctgggccggaaatacggagacccagcatggcgtat

SEQ ID NO: 421497 - DNA, 140 bp, Artificial Sequence
  Synthetic
atacgccatgctgggtctccggtaactccccagtgtttaactacaataagacaactaagaggcttacagtccttgggaaagatgcaggttcattgacagaagacccagatgaggggacagcgtacttgggagtcggccat

SEQ ID NO: 421498 - DNA, 140 bp, Artificial Sequence
  Synthetic
atggccgactcccaagtacgctgtcccctcatctgggtcttctgtcaatgaacctgcatctttcccaaggactgtaagcctcttagttgtcttattgtagttaaacactggggagttaccggagacccagcatggcgtat

SEQ ID NO: 421499 - DNA, 140 bp, Artificial Sequence
  Synthetic
aggccctggctgctgatatgtcaccataaggcaggaaatggccagcaggggtctatgggattcctttcgtcagtccgaaagaggcgaagaaacaattgaagaaagatttgaaatcacagggaccttttgggacagcggtg

SEQ ID NO: 421500 - DNA, 140 bp, Artificial Sequence
  Synthetic
caccgctgtcccaaaaggtccctgtgatttcaaatctttcttcaattgtttcttcgcctctttcggactgacgaaaggaatcccatagacccctgctggccatttcctgccttatggtgacatatcagcagccagggcct

SEQ ID NO: 421501 - DNA, 140 bp, Artificial Sequence
  Synthetic
aggccctggctgctgatatgaagaaccagacgatgttgatggcccaactgaaatagtattaagggacatgaacaacaaagatgcaaggcaaaagataaaggaggaagtaaacactcagaagaccttttgggacagcggtg

SEQ ID NO: 421502 - DNA, 140 bp, Artificial Sequence
  Synthetic
caccgctgtcccaaaaggtcttctgagtgtttacttcctcctttatcttttgccttgcatctttgttgttcatgtcccttaatactatttcagttgggccatcaacatcgtctggttcttcatatcagcagccagggcct

SEQ ID NO: 421503 - DNA, 140 bp, Artificial Sequence
  Synthetic
aggccctggctgctgatatgaacaacaaagatgcaaggcaaaagataaaggaggaagtaaacactcagaaagaagggaagttccgtttgacaataaaaagggatatgcgtaatgtattgtgaccttttgggacagcggtg

SEQ ID NO: 421504 - DNA, 140 bp, Artificial Sequence
  Synthetic
caccgctgtcccaaaaggtcacaatacattacgcatatccctttttattgtcaaacggaacttcccttctttctgagtgtttacttcctcctttatcttttgccttgcatctttgttgttcatatcagcagccagggcct

SEQ ID NO: 421505 - DNA, 140 bp, Artificial Sequence
  Synthetic
atacgccatgctgggtctccaagtccttatcaactctgcatagattgaatgcatatgaccagagtggaaggcttgttgctaaacttgttgctactgatgatcttacagtggaggatgaagcgtacttgggagtcggccat

SEQ ID NO: 421506 - DNA, 140 bp, Artificial Sequence
  Synthetic
atggccgactcccaagtacgcttcatcctccactgtaagatcatcagtagcaacaagtttagcaacaagccttccactctggtcatatgcattcaatctatgcagagttgataaggacttggagacccagcatggcgtat

SEQ ID NO: 421507 - DNA, 140 bp, Artificial Sequence
  Synthetic
atacgccatgctgggtctccaagccaacaaaataaaatccgagaagacacacattcacattttttcattcactggagaggagatggccaccaaagcggactacacccttgatgaagagagcgtacttgggagtcggccat

SEQ ID NO: 421508 - DNA, 140 bp, Artificial Sequence
  Synthetic
atggccgactcccaagtacgctctcttcatcaagggtgtagtccgctttggtggccatctcctctccagtgaatgaaaaaatgtgaatgtgtgtcttctcggattttattttgttggcttggagacccagcatggcgtat

SEQ ID NO: 421509 - DNA, 140 bp, Artificial Sequence
  Synthetic
atacgccatgctgggtctccaagatggccatcggatcctcaattcactcttcgagcgccttaatgaaggacattcaaagccaattcgagcagctgaaactgcggtgggagtcttatcccacgtacttgggagtcggccat

SEQ ID NO: 421510 - DNA, 140 bp, Artificial Sequence
  Synthetic
atggccgactcccaagtacgtgggataagactcccaccgcagtttcagctgctcgaattggctttgaatgtccttcattaaggcgctcgaagagtgaattgaggatccgatggccatcttggagacccagcatggcgtat

SEQ ID NO: 421511 - DNA, 140 bp, Artificial Sequence
  Synthetic
atacgccatgctgggtctcccaatggatggacagagacggataacagtttctctgtgaagcaagacattgtcgcaataactgattggtcaggatacagcggaagttttgttcagcacccgcgtacttgggagtcggccat

SEQ ID NO: 421512 - DNA, 140 bp, Artificial Sequence
  Synthetic
atggccgactcccaagtacgcgggtgctgaacaaaacttccgctgtatcctgaccaatcagttattgcgacaatgtcttgcttcacagagaaactgttatccgtctctgtccatccattgggagacccagcatggcgtat

SEQ ID NO: 421513 - DNA, 140 bp, Artificial Sequence
  Synthetic
atacgccatgctgggtctccatttggtcaagagcaccgattatcaccagaagagggagacaattagactggtcacggaagaactttatcttttaagtaaaagaattgatgataacatattcgtacttgggagtcggccat

SEQ ID NO: 421514 - DNA, 140 bp, Artificial Sequence
  Synthetic
atggccgactcccaagtacgaatatgttatcatcaattcttttacttaaaagataaagttcttccgtgaccagtctaattgtctccctcttctggtgataatcggtgctcttgaccaaatggagacccagcatggcgtat

SEQ ID NO: 421515 - DNA, 140 bp, Artificial Sequence
  Synthetic
aggccctggctgctgatatgaaaaagatggtcacacaaagaacaatagggaagaaaaaacaaagagtgaataggaaaagttatctaataagagcactaacattaaatacgatgactaaaggaccttttgggacagcggtg

SEQ ID NO: 421516 - DNA, 140 bp, Artificial Sequence
  Synthetic
caccgctgtcccaaaaggtcctttagtcatcgtatttaatgttagtgctcttattagataacttttcctattcactctttgttttttcttccctattgttctttgtgtgaccatctttttcatatcagcagccagggcct

SEQ ID NO: 421517 - DNA, 140 bp, Artificial Sequence
  Synthetic
aggccctggctgctgatatgcagagcaagaatcaaaaccaggctattcaccataagacaagagatggccagtaggggtctatgggattcctttcgtcagtccgagagaggcgaagagacagaccttttgggacagcggtg

SEQ ID NO: 421518 - DNA, 140 bp, Artificial Sequence
  Synthetic
caccgctgtcccaaaaggtctgtctcttcgcctctctcggactgacgaaaggaatcccatagacccctactggccatctcttgtcttatggtgaatagcctggttttgattcttgctctgcatatcagcagccagggcct

SEQ ID NO: 421519 - DNA, 140 bp, Artificial Sequence
  Synthetic
atacgccatgctgggtctcccagttattcatggcaaagttgaagaccataaaggtgaaatttcaccaaacaccacacctcaaccgatttacaattgtagcggcactgcaataacaaacaacgtacttgggagtcggccat

SEQ ID NO: 421520 - DNA, 140 bp, Artificial Sequence
  Synthetic
atggccgactcccaagtacgttgtttgttattgcagtgccgctacaattgtaaatcggttgaggtgtggtgtttggtgaaatttcacctttatggtcttcaactttgccatgaataactgggagacccagcatggcgtat

SEQ ID NO: 421521 - DNA, 140 bp, Artificial Sequence
  Synthetic
atacgccatgctgggtctccagatcactggcaagctggattcagagtgaattcaacaaggcatgtgagttgacagattccagctggatagagcttgatgaaataggagaggatgtcgctccgtacttgggagtcggccat

SEQ ID NO: 421522 - DNA, 140 bp, Artificial Sequence
  Synthetic
atggccgactcccaagtacggagcgacatcctctcctatttcatcaagctctatccagctggaatctgtcaactcacatgccttgttgaattcactctgaatccagcttgccagtgatctggagacccagcatggcgtat

SEQ ID NO: 421523 - DNA, 140 bp, Artificial Sequence
  Synthetic
aggccctggctgctgatatgtctcattgcagagccacggaatacataatgaaaggagtgtatataaacacagccctactcaatgcatcttgtgcagcaatggatgatttccagttaatacgaccttttgggacagcggtg

SEQ ID NO: 421524 - DNA, 140 bp, Artificial Sequence
  Synthetic
caccgctgtcccaaaaggtcgtattaactggaaatcatccattgctgcacaagatgcattgagtagggctgtgtttatatacactcctttcattatgtattccgtggctctgcaatgagacatatcagcagccagggcct

SEQ ID NO: 421525 - DNA, 140 bp, Artificial Sequence
  Synthetic
aggccctggctgctgatatgatagatggcacagcatcattgagtcctgggatgatgatgggcatgttcaacatgctaagtacggttttgggagtctcaatactgaatcttggacaaaagagaccttttgggacagcggtg

SEQ ID NO: 421526 - DNA, 140 bp, Artificial Sequence
  Synthetic
caccgctgtcccaaaaggtctcttttgtccaagattcagtattgagactcccaaaaccgtacttagcatgttgaacatgcccatcatcatcccaggactcaatgatgctgtgccatctatcatatcagcagccagggcct

SEQ ID NO: 421527 - DNA, 140 bp, Artificial Sequence
  Synthetic
atacgccatgctgggtctcctaaagcatgcatgagaaatggaggaaatagtttctatgcggagctaaagtggctagtgtcgaagaataaaggacagaacttcccacaaacaacaaacacacgtacttgggagtcggccat

SEQ ID NO: 421528 - DNA, 140 bp, Artificial Sequence
  Synthetic
atggccgactcccaagtacgtgtgtttgttgtttgtgggaagttctgtcctttattcttcgacactagccactttagctccgcatagaaactatttcctccatttctcatgcatgctttaggagacccagcatggcgtat

SEQ ID NO: 421529 - DNA, 140 bp, Artificial Sequence
  Synthetic
atacgccatgctgggtctcctatgggttcattgtaaaaggaagatcacatctaaggaacgacaccgacgtggtaaattttgtgagcatggagttttctctcaccgatccgaggctggagccgtacttgggagtcggccat

SEQ ID NO: 421530 - DNA, 140 bp, Artificial Sequence
  Synthetic
atggccgactcccaagtacggctccagcctcggatcggtgagagaaaactccatgctcacaaaatttaccacgtcggtgtcgttccttagatgtgatcttccttttacaatgaacccataggagacccagcatggcgtat

SEQ ID NO: 421531 - DNA, 140 bp, Artificial Sequence
  Synthetic
aggccctggctgctgatatgggtaaattttgtgagcatggagttttctctcaccgatccgaggctggagccacacaagtgggagaagtattgtgttcttgaaataggaaacatgattctggaccttttgggacagcggtg

SEQ ID NO: 421532 - DNA, 140 bp, Artificial Sequence
  Synthetic
caccgctgtcccaaaaggtccagaatcatgtttcctatttcaagaacacaatacttctcccacttgtgtggctccagcctcggatcggtgagagaaaactccatgctcacaaaatttacccatatcagcagccagggcct

SEQ ID NO: 421533 - DNA, 140 bp, Artificial Sequence
  Synthetic
aggccctggctgctgatatgaattctttgaaaacaaatcagaaacatggccaattggagagtcacctaaaggagtggaggaaggttccatcgggaaggtgtgcagaaccttactagcaaagaccttttgggacagcggtg

SEQ ID NO: 421534 - DNA, 140 bp, Artificial Sequence
  Synthetic
caccgctgtcccaaaaggtctttgctagtaaggttctgcacaccttcccgatggaaccttcctccactcctttaggtgactctccaattggccatgtttctgatttgttttcaaagaattcatatcagcagccagggcct

SEQ ID NO: 421535 - DNA, 140 bp, Artificial Sequence
  Synthetic
atacgccatgctgggtctcccaatggaacctcaaaaattaaaatgaaatggggcatggaaatgaggcgttgtctccttcaatctctccaacagattgagagcatgatcgaagctgaatctcgtacttgggagtcggccat

SEQ ID NO: 421536 - DNA, 140 bp, Artificial Sequence
  Synthetic
atggccgactcccaagtacgagattcagcttcgatcatgctctcaatctgttggagagattgaaggagacaacgcctcatttccatgccccatttcattttaatttttgaggttccattgggagacccagcatggcgtat

SEQ ID NO: 421537 - DNA, 140 bp, Artificial Sequence
  Synthetic
atacgccatgctgggtctcctccgttaaagaaaaagacatgaccaaagaattttttgaaaacaaatctgaagtatggcccattggggaatcacccaaaggggtggaagaaggctccatcgcgtacttgggagtcggccat

SEQ ID NO: 421538 - DNA, 140 bp, Artificial Sequence
  Synthetic
atggccgactcccaagtacgcgatggagccttcttccacccctttgggtgattccccaatgggccatacttcagatttgttttcaaaaaattctttggtcatgtctttttctttaacggaggagacccagcatggcgtat

SEQ ID NO: 421539 - DNA, 140 bp, Artificial Sequence
  Synthetic
aggccctggctgctgatatgatgagtcttctaaccgaggttgaaacgtacgttctctctatcattccgtcaggccccctcaaagccgagatagcacagagacttgaagatgtttttgcaggaccttttgggacagcggtg

SEQ ID NO: 421540 - DNA, 140 bp, Artificial Sequence
  Synthetic
caccgctgtcccaaaaggtcctgcaaaaacatcttcaagtctctgtgctatctcggctttgagggggcctgacggaatgatagagagaacgtacgtttcaacctcggttagaagactcatcatatcagcagccagggcct

SEQ ID NO: 421541 - DNA, 140 bp, Artificial Sequence
  Synthetic
atacgccatgctgggtctccgggatatttgagaattcatgccttgaaacaatggaaattgtccaacaaacaagggtggataaactaactcagggtcgccagacttatgattggacattaacgtacttgggagtcggccat

SEQ ID NO: 421542 - DNA, 140 bp, Artificial Sequence
  Synthetic
atggccgactcccaagtacgttaatgtccaatcataagtctggcgaccctgagttagtttatccacccttgtttgttggacaatttccattgtttcaaggcatgaattctcaaatatcccggagacccagcatggcgtat

SEQ ID NO: 421543 - DNA, 140 bp, Artificial Sequence
  Synthetic
aggccctggctgctgatatgaatttatacaatatccggaatcttcacattcctgaagtctgcttaaaatgggagctaatggatgaggattatcggggaagactttgtaatcccctgaatcgaccttttgggacagcggtg

SEQ ID NO: 421544 - DNA, 140 bp, Artificial Sequence
  Synthetic
caccgctgtcccaaaaggtcgattcaggggattacaaagtcttccccgataatcctcatccattagctcccattttaagcagacttcaggaatgtgaagattccggatattgtataaattcatatcagcagccagggcct

SEQ ID NO: 421545 - DNA, 140 bp, Artificial Sequence
  Synthetic
aggccctggctgctgatatgagtaaaaactgattcagcaacatatccagtaattaaggggacgtacaacaatactggaacccagccaatcctctatttctggggtgtccatcatcctcctgaccttttgggacagcggtg

SEQ ID NO: 421546 - DNA, 140 bp, Artificial Sequence
  Synthetic
caccgctgtcccaaaaggtcaggaggatgatggacaccccagaaatagaggattggctgggttccagtattgttgtacgtccccttaattactggatatgttgctgaatcagtttttactcatatcagcagccagggcct

SEQ ID NO: 421547 - DNA, 140 bp, Artificial Sequence
  Synthetic
atacgccatgctgggtctcctccgatcgatggaccactacctgaggacaatgagccaagcggatatgctcaaacagactgtgtcctggaggcaatggctttccttgaggaatcccatccacgtacttgggagtcggccat

SEQ ID NO: 421548 - DNA, 140 bp, Artificial Sequence
  Synthetic
atggccgactcccaagtacgtggatgggattcctcaaggaaagccattgcctccaggacacagtctgtttgagcatatccgcttggctcattgtcctcaggtagtggtccatcgatcggaggagacccagcatggcgtat

SEQ ID NO: 421549 - DNA, 140 bp, Artificial Sequence
  Synthetic
aggccctggctgctgatatgaaacagactgtgtcctggaggcaatggctttccttgaggaatcccatccagggatatttgaaaactcttgtctagaaacaatggagattgtccaacaaacgaccttttgggacagcggtg

SEQ ID NO: 421550 - DNA, 140 bp, Artificial Sequence
  Synthetic
caccgctgtcccaaaaggtcgtttgttggacaatctccattgtttctagacaagagttttcaaatatccctggatgggattcctcaaggaaagccattgcctccaggacacagtctgtttcatatcagcagccagggcct

SEQ ID NO: 421551 - DNA, 140 bp, Artificial Sequence
  Synthetic
aggccctggctgctgatatgaattcaaacaaggagatcatttgagataaagaagttgtgggagcagacccgttcaaaggcaggactgttggttgcagatggaggaccaaatttatacaatgaccttttgggacagcggtg

SEQ ID NO: 421552 - DNA, 140 bp, Artificial Sequence
  Synthetic
caccgctgtcccaaaaggtcattgtataaatttggtcctccatctgcaaccaacagtcctgcctttgaacgggtctgctcccacaacttctttatctcaaatgatctccttgtttgaattcatatcagcagccagggcct

SEQ ID NO: 421553 - DNA, 140 bp, Artificial Sequence
  Synthetic
aggccctggctgctgatatgacgttgtgagaaagatgatgactaattcacaagacacagagctttctttcacaatcactggggacaacactaaatggaatgaaaaccaaaatcctcgaatgaccttttgggacagcggtg

SEQ ID NO: 421554 - DNA, 140 bp, Artificial Sequence
  Synthetic
caccgctgtcccaaaaggtcattcgaggattttggttttcattccatttagtgttgtccccagtgattgtgaaagaaagctctgtgtcttgtgaattagtcatcatctttctcacaacgtcatatcagcagccagggcct

SEQ ID NO: 421555 - DNA, 140 bp, Artificial Sequence
  Synthetic
aggccctggctgctgatatgaggatgaacagtttaacagccaatgaatcgggaagattaatagatttccttaaggatgtgatggaatcaatggatagagatgagatggaaataacaacacgaccttttgggacagcggtg

SEQ ID NO: 421556 - DNA, 140 bp, Artificial Sequence
  Synthetic
caccgctgtcccaaaaggtcgtgttgttatttccatctcatctctatccattgattccatcacatccttaaggaaatctattaatcttcccgattcattggctgttaaactgttcatcctcatatcagcagccagggcct

SEQ ID NO: 421557 - DNA, 140 bp, Artificial Sequence
  Synthetic
atacgccatgctgggtctcctacagagaatagctttgaacaaataacttttatgcaagccttacaactattgcttgaagtggagcaagagataagaactttctcgtttcagcttatttaacgtacttgggagtcggccat

SEQ ID NO: 421558 - DNA, 140 bp, Artificial Sequence
  Synthetic
atggccgactcccaagtacgttaaataagctgaaacgagaaagttcttatctcttgctccacttcaagcaatagttgtaaggcttgcataaaagttatttgttcaaagctattctctgtaggagacccagcatggcgtat

SEQ ID NO: 421559 - DNA, 140 bp, Artificial Sequence
  Synthetic
aggccctggctgctgatatgggacaatggcatggacagtagtgaatagtatctgcaacaccacaggagtcgagaaacctaaattcctcccagatttgtatgactacaaagaagaccgattgaccttttgggacagcggtg

SEQ ID NO: 421560 - DNA, 140 bp, Artificial Sequence
  Synthetic
caccgctgtcccaaaaggtcaatcggtcttctttgtagtcatacaaatctgggaggaatttaggtttctcgactcctgtggtgttgcagatactattcactactgtccatgccattgtcccatatcagcagccagggcct

SEQ ID NO: 421561 - DNA, 140 bp, Artificial Sequence
  Synthetic
atacgccatgctgggtctccgagaaacctaaattcctcccagatttgtatgactacaaagaagaccgattcattgaaattggggtgacacggagggaagttcacatatactatctagaaacgtacttgggagtcggccat

SEQ ID NO: 421562 - DNA, 140 bp, Artificial Sequence
  Synthetic
atggccgactcccaagtacgtttctagatagtatatgtgaacttccctccgtgtcaccccaatttcaatgaatcggtcttctttgtagtcatacaaatctgggaggaatttaggtttctcggagacccagcatggcgtat

SEQ ID NO: 421563 - DNA, 140 bp, Artificial Sequence
  Synthetic
aggccctggctgctgatatgactggagaggaaatggcaaccagatcagactacacccttgatgaagagagcagggcaagaatcaagaccaggctgtttactataaggcaggaaatggccagaccttttgggacagcggtg

SEQ ID NO: 421564 - DNA, 140 bp, Artificial Sequence
  Synthetic
caccgctgtcccaaaaggtctggccatttcctgccttatagtaaacagcctggtcttgattcttgccctgctctcttcatcaagggtgtagtctgatctggttgccatttcctctccagtcatatcagcagccagggcct

SEQ ID NO: 421565 - DNA, 140 bp, Artificial Sequence
  Synthetic
aggccctggctgctgatatgagcatttaaaatgagtattgcttcagtgccagctccacgctatctaactgacatgactcttgaagaaatgtcaagagattggttaatgctcattcccaaagaccttttgggacagcggtg

SEQ ID NO: 421566 - DNA, 140 bp, Artificial Sequence
  Synthetic
caccgctgtcccaaaaggtctttgggaatgagcattaaccaatctcttgacatttcttcaagagtcatgtcagttagatagcgtggagctggcactgaagcaatactcattttaaatgctcatatcagcagccagggcct

SEQ ID NO: 421567 - DNA, 140 bp, Artificial Sequence
  Synthetic
aggccctggctgctgatatgaataccagcagaaatgctcgcagatattgacttgaaatatttcaatgaatcaacaagagaaaagattgagaagataaggccactcctcatagatggcacggaccttttgggacagcggtg

SEQ ID NO: 421568 - DNA, 140 bp, Artificial Sequence
  Synthetic
caccgctgtcccaaaaggtccgtgccatctatgaggagtggccttatcttctcaatcttttctcttgttgattcattgaaatatttcaagtcaatatctgcgagcatttctgctggtattcatatcagcagccagggcct

SEQ ID NO: 421569 - DNA, 140 bp, Artificial Sequence
  Synthetic
atacgccatgctgggtctccagttctaggagtctcaatcctaaaccttgggcaaaagaggtacactaaaaccacatactggtgggatggactccaatcttctgatgacttcgccctcatacgtacttgggagtcggccat

SEQ ID NO: 421570 - DNA, 140 bp, Artificial Sequence
  Synthetic
atggccgactcccaagtacgtatgagggcgaagtcatcagaagattggagtccatcccaccagtatgtggttttagtgtacctcttttgcccaaggtttaggattgagactcctagaactggagacccagcatggcgtat

SEQ ID NO: 421571 - DNA, 140 bp, Artificial Sequence
  Synthetic
aggccctggctgctgatatgttatggatgcccttaaactgagcattgaagacccgagtcatgagggagagggtatcccattatatgatgcaatcaaatgcatgaatacatttttcggatggaccttttgggacagcggtg

SEQ ID NO: 421572 - DNA, 140 bp, Artificial Sequence
  Synthetic
caccgctgtcccaaaaggtccatccgaaaaatgtattcatgcatttgattgcatcatataatgggataccctctccctcatgactcgggtcttcaatgctcagtttaagggcatccataacatatcagcagccagggcct

SEQ ID NO: 421573 - DNA, 140 bp, Artificial Sequence
  Synthetic
atacgccatgctgggtctccggtatcccattatatgatgcaatcaaatgcatgaatacatttttcggatggaaagagcccaaagttttaaagccacatgaaaagggcataaaccccaattcgtacttgggagtcggccat

SEQ ID NO: 421574 - DNA, 140 bp, Artificial Sequence
  Synthetic
atggccgactcccaagtacgaattggggtttatgcccttttcatgtggctttaaaactttgggctctttccatccgaaaaatgtattcatgcatttgattgcatcatataatgggataccggagacccagcatggcgtat

SEQ ID NO: 421575 - DNA, 140 bp, Artificial Sequence
  Synthetic
atacgccatgctgggtctccataaagagattgattctgtaaacagtgctgtggtgatgccagcccatggcccagccaaaagcatggaatatgatgccgttgcaactacacactcctggatcgtacttgggagtcggccat

SEQ ID NO: 421576 - DNA, 140 bp, Artificial Sequence
  Synthetic
atggccgactcccaagtacgatccaggagtgtgtagttgcaacggcatcatattccatgcttttggctgggccatgggctggcatcaccacagcactgtttacagaatcaatctctttatggagacccagcatggcgtat

SEQ ID NO: 421577 - DNA, 140 bp, Artificial Sequence
  Synthetic
aggccctggctgctgatatgtaaatagaacaggaacatttgaattcacaagctttttctaccgctatgggtttgtagccaacttcagtatggaactacccagctttggggtatctggaatgaccttttgggacagcggtg

SEQ ID NO: 421578 - DNA, 140 bp, Artificial Sequence
  Synthetic
caccgctgtcccaaaaggtcattccagataccccaaagctgggtagttccatactgaagttggctacaaacccatagcggtagaaaaagcttgtgaattcaaatgttcctgttctatttacatatcagcagccagggcct

SEQ ID NO: 421579 - DNA, 140 bp, Artificial Sequence
  Synthetic
aggccctggctgctgatatggaggagagaacaccaaaggcaaagaacatgaagaaaacaagccaattgaaatgggcacttggtgaaaatatggcaccagagaaggtagactttgagtattgaccttttgggacagcggtg

SEQ ID NO: 421580 - DNA, 140 bp, Artificial Sequence
  Synthetic
caccgctgtcccaaaaggtcaatactcaaagtctaccttctctggtgccatattttcaccaagtgcccatttcaattggcttgttttcttcatgttctttgcctttggtgttctctcctccatatcagcagccagggcct

SEQ ID NO: 421581 - DNA, 140 bp, Artificial Sequence
  Synthetic
atacgccatgctgggtctccgaggcaataattgtggccatggtattttcacaagaggattgcatgatcaaggcagttaggggcgatctgaactttgtcaatagggcaaaccagcgactgacgtacttgggagtcggccat

SEQ ID NO: 421582 - DNA, 140 bp, Artificial Sequence
  Synthetic
atggccgactcccaagtacgtcagtcgctggtttgccctattgacaaagttcagatcgcccctaactgccttgatcatgcaatcctcttgtgaaaataccatggccacaattattgcctcggagacccagcatggcgtat

SEQ ID NO: 421583 - DNA, 140 bp, Artificial Sequence
  Synthetic
atacgccatgctgggtctccatggatgtcaatccgactttacttttcttaaaaataccagcgcaaaatgctataagtactacattcccttatactggagatcctccatacagccatgggacgtacttgggagtcggccat

SEQ ID NO: 421584 - DNA, 140 bp, Artificial Sequence
  Synthetic
atggccgactcccaagtacgtcccatggctgtatggaggatctccagtataagggaatgtagtacttatagcattttgcgctggtatttttaagaaaagtaaagtcggattgacatccatggagacccagcatggcgtat

SEQ ID NO: 421585 - DNA, 140 bp, Artificial Sequence
  Synthetic
aggccctggctgctgatatgtgccaggattgacttcgagtctggacggatcaagaaagaagagttctctgagatcatgaagatctgttccaccattgaagaactcagacggcaaaagtaagaccttttgggacagcggtg

SEQ ID NO: 421586 - DNA, 140 bp, Artificial Sequence
  Synthetic
caccgctgtcccaaaaggtcttacttttgccgtctgagttcttcaatggtggaacagatcttcatgatctcagagaactcttctttcttgatccgtccagactcgaagtcaatcctggcacatatcagcagccagggcct

SEQ ID NO: 421587 - DNA, 140 bp, Artificial Sequence
  Synthetic
aggccctggctgctgatatggaccgattcaagttgggttgaacttgatgaaataggggaagacgttgctccaattgaacacattgcgagtatgagaagaaactacttcacagcggaagtagaccttttgggacagcggtg

SEQ ID NO: 421588 - DNA, 140 bp, Artificial Sequence
  Synthetic
caccgctgtcccaaaaggtctacttccgctgtgaagtagtttcttctcatactcgcaatgtgttcaattggagcaacgtcttcccctatttcatcaagttcaacccaacttgaatcggtccatatcagcagccagggcct

SEQ ID NO: 421589 - DNA, 140 bp, Artificial Sequence
  Synthetic
atacgccatgctgggtctcccaattgaacacattgcgagtatgagaagaaactacttcacagcggaagtatcccgttgtagggcaactgaatacataatgaagggagtttatataaacaccgtacttgggagtcggccat

SEQ ID NO: 421590 - DNA, 140 bp, Artificial Sequence
  Synthetic
atggccgactcccaagtacggtgtttatataaactcccttcattatgtattcagttgccctacaacgggatacttccgctgtgaagtagtttcttctcatactcgcaatgtgttcaattgggagacccagcatggcgtat

SEQ ID NO: 421591 - DNA, 140 bp, Artificial Sequence
  Synthetic
atacgccatgctgggtctcctccaattgatgggccactacccgaggataatgagccgagcgggtatgcacaaacagattgtgtgttggaggcaatggctttccttgaagagtcccacccacgtacttgggagtcggccat

SEQ ID NO: 421592 - DNA, 140 bp, Artificial Sequence
  Synthetic
atggccgactcccaagtacgtgggtgggactcttcaaggaaagccattgcctccaacacacaatctgtttgtgcatacccgctcggctcattatcctcgggtagtggcccatcaattggaggagacccagcatggcgtat

SEQ ID NO: 421593 - DNA, 140 bp, Artificial Sequence
  Synthetic
aggccctggctgctgatatgcaatgataagcaaatgcagaaccaaggaaggaagacgaaagactaatttgtacgggttcattataaaagggagatcccatttgagaaatgacacagatgtgaccttttgggacagcggtg

SEQ ID NO: 421594 - DNA, 140 bp, Artificial Sequence
  Synthetic
caccgctgtcccaaaaggtcacatctgtgtcatttctcaaatgggatctcccttttataatgaacccgtacaaattagtctttcgtcttccttccttggttctgcatttgcttatcattgcatatcagcagccagggcct

SEQ ID NO: 421595 - DNA, 140 bp, Artificial Sequence
  Synthetic
atacgccatgctgggtctcctacgggttcattataaaagggagatcccatttgagaaatgacacagatgtggtgaattttgtgagtatggagttctctcttaccgacccgaggctggagccgtacttgggagtcggccat

SEQ ID NO: 421596 - DNA, 140 bp, Artificial Sequence
  Synthetic
atggccgactcccaagtacggctccagcctcgggtcggtaagagagaactccatactcacaaaattcaccacatctgtgtcatttctcaaatgggatctcccttttataatgaacccgtaggagacccagcatggcgtat

SEQ ID NO: 421597 - DNA, 140 bp, Artificial Sequence
  Synthetic
atacgccatgctgggtctccaggtggatccatcaacaccaaactcccttttcagaatctttccccaagaactgtgggtcaatgccccaaatatgtgaacaaaaggagcctgttacttgctcgtacttgggagtcggccat

SEQ ID NO: 421598 - DNA, 140 bp, Artificial Sequence
  Synthetic
atggccgactcccaagtacgagcaagtaacaggctccttttgttcacatatttggggcattgacccacagttcttggggaaagattctgaaaagggagtttggtgttgatggatccacctggagacccagcatggcgtat

SEQ ID NO: 421599 - DNA, 140 bp, Artificial Sequence
  Synthetic
aggccctggctgctgatatgcgaactgcaattggccaagtgtcaaggcctatgttcctgtatgtgagaaccaatggaacctccaaaataaagatgaagtggggcatggagatgagacgatgaccttttgggacagcggtg

SEQ ID NO: 421600 - DNA, 140 bp, Artificial Sequence
  Synthetic
caccgctgtcccaaaaggtcatcgtctcatctccatgccccacttcatctttattttggaggttccattggttctcacatacaggaacataggccttgacacttggccaattgcagttcgcatatcagcagccagggcct

SEQ ID NO: 421601 - DNA, 140 bp, Artificial Sequence
  Synthetic
atacgccatgctgggtctccgaatgggaactgtgaccacagaagtggcttttggtctagtatgtgccacttgtgagcagattgctgactcccagcatcggtcccacaggcagatggtgaccgtacttgggagtcggccat

SEQ ID NO: 421602 - DNA, 140 bp, Artificial Sequence
  Synthetic
atggccgactcccaagtacggtcaccatctgcctgtgggaccgatgctgggagtcagcaatctgctcacaagtggcacatactagaccaaaagccacttctgtggtcacagttcccattcggagacccagcatggcgtat

SEQ ID NO: 421603 - DNA, 140 bp, Artificial Sequence
  Synthetic
aggccctggctgctgatatgtccgtcaaagagaaagacatgaccaaagaattctttgagaacaaatcagaaaaatggccagttggtgaatcacccaaaggggtggaagaaggctctatcggaccttttgggacagcggtg

SEQ ID NO: 421604 - DNA, 140 bp, Artificial Sequence
  Synthetic
caccgctgtcccaaaaggtccgatagagccttcttccacccctttgggtgattcaccaactggccatttttctgatttgttctcaaagaattctttggtcatgtctttctctttgacggacatatcagcagccagggcct

SEQ ID NO: 421605 - DNA, 140 bp, Artificial Sequence
  Synthetic
atacgccatgctgggtctccattccggtgaaatcatatgtgtgtgcagggacaactggcatggttcgaatcgaccatgggtgtctttcaatcagaatctggagtatcaaataggatacatcgtacttgggagtcggccat

SEQ ID NO: 421606 - DNA, 140 bp, Artificial Sequence
  Synthetic
atggccgactcccaagtacgatgtatcctatttgatactccagattctgattgaaagacacccatggtcgattcgaaccatgccagttgtccctgcacacacatatgatttcaccggaatggagacccagcatggcgtat

SEQ ID NO: 421607 - DNA, 140 bp, Artificial Sequence
  Synthetic
aggccctggctgctgatatgatggcaatgaagtatccgattactgcagacaggaggataatggagatgattcctgaaagaaacgaacacgggcaaatactttggagtaagacaaatgatggaccttttgggacagcggtg

SEQ ID NO: 421608 - DNA, 140 bp, Artificial Sequence
  Synthetic
caccgctgtcccaaaaggtccatcatttgtcttactccaaagtatttgcccgtgttcgtttctttcaggaatcatctccattatcctcctgtctgcagtaatcggatacttcattgccatcatatcagcagccagggcct

SEQ ID NO: 421609 - DNA, 140 bp, Artificial Sequence
  Synthetic
atacgccatgctgggtctccacgttgtaagaaagatgatgactaattcacaagatacagaactctcctttacaattactggagacaataccaaatggaatgagaatcagaatcctcggatcgtacttgggagtcggccat

SEQ ID NO: 421610 - DNA, 140 bp, Artificial Sequence
  Synthetic
atggccgactcccaagtacgatccgaggattctgattctcattccatttggtattgtctccagtaattgtaaaggagagttctgtatcttgtgaattagtcatcatctttcttacaacgtggagacccagcatggcgtat

SEQ ID NO: 421611 - DNA, 140 bp, Artificial Sequence
  Synthetic
atacgccatgctgggtctccgggggctatatgaagcaattgaggagtgcctgattaatgatccctgggttttgcttaatgcgtcttggttcaactccttcctcacacatgcactaaaatacgtacttgggagtcggccat

SEQ ID NO: 421612 - DNA, 140 bp, Artificial Sequence
  Synthetic
atggccgactcccaagtacgtattttagtgcatgtgtgaggaaggagttgaaccaagacgcattaagcaaaacccagggatcattaatcaggcactcctcaattgcttcatatagcccccggagacccagcatggcgtat

SEQ ID NO: 421613 - DNA, 140 bp, Artificial Sequence
  Synthetic
aggccctggctgctgatatgaaaggatgtaatggaatcaatggataaagaggaaatagagataacaacacattttcaaagaaaaaggagagtgagagacaacatgaccaagaagatggtcgaccttttgggacagcggtg

SEQ ID NO: 421614 - DNA, 140 bp, Artificial Sequence
  Synthetic
caccgctgtcccaaaaggtcgaccatcttcttggtcatgttgtctctcactctcctttttctttgaaaatgtgttgttatctctatttcctctttatccattgattccattacatcctttcatatcagcagccagggcct

SEQ ID NO: 421615 - DNA, 140 bp, Artificial Sequence
  Synthetic
aggccctggctgctgatatgcatgcagacctcagtgccaaggaagcacaagatgttatcatggaagttgttttcccaaatgaagtgggagccagaatactaacatcagagtcgcaattaagaccttttgggacagcggtg

SEQ ID NO: 421616 - DNA, 140 bp, Artificial Sequence
  Synthetic
caccgctgtcccaaaaggtcttaattgcgactctgatgttagtattctggctcccacttcatttgggaaaacaacttccatgataacatcttgtgcttccttggcactgaggtctgcatgcatatcagcagccagggcct

SEQ ID NO: 421617 - DNA, 140 bp, Artificial Sequence
  Synthetic
atacgccatgctgggtctccggcaattctccagtgttcaattacaacaaagcaaccaaaaggcttacaattcttggaaaagatgcaggtgcattgactgaagatccagatgaaggcacagcgtacttgggagtcggccat

SEQ ID NO: 421618 - DNA, 140 bp, Artificial Sequence
  Synthetic
atggccgactcccaagtacgctgtgccttcatctggatcttcagtcaatgcacctgcatcttttccaagaattgtaagccttttggttgctttgttgtaattgaacactggagaattgccggagacccagcatggcgtat

SEQ ID NO: 421619 - DNA, 140 bp, Artificial Sequence
  Synthetic
atacgccatgctgggtctccaaaccgattgtgtgttggaagcaatggctttccttgaagaatcccacccagggatctttgaaaactcatgccttgaaacgatggaagttattcagcaaaccgtacttgggagtcggccat

SEQ ID NO: 421620 - DNA, 140 bp, Artificial Sequence
  Synthetic
atggccgactcccaagtacggtttgctgaataacttccatcgtttcaaggcatgagttttcaaagatccctgggtgggattcttcaaggaaagccattgcttccaacacacaatcggtttggagacccagcatggcgtat

SEQ ID NO: 421621 - DNA, 140 bp, Artificial Sequence
  Synthetic
atacgccatgctgggtctcccaacgagtcagcagacatgagcattggtgttacagtaataaagaacaatatgattaacaacgatcttggaccagcaacagctcagatggcccttcagctacgtacttgggagtcggccat

SEQ ID NO: 421622 - DNA, 140 bp, Artificial Sequence
  Synthetic
atggccgactcccaagtacgtagctgaagggccatctgagctgttgctggtccaagatcgttgttaatcatattgttctttattactgtaacaccaatgctcatgtctgctgactcgttgggagacccagcatggcgtat

SEQ ID NO: 421623 - DNA, 140 bp, Artificial Sequence
  Synthetic
atacgccatgctgggtctccagatcgaatggtctaacagccaatgaatcagggagactaatagacttcctcaaggatgtaatggaatcaatggacaaagaagaaatggagataacaacaccgtacttgggagtcggccat

SEQ ID NO: 421624 - DNA, 140 bp, Artificial Sequence
  Synthetic
atggccgactcccaagtacggtgttgttatctccatttcttctttgtccattgattccattacatccttgaggaagtctattagtctccctgattcattggctgttagaccattcgatctggagacccagcatggcgtat

SEQ ID NO: 421625 - DNA, 140 bp, Artificial Sequence
  Synthetic
aggccctggctgctgatatgcaaggatgtaatggaatcaatggacaaagaagaaatggagataacaacacattttcagagaaagagaagagtaagagacaacattaccaaaaggatggtcgaccttttgggacagcggtg

SEQ ID NO: 421626 - DNA, 140 bp, Artificial Sequence
  Synthetic
caccgctgtcccaaaaggtcgaccatccttttggtaatgttgtctcttactcttctctttctctgaaaatgtgttgttatctccatttcttctttgtccattgattccattacatccttgcatatcagcagccagggcct

SEQ ID NO: 421627 - DNA, 140 bp, Artificial Sequence
  Synthetic
atacgccatgctgggtctccatccggaatctccacattccagaggtctgcttgaaatgggaattgatggatgaagactatcaaggcaggctgtgtaaccctatgaacccatttgtcagtccgtacttgggagtcggccat

SEQ ID NO: 421628 - DNA, 140 bp, Artificial Sequence
  Synthetic
atggccgactcccaagtacggactgacaaatgggttcatagggttacacagcctgccttgatagtcttcatccatcaattcccatttcaagcagacctctggaatgtggagattccggatggagacccagcatggcgtat

SEQ ID NO: 421629 - DNA, 140 bp, Artificial Sequence
  Synthetic
atacgccatgctgggtctccgagaatcagctcctcctttagctttggaggcttcaccttcaaaagaacaagtggatcatctgttaaaaaggaagaagaagtgctcacaggcaacctccaacgtacttgggagtcggccat

SEQ ID NO: 421630 - DNA, 140 bp, Artificial Sequence
  Synthetic
atggccgactcccaagtacgttggaggttgcctgtgagcacttcttcttcctttttaacagatgatccacttgttcttttgaaggtgaagcctccaaagctaaaggaggagctgattctcggagacccagcatggcgtat

SEQ ID NO: 421631 - DNA, 140 bp, Artificial Sequence
  Synthetic
atacgccatgctgggtctcccttaataagagcattgacattaaacacaatgactaaagatgcagaacggggcaaattgaaaaggcgggcaattgcaacacccggaatgcagatcaggggacgtacttgggagtcggccat

SEQ ID NO: 421632 - DNA, 140 bp, Artificial Sequence
  Synthetic
atggccgactcccaagtacgtcccctgatctgcattccgggtgttgcaattgcccgccttttcaatttgccccgttctgcatctttagtcattgtgtttaatgtcaatgctcttattaagggagacccagcatggcgtat

SEQ ID NO: 421633 - DNA, 140 bp, Artificial Sequence
  Synthetic
aggccctggctgctgatatgtcctaagaggaatcgctccattctcaacaccagccaaagggggattcttgaggatgaacagatgtaccagaagtgctgcaacctattcgaaaagttcttcgaccttttgggacagcggtg

SEQ ID NO: 421634 - DNA, 140 bp, Artificial Sequence
  Synthetic
caccgctgtcccaaaaggtcgaagaacttttcgaataggttgcagcacttctggtacatctgttcatcctcaagaatccccctttggctggtgttgagaatggagcgattcctcttaggacatatcagcagccagggcct

SEQ ID NO: 421635 - DNA, 140 bp, Artificial Sequence
  Synthetic
atacgccatgctgggtctccatatacaacaggatgggaacagtgaccacagaagctgcttttggtctagtgtgtgccacttgtgaacagattgctgattcacagcatcggtctcacagaccgtacttgggagtcggccat

SEQ ID NO: 421636 - DNA, 140 bp, Artificial Sequence
  Synthetic
atggccgactcccaagtacggtctgtgagaccgatgctgtgaatcagcaatctgttcacaagtggcacacactagaccaaaagcagcttctgtggtcactgttcccatcctgttgtatatggagacccagcatggcgtat

SEQ ID NO: 421637 - DNA, 140 bp, Artificial Sequence
  Synthetic
atacgccatgctgggtctccagtgaaaatgaatccaaatcagaagataataacaattggctcagtctctctaaccattgcaacagtatgtttcctcatgcagattgccatcctagcaacgcgtacttgggagtcggccat

SEQ ID NO: 421638 - DNA, 140 bp, Artificial Sequence
  Synthetic
atggccgactcccaagtacgcgttgctaggatggcaatctgcatgaggaaacatactgttgcaatggttagagagactgagccaattgttattatcttctgatttggattcattttcactggagacccagcatggcgtat

SEQ ID NO: 421639 - DNA, 140 bp, Artificial Sequence
  Synthetic
aggccctggctgctgatatgacaattactggagacaataccaaatggaatgagaatcagaatcctcggatgttcctggcaatgataacatacatcacaagaagccaacctgaatggttcagaccttttgggacagcggtg

SEQ ID NO: 421640 - DNA, 140 bp, Artificial Sequence
  Synthetic
caccgctgtcccaaaaggtctgaaccattcaggttggcttcttgtgatgtatgttatcattgccaggaacatccgaggattctgattctcattccatttggtattgtctccagtaattgtcatatcagcagccagggcct

SEQ ID NO: 421641 - DNA, 140 bp, Artificial Sequence
  Synthetic
aggccctggctgctgatatggactccaagcacagagatgtcattaagaggagtgaggatcagtaaaacaggagtagacgaatattccagtactgagagagtggttgtgagtattgatcgcgaccttttgggacagcggtg

SEQ ID NO: 421642 - DNA, 140 bp, Artificial Sequence
  Synthetic
caccgctgtcccaaaaggtcgcgatcaatactcacaaccactctctcagtactggaatattcgtctactcctgttttactgatcctcactcctcttaatgacatctctgtgcttggagtccatatcagcagccagggcct

SEQ ID NO: 421643 - DNA, 140 bp, Artificial Sequence
  Synthetic
aggccctggctgctgatatgaataccagcagaaatgcttgcaagcattgacctaaaatacttcaatgaatcgacaagaaagaaaatcgagagaataagacctctcttaatagatggtacagaccttttgggacagcggtg

SEQ ID NO: 421644 - DNA, 140 bp, Artificial Sequence
  Synthetic
caccgctgtcccaaaaggtctgtaccatctattaagagaggtcttattctctcgattttctttcttgtcgattcattgaagtattttaggtcaatgcttgcaagcatttctgctggtattcatatcagcagccagggcct

SEQ ID NO: 421645 - DNA, 140 bp, Artificial Sequence
  Synthetic
atacgccatgctgggtctccagtattaggagtctcaatcctgaatcttgggcaaaagaggtataccaaaaccacatactggtgggatggactccaatcctctgatgatttcgctttaatacgtacttgggagtcggccat

SEQ ID NO: 421646 - DNA, 140 bp, Artificial Sequence
  Synthetic
atggccgactcccaagtacgtattaaagcgaaatcatcagaggattggagtccatcccaccagtatgtggttttggtatacctcttttgcccaagattcaggattgagactcctaatactggagacccagcatggcgtat

SEQ ID NO: 421647 - DNA, 140 bp, Artificial Sequence
  Synthetic
aggccctggctgctgatatgccacatactggtgggatggactccaatcctctgatgatttcgctttaatagtgaatgcaccaaaccatgaaggaatacaagcaggagtggataggttctagaccttttgggacagcggtg

SEQ ID NO: 421648 - DNA, 140 bp, Artificial Sequence
  Synthetic
caccgctgtcccaaaaggtctagaacctatccactcctgcttgtattccttcatggtttggtgcattcactattaaagcgaaatcatcagaggattggagtccatcccaccagtatgtggcatatcagcagccagggcct

SEQ ID NO: 421649 - DNA, 140 bp, Artificial Sequence
  Synthetic
aggccctggctgctgatatgtacctaaagcatccagaggtcaatacagcggatttgtgagaacattattccagcaaatgcgtgatgtgctggggacatttgataccgcacaaataataaagaccttttgggacagcggtg

SEQ ID NO: 421650 - DNA, 140 bp, Artificial Sequence
  Synthetic
caccgctgtcccaaaaggtctttattatttgtgcggtatcaaatgtccccagcacatcacgcatttgctggaataatgttctcacaaatccgctgtattgacctctggatgctttaggtacatatcagcagccagggcct

SEQ ID NO: 421651 - DNA, 140 bp, Artificial Sequence
  Synthetic
atacgccatgctgggtctcctaaatcggacagggacatttgaattcacaagctttttctatcgctatggatttgtagccaacttcagtatggagttgcccagctttggggtgtctgggatcgtacttgggagtcggccat

SEQ ID NO: 421652 - DNA, 140 bp, Artificial Sequence
  Synthetic
atggccgactcccaagtacgatcccagacaccccaaagctgggcaactccatactgaagttggctacaaatccatagcgatagaaaaagcttgtgaattcaaatgtccctgtccgatttaggagacccagcatggcgtat

SEQ ID NO: 421653 - DNA, 140 bp, Artificial Sequence
  Synthetic
aggccctggctgctgatatgtttgtagccaacttcagtatggagttgcccagctttggggtgtctgggattaacgaatcagctgacatgagcattggagttactgtgataaagaacaatagaccttttgggacagcggtg

SEQ ID NO: 421654 - DNA, 140 bp, Artificial Sequence
  Synthetic
caccgctgtcccaaaaggtctattgttctttatcacagtaactccaatgctcatgtcagctgattcgttaatcccagacaccccaaagctgggcaactccatactgaagttggctacaaacatatcagcagccagggcct

SEQ ID NO: 421655 - DNA, 140 bp, Artificial Sequence
  Synthetic
aggccctggctgctgatatgccaataggggcgataaactctagtatgccattccacaacatacaccctctcaccatcggagaatgtcccaaatatgtgaaatcaaacaaattagtccttggaccttttgggacagcggtg

SEQ ID NO: 421656 - DNA, 140 bp, Artificial Sequence
  Synthetic
caccgctgtcccaaaaggtccaaggactaatttgtttgatttcacatatttgggacattctccgatggtgagagggtgtatgttgtggaatggcatactagagtttatcgcccctattggcatatcagcagccagggcct

SEQ ID NO: 421657 - DNA, 140 bp, Artificial Sequence
  Synthetic
aggccctggctgctgatatgatagtaatttctctatgaagcaggacattatagcattaactgattggtcaggatacagtggaagttttgtccaacatcctgaattaacaggaatgaattggaccttttgggacagcggtg

SEQ ID NO: 421658 - DNA, 140 bp, Artificial Sequence
  Synthetic
caccgctgtcccaaaaggtccaattcattcctgttaattcaggatgttggacaaaacttccactgtatcctgaccaatcagttaatgctataatgtcctgcttcatagagaaattactatcatatcagcagccagggcct

SEQ ID NO: 421659 - DNA, 140 bp, Artificial Sequence
  Synthetic
atacgccatgctgggtctccttcataaaggactacagatacacatatcgatgtcacaggggggatacacaaattcaaactaagaggtcattcgagttgaaaaagctgtgggagcaaaccccgtacttgggagtcggccat

SEQ ID NO: 421660 - DNA, 140 bp, Artificial Sequence
  Synthetic
atggccgactcccaagtacggggtttgctcccacagctttttcaactcgaatgacctcttagtttgaatttgtgtatcccccctgtgacatcgatatgtgtatctgtagtcctttatgaaggagacccagcatggcgtat

SEQ ID NO: 421661 - DNA, 140 bp, Artificial Sequence
  Synthetic
aggccctggctgctgatatgaattcaaactaagaggtcattcgagttgaaaaagctgtgggagcaaacccgctcaaaggcagggctgttggtttcagatgggggaccaaacctgtataacgaccttttgggacagcggtg

SEQ ID NO: 421662 - DNA, 140 bp, Artificial Sequence
  Synthetic
caccgctgtcccaaaaggtcgttatacaggtttggtcccccatctgaaaccaacagccctgcctttgagcgggtttgctcccacagctttttcaactcgaatgacctcttagtttgaattcatatcagcagccagggcct

SEQ ID NO: 421663 - DNA, 140 bp, Artificial Sequence
  Synthetic
aggccctggctgctgatatgggctctacttaatgcatcttgtgcagccatggatgacttccaattgatcccaatgataagcaaatgtaggaccaaagaaggaagacgaaaaacaaatctggaccttttgggacagcggtg

SEQ ID NO: 421664 - DNA, 140 bp, Artificial Sequence
  Synthetic
caccgctgtcccaaaaggtccagatttgtttttcgtcttccttctttggtcctacatttgcttatcattgggatcaattggaagtcatccatggctgcacaagatgcattaagtagagcccatatcagcagccagggcct

SEQ ID NO: 421665 - DNA, 140 bp, Artificial Sequence
  Synthetic
atacgccatgctgggtctcctgaagactatcagggtaggttgtgtcatcctctgaacccctttgccagtcatagggaaattgagtctgtaaacaatgctgtggtaacgccagctcatggccgtacttgggagtcggccat

SEQ ID NO: 421666 - DNA, 140 bp, Artificial Sequence
  Synthetic
atggccgactcccaagtacggccatgagctggcgttaccacagcattgtttacagactcaatttccctatgactggcaaaggggttcagaggatgacacaacctaccctgatagtcttcaggagacccagcatggcgtat

SEQ ID NO: 421667 - DNA, 140 bp, Artificial Sequence
  Synthetic
aggccctggctgctgatatgcggaacagtcagcttgattgtacaaattggaaacataatctcaatatgggttaatcattcaattcagacatgcattacttatgaaaacaacacctgggtagaccttttgggacagcggtg

SEQ ID NO: 421668 - DNA, 140 bp, Artificial Sequence
  Synthetic
caccgctgtcccaaaaggtctacccaggtgttgttttcataagtaatgcatgtctgaattgaatgattaacccatattgagattatgtttccaatttgtacaatcaagctgactgttccgcatatcagcagccagggcct

SEQ ID NO: 421669 - DNA, 140 bp, Artificial Sequence
  Synthetic
atacgccatgctgggtctccaatgggaactgaaagcatgaattttgccaagagtccggaaattgcagcaagacctgctgtgaacggccaaaggagcagaattgattattactggtctgtccgtacttgggagtcggccat

SEQ ID NO: 421670 - DNA, 140 bp, Artificial Sequence
  Synthetic
atggccgactcccaagtacggacagaccagtaataatcaattctgctcctttggccgttcacagcaggtcttgctgcaatttccggactcttggcaaaattcatgctttcagttcccattggagacccagcatggcgtat

SEQ ID NO: 421671 - DNA, 140 bp, Artificial Sequence
  Synthetic
atacgccatgctgggtctccccctaagaggaaccgatccattcttaataccagccagagaggaattcttgaagatgaacggatgtaccagaagtgctgcaatctattcgagaaattcttccgtacttgggagtcggccat

SEQ ID NO: 421672 - DNA, 140 bp, Artificial Sequence
  Synthetic
atggccgactcccaagtacggaagaatttctcgaatagattgcagcacttctggtacatccgttcatcttcaagaattcctctctggctggtattaagaatggatcggttcctcttagggggagacccagcatggcgtat

SEQ ID NO: 421673 - DNA, 140 bp, Artificial Sequence
  Synthetic
aggccctggctgctgatatgaagatgaacggatgtaccagaagtgctgcaatctattcgagaaattcttccctagtagctcatacaggaggccggttgggatttctagcatggtggaggcgaccttttgggacagcggtg

SEQ ID NO: 421674 - DNA, 140 bp, Artificial Sequence
  Synthetic
caccgctgtcccaaaaggtcgcctccaccatgctagaaatcccaaccggcctcctgtatgagctactagggaagaatttctcgaatagattgcagcacttctggtacatccgttcatcttcatatcagcagccagggcct

SEQ ID NO: 421675 - DNA, 140 bp, Artificial Sequence
  Synthetic
atacgccatgctgggtctccccatatacagtaaggacaatggtataagaattggttccaagggggatgtatttgttataagagaaccatttatctcgtgttctcatttagaatgcaggaccgtacttgggagtcggccat

SEQ ID NO: 421676 - DNA, 140 bp, Artificial Sequence
  Synthetic
atggccgactcccaagtacggtcctgcattctaaatgagaacacgagataaatggttctcttataacaaatacatcccccttggaaccaattcttataccattgtccttactgtatatggggagacccagcatggcgtat

SEQ ID NO: 421677 - DNA, 140 bp, Artificial Sequence
  Synthetic
aggccctggctgctgatatgtttgttataagagaaccatttatctcgtgttctcatttagaatgcaggaccttcttcttaacccagggagctttgttgaatgataaacattctaatggaagaccttttgggacagcggtg

SEQ ID NO: 421678 - DNA, 140 bp, Artificial Sequence
  Synthetic
caccgctgtcccaaaaggtcttccattagaatgtttatcattcaacaaagctccctgggttaagaagaaggtcctgcattctaaatgagaacacgagataaatggttctcttataacaaacatatcagcagccagggcct

SEQ ID NO: 421679 - DNA, 140 bp, Artificial Sequence
  Synthetic
atacgccatgctgggtctcctcttcccttcgaaagagcaaccattatggcagcatttacaggaaatactgagggtagaacgtctgacatgaggactgaaatcataagaatgatggaaagtcgtacttgggagtcggccat

SEQ ID NO: 421680 - DNA, 140 bp, Artificial Sequence
  Synthetic
atggccgactcccaagtacgactttccatcattcttatgatttcagtcctcatgtcagacgttctaccctcagtatttcctgtaaatgctgccataatggttgctctttcgaagggaagaggagacccagcatggcgtat

SEQ ID NO: 421681 - DNA, 140 bp, Artificial Sequence
  Synthetic
atacgccatgctgggtctccgaatgggaacagtgaccacagaagctgcttttggcctagtgtgtgccacttgtgagcaaatcgctgactcacagcatcggtcacacagacaaatggctaccgtacttgggagtcggccat

SEQ ID NO: 421682 - DNA, 140 bp, Artificial Sequence
  Synthetic
atggccgactcccaagtacggtagccatttgtctgtgtgaccgatgctgtgagtcagcgatttgctcacaagtggcacacactaggccaaaagcagcttctgtggtcactgttcccattcggagacccagcatggcgtat

SEQ ID NO: 421683 - DNA, 140 bp, Artificial Sequence
  Synthetic
atacgccatgctgggtctccacacatcaggaagacaggagaagaaccctgccctcagaatgaaatggatgatggcaatgaaatatccgatcacagcagacaagagaataatagagatgatcgtacttgggagtcggccat

SEQ ID NO: 421684 - DNA, 140 bp, Artificial Sequence
  Synthetic
atggccgactcccaagtacgatcatctctattattctcttgtctgctgtgatcggatatttcattgccatcatccatttcattctgagggcagggttcttctcctgtcttcctgatgtgtggagacccagcatggcgtat

SEQ ID NO: 421685 - DNA, 140 bp, Artificial Sequence
  Synthetic
atacgccatgctgggtctccccgggtcagacagagtgatggtatcccctctagctgtaacttggtggaacaggaatgggccgacaacaagtacagtccattatccaaaagtttacaaaaccgtacttgggagtcggccat

SEQ ID NO: 421686 - DNA, 140 bp, Artificial Sequence
  Synthetic
atggccgactcccaagtacggttttgtaaacttttggataatggactgtacttgttgtcggcccattcctgttccaccaagttacagctagaggggataccatcactctgtctgacccggggagacccagcatggcgtat

SEQ ID NO: 421687 - DNA, 140 bp, Artificial Sequence
  Synthetic
aggccctggctgctgatatgagacacaatatgtgtaggctaccatgccaacaactcatctgacactgttgacacagtacttgagaagaatgtgacagtgacacactctgtcaacctacttgaccttttgggacagcggtg

SEQ ID NO: 421688 - DNA, 140 bp, Artificial Sequence
  Synthetic
caccgctgtcccaaaaggtcaagtaggttgacagagtgtgtcactgtcacattcttctcaagtactgtgtcaacagtgtcagatgagttgttggcatggtagcctacacatattgtgtctcatatcagcagccagggcct

SEQ ID NO: 421689 - DNA, 140 bp, Artificial Sequence
  Synthetic
atacgccatgctgggtctccacacagtacttgagaagaatgtgacagtgacacactctgtcaacctacttgagaacagccacaatggaaaactatgtctactaaaaggaatagctccactcgtacttgggagtcggccat

SEQ ID NO: 421690 - DNA, 140 bp, Artificial Sequence
  Synthetic
atggccgactcccaagtacgagtggagctattccttttagtagacatagttttccattgtggctgttctcaagtaggttgacagagtgtgtcactgtcacattcttctcaagtactgtgtggagacccagcatggcgtat

SEQ ID NO: 421691 - DNA, 140 bp, Artificial Sequence
  Synthetic
atacgccatgctgggtctccgctcgaatcgaccatgggtatctttcaatcaaaatttagagtaccaaacaggatacatatgtagtggggttttcggagacagtccacgccctaatgatggcgtacttgggagtcggccat

SEQ ID NO: 421692 - DNA, 140 bp, Artificial Sequence
  Synthetic
atggccgactcccaagtacgccatcattagggcgtggactgtctccgaaaaccccactacatatgtatcctgtttggtactctaaattttgattgaaagatacccatggtcgattcgagcggagacccagcatggcgtat

SEQ ID NO: 421693 - DNA, 140 bp, Artificial Sequence
  Synthetic
atacgccatgctgggtctccgcgaattgctgatttccaaggaatcatggtcctacattgtagaaacaccaaatcctgagaatggaacatgttacccagggtatttcacagactatgaagacgtacttgggagtcggccat

SEQ ID NO: 421694 - DNA, 140 bp, Artificial Sequence
  Synthetic
atggccgactcccaagtacgtcttcatagtctgtgaaataccctgggtaacatgttccattctcaggatttggtgtttctacaatgtaggaccatgattccttggaaatcagcaattcgcggagacccagcatggcgtat

SEQ ID NO: 421695 - DNA, 140 bp, Artificial Sequence
  Synthetic
aggccctggctgctgatatgaatcctgagaatggaacatgttacccagggtatttcacagactatgaagaactgagggagcaattgagttcagtatcttcatttaagaggttccaaatatgaccttttgggacagcggtg

SEQ ID NO: 421696 - DNA, 140 bp, Artificial Sequence
  Synthetic
caccgctgtcccaaaaggtcatatttggaacctcttaaatgaagatactgaactcaattgctccctcagttcttcatagtctgtgaaataccctgggtaacatgttccattctcaggattcatatcagcagccagggcct

SEQ ID NO: 421697 - DNA, 140 bp, Artificial Sequence
  Synthetic
aggccctggctgctgatatgaggtttacaagacatactttgagaaggttgaaaggttaaaacatggaaccttcggtcccgttcacttccgaaatcaggttaagatacgccgtcgagttgagaccttttgggacagcggtg

SEQ ID NO: 421698 - DNA, 140 bp, Artificial Sequence
  Synthetic
caccgctgtcccaaaaggtctcaactcgacggcgtatcttaacctgatttcggaagtgaacgggaccgaaggttccatgttttaacctttcaaccttctcaaagtatgtcttgtaaacctcatatcagcagccagggcct

SEQ ID NO: 421699 - DNA, 140 bp, Artificial Sequence
  Synthetic
atacgccatgctgggtctcctctaccggtaacaggcggaacaagcagtgtgtacattgaggtattgcatttaactcaagggacttgttgggaacagatgtacactccaggaggagaagtgcgtacttgggagtcggccat

SEQ ID NO: 421700 - DNA, 140 bp, Artificial Sequence
  Synthetic
atggccgactcccaagtacgcacttctcctcctggagtgtacatctgttcccaacaagtcccttgagttaaatgcaatacctcaatgtacacactgcttgttccgcctgttaccggtagaggagacccagcatggcgtat

SEQ ID NO: 421701 - DNA, 140 bp, Artificial Sequence
  Synthetic
atacgccatgctgggtctcctcatgctcccataacgggaaaagcagcttctacagaaatttgctatggctgacggtgaagaacggtttgtacccaaacctgagcaagtcctatacaaacacgtacttgggagtcggccat

SEQ ID NO: 421702 - DNA, 140 bp, Artificial Sequence
  Synthetic
atggccgactcccaagtacgtgtttgtataggacttgctcaggtttgggtacaaaccgttcttcaccgtcagccatagcaaatttctgtagaagctgcttttcccgttatgggagcatgaggagacccagcatggcgtat

SEQ ID NO: 421703 - DNA, 140 bp, Artificial Sequence
  Synthetic
aggccctggctgctgatatggacggtgaagaacggtttgtacccaaacctgagcaagtcctatacaaacaaaaaggagaaagaagtccttgtactatggggtgttcatcacccatctaacgaccttttgggacagcggtg

SEQ ID NO: 421704 - DNA, 140 bp, Artificial Sequence
  Synthetic
caccgctgtcccaaaaggtcgttagatgggtgatgaacaccccatagtacaaggacttctttctcctttttgtttgtataggacttgctcaggtttgggtacaaaccgttcttcaccgtccatatcagcagccagggcct

SEQ ID NO: 421705 - DNA, 140 bp, Artificial Sequence
  Synthetic
atacgccatgctgggtctccaattagtaggtagttcttctctatgccctgttagtgggtgggctatatacagtaaagataatagtgtaagaatcggttccaaaggggatgtgtttgtcatcgtacttgggagtcggccat

SEQ ID NO: 421706 - DNA, 140 bp, Artificial Sequence
  Synthetic
atggccgactcccaagtacgatgacaaacacatcccctttggaaccgattcttacactattatctttactgtatatagcccacccactaacagggcatagagaagaactacctactaattggagacccagcatggcgtat

SEQ ID NO: 421707 - DNA, 140 bp, Artificial Sequence
  Synthetic
atacgccatgctgggtctccgccacagcacgcaaattggtggagtacggatggtagacatccttaggcaaaacccaactgaggagcaagctgtggatatatgtaaagcagcaatggggttcgtacttgggagtcggccat

SEQ ID NO: 421708 - DNA, 140 bp, Artificial Sequence
  Synthetic
atggccgactcccaagtacgaaccccattgctgctttacatatatccacagcttgctcctcagttgggttttgcctaaggatgtctaccatccgtactccaccaatttgcgtgctgtggcggagacccagcatggcgtat

SEQ ID NO: 421709 - DNA, 140 bp, Artificial Sequence
  Synthetic
atacgccatgctgggtctccagtgtcttcacattatagcagaagattcaccccagaaatagtcaaaagacccaaggtgagaaatcaggaaggaagaatcaactactactggactctgctacgtacttgggagtcggccat

SEQ ID NO: 421710 - DNA, 140 bp, Artificial Sequence
  Synthetic
atggccgactcccaagtacgtagcagagtccagtagtagttgattcttccttcctgatttctcaccttgggtcttttgactatttctggggtgaatcttctgctataatgtgaagacactggagacccagcatggcgtat

SEQ ID NO: 421711 - DNA, 140 bp, Artificial Sequence
  Synthetic
atacgccatgctgggtctccgtggatcatccatcaagaaggaagatgaagtgctcacaggaaacctccaaacattgaaaataagagtgcatgaaggatacgaggaattcacaatggttggcgtacttgggagtcggccat

SEQ ID NO: 421712 - DNA, 140 bp, Artificial Sequence
  Synthetic
atggccgactcccaagtacgccaaccattgtgaattcctcgtatccttcatgcactcttattttcaatgtttggaggtttcctgtgagcacttcatcttccttcttgatggatgatccacggagacccagcatggcgtat

SEQ ID NO: 421713 - DNA, 140 bp, Artificial Sequence
  Synthetic
atacgccatgctgggtctccaaggtatgccttcgaactgagtaaaggttttggatcaggaataatcacatcaaatgccccaatgggtgaatgtaatgcaaagtgtcaaacacctcagggacgtacttgggagtcggccat

SEQ ID NO: 421714 - DNA, 140 bp, Artificial Sequence
  Synthetic
atggccgactcccaagtacgtccctgaggtgtttgacactttgcattacattcacccattggggcatttgatgtgattattcctgatccaaaacctttactcagttcgaaggcataccttggagacccagcatggcgtat

SEQ ID NO: 421715 - DNA, 140 bp, Artificial Sequence
  Synthetic
aggccctggctgctgatatggtcctgctatatacatttacaactgcaaatgccgacacattatgtataggttatcatgcgaacaattcaactgacaccgtggacacagtactagaaaagagaccttttgggacagcggtg

SEQ ID NO: 421716 - DNA, 140 bp, Artificial Sequence
  Synthetic
caccgctgtcccaaaaggtctcttttctagtactgtgtccacggtgtcagttgaattgttcgcatgataacctatacataatgtgtcggcatttgcagttgtaaatgtatatagcaggaccatatcagcagccagggcct

SEQ ID NO: 421717 - DNA, 140 bp, Artificial Sequence
  Synthetic
aggccctggctgctgatatggctataaacagcagtcttcctttccagaatgtacacccaataacaataggagagtgtccaaagtatgtcaggagtgcaaaattaaggatggctacaggacgaccttttgggacagcggtg

SEQ ID NO: 421718 - DNA, 140 bp, Artificial Sequence
  Synthetic
caccgctgtcccaaaaggtcgtcctgtagccatccttaattttgcactcctgacatactttggacactctcctattgttattgggtgtacattctggaaaggaagactgctgtttatagccatatcagcagccagggcct

SEQ ID NO: 421719 - DNA, 140 bp, Artificial Sequence
  Synthetic
aggccctggctgctgatatggcaatggtgttctcacaggaggattgcatgataaaagcagtccgaggtgatctaaatttcgtgaacagagcaaaccaaagattaaaccccatgtatcaacgaccttttgggacagcggtg

SEQ ID NO: 421720 - DNA, 140 bp, Artificial Sequence
  Synthetic
caccgctgtcccaaaaggtcgttgatacatggggtttaatctttggtttgctctgttcacgaaatttagatcacctcggactgcttttatcatgcaatcctcctgtgagaacaccattgccatatcagcagccagggcct

SEQ ID NO: 421721 - DNA, 140 bp, Artificial Sequence
  Synthetic
aggccctggctgctgatatgaaactatgtaaactaagaggggtagctccattgcatttgggtaaatgtaacattgctggctggctcctgggaaatccagagtgtgaatcactctccacaggaccttttgggacagcggtg

SEQ ID NO: 421722 - DNA, 140 bp, Artificial Sequence
  Synthetic
caccgctgtcccaaaaggtcctgtggagagtgattcacactctggatttcccaggagccagccagcaatgttacatttacccaaatgcaatggagctacccctcttagtttacatagtttcatatcagcagccagggcct

SEQ ID NO: 421723 - DNA, 140 bp, Artificial Sequence
  Synthetic
atacgccatgctgggtctccggtttcattgaaggagggtggactggaatggtagatggttggtatggttatcaccatcagaatgagcaaggatccgggtatgctgcagaccaacaaagcacgtacttgggagtcggccat

SEQ ID NO: 421724 - DNA, 140 bp, Artificial Sequence
  Synthetic
atggccgactcccaagtacgtgctttgttggtctgcagcatacccggatccttgctcattctgatggtgataaccataccaaccatctaccattccagtccaccctccttcaatgaaaccggagacccagcatggcgtat

SEQ ID NO: 421725 - DNA, 140 bp, Artificial Sequence
  Synthetic
atacgccatgctgggtctccattgaacctattgataatgtcatggggatgatcggaatattgcctgacatgactccaagcacagagatgtcactgaggggggtaagaattagtaagatggcgtacttgggagtcggccat

SEQ ID NO: 421726 - DNA, 140 bp, Artificial Sequence
  Synthetic
atggccgactcccaagtacgccatcttactaattcttacccccctcagtgacatctctgtgcttggagtcatgtcaggcaatattccgatcatccccatgacattatcaataggttcaatggagacccagcatggcgtat

SEQ ID NO: 421727 - DNA, 140 bp, Artificial Sequence
  Synthetic
aggccctggctgctgatatgtgacccaaggcgctttgctgaatgacaaacattctaatggaaccgtcaaggacaggagtccctatagaaccctgatgagctgccccatcggtgaagctccgaccttttgggacagcggtg

SEQ ID NO: 421728 - DNA, 140 bp, Artificial Sequence
  Synthetic
caccgctgtcccaaaaggtcggagcttcaccgatggggcagctcatcagggttctatagggactcctgtccttgacggttccattagaatgtttgtcattcagcaaagcgccttgggtcacatatcagcagccagggcct

SEQ ID NO: 421729 - DNA, 140 bp, Artificial Sequence
  Synthetic
aggccctggctgctgatatgcgaccatgggtgtctttcaatcagaatctggagtatcaaataggatacatatgcagcggggttctcggagacaatccgcgccctaatgacagaataggcagaccttttgggacagcggtg

SEQ ID NO: 421730 - DNA, 140 bp, Artificial Sequence
  Synthetic
caccgctgtcccaaaaggtctgcctattctgtcattagggcgcggattgtctccgagaaccccgctgcatatgtatcctatttgatactccagattctgattgaaagacacccatggtcgcatatcagcagccagggcct

SEQ ID NO: 421731 - DNA, 140 bp, Artificial Sequence
  Synthetic
aggccctggctgctgatatgttatggaggttgttttcccaaatgaagtgggagctagaatattgacatcagagtcgcagttgaccataactagagagaagaaagaagagctccaggattggaccttttgggacagcggtg

SEQ ID NO: 421732 - DNA, 140 bp, Artificial Sequence
  Synthetic
caccgctgtcccaaaaggtccaatcctggagctcttctttcttctctctagttatggtcaactgcgactctgatgtcaatattctagctcccacttcatttgggaaaacaacctccataacatatcagcagccagggcct

SEQ ID NO: 421733 - DNA, 140 bp, Artificial Sequence
  Synthetic
atacgccatgctgggtctccggttagcgaaacgcaagggacagagaagctgactataacatattcatcatcaatgatgtgggagatcaatggcccagagtcagtgcttgttaatacttatcgtacttgggagtcggccat

SEQ ID NO: 421734 - DNA, 140 bp, Artificial Sequence
  Synthetic
atggccgactcccaagtacgataagtattaacaagcactgactctgggccattgatctcccacatcattgatgatgaatatgttatagtcagcttctctgtcccttgcgtttcgctaaccggagacccagcatggcgtat

SEQ ID NO: 421735 - DNA, 140 bp, Artificial Sequence
  Synthetic
aggccctggctgctgatatgcaatgatgtgggagatcaatggcccagagtcagtgcttgttaatacttatcaatggatcatcagacattgggagactgtaaagattcaatggtctcaagagaccttttgggacagcggtg

SEQ ID NO: 421736 - DNA, 140 bp, Artificial Sequence
  Synthetic
caccgctgtcccaaaaggtctcttgagaccattgaatctttacagtctcccaatgtctgatgatccattgataagtattaacaagcactgactctgggccattgatctcccacatcattgcatatcagcagccagggcct

SEQ ID NO: 421737 - DNA, 140 bp, Artificial Sequence
  Synthetic
aggccctggctgctgatatggcagaagtgtctcactgcagggccactgaatacataatgaagggagtgtatataaacacagccctattgaatgcatcctgtgcagccatggatgacttccgaccttttgggacagcggtg

SEQ ID NO: 421738 - DNA, 140 bp, Artificial Sequence
  Synthetic
caccgctgtcccaaaaggtcggaagtcatccatggctgcacaggatgcattcaatagggctgtgtttatatacactcccttcattatgtattcagtggccctgcagtgagacacttctgccatatcagcagccagggcct

SEQ ID NO: 421739 - DNA, 140 bp, Artificial Sequence
  Synthetic
atacgccatgctgggtctcctgtccatcttatactattgattcatctttctacagaaaccttgtatggatagtaaaaactgattcagcaacatatccagtaattaaggggacgtacaacacgtacttgggagtcggccat

SEQ ID NO: 421740 - DNA, 140 bp, Artificial Sequence
  Synthetic
atggccgactcccaagtacgtgttgtacgtccccttaattactggatatgttgctgaatcagtttttactatccatacaaggtttctgtagaaagatgaatcaatagtataagatggacaggagacccagcatggcgtat

SEQ ID NO: 421741 - DNA, 140 bp, Artificial Sequence
  Synthetic
atacgccatgctgggtctcctgcctaaagctgccagaggtcagtatagtgggtttgtgagaacactattccaacaaatgcgtgatgtactgggaacgtttgatacggtccagataataaacgtacttgggagtcggccat

SEQ ID NO: 421742 - DNA, 140 bp, Artificial Sequence
  Synthetic
atggccgactcccaagtacgtttattatctggaccgtatcaaacgttcccagtacatcacgcatttgttggaatagtgttctcacaaacccactatactgacctctggcagctttaggcaggagacccagcatggcgtat

SEQ ID NO: 421743 - DNA, 140 bp, Artificial Sequence
  Synthetic
atacgccatgctgggtctcctggagtgaaattggaatcaatgggagtctataatatcttggcgatctactcaacagtcgccagttccctagttcttttagtctccctgggggcaatcagccgtacttgggagtcggccat

SEQ ID NO: 421744 - DNA, 140 bp, Artificial Sequence
  Synthetic
atggccgactcccaagtacggctgattgcccccagggagactaaaagaactagggaactggcgactgttgagtagatcgccaagatattatagactcccattgattccaatttcactccaggagacccagcatggcgtat

SEQ ID NO: 421745 - DNA, 140 bp, Artificial Sequence
  Synthetic
aggccctggctgctgatatgctcaacagtcgccagttccctagttcttttagtctccctgggggcaatcagcttctggatgtgttccaatgggtctttacagtgtagaatatgcatctaagaccttttgggacagcggtg

SEQ ID NO: 421746 - DNA, 140 bp, Artificial Sequence
  Synthetic
caccgctgtcccaaaaggtcttagatgcatattctacactgtaaagacccattggaacacatccagaagctgattgcccccagggagactaaaagaactagggaactggcgactgttgagcatatcagcagccagggcct

SEQ ID NO: 421747 - DNA, 140 bp, Artificial Sequence
  Synthetic
atacgccatgctgggtctccatcggctccgccgagatcaaaagtccctaaaaggaagaggcaacacccttggcctcgatatcgaaactgccactcttgttgggaagcaaattgtggagtgcgtacttgggagtcggccat

SEQ ID NO: 421748 - DNA, 140 bp, Artificial Sequence
  Synthetic
atggccgactcccaagtacgcactccacaatttgcttcccaacaagagtggcagtttcgatatcgaggccaagggtgttgcctcttccttttagggacttttgatctcggcggagccgatggagacccagcatggcgtat

SEQ ID NO: 421749 - DNA, 140 bp, Artificial Sequence
  Synthetic
atacgccatgctgggtctccggtaactcccccgtgttcaattacaataaagcaaccaaaaggctgacggtcctagggaaggatgcaggctcattggcggaagacccagaagagggtacagcgtacttgggagtcggccat

SEQ ID NO: 421750 - DNA, 140 bp, Artificial Sequence
  Synthetic
atggccgactcccaagtacgctgtaccctcttctgggtcttccgccaatgagcctgcatccttccctaggaccgtcagccttttggttgctttattgtaattgaacacgggggagttaccggagacccagcatggcgtat

SEQ ID NO: 421751 - DNA, 140 bp, Artificial Sequence
  Synthetic
aggccctggctgctgatatgcctagggaaggatgcaggctcattggcggaagacccagaagagggtacagctggggtggaatctgctgtattgaggggattcctaattctaggcaaggaggaccttttgggacagcggtg

SEQ ID NO: 421752 - DNA, 140 bp, Artificial Sequence
  Synthetic
caccgctgtcccaaaaggtcctccttgcctagaattaggaatcccctcaatacagcagattccaccccagctgtaccctcttctgggtcttccgccaatgagcctgcatccttccctaggcatatcagcagccagggcct

SEQ ID NO: 421753 - DNA, 140 bp, Artificial Sequence
  Synthetic
atacgccatgctgggtctcctcaagtcagatttaccaatcgagaactgcgatgccacatgccagacaattgcaggagtcctaagaacaaataaaacatttcagaatgtgagccctctatgcgtacttgggagtcggccat

SEQ ID NO: 421754 - DNA, 140 bp, Artificial Sequence
  Synthetic
atggccgactcccaagtacgcatagagggctcacattctgaaatgttttatttgttcttaggactcctgcaattgtctggcatgtggcatcgcagttctcgattggtaaatctgacttgaggagacccagcatggcgtat

SEQ ID NO: 421755 - DNA, 140 bp, Artificial Sequence
  Synthetic
aggccctggctgctgatatgaaaaggggaaaaagctaatgtgctgataggacaaggagacgtggtgttggtaatgaaacggaaacgggactctagtatacttactgacagtcagacagctgaccttttgggacagcggtg

SEQ ID NO: 421756 - DNA, 140 bp, Artificial Sequence
  Synthetic
caccgctgtcccaaaaggtcagctgtctgactgtcagtaagtatactagagtcccgtttccgtttcattaccaacaccacgtctccttgtcctatcagcacattagctttttccccttttcatatcagcagccagggcct

SEQ ID NO: 421757 - DNA, 140 bp, Artificial Sequence
  Synthetic
atacgccatgctgggtctccatggaagactttgtgcgacaatgcttcaatccaatgatcgtcgagcttgcggaaaaggcaatgaaagaatatggggaagatccaaaaatcgaaacaaacacgtacttgggagtcggccat

SEQ ID NO: 421758 - DNA, 140 bp, Artificial Sequence
  Synthetic
atggccgactcccaagtacgtgtttgtttcgatttttggatcttccccatattctttcattgccttttccgcaagctcgacgatcattggattgaagcattgtcgcacaaagtcttccatggagacccagcatggcgtat

SEQ ID NO: 421759 - DNA, 140 bp, Artificial Sequence
  Synthetic
atacgccatgctgggtctccattgcaggtttcattgaaggaggatggactggaatgatagatggatggtatggttatcaccatgaaaattctcaaggctcaggatatgcagcagacagagcgtacttgggagtcggccat

SEQ ID NO: 421760 - DNA, 140 bp, Artificial Sequence
  Synthetic
atggccgactcccaagtacgctctgtctgctgcatatcctgagccttgagaattttcatggtgataaccataccatccatctatcattccagtccatcctccttcaatgaaacctgcaatggagacccagcatggcgtat

SEQ ID NO: 421761 - DNA, 140 bp, Artificial Sequence
  Synthetic
aggccctggctgctgatatgtggttatcaccatgaaaattctcaaggctcaggatatgcagcagacagagaaagcacccaaaaggctatagacggaattacaaataaggtcaactccatcgaccttttgggacagcggtg

SEQ ID NO: 421762 - DNA, 140 bp, Artificial Sequence
  Synthetic
caccgctgtcccaaaaggtcgatggagttgaccttatttgtaattccgtctatagccttttgggtgctttctctgtctgctgcatatcctgagccttgagaattttcatggtgataaccacatatcagcagccagggcct

SEQ ID NO: 421763 - DNA, 140 bp, Artificial Sequence
  Synthetic
aggccctggctgctgatatgtgcaaaatgctataagtaccacattcccttatactggagaccctccatacagccatgggacagggacagggtacaccatggacacagtcaacagaacacagaccttttgggacagcggtg

SEQ ID NO: 421764 - DNA, 140 bp, Artificial Sequence
  Synthetic
caccgctgtcccaaaaggtctgtgttctgttgactgtgtccatggtgtaccctgtccctgtcccatggctgtatggagggtctccagtataagggaatgtggtacttatagcattttgcacatatcagcagccagggcct

SEQ ID NO: 421765 - DNA, 140 bp, Artificial Sequence
  Synthetic
aggccctggctgctgatatgcgtgcccagtgagcgaggactgcagcgcagacgctttgttcagaatgccctaaatggaaatggagatccaaacaacatggataaggcagttaaactatacgaccttttgggacagcggtg

SEQ ID NO: 421766 - DNA, 140 bp, Artificial Sequence
  Synthetic
caccgctgtcccaaaaggtcgtatagtttaactgccttatccatgttgtttggatctccatttccatttagggcattctgaacaaagcgtctgcgctgcagtcctcgctcactgggcacgcatatcagcagccagggcct

SEQ ID NO: 421767 - DNA, 140 bp, Artificial Sequence
  Synthetic
atacgccatgctgggtctcccccaactcaacccgattgatggaccattacctgaggataacgagcccagtgggtatgcacaaacagattgtgtattagaagcaatggctttccttgaagacgtacttgggagtcggccat

SEQ ID NO: 421768 - DNA, 140 bp, Artificial Sequence
  Synthetic
atggccgactcccaagtacgtcttcaaggaaagccattgcttctaatacacaatctgtttgtgcatacccactgggctcgttatcctcaggtaatggtccatcaatcgggttgagttgggggagacccagcatggcgtat

SEQ ID NO: 421769 - DNA, 140 bp, Artificial Sequence
  Synthetic
aggccctggctgctgatatgtggatgtttggacttacaatgctgagttgttggttcttcttgaaaatgaaagaacactagatctgcatgatgcaaatgtgaagaatctatatgaaaaggtgaccttttgggacagcggtg

SEQ ID NO: 421770 - DNA, 140 bp, Artificial Sequence
  Synthetic
caccgctgtcccaaaaggtcaccttttcatatagattcttcacatttgcatcatgcagatctagtgttctttcattttcaagaagaaccaacaactcagcattgtaagtccaaacatccacatatcagcagccagggcct

SEQ ID NO: 421771 - DNA, 140 bp, Artificial Sequence
  Synthetic
aggccctggctgctgatatgggatgggaacagtaactacagaagtggctttgggcctagtgtgtgccacttgtgagcagattgctgattcacagcataggtctcatagacagatggtggcgaccttttgggacagcggtg

SEQ ID NO: 421772 - DNA, 140 bp, Artificial Sequence
  Synthetic
caccgctgtcccaaaaggtcgccaccatctgtctatgagacctatgctgtgaatcagcaatctgctcacaagtggcacacactaggcccaaagccacttctgtagttactgttcccatcccatatcagcagccagggcct

SEQ ID NO: 421773 - DNA, 140 bp, Artificial Sequence
  Synthetic
atacgccatgctgggtctccaattttggcataaatgtgacaatgaatgcatggagtctgtcaaaaatggtacctatgactatcccaaatatcaaaaggagagtaaattaaacaggcagggcgtacttgggagtcggccat

SEQ ID NO: 421774 - DNA, 140 bp, Artificial Sequence
  Synthetic
atggccgactcccaagtacgccctgcctgtttaatttactctccttttgatatttgggatagtcataggtaccatttttgacagactccatgcattcattgtcacatttatgccaaaattggagacccagcatggcgtat

SEQ ID NO: 421775 - DNA, 140 bp, Artificial Sequence
  Synthetic
aggccctggctgctgatatgtttcaggtagactgtttcctttggcacatccgcaaacggtttgcagacaatggattgggtgatgccccattccttgatcggctccgccgagatcaaaagtgaccttttgggacagcggtg

SEQ ID NO: 421776 - DNA, 140 bp, Artificial Sequence
  Synthetic
caccgctgtcccaaaaggtcacttttgatctcggcggagccgatcaaggaatggggcatcacccaatccattgtctgcaaaccgtttgcggatgtgccaaaggaaacagtctacctgaaacatatcagcagccagggcct

SEQ ID NO: 421777 - DNA, 140 bp, Artificial Sequence
  Synthetic
atacgccatgctgggtctccttgtggcaagtggatatgactttgaaagagaaggatactccctagtcgggatagatccttttcgtctgcttcagaacagccaagtttacagcctcattagcgtacttgggagtcggccat

SEQ ID NO: 421778 - DNA, 140 bp, Artificial Sequence
  Synthetic
atggccgactcccaagtacgctaatgaggctgtaaacttggctgttctgaagcagacgaaaaggatctatcccgactagggagtatccttctctttcaaagtcatatccacttgccacaaggagacccagcatggcgtat

SEQ ID NO: 421779 - DNA, 140 bp, Artificial Sequence
  Synthetic
atacgccatgctgggtctcctctatagtacggtatcgagcagtctagtgttggtagggctgatcatggcaataggtctttggatgtgttcaaatggttcaatgcaatgcaggatatgtatcgtacttgggagtcggccat

SEQ ID NO: 421780 - DNA, 140 bp, Artificial Sequence
  Synthetic
atggccgactcccaagtacgatacatatcctgcattgcattgaaccatttgaacacatccaaagacctattgccatgatcagccctaccaacactagactgctcgataccgtactatagaggagacccagcatggcgtat

SEQ ID NO: 421781 - DNA, 140 bp, Artificial Sequence
  Synthetic
atacgccatgctgggtctccattctgcagcatttgaagatctgagggtgtcaagttttatcagaggtaaaaaagtgataccaagaggacaattgtccaccagaggggttcaaattgcttccgtacttgggagtcggccat

SEQ ID NO: 421782 - DNA, 140 bp, Artificial Sequence
  Synthetic
atggccgactcccaagtacggaagcaatttgaacccctctggtggacaattgtcctcttggtatcacttttttacctctgataaaacttgacaccctcagatcttcaaatgctgcagaatggagacccagcatggcgtat

SEQ ID NO: 421783 - DNA, 140 bp, Artificial Sequence
  Synthetic
atacgccatgctgggtctcctcacaatggttgggcggagagcgacagctatcctgaggaaagcaaccagaagactgattcagttgatagtaagtggaaaagacgaacaatcaatcgctgacgtacttgggagtcggccat

SEQ ID NO: 421784 - DNA, 140 bp, Artificial Sequence
  Synthetic
atggccgactcccaagtacgtcagcgattgattgttcgtcttttccacttactatcaactgaatcagtcttctggttgctttcctcaggatagctgtcgctctccgcccaaccattgtgaggagacccagcatggcgtat

SEQ ID NO: 421785 - DNA, 140 bp, Artificial Sequence
  Synthetic
atacgccatgctgggtctccatgaatccaaatcagaggataataacaatcggctccgtctctctagctactgcaacagtatgtttcctcatgcagattgccatcttaacaatgactgtgacgtacttgggagtcggccat

SEQ ID NO: 421786 - DNA, 140 bp, Artificial Sequence
  Synthetic
atggccgactcccaagtacgtcacagtcattgttaagatggcaatctgcatgaggaaacatactgttgcagtagctagagagacggagccgattgttattatcctctgatttggattcatggagacccagcatggcgtat

SEQ ID NO: 421787 - DNA, 140 bp, Artificial Sequence
  Synthetic
aggccctggctgctgatatgtgcaacagtatgtttcctcatgcagattgccatcttaacaatgactgtgacactacatttcaaacacaacgaatgcagcatctccgctaacaaccagattgaccttttgggacagcggtg

SEQ ID NO: 421788 - DNA, 140 bp, Artificial Sequence
  Synthetic
caccgctgtcccaaaaggtcaatctggttgttagcggagatgctgcattcgttgtgtttgaaatgtagtgtcacagtcattgttaagatggcaatctgcatgaggaaacatactgttgcacatatcagcagccagggcct

SEQ ID NO: 421789 - DNA, 140 bp, Artificial Sequence
  Synthetic
aggccctggctgctgatatgtgtgctcggaaactacaaagaaatgtgtgctgcatggtccagtagcagctgcttcgatggaaaagaatggttgcatgtttgtatcacaggaaacgataatgaccttttgggacagcggtg

SEQ ID NO: 421790 - DNA, 140 bp, Artificial Sequence
  Synthetic
caccgctgtcccaaaaggtcattatcgtttcctgtgatacaaacatgcaaccattcttttccatcgaagcagctgctactggaccatgcagcacacatttctttgtagtttccgagcacacatatcagcagccagggcct

SEQ ID NO: 421791 - DNA, 140 bp, Artificial Sequence
  Synthetic
atacgccatgctgggtctccgtgccatgtaaaccaatcataatggagaggagcatagactacaggaattggtcaaaaccgcagtgtcaaatcaccgggtttgctcctttttccaaggacacgtacttgggagtcggccat

SEQ ID NO: 421792 - DNA, 140 bp, Artificial Sequence
  Synthetic
atggccgactcccaagtacgtgtccttggaaaaaggagcaaacccggtgatttgacactgcggttttgaccaattcctgtagtctatgctcctctccattatgattggtttacatggcacggagacccagcatggcgtat

SEQ ID NO: 421793 - DNA, 140 bp, Artificial Sequence
  Synthetic
atacgccatgctgggtctcctttaaatacggcaatggcatttggatagggagaactaaaagcactagctcaaggagcggttttgagatgatttgggatccaaacggatggactggaacagcgtacttgggagtcggccat

SEQ ID NO: 421794 - DNA, 140 bp, Artificial Sequence
  Synthetic
atggccgactcccaagtacgctgttccagtccatccgtttggatcccaaatcatctcaaaaccgctccttgagctagtgcttttagttctccctatccaaatgccattgccgtatttaaaggagacccagcatggcgtat

SEQ ID NO: 421795 - DNA, 140 bp, Artificial Sequence
  Synthetic
atacgccatgctgggtctccattcttggattcctaaaaggaatcgttccattctcaacacgagtcaaaggggaattcttgaggatgaacagatgtaccaaaagtgctgcaatctattcgacgtacttgggagtcggccat

SEQ ID NO: 421796 - DNA, 140 bp, Artificial Sequence
  Synthetic
atggccgactcccaagtacgtcgaatagattgcagcacttttggtacatctgttcatcctcaagaattcccctttgactcgtgttgagaatggaacgattccttttaggaatccaagaatggagacccagcatggcgtat

SEQ ID NO: 421797 - DNA, 140 bp, Artificial Sequence
  Synthetic
aggccctggctgctgatatgctattggagatgtgccacagcacacaaattggtgggataaagatggtggacatccttaggcaaaatccaaccgaagaacaagctgttgatatatgtaaaggaccttttgggacagcggtg

SEQ ID NO: 421798 - DNA, 140 bp, Artificial Sequence
  Synthetic
caccgctgtcccaaaaggtcctttacatatatcaacagcttgttcttcggttggattttgcctaaggatgtccaccatctttatcccaccaatttgtgtgctgtggcacatctccaatagcatatcagcagccagggcct

SEQ ID NO: 421799 - DNA, 140 bp, Artificial Sequence
  Synthetic
atacgccatgctgggtctccagcatggttgcatgtctgtgttactggggatgatagaaatgcgactgctagtttcatttatgatgggatgctcgttgacagtataggttcatggtctcaacgtacttgggagtcggccat

SEQ ID NO: 421800 - DNA, 140 bp, Artificial Sequence
  Synthetic
atggccgactcccaagtacgttgagaccatgaacctatactgtcaacgagcatcccatcataaatgaaactagcagtcgcatttctatcatccccagtaacacagacatgcaaccatgctggagacccagcatggcgtat

SEQ ID NO: 421801 - DNA, 140 bp, Artificial Sequence
  Synthetic
atacgccatgctgggtctcctaatagatatgattcctgaaaggaatgaacaagggcagacactctggagcaagacaaatgatgctgggtcggacagggtgatggtgtcccccctagcagtcgtacttgggagtcggccat

SEQ ID NO: 421802 - DNA, 140 bp, Artificial Sequence
  Synthetic
atggccgactcccaagtacgactgctaggggggacaccatcaccctgtccgacccagcatcatttgtcttgctccagagtgtctgcccttgttcattcctttcaggaatcatatctattaggagacccagcatggcgtat

SEQ ID NO: 421803 - DNA, 140 bp, Artificial Sequence
  Synthetic
atacgccatgctgggtctcccatccttaggcaaaatccaaccgaagaacaagctgttgatatatgtaaagcagcaatgggtttgaggatcagttcatcctttagctttggaggcttcactcgtacttgggagtcggccat

SEQ ID NO: 421804 - DNA, 140 bp, Artificial Sequence
  Synthetic
atggccgactcccaagtacgagtgaagcctccaaagctaaaggatgaactgatcctcaaacccattgctgctttacatatatcaacagcttgttcttcggttggattttgcctaaggatgggagacccagcatggcgtat

SEQ ID NO: 421805 - DNA, 140 bp, Artificial Sequence
  Synthetic
aggccctggctgctgatatgcagatgtgtatgcagagacaactggaagggctctaataggcccgttatagatataaatatggcagactatagcatcggttccagctatgtgtgctcaggggaccttttgggacagcggtg

SEQ ID NO: 421806 - DNA, 140 bp, Artificial Sequence
  Synthetic
caccgctgtcccaaaaggtcccctgagcacacatagctggaaccgatgctatagtctgccatatttatatctataacgggcctattagagcccttccagttgtctctgcatacacatctgcatatcagcagccagggcct

SEQ ID NO: 421807 - DNA, 140 bp, Artificial Sequence
  Synthetic
atacgccatgctgggtctccgccagacttatgattggacattaaacaggaatcaaccggcagcaactgcattagccaacaccatagaagtctttagatcgaacggattaacagctaatgacgtacttgggagtcggccat

SEQ ID NO: 421808 - DNA, 140 bp, Artificial Sequence
  Synthetic
atggccgactcccaagtacgtcattagctgttaatccgttcgatctaaagacttctatggtgttggctaatgcagttgctgccggttgattcctgtttaatgtccaatcataagtctggcggagacccagcatggcgtat

SEQ ID NO: 421809 - DNA, 140 bp, Artificial Sequence
  Synthetic
atacgccatgctgggtctcccagagatcctaataatgagaggggaaaccctggagtgaaagggtgggcctttgacgatggaaatgatgtctggatgggaaggacaatcagtaaagattcgcgtacttgggagtcggccat

SEQ ID NO: 421810 - DNA, 140 bp, Artificial Sequence
  Synthetic
atggccgactcccaagtacgcgaatctttactgattgtccttcccatccagacatcatttccatcgtcaaaggcccaccctttcactccagggtttcccctctcattattaggatctctgggagacccagcatggcgtat

SEQ ID NO: 421811 - DNA, 140 bp, Artificial Sequence
  Synthetic
aggccctggctgctgatatgttgacgatggaaatgatgtctggatgggaaggacaatcagtaaagattcgcgctcaggctatgagacttttagggtcattggtggttgggcaattgccaagaccttttgggacagcggtg

SEQ ID NO: 421812 - DNA, 140 bp, Artificial Sequence
  Synthetic
caccgctgtcccaaaaggtcttggcaattgcccaaccaccaatgaccctaaaagtctcatagcctgagcgcgaatctttactgattgtccttcccatccagacatcatttccatcgtcaacatatcagcagccagggcct

SEQ ID NO: 421813 - DNA, 140 bp, Artificial Sequence
  Synthetic
atacgccatgctgggtctcctctcagattgcctaatgggcctccctgctctcagcggtcgaaattcttgctgatggatgctctgaaattaagcattgaggacccgagccacgaaggggagcgtacttgggagtcggccat

SEQ ID NO: 421814 - DNA, 140 bp, Artificial Sequence
  Synthetic
atggccgactcccaagtacgctccccttcgtggctcgggtcctcaatgcttaatttcagagcatccatcagcaagaatttcgaccgctgagagcagggaggcccattaggcaatctgagaggagacccagcatggcgtat

SEQ ID NO: 421815 - DNA, 140 bp, Artificial Sequence
  Synthetic
aggccctggctgctgatatggaaagagcccaacattatcaaaccacatgagaaaggcataaaccccaattatctcctgacttggaagcaggtgctagcagaacttcaggacattgaaaatgaccttttgggacagcggtg

SEQ ID NO: 421816 - DNA, 140 bp, Artificial Sequence
  Synthetic
caccgctgtcccaaaaggtcattttcaatgtcctgaagttctgctagcacctgcttccaagtcaggagataattggggtttatgcctttctcatgtggtttgataatgttgggctctttccatatcagcagccagggcct

SEQ ID NO: 421817 - DNA, 140 bp, Artificial Sequence
  Synthetic
atacgccatgctgggtctcctgctaccccggagaattcgctgattatgaagagttaaaggagcagctgagtacagtttcttcatttgaaagatttgagattttcccaaaggcaacctcatcgtacttgggagtcggccat

SEQ ID NO: 421818 - DNA, 140 bp, Artificial Sequence
  Synthetic
atggccgactcccaagtacgatgaggttgcctttgggaaaatctcaaatctttcaaatgaagaaactgtactcagctgctcctttaactcttcataatcagcgaattctccggggtagcaggagacccagcatggcgtat

SEQ ID NO: 421819 - DNA, 140 bp, Artificial Sequence
  Synthetic
atacgccatgctgggtctccttcaaaagaacaagtgggtcatccgtcacgaaagaagaggaagtgcttacgggcaaccttcaaacattaaaaataaaagtacatgaggggtatgaagaatcgtacttgggagtcggccat

SEQ ID NO: 421820 - DNA, 140 bp, Artificial Sequence
  Synthetic
atggccgactcccaagtacgattcttcatacccctcatgtacttttatttttaatgtttgaaggttgcccgtaagcacttcctcttctttcgtgacggatgacccacttgttcttttgaaggagacccagcatggcgtat

SEQ ID NO: 421821 - DNA, 140 bp, Artificial Sequence
  Synthetic
atacgccatgctgggtctcctctctctgcatttgatgaaagaaggaacagatacctggaagaacatcccaatgcggggaaggacccaaagaagactggaggtccaatctaccgaaggagacgtacttgggagtcggccat

SEQ ID NO: 421822 - DNA, 140 bp, Artificial Sequence
  Synthetic
atggccgactcccaagtacgtctccttcggtagattggacctccagtcttctttgggtccttccccgcattgggatgttcttccaggtatctgttccttctttcatcaaatgcagagagaggagacccagcatggcgtat

SEQ ID NO: 421823 - DNA, 140 bp, Artificial Sequence
  Synthetic
atacgccatgctgggtctccaggctgattcagttgatagtaagcgggaggaacgaacaatcaatcgctgaggcaatcattgtagcgatggtgttctcacaggaggattgcatgatgaaggcgtacttgggagtcggccat

SEQ ID NO: 421824 - DNA, 140 bp, Artificial Sequence
  Synthetic
atggccgactcccaagtacgccttcatcatgcaatcctcctgtgagaacaccatcgctacaatgattgcctcagcgattgattgttcgttcctcccgcttactatcaactgaatcagcctggagacccagcatggcgtat

SEQ ID NO: 421825 - DNA, 140 bp, Artificial Sequence
  Synthetic
aggccctggctgctgatatgaggcaatctccaaacgttgaaaataagagtacatgagggctatgaggaattcacaatggttgggcggagagcgacagctatcctgaggaaagcaaccagagaccttttgggacagcggtg

SEQ ID NO: 421826 - DNA, 140 bp, Artificial Sequence
  Synthetic
caccgctgtcccaaaaggtctctggttgctttcctcaggatagctgtcgctctccgcccaaccattgtgaattcctcatagccctcatgtactcttattttcaacgtttggagattgcctcatatcagcagccagggcct

SEQ ID NO: 421827 - DNA, 140 bp, Artificial Sequence
  Synthetic
aggccctggctgctgatatgagctttgctcaatgcatcttgtgcagccatggatgactttcaactgattccaatgataagtaaatgtagaaccaaagaaggaagacggaaaacaaacctggaccttttgggacagcggtg

SEQ ID NO: 421828 - DNA, 140 bp, Artificial Sequence
  Synthetic
caccgctgtcccaaaaggtccaggtttgttttccgtcttccttctttggttctacatttacttatcattggaatcagttgaaagtcatccatggctgcacaagatgcattgagcaaagctcatatcagcagccagggcct

SEQ ID NO: 421829 - DNA, 140 bp, Artificial Sequence
  Synthetic
aggccctggctgctgatatgccagccaatgacctctgttacccagggaatttcaacgattatgaagaattgaaacacctattgagcaggataaaccattttgagaaaatacagatcatccgaccttttgggacagcggtg

SEQ ID NO: 421830 - DNA, 140 bp, Artificial Sequence
  Synthetic
caccgctgtcccaaaaggtcggatgatctgtattttctcaaaatggtttatcctgctcaataggtgtttcaattcttcataatcgttgaaattccctgggtaacagaggtcattggctggcatatcagcagccagggcct

SEQ ID NO: 421831 - DNA, 140 bp, Artificial Sequence
  Synthetic
aggccctggctgctgatatgagggagtcggaacaatggtgatggaaataattcgaatgataaaaagagggattaatgaccggaatttctggagaggtgaaaatgggcgaagaacaagggtgaccttttgggacagcggtg

SEQ ID NO: 421832 - DNA, 140 bp, Artificial Sequence
  Synthetic
caccgctgtcccaaaaggtcacccttgttcttcgcccattttcacctctccagaaattccggtcattaatccctctttttatcattcgaattatttccatcaccattgttccgactccctcatatcagcagccagggcct

SEQ ID NO: 421833 - DNA, 140 bp, Artificial Sequence
  Synthetic
atacgccatgctgggtctcccacataaatgggaaaagtattgtgttcttgaaataggggacatgctcctgcgaactgcagtaggccaagtgtcaagacccatgtttctgtatgtgagaaccgtacttgggagtcggccat

SEQ ID NO: 421834 - DNA, 140 bp, Artificial Sequence
  Synthetic
atggccgactcccaagtacggttctcacatacagaaacatgggtcttgacacttggcctactgcagttcgcaggagcatgtcccctatttcaagaacacaatacttttcccatttatgtgggagacccagcatggcgtat

SEQ ID NO: 421835 - DNA, 140 bp, Artificial Sequence
  Synthetic
atacgccatgctgggtctccggtctggaaattgaaccagccactcgtgctgggaaacaaatagtgaagcgtatcctagaagaagaaaacgatgaggcatttaaaataactatagcttctgcgtacttgggagtcggccat

SEQ ID NO: 421836 - DNA, 140 bp, Artificial Sequence
  Synthetic
atggccgactcccaagtacgcagaagctatagttattttaaatgcctcatcgttttcttcttctaggatacgcttcactatttgtttcccagcacgagtggctggttcaatttccagaccggagacccagcatggcgtat

SEQ ID NO: 421837 - DNA, 140 bp, Artificial Sequence
  Synthetic
aggccctggctgctgatatgcaatgggacctccaagatcaagatgaaatggggtatggaaatgagacgctgccttcttcaatctctccaacagattgagagcatgattgaagctgaatccgaccttttgggacagcggtg

SEQ ID NO: 421838 - DNA, 140 bp, Artificial Sequence
  Synthetic
caccgctgtcccaaaaggtcggattcagcttcaatcatgctctcaatctgttggagagattgaagaaggcagcgtctcatttccataccccatttcatcttgatcttggaggtcccattgcatatcagcagccagggcct

SEQ ID NO: 421839 - DNA, 140 bp, Artificial Sequence
  Synthetic
aggccctggctgctgatatggctgaaattgaagatctcatcttcctggcacgatctgcactcatcctgagaggatcagtagcccataagtcctgcctgcctgcatgtgtatacggccttggaccttttgggacagcggtg

SEQ ID NO: 421840 - DNA, 140 bp, Artificial Sequence
  Synthetic
caccgctgtcccaaaaggtccaaggccgtatacacatgcaggcaggcaggacttatgggctactgatcctctcaggatgagtgcagatcgtgccaggaagatgagatcttcaatttcagccatatcagcagccagggcct

SEQ ID NO: 421841 - DNA, 140 bp, Artificial Sequence
  Synthetic
aggccctggctgctgatatgcagaatggaccaagcaataatggataaaaaaatcacattgaaagcaaacttcagtgtgatttttgatcgactggaaaccctgatactccttagagctttcgaccttttgggacagcggtg

SEQ ID NO: 421842 - DNA, 140 bp, Artificial Sequence
  Synthetic
caccgctgtcccaaaaggtcgaaagctctaaggagtatcagggtttccagtcgatcaaaaatcacactgaagtttgctttcaatgtgatttttttatccattattgcttggtccattctgcatatcagcagccagggcct

SEQ ID NO: 421843 - DNA, 140 bp, Artificial Sequence
  Synthetic
aggccctggctgctgatatggagaacattatttcaacaaatgcgtgatgtactagggacatttgatactgtccagataataaagctgctaccatttgcagcagcaccacctgagcagagcgaccttttgggacagcggtg

SEQ ID NO: 421844 - DNA, 140 bp, Artificial Sequence
  Synthetic
caccgctgtcccaaaaggtcgctctgctcaggtggtgctgctgcaaatggtagcagctttattatctggacagtatcaaatgtccctagtacatcacgcatttgttgaaataatgttctccatatcagcagccagggcct

SEQ ID NO: 421845 - DNA, 140 bp, Artificial Sequence
  Synthetic
aggccctggctgctgatatggcatctccgcaactcgaggggttctcagctgaatcgagaaaactgctactcattgttcaggcgcttagggataacctggaacctggaacctttgatcttggaccttttgggacagcggtg

SEQ ID NO: 421846 - DNA, 140 bp, Artificial Sequence
  Synthetic
caccgctgtcccaaaaggtccaagatcaaaggttccaggttccaggttatccctaagcgcctgaacaatgagtagcagttttctcgattcagctgagaacccctcgagttgcggagatgccatatcagcagccagggcct

SEQ ID NO: 421847 - DNA, 140 bp, Artificial Sequence
  Synthetic
aggccctggctgctgatatgagaatgcagttttcttctctaactgtgaatgtgagggggtcaggaatgagaatactcataaggggcaattcccctgtgttcaactacaataaggcgaccagaccttttgggacagcggtg

SEQ ID NO: 421848 - DNA, 140 bp, Artificial Sequence
  Synthetic
caccgctgtcccaaaaggtctggtcgccttattgtagttgaacacaggggaattgccccttatgagtattctcattcctgaccccctcacattcacagttagagaagaaaactgcattctcatatcagcagccagggcct

SEQ ID NO: 421849 - DNA, 140 bp, Artificial Sequence
  Synthetic
aggccctggctgctgatatggacttgaatggaatggtaacaaaattcgagtctctgaagctctacagagattcacttggagaagcactaatgaggacgggagacctccattatctccaaggaccttttgggacagcggtg

SEQ ID NO: 421850 - DNA, 140 bp, Artificial Sequence
  Synthetic
caccgctgtcccaaaaggtccttggagataatggaggtctcccgtcctcattagtgcttctccaagtgaatctctgtagagcttcagagactcgaattttgttaccattccattcaagtccatatcagcagccagggcct

SEQ ID NO: 421851 - DNA, 140 bp, Artificial Sequence
  Synthetic
atacgccatgctgggtctccgaatgagaacatggaaacaatagactccagcactcttgaactaagaagtagatactgggccataagaaccagaagtggaggaaacaccaaccagcagagacgtacttgggagtcggccat

SEQ ID NO: 421852 - DNA, 140 bp, Artificial Sequence
  Synthetic
atggccgactcccaagtacgtctctgctggttggtgtttcctccacttctggttcttatggcccagtatctacttcttagttcaagagtgctggagtctattgtttccatgttctcattcggagacccagcatggcgtat

SEQ ID NO: 421853 - DNA, 140 bp, Artificial Sequence
  Synthetic
aggccctggctgctgatatggatactgggccataagaaccagaagtggaggaaacaccaaccagcagagagcttctgcaggacagatcagtgtgcaacctactttctcagtacagagaaagaccttttgggacagcggtg

SEQ ID NO: 421854 - DNA, 140 bp, Artificial Sequence
  Synthetic
caccgctgtcccaaaaggtctttctctgtactgagaaagtaggttgcacactgatctgtcctgcagaagctctctgctggttggtgtttcctccacttctggttcttatggcccagtatccatatcagcagccagggcct

SEQ ID NO: 421855 - DNA, 140 bp, Artificial Sequence
  Synthetic
atacgccatgctgggtctccgaaatagtcctcaaagagagagaagaagaaaaagaggactgtttggagctatagcaggttttatagagggaggatggcagggaatggtagatggttggtacgtacttgggagtcggccat

SEQ ID NO: 421856 - DNA, 140 bp, Artificial Sequence
  Synthetic
atggccgactcccaagtacgtaccaaccatctaccattccctgccatcctccctctataaaacctgctatagctccaaacagtcctctttttcttcttctctctctttgaggactatttcggagacccagcatggcgtat

SEQ ID NO: 421857 - DNA, 140 bp, Artificial Sequence
  Synthetic
aggccctggctgctgatatgaaatagcttcgagcagataacattcatgcaagcattacaactactgcttgaagtagagcaagaaataaggacattctcttttcagtttatttaatgataagaccttttgggacagcggtg

SEQ ID NO: 421858 - DNA, 140 bp, Artificial Sequence
  Synthetic
caccgctgtcccaaaaggtcttatcattaaataaactgaaaagagaatgtccttatttcttgctctacttcaagcagtagttgtaatgcttgcatgaatgttatctgctcgaagctatttcatatcagcagccagggcct

SEQ ID NO: 421859 - DNA, 140 bp, Artificial Sequence
  Synthetic
atacgccatgctgggtctccatggaaagaatagtgattgcccttgcaatagtaagcattgccacaggtgaccgaatctgcattggttatcatgcaaacaattcaacgaagcaggttgacacgtacttgggagtcggccat

SEQ ID NO: 421860 - DNA, 140 bp, Artificial Sequence
  Synthetic
atggccgactcccaagtacgtgtcaacctgcttcgttgaattgtttgcatgataaccaatgcagattcggtcacctgtggcaatgcttactattgcaagggcaatcactattctttccatggagacccagcatggcgtat

SEQ ID NO: 421861 - DNA, 140 bp, Artificial Sequence
  Synthetic
aggccctggctgctgatatgccgaatctgcattggttatcatgcaaacaattcaacgaagcaggttgacacaatcatggagaagaatgtgacggtaacacatgctcaggacatactggaagaccttttgggacagcggtg

SEQ ID NO: 421862 - DNA, 140 bp, Artificial Sequence
  Synthetic
caccgctgtcccaaaaggtcttccagtatgtcctgagcatgtgttaccgtcacattcttctccatgattgtgtcaacctgcttcgttgaattgtttgcatgataaccaatgcagattcggcatatcagcagccagggcct

SEQ ID NO: 421863 - DNA, 140 bp, Artificial Sequence
  Synthetic
atacgccatgctgggtctcccaatcatggagaagaatgtgacggtaacacatgctcaggacatactggaaagggaacacaatggaagactctgcagtcttaaaggagtgaagcccctcctcgtacttgggagtcggccat

SEQ ID NO: 421864 - DNA, 140 bp, Artificial Sequence
  Synthetic
atggccgactcccaagtacgaggaggggcttcactcctttaagactgcagagtcttccattgtgttccctttccagtatgtcctgagcatgtgttaccgtcacattcttctccatgattgggagacccagcatggcgtat

SEQ ID NO: 421865 - DNA, 140 bp, Artificial Sequence
  Synthetic
atacgccatgctgggtctccagatcgaatggcctgacagccaatgaatcaggaaggttgatcgatttcctcaaggacgtgatggattcaatggataaggaagaaatggagattacaacaccgtacttgggagtcggccat

SEQ ID NO: 421866 - DNA, 140 bp, Artificial Sequence
  Synthetic
atggccgactcccaagtacggtgttgtaatctccatttcttccttatccattgaatccatcacgtccttgaggaaatcgatcaaccttcctgattcattggctgtcaggccattcgatctggagacccagcatggcgtat

SEQ ID NO: 421867 - DNA, 140 bp, Artificial Sequence
  Synthetic
aggccctggctgctgatatggatgcgactggccaaataatatatgcagggaagatgacggactccattaaatcatggagaagggatatactaagaactcaagagtctgaatgtcaatgcagaccttttgggacagcggtg

SEQ ID NO: 421868 - DNA, 140 bp, Artificial Sequence
  Synthetic
caccgctgtcccaaaaggtctgcattgacattcagactcttgagttcttagtatatcccttctccatgatttaatggagtccgtcatcttccctgcatatattatttggccagtcgcatccatatcagcagccagggcct

SEQ ID NO: 421869 - DNA, 140 bp, Artificial Sequence
  Synthetic
atacgccatgctgggtctccatgaattcctaaatgtaccggaatggtcatacattgtggaaaaagataatccagccaatggcctgtgctatccgggaaagttcaactattatgaagaactcgtacttgggagtcggccat

SEQ ID NO: 421870 - DNA, 140 bp, Artificial Sequence
  Synthetic
atggccgactcccaagtacgagttcttcataatagttgaactttcccggatagcacaggccattggctggattatctttttccacaatgtatgaccattccggtacatttaggaattcatggagacccagcatggcgtat

SEQ ID NO: 421871 - DNA, 140 bp, Artificial Sequence
  Synthetic
atacgccatgctgggtctccgtgtgccacttgtgagcagattgcagattcacagcatcggtctcacagacagatggcaaccatcaccaacccactaatcaggcatgagaacagaatggtgcgtacttgggagtcggccat

SEQ ID NO: 421872 - DNA, 140 bp, Artificial Sequence
  Synthetic
atggccgactcccaagtacgcaccattctgttctcatgcctgattagtgggttggtgatggttgccatctgtctgtgagaccgatgctgtgaatctgcaatctgctcacaagtggcacacggagacccagcatggcgtat

SEQ ID NO: 421873 - DNA, 140 bp, Artificial Sequence
  Synthetic
atacgccatgctgggtctcctgcccatacaataacaggtcctcctttttcaggaatgtagtgtggttgatcaagaagaacaatgtgtaccgaacaataacaaggacatacaaaaacaccacgtacttgggagtcggccat

SEQ ID NO: 421874 - DNA, 140 bp, Artificial Sequence
  Synthetic
atggccgactcccaagtacgtggtgtttttgtatgtccttgttattgttcggtacacattgttcttcttgatcaaccacactacattcctgaaaaaggaggacctgttattgtatgggcaggagacccagcatggcgtat

SEQ ID NO: 421875 - DNA, 140 bp, Artificial Sequence
  Synthetic
aggccctggctgctgatatgcaagaagaacaatgtgtaccgaacaataacaaggacatacaaaaacaccaatgtagaagaccttttagtattatggggaattcaccaccctaatgatgcagaccttttgggacagcggtg

SEQ ID NO: 421876 - DNA, 140 bp, Artificial Sequence
  Synthetic
caccgctgtcccaaaaggtctgcatcattagggtggtgaattccccataatactaaaaggtcttctacattggtgtttttgtatgtccttgttattgttcggtacacattgttcttcttgcatatcagcagccagggcct

SEQ ID NO: 421877 - DNA, 140 bp, Artificial Sequence
  Synthetic
atacgccatgctgggtctccaagaaggagcaatcgtgggagaaatctcaccattaccttctcttccaggacatactggtgaggatgtcaaaaatgcaattggcgtcctcatcggaggactcgtacttgggagtcggccat

SEQ ID NO: 421878 - DNA, 140 bp, Artificial Sequence
  Synthetic
atggccgactcccaagtacgagtcctccgatgaggacgccaattgcatttttgacatcctcaccagtatgtcctggaagagaaggtaatggtgagatttctcccacgattgctccttcttggagacccagcatggcgtat

SEQ ID NO: 421879 - DNA, 140 bp, Artificial Sequence
  Synthetic
atacgccatgctgggtctccgtttctagcaatgataacatacatcacaagaaaccagccagaatggtttagaaatgtcttaagcattgctcctataatgttctcaaacaagatggcgagacgtacttgggagtcggccat

SEQ ID NO: 421880 - DNA, 140 bp, Artificial Sequence
  Synthetic
atggccgactcccaagtacgtctcgccatcttgtttgagaacattataggagcaatgcttaagacatttctaaaccattctggctggtttcttgtgatgtatgttatcattgctagaaacggagacccagcatggcgtat

SEQ ID NO: 421881 - DNA, 140 bp, Artificial Sequence
  Synthetic
aggccctggctgctgatatgaagtgaatggacagagtggaaggatggagtttttttggacaatactaaggccgaatgactcaatcacctttgagagtactgggaactttatagctcccgagaccttttgggacagcggtg

SEQ ID NO: 421882 - DNA, 140 bp, Artificial Sequence
  Synthetic
caccgctgtcccaaaaggtctcgggagctataaagttcccagtactctcaaaggtgattgagtcattcggccttagtattgtccaaaaaaactccatccttccactctgtccattcacttcatatcagcagccagggcct

SEQ ID NO: 421883 - DNA, 140 bp, Artificial Sequence
  Synthetic
aggccctggctgctgatatgcaacaagagagaaaatcgagaaaataagacctctactgatagatggcacagcctcattgagtcctggaatgatgatgggcatgttcaacatgttgagtacgaccttttgggacagcggtg

SEQ ID NO: 421884 - DNA, 140 bp, Artificial Sequence
  Synthetic
caccgctgtcccaaaaggtcgtactcaacatgttgaacatgcccatcatcattccaggactcaatgaggctgtgccatctatcagtagaggtcttattttctcgattttctctcttgttgcatatcagcagccagggcct

SEQ ID NO: 421885 - DNA, 140 bp, Artificial Sequence
  Synthetic
aggccctggctgctgatatgataaattccagtatgcctttccataatgtccatccccttaccattggggagtgccccaagtatgtcaaattgaaaaagctggtccttgcaacagggctaagaccttttgggacagcggtg

SEQ ID NO: 421886 - DNA, 140 bp, Artificial Sequence
  Synthetic
caccgctgtcccaaaaggtcttagccctgttgcaaggaccagctttttcaatttgacatacttggggcactccccaatggtaaggggatggacattatggaaaggcatactggaatttatcatatcagcagccagggcct

SEQ ID NO: 421887 - DNA, 140 bp, Artificial Sequence
  Synthetic
aggccctggctgctgatatgtattgcctgatatgactcccagcacagagatgtcactgagaggagtgagagttagtaaaatgggagtggatgaatattccagcactgagagagtggttgtgaccttttgggacagcggtg

SEQ ID NO: 421888 - DNA, 140 bp, Artificial Sequence
  Synthetic
caccgctgtcccaaaaggtcacaaccactctctcagtgctggaatattcatccactcccattttactaactctcactcctctcagtgacatctctgtgctgggagtcatatcaggcaatacatatcagcagccagggcct

SEQ ID NO: 421889 - DNA, 140 bp, Artificial Sequence
  Synthetic
aggccctggctgctgatatgctagtagctccactgtattttgtggtgtttcgagtgaggtcccagggtggtcctgggatgatggagcaattcttccctttgacatcgataagatgtaattgaccttttgggacagcggtg

SEQ ID NO: 421890 - DNA, 140 bp, Artificial Sequence
  Synthetic
caccgctgtcccaaaaggtcaattacatcttatcgatgtcaaagggaagaattgctccatcatcccaggaccaccctgggacctcactcgaaacaccacaaaatacagtggagctactagcatatcagcagccagggcct

SEQ ID NO: 421891 - DNA, 140 bp, Artificial Sequence
  Synthetic
aggccctggctgctgatatgtcatagcaatgagcaaggtagcggatatgctgcggataaagaatctacacagaaagcagtcgatggaatcactaataaagtcaattcaattattgacaaagaccttttgggacagcggtg

SEQ ID NO: 421892 - DNA, 140 bp, Artificial Sequence
  Synthetic
caccgctgtcccaaaaggtctttgtcaataattgaattgactttattagtgattccatcgactgctttctgtgtagattctttatccgcagcatatccgctaccttgctcattgctatgacatatcagcagccagggcct

SEQ ID NO: 421893 - DNA, 140 bp, Artificial Sequence
  Synthetic
aggccctggctgctgatatgcacagccttactcaatgcttcttgtgctgcaatggatgattttcagctgattccaatgataagcaaatgcagaaccaaagaagggcggcgaaagacaaatgaccttttgggacagcggtg

SEQ ID NO: 421894 - DNA, 140 bp, Artificial Sequence
  Synthetic
caccgctgtcccaaaaggtcatttgtctttcgccgcccttctttggttctgcatttgcttatcattggaatcagctgaaaatcatccattgcagcacaagaagcattgagtaaggctgtgcatatcagcagccagggcct

SEQ ID NO: 421895 - DNA, 140 bp, Artificial Sequence
  Synthetic
atacgccatgctgggtctccttcgtagctaacttcagtatggagttgcccagttttggagtgtccgggattaatgagtcagctgacatgagcgttggtgttacagtaataaagaacaatacgtacttgggagtcggccat

SEQ ID NO: 421896 - DNA, 140 bp, Artificial Sequence
  Synthetic
atggccgactcccaagtacgtattgttctttattactgtaacaccaacgctcatgtcagctgactcattaatcccggacactccaaaactgggcaactccatactgaagttagctacgaaggagacccagcatggcgtat

SEQ ID NO: 421897 - DNA, 140 bp, Artificial Sequence
  Synthetic
atacgccatgctgggtctccgagaatagagaatttgaataagaaaatggaagacggctttatagatgtatggacttacaatgctgaacttctagtgctcatggaaaacgaaaaaactctgcgtacttgggagtcggccat

SEQ ID NO: 421898 - DNA, 140 bp, Artificial Sequence
  Synthetic
atggccgactcccaagtacgcagagttttttcgttttccatgagcactagaagttcagcattgtaagtccatacatctataaagccgtcttccattttcttattcaaattctctattctcggagacccagcatggcgtat

SEQ ID NO: 421899 - DNA, 140 bp, Artificial Sequence
  Synthetic
aggccctggctgctgatatgacgatggaaaagcatggctgcatgtttgtataactgggaatgataacaatgcaacagctagcttcatttacaatgggaggcttgtagatagtattggttcgaccttttgggacagcggtg

SEQ ID NO: 421900 - DNA, 140 bp, Artificial Sequence
  Synthetic
caccgctgtcccaaaaggtcgaaccaatactatctacaagcctcccattgtaaatgaagctagctgttgcattgttatcattcccagttatacaaacatgcagccatgcttttccatcgtcatatcagcagccagggcct

SEQ ID NO: 421901 - DNA, 140 bp, Artificial Sequence
  Synthetic
atacgccatgctgggtctcctttatcaaagactacagatacacataccgatgtcacaggggtgatacgcaaattcaaacgaggagagcattcgagctgaagaagctgtgggagcagaccccgtacttgggagtcggccat

SEQ ID NO: 421902 - DNA, 140 bp, Artificial Sequence
  Synthetic
atggccgactcccaagtacggggtctgctcccacagcttcttcagctcgaatgctctcctcgtttgaatttgcgtatcacccctgtgacatcggtatgtgtatctgtagtctttgataaaggagacccagcatggcgtat

SEQ ID NO: 421903 - DNA, 140 bp, Artificial Sequence
  Synthetic
atacgccatgctgggtctccgctgagagacaatgcaaaggaattaggcaatggatgctttgaattctatcacaggtgtgatgataaatgcatggaaagtgtgaggaatggaacgtatgaccgtacttgggagtcggccat

SEQ ID NO: 421904 - DNA, 140 bp, Artificial Sequence
  Synthetic
atggccgactcccaagtacggtcatacgttccattcctcacactttccatgcatttatcatcacacctgtgatagaattcaaagcatccattgcctaattcctttgcattgtctctcagcggagacccagcatggcgtat

SEQ ID NO: 421905 - DNA, 140 bp, Artificial Sequence
  Synthetic
aggccctggctgctgatatgacaggtgtgatgataaatgcatggaaagtgtgaggaatggaacgtatgactatccgcaatactcagaagaatcaagaatgaaaagggaggagatagacgggaccttttgggacagcggtg

SEQ ID NO: 421906 - DNA, 140 bp, Artificial Sequence
  Synthetic
caccgctgtcccaaaaggtcccgtctatctcctcccttttcattcttgattcttctgagtattgcggatagtcatacgttccattcctcacactttccatgcatttatcatcacacctgtcatatcagcagccagggcct

SEQ ID NO: 421907 - DNA, 140 bp, Artificial Sequence
  Synthetic
aggccctggctgctgatatgtgaagactaccaaggcaggttgtgtaatcctatgaacccgtttgtcagtcataaggaaattgattcagtcaacaatgctgtggtgatgccagctcatggcgaccttttgggacagcggtg

SEQ ID NO: 421908 - DNA, 140 bp, Artificial Sequence
  Synthetic
caccgctgtcccaaaaggtcgccatgagctggcatcaccacagcattgttgactgaatcaatttccttatgactgacaaacgggttcataggattacacaacctgccttggtagtcttcacatatcagcagccagggcct

SEQ ID NO: 421909 - DNA, 140 bp, Artificial Sequence
  Synthetic
atacgccatgctgggtctcctgacaataataactggtctggttattctggtattttctctgttgaaaacaaaagctgcatcaacaggtgcttttatgtggagttaataagagggagaccacgtacttgggagtcggccat

SEQ ID NO: 421910 - DNA, 140 bp, Artificial Sequence
  Synthetic
atggccgactcccaagtacgtggtctccctcttattaactccacataaaagcacctgttgatgcagcttttgttttcaacagagaaaataccagaataaccagaccagttattattgtcaggagacccagcatggcgtat

SEQ ID NO: 421911 - DNA, 140 bp, Artificial Sequence
  Synthetic
aggccctggctgctgatatggagagaactggttcgcaaaacaagatttctaccagtagctggaggaacaagcagtgtgtatatcgaagtgttgcatttgacccaagggacctgctgggaggaccttttgggacagcggtg

SEQ ID NO: 421912 - DNA, 140 bp, Artificial Sequence
  Synthetic
caccgctgtcccaaaaggtcctcccagcaggtcccttgggtcaaatgcaacacttcgatatacacactgcttgttcctccagctactggtagaaatcttgttttgcgaaccagttctctccatatcagcagccagggcct

SEQ ID NO: 421913 - DNA, 140 bp, Artificial Sequence
  Synthetic
aggccctggctgctgatatgaagtccacatatattacctagagaaagccaataaaataaaatccgagaagacacacatccacattttctcattcactggagaagagatggccaccaaagcgaccttttgggacagcggtg

SEQ ID NO: 421914 - DNA, 140 bp, Artificial Sequence
  Synthetic
caccgctgtcccaaaaggtcgctttggtggccatctcttctccagtgaatgagaaaatgtggatgtgtgtcttctcggattttattttattggctttctctaggtaatatatgtggacttcatatcagcagccagggcct

SEQ ID NO: 421915 - DNA, 140 bp, Artificial Sequence
  Synthetic
aggccctggctgctgatatgtgcacgaattgacttcgaatctggaaggattaagaaagaagagtttgctgagatcatgaagatctgttccaccattgaagagctcagacggcaaaaataggaccttttgggacagcggtg

SEQ ID NO: 421916 - DNA, 140 bp, Artificial Sequence
  Synthetic
caccgctgtcccaaaaggtcctatttttgccgtctgagctcttcaatggtggaacagatcttcatgatctcagcaaactcttctttcttaatccttccagattcgaagtcaattcgtgcacatatcagcagccagggcct

SEQ ID NO: 421917 - DNA, 140 bp, Artificial Sequence
  Synthetic
aggccctggctgctgatatgtcagtgtgatttttgatcgattggagaccctaatactacttagagctttcacagaagaaggagcaatagttggagaaatctcaccgttaccttctcttccgaccttttgggacagcggtg

SEQ ID NO: 421918 - DNA, 140 bp, Artificial Sequence
  Synthetic
caccgctgtcccaaaaggtcggaagagaaggtaacggtgagatttctccaactattgctccttcttctgtgaaagctctaagtagtattagggtctccaatcgatcaaaaatcacactgacatatcagcagccagggcct

SEQ ID NO: 421919 - DNA, 140 bp, Artificial Sequence
  Synthetic
aggccctggctgctgatatgcttccttttcagaatgtacatcccgtcactattggagaatgccccaaatatgttaaaagcacccaactgagaatggcaacaggactaaggaatatcccatgaccttttgggacagcggtg

SEQ ID NO: 421920 - DNA, 140 bp, Artificial Sequence
  Synthetic
caccgctgtcccaaaaggtcatgggatattccttagtcctgttgccattctcagttgggtgcttttaacatatttggggcattctccaatagtgacgggatgtacattctgaaaaggaagcatatcagcagccagggcct

SEQ ID NO: 421921 - DNA, 140 bp, Artificial Sequence
  Synthetic
aggccctggctgctgatatgctggatcagacagagtgatggtgtcacctctggctgtgacgtggtggaacagaaatggaccaacgacaagcacagtccattatccaaaggtctataaaacgaccttttgggacagcggtg

SEQ ID NO: 421922 - DNA, 140 bp, Artificial Sequence
  Synthetic
caccgctgtcccaaaaggtcgttttatagacctttggataatggactgtgcttgtcgttggtccatttctgttccaccacgtcacagccagaggtgacaccatcactctgtctgatccagcatatcagcagccagggcct

SEQ ID NO: 421923 - DNA, 140 bp, Artificial Sequence
  Synthetic
atacgccatgctgggtctccctcttgagacacttccaaaaggatgcaaaagtgcttttccaaaattggggaattgaacccattgacaatgtgatgggaatgatcgggatattgcctgacacgtacttgggagtcggccat

SEQ ID NO: 421924 - DNA, 140 bp, Artificial Sequence
  Synthetic
atggccgactcccaagtacgtgtcaggcaatatcccgatcattcccatcacattgtcaatgggttcaattccccaattttggaaaagcacttttgcatccttttggaagtgtctcaagagggagacccagcatggcgtat

SEQ ID NO: 421925 - DNA, 140 bp, Artificial Sequence
  Synthetic
atacgccatgctgggtctcccggagaaggtggactttgaggattgcaaagatgtcaacgacctgaaacagtacgacagtgatgagccagagcccagatcactagcatgttggatccagaacgtacttgggagtcggccat

SEQ ID NO: 421926 - DNA, 140 bp, Artificial Sequence
  Synthetic
atggccgactcccaagtacgttctggatccaacatgctagtgatctgggctctggctcatcactgtcgtactgtttcaggtcgttgacatctttgcaatcctcaaagtccaccttctccgggagacccagcatggcgtat

SEQ ID NO: 421927 - DNA, 140 bp, Artificial Sequence
  Synthetic
atacgccatgctgggtctccgcaaagatgtcaacgacctgaaacagtacgacagtgatgagccagagcccagatcactagcatgttggatccagaatgaattcaacaaggcatgtgaattcgtacttgggagtcggccat

SEQ ID NO: 421928 - DNA, 140 bp, Artificial Sequence
  Synthetic
atggccgactcccaagtacgaattcacatgccttgttgaattcattctggatccaacatgctagtgatctgggctctggctcatcactgtcgtactgtttcaggtcgttgacatctttgcggagacccagcatggcgtat

SEQ ID NO: 421929 - DNA, 140 bp, Artificial Sequence
  Synthetic
aggccctggctgctgatatgagaaatgatgatgttgatcagagtttaattattgctgctagaaatattgttagaagagcaacagtatcagcagacccgttggcttcgcttttggagatgtgaccttttgggacagcggtg

SEQ ID NO: 421930 - DNA, 140 bp, Artificial Sequence
  Synthetic
caccgctgtcccaaaaggtcacatctccaaaagcgaagccaacgggtctgctgatactgttgctcttctaacaatatttctagcagcaataattaaactctgatcaacatcatcatttctcatatcagcagccagggcct

SEQ ID NO: 421931 - DNA, 140 bp, Artificial Sequence
  Synthetic
aggccctggctgctgatatgacccagcacataagagtcaattagtgtggatggcatgccactctgcagcatttgaggacctcagagtctcaagtttcatcagaggggcaagagtggtcccgaccttttgggacagcggtg

SEQ ID NO: 421932 - DNA, 140 bp, Artificial Sequence
  Synthetic
caccgctgtcccaaaaggtcgggaccactcttgcccctctgatgaaacttgagactctgaggtcctcaaatgctgcagagtggcatgccatccacactaattgactcttatgtgctgggtcatatcagcagccagggcct

SEQ ID NO: 421933 - DNA, 140 bp, Artificial Sequence
  Synthetic
atacgccatgctgggtctccagactacactctcgacgaggaaagcagggctaggattaaaaccaggctgtttaccataagacaagaaatggccaacagaggcctctgggattcctttcgtcgtacttgggagtcggccat

SEQ ID NO: 421934 - DNA, 140 bp, Artificial Sequence
  Synthetic
atggccgactcccaagtacgacgaaaggaatcccagaggcctctgttggccatttcttgtcttatggtaaacagcctggttttaatcctagccctgctttcctcgtcgagagtgtagtctggagacccagcatggcgtat

SEQ ID NO: 421935 - DNA, 140 bp, Artificial Sequence
  Synthetic
aggccctggctgctgatatgttaccataagacaagaaatggccaacagaggcctctgggattcctttcgtcagtccgaaagaggcgaagaaacaattgaagaaaaatttgaaatcacagggaccttttgggacagcggtg

SEQ ID NO: 421936 - DNA, 140 bp, Artificial Sequence
  Synthetic
caccgctgtcccaaaaggtccctgtgatttcaaatttttcttcaattgtttcttcgcctctttcggactgacgaaaggaatcccagaggcctctgttggccatttcttgtcttatggtaacatatcagcagccagggcct

SEQ ID NO: 421937 - DNA, 140 bp, Artificial Sequence
  Synthetic
aggccctggctgctgatatggcgaagagcaacagccattctaaggaaagcaaccagaagactgatccaactgatagtgagtgggaaagacgagcaatcaatcgccgaggcaatcatagtggaccttttgggacagcggtg

SEQ ID NO: 421938 - DNA, 140 bp, Artificial Sequence
  Synthetic
caccgctgtcccaaaaggtccactatgattgcctcggcgattgattgctcgtctttcccactcactatcagttggatcagtcttctggttgctttccttagaatggctgttgctcttcgccatatcagcagccagggcct

SEQ ID NO: 421939 - DNA, 140 bp, Artificial Sequence
  Synthetic
atacgccatgctgggtctccattgcaatgaaacagtcattagagaatacaatgaaacagtaaggattgagaaggtaacacaatggcacaataccaatgtcattgagtacatagaaaggcccgtacttgggagtcggccat

SEQ ID NO: 421940 - DNA, 140 bp, Artificial Sequence
  Synthetic
atggccgactcccaagtacgggcctttctatgtactcaatgacattggtattgtgccattgtgttaccttctcaatccttactgtttcattgtattctctaatgactgtttcattgcaatggagacccagcatggcgtat

SEQ ID NO: 421941 - DNA, 140 bp, Artificial Sequence
  Synthetic
aggccctggctgctgatatggcaatggtattctcacaagaggattgtatgataaaggcagtgagaggtgatttgaactttgtcaacagagcaaaccagcggctaaatcccatgcatcaacgaccttttgggacagcggtg

SEQ ID NO: 421942 - DNA, 140 bp, Artificial Sequence
  Synthetic
caccgctgtcccaaaaggtcgttgatgcatgggatttagccgctggtttgctctgttgacaaagttcaaatcacctctcactgcctttatcatacaatcctcttgtgagaataccattgccatatcagcagccagggcct

SEQ ID NO: 421943 - DNA, 140 bp, Artificial Sequence
  Synthetic
atacgccatgctgggtctccgtcaacagaacacataaatactcagaaaaaggaaagtggacaacgaacacagagactggagcaccccaactcaatccgattgatggaccattgcctgaggcgtacttgggagtcggccat

SEQ ID NO: 421944 - DNA, 140 bp, Artificial Sequence
  Synthetic
atggccgactcccaagtacgcctcaggcaatggtccatcaatcggattgagttggggtgctccagtctctgtgttcgttgtccactttcctttttctgagtatttatgtgttctgttgacggagacccagcatggcgtat

SEQ ID NO: 421945 - DNA, 140 bp, Artificial Sequence
  Synthetic
atacgccatgctgggtctccattgaacccattgacaatgtaatggggatgatcggaatattgcctgacatgacccccagcacagagatgtcattgagaggagtgagagttagtaaaatggcgtacttgggagtcggccat

SEQ ID NO: 421946 - DNA, 140 bp, Artificial Sequence
  Synthetic
atggccgactcccaagtacgccattttactaactctcactcctctcaatgacatctctgtgctgggggtcatgtcaggcaatattccgatcatccccattacattgtcaatgggttcaatggagacccagcatggcgtat

SEQ ID NO: 421947 - DNA, 140 bp, Artificial Sequence
  Synthetic
atacgccatgctgggtctccgaggaattggaaggttctacatacaaatgtgcactgaactcaaactaagtgacaatgaagggaggctgatccaaaacagtatcacaatagaaagaatggtcgtacttgggagtcggccat

SEQ ID NO: 421948 - DNA, 140 bp, Artificial Sequence
  Synthetic
atggccgactcccaagtacgaccattctttctattgtgatactgttttggatcagcctcccttcattgtcacttagtttgagttcagtgcacatttgtatgtagaaccttccaattcctcggagacccagcatggcgtat

SEQ ID NO: 421949 - DNA, 140 bp, Artificial Sequence
  Synthetic
aggccctggctgctgatatgttcttgagggtccgagaccagaggggaaacgtactcctgtctcctgaagaggttagtgaaacacagggaacagaaaagctgactataacatattcatcgtgaccttttgggacagcggtg

SEQ ID NO: 421950 - DNA, 140 bp, Artificial Sequence
  Synthetic
caccgctgtcccaaaaggtcacgatgaatatgttatagtcagcttttctgttccctgtgtttcactaacctcttcaggagacaggagtacgtttcccctctggtctcggaccctcaagaacatatcagcagccagggcct

SEQ ID NO: 421951 - DNA, 140 bp, Artificial Sequence
  Synthetic
aggccctggctgctgatatgggttagtgaaacacagggaacagaaaagctgactataacatattcatcgtccatgatgtgggagatcaatggtccggaatcagtgctagttaacacatatgaccttttgggacagcggtg

SEQ ID NO: 421952 - DNA, 140 bp, Artificial Sequence
  Synthetic
caccgctgtcccaaaaggtcatatgtgttaactagcactgattccggaccattgatctcccacatcatggacgatgaatatgttatagtcagcttttctgttccctgtgtttcactaacccatatcagcagccagggcct

SEQ ID NO: 421953 - DNA, 140 bp, Artificial Sequence
  Synthetic
aggccctggctgctgatatggaactggttgactaaatcaggaaacgcatatccagtgttgaacgtgactatgccaaacaatgacaattttgacaaactatacatctggggagttcatcacgaccttttgggacagcggtg

SEQ ID NO: 421954 - DNA, 140 bp, Artificial Sequence
  Synthetic
caccgctgtcccaaaaggtcgtgatgaactccccagatgtatagtttgtcaaaattgtcattgtttggcatagtcacgttcaacactggatatgcgtttcctgatttagtcaaccagttccatatcagcagccagggcct

SEQ ID NO: 421955 - DNA, 140 bp, Artificial Sequence
  Synthetic
atacgccatgctgggtctcctcctacaatgctatacaataagatggaatttgaaccctttcaatccctagtgcctaaagctgccagaggccaatatagtgggttcgtgagggttctattccgtacttgggagtcggccat

SEQ ID NO: 421956 - DNA, 140 bp, Artificial Sequence
  Synthetic
atggccgactcccaagtacggaatagaaccctcacgaacccactatattggcctctggcagctttaggcactagggattgaaagggttcaaattccatcttattgtatagcattgtaggaggagacccagcatggcgtat

SEQ ID NO: 421957 - DNA, 140 bp, Artificial Sequence
  Synthetic
aggccctggctgctgatatgtgcctaaagctgccagaggccaatatagtgggttcgtgagggttctattccaacagatgcgtgacgtactgggaacatttgacactgtccaaataataaagaccttttgggacagcggtg

SEQ ID NO: 421958 - DNA, 140 bp, Artificial Sequence
  Synthetic
caccgctgtcccaaaaggtctttattatttggacagtgtcaaatgttcccagtacgtcacgcatctgttggaatagaaccctcacgaacccactatattggcctctggcagctttaggcacatatcagcagccagggcct

SEQ ID NO: 421959 - DNA, 140 bp, Artificial Sequence
  Synthetic
atacgccatgctgggtctccgcttggaaaggatgcaggtgcattgatggaagaccccgatgagggaacagcaggagtggaatctgcggtattgaggggatttctgattctgggcaaagaacgtacttgggagtcggccat

SEQ ID NO: 421960 - DNA, 140 bp, Artificial Sequence
  Synthetic
atggccgactcccaagtacgttctttgcccagaatcagaaatcccctcaataccgcagattccactcctgctgttccctcatcggggtcttccatcaatgcacctgcatcctttccaagcggagacccagcatggcgtat

SEQ ID NO: 421961 - DNA, 140 bp, Artificial Sequence
  Synthetic
atacgccatgctgggtctccattttaaaaccgaatgacgcaatccacttcgagagtaatggaaatttcattgctccagaatatgcatacaaaattgtcaagaaagggagactccacaatccgtacttgggagtcggccat

SEQ ID NO: 421962 - DNA, 140 bp, Artificial Sequence
  Synthetic
atggccgactcccaagtacggattgtggagtctccctttcttgacaattttgtatgcatattctggagcaatgaaatttccattactctcgaagtggattgcgtcattcggttttaaaatggagacccagcatggcgtat

SEQ ID NO: 421963 - DNA, 140 bp, Artificial Sequence
  Synthetic
aggccctggctgctgatatggcaaggagacgttgtgttggtgatgaaacggaaacgggactctagcatacttactgacagtcagacagcgaccaaaaggattcggatggccatcaattaagaccttttgggacagcggtg

SEQ ID NO: 421964 - DNA, 140 bp, Artificial Sequence
  Synthetic
caccgctgtcccaaaaggtcttaattgatggccatccgaatccttttggtcgctgtctgactgtcagtaagtatgctagagtcccgtttccgtttcatcaccaacacaacgtctccttgccatatcagcagccagggcct

SEQ ID NO: 421965 - DNA, 140 bp, Artificial Sequence
  Synthetic
atacgccatgctgggtctccatgagtcttctaaccgaggtcgaaacgtacgttctctctatcattccatcaggccccctcaaagccgagatcgcgcagagacttgaggatgtttttgcagcgtacttgggagtcggccat

SEQ ID NO: 421966 - DNA, 140 bp, Artificial Sequence
  Synthetic
atggccgactcccaagtacgctgcaaaaacatcctcaagtctctgcgcgatctcggctttgagggggcctgatggaatgatagagagaacgtacgtttcgacctcggttagaagactcatggagacccagcatggcgtat

SEQ ID NO: 421967 - DNA, 140 bp, Artificial Sequence
  Synthetic
atacgccatgctgggtctccgcgctgggagggatccaaagaaaactggtggaccaatttacagaaggagagaaggaaaatgggtaagagaattggtcctgtatgacaaggaagaaataagcgtacttgggagtcggccat

SEQ ID NO: 421968 - DNA, 140 bp, Artificial Sequence
  Synthetic
atggccgactcccaagtacgcttatttcttccttgtcatacaggaccaattctcttacccattttccttctctccttctgtaaattggtccaccagttttctttggatccctcccagcgcggagacccagcatggcgtat

SEQ ID NO: 421969 - DNA, 140 bp, Artificial Sequence
  Synthetic
aggccctggctgctgatatgcaccatcggagaatgtcccaaatatgtgaaatcaaacaaattagtccttgcaactgggctcagaaatagtcctcaaagagagagaagaagaaaaagaggagaccttttgggacagcggtg

SEQ ID NO: 421970 - DNA, 140 bp, Artificial Sequence
  Synthetic
caccgctgtcccaaaaggtctcctctttttcttcttctctctctttgaggactatttctgagcccagttgcaaggactaatttgtttgatttcacatatttgggacattctccgatggtgcatatcagcagccagggcct

SEQ ID NO: 421971 - DNA, 140 bp, Artificial Sequence
  Synthetic
aggccctggctgctgatatgcacacatattatctagagaaggccaacaagataaaatccgagaagacacatattcacatattctcattcacaggagaagagatggcaaccaaagcggactgaccttttgggacagcggtg

SEQ ID NO: 421972 - DNA, 140 bp, Artificial Sequence
  Synthetic
caccgctgtcccaaaaggtcagtccgctttggttgccatctcttctcctgtgaatgagaatatgtgaatatgtgtcttctcggattttatcttgttggccttctctagataatatgtgtgcatatcagcagccagggcct

SEQ ID NO: 421973 - DNA, 140 bp, Artificial Sequence
  Synthetic
aggccctggctgctgatatgtttcattgaaattggagtaaccaggagggaagtccatatctactatttagaaaaggccaacaagataaagtctgagaagacacacatccacatcttttcagaccttttgggacagcggtg

SEQ ID NO: 421974 - DNA, 140 bp, Artificial Sequence
  Synthetic
caccgctgtcccaaaaggtctgaaaagatgtggatgtgtgtcttctcagactttatcttgttggccttttctaaatagtagatatggacttccctcctggttactccaatttcaatgaaacatatcagcagccagggcct

SEQ ID NO: 421975 - DNA, 140 bp, Artificial Sequence
  Synthetic
atacgccatgctgggtctccctacggctaaggctatggagcagatggctggatcaagtgaacaggcagcggaagccatggaagtcgcaagccaggctaggcaaatggtgcaggctatgagcgtacttgggagtcggccat

SEQ ID NO: 421976 - DNA, 140 bp, Artificial Sequence
  Synthetic
atggccgactcccaagtacgctcatagcctgcaccatttgcctagcctggcttgcgacttccatggcttccgctgcctgttcacttgatccagccatctgctccatagccttagccgtagggagacccagcatggcgtat

SEQ ID NO: 421977 - DNA, 140 bp, Artificial Sequence
  Synthetic
aggccctggctgctgatatgataatgaaccaagtggatatgcacaaacagactgtgtcctggaggctatggccttccttgaagaatcccacccaggtatctttgagaactcatgccttgagaccttttgggacagcggtg

SEQ ID NO: 421978 - DNA, 140 bp, Artificial Sequence
  Synthetic
caccgctgtcccaaaaggtctcaaggcatgagttctcaaagatacctgggtgggattcttcaaggaaggccatagcctccaggacacagtctgtttgtgcatatccacttggttcattatcatatcagcagccagggcct

SEQ ID NO: 421979 - DNA, 140 bp, Artificial Sequence
  Synthetic
aggccctggctgctgatatgtgatattgtggattcttgatcgtcttttcttcaaatgcatttatcgtcgctttaaatacggtttgaaaagagggccttctacggaaggaatgcctgagtcgaccttttgggacagcggtg

SEQ ID NO: 421980 - DNA, 140 bp, Artificial Sequence
  Synthetic
caccgctgtcccaaaaggtcgactcaggcattccttccgtagaaggccctcttttcaaaccgtatttaaagcgacgataaatgcatttgaagaaaagacgatcaagaatccacaatatcacatatcagcagccagggcct

SEQ ID NO: 421981 - DNA, 140 bp, Artificial Sequence
  Synthetic
aggccctggctgctgatatgtccgattgaacacattgcaagtatgaggaggaactattttacagcagaagtgtcccattgcagggccactgaatacataatgaagggagtctacataaatgaccttttgggacagcggtg

SEQ ID NO: 421982 - DNA, 140 bp, Artificial Sequence
  Synthetic
caccgctgtcccaaaaggtcatttatgtagactcccttcattatgtattcagtggccctgcaatgggacacttctgctgtaaaatagttcctcctcatacttgcaatgtgttcaatcggacatatcagcagccagggcct

SEQ ID NO: 421983 - DNA, 140 bp, Artificial Sequence
  Synthetic
atacgccatgctgggtctccatgaatccaaatcagaagattctatgcacttcagccactgctatcataataggcgcaatcgcagtactcattggaatagcaaacctaggattgaacatagcgtacttgggagtcggccat

SEQ ID NO: 421984 - DNA, 140 bp, Artificial Sequence
  Synthetic
atggccgactcccaagtacgctatgttcaatcctaggtttgctattccaatgagtactgcgattgcgcctattatgatagcagtggctgaagtgcatagaatcttctgatttggattcatggagacccagcatggcgtat

SEQ ID NO: 421985 - DNA, 140 bp, Artificial Sequence
  Synthetic
aggccctggctgctgatatgaggcgcaatcgcagtactcattggaatagcaaacctaggattgaacataggactgcatctaaaaccgagctgcaattgctcacactcacaacctgaaacagaccttttgggacagcggtg

SEQ ID NO: 421986 - DNA, 140 bp, Artificial Sequence
  Synthetic
caccgctgtcccaaaaggtctgtttcaggttgtgagtgtgagcaattgcagctcggttttagatgcagtcctatgttcaatcctaggtttgctattccaatgagtactgcgattgcgcctcatatcagcagccagggcct

SEQ ID NO: 421987 - DNA, 140 bp, Artificial Sequence
  Synthetic
atacgccatgctgggtctccgactgcatctaaaaccgagctgcaattgctcacactcacaacctgaaacaaccaacacaagccaaacaataataaacaactattataatgaaacaaacatcgtacttgggagtcggccat

SEQ ID NO: 421988 - DNA, 140 bp, Artificial Sequence
  Synthetic
atggccgactcccaagtacgatgtttgtttcattataatagttgtttattattgtttggcttgtgttggttgtttcaggttgtgagtgtgagcaattgcagctcggttttagatgcagtcggagacccagcatggcgtat

SEQ ID NO: 421989 - DNA, 140 bp, Artificial Sequence
  Synthetic
aggccctggctgctgatatgactgcaaggatgtcagcgatttgaggcagtatgacagcgatgagcctgagcaaagatcactagcaagttggattcaaagtgagttcaacaaagcttgtgagaccttttgggacagcggtg

SEQ ID NO: 421990 - DNA, 140 bp, Artificial Sequence
  Synthetic
caccgctgtcccaaaaggtctcacaagctttgttgaactcactttgaatccaacttgctagtgatctttgctcaggctcatcgctgtcatactgcctcaaatcgctgacatccttgcagtcatatcagcagccagggcct

SEQ ID NO: 421991 - DNA, 140 bp, Artificial Sequence
  Synthetic
atacgccatgctgggtctcccaaagatcactagcaagttggattcaaagtgagttcaacaaagcttgtgaactgactgactcaagttggatagaactcgatgaaataggggaggacgttgcgtacttgggagtcggccat

SEQ ID NO: 421992 - DNA, 140 bp, Artificial Sequence
  Synthetic
atggccgactcccaagtacgcaacgtcctcccctatttcatcgagttctatccaacttgagtcagtcagttcacaagctttgttgaactcactttgaatccaacttgctagtgatctttgggagacccagcatggcgtat

SEQ ID NO: 421993 - DNA, 140 bp, Artificial Sequence
  Synthetic
atacgccatgctgggtctccctaaagggctctgtactataaattcatggcacatatatgggaaagacaatgcagtaagaattggagagagctcggatgttttagtcacaagagaaccctacgtacttgggagtcggccat

SEQ ID NO: 421994 - DNA, 140 bp, Artificial Sequence
  Synthetic
atggccgactcccaagtacgtagggttctcttgtgactaaaacatccgagctctctccaattcttactgcattgtctttcccatatatgtgccatgaatttatagtacagagccctttagggagacccagcatggcgtat

SEQ ID NO: 421995 - DNA, 140 bp, Artificial Sequence
  Synthetic
aggccctggctgctgatatggcagtaagaattggagagagctcggatgttttagtcacaagagaaccctatgtttcatgcgacccagatgaatgcaggttctatgctctcagccaaggaagaccttttgggacagcggtg

SEQ ID NO: 421996 - DNA, 140 bp, Artificial Sequence
  Synthetic
caccgctgtcccaaaaggtcttccttggctgagagcatagaacctgcattcatctgggtcgcatgaaacatagggttctcttgtgactaaaacatccgagctctctccaattcttactgccatatcagcagccagggcct

SEQ ID NO: 421997 - DNA, 140 bp, Artificial Sequence
  Synthetic
aggccctggctgctgatatggaatactgacatcagagtcacagttaacgataaccaaggaaaagaaggaggagcttcaggactgcaaaattgcccctttaatggtggcatacatgttggagaccttttgggacagcggtg

SEQ ID NO: 421998 - DNA, 140 bp, Artificial Sequence
  Synthetic
caccgctgtcccaaaaggtctccaacatgtatgccaccattaaaggggcaattttgcagtcctgaagctcctccttcttttccttggttatcgttaactgtgactctgatgtcagtattccatatcagcagccagggcct

SEQ ID NO: 421999 - DNA, 140 bp, Artificial Sequence
  Synthetic
atacgccatgctgggtctcctatcgcgccctgataagctggccactatcatcaccgcccacagtgtacaacagcagggtggaatgcattgggtggtcaagtactagttgccatgatggcacgtacttgggagtcggccat

SEQ ID NO: 422000 - DNA, 140 bp, Artificial Sequence
  Synthetic
atggccgactcccaagtacgtgccatcatggcaactagtacttgaccacccaatgcattccaccctgctgttgtacactgtgggcggtgatgatagtggccagcttatcagggcgcgataggagacccagcatggcgtat

SEQ ID NO: 422001 - DNA, 140 bp, Artificial Sequence
  Synthetic
aggccctggctgctgatatgcagcagggtggaatgcattgggtggtcaagtactagttgccatgatggcaaatccaggatgtcaatatgtatatcaggaccaaacaacaatgcatctgcagaccttttgggacagcggtg

SEQ ID NO: 422002 - DNA, 140 bp, Artificial Sequence
  Synthetic
caccgctgtcccaaaaggtctgcagatgcattgttgtttggtcctgatatacatattgacatcctggatttgccatcatggcaactagtacttgaccacccaatgcattccaccctgctgcatatcagcagccagggcct

SEQ ID NO: 422003 - DNA, 140 bp, Artificial Sequence
  Synthetic
aggccctggctgctgatatggcagggatcgacactcccaagaaggtctggagcggctggtgcagccgtaaaaggagttggaacaatggtgatggagcttatcagaatgataaagagaggagaccttttgggacagcggtg

SEQ ID NO: 422004 - DNA, 140 bp, Artificial Sequence
  Synthetic
caccgctgtcccaaaaggtctcctctctttatcattctgataagctccatcaccattgttccaactccttttacggctgcaccagccgctccagaccttcttgggagtgtcgatccctgccatatcagcagccagggcct

SEQ ID NO: 422005 - DNA, 140 bp, Artificial Sequence
  Synthetic
atacgccatgctgggtctccaaacatactaagaacacaggaatctgaatgtgtatgccacaacggcgtatgcccagtagtgttcaccgatgggtctgccactggacctgcagacacaagacgtacttgggagtcggccat

SEQ ID NO: 422006 - DNA, 140 bp, Artificial Sequence
  Synthetic
atggccgactcccaagtacgtcttgtgtctgcaggtccagtggcagacccatcggtgaacactactgggcatacgccgttgtggcatacacattcagattcctgtgttcttagtatgtttggagacccagcatggcgtat

SEQ ID NO: 422007 - DNA, 140 bp, Artificial Sequence
  Synthetic
atacgccatgctgggtctccgaccaatggaacttccaaaatcaaaatgaaatggggtatggagatgaggcgttgtcttcttcaatcccttcagcaaattgaaagcatgattgaggccgagcgtacttgggagtcggccat

SEQ ID NO: 422008 - DNA, 140 bp, Artificial Sequence
  Synthetic
atggccgactcccaagtacgctcggcctcaatcatgctttcaatttgctgaagggattgaagaagacaacgcctcatctccataccccatttcattttgattttggaagttccattggtcggagacccagcatggcgtat

SEQ ID NO: 422009 - DNA, 140 bp, Artificial Sequence
  Synthetic
aggccctggctgctgatatgggatatatgcaaggcagcaatgggtctaaggatcagttcatccttcagctttggaggtttcactttcaaaaggacaagtgggtcatctgtcaaaagggaagaccttttgggacagcggtg

SEQ ID NO: 422010 - DNA, 140 bp, Artificial Sequence
  Synthetic
caccgctgtcccaaaaggtcttcccttttgacagatgacccacttgtccttttgaaagtgaaacctccaaagctgaaggatgaactgatccttagacccattgctgccttgcatatatcccatatcagcagccagggcct

SEQ ID NO: 422011 - DNA, 140 bp, Artificial Sequence
  Synthetic
aggccctggctgctgatatggctctcagcgatcaaagttcttgctgatggatgctctgaaactaagtattgaagacccgagtcatgaaggggaaggaataccactatatgatgcaatcaagaccttttgggacagcggtg

SEQ ID NO: 422012 - DNA, 140 bp, Artificial Sequence
  Synthetic
caccgctgtcccaaaaggtcttgattgcatcatatagtggtattccttccccttcatgactcgggtcttcaatacttagtttcagagcatccatcagcaagaactttgatcgctgagagccatatcagcagccagggcct

SEQ ID NO: 422013 - DNA, 140 bp, Artificial Sequence
  Synthetic
atacgccatgctgggtctccatcatggcagaacaatatattgaggacacaagagtcagaatgccagtgtctatacgggacctgcatcgtggcagtaacagatgggccagcagacaataagcgtacttgggagtcggccat

SEQ ID NO: 422014 - DNA, 140 bp, Artificial Sequence
  Synthetic
atggccgactcccaagtacgcttattgtctgctggcccatctgttactgccacgatgcaggtcccgtatagacactggcattctgactcttgtgtcctcaatatattgttctgccatgatggagacccagcatggcgtat

SEQ ID NO: 422015 - DNA, 140 bp, Artificial Sequence
  Synthetic
atacgccatgctgggtctcctgttcttacagacaatccccgaccgaatgacccaaatataggtaagtgtaatgacccttatccaggtattaataacaatggagtcaagggattctcataccgtacttgggagtcggccat

SEQ ID NO: 422016 - DNA, 140 bp, Artificial Sequence
  Synthetic
atggccgactcccaagtacggtatgagaatcccttgactccattgttattaatacctggataagggtcattacacttacctatatttgggtcattcggtcggggattgtctgtaagaacaggagacccagcatggcgtat

SEQ ID NO: 422017 - DNA, 140 bp, Artificial Sequence
  Synthetic
atacgccatgctgggtctccctggatggggctaacacttggctagggaggacaataagcacagcctcgaggtctggatacgagatgttaaaagtgccaaatgcattgacagatgatagatcgtacttgggagtcggccat

SEQ ID NO: 422018 - DNA, 140 bp, Artificial Sequence
  Synthetic
atggccgactcccaagtacgatctatcatctgtcaatgcatttggcacttttaacatctcgtatccagacctcgaggctgtgcttattgtcctccctagccaagtgttagccccatccagggagacccagcatggcgtat

SEQ ID NO: 422019 - DNA, 140 bp, Artificial Sequence
  Synthetic
aggccctggctgctgatatgggggatgatcggaatattgcctgacatgacccccagcacagagatgtcattgagaggagtgagagttagtaaaatgggagtagatgaatattccagtactgaccttttgggacagcggtg

SEQ ID NO: 422020 - DNA, 140 bp, Artificial Sequence
  Synthetic
caccgctgtcccaaaaggtcagtactggaatattcatctactcccattttactaactctcactcctctcaatgacatctctgtgctgggggtcatgtcaggcaatattccgatcatcccccatatcagcagccagggcct

SEQ ID NO: 422021 - DNA, 140 bp, Artificial Sequence
  Synthetic
atacgccatgctgggtctcctacagtggatctttcatggactattgggctgaaggggactgctatcgagcgtgtttttatgtggagttgatacgtggaagacccaaggaggataaagtgtcgtacttgggagtcggccat

SEQ ID NO: 422022 - DNA, 140 bp, Artificial Sequence
  Synthetic
atggccgactcccaagtacgacactttatcctccttgggtcttccacgtatcaactccacataaaaacacgctcgatagcagtccccttcagcccaatagtccatgaaagatccactgtaggagacccagcatggcgtat

SEQ ID NO: 422023 - DNA, 140 bp, Artificial Sequence
  Synthetic
aggccctggctgctgatatggtggtggaccagcaatagtatagtatcgatgtgttccagtacagaattcctgggacaatggaactggcctgatggggctaaaatagagtacttcctctaagaccttttgggacagcggtg

SEQ ID NO: 422024 - DNA, 140 bp, Artificial Sequence
  Synthetic
caccgctgtcccaaaaggtcttagaggaagtactctattttagccccatcaggccagttccattgtcccaggaattctgtactggaacacatcgatactatactattgctggtccaccaccatatcagcagccagggcct

SEQ ID NO: 422025 - DNA, 140 bp, Artificial Sequence
  Synthetic
atacgccatgctgggtctccatggcgtctcaaggcaccaaacgatcctatgaacagatggaaactggtggggaacgccagaatgctactgagatcagggcatctgttggaagaatggttacgtacttgggagtcggccat

SEQ ID NO: 422026 - DNA, 140 bp, Artificial Sequence
  Synthetic
atggccgactcccaagtacgtaaccattcttccaacagatgccctgatctcagtagcattctggcgttccccaccagtttccatctgttcataggatcgtttggtgccttgagacgccatggagacccagcatggcgtat

SEQ ID NO: 422027 - DNA, 140 bp, Artificial Sequence
  Synthetic
atacgccatgctgggtctccggaattctttgaaaacaaatcggaaacatggccaatcggagaatcacccaaaggagtggaggaaggctccattgggaaagtgtgcaggaccttactggcacgtacttgggagtcggccat

SEQ ID NO: 422028 - DNA, 140 bp, Artificial Sequence
  Synthetic
atggccgactcccaagtacgtgccagtaaggtcctgcacactttcccaatggagccttcctccactcctttgggtgattctccgattggccatgtttccgatttgttttcaaagaattccggagacccagcatggcgtat

SEQ ID NO: 422029 - DNA, 140 bp, Artificial Sequence
  Synthetic
aggccctggctgctgatatgcgttgcaactacacactcctggattcccaaaaggaaccgctctattctaaacacaagccaaaggggaattcttgaggatgaacagatgtaccagaagtgcgaccttttgggacagcggtg

SEQ ID NO: 422030 - DNA, 140 bp, Artificial Sequence
  Synthetic
caccgctgtcccaaaaggtcgcacttctggtacatctgttcatcctcaagaattcccctttggcttgtgtttagaatagagcggttccttttgggaatccaggagtgtgtagttgcaacgcatatcagcagccagggcct

SEQ ID NO: 422031 - DNA, 140 bp, Artificial Sequence
  Synthetic
atacgccatgctgggtctccgccggatcagaccgagtgatggtatcacctctggctgtgacatggtggaataggaatggaccaacaacaagtacagttcattatccaaaggtatataaaacgtacttgggagtcggccat

SEQ ID NO: 422032 - DNA, 140 bp, Artificial Sequence
  Synthetic
atggccgactcccaagtacgttttatatacctttggataatgaactgtacttgttgttggtccattcctattccaccatgtcacagccagaggtgataccatcactcggtctgatccggcggagacccagcatggcgtat

SEQ ID NO: 422033 - DNA, 140 bp, Artificial Sequence
  Synthetic
aggccctggctgctgatatgccatgctgacctcagtgccaaagaggcgcaggatgtaatcatggaagttgtctttccaaatgaagtgggagcgagaatactgacgtcggagtcacaactggaccttttgggacagcggtg

SEQ ID NO: 422034 - DNA, 140 bp, Artificial Sequence
  Synthetic
caccgctgtcccaaaaggtccagttgtgactccgacgtcagtattctcgctcccacttcatttggaaagacaacttccatgattacatcctgcgcctctttggcactgaggtcagcatggcatatcagcagccagggcct

SEQ ID NO: 422035 - DNA, 140 bp, Artificial Sequence
  Synthetic
aggccctggctgctgatatggaatctgatgtcgcagtctcgcactcgcgagatactgacaaaaaccacagtggaccatatggccataattaagaagtacacatcggggagacaggaaaaggaccttttgggacagcggtg

SEQ ID NO: 422036 - DNA, 140 bp, Artificial Sequence
  Synthetic
caccgctgtcccaaaaggtccttttcctgtctccccgatgtgtacttcttaattatggccatatggtccactgtggtttttgtcagtatctcgcgagtgcgagactgcgacatcagattccatatcagcagccagggcct

SEQ ID NO: 422037 - DNA, 140 bp, Artificial Sequence
  Synthetic
aggccctggctgctgatatgcaatggatcattagaaattgggaaactgtaaagattcaatggtcccaagatcctacaatgctatacaataagatggaatttgaaccctttcaatccctaggaccttttgggacagcggtg

SEQ ID NO: 422038 - DNA, 140 bp, Artificial Sequence
  Synthetic
caccgctgtcccaaaaggtcctagggattgaaagggttcaaattccatcttattgtatagcattgtaggatcttgggaccattgaatctttacagtttcccaatttctaatgatccattgcatatcagcagccagggcct

SEQ ID NO: 422039 - DNA, 140 bp, Artificial Sequence
  Synthetic
aggccctggctgctgatatggcctcattgagccctggaatgatgatgggcatgttcaacatgctgagtacagttttgggagtttcgattctaaatctagggcaaaagaggtacaccaaaagaccttttgggacagcggtg

SEQ ID NO: 422040 - DNA, 140 bp, Artificial Sequence
  Synthetic
caccgctgtcccaaaaggtcttttggtgtacctcttttgccctagatttagaatcgaaactcccaaaactgtactcagcatgttgaacatgcccatcatcattccagggctcaatgaggccatatcagcagccagggcct

SEQ ID NO: 422041 - DNA, 140 bp, Artificial Sequence
  Synthetic
aggccctggctgctgatatgtgcagggcaaatcagtgtacagcctactttctcagtacagagaaatcttcctttcgagagagcgaccatcatggcagcatttactggaaacactgaaggcgaccttttgggacagcggtg

SEQ ID NO: 422042 - DNA, 140 bp, Artificial Sequence
  Synthetic
caccgctgtcccaaaaggtcgccttcagtgtttccagtaaatgctgccatgatggtcgctctctcgaaaggaagatttctctgtactgagaaagtaggctgtacactgatttgccctgcacatatcagcagccagggcct

SEQ ID NO: 422043 - DNA, 140 bp, Artificial Sequence
  Synthetic
aggccctggctgctgatatgagccatggaacggggacaggatacaccatggacacagtaaacagaacacatcaatactcagaaaagggaaagtggacaacaaacactgaaactggagcacgaccttttgggacagcggtg

SEQ ID NO: 422044 - DNA, 140 bp, Artificial Sequence
  Synthetic
caccgctgtcccaaaaggtcgtgctccagtttcagtgtttgttgtccactttcccttttctgagtattgatgtgttctgtttactgtgtccatggtgtatcctgtccccgttccatggctcatatcagcagccagggcct

SEQ ID NO: 422045 - DNA, 140 bp, Artificial Sequence
  Synthetic
aggccctggctgctgatatggaatggtttatgcttatgcccaaatggaaatttgctgggcccctccgcatcagaatggatcaggcaatcatagataaggaagtcacactaaaagcgaattgaccttttgggacagcggtg

SEQ ID NO: 422046 - DNA, 140 bp, Artificial Sequence
  Synthetic
caccgctgtcccaaaaggtcaattcgcttttagtgtgacttccttatctatgattgcctgatccattctgatgcggaggggcccagcaaatttccatttgggcataagcataaaccattccatatcagcagccagggcct

SEQ ID NO: 422047 - DNA, 140 bp, Artificial Sequence
  Synthetic
aggccctggctgctgatatgtggaatttgaaccctttcaatccctagtgcctaaagctgccagaggccaatatagtggattcgtaagggttctattccagcagatgcgtgacgtactggggaccttttgggacagcggtg

SEQ ID NO: 422048 - DNA, 140 bp, Artificial Sequence
  Synthetic
caccgctgtcccaaaaggtccccagtacgtcacgcatctgctggaatagaacccttacgaatccactatattggcctctggcagctttaggcactagggattgaaagggttcaaattccacatatcagcagccagggcct

SEQ ID NO: 422049 - DNA, 140 bp, Artificial Sequence
  Synthetic
atacgccatgctgggtctccctgtggcaagtgggtacgactttgagagggaagggtattcccttgttgggatagaccccttccggctgctccaaaacagccaagtgttcagtctaatccgcgtacttgggagtcggccat

SEQ ID NO: 422050 - DNA, 140 bp, Artificial Sequence
  Synthetic
atggccgactcccaagtacgcggattagactgaacacttggctgttttggagcagccggaaggggtctatcccaacaagggaatacccttccctctcaaagtcgtacccacttgccacagggagacccagcatggcgtat

SEQ ID NO: 422051 - DNA, 140 bp, Artificial Sequence
  Synthetic
aggccctggctgctgatatgcactacatttcaagcagaatgaatgcagtaacccatcgaataatcaagtgatgccatgtgaaccgatcataatagagaggaacacagtgcatttgaataggaccttttgggacagcggtg

SEQ ID NO: 422052 - DNA, 140 bp, Artificial Sequence
  Synthetic
caccgctgtcccaaaaggtcctattcaaatgcactgtgttcctctctattatgatcggttcacatggcatcacttgattattcgatgggttactgcattcattctgcttgaaatgtagtgcatatcagcagccagggcct

SEQ ID NO: 422053 - DNA, 140 bp, Artificial Sequence
  Synthetic
aggccctggctgctgatatgtgcagacaaaatctgcctcggacatcatgccgtgtcaaacggaaccaaagtaaacacattaactgaaagaggagtggaagtcgtcaatgcaactgaaacagaccttttgggacagcggtg

SEQ ID NO: 422054 - DNA, 140 bp, Artificial Sequence
  Synthetic
caccgctgtcccaaaaggtctgtttcagttgcattgacgacttccactcctctttcagttaatgtgtttactttggttccgtttgacacggcatgatgtccgaggcagattttgtctgcacatatcagcagccagggcct

SEQ ID NO: 422055 - DNA, 140 bp, Artificial Sequence
  Synthetic
atacgccatgctgggtctccgttcctggcaatgataacgtacatcacaagaaatcagcctgagtggttcagaaatgttttaagcatcgcccctataatgttctcaaacaaaatggcaagacgtacttgggagtcggccat

SEQ ID NO: 422056 - DNA, 140 bp, Artificial Sequence
  Synthetic
atggccgactcccaagtacgtcttgccattttgtttgagaacattataggggcgatgcttaaaacatttctgaaccactcaggctgatttcttgtgatgtacgttatcattgccaggaacggagacccagcatggcgtat

SEQ ID NO: 422057 - DNA, 140 bp, Artificial Sequence
  Synthetic
aggccctggctgctgatatgatagaccccttccggctgctccaaaacagccaagtgttcagtctaatccgtcccaatgaaaatccagcacacaagagccagttggtgtggatggcatgtcgaccttttgggacagcggtg

SEQ ID NO: 422058 - DNA, 140 bp, Artificial Sequence
  Synthetic
caccgctgtcccaaaaggtcgacatgccatccacaccaactggctcttgtgtgctggattttcattgggacggattagactgaacacttggctgttttggagcagccggaaggggtctatcatatcagcagccagggcct

SEQ ID NO: 422059 - DNA, 140 bp, Artificial Sequence
  Synthetic
aggccctggctgctgatatggtgaccaattcctagaattttcagccgatttaattattgagaggcgagaaggaagtgatgtctgttatcctgggaaattcgtgaatgaagaagctctgaggaccttttgggacagcggtg

SEQ ID NO: 422060 - DNA, 140 bp, Artificial Sequence
  Synthetic
caccgctgtcccaaaaggtcctcagagcttcttcattcacgaatttcccaggataacagacatcacttccttctcgcctctcaataattaaatcggctgaaaattctaggaattggtcaccatatcagcagccagggcct

SEQ ID NO: 422061 - DNA, 140 bp, Artificial Sequence
  Synthetic
atacgccatgctgggtctccgcaaatactcagagaatcaggcggaattgacaaggaagcaatgggattcacatacagtggaataagaactaatggagcaaccagtgcatgtaggagatcacgtacttgggagtcggccat

SEQ ID NO: 422062 - DNA, 140 bp, Artificial Sequence
  Synthetic
atggccgactcccaagtacgtgatctcctacatgcactggttgctccattagttcttattccactgtatgtgaatcccattgcttccttgtcaattccgcctgattctctgagtatttgcggagacccagcatggcgtat

SEQ ID NO: 422063 - DNA, 140 bp, Artificial Sequence
  Synthetic
atacgccatgctgggtctccctcatatacaacagaatggggactgtaaccaccgaagtggcattcggcctagtatgcgccacatgtgagcagattgctgattcccagcataggtctcacacgtacttgggagtcggccat

SEQ ID NO: 422064 - DNA, 140 bp, Artificial Sequence
  Synthetic
atggccgactcccaagtacgtgtgagacctatgctgggaatcagcaatctgctcacatgtggcgcatactaggccgaatgccacttcggtggttacagtccccattctgttgtatatgagggagacccagcatggcgtat

SEQ ID NO: 422065 - DNA, 140 bp, Artificial Sequence
  Synthetic
aggccctggctgctgatatgagtatgcgccacatgtgagcagattgctgattcccagcataggtctcacagacaaatggtgacaacaaccaacccactgatcagacatgagaacagaatggaccttttgggacagcggtg

SEQ ID NO: 422066 - DNA, 140 bp, Artificial Sequence
  Synthetic
caccgctgtcccaaaaggtccattctgttctcatgtctgatcagtgggttggttgttgtcaccatttgtctgtgagacctatgctgggaatcagcaatctgctcacatgtggcgcatactcatatcagcagccagggcct

SEQ ID NO: 422067 - DNA, 140 bp, Artificial Sequence
  Synthetic
aggccctggctgctgatatgaagtgcccagcacgttgaggaatgctcctgttatccccggtatcctgaagttaggtgtgtctgcagagacaattggaagggctccaataggcccattctagaccttttgggacagcggtg

SEQ ID NO: 422068 - DNA, 140 bp, Artificial Sequence
  Synthetic
caccgctgtcccaaaaggtctagaatgggcctattggagcccttccaattgtctctgcagacacacctaacttcaggataccggggataacaggagcattcctcaacgtgctgggcacttcatatcagcagccagggcct

SEQ ID NO: 422069 - DNA, 140 bp, Artificial Sequence
  Synthetic
atacgccatgctgggtctccatgtatggacatataatgctgagttgctcattttactcgagaacgaaaggactctagatttccatgactttaatgtaaagaatttatatgaaaaagtcaacgtacttgggagtcggccat

SEQ ID NO: 422070 - DNA, 140 bp, Artificial Sequence
  Synthetic
atggccgactcccaagtacgttgactttttcatataaattctttacattaaagtcatggaaatctagagtcctttcgttctcgagtaaaatgagcaactcagcattatatgtccatacatggagacccagcatggcgtat

SEQ ID NO: 422071 - DNA, 140 bp, Artificial Sequence
  Synthetic
aggccctggctgctgatatgcttcctgagaggaaaatctatgggaatccagagtggagtacaggttgatgccaattgtgaaggggactgctatcatagtggagggacaataataagtaacgaccttttgggacagcggtg

SEQ ID NO: 422072 - DNA, 140 bp, Artificial Sequence
  Synthetic
caccgctgtcccaaaaggtcgttacttattattgtccctccactatgatagcagtccccttcacaattggcatcaacctgtactccactctggattcccatagattttcctctcaggaagcatatcagcagccagggcct

SEQ ID NO: 422073 - DNA, 140 bp, Artificial Sequence
  Synthetic
aggccctggctgctgatatgacgctcaggttttgagacttttagagtcgtcaatggttggaccatggccaattcaaagtcacagataaatagacaagtcatagttgacagtgacgactgggaccttttgggacagcggtg

SEQ ID NO: 422074 - DNA, 140 bp, Artificial Sequence
  Synthetic
caccgctgtcccaaaaggtcccagtcgtcactgtcaactatgacttgtctatttatctgtgactttgaattggccatggtccaaccattgacgactctaaaagtctcaaaacctgagcgtcatatcagcagccagggcct

SEQ ID NO: 422075 - DNA, 140 bp, Artificial Sequence
  Synthetic
atacgccatgctgggtctcctgttaagcaaaggagtctgctgctagcaacagggatgaagaatgttcctgagattccaaagggaagaggcctatttggtgctatagcgggtttcattgaacgtacttgggagtcggccat

SEQ ID NO: 422076 - DNA, 140 bp, Artificial Sequence
  Synthetic
atggccgactcccaagtacgttcaatgaaacccgctatagcaccaaataggcctcttccctttggaatctcaggaacattcttcatccctgttgctagcagcagactcctttgcttaacaggagacccagcatggcgtat

SEQ ID NO: 422077 - DNA, 140 bp, Artificial Sequence
  Synthetic
atacgccatgctgggtctccgtaggctacaggaattggtcaaaaccgcaatgtcaaattgcagggtttgctcctttttccaaggacaattcgattcgactttcagctggtggggacatttcgtacttgggagtcggccat

SEQ ID NO: 422078 - DNA, 140 bp, Artificial Sequence
  Synthetic
atggccgactcccaagtacgaaatgtccccaccagctgaaagtcgaatcgaattgtccttggaaaaaggagcaaaccctgcaatttgacattgcggttttgaccaattcctgtagcctacggagacccagcatggcgtat

SEQ ID NO: 422079 - DNA, 140 bp, Artificial Sequence
  Synthetic
aggccctggctgctgatatgtcctttttccaaggacaattcgattcgactttcagctggtggggacatttgggtaacaagagaaccttatgtgtcatgtgacaccagtaaatgttaccaagaccttttgggacagcggtg

SEQ ID NO: 422080 - DNA, 140 bp, Artificial Sequence
  Synthetic
caccgctgtcccaaaaggtcttggtaacatttactggtgtcacatgacacataaggttctcttgttacccaaatgtccccaccagctgaaagtcgaatcgaattgtccttggaaaaaggacatatcagcagccagggcct

SEQ ID NO: 422081 - DNA, 140 bp, Artificial Sequence
  Synthetic
atacgccatgctgggtctcctgcacagggagagggaactgctgcagattacaaaagcactcaatcggcaattgatcaaataacaggaaaattaaaccggcttatagaaaaaaccaaccaacgtacttgggagtcggccat

SEQ ID NO: 422082 - DNA, 140 bp, Artificial Sequence
  Synthetic
atggccgactcccaagtacgttggttggttttttctataagccggtttaattttcctgttatttgatcaattgccgattgagtgcttttgtaatctgcagcagttccctctccctgtgcaggagacccagcatggcgtat

SEQ ID NO: 422083 - DNA, 140 bp, Artificial Sequence
  Synthetic
atacgccatgctgggtctccaatacatgatagaatccctcatcggactcttttgatgagtgagttgggtgttccgtttcatttgggaaccaaacaagtatgcatagcatggtccagctcacgtacttgggagtcggccat

SEQ ID NO: 422084 - DNA, 140 bp, Artificial Sequence
  Synthetic
atggccgactcccaagtacgtgagctggaccatgctatgcatacttgtttggttcccaaatgaaacggaacacccaactcactcatcaaaagagtccgatgagggattctatcatgtattggagacccagcatggcgtat

SEQ ID NO: 422085 - DNA, 140 bp, Artificial Sequence
  Synthetic
atacgccatgctgggtctcctaatgtgataaattggaccagagattctataacagaagtgtggtcatacaatgctgaactcttggtagcaatggagaaccagcatacaattgatctggctcgtacttgggagtcggccat

SEQ ID NO: 422086 - DNA, 140 bp, Artificial Sequence
  Synthetic
atggccgactcccaagtacgagccagatcaattgtatgctggttctccattgctaccaagagttcagcattgtatgaccacacttctgttatagaatctctggtccaatttatcacattaggagacccagcatggcgtat

SEQ ID NO: 422087 - DNA, 140 bp, Artificial Sequence
  Synthetic
atacgccatgctgggtctccttggttcatggtcccaaaacatcctcagaactcaggagtcagagtgcgtttgcatcaatgggacttgtaccgtagtaatgactgatggaagtgcatcaggcgtacttgggagtcggccat

SEQ ID NO: 422088 - DNA, 140 bp, Artificial Sequence
  Synthetic
atggccgactcccaagtacgcctgatgcacttccatcagtcattactacggtacaagtcccattgatgcaaacgcactctgactcctgagttctgaggatgttttgggaccatgaaccaaggagacccagcatggcgtat

SEQ ID NO: 422089 - DNA, 140 bp, Artificial Sequence
  Synthetic
aggccctggctgctgatatgtgcatcaatgggacttgtaccgtagtaatgactgatggaagtgcatcaggaaaagccgacactagaatattattcattaaagagggagaaattgttcacagaccttttgggacagcggtg

SEQ ID NO: 422090 - DNA, 140 bp, Artificial Sequence
  Synthetic
caccgctgtcccaaaaggtctgtgaacaatttctccctctttaatgaataatattctagtgtcggcttttcctgatgcacttccatcagtcattactacggtacaagtcccattgatgcacatatcagcagccagggcct

SEQ ID NO: 422091 - DNA, 140 bp, Artificial Sequence
  Synthetic
aggccctggctgctgatatgaagcagcggctacaaagatgtgatactttggtttagcttcggggcatcatgtttcatacttctagccattgtaatgggccttgtcttcatatgtgtaaaggaccttttgggacagcggtg

SEQ ID NO: 422092 - DNA, 140 bp, Artificial Sequence
  Synthetic
caccgctgtcccaaaaggtcctttacacatatgaagacaaggcccattacaatggctagaagtatgaaacatgatgccccgaagctaaaccaaagtatcacatctttgtagccgctgcttcatatcagcagccagggcct

SEQ ID NO: 422093 - DNA, 140 bp, Artificial Sequence
  Synthetic
atacgccatgctgggtctccccccgatacccaaacgtcagatgtgtttgcagagataactggaagggctctaataggccaattatagatataaatatggcagattatagcattgattccacgtacttgggagtcggccat

SEQ ID NO: 422094 - DNA, 140 bp, Artificial Sequence
  Synthetic
atggccgactcccaagtacgtggaatcaatgctataatctgccatatttatatctataattggcctattagagcccttccagttatctctgcaaacacatctgacgtttgggtatcggggggagacccagcatggcgtat

SEQ ID NO: 422095 - DNA, 140 bp, Artificial Sequence
  Synthetic
aggccctggctgctgatatgtaataggccaattatagatataaatatggcagattatagcattgattccagttatgtgtgttcaggacttgttggagacacaccaaggaacgacgatagtgaccttttgggacagcggtg

SEQ ID NO: 422096 - DNA, 140 bp, Artificial Sequence
  Synthetic
caccgctgtcccaaaaggtcactatcgtcgttccttggtgtgtctccaacaagtcctgaacacacataactggaatcaatgctataatctgccatatttatatctataattggcctattacatatcagcagccagggcct

SEQ ID NO: 422097 - DNA, 140 bp, Artificial Sequence
  Synthetic
atacgccatgctgggtctccagtgaaagggtgggcctttgacagtggagatgatgtttggatgggaagaacaatcagtaaagattcacgttcgggctatgagacctttagggtcattggtcgtacttgggagtcggccat

SEQ ID NO: 422098 - DNA, 140 bp, Artificial Sequence
  Synthetic
atggccgactcccaagtacgaccaatgaccctaaaggtctcatagcccgaacgtgaatctttactgattgttcttcccatccaaacatcatctccactgtcaaaggcccaccctttcactggagacccagcatggcgtat

SEQ ID NO: 422099 - DNA, 140 bp, Artificial Sequence
  Synthetic
atacgccatgctgggtctccactctgcagcatttgaggaccttagggtctcaagtttcatcagagggacaagaatggtcccaagaggacagctatccactagaggggttcaaattgcttccgtacttgggagtcggccat

SEQ ID NO: 422100 - DNA, 140 bp, Artificial Sequence
  Synthetic
atggccgactcccaagtacggaagcaatttgaacccctctagtggatagctgtcctcttgggaccattcttgtccctctgatgaaacttgagaccctaaggtcctcaaatgctgcagagtggagacccagcatggcgtat

SEQ ID NO: 422101 - DNA, 140 bp, Artificial Sequence
  Synthetic
atacgccatgctgggtctcctgataataacaactggtctggttattctggtattttctctgttgaaaacaaaggctgcatcaataggtgtttctatgtggagttgataagaggaaggccgcgtacttgggagtcggccat

SEQ ID NO: 422102 - DNA, 140 bp, Artificial Sequence
  Synthetic
atggccgactcccaagtacgcggccttcctcttatcaactccacatagaaacacctattgatgcagcctttgttttcaacagagaaaataccagaataaccagaccagttgttattatcaggagacccagcatggcgtat

SEQ ID NO: 422103 - DNA, 140 bp, Artificial Sequence
  Synthetic
atacgccatgctgggtctccgcatcagctggacaaatcagtgtgcaacccactttctcagtacaaaggaatctcccttttgaaagagcgaccatcatggccgcattcacagggaacgcagcgtacttgggagtcggccat

SEQ ID NO: 422104 - DNA, 140 bp, Artificial Sequence
  Synthetic
atggccgactcccaagtacgctgcgttccctgtgaatgcggccatgatggtcgctctttcaaaagggagattcctttgtactgagaaagtgggttgcacactgatttgtccagctgatgcggagacccagcatggcgtat

SEQ ID NO: 422105 - DNA, 140 bp, Artificial Sequence
  Synthetic
atacgccatgctgggtctcctcagtgtgattttcaatcggcttgaagccctgatactacttagagcttttacggaagaaggagcaattgtaggcgaaatctcaccattaccttctcttcccgtacttgggagtcggccat

SEQ ID NO: 422106 - DNA, 140 bp, Artificial Sequence
  Synthetic
atggccgactcccaagtacgggaagagaaggtaatggtgagatttcgcctacaattgctccttcttccgtaaaagctctaagtagtatcagggcttcaagccgattgaaaatcacactgaggagacccagcatggcgtat

SEQ ID NO: 422107 - DNA, 140 bp, Artificial Sequence
  Synthetic
atacgccatgctgggtctcccttctacggaaggagtacctgagtctatgagggaagaatatcgaaaggaacagcagaatgctgtggatgctgacgacagtcattttgtcagcatagagttcgtacttgggagtcggccat

SEQ ID NO: 422108 - DNA, 140 bp, Artificial Sequence
  Synthetic
atggccgactcccaagtacgaactctatgctgacaaaatgactgtcgtcagcatccacagcattctgctgttcctttcgatattcttccctcatagactcaggtactccttccgtagaagggagacccagcatggcgtat

SEQ ID NO: 422109 - DNA, 140 bp, Artificial Sequence
  Synthetic
aggccctggctgctgatatgaatccaactgaggaacaagctgtggatatatgcaaggcagcaatgggtatgaggatcagctcatcttttagctttggaggtttcactttcaaaagaacaagaccttttgggacagcggtg

SEQ ID NO: 422110 - DNA, 140 bp, Artificial Sequence
  Synthetic
caccgctgtcccaaaaggtcttgttcttttgaaagtgaaacctccaaagctaaaagatgagctgatcctcatacccattgctgccttgcatatatccacagcttgttcctcagttggattcatatcagcagccagggcct

SEQ ID NO: 422111 - DNA, 140 bp, Artificial Sequence
  Synthetic
atacgccatgctgggtctcccagtggctcataagtcctgcctgcctgcttgtgtgtatggacttgcggtggccagtggatacgactttgaaagagagggatactccctggtcggaattgacgtacttgggagtcggccat

SEQ ID NO: 422112 - DNA, 140 bp, Artificial Sequence
  Synthetic
atggccgactcccaagtacgtcaattccgaccagggagtatccctctctttcaaagtcgtatccactggccaccgcaagtccatacacacaagcaggcaggcaggacttatgagccactgggagacccagcatggcgtat

SEQ ID NO: 422113 - DNA, 140 bp, Artificial Sequence
  Synthetic
atacgccatgctgggtctcctacggagaatagctttgagcaaataacttttatgcaagccttacaactattgcttgaagtggagcaagagataagaactttctcgtttcagcttatttaacgtacttgggagtcggccat

SEQ ID NO: 422114 - DNA, 140 bp, Artificial Sequence
  Synthetic
atggccgactcccaagtacgttaaataagctgaaacgagaaagttcttatctcttgctccacttcaagcaatagttgtaaggcttgcataaaagttatttgctcaaagctattctccgtaggagacccagcatggcgtat

SEQ ID NO: 422115 - DNA, 140 bp, Artificial Sequence
  Synthetic
aggccctggctgctgatatgaagtgttatcaatttgcccttggacagggaacaacactaaacaacgtgcattcaaataacacagtacgtgataggaccccttatcggactctattgatgagaccttttgggacagcggtg

SEQ ID NO: 422116 - DNA, 140 bp, Artificial Sequence
  Synthetic
caccgctgtcccaaaaggtctcatcaatagagtccgataaggggtcctatcacgtactgtgttatttgaatgcacgttgtttagtgttgttccctgtccaagggcaaattgataacacttcatatcagcagccagggcct

SEQ ID NO: 422117 - DNA, 140 bp, Artificial Sequence
  Synthetic
atacgccatgctgggtctccaatctgtacacaagaaccgacacaacaacgagtgtggcaacagaagaaataaataggatcttcaaaccattgataggaccaaggcctcttgtcaacggttcgtacttgggagtcggccat

SEQ ID NO: 422118 - DNA, 140 bp, Artificial Sequence
  Synthetic
atggccgactcccaagtacgaaccgttgacaagaggccttggtcctatcaatggtttgaagatcctatttatttcttctgttgccacactcgttgttgtgtcggttcttgtgtacagattggagacccagcatggcgtat

SEQ ID NO: 422119 - DNA, 140 bp, Artificial Sequence
  Synthetic
aggccctggctgctgatatgtggtccagctcaagttgtcacgatggaaaagcatggctgcatgtttgtataacgggggatgataaaaatgcaactgctagcttcatttacaatgggaggcgaccttttgggacagcggtg

SEQ ID NO: 422120 - DNA, 140 bp, Artificial Sequence
  Synthetic
caccgctgtcccaaaaggtcgcctcccattgtaaatgaagctagcagttgcatttttatcatcccccgttatacaaacatgcagccatgcttttccatcgtgacaacttgagctggaccacatatcagcagccagggcct

SEQ ID NO: 422121 - DNA, 140 bp, Artificial Sequence
  Synthetic
aggccctggctgctgatatgatgcagagagaggcaaattaaaaaggagggctattgcaacacctgggatgcaaattagagggttcgtgtactttgttgagactctagctagaagcatttggaccttttgggacagcggtg

SEQ ID NO: 422122 - DNA, 140 bp, Artificial Sequence
  Synthetic
caccgctgtcccaaaaggtccaaatgcttctagctagagtctcaacaaagtacacgaaccctctaatttgcatcccaggtgttgcaatagccctcctttttaatttgcctctctctgcatcatatcagcagccagggcct

SEQ ID NO: 422123 - DNA, 140 bp, Artificial Sequence
  Synthetic
aggccctggctgctgatatgagtaccagcagaaatgctcgtgaatattgacctgaaatacttcaacaaatcaacaagagagaagatcgagaaaataaggcctctactaatggatggcacagaccttttgggacagcggtg

SEQ ID NO: 422124 - DNA, 140 bp, Artificial Sequence
  Synthetic
caccgctgtcccaaaaggtctgtgccatccattagtagaggccttattttctcgatcttctctcttgttgatttgttgaagtatttcaggtcaatattcacgagcatttctgctggtactcatatcagcagccagggcct

SEQ ID NO: 422125 - DNA, 140 bp, Artificial Sequence
  Synthetic
aggccctggctgctgatatgctggaaaggctccaatcggcccatcgtagatataaacataaaggatcatagcattgtttccagttatgtgtgttcaggacttgttggagacacacccagagaccttttgggacagcggtg

SEQ ID NO: 422126 - DNA, 140 bp, Artificial Sequence
  Synthetic
caccgctgtcccaaaaggtctctgggtgtgtctccaacaagtcctgaacacacataactggaaacaatgctatgatcctttatgtttatatctacgatgggccgattggagcctttccagcatatcagcagccagggcct

SEQ ID NO: 422127 - DNA, 140 bp, Artificial Sequence
  Synthetic
atacgccatgctgggtctccataaaataacatccaaagtgaataacatagtcgacaaaatgaacaagcagtatgaaattattgatcatgaattcagtgaggtagaaactagacttaacatcgtacttgggagtcggccat

SEQ ID NO: 422128 - DNA, 140 bp, Artificial Sequence
  Synthetic
atggccgactcccaagtacgatgttaagtctagtttctacctcactgaattcatgatcaataatttcatactgcttgttcattttgtcgactatgttattcactttggatgttattttatggagacccagcatggcgtat

SEQ ID NO: 422129 - DNA, 140 bp, Artificial Sequence
  Synthetic
atacgccatgctgggtctccagatctctagcaagctgggtccaaaatgagttcaacaaggcatgtgaattgaccgattcaagctggatagaacttgatgagataggagaagatgttgccccgtacttgggagtcggccat

SEQ ID NO: 422130 - DNA, 140 bp, Artificial Sequence
  Synthetic
atggccgactcccaagtacggggcaacatcttctcctatctcatcaagttctatccagcttgaatcggtcaattcacatgccttgttgaactcattttggacccagcttgctagagatctggagacccagcatggcgtat

SEQ ID NO: 422131 - DNA, 140 bp, Artificial Sequence
  Synthetic
aggccctggctgctgatatgaggggaagaaaagaggaaactgaagtattgtggacctcaaacagtattgttgtgttttgtggcacctcaggtacatatggaacaggctcatggcctgatggaccttttgggacagcggtg

SEQ ID NO: 422132 - DNA, 140 bp, Artificial Sequence
  Synthetic
caccgctgtcccaaaaggtccatcaggccatgagcctgttccatatgtacctgaggtgccacaaaacacaacaatactgtttgaggtccacaatacttcagtttcctcttttcttcccctcatatcagcagccagggcct

SEQ ID NO: 422133 - DNA, 140 bp, Artificial Sequence
  Synthetic
aggccctggctgctgatatgttcgactgtcgcctcatctcttgtgattgcaatggggtttgctgccttcttgttctgggccatgtccaatggatcttgcagatgcaacatttgtatataagaccttttgggacagcggtg

SEQ ID NO: 422134 - DNA, 140 bp, Artificial Sequence
  Synthetic
caccgctgtcccaaaaggtcttatatacaaatgttgcatctgcaagatccattggacatggcccagaacaagaaggcagcaaaccccattgcaatcacaagagatgaggcgacagtcgaacatatcagcagccagggcct

SEQ ID NO: 422135 - DNA, 140 bp, Artificial Sequence
  Synthetic
atacgccatgctgggtctccttccaggtagactgctttctttggcatgtccgcaaacggtttgcagaccaagaactgggtgatgccccatttctagaccggcttcgccgagatcagaagtcgtacttgggagtcggccat

SEQ ID NO: 422136 - DNA, 140 bp, Artificial Sequence
  Synthetic
atggccgactcccaagtacgacttctgatctcggcgaagccggtctagaaatggggcatcacccagttcttggtctgcaaaccgtttgcggacatgccaaagaaagcagtctacctggaaggagacccagcatggcgtat

SEQ ID NO: 422137 - DNA, 140 bp, Artificial Sequence
  Synthetic
atacgccatgctgggtctccaacatggccaatcggagaatcacccaaaggagtggaggaaggctctattgggaaagtgtgcaggaccttactggcaaaatctgtattcaacagtctataccgtacttgggagtcggccat

SEQ ID NO: 422138 - DNA, 140 bp, Artificial Sequence
  Synthetic
atggccgactcccaagtacggtatagactgttgaatacagattttgccagtaaggtcctgcacactttcccaatagagccttcctccactcctttgggtgattctccgattggccatgttggagacccagcatggcgtat

SEQ ID NO: 422139 - DNA, 140 bp, Artificial Sequence
  Synthetic
atacgccatgctgggtctccttcgagtctctgaaactctacagagattcgcttggagaagcagcgatgaggatgggagacctccactctctccaaagtaggaacgggaaatggagagaaccgtacttgggagtcggccat

SEQ ID NO: 422140 - DNA, 140 bp, Artificial Sequence
  Synthetic
atggccgactcccaagtacggttctctccatttcccgttcctactttggagagagtggaggtctcccatcctcatcgctgcttctccaagcgaatctctgtagagtttcagagactcgaaggagacccagcatggcgtat

SEQ ID NO: 422141 - DNA, 140 bp, Artificial Sequence
  Synthetic
aggccctggctgctgatatggaaggattaagaaagaagagtttgctgagatcatgaagatctgttccaccattgaagagctcagacggcaaaaatagtgaatttagcttgtccttcatgagaccttttgggacagcggtg

SEQ ID NO: 422142 - DNA, 140 bp, Artificial Sequence
  Synthetic
caccgctgtcccaaaaggtctcatgaaggacaagctaaattcactatttttgccgtctgagctcttcaatggtggaacagatcttcatgatctcagcaaactcttctttcttaatccttccatatcagcagccagggcct

SEQ ID NO: 422143 - DNA, 140 bp, Artificial Sequence
  Synthetic
atacgccatgctgggtctccttctcattcactggggaggagatggccaccaaagctgactatacccttgatgaagagagcagagcaaggatcaaaaccaggttgttcactatcaggcaagcgtacttgggagtcggccat

SEQ ID NO: 422144 - DNA, 140 bp, Artificial Sequence
  Synthetic
atggccgactcccaagtacgcttgcctgatagtgaacaacctggttttgatccttgctctgctctcttcatcaagggtatagtcagctttggtggccatctcctccccagtgaatgagaaggagacccagcatggcgtat

SEQ ID NO: 422145 - DNA, 140 bp, Artificial Sequence
  Synthetic
atacgccatgctgggtctccacaagagcgcttgttcgcactggaatggatcccagaatgtgctctctaatgcaaggttcaacacttcccagaagatctggggccgcaggtgctgcagtaacgtacttgggagtcggccat

SEQ ID NO: 422146 - DNA, 140 bp, Artificial Sequence
  Synthetic
atggccgactcccaagtacgttactgcagcacctgcggccccagatcttctgggaagtgttgaaccttgcattagagagcacattctgggatccattccagtgcgaacaagcgctcttgtggagacccagcatggcgtat

SEQ ID NO: 422147 - DNA, 140 bp, Artificial Sequence
  Synthetic
aggccctggctgctgatatggagggggaaggtataccgctgtatgatgcaatcaaatgcatgaagacattttttggctggaaagagcccaacattgtaaagccacacgaaaagggcataagaccttttgggacagcggtg

SEQ ID NO: 422148 - DNA, 140 bp, Artificial Sequence
  Synthetic
caccgctgtcccaaaaggtcttatgcccttttcgtgtggctttacaatgttgggctctttccagccaaaaaatgtcttcatgcatttgattgcatcatacagcggtataccttccccctccatatcagcagccagggcct

SEQ ID NO: 422149 - DNA, 140 bp, Artificial Sequence
  Synthetic
aggccctggctgctgatatgttctacagcggcgagttccctagcactggcaatcatggtagctggtctatccttatggatgtgctccaatgggtcgttacaatgcagaatttgcatttaagaccttttgggacagcggtg

SEQ ID NO: 422150 - DNA, 140 bp, Artificial Sequence
  Synthetic
caccgctgtcccaaaaggtcttaaatgcaaattctgcattgtaacgacccattggagcacatccataaggatagaccagctaccatgattgccagtgctagggaactcgccgctgtagaacatatcagcagccagggcct

SEQ ID NO: 422151 - DNA, 140 bp, Artificial Sequence
  Synthetic
atacgccatgctgggtctccgagttggagaaaaaacatattaagaacacaagaatctgaatgtgcatgcgtgaatggttcttgctttactgtaatgaccgatggaccaagtaatgggcagcgtacttgggagtcggccat

SEQ ID NO: 422152 - DNA, 140 bp, Artificial Sequence
  Synthetic
atggccgactcccaagtacgctgcccattacttggtccatcggtcattacagtaaagcaagaaccattcacgcatgcacattcagattcttgtgttcttaatatgttttttctccaactcggagacccagcatggcgtat

SEQ ID NO: 422153 - DNA, 140 bp, Artificial Sequence
  Synthetic
aggccctggctgctgatatgataaagagattgattctgtaaacagtgctgtggtgatgccagcccatggtccagccaaaagtatggaatatgatgccgttgcaactacacactcctggatgaccttttgggacagcggtg

SEQ ID NO: 422154 - DNA, 140 bp, Artificial Sequence
  Synthetic
caccgctgtcccaaaaggtcatccaggagtgtgtagttgcaacggcatcatattccatacttttggctggaccatgggctggcatcaccacagcactgtttacagaatcaatctctttatcatatcagcagccagggcct

SEQ ID NO: 422155 - DNA, 140 bp, Artificial Sequence
  Synthetic
aggccctggctgctgatatggagtcagcaaaatgggagtagatgaatattccagtacggagagagtggtagtgagcattgaccgatttttgagagttcgggatcaacgagggaacgtactgaccttttgggacagcggtg

SEQ ID NO: 422156 - DNA, 140 bp, Artificial Sequence
  Synthetic
caccgctgtcccaaaaggtcagtacgttccctcgttgatcccgaactctcaaaaatcggtcaatgctcactaccactctctccgtactggaatattcatctactcccattttgctgactccatatcagcagccagggcct

SEQ ID NO: 422157 - DNA, 140 bp, Artificial Sequence
  Synthetic
aggccctggctgctgatatggagtggatgaatactccagtactgagagagtggtcgtgagcattgatcgtttcttgagagtccgagatcagaggggaaacgtgctcctgtctcctgaggagaccttttgggacagcggtg

SEQ ID NO: 422158 - DNA, 140 bp, Artificial Sequence
  Synthetic
caccgctgtcccaaaaggtctcctcaggagacaggagcacgtttcccctctgatctcggactctcaagaaacgatcaatgctcacgaccactctctcagtactggagtattcatccactccatatcagcagccagggcct

SEQ ID NO: 422159 - DNA, 140 bp, Artificial Sequence
  Synthetic
atacgccatgctgggtctccctggttcagaattcctcaataggtgaaatatgcgacagtcctcatcagatccttgatggagaaaactgtacactaatagatgctctattgggagaccctccgtacttgggagtcggccat

SEQ ID NO: 422160 - DNA, 140 bp, Artificial Sequence
  Synthetic
atggccgactcccaagtacggagggtctcccaatagagcatctattagtgtacagttttctccatcaaggatctgatgaggactgtcgcatatttcacctattgaggaattctgaaccagggagacccagcatggcgtat

SEQ ID NO: 422161 - DNA, 140 bp, Artificial Sequence
  Synthetic
atacgccatgctgggtctccaatgaagggagtgtacataaatacggctcttcttaatgcatcttgtgcagccatggatgactttcagctgatcccaatgataagcaaatgtaggacaaaacgtacttgggagtcggccat

SEQ ID NO: 422162 - DNA, 140 bp, Artificial Sequence
  Synthetic
atggccgactcccaagtacgttttgtcctacatttgcttatcattgggatcagctgaaagtcatccatggctgcacaagatgcattaagaagagccgtatttatgtacactcccttcattggagacccagcatggcgtat

SEQ ID NO: 422163 - DNA, 140 bp, Artificial Sequence
  Synthetic
atacgccatgctgggtctcctcccaggagagttggataacaatggtgagctgcggcaccttttcagtggagtaaactcttttagcaggacagaattgataagccccagcaaatggggggccgtacttgggagtcggccat

SEQ ID NO: 422164 - DNA, 140 bp, Artificial Sequence
  Synthetic
atggccgactcccaagtacggccccccatttgctggggcttatcaattctgtcctgctaaaagagtttactccactgaaaaggtgccgcagctcaccattgttatccaactctcctgggaggagacccagcatggcgtat

SEQ ID NO: 422165 - DNA, 140 bp, Artificial Sequence
  Synthetic
atacgccatgctgggtctcctttgtagctaattttagcatggagctgcccagttttggagtgtctggaataaacgaatcagctgatatgagtattggagtaacagtgataaagaacaacacgtacttgggagtcggccat

SEQ ID NO: 422166 - DNA, 140 bp, Artificial Sequence
  Synthetic
atggccgactcccaagtacgtgttgttctttatcactgttactccaatactcatatcagctgattcgtttattccagacactccaaaactgggcagctccatgctaaaattagctacaaaggagacccagcatggcgtat

SEQ ID NO: 422167 - DNA, 140 bp, Artificial Sequence
  Synthetic
atacgccatgctgggtctcctaccgatgtggtaaactttgtgagcatggaattctctcttactgacccgaggctggaaccacacaagtgggaaaagtactgtgttcttgaaataggagaccgtacttgggagtcggccat

SEQ ID NO: 422168 - DNA, 140 bp, Artificial Sequence
  Synthetic
atggccgactcccaagtacggtctcctatttcaagaacacagtacttttcccacttgtgtggttccagcctcgggtcagtaagagagaattccatgctcacaaagtttaccacatcggtaggagacccagcatggcgtat

SEQ ID NO: 422169 - DNA, 140 bp, Artificial Sequence
  Synthetic
aggccctggctgctgatatgttcatcaaagactacagatacacctatagatgccatagaggggacacacaaattcagacgagaagatcattcgagctaaagaagctgtgggatcaaacccgaccttttgggacagcggtg

SEQ ID NO: 422170 - DNA, 140 bp, Artificial Sequence
  Synthetic
caccgctgtcccaaaaggtcgggtttgatcccacagcttctttagctcgaatgatcttctcgtctgaatttgtgtgtcccctctatggcatctataggtgtatctgtagtctttgatgaacatatcagcagccagggcct

SEQ ID NO: 422171 - DNA, 140 bp, Artificial Sequence
  Synthetic
aggccctggctgctgatatgccccccaaacaaccaagcaatgctgtgtgaaccaacaataatagaaagaaacacaacagagattgtgtatttgaccaacaccaccatagagaaagaaatagaccttttgggacagcggtg

SEQ ID NO: 422172 - DNA, 140 bp, Artificial Sequence
  Synthetic
caccgctgtcccaaaaggtctatttctttctctatggtggtgttggtcaaatacacaatctctgttgtgtttctttctattattgttggttcacacagcattgcttggttgtttggggggcatatcagcagccagggcct

SEQ ID NO: 422173 - DNA, 140 bp, Artificial Sequence
  Synthetic
aggccctggctgctgatatgttccagaactggggaattgaacccattgacaatgtaatgggaatgatcgggatattgcccgacatgaccccaagtactgagatgtcgctgagggggataagaccttttgggacagcggtg

SEQ ID NO: 422174 - DNA, 140 bp, Artificial Sequence
  Synthetic
caccgctgtcccaaaaggtcttatccccctcagcgacatctcagtacttggggtcatgtcgggcaatatcccgatcattcccattacattgtcaatgggttcaattccccagttctggaacatatcagcagccagggcct

SEQ ID NO: 422175 - DNA, 140 bp, Artificial Sequence
  Synthetic
atacgccatgctgggtctccatggcgtctcaaggcaccaaacgatcttacgaacaaatggagaccagtggagaacgccagaatgccactgagatcagagcatctgttggaaggatggttacgtacttgggagtcggccat

SEQ ID NO: 422176 - DNA, 140 bp, Artificial Sequence
  Synthetic
atggccgactcccaagtacgtaaccatccttccaacagatgctctgatctcagtggcattctggcgttctccactggtctccatttgttcgtaagatcgtttggtgccttgagacgccatggagacccagcatggcgtat

SEQ ID NO: 422177 - DNA, 140 bp, Artificial Sequence
  Synthetic
atacgccatgctgggtctcccaggagtggaatctgcggtattgagaggatttctgattctgggcaaagaagacaaaagatatgggccagcattgagcatcaacgaattgagcaatcttgccgtacttgggagtcggccat

SEQ ID NO: 422178 - DNA, 140 bp, Artificial Sequence
  Synthetic
atggccgactcccaagtacggcaagattgctcaattcgttgatgctcaatgctggcccatatcttttgtcttctttgcccagaatcagaaatcctctcaataccgcagattccactcctgggagacccagcatggcgtat

SEQ ID NO: 422179 - DNA, 140 bp, Artificial Sequence
  Synthetic
aggccctggctgctgatatgttatttcgaaaaagtcgaaaggttaaaacatggtacctttggccctgtccacttcagaaatcaagttaaaataagaaggagggttgacacaaaccctggtgaccttttgggacagcggtg

SEQ ID NO: 422180 - DNA, 140 bp, Artificial Sequence
  Synthetic
caccgctgtcccaaaaggtcaccagggtttgtgtcaaccctccttcttattttaacttgatttctgaagtggacagggccaaaggtaccatgttttaacctttcgactttttcgaaataacatatcagcagccagggcct

SEQ ID NO: 422181 - DNA, 140 bp, Artificial Sequence
  Synthetic
atacgccatgctgggtctccactctctgcatttgatgagagacgaaacagatacttggaagaacaccctagtgcaggaaaagatcctaagaaaactggaggtcctatttacaggagaagacgtacttgggagtcggccat

SEQ ID NO: 422182 - DNA, 140 bp, Artificial Sequence
  Synthetic
atggccgactcccaagtacgtcttctcctgtaaataggacctccagttttcttaggatcttttcctgcactagggtgttcttccaagtatctgtttcgtctctcatcaaatgcagagagtggagacccagcatggcgtat

SEQ ID NO: 422183 - DNA, 140 bp, Artificial Sequence
  Synthetic
atacgccatgctgggtctcccatgcagatctcagtgccaaggaggcacaggatgtgatcatggaagttgttttcccaaatgaagtgggggcaagaatactgacatcagagtcacagctgacgtacttgggagtcggccat

SEQ ID NO: 422184 - DNA, 140 bp, Artificial Sequence
  Synthetic
atggccgactcccaagtacgtcagctgtgactctgatgtcagtattcttgcccccacttcatttgggaaaacaacttccatgatcacatcctgtgcctccttggcactgagatctgcatgggagacccagcatggcgtat

SEQ ID NO: 422185 - DNA, 140 bp, Artificial Sequence
  Synthetic
atacgccatgctgggtctccaggtggtcatggggtgaaaggctgggcctttgatgatggaaatgacgtgtggatgggaaggacaatcaacgagacgttacgcttaggttatgaaaccttccgtacttgggagtcggccat

SEQ ID NO: 422186 - DNA, 140 bp, Artificial Sequence
  Synthetic
atggccgactcccaagtacggaaggtttcataacctaagcgtaacgtctcgttgattgtccttcccatccacacgtcatttccatcatcaaaggcccagcctttcaccccatgaccacctggagacccagcatggcgtat

SEQ ID NO: 422187 - DNA, 140 bp, Artificial Sequence
  Synthetic
aggccctggctgctgatatgaaagtcattgaaggctggtccaaagctaactccaaattacagacaaataggcaagtcatagttgaaaagggtgacaggtccggttattctggtattttctgaccttttgggacagcggtg

SEQ ID NO: 422188 - DNA, 140 bp, Artificial Sequence
  Synthetic
caccgctgtcccaaaaggtcagaaaataccagaataaccggacctgtcacccttttcaactatgacttgcctatttgtctgtaatttggagttagctttggaccagccttcaatgactttcatatcagcagccagggcct

SEQ ID NO: 422189 - DNA, 140 bp, Artificial Sequence
  Synthetic
atacgccatgctgggtctccacgagagctctcgtgcgtactggaatggacccccggatgtgctctctgatgcaaggatcaactctcccgaggagatctggagctgcaggtgcagcagtaacgtacttgggagtcggccat

SEQ ID NO: 422190 - DNA, 140 bp, Artificial Sequence
  Synthetic
atggccgactcccaagtacgttactgctgcacctgcagctccagatctcctcgggagagttgatccttgcatcagagagcacatccgggggtccattccagtacgcacgagagctctcgtggagacccagcatggcgtat

SEQ ID NO: 422191 - DNA, 140 bp, Artificial Sequence
  Synthetic
aggccctggctgctgatatgaggggaaggaaagaggaaactaaagtctggtggacctcaaacagtattgttgtgttttgtggcacctcaggtacatatggaacaggctcatggcctgatggaccttttgggacagcggtg

SEQ ID NO: 422192 - DNA, 140 bp, Artificial Sequence
  Synthetic
caccgctgtcccaaaaggtccatcaggccatgagcctgttccatatgtacctgaggtgccacaaaacacaacaatactgtttgaggtccaccagactttagtttcctctttccttcccctcatatcagcagccagggcct

SEQ ID NO: 422193 - DNA, 140 bp, Artificial Sequence
  Synthetic
aggccctggctgctgatatgtcacaatggttgggcagagggcaacagctatcctgaggaaagcaactaggaggctgattcagttgatagtaagcggaagaaacgaacagtcaatcgccgagaccttttgggacagcggtg

SEQ ID NO: 422194 - DNA, 140 bp, Artificial Sequence
  Synthetic
caccgctgtcccaaaaggtctcggcgattgactgttcgtttcttccgcttactatcaactgaatcagcctcctagttgctttcctcaggatagctgttgccctctgcccaaccattgtgacatatcagcagccagggcct

SEQ ID NO: 422195 - DNA, 140 bp, Artificial Sequence
  Synthetic
aggccctggctgctgatatggctgaaatagaagatctcatttttctggcaaggtctgcactcatcctgagaggatcagtggctcataagtcctgcttgcctgcttgtgtgtacggacttggaccttttgggacagcggtg

SEQ ID NO: 422196 - DNA, 140 bp, Artificial Sequence
  Synthetic
caccgctgtcccaaaaggtccaagtccgtacacacaagcaggcaagcaggacttatgagccactgatcctctcaggatgagtgcagaccttgccagaaaaatgagatcttctatttcagccatatcagcagccagggcct

SEQ ID NO: 422197 - DNA, 140 bp, Artificial Sequence
  Synthetic
aggccctggctgctgatatgggaaaaccgattcattgagattggagtaacacggagagaggttcatatatactacctagagaaagccaacaagataaaatctgaaaagacacacattcacgaccttttgggacagcggtg

SEQ ID NO: 422198 - DNA, 140 bp, Artificial Sequence
  Synthetic
caccgctgtcccaaaaggtcgtgaatgtgtgtcttttcagattttatcttgttggctttctctaggtagtatatatgaacctctctccgtgttactccaatctcaatgaatcggttttcccatatcagcagccagggcct

SEQ ID NO: 422199 - DNA, 140 bp, Artificial Sequence
  Synthetic
aggccctggctgctgatatgtgttcacgctcaccgtgcccagtgagcgaggactgcagcgtagacgctttgtccaaaatgccctcaatgggaatggagacccaaataacatggacaaagcgaccttttgggacagcggtg

SEQ ID NO: 422200 - DNA, 140 bp, Artificial Sequence
  Synthetic
caccgctgtcccaaaaggtcgctttgtccatgttatttgggtctccattcccattgagggcattttggacaaagcgtctacgctgcagtcctcgctcactgggcacggtgagcgtgaacacatatcagcagccagggcct

SEQ ID NO: 422201 - DNA, 140 bp, Artificial Sequence
  Synthetic
aggccctggctgctgatatggatgggaaatgggtgagagaactgatcctgtatgacaaagaggagataaggaggatctggcgtcaggcgaataatggggaagacgcaactgctggcctcagaccttttgggacagcggtg

SEQ ID NO: 422202 - DNA, 140 bp, Artificial Sequence
  Synthetic
caccgctgtcccaaaaggtctgaggccagcagttgcgtcttccccattattcgcctgacgccagatcctccttatctcctctttgtcatacaggatcagttctctcacccatttcccatccatatcagcagccagggcct

SEQ ID NO: 422203 - DNA, 140 bp, Artificial Sequence
  Synthetic
aggccctggctgctgatatgtgggtaccaccatagtaatgagcagggaagtggatacgctgcagacaaagaatccactcaaaaagcattagatggaatcaccaacaagatcaactcaatcgaccttttgggacagcggtg

SEQ ID NO: 422204 - DNA, 140 bp, Artificial Sequence
  Synthetic
caccgctgtcccaaaaggtcgattgagttgatcttgttggtgattccatctaatgctttttgagtggattctttgtctgcagcgtatccacttccctgctcattactatggtggtacccacatatcagcagccagggcct

SEQ ID NO: 422205 - DNA, 140 bp, Artificial Sequence
  Synthetic
  misc_feature (29)..(29): n is a, c, g, or t
  misc_feature (34)..(34): n is a, c, g, or t
  misc_feature (84)..(84): n is a, c, g, or t
  misc_feature (108)..(108): n is a, c, g, or t
atacgccatgctgggtctcctttcctttnccatntcatgctttttgctttgtgttgttctgctggggttcattatgtgggcctnccaaaaaggcaacattaggtgcancatttgcatttgcgtacttgggagtcggccat

SEQ ID NO: 422206 - DNA, 140 bp, Artificial Sequence
  Synthetic
  misc_feature (33)..(33): n is a, c, g, or t
  misc_feature (57)..(57): n is a, c, g, or t
  misc_feature (107)..(107): n is a, c, g, or t
  misc_feature (112)..(112): n is a, c, g, or t
atggccgactcccaagtacgcaaatgcaaatgntgcacctaatgttgcctttttggnaggcccacataatgaaccccagcagaacaacacaaagcaaaaagcatganatggnaaaggaaaggagacccagcatggcgtat

SEQ ID NO: 422207 - DNA, 140 bp, Artificial Sequence
  Synthetic
atacgccatgctgggtctccacaaaaacataatggattccaacactgtgtcaagctttcaggtagactgctttctttggcatgtccgcaaacgatttgcagaccaagaactgggtgatgccgtacttgggagtcggccat

SEQ ID NO: 422208 - DNA, 140 bp, Artificial Sequence
  Synthetic
atggccgactcccaagtacggcatcacccagttcttggtctgcaaatcgtttgcggacatgccaaagaaagcagtctacctgaaagcttgacacagtgttggaatccattatgtttttgtggagacccagcatggcgtat

SEQ ID NO: 422209 - DNA, 140 bp, Artificial Sequence
  Synthetic
atacgccatgctgggtctccgtgattgagaatgaatcctaatcaaaaattattcgcactctctggagtggccatagcactgagcatcctcaacctactaataggaatatccaatgtgggacgtacttgggagtcggccat

SEQ ID NO: 422210 - DNA, 140 bp, Artificial Sequence
  Synthetic
atggccgactcccaagtacgtcccacattggatattcctattagtaggttgaggatgctcagtgctatggccactccagagagtgcgaataatttttgattaggattcattctcaatcacggagacccagcatggcgtat

SEQ ID NO: 422211 - DNA, 140 bp, Artificial Sequence
  Synthetic
atacgccatgctgggtctccaaggaagtgagtgcccaaattgaaccattcttgaaaacaacaccacgcccactcagattgcctgaagggcctccttgctttcagcggtcaaagttcttgccgtacttgggagtcggccat

SEQ ID NO: 422212 - DNA, 140 bp, Artificial Sequence
  Synthetic
atggccgactcccaagtacggcaagaactttgaccgctgaaagcaaggaggcccttcaggcaatctgagtgggcgtggtgttgttttcaagaatggttcaatttgggcactcacttccttggagacccagcatggcgtat

SEQ ID NO: 422213 - DNA, 140 bp, Artificial Sequence
  Synthetic
atacgccatgctgggtctcctactagccggcaattcctcactttgcccagtaagtggatgggctatatacagcaaagacaatagcataaggattggttctaaaggggacatttttgtcatcgtacttgggagtcggccat

SEQ ID NO: 422214 - DNA, 140 bp, Artificial Sequence
  Synthetic
atggccgactcccaagtacgatgacaaaaatgtcccctttagaaccaatccttatgctattgtctttgctgtatatagcccatccacttactgggcaaagtgaggaattgccggctagtaggagacccagcatggcgtat

SEQ ID NO: 422215 - DNA, 140 bp, Artificial Sequence
  Synthetic
atacgccatgctgggtctccgaaggggaggggataccgctatatgatgcgatcaaatgtatgaaaacgttcttcgggtggaaagagccaaacattatcaaaccacatgagaaaggcataacgtacttgggagtcggccat

SEQ ID NO: 422216 - DNA, 140 bp, Artificial Sequence
  Synthetic
atggccgactcccaagtacgttatgcctttctcatgtggtttgataatgtttggctctttccacccgaagaacgttttcatacatttgatcgcatcatatagcggtatcccctccccttcggagacccagcatggcgtat

SEQ ID NO: 422217 - DNA, 140 bp, Artificial Sequence
  Synthetic
atacgccatgctgggtctccgacagtgaaaaatggtttgtacccaaacctgagcaagtcctatgaaaacgacaaagggaaagaagtccttattttatggggtgttcatcatccgtctaaccgtacttgggagtcggccat

SEQ ID NO: 422218 - DNA, 140 bp, Artificial Sequence
  Synthetic
atggccgactcccaagtacggttagacggatgatgaacaccccataaaataaggacttctttccctttgtcgttttcataggacttgctcaggtttgggtacaaaccatttttcactgtcggagacccagcatggcgtat

SEQ ID NO: 422219 - DNA, 140 bp, Artificial Sequence
  Synthetic
atacgccatgctgggtctccgctgatggatgctctgaaactaagtattgaggacccgagtcatgagggggaggggataccgctgtatgatgcaatcaaatgcatgaagacattttttggccgtacttgggagtcggccat

SEQ ID NO: 422220 - DNA, 140 bp, Artificial Sequence
  Synthetic
atggccgactcccaagtacggccaaaaaatgtcttcatgcatttgattgcatcatacagcggtatcccctccccctcatgactcgggtcctcaatacttagtttcagagcatccatcagcggagacccagcatggcgtat

SEQ ID NO: 422221 - DNA, 140 bp, Artificial Sequence
  Synthetic
atacgccatgctgggtctcctgtaaaaagtactaaactgagaatggctacaggattaagaaatatcccgtctattcaatctagaggcctgtttggggccattgctggctttatcgaagggcgtacttgggagtcggccat

SEQ ID NO: 422222 - DNA, 140 bp, Artificial Sequence
  Synthetic
atggccgactcccaagtacgcccttcgataaagccagcaatggccccaaacaggcctctagattgaatagacgggatatttcttaatcctgtagccattctcagtttagtactttttacaggagacccagcatggcgtat

SEQ ID NO: 422223 - DNA, 140 bp, Artificial Sequence
  Synthetic
aggccctggctgctgatatgaagtgggcactcggtgaaaatatggcgccagagaaagtagactttgatgattgcaaagatgttagtgatctcaaacagtatgacagcgatgagccagaacgaccttttgggacagcggtg

SEQ ID NO: 422224 - DNA, 140 bp, Artificial Sequence
  Synthetic
caccgctgtcccaaaaggtcgttctggctcatcgctgtcatactgtttgagatcactaacatctttgcaatcatcaaagtctactttctctggcgccatattttcaccgagtgcccacttcatatcagcagccagggcct

SEQ ID NO: 422225 - DNA, 140 bp, Artificial Sequence
  Synthetic
aggccctggctgctgatatgcataagcaccacattcccgtatactggagatcctccatacagccatggaacaggaacaggatacaccatggacacggttaacagaacacatcaatattcagaccttttgggacagcggtg

SEQ ID NO: 422226 - DNA, 140 bp, Artificial Sequence
  Synthetic
caccgctgtcccaaaaggtctgaatattgatgtgttctgttaaccgtgtccatggtgtatcctgttcctgttccatggctgtatggaggatctccagtatacgggaatgtggtgcttatgcatatcagcagccagggcct

SEQ ID NO: 422227 - DNA, 140 bp, Artificial Sequence
  Synthetic
aggccctggctgctgatatgcaggaacaggatacaccatggacacggttaacagaacacatcaatattcagaaaaggggaaatggacaacaaactcagagactggagcaccccaacttaagaccttttgggacagcggtg

SEQ ID NO: 422228 - DNA, 140 bp, Artificial Sequence
  Synthetic
caccgctgtcccaaaaggtcttaagttggggtgctccagtctctgagtttgttgtccatttccccttttctgaatattgatgtgttctgttaaccgtgtccatggtgtatcctgttcctgcatatcagcagccagggcct

SEQ ID NO: 422229 - DNA, 140 bp, Artificial Sequence
  Synthetic
aggccctggctgctgatatggaaaaggggaaatggacaacaaactcagagactggagcaccccaacttaacccaattgatggaccactgcctgaggacaatgagccaagtggatatgcacgaccttttgggacagcggtg

SEQ ID NO: 422230 - DNA, 140 bp, Artificial Sequence
  Synthetic
caccgctgtcccaaaaggtcgtgcatatccacttggctcattgtcctcaggcagtggtccatcaattgggttaagttggggtgctccagtctctgagtttgttgtccatttccccttttccatatcagcagccagggcct

SEQ ID NO: 422231 - DNA, 140 bp, Artificial Sequence
  Synthetic
aggccctggctgctgatatgacaggaatcagccggctgcaactgcattagctaatactatagaggtcttcagatcgaacggtctgacagctaatgaatcaggaaggctaatagattttctgaccttttgggacagcggtg

SEQ ID NO: 422232 - DNA, 140 bp, Artificial Sequence
  Synthetic
caccgctgtcccaaaaggtcagaaaatctattagccttcctgattcattagctgtcagaccgttcgatctgaagacctctatagtattagctaatgcagttgcagccggctgattcctgtcatatcagcagccagggcct

SEQ ID NO: 422233 - DNA, 140 bp, Artificial Sequence
  Synthetic
aggccctggctgctgatatgagaactgcgataggccaagtgtcgaggcccatgtttctatatgtaagaaccaatgggacctccaagatcaaaatgaaatggggaatggaaatgagacgctgaccttttgggacagcggtg

SEQ ID NO: 422234 - DNA, 140 bp, Artificial Sequence
  Synthetic
caccgctgtcccaaaaggtcagcgtctcatttccattccccatttcattttgatcttggaggtcccattggttcttacatatagaaacatgggcctcgacacttggcctatcgcagttctcatatcagcagccagggcct

SEQ ID NO: 422235 - DNA, 140 bp, Artificial Sequence
  Synthetic
aggccctggctgctgatatgagttctaccacaaatgtgataatgaatgtatggaaagtgtaaaaaatgggacgtatgactacccgcaatattcagaggaagcaagactaaacagagaggagaccttttgggacagcggtg

SEQ ID NO: 422236 - DNA, 140 bp, Artificial Sequence
  Synthetic
caccgctgtcccaaaaggtctcctctctgtttagtcttgcttcctctgaatattgcgggtagtcatacgtcccattttttacactttccatacattcattatcacatttgtggtagaactcatatcagcagccagggcct

SEQ ID NO: 422237 - DNA, 140 bp, Artificial Sequence
  Synthetic
atacgccatgctgggtctccagtttcataagagggaaaaaagtgattccaagagggaagctgtccacaagaggagttcagattgcttcaaatgaaaatgtggaagccatggattccaacacgtacttgggagtcggccat

SEQ ID NO: 422238 - DNA, 140 bp, Artificial Sequence
  Synthetic
atggccgactcccaagtacgtgttggaatccatggcttccacattttcatttgaagcaatctgaactcctcttgtggacagcttccctcttggaatcacttttttccctcttatgaaactggagacccagcatggcgtat

SEQ ID NO: 422239 - DNA, 140 bp, Artificial Sequence
  Synthetic
atacgccatgctgggtctcccaacaagaaagaaaatagagaagataaggcctcttctaatagatggtacagcctcattgagccctggaatgatgatgggcatgttcaacatgctaagtaccgtacttgggagtcggccat

SEQ ID NO: 422240 - DNA, 140 bp, Artificial Sequence
  Synthetic
atggccgactcccaagtacggtacttagcatgttgaacatgcccatcatcattccagggctcaatgaggctgtaccatctattagaagaggccttatcttctctattttctttcttgttgggagacccagcatggcgtat

SEQ ID NO: 422241 - DNA, 140 bp, Artificial Sequence
  Synthetic
atacgccatgctgggtctcccgttcaaataataaaacttctcccttttgctgctgctccaccagagcagagtaggatgcaattttcttcactgactgtgaatgtgagaggatcaggaatgcgtacttgggagtcggccat

SEQ ID NO: 422242 - DNA, 140 bp, Artificial Sequence
  Synthetic
atggccgactcccaagtacgcattcctgatcctctcacattcacagtcagtgaagaaaattgcatcctactctgctctggtggagcagcagcaaaagggagaagttttattatttgaacgggagacccagcatggcgtat

SEQ ID NO: 422243 - DNA, 140 bp, Artificial Sequence
  Synthetic
aggccctggctgctgatatggctgctcccatttgcagcagccccaccggagcaaagcagaatgcagttttattctctaactgtgaacgtgagaggttcaggaatgagaataatcgtgagggaccttttgggacagcggtg

SEQ ID NO: 422244 - DNA, 140 bp, Artificial Sequence
  Synthetic
caccgctgtcccaaaaggtccctcacgattattctcattcctgaacctctcacgttcacagttagagaataaaactgcattctgctttgctccggtggggctgctgcaaatgggagcagccatatcagcagccagggcct

SEQ ID NO: 422245 - DNA, 140 bp, Artificial Sequence
  Synthetic
atacgccatgctgggtctccttcatcaaggattacagatacacgtatcggtgtcacagaggagacacacaaattcagacaaggaggtcattcgagctgaagaaattgtgggaacaaaccccgtacttgggagtcggccat

SEQ ID NO: 422246 - DNA, 140 bp, Artificial Sequence
  Synthetic
atggccgactcccaagtacggggtttgttcccacaatttcttcagctcgaatgacctccttgtctgaatttgtgtgtctcctctgtgacaccgatacgtgtatctgtaatccttgatgaaggagacccagcatggcgtat

SEQ ID NO: 422247 - DNA, 140 bp, Artificial Sequence
  Synthetic
aggccctggctgctgatatgcccgagtcatgagggagaagggataccactatacgatgcaatcaaatgcatgaagacatttttcgggtggaaagagcccagcatcgtgaaaccacatgaggaccttttgggacagcggtg

SEQ ID NO: 422248 - DNA, 140 bp, Artificial Sequence
  Synthetic
caccgctgtcccaaaaggtcctcatgtggtttcacgatgctgggctctttccacccgaaaaatgtcttcatgcatttgattgcatcgtatagtggtatcccttctccctcatgactcgggcatatcagcagccagggcct

SEQ ID NO: 422249 - DNA, 140 bp, Artificial Sequence
  Synthetic
atacgccatgctgggtctccgcaagttgaaaaggagggcaatcgcaacacccgggatgcaaatcagaggattcgtgtattttgtagaagcactagcgaggagcatctgtgagaaacttgacgtacttgggagtcggccat

SEQ ID NO: 422250 - DNA, 140 bp, Artificial Sequence
  Synthetic
atggccgactcccaagtacgtcaagtttctcacagatgctcctcgctagtgcttctacaaaatacacgaatcctctgatttgcatcccgggtgttgcgattgccctccttttcaacttgcggagacccagcatggcgtat

SEQ ID NO: 422251 - DNA, 140 bp, Artificial Sequence
  Synthetic
atacgccatgctgggtctccagaaatgatgatgttgaccaaagtttgattatcgccgctagaaacatagtaagaagagcagcagtgtcagcagacccattagcatctctcttggaaatgtcgtacttgggagtcggccat

SEQ ID NO: 422252 - DNA, 140 bp, Artificial Sequence
  Synthetic
atggccgactcccaagtacgacatttccaagagagatgctaatgggtctgctgacactgctgctcttcttactatgtttctagcggcgataatcaaactttggtcaacatcatcatttctggagacccagcatggcgtat

SEQ ID NO: 422253 - DNA, 140 bp, Artificial Sequence
  Synthetic
aggccctggctgctgatatgaagatgaacagatgtatcaaaagtgctgcaatctattcgagaaattcttccctagcagctcatacaggagaccggttggaatttccagcatggtggaggcgaccttttgggacagcggtg

SEQ ID NO: 422254 - DNA, 140 bp, Artificial Sequence
  Synthetic
caccgctgtcccaaaaggtcgcctccaccatgctggaaattccaaccggtctcctgtatgagctgctagggaagaatttctcgaatagattgcagcacttttgatacatctgttcatcttcatatcagcagccagggcct

SEQ ID NO: 422255 - DNA, 140 bp, Artificial Sequence
  Synthetic
aggccctggctgctgatatggcagaccaccgaatttactggatacgagaagggaagataataaagtatgaaaacattcccaaaacaaagatacaacatttagaggagtgttcttgctatggaccttttgggacagcggtg

SEQ ID NO: 422256 - DNA, 140 bp, Artificial Sequence
  Synthetic
caccgctgtcccaaaaggtccatagcaagaacactcctctaaatgttgtatctttgttttgggaatgttttcatactttattatcttcccttctcgtatccagtaaattcggtggtctgccatatcagcagccagggcct

SEQ ID NO: 422257 - DNA, 140 bp, Artificial Sequence
  Synthetic
atacgccatgctgggtctcccagtccgaggcgacctgaatttcgtaaacagagcaaaccaaagattaaaccccatgcatcaactcttgagacacttccaaaaagatgcaaaggtgctgttcgtacttgggagtcggccat

SEQ ID NO: 422258 - DNA, 140 bp, Artificial Sequence
  Synthetic
atggccgactcccaagtacgaacagcacctttgcatctttttggaagtgtctcaagagttgatgcatggggtttaatctttggtttgctctgtttacgaaattcaggtcgcctcggactgggagacccagcatggcgtat

SEQ ID NO: 422259 - DNA, 140 bp, Artificial Sequence
  Synthetic
atacgccatgctgggtctccattccctcaatcatgctaaatcagttacacaaacactagtatcgaacagtgattggtcaggttactcagggagtttcattgttgagaacaatggctgtttcgtacttgggagtcggccat

SEQ ID NO: 422260 - DNA, 140 bp, Artificial Sequence
  Synthetic
atggccgactcccaagtacgaaacagccattgttctcaacaatgaaactccctgagtaacctgaccaatcactgttcgatactagtgtttgtgtaactgatttagcatgattgagggaatggagacccagcatggcgtat

SEQ ID NO: 422261 - DNA, 140 bp, Artificial Sequence
  Synthetic
aggccctggctgctgatatggcatttgggtaaatgcaacattgctggctggcttctgggaaatccagagtgtgaatcactctccacagcaagctcatggtcctacattgtggaaacatctgaccttttgggacagcggtg

SEQ ID NO: 422262 - DNA, 140 bp, Artificial Sequence
  Synthetic
caccgctgtcccaaaaggtcagatgtttccacaatgtaggaccatgagcttgctgtggagagtgattcacactctggatttcccagaagccagccagcaatgttgcatttacccaaatgccatatcagcagccagggcct

SEQ ID NO: 422263 - DNA, 140 bp, Artificial Sequence
  Synthetic
aggccctggctgctgatatgcccctgtagtcagcaatagtgactttctttgtgtaggatggtcaagcaccagttgccatgacggcatcgggcggatgaccatttgtgtgcagggaaataagaccttttgggacagcggtg

SEQ ID NO: 422264 - DNA, 140 bp, Artificial Sequence
  Synthetic
caccgctgtcccaaaaggtcttatttccctgcacacaaatggtcatccgcccgatgccgtcatggcaactggtgcttgaccatcctacacaaagaaagtcactattgctgactacaggggcatatcagcagccagggcct

SEQ ID NO: 422265 - DNA, 140 bp, Artificial Sequence
  Synthetic
aggccctggctgctgatatgtaaccattgcaacagtatgtttcctcatgcagattgccatcctagcaacgactgtgacactgcatttcaagcaaaatgaatgcagcatccccacgaacaagaccttttgggacagcggtg

SEQ ID NO: 422266 - DNA, 140 bp, Artificial Sequence
  Synthetic
caccgctgtcccaaaaggtcttgttcgtggggatgctgcattcattttgcttgaaatgcagtgtcacagtcgttgctaggatggcaatctgcatgaggaaacatactgttgcaatggttacatatcagcagccagggcct

SEQ ID NO: 422267 - DNA, 140 bp, Artificial Sequence
  Synthetic
atacgccatgctgggtctccactgtgacactgcatttcaagcaaaatgaatgcagcatccccacgaacaaccaagtagtgccatgtgaaccaattataatagagaggaacacaacagaggcgtacttgggagtcggccat

SEQ ID NO: 422268 - DNA, 140 bp, Artificial Sequence
  Synthetic
atggccgactcccaagtacgcctctgttgtgttcctctctattataattggttcacatggcactacttggttgttcgtggggatgctgcattcattttgcttgaaatgcagtgtcacagtggagacccagcatggcgtat

SEQ ID NO: 422269 - DNA, 140 bp, Artificial Sequence
  Synthetic
aggccctggctgctgatatgatggaaagaataaaagaattaagagatctaatgtcacagtcccacactcgcgagatactgacaaaaaccacagtggaccatatggcaataatcaaaaaatgaccttttgggacagcggtg

SEQ ID NO: 422270 - DNA, 140 bp, Artificial Sequence
  Synthetic
caccgctgtcccaaaaggtcattttttgattattgccatatggtccactgtggtttttgtcagtatctcgcgagtgtgggactgtgacattagatctcttaattcttttattctttccatcatatcagcagccagggcct

SEQ ID NO: 422271 - DNA, 140 bp, Artificial Sequence
  Synthetic
aggccctggctgctgatatggagatcctccatacagccatggaacaggaacaggatacaccatggacacagtaaacagaacacaccaatactcagaaaagggaaagtggacaacaaacacgaccttttgggacagcggtg

SEQ ID NO: 422272 - DNA, 140 bp, Artificial Sequence
  Synthetic
caccgctgtcccaaaaggtcgtgtttgttgtccactttcccttttctgagtattggtgtgttctgtttactgtgtccatggtgtatcctgttcctgttccatggctgtatggaggatctccatatcagcagccagggcct

SEQ ID NO: 422273 - DNA, 140 bp, Artificial Sequence
  Synthetic
aggccctggctgctgatatgtataaaatactatcgatttatagctgcattgcaagcagtactgtactggtgggtctcatacttgcatttataatgtgggcatgcagcagtggtaattgccgaccttttgggacagcggtg

SEQ ID NO: 422274 - DNA, 140 bp, Artificial Sequence
  Synthetic
caccgctgtcccaaaaggtcggcaattaccactgctgcatgcccacattataaatgcaagtatgagacccaccagtacagtactgcttgcaatgcagctataaatcgatagtattttatacatatcagcagccagggcct

SEQ ID NO: 422275 - DNA, 140 bp, Artificial Sequence
  Synthetic
atacgccatgctgggtctcctgtgcttgggacatcatgcagtaccaaacggaacaatagtgaaaacaataacggatgatcaaattgaagtaactaatgcgactgagctggttcagagttccgtacttgggagtcggccat

SEQ ID NO: 422276 - DNA, 140 bp, Artificial Sequence
  Synthetic
atggccgactcccaagtacggaactctgaaccagctcagtcgcattagttacttcaatttgatcatccgttattgttttcactattgttccgtttggtactgcatgatgtcccaagcacaggagacccagcatggcgtat

SEQ ID NO: 422277 - DNA, 140 bp, Artificial Sequence
  Synthetic
aggccctggctgctgatatgaagaggaaatagagataacaacccactttcaaagaaaaaggagagtaagagacaacatgaccaagaagatggtcacgcaaagaacaatagggaagaaaaagaccttttgggacagcggtg

SEQ ID NO: 422278 - DNA, 140 bp, Artificial Sequence
  Synthetic
caccgctgtcccaaaaggtctttttcttccctattgttctttgcgtgaccatcttcttggtcatgttgtctcttactctcctttttctttgaaagtgggttgttatctctatttcctcttcatatcagcagccagggcct

SEQ ID NO: 422279 - DNA, 140 bp, Artificial Sequence
  Synthetic
atacgccatgctgggtctccaggcaattccccagtgttcaattacaacaaggccaccaagaggctcacagttctcgggaaagatgcaggtgcattgattgaagacccagatgaaggcacacgtacttgggagtcggccat

SEQ ID NO: 422280 - DNA, 140 bp, Artificial Sequence
  Synthetic
atggccgactcccaagtacgtgtgccttcatctgggtcttcaatcaatgcacctgcatctttcccgagaactgtgagcctcttggtggccttgttgtaattgaacactggggaattgcctggagacccagcatggcgtat

SEQ ID NO: 422281 - DNA, 140 bp, Artificial Sequence
  Synthetic
aggccctggctgctgatatgatggactccaatactgtgtcaagctttcaggtagactgtttcctttggcacatccgcaaacggtttgcagacaatggattgggtgatgccccattccttggaccttttgggacagcggtg

SEQ ID NO: 422282 - DNA, 140 bp, Artificial Sequence
  Synthetic
caccgctgtcccaaaaggtccaaggaatggggcatcacccaatccattgtctgcaaaccgtttgcggatgtgccaaaggaaacagtctacctgaaagcttgacacagtattggagtccatcatatcagcagccagggcct

SEQ ID NO: 422283 - DNA, 140 bp, Artificial Sequence
  Synthetic
atacgccatgctgggtctccatcggctccgccgagatcaaaagtccctaaaaggaagaggcaacacccttagcctcgacatcgaaacagccactcttgttgggaaacaaattgttgagtgcgtacttgggagtcggccat

SEQ ID NO: 422284 - DNA, 140 bp, Artificial Sequence
  Synthetic
atggccgactcccaagtacgcactcaacaatttgtttcccaacaagagtggctgtttcgatgtcgaggctaagggtgttgcctcttccttttagggacttttgatctcggcggagccgatggagacccagcatggcgtat

SEQ ID NO: 422285 - DNA, 140 bp, Artificial Sequence
  Synthetic
atacgccatgctgggtctcctcgaagacaccaaaatagacctatggtcttacaatgcagaacttcttgtggcactggaaaaccagcatacaattgatctgactgattcagaaatgaacaacgtacttgggagtcggccat

SEQ ID NO: 422286 - DNA, 140 bp, Artificial Sequence
  Synthetic
atggccgactcccaagtacgttgttcatttctgaatcagtcagatcaattgtatgctggttttccagtgccacaagaagttctgcattgtaagaccataggtctattttggtgtcttcgaggagacccagcatggcgtat

SEQ ID NO: 422287 - DNA, 140 bp, Artificial Sequence
  Synthetic
atacgccatgctgggtctccagcgaaagcaggagtttaaaatgaatccaaatcagaaaataataaccattggctcagtgtccttaggattggtagtccttaatattctcctacatatagtcgtacttgggagtcggccat

SEQ ID NO: 422288 - DNA, 140 bp, Artificial Sequence
  Synthetic
atggccgactcccaagtacgactatatgtaggagaatattaaggactaccaatcctaaggacactgagccaatggttattattttctgatttggattcattttaaactcctgctttcgctggagacccagcatggcgtat

SEQ ID NO: 422289 - DNA, 140 bp, Artificial Sequence
  Synthetic
atacgccatgctgggtctcctcagtgtgattttcaatcgactggaagccctaatactacttagagcttttacggatgaaggagcaatagtgggcgaaatctcaccattaccttctcttcccgtacttgggagtcggccat

SEQ ID NO: 422290 - DNA, 140 bp, Artificial Sequence
  Synthetic
atggccgactcccaagtacgggaagagaaggtaatggtgagatttcgcccactattgctccttcatccgtaaaagctctaagtagtattagggcttccagtcgattgaaaatcacactgaggagacccagcatggcgtat

SEQ ID NO: 422291 - DNA, 140 bp, Artificial Sequence
  Synthetic
aggccctggctgctgatatgccaaacctaattccaaattacagacaaataggcaagtcatagttgaaagaggtgacaggtccggttattctggtattttctccgttgaaggcaaaagctggaccttttgggacagcggtg

SEQ ID NO: 422292 - DNA, 140 bp, Artificial Sequence
  Synthetic
caccgctgtcccaaaaggtccagcttttgccttcaacggagaaaataccagaataaccggacctgtcacctctttcaactatgacttgcctatttgtctgtaatttggaattaggtttggcatatcagcagccagggcct

SEQ ID NO: 422293 - DNA, 140 bp, Artificial Sequence
  Synthetic
atacgccatgctgggtctccttcgcttggagaaaccgtaatgaggatgggagaccttcactacctccagaacagaaatgaaaagtggcgagagcaattgggacagaaatttgaggaaatacgtacttgggagtcggccat

SEQ ID NO: 422294 - DNA, 140 bp, Artificial Sequence
  Synthetic
atggccgactcccaagtacgtatttcctcaaatttctgtcccaattgctctcgccacttttcatttctgttctggaggtagtgaaggtctcccatcctcattacggtttctccaagcgaaggagacccagcatggcgtat

SEQ ID NO: 422295 - DNA, 140 bp, Artificial Sequence
  Synthetic
atacgccatgctgggtctccggtttgcacccttttccaaagacaatggaataagaattggatcgagaggtcatgtttttgttataagggaaccatttgtttcttgctctccaacagagtgcgtacttgggagtcggccat

SEQ ID NO: 422296 - DNA, 140 bp, Artificial Sequence
  Synthetic
atggccgactcccaagtacgcactctgttggagagcaagaaacaaatggttcccttataacaaaaacatgacctctcgatccaattcttattccattgtctttggaaaagggtgcaaaccggagacccagcatggcgtat

SEQ ID NO: 422297 - DNA, 140 bp, Artificial Sequence
  Synthetic
atacgccatgctgggtctcccaggacgttcttccttacccagggttccttactcaatgacaaacactccaatggcacagtgaaagaccggagcccctatagaaccctaatgagtgtagaacgtacttgggagtcggccat

SEQ ID NO: 422298 - DNA, 140 bp, Artificial Sequence
  Synthetic
atggccgactcccaagtacgttctacactcattagggttctataggggctccggtctttcactgtgccattggagtgtttgtcattgagtaaggaaccctgggtaaggaagaacgtcctgggagacccagcatggcgtat

SEQ ID NO: 422299 - DNA, 140 bp, Artificial Sequence
  Synthetic
atacgccatgctgggtctccatagggcaatcacccaatgtgtaccaggcaaggtttgaggcagtagcgtggtcagccactgcatgccatgatgggaagaaatggatgacaattggagtaacgtacttgggagtcggccat

SEQ ID NO: 422300 - DNA, 140 bp, Artificial Sequence
  Synthetic
atggccgactcccaagtacgttactccaattgtcatccatttcttcccatcatggcatgcagtggctgaccacgctactgcctcaaaccttgcctggtacacattgggtgattgccctatggagacccagcatggcgtat

SEQ ID NO: 422301 - DNA, 140 bp, Artificial Sequence
  Synthetic
aggccctggctgctgatatgagtttgctgcaatatgcacacatttggaagtttgtttcatgtattcggatttccatttcatcgacgaacggggtgaatcaataattgtagaatctggtgagaccttttgggacagcggtg

SEQ ID NO: 422302 - DNA, 140 bp, Artificial Sequence
  Synthetic
caccgctgtcccaaaaggtctcaccagattctacaattattgattcaccccgttcgtcgatgaaatggaaatccgaatacatgaaacaaacttccaaatgtgtgcatattgcagcaaactcatatcagcagccagggcct

SEQ ID NO: 422303 - DNA, 140 bp, Artificial Sequence
  Synthetic
atacgccatgctgggtctccaaaggactcgcgcgcaggttatgaaactttcagggttgttgatggttggaccttggctaattccaagtcacagacaaataggcaagtcatagttgacagtcgtacttgggagtcggccat

SEQ ID NO: 422304 - DNA, 140 bp, Artificial Sequence
  Synthetic
atggccgactcccaagtacgactgtcaactatgacttgcctatttgtctgtgacttggaattagccaaggtccaaccatcaacaaccctgaaagtttcataacctgcgcgcgagtcctttggagacccagcatggcgtat

SEQ ID NO: 422305 - DNA, 140 bp, Artificial Sequence
  Synthetic
atacgccatgctgggtctccaaatggctgggtacaaaacagtaaagagcagatcaaaaggcaagttgtggtcgataacttgaattggtcaggatacagtggttctttcacactaccggtgcgtacttgggagtcggccat

SEQ ID NO: 422306 - DNA, 140 bp, Artificial Sequence
  Synthetic
atggccgactcccaagtacgcaccggtagtgtgaaagaaccactgtatcctgaccaattcaagttatcgaccacaacttgccttttgatctgctctttactgttttgtacccagccatttggagacccagcatggcgtat

SEQ ID NO: 422307 - DNA, 140 bp, Artificial Sequence
  Synthetic
atacgccatgctgggtctccatgagtcttctaaccgaggtcgaaacgtatgttctctctatcatcccgtcaggccccctcaaagccgagatagcacagagacttgaagacgtttttgcagcgtacttgggagtcggccat

SEQ ID NO: 422308 - DNA, 140 bp, Artificial Sequence
  Synthetic
atggccgactcccaagtacgctgcaaaaacgtcttcaagtctctgtgctatctcggctttgagggggcctgacgggatgatagagagaacatacgtttcgacctcggttagaagactcatggagacccagcatggcgtat

SEQ ID NO: 422309 - DNA, 140 bp, Artificial Sequence
  Synthetic
aggccctggctgctgatatgttccgtttcatttgggaaccaaacaagtatgcatagcatggtccagctcaagttgccatgatggaaaagcatggctacacgtttgtgtcactggggatgagaccttttgggacagcggtg

SEQ ID NO: 422310 - DNA, 140 bp, Artificial Sequence
  Synthetic
caccgctgtcccaaaaggtctcatccccagtgacacaaacgtgtagccatgcttttccatcatggcaacttgagctggaccatgctatgcatacttgtttggttcccaaatgaaacggaacatatcagcagccagggcct

SEQ ID NO: 422311 - DNA, 140 bp, Artificial Sequence
  Synthetic
atacgccatgctgggtctccaggaaactaaaacgagaaataacattccatggagccaaggaagtagcgctcagttactctgctggtgcacttgccagttgcatgggcctaatatacaacacgtacttgggagtcggccat

SEQ ID NO: 422312 - DNA, 140 bp, Artificial Sequence
  Synthetic
atggccgactcccaagtacgtgttgtatattaggcccatgcaactggcaagtgcaccagcagagtaactgagcgctacttccttggctccatggaatgttatttctcgttttagtttcctggagacccagcatggcgtat

SEQ ID NO: 422313 - DNA, 140 bp, Artificial Sequence
  Synthetic
aggccctggctgctgatatgcagttactctgctggtgcacttgccagttgcatgggcctaatatacaacagaatggggactgtcgccactgaggtggcatttggtctggtatgcgcaaccgaccttttgggacagcggtg

SEQ ID NO: 422314 - DNA, 140 bp, Artificial Sequence
  Synthetic
caccgctgtcccaaaaggtcggttgcgcataccagaccaaatgccacctcagtggcgacagtccccattctgttgtatattaggcccatgcaactggcaagtgcaccagcagagtaactgcatatcagcagccagggcct

SEQ ID NO: 422315 - DNA, 140 bp, Artificial Sequence
  Synthetic
atacgccatgctgggtctccaacaaccaatccactaatcaagcacgagaacagaatggtaatagccagcacaacagctaaggccatggaacaaatggctgggtcaagtgaacaagcagcacgtacttgggagtcggccat

SEQ ID NO: 422316 - DNA, 140 bp, Artificial Sequence
  Synthetic
atggccgactcccaagtacgtgctgcttgttcacttgacccagccatttgttccatggccttagctgttgtgctggctattaccattctgttctcgtgcttgattagtggattggttgttggagacccagcatggcgtat

SEQ ID NO: 422317 - DNA, 140 bp, Artificial Sequence
  Synthetic
aggccctggctgctgatatgagatctctagcaagctgggtccaaaatgaattcaataaggcatgtgaattgactgattcaagctggatagaacttgatgaaataggagaagatgttgcccgaccttttgggacagcggtg

SEQ ID NO: 422318 - DNA, 140 bp, Artificial Sequence
  Synthetic
caccgctgtcccaaaaggtcgggcaacatcttctcctatttcatcaagttctatccagcttgaatcagtcaattcacatgccttattgaattcattttggacccagcttgctagagatctcatatcagcagccagggcct

SEQ ID NO: 422319 - DNA, 140 bp, Artificial Sequence
  Synthetic
atacgccatgctgggtctccaacaattgggactcaccctagttccagcactggtctaaaagatgatcttcttgaaaatttacaggcctaccagaaacggatgggagtgcaaatgcaacgacgtacttgggagtcggccat

SEQ ID NO: 422320 - DNA, 140 bp, Artificial Sequence
  Synthetic
atggccgactcccaagtacgtcgttgcatttgcactcccatccgtttctggtaggcctgtaaattttcaagaagatcatcttttagaccagtgctggaactagggtgagtcccaattgttggagacccagcatggcgtat

SEQ ID NO: 422321 - DNA, 140 bp, Artificial Sequence
  Synthetic
aggccctggctgctgatatgttgaaaatttacaggcctaccagaaacggatgggagtgcaaatgcaacgattcaagtgaccctctcactgatgcagcaagcatcattgggattttgcaccgaccttttgggacagcggtg

SEQ ID NO: 422322 - DNA, 140 bp, Artificial Sequence
  Synthetic
caccgctgtcccaaaaggtcggtgcaaaatcccaatgatgcttgctgcatcagtgagagggtcacttgaatcgttgcatttgcactcccatccgtttctggtaggcctgtaaattttcaacatatcagcagccagggcct

SEQ ID NO: 422323 - DNA, 140 bp, Artificial Sequence
  Synthetic
atacgccatgctgggtctccaagtgctcagcacgttgaggaatgctcctgttatccccggtatcctgaagttaggtgtgtttgcagagacaattggaagggctccaataggcccattatacgtacttgggagtcggccat

SEQ ID NO: 422324 - DNA, 140 bp, Artificial Sequence
  Synthetic
atggccgactcccaagtacgtataatgggcctattggagcccttccaattgtctctgcaaacacacctaacttcaggataccggggataacaggagcattcctcaacgtgctgagcacttggagacccagcatggcgtat

SEQ ID NO: 422325 - DNA, 140 bp, Artificial Sequence
  Synthetic
atacgccatgctgggtctccctgaatactgcggttcctataggatcctgcgttagtaagtgccacaccgacaggggctcaatcactaccactaaaccctttcagaacatctcgagaatatcgtacttgggagtcggccat

SEQ ID NO: 422326 - DNA, 140 bp, Artificial Sequence
  Synthetic
atggccgactcccaagtacgatattctcgagatgttctgaaagggtttagtggtagtgattgagcccctgtcggtgtggcacttactaacgcaggatcctataggaaccgcagtattcagggagacccagcatggcgtat

SEQ ID NO: 422327 - DNA, 140 bp, Artificial Sequence
  Synthetic
atacgccatgctgggtctccttcaaatacggtctgcaaagagggccttctacggaaggagtgccggagtccatgagggaagaatatcggcagaaacagcagagtgctgtggatgttgacgcgtacttgggagtcggccat

SEQ ID NO: 422328 - DNA, 140 bp, Artificial Sequence
  Synthetic
atggccgactcccaagtacgcgtcaacatccacagcactctgctgtttctgccgatattcttccctcatggactccggcactccttccgtagaaggccctctttgcagaccgtatttgaaggagacccagcatggcgtat

SEQ ID NO: 422329 - DNA, 140 bp, Artificial Sequence
  Synthetic
aggccctggctgctgatatgggaaggagtgccggagtccatgagggaagaatatcggcagaaacagcagagtgctgtggatgttgacgatggtcattttgtcaacatagtgctagagtaagaccttttgggacagcggtg

SEQ ID NO: 422330 - DNA, 140 bp, Artificial Sequence
  Synthetic
caccgctgtcccaaaaggtcttactctagcactatgttgacaaaatgaccatcgtcaacatccacagcactctgctgtttctgccgatattcttccctcatggactccggcactccttcccatatcagcagccagggcct

SEQ ID NO: 422331 - DNA, 140 bp, Artificial Sequence
  Synthetic
atacgccatgctgggtctccatgaatacaaatcaaagaataataaccattgggactgtttgtttgataattgggatagttagtctattgttacaaataggaaacatggtttcgatatggacgtacttgggagtcggccat

SEQ ID NO: 422332 - DNA, 140 bp, Artificial Sequence
  Synthetic
atggccgactcccaagtacgtccatatcgaaaccatgtttcctatttgtaacaatagactaactatcccaattatcaaacaaacagtcccaatggttattattctttgatttgtattcatggagacccagcatggcgtat

SEQ ID NO: 422333 - DNA, 140 bp, Artificial Sequence
  Synthetic
aggccctggctgctgatatgtgggatagttagtctattgttacaaataggaaacatggtttcgatatggatcagccatccaattcagactggaggggaaaatcacactgagatgtgcaacgaccttttgggacagcggtg

SEQ ID NO: 422334 - DNA, 140 bp, Artificial Sequence
  Synthetic
caccgctgtcccaaaaggtcgttgcacatctcagtgtgattttcccctccagtctgaattggatggctgatccatatcgaaaccatgtttcctatttgtaacaatagactaactatcccacatatcagcagccagggcct

SEQ ID NO: 422335 - DNA, 140 bp, Artificial Sequence
  Synthetic
atacgccatgctgggtctccaaacattagcaacaccaaaacagtcaaagtgcaggacatggcttcagtaatcttaaccggcaattcctctctttgctcaataaatgggtgggctatacaccgtacttgggagtcggccat

SEQ ID NO: 422336 - DNA, 140 bp, Artificial Sequence
  Synthetic
atggccgactcccaagtacggtgtatagcccacccatttattgagcaaagagaggaattgccggttaagattactgaagccatgtcctgcactttgactgttttggtgttgctaatgtttggagacccagcatggcgtat

SEQ ID NO: 422337 - DNA, 140 bp, Artificial Sequence
  Synthetic
aggccctggctgctgatatgtcttaaccggcaattcctctctttgctcaataaatgggtgggctatacacagcaaagacaatagcataaggattggctctaaaggggacatttttgtcatgaccttttgggacagcggtg

SEQ ID NO: 422338 - DNA, 140 bp, Artificial Sequence
  Synthetic
caccgctgtcccaaaaggtcatgacaaaaatgtcccctttagagccaatccttatgctattgtctttgctgtgtatagcccacccatttattgagcaaagagaggaattgccggttaagacatatcagcagccagggcct

SEQ ID NO: 422339 - DNA, 140 bp, Artificial Sequence
  Synthetic
atacgccatgctgggtctccacaagtgatggggctattgttggtgaaatctcaccattaccttctcttccaggacatactaatgaggatgtcaaaaatgcaattggaatcctcatcggggcgtacttgggagtcggccat

SEQ ID NO: 422340 - DNA, 140 bp, Artificial Sequence
  Synthetic
atggccgactcccaagtacgccccgatgaggattccaattgcatttttgacatcctcattagtatgtcctggaagagaaggtaatggtgagatttcaccaacaatagccccatcacttgtggagacccagcatggcgtat

SEQ ID NO: 422341 - DNA, 140 bp, Artificial Sequence
  Synthetic
atacgccatgctgggtctccacggatgatcaaattgaagtgaccaatgccactgaattagtccagagctcctcaacagggaaaatatgcaacaacccacatagaatccttgatgggagggcgtacttgggagtcggccat

SEQ ID NO: 422342 - DNA, 140 bp, Artificial Sequence
  Synthetic
atggccgactcccaagtacgccctcccatcaaggattctatgtgggttgttgcatattttccctgttgaggagctctggactaattcagtggcattggtcacttcaatttgatcatccgtggagacccagcatggcgtat

SEQ ID NO: 422343 - DNA, 140 bp, Artificial Sequence
  Synthetic
atacgccatgctgggtctccagggagttgggacactagtaatggagctgatccgaatgataaagcggggtatcaatgatcggaacttctggagaggcgagaatggtcgaaggacaagaatcgtacttgggagtcggccat

SEQ ID NO: 422344 - DNA, 140 bp, Artificial Sequence
  Synthetic
atggccgactcccaagtacgattcttgtccttcgaccattctcgcctctccagaagttccgatcattgataccccgctttatcattcggatcagctccattactagtgtcccaactccctggagacccagcatggcgtat

SEQ ID NO: 422345 - DNA, 140 bp, Artificial Sequence
  Synthetic
atacgccatgctgggtctcccaagatgaaacctgggacctttatgtggaacgtagcagcgcattcagcaactgctatccctatgacgtaccagactatgcatcgctcaggtctctagttgcgtacttgggagtcggccat

SEQ ID NO: 422346 - DNA, 140 bp, Artificial Sequence
  Synthetic
atggccgactcccaagtacgcaactagagacctgagcgatgcatagtctggtacgtcatagggatagcagttgctgaatgcgctgctacgttccacataaaggtcccaggtttcatcttgggagacccagcatggcgtat

SEQ ID NO: 422347 - DNA, 140 bp, Artificial Sequence
  Synthetic
atacgccatgctgggtctcctgagctggatgcgcccaattaccactatgaggaatgctcctgttatcctgatgcaggtaaggtaatgtgtgtttgcagagacaactggcatgcctcgaaccgtacttgggagtcggccat

SEQ ID NO: 422348 - DNA, 140 bp, Artificial Sequence
  Synthetic
atggccgactcccaagtacggttcgaggcatgccagttgtctctgcaaacacacattaccttacctgcatcaggataacaggagcattcctcatagtggtaattgggcgcatccagctcaggagacccagcatggcgtat

SEQ ID NO: 422349 - DNA, 140 bp, Artificial Sequence
  Synthetic
atacgccatgctgggtctccgtcactcaaaatggaggaagcaatgcctgcaaaagagggcctgctagtggtttcttcagcaggctgaattggttgactaaatctggaaatgcttatccagcgtacttgggagtcggccat

SEQ ID NO: 422350 - DNA, 140 bp, Artificial Sequence
  Synthetic
atggccgactcccaagtacgctggataagcatttccagatttagtcaaccaattcagcctgctgaagaaaccactagcaggccctcttttgcaggcattgcttcctccattttgagtgacggagacccagcatggcgtat

SEQ ID NO: 422351 - DNA, 140 bp, Artificial Sequence
  Synthetic
aggccctggctgctgatatgattgtggcccagtacattctaatggagcaaatggagtgaaaggattctcatatagatatggtaatggtgtttggataggaaggactaaaagcatcaactcgaccttttgggacagcggtg

SEQ ID NO: 422352 - DNA, 140 bp, Artificial Sequence
  Synthetic
caccgctgtcccaaaaggtcgagttgatgcttttagtccttcctatccaaacaccattaccatatctatatgagaatcctttcactccatttgctccattagaatgtactgggccacaatcatatcagcagccagggcct

SEQ ID NO: 422353 - DNA, 140 bp, Artificial Sequence
  Synthetic
atacgccatgctgggtctcctggggagttcaccacccaagcacaaaccaggaacagaccaacctatacgttcaggcatcaggaagggtaacagtctcaaccagaaggagccaacaaaccacgtacttgggagtcggccat

SEQ ID NO: 422354 - DNA, 140 bp, Artificial Sequence
  Synthetic
atggccgactcccaagtacgtggtttgttggctccttctggttgagactgttacccttcctgatgcctgaacgtataggttggtctgttcctggtttgtgcttgggtggtgaactccccaggagacccagcatggcgtat

SEQ ID NO: 422355 - DNA, 140 bp, Artificial Sequence
  Synthetic
aggccctggctgctgatatgtcaggcatcaggaagggtaacagtctcaaccagaaggagccaacaaaccataataccgaatattggatcaaggccttgggtcaggggccaatcagggagggaccttttgggacagcggtg

SEQ ID NO: 422356 - DNA, 140 bp, Artificial Sequence
  Synthetic
caccgctgtcccaaaaggtccctccctgattggcccctgacccaaggccttgatccaatattcggtattatggtttgttggctccttctggttgagactgttacccttcctgatgcctgacatatcagcagccagggcct

SEQ ID NO: 422357 - DNA, 140 bp, Artificial Sequence
  Synthetic
atacgccatgctgggtctcccagtaatggtaatctaatcgctcctcgaggatacttcaagatgcgcactgggaaaagttcaataatgagatcagatgtgcctattgacacatgcatttctcgtacttgggagtcggccat

SEQ ID NO: 422358 - DNA, 140 bp, Artificial Sequence
  Synthetic
atggccgactcccaagtacgagaaatgcatgtgtcaataggcacatctgatctcattattgaacttttcccagtgcgcatcttgaagtatcctcgaggagcgattagattaccattactgggagacccagcatggcgtat

SEQ ID NO: 422359 - DNA, 140 bp, Artificial Sequence
  Synthetic
aggccctggctgctgatatgaaaaaacgagccagttgaggtgggcactcggtgagaacatggcaccagagaaagtagattttgaggactgcaaagatgttagagatctgaaacaatatgagaccttttgggacagcggtg

SEQ ID NO: 422360 - DNA, 140 bp, Artificial Sequence
  Synthetic
caccgctgtcccaaaaggtctcatattgtttcagatctctaacatctttgcagtcctcaaaatctactttctctggtgccatgttctcaccgagtgcccacctcaactggctcgttttttcatatcagcagccagggcct

SEQ ID NO: 422361 - DNA, 140 bp, Artificial Sequence
  Synthetic
atacgccatgctgggtctccggtctgttcggtgcaatagccggatttatagaaaatggatgggaaggaatgatagacggttggtatggtttcagacaccagaactctgagggtacaggaccgtacttgggagtcggccat

SEQ ID NO: 422362 - DNA, 140 bp, Artificial Sequence
  Synthetic
atggccgactcccaagtacggtcctgtaccctcagagttctggtgtctgaaaccataccaaccgtctatcattccttcccatccattttctataaatccggctattgcaccgaacagaccggagacccagcatggcgtat

SEQ ID NO: 422363 - DNA, 140 bp, Artificial Sequence
  Synthetic
aggccctggctgctgatatggatagacggttggtatggtttcagacaccagaactctgagggtacaggacaagctgcagatctgaaaagtacacaggcagccattgaccagattaatggagaccttttgggacagcggtg

SEQ ID NO: 422364 - DNA, 140 bp, Artificial Sequence
  Synthetic
caccgctgtcccaaaaggtctccattaatctggtcaatggctgcctgtgtacttttcagatctgcagcttgtcctgtaccctcagagttctggtgtctgaaaccataccaaccgtctatccatatcagcagccagggcct

SEQ ID NO: 422365 - DNA, 140 bp, Artificial Sequence
  Synthetic
atacgccatgctgggtctccgaaggaattttctgaagtagaaggaagaatccaggaccttgagaaatatgtagaagacactaagatagatctatggtcttacaatgcagagcttctggtgcgtacttgggagtcggccat

SEQ ID NO: 422366 - DNA, 140 bp, Artificial Sequence
  Synthetic
atggccgactcccaagtacgcaccagaagctctgcattgtaagaccatagatctatcttagtgtcttctacatatttctcaaggtcctggattcttccttctacttcagaaaattccttcggagacccagcatggcgtat

SEQ ID NO: 422367 - DNA, 140 bp, Artificial Sequence
  Synthetic
aggccctggctgctgatatgtagaagacactaagatagatctatggtcttacaatgcagagcttctggtggccttggaaaaccagcatacaatcgatctgactgattctgaaatgaacaagaccttttgggacagcggtg

SEQ ID NO: 422368 - DNA, 140 bp, Artificial Sequence
  Synthetic
caccgctgtcccaaaaggtcttgttcatttcagaatcagtcagatcgattgtatgctggttttccaaggccaccagaagctctgcattgtaagaccatagatctatcttagtgtcttctacatatcagcagccagggcct

SEQ ID NO: 422369 - DNA, 140 bp, Artificial Sequence
  Synthetic
atacgccatgctgggtctccgcaatggttgcttcaaaatataccacaaatgtgacaactcatgtatagagtcaatcagaaacgggacctatgatcatgacatatacagggatgaggcattcgtacttgggagtcggccat

SEQ ID NO: 422370 - DNA, 140 bp, Artificial Sequence
  Synthetic
atggccgactcccaagtacgaatgcctcatccctgtatatgtcatgatcataggtcccgtttctgattgactctatacatgagttgtcacatttgtggtatattttgaagcaaccattgcggagacccagcatggcgtat

SEQ ID NO: 422371 - DNA, 140 bp, Artificial Sequence
  Synthetic
atacgccatgctgggtctccattggatcttatggatttcctttgccatatcatgctttttgctttgtgttgttatactggggttcattatgtgggcctgccaaagaggcaacattaggtgcgtacttgggagtcggccat

SEQ ID NO: 422372 - DNA, 140 bp, Artificial Sequence
  Synthetic
atggccgactcccaagtacgcacctaatgttgcctctttggcaggcccacataatgaaccccagtataacaacacaaagcaaaaagcatgatatggcaaaggaaatccataagatccaatggagacccagcatggcgtat

SEQ ID NO: 422373 - DNA, 140 bp, Artificial Sequence
  Synthetic
aggccctggctgctgatatggtctcaaggcaccaaacgatcttatgaacagatggaaactggtggggaacgccagaatgccactgaaatcagagcatctgttgggagaatggttggtggagaccttttgggacagcggtg

SEQ ID NO: 422374 - DNA, 140 bp, Artificial Sequence
  Synthetic
caccgctgtcccaaaaggtctccaccaaccattctcccaacagatgctctgatttcagtggcattctggcgttccccaccagtttccatctgttcataagatcgtttggtgccttgagaccatatcagcagccagggcct

SEQ ID NO: 422375 - DNA, 140 bp, Artificial Sequence
  Synthetic
atacgccatgctgggtctccagtcacagtctccaccaggaagagccaacagactataatcccgaacattggatctagaccctgggtaaggggccagtctggcagaataagcatctattggcgtacttgggagtcggccat

SEQ ID NO: 422376 - DNA, 140 bp, Artificial Sequence
  Synthetic
atggccgactcccaagtacgccaatagatgcttattctgccagactggccccttacccagggtctagatccaatgttcgggattatagtctgttggctcttcctggtggagactgtgactggagacccagcatggcgtat

SEQ ID NO: 422377 - DNA, 140 bp, Artificial Sequence
  Synthetic
aggccctggctgctgatatggccagaatgccactgaaatcagagcatctgttgggagaatggttggcggaatcgggagattctacatacagatgtgcactgagctcaaactcagtgactagaccttttgggacagcggtg

SEQ ID NO: 422378 - DNA, 140 bp, Artificial Sequence
  Synthetic
caccgctgtcccaaaaggtctagtcactgagtttgagctcagtgcacatctgtatgtagaatctcccgattccgccaaccattctcccaacagatgctctgatttcagtggcattctggccatatcagcagccagggcct

SEQ ID NO: 422379 - DNA, 140 bp, Artificial Sequence
  Synthetic
aggccctggctgctgatatgaaaatgaatccaaatcagaagataataaccatcggatcaatctgtatggtaactggagtagttagcttaatgttacaagttgggaacatgatctcggtatgaccttttgggacagcggtg

SEQ ID NO: 422380 - DNA, 140 bp, Artificial Sequence
  Synthetic
caccgctgtcccaaaaggtcataccgagatcatgttcccaacttgtaacattaagctaactactccagttaccatacagattgatccgatggttattatcttctgatttggattcattttcatatcagcagccagggcct

SEQ ID NO: 422381 - DNA, 140 bp, Artificial Sequence
  Synthetic
aggccctggctgctgatatggaagtaaggaaagggtcccctctattttcctataatccacaaacagaagtcctaactatatgcggcaggatgatgtcattaaaagggaaaattgaagatggaccttttgggacagcggtg

SEQ ID NO: 422382 - DNA, 140 bp, Artificial Sequence
  Synthetic
caccgctgtcccaaaaggtccatcttcaattttcccttttaatgacatcatcctgccgcatatagttaggacttctgtttgtggattataggaaaatagaggggaccctttccttacttccatatcagcagccagggcct

SEQ ID NO: 422383 - DNA, 140 bp, Artificial Sequence
  Synthetic
atacgccatgctgggtctccatgaaggcaataatagtagtcttgctgtatacatttacaactgcagatgctgacacattatgtattggctatcatgcaaataattcaactgaaactgttgcgtacttgggagtcggccat

SEQ ID NO: 422384 - DNA, 140 bp, Artificial Sequence
  Synthetic
atggccgactcccaagtacgcaacagtttcagttgaattatttgcatgatagccaatacataatgtgtcagcatctgcagttgtaaatgtatacagcaagactactattattgccttcatggagacccagcatggcgtat

SEQ ID NO: 422385 - DNA, 140 bp, Artificial Sequence
  Synthetic
aggccctggctgctgatatgtgacacattatgtattggctatcatgcaaataattcaactgaaactgttgacacagtactagaaaagaatgtaacagtaacacactctgtcaaccttctagaccttttgggacagcggtg

SEQ ID NO: 422386 - DNA, 140 bp, Artificial Sequence
  Synthetic
caccgctgtcccaaaaggtctagaaggttgacagagtgtgttactgttacattcttttctagtactgtgtcaacagtttcagttgaattatttgcatgatagccaatacataatgtgtcacatatcagcagccagggcct

SEQ ID NO: 422387 - DNA, 140 bp, Artificial Sequence
  Synthetic
atacgccatgctgggtctccacacagtactagaaaagaatgtaacagtaacacactctgtcaaccttctagaaaccaagcatgacggaaaactatgtaaattaaaaggagtagccccattcgtacttgggagtcggccat

SEQ ID NO: 422388 - DNA, 140 bp, Artificial Sequence
  Synthetic
atggccgactcccaagtacgaatggggctactccttttaatttacatagttttccgtcatgcttggtttctagaaggttgacagagtgtgttactgttacattcttttctagtactgtgtggagacccagcatggcgtat

SEQ ID NO: 422389 - DNA, 140 bp, Artificial Sequence
  Synthetic
atacgccatgctgggtctcctgcggaaaaggcaatgaaggaatatggggaagatccaaaaatcgagacaaacaaatttgctgcaatatgcacacacttagaagtgtgtttcatgtattcacgtacttgggagtcggccat

SEQ ID NO: 422390 - DNA, 140 bp, Artificial Sequence
  Synthetic
atggccgactcccaagtacgtgaatacatgaaacacacttctaagtgtgtgcatattgcagcaaatttgtttgtctcgatttttggatcttccccatattccttcattgccttttccgcaggagacccagcatggcgtat

SEQ ID NO: 422391 - DNA, 140 bp, Artificial Sequence
  Synthetic
atacgccatgctgggtctccgtgagtcactattcacaacaagctcatggtcctacatagtggaaacgactaattcagacaatgggacttgttacccaggagatttcatcaattatgaagacgtacttgggagtcggccat

SEQ ID NO: 422392 - DNA, 140 bp, Artificial Sequence
  Synthetic
atggccgactcccaagtacgtcttcataattgatgaaatctcctgggtaacaagtcccattgtctgaattagtcgtttccactatgtaggaccatgagcttgttgtgaatagtgactcacggagacccagcatggcgtat

SEQ ID NO: 422393 - DNA, 140 bp, Artificial Sequence
  Synthetic
aggccctggctgctgatatgaattcagacaatgggacttgttacccaggagatttcatcaattatgaagagctaagagagcatttgagctctgtgtcatcatttgaaaggtttgaaatatgaccttttgggacagcggtg

SEQ ID NO: 422394 - DNA, 140 bp, Artificial Sequence
  Synthetic
caccgctgtcccaaaaggtcatatttcaaacctttcaaatgatgacacagagctcaaatgctctcttagctcttcataattgatgaaatctcctgggtaacaagtcccattgtctgaattcatatcagcagccagggcct

SEQ ID NO: 422395 - DNA, 140 bp, Artificial Sequence
  Synthetic
atacgccatgctgggtctccaggaatggcccaacaacaagtacagttcattaccctaaggtatataaaacttatttcgaaaaggtcgaaaggttgaaacatggtaccttcggccctgtcccgtacttgggagtcggccat

SEQ ID NO: 422396 - DNA, 140 bp, Artificial Sequence
  Synthetic
atggccgactcccaagtacgggacagggccgaaggtaccatgtttcaacctttcgaccttttcgaaataagttttatataccttagggtaatgaactgtacttgttgttgggccattcctggagacccagcatggcgtat

SEQ ID NO: 422397 - DNA, 140 bp, Artificial Sequence
  Synthetic
atacgccatgctgggtctccgcagcctgtccttatgctggagcaaacagcttttacagaaatttaatatggctagttaaaaaaggaaattcatacccaaagctcagcaaatcctacattacgtacttgggagtcggccat

SEQ ID NO: 422398 - DNA, 140 bp, Artificial Sequence
  Synthetic
atggccgactcccaagtacgtaatgtaggatttgctgagctttgggtatgaatttccttttttaactagccatattaaatttctgtaaaagctgtttgctccagcataaggacaggctgcggagacccagcatggcgtat

SEQ ID NO: 422399 - DNA, 140 bp, Artificial Sequence
  Synthetic
aggccctggctgctgatatggctagttaaaaaaggaaattcatacccaaagctcagcaaatcctacattaacaataagaagaaggaagtcctcgtgatatggggcatccaccatccacctgaccttttgggacagcggtg

SEQ ID NO: 422400 - DNA, 140 bp, Artificial Sequence
  Synthetic
caccgctgtcccaaaaggtcaggtggatggtggatgccccatatcacgaggacttccttcttcttattgttaatgtaggatttgctgagctttgggtatgaatttccttttttaactagccatatcagcagccagggcct

SEQ ID NO: 422401 - DNA, 140 bp, Artificial Sequence
  Synthetic
atacgccatgctgggtctcctgtgggatcatcgaaatatagcaaaatattcaaaccagaaatagcaataaggcccaaggtgagggatcaagcaggaagaatggactattactggacaatacgtacttgggagtcggccat

SEQ ID NO: 422402 - DNA, 140 bp, Artificial Sequence
  Synthetic
atggccgactcccaagtacgtattgtccagtaatagtccattcttcctgcttgatccctcaccttgggccttattgctatttctggtttgaatattttgctatatttcgatgatcccacaggagacccagcatggcgtat

SEQ ID NO: 422403 - DNA, 140 bp, Artificial Sequence
  Synthetic
aggccctggctgctgatatgggcccaaggtgagggatcaagcaggaagaatggactattactggacaataatagaacctggagacacaataacattcgaagcaactggaaatctagtggtgaccttttgggacagcggtg

SEQ ID NO: 422404 - DNA, 140 bp, Artificial Sequence
  Synthetic
caccgctgtcccaaaaggtcaccactagatttccagttgcttcgaatgttattgtgtctccaggttctattattgtccagtaatagtccattcttcctgcttgatccctcaccttgggcccatatcagcagccagggcct

SEQ ID NO: 422405 - DNA, 140 bp, Artificial Sequence
  Synthetic
aggccctggctgctgatatggtgaggacactgttccagcaaatgcgggacgtgcttgggacattcgacactgttcagataataaaacttctacccttcgctgctgctccaccagaacaaagaccttttgggacagcggtg

SEQ ID NO: 422406 - DNA, 140 bp, Artificial Sequence
  Synthetic
caccgctgtcccaaaaggtctttgttctggtggagcagcagcgaagggtagaagttttattatctgaacagtgtcgaatgtcccaagcacgtcccgcatttgctggaacagtgtcctcaccatatcagcagccagggcct

SEQ ID NO: 422407 - DNA, 140 bp, Artificial Sequence
  Synthetic
atacgccatgctgggtctcctttcagatgcaccagtccatgattgtagcacggcttgtcaaacacccaaaggtgctataaacaccagccttccatttcagaatatacatccagttacaatcgtacttgggagtcggccat

SEQ ID NO: 422408 - DNA, 140 bp, Artificial Sequence
  Synthetic
atggccgactcccaagtacgattgtaactggatgtatattctgaaatggaaggctggtgtttatagcacctttgggtgtttgacaagccgtgctacaatcatggactggtgcatctgaaaggagacccagcatggcgtat

SEQ ID NO: 422409 - DNA, 140 bp, Artificial Sequence
  Synthetic
aggccctggctgctgatatgggtgctataaacaccagccttccatttcagaatatacatccagttacaattggagaatgtccaaaatatgtcaaaagcacaaaattgagaatggctacaggaccttttgggacagcggtg

SEQ ID NO: 422410 - DNA, 140 bp, Artificial Sequence
  Synthetic
caccgctgtcccaaaaggtcctgtagccattctcaattttgtgcttttgacatattttggacattctccaattgtaactggatgtatattctgaaatggaaggctggtgtttatagcacccatatcagcagccagggcct

SEQ ID NO: 422411 - DNA, 140 bp, Artificial Sequence
  Synthetic
atacgccatgctgggtctccgctggcttcattgaaggggggtggacaggaatgatagatggatggtacggttaccatcatcaaaatgagcagggatcaggatatgcagccgacaaaaagacgtacttgggagtcggccat

SEQ ID NO: 422412 - DNA, 140 bp, Artificial Sequence
  Synthetic
atggccgactcccaagtacgtctttttgtcggctgcatatcctgatccctgctcattttgatgatggtaaccgtaccatccatctatcattcctgtccaccccccttcaatgaagccagcggagacccagcatggcgtat

SEQ ID NO: 422413 - DNA, 140 bp, Artificial Sequence
  Synthetic
atacgccatgctgggtctcctgatggacgactaatccagaatagcataacaatagagaggatggtgctttctgcttttgatgagagaagaaataaatacctagaagagcatcccagtgctcgtacttgggagtcggccat

SEQ ID NO: 422414 - DNA, 140 bp, Artificial Sequence
  Synthetic
atggccgactcccaagtacgagcactgggatgctcttctaggtatttatttcttctctcatcaaaagcagaaagcaccatcctctctattgttatgctattctggattagtcgtccatcaggagacccagcatggcgtat

SEQ ID NO: 422415 - DNA, 140 bp, Artificial Sequence
  Synthetic
aggccctggctgctgatatgaaagtggatgagagaactcatcctttatgacaaagaagaaataaggagagtttggcgccaagcaaacaatggcgaagatgcaacagcaggccttactcatgaccttttgggacagcggtg

SEQ ID NO: 422416 - DNA, 140 bp, Artificial Sequence
  Synthetic
caccgctgtcccaaaaggtcatgagtaaggcctgctgttgcatcttcgccattgtttgcttggcgccaaactctccttatttcttctttgtcataaaggatgagttctctcatccactttcatatcagcagccagggcct

SEQ ID NO: 422417 - DNA, 140 bp, Artificial Sequence
  Synthetic
atacgccatgctgggtctccagaaaaaagaatagaaagtttaaacaataaggttgatgatgggtttctggatatttggacttacaatgccgaactgctggttctattggaaaatgaaaggcgtacttgggagtcggccat

SEQ ID NO: 422418 - DNA, 140 bp, Artificial Sequence
  Synthetic
atggccgactcccaagtacgcctttcattttccaatagaaccagcagttcggcattgtaagtccaaatatccagaaacccatcatcaaccttattgtttaaactttctattcttttttctggagacccagcatggcgtat

SEQ ID NO: 422419 - DNA, 140 bp, Artificial Sequence
  Synthetic
aggccctggctgctgatatgatatttggacttacaatgccgaactgctggttctattggaaaatgaaaggactctagattatcacgattcaaatgtgaagaacctatatgaaagagtaaggaccttttgggacagcggtg

SEQ ID NO: 422420 - DNA, 140 bp, Artificial Sequence
  Synthetic
caccgctgtcccaaaaggtccttactctttcatataggttcttcacatttgaatcgtgataatctagagtcctttcattttccaatagaaccagcagttcggcattgtaagtccaaatatcatatcagcagccagggcct

SEQ ID NO: 422421 - DNA, 140 bp, Artificial Sequence
  Synthetic
atacgccatgctgggtctcctttaccacaaatgcgatgacacgtgcatggagagtgtcaaaaatggaacttatgattacccaaaatactcagaagaagcaaagctaaatagagaggagatcgtacttgggagtcggccat

SEQ ID NO: 422422 - DNA, 140 bp, Artificial Sequence
  Synthetic
atggccgactcccaagtacgatctcctctctatttagctttgcttcttctgagtattttgggtaatcataagttccatttttgacactctccatgcacgtgtcatcgcatttgtggtaaaggagacccagcatggcgtat

SEQ ID NO: 422423 - DNA, 140 bp, Artificial Sequence
  Synthetic
atacgccatgctgggtctccattcaactgtcgccagctcattggtactattagtctctctgggggcagtcagtttctggatgtgctccaatgggtctttacagtgcagaatatgtatctacgtacttgggagtcggccat

SEQ ID NO: 422424 - DNA, 140 bp, Artificial Sequence
  Synthetic
atggccgactcccaagtacgtagatacatattctgcactgtaaagacccattggagcacatccagaaactgactgcccccagagagactaatagtaccaatgagctggcgacagttgaatggagacccagcatggcgtat

SEQ ID NO: 422425 - DNA, 140 bp, Artificial Sequence
  Synthetic
atacgccatgctgggtctccctaatgatctggcattccaatctgaatgatgccacatatcagaggacaagggcacttgtgcgtactgggatggaccccaggatgtgttctctgatgcaagcgtacttgggagtcggccat

SEQ ID NO: 422426 - DNA, 140 bp, Artificial Sequence
  Synthetic
atggccgactcccaagtacgcttgcatcagagaacacatcctggggtccatcccagtacgcacaagtgcccttgtcctctgatatgtggcatcattcagattggaatgccagatcattagggagacccagcatggcgtat

SEQ ID NO: 422427 - DNA, 140 bp, Artificial Sequence
  Synthetic
atacgccatgctgggtctccgaaaagtatgcaggaccttattggcaaaatctgtattcaatagcctgtatgcatccccacaactcgagggattctcagctgaatcaagaaagctacttctcgtacttgggagtcggccat

SEQ ID NO: 422428 - DNA, 140 bp, Artificial Sequence
  Synthetic
atggccgactcccaagtacgagaagtagctttcttgattcagctgagaatccctcgagttgtggggatgcatacaggctattgaatacagattttgccaataaggtcctgcatacttttcggagacccagcatggcgtat

SEQ ID NO: 422429 - DNA, 140 bp, Artificial Sequence
  Synthetic
aggccctggctgctgatatgacttctcccctttgctgctgctccaccagaacagagtaggatgcaattttcctcattgactgtgaatgtgagaggatcagggttgaggatactggtaagagaccttttgggacagcggtg

SEQ ID NO: 422430 - DNA, 140 bp, Artificial Sequence
  Synthetic
caccgctgtcccaaaaggtctcttaccagtatcctcaaccctgatcctctcacattcacagtcaatgaggaaaattgcatcctactctgttctggtggagcagcagcaaaggggagaagtcatatcagcagccagggcct

SEQ ID NO: 422431 - DNA, 140 bp, Artificial Sequence
  Synthetic
aggccctggctgctgatatggtctcaaggcaccaaacgatcttatgagcaaatggaaactggtggagaacgccagaatgctactgagatcagagcatctgttgggagaatggtcggtggagaccttttgggacagcggtg

SEQ ID NO: 422432 - DNA, 140 bp, Artificial Sequence
  Synthetic
caccgctgtcccaaaaggtctccaccgaccattctcccaacagatgctctgatctcagtagcattctggcgttctccaccagtttccatttgctcataagatcgtttggtgccttgagaccatatcagcagccagggcct

SEQ ID NO: 422433 - DNA, 140 bp, Artificial Sequence
  Synthetic
atacgccatgctgggtctcctatataaatatggcagattatagtattgagtccagttatgtgtgctcaggacttgttggcgacacaccaagaaatgatgatagctccagcagcagcaattcgtacttgggagtcggccat

SEQ ID NO: 422434 - DNA, 140 bp, Artificial Sequence
  Synthetic
atggccgactcccaagtacgaattgctgctgctggagctatcatcatttcttggtgtgtcgccaacaagtcctgagcacacataactggactcaatactataatctgccatatttatataggagacccagcatggcgtat

SEQ ID NO: 422435 - DNA, 140 bp, Artificial Sequence
  Synthetic
atacgccatgctgggtctcctgaaggaaggctaatccaaaacagcataacaatagagagaatggttctctctgcatttgatgaaaggaggaacaaatatctggaagaacatcccagtgcgcgtacttgggagtcggccat

SEQ ID NO: 422436 - DNA, 140 bp, Artificial Sequence
  Synthetic
atggccgactcccaagtacgcgcactgggatgttcttccagatatttgttcctcctttcatcaaatgcagagagaaccattctctctattgttatgctgttttggattagccttccttcaggagacccagcatggcgtat

SEQ ID NO: 422437 - DNA, 140 bp, Artificial Sequence
  Synthetic
aggccctggctgctgatatggttctgctatatacatttgcaaccgcaaatgcagacacattatgtataggttatcatgcgaacaattcaacagacactgtagacacagtactagaaaagagaccttttgggacagcggtg

SEQ ID NO: 422438 - DNA, 140 bp, Artificial Sequence
  Synthetic
caccgctgtcccaaaaggtctcttttctagtactgtgtctacagtgtctgttgaattgttcgcatgataacctatacataatgtgtctgcatttgcggttgcaaatgtatatagcagaaccatatcagcagccagggcct

SEQ ID NO: 422439 - DNA, 140 bp, Artificial Sequence
  Synthetic
atacgccatgctgggtctccaaactatgcaaactaagaggggtagccccattgcatttgggtaaatgtaacattgctggctggatcctgggaaatccagagtgtgaatcactctccacagcgtacttgggagtcggccat

SEQ ID NO: 422440 - DNA, 140 bp, Artificial Sequence
  Synthetic
atggccgactcccaagtacgctgtggagagtgattcacactctggatttcccaggatccagccagcaatgttacatttacccaaatgcaatggggctacccctcttagtttgcatagtttggagacccagcatggcgtat

SEQ ID NO: 422441 - DNA, 140 bp, Artificial Sequence
  Synthetic
aggccctggctgctgatatgctgatgatctggcattccaacctgaatgatgccacatatcagagaacaagagctctcgtgcgtactgggatggaccctagaatgtgctccctgatgcaaggaccttttgggacagcggtg

SEQ ID NO: 422442 - DNA, 140 bp, Artificial Sequence
  Synthetic
caccgctgtcccaaaaggtccttgcatcagggagcacattctagggtccatcccagtacgcacgagagctcttgttctctgatatgtggcatcattcaggttggaatgccagatcatcagcatatcagcagccagggcct

SEQ ID NO: 422443 - DNA, 140 bp, Artificial Sequence
  Synthetic
atacgccatgctgggtctcctgttacccaggagatttcatcaattatgaggagctaagagagcaattgagctcagtgtcatcatttgaaaggtttgagatattccccaagacaagttcatcgtacttgggagtcggccat

SEQ ID NO: 422444 - DNA, 140 bp, Artificial Sequence
  Synthetic
atggccgactcccaagtacgatgaacttgtcttggggaatatctcaaacctttcaaatgatgacactgagctcaattgctctcttagctcctcataattgatgaaatctcctgggtaacaggagacccagcatggcgtat

SEQ ID NO: 422445 - DNA, 140 bp, Artificial Sequence
  Synthetic
atacgccatgctgggtctccgttgggacaatggtgatggaactgattcggatgataaaacgggggatcaatgaccggaatttctggagaggcgagaatgggcggagaacaaggatcgcttcgtacttgggagtcggccat

SEQ ID NO: 422446 - DNA, 140 bp, Artificial Sequence
  Synthetic
atggccgactcccaagtacgaagcgatccttgttctccgcccattctcgcctctccagaaattccggtcattgatcccccgttttatcatccgaatcagttccatcaccattgtcccaacggagacccagcatggcgtat

SEQ ID NO: 422447 - DNA, 140 bp, Artificial Sequence
  Synthetic
atacgccatgctgggtctccatgagagaatgtgcaacatcctcaaagggaaattccaaacagcagcacaacgagcaatgatggaccaagtgcgagaaagcagaaatcctgggaatgctgacgtacttgggagtcggccat

SEQ ID NO: 422448 - DNA, 140 bp, Artificial Sequence
  Synthetic
atggccgactcccaagtacgtcagcattcccaggatttctgctttctcgcacttggtccatcattgctcgttgtgctgctgtttggaatttccctttgaggatgttgcacattctctcatggagacccagcatggcgtat

SEQ ID NO: 422449 - DNA, 140 bp, Artificial Sequence
  Synthetic
atacgccatgctgggtctccatgagaatccggcacataagagtcagctggtatggatggcatgccattctgcagcatttgaagacctgagagtgtcgagtttcatcagaggaacaagagtcgtacttgggagtcggccat

SEQ ID NO: 422450 - DNA, 140 bp, Artificial Sequence
  Synthetic
atggccgactcccaagtacgactcttgttcctctgatgaaactcgacactctcaggtcttcaaatgctgcagaatggcatgccatccataccagctgactcttatgtgccggattctcatggagacccagcatggcgtat

SEQ ID NO: 422451 - DNA, 140 bp, Artificial Sequence
  Synthetic
atacgccatgctgggtctccatgaatccaaaccaaaagataataaccattggttcggtctgtatgacaattggaattgctaacttaatattacaaattggaaacataatctcaatatggacgtacttgggagtcggccat

SEQ ID NO: 422452 - DNA, 140 bp, Artificial Sequence
  Synthetic
atggccgactcccaagtacgtccatattgagattatgtttccaatttgtaatattaagttagcaattccaattgtcatacagaccgaaccaatggttattatcttttggtttggattcatggagacccagcatggcgtat

SEQ ID NO: 422453 - DNA, 140 bp, Artificial Sequence
  Synthetic
atacgccatgctgggtctcctgcaggcaatgaggaccattggaactcatcctagctccagtgctggtctgaaagatgatcttcttgaaaatttgcaggcctaccagaaacggatgggagtcgtacttgggagtcggccat

SEQ ID NO: 422454 - DNA, 140 bp, Artificial Sequence
  Synthetic
atggccgactcccaagtacgactcccatccgtttctggtaggcctgcaaattttcaagaagatcatctttcagaccagcactggagctaggatgagttccaatggtcctcattgcctgcaggagacccagcatggcgtat

SEQ ID NO: 422455 - DNA, 140 bp, Artificial Sequence
  Synthetic
aggccctggctgctgatatgtcaacaaggcatgtgaattgacagactctagttggattgaacttgatgaaataggagaggatgttgctccaattgagcacattgcaagtatgagaaggaagaccttttgggacagcggtg

SEQ ID NO: 422456 - DNA, 140 bp, Artificial Sequence
  Synthetic
caccgctgtcccaaaaggtcttccttctcatacttgcaatgtgctcaattggagcaacatcctctcctatttcatcaagttcaatccaactagagtctgtcaattcacatgccttgttgacatatcagcagccagggcct

SEQ ID NO: 422457 - DNA, 140 bp, Artificial Sequence
  Synthetic
aggccctggctgctgatatgaattcgcatcaatatgcacacacttagaagtctgcttcatgtactctgatttccacttcattgacgaacgaggcgaatcaactattatagaatctggcgagaccttttgggacagcggtg

SEQ ID NO: 422458 - DNA, 140 bp, Artificial Sequence
  Synthetic
caccgctgtcccaaaaggtctcgccagattctataatagttgattcgcctcgttcgtcaatgaagtggaaatcagagtacatgaagcagacttctaagtgtgtgcatattgatgcgaattcatatcagcagccagggcct

SEQ ID NO: 422459 - DNA, 140 bp, Artificial Sequence
  Synthetic
aggccctggctgctgatatggaatagctttgaacagataacatttatgcaagcattacaactactgcttgaggtggagcaagagataagaactttctcgtttcagtttatttaataataagaccttttgggacagcggtg

SEQ ID NO: 422460 - DNA, 140 bp, Artificial Sequence
  Synthetic
caccgctgtcccaaaaggtcttattattaaataaactgaaacgagaaagttcttatctcttgctccacctcaagcagtagttgtaatgcttgcataaatgttatctgttcaaagctattccatatcagcagccagggcct

SEQ ID NO: 422461 - DNA, 140 bp, Artificial Sequence
  Synthetic
aggccctggctgctgatatgcttctgtcaaggaaaaggacatgactaaagaattttttgagaacaagtcggagacatggccaattggggaatcccccagaggggtagaggaaggctctatgaccttttgggacagcggtg

SEQ ID NO: 422462 - DNA, 140 bp, Artificial Sequence
  Synthetic
caccgctgtcccaaaaggtcatagagccttcctctacccctctgggggattccccaattggccatgtctccgacttgttctcaaaaaattctttagtcatgtccttttccttgacagaagcatatcagcagccagggcct

SEQ ID NO: 422463 - DNA, 140 bp, Artificial Sequence
  Synthetic
atacgccatgctgggtctccccaaggcctcttgtcaatggtctacaaggaaggattgattattattgggcggtgttaaaaccaggtcagacattgcgagtaagatccaacgggaatctaacgtacttgggagtcggccat

SEQ ID NO: 422464 - DNA, 140 bp, Artificial Sequence
  Synthetic
atggccgactcccaagtacgttagattcccgttggatcttactcgcaatgtctgacctggttttaacaccgcccaataataatcaatccttccttgtagaccattgacaagaggccttggggagacccagcatggcgtat

SEQ ID NO: 422465 - DNA, 140 bp, Artificial Sequence
  Synthetic
aggccctggctgctgatatgaatacttaccatttattcgactgtcgcctcatctcttgtacttgcaatggggtttgctgccttcttattctgggccatgtcaaacggatcatgcagatgcgaccttttgggacagcggtg

SEQ ID NO: 422466 - DNA, 140 bp, Artificial Sequence
  Synthetic
caccgctgtcccaaaaggtcgcatctgcatgatccgtttgacatggcccagaataagaaggcagcaaaccccattgcaagtacaagagatgaggcgacagtcgaataaatggtaagtattcatatcagcagccagggcct

SEQ ID NO: 422467 - DNA, 140 bp, Artificial Sequence
  Synthetic
aggccctggctgctgatatgacatgaccctcgaggaaatgtcacgagactggttcatgctcatgcctaggcaaaagataataggccctctttgcgtgcgattggaccaggcggtcatggagaccttttgggacagcggtg

SEQ ID NO: 422468 - DNA, 140 bp, Artificial Sequence
  Synthetic
caccgctgtcccaaaaggtctccatgaccgcctggtccaatcgcacgcaaagagggcctattatcttttgcctaggcatgagcatgaaccagtctcgtgacatttcctcgagggtcatgtcatatcagcagccagggcct

SEQ ID NO: 422469 - DNA, 140 bp, Artificial Sequence
  Synthetic
aggccctggctgctgatatgcattaaagggaagaggcagcacacttggactcgacctgcgagtggccacaatggaaggcaaaaagattgttgaagacatcctaaagagtgaaacggatgagaccttttgggacagcggtg

SEQ ID NO: 422470 - DNA, 140 bp, Artificial Sequence
  Synthetic
caccgctgtcccaaaaggtctcatccgtttcactctttaggatgtcttcaacaatctttttgccttccattgtggccactcgcaggtcgagtccaagtgtgctgcctcttccctttaatgcatatcagcagccagggcct

SEQ ID NO: 422471 - DNA, 140 bp, Artificial Sequence
  Synthetic
aggccctggctgctgatatggactagcgggagcagcatatccttttgtggtgtaaacagtgacactgtgggttggtcttggccagacggtgctgagttgccatttaccattgacaagtaagaccttttgggacagcggtg

SEQ ID NO: 422472 - DNA, 140 bp, Artificial Sequence
  Synthetic
caccgctgtcccaaaaggtcttacttgtcaatggtaaatggcaactcagcaccgtctggccaagaccaacccacagtgtcactgtttacaccacaaaaggatatgctgctcccgctagtccatatcagcagccagggcct

SEQ ID NO: 422473 - DNA, 140 bp, Artificial Sequence
  Synthetic
aggccctggctgctgatatgcagaaaataacagggggtctgatggtgaaaatggatcaggccatcatggacaagagaataacactcaaggcaaacttctctgtcctatttgatcaactgggaccttttgggacagcggtg

SEQ ID NO: 422474 - DNA, 140 bp, Artificial Sequence
  Synthetic
caccgctgtcccaaaaggtcccagttgatcaaataggacagagaagtttgccttgagtgttattctcttgtccatgatggcctgatccattttcaccatcagaccccctgttattttctgcatatcagcagccagggcct

SEQ ID NO: 422475 - DNA, 140 bp, Artificial Sequence
  Synthetic
atacgccatgctgggtctccaacatggccaattggagaatcacctaagggagtggaggaaggttccatcgggaaggtgtgcagaaccttactagcaaaatctgtattcaacagcctatatcgtacttgggagtcggccat

SEQ ID NO: 422476 - DNA, 140 bp, Artificial Sequence
  Synthetic
atggccgactcccaagtacgatataggctgttgaatacagattttgctagtaaggttctgcacaccttcccgatggaaccttcctccactcccttaggtgattctccaattggccatgttggagacccagcatggcgtat

SEQ ID NO: 422477 - DNA, 140 bp, Artificial Sequence
  Synthetic
atacgccatgctgggtctccgctgagattgaagacctcattttcctggcacggtcagcactcattctgaggggatcagttgcacataaatcctgcctgcctgcttgtgtgtatgggcttgcgtacttgggagtcggccat

SEQ ID NO: 422478 - DNA, 140 bp, Artificial Sequence
  Synthetic
atggccgactcccaagtacgcaagcccatacacacaagcaggcaggcaggatttatgtgcaactgatcccctcagaatgagtgctgaccgtgccaggaaaatgaggtcttcaatctcagcggagacccagcatggcgtat

SEQ ID NO: 422479 - DNA, 140 bp, Artificial Sequence
  Synthetic
aggccctggctgctgatatgctcggacgaaaaggcaacgagcccgatcgtgccttcctttgacatgagtaatgaaggatcttatttcttcggagacaatgcagaggagtatgacagttgagaccttttgggacagcggtg

SEQ ID NO: 422480 - DNA, 140 bp, Artificial Sequence
  Synthetic
caccgctgtcccaaaaggtctcaactgtcatactcctctgcattgtctccgaagaaataagatccttcattactcatgtcaaaggaaggcacgatcgggctcgttgccttttcgtccgagcatatcagcagccagggcct

SEQ ID NO: 422481 - DNA, 140 bp, Artificial Sequence
  Synthetic
atacgccatgctgggtctccaaatgtagagtggctgcttgggttcaaacagagatgaatctattgagcactctgacaagtaaaagagctctggacctaccagaaatagggccagacgtagcgtacttgggagtcggccat

SEQ ID NO: 422482 - DNA, 140 bp, Artificial Sequence
  Synthetic
atggccgactcccaagtacgctacgtctggccctatttctggtaggtccagagctcttttacttgtcagagtgctcaatagattcatctctgtttgaacccaagcagccactctacatttggagacccagcatggcgtat

SEQ ID NO: 422483 - DNA, 140 bp, Artificial Sequence
  Synthetic
atacgccatgctgggtctcctggaggggatctaatagacccgttctatacataaatatggcagattatagtattgactccggttatgtgtgctcgggacttgttggtgacacaccaagaacgtacttgggagtcggccat

SEQ ID NO: 422484 - DNA, 140 bp, Artificial Sequence
  Synthetic
atggccgactcccaagtacgttcttggtgtgtcaccaacaagtcccgagcacacataaccggagtcaatactataatctgccatatttatgtatagaacgggtctattagatcccctccaggagacccagcatggcgtat

SEQ ID NO: 422485 - DNA, 140 bp, Artificial Sequence
  Synthetic
atacgccatgctgggtctccgcatccgcaggccagatcagtgtgcagcctacattctcagtgcagcgaaatctcccttttgaaagagcaaccgttatggcagcattcagcgggaacaatgcgtacttgggagtcggccat

SEQ ID NO: 422486 - DNA, 140 bp, Artificial Sequence
  Synthetic
atggccgactcccaagtacgcattgttcccgctgaatgctgccataacggttgctctttcaaaagggagatttcgctgcactgagaatgtaggctgcacactgatctggcctgcggatgcggagacccagcatggcgtat

SEQ ID NO: 422487 - DNA, 140 bp, Artificial Sequence
  Synthetic
aggccctggctgctgatatggaccccaagcacggaaatatcgctgagggggataagagtcagcaaaatgggggtggacgaatattccagcacggagagagtggtggtgagcattgaccgagaccttttgggacagcggtg

SEQ ID NO: 422488 - DNA, 140 bp, Artificial Sequence
  Synthetic
caccgctgtcccaaaaggtctcggtcaatgctcaccaccactctctccgtgctggaatattcgtccacccccattttgctgactcttatccccctcagcgatatttccgtgcttggggtccatatcagcagccagggcct

SEQ ID NO: 422489 - DNA, 140 bp, Artificial Sequence
  Synthetic
aggccctggctgctgatatgggtcccaagagggcaactgtccaccagaggagtacagattgcttcaaatgagaacatggaaacaatggactccagtactcttgaattgagaagcagatacgaccttttgggacagcggtg

SEQ ID NO: 422490 - DNA, 140 bp, Artificial Sequence
  Synthetic
caccgctgtcccaaaaggtcgtatctgcttctcaattcaagagtactggagtccattgtttccatgttctcatttgaagcaatctgtactcctctggtggacagttgccctcttgggacccatatcagcagccagggcct

SEQ ID NO: 422491 - DNA, 140 bp, Artificial Sequence
  Synthetic
aggccctggctgctgatatgtaagagaagttatctaataagagcactgacattgaatacgatgaccaaagatgcagagagaggcaaattaaaaaggagggctattgcaacacctgggatggaccttttgggacagcggtg

SEQ ID NO: 422492 - DNA, 140 bp, Artificial Sequence
  Synthetic
caccgctgtcccaaaaggtccatcccaggtgttgcaatagccctcctttttaatttgcctctctctgcatctttggtcatcgtattcaatgtcagtgctcttattagataacttctcttacatatcagcagccagggcct

SEQ ID NO: 422493 - DNA, 140 bp, Artificial Sequence
  Synthetic
atacgccatgctgggtctccgcctcattgagtcctggaatgatgatgggcatgttcaacatgttgagtacagtcttaggagtttcaattctgaatctcgggcaaaagaagtacaccaaaacgtacttgggagtcggccat

SEQ ID NO: 422494 - DNA, 140 bp, Artificial Sequence
  Synthetic
atggccgactcccaagtacgttttggtgtacttcttttgcccgagattcagaattgaaactcctaagactgtactcaacatgttgaacatgcccatcatcattccaggactcaatgaggcggagacccagcatggcgtat

SEQ ID NO: 422495 - DNA, 140 bp, Artificial Sequence
  Synthetic
atacgccatgctgggtctcccagtggatcatcagaaactgggaaactgtaaagattcaatggtctcaggatcccactatgctgtacaataagatggagttcgaaccgttccaatccttggcgtacttgggagtcggccat

SEQ ID NO: 422496 - DNA, 140 bp, Artificial Sequence
  Synthetic
atggccgactcccaagtacgccaaggattggaacggttcgaactccatcttattgtacagcatagtgggatcctgagaccattgaatctttacagtttcccagtttctgatgatccactgggagacccagcatggcgtat

SEQ ID NO: 422497 - DNA, 140 bp, Artificial Sequence
  Synthetic
atacgccatgctgggtctccggggccccaggagtgaaagggtgggcctttgacagtggaaatgacatttggatgggaagaactattgaaaaggattcgcgctcaggttatgagactttcacgtacttgggagtcggccat

SEQ ID NO: 422498 - DNA, 140 bp, Artificial Sequence
  Synthetic
atggccgactcccaagtacgtgaaagtctcataacctgagcgcgaatccttttcaatagttcttcccatccaaatgtcatttccactgtcaaaggcccaccctttcactcctggggccccggagacccagcatggcgtat

SEQ ID NO: 422499 - DNA, 140 bp, Artificial Sequence
  Synthetic
aggccctggctgctgatatgaggacatactaatgaggatgtcaaaaatgcaattggaatcctcatcgggggacttgagtggaatgataacacagttcgaatctctgaaaatttacagagagaccttttgggacagcggtg

SEQ ID NO: 422500 - DNA, 140 bp, Artificial Sequence
  Synthetic
caccgctgtcccaaaaggtctctctgtaaattttcagagattcgaactgtgttatcattccactcaagtcccccgatgaggattccaattgcatttttgacatcctcattagtatgtcctcatatcagcagccagggcct

SEQ ID NO: 422501 - DNA, 140 bp, Artificial Sequence
  Synthetic
aggccctggctgctgatatggatgggaagaactattgaaaaggattcgcgctcaggttatgagactttcagggtcattgatggttggaacactgcaaattccaagtcacagacaaatagagaccttttgggacagcggtg

SEQ ID NO: 422502 - DNA, 140 bp, Artificial Sequence
  Synthetic
caccgctgtcccaaaaggtctctatttgtctgtgacttggaatttgcagtgttccaaccatcaatgaccctgaaagtctcataacctgagcgcgaatccttttcaatagttcttcccatccatatcagcagccagggcct

SEQ ID NO: 422503 - DNA, 140 bp, Artificial Sequence
  Synthetic
aggccctggctgctgatatgtggacagtggtaaatagtatctgcaacaccacaggagtcgataagcctaaattcctcccagatttgtatgattacaaagagaaccgattcattgaaattggaccttttgggacagcggtg

SEQ ID NO: 422504 - DNA, 140 bp, Artificial Sequence
  Synthetic
caccgctgtcccaaaaggtccaatttcaatgaatcggttctctttgtaatcatacaaatctgggaggaatttaggcttatcgactcctgtggtgttgcagatactatttaccactgtccacatatcagcagccagggcct

SEQ ID NO: 422505 - DNA, 140 bp, Artificial Sequence
  Synthetic
atacgccatgctgggtctccatactatacttgagaagaatgtcactgtcacacactcagttgaattgctagagaaccagaaggaagaaagattctgcaagatcttaaacaaggcccctctcgtacttgggagtcggccat

SEQ ID NO: 422506 - DNA, 140 bp, Artificial Sequence
  Synthetic
atggccgactcccaagtacgagaggggccttgtttaagatcttgcagaatctttcttccttctggttctctagcaattcaactgagtgtgtgacagtgacattcttctcaagtatagtatggagacccagcatggcgtat

SEQ ID NO: 422507 - DNA, 140 bp, Artificial Sequence
  Synthetic
atacgccatgctgggtctcctcaaaaccaggctgttcactataaggcaagaaatggccagtaggggtctatgggattcctttcgtcagtccgagagaggcgaagagacaattgaagaaagcgtacttgggagtcggccat

SEQ ID NO: 422508 - DNA, 140 bp, Artificial Sequence
  Synthetic
atggccgactcccaagtacgctttcttcaattgtctcttcgcctctctcggactgacgaaaggaatcccatagacccctactggccatttcttgccttatagtgaacagcctggttttgaggagacccagcatggcgtat

SEQ ID NO: 422509 - DNA, 140 bp, Artificial Sequence
  Synthetic
atacgccatgctgggtctcctgggattcctttcgtcagtccgagagaggcgaagagacaattgaagaaagatttgaaatcacaggaaccatgcgcaggcttgccgaccaaagtctcccaccgtacttgggagtcggccat

SEQ ID NO: 422510 - DNA, 140 bp, Artificial Sequence
  Synthetic
atggccgactcccaagtacggtgggagactttggtcggcaagcctgcgcatggttcctgtgatttcaaatctttcttcaattgtctcttcgcctctctcggactgacgaaaggaatcccaggagacccagcatggcgtat

SEQ ID NO: 422511 - DNA, 140 bp, Artificial Sequence
  Synthetic
atacgccatgctgggtctccaaaccagttaaaaaacaatgccaaggaaattggaaacggctgctttgaattttaccacaaatgcgataacacgtgcatggaaagtgtcaaaaatgggactcgtacttgggagtcggccat

SEQ ID NO: 422512 - DNA, 140 bp, Artificial Sequence
  Synthetic
atggccgactcccaagtacgagtcccatttttgacactttccatgcacgtgttatcgcatttgtggtaaaattcaaagcagccgtttccaatttccttggcattgttttttaactggtttggagacccagcatggcgtat

SEQ ID NO: 422513 - DNA, 140 bp, Artificial Sequence
  Synthetic
atacgccatgctgggtctcccgccaggattgagccatttctgaaaacaacaccacgccctctcagattacctgatgggcctccctgctctcagcgatcgaagttcttactgatggatgcccgtacttgggagtcggccat

SEQ ID NO: 422514 - DNA, 140 bp, Artificial Sequence
  Synthetic
atggccgactcccaagtacgggcatccatcagtaagaacttcgatcgctgagagcagggaggcccatcaggtaatctgagagggcgtggtgttgttttcagaaatggctcaatcctggcgggagacccagcatggcgtat

SEQ ID NO: 422515 - DNA, 140 bp, Artificial Sequence
  Synthetic
aggccctggctgctgatatgccatgatgtgggagatcaatggtccggaatcagtgctagttaacacatatcaatggatcattagaaattgggaaactgtaaagattcaatggtcccaagagaccttttgggacagcggtg

SEQ ID NO: 422516 - DNA, 140 bp, Artificial Sequence
  Synthetic
caccgctgtcccaaaaggtctcttgggaccattgaatctttacagtttcccaatttctaatgatccattgatatgtgttaactagcactgattccggaccattgatctcccacatcatggcatatcagcagccagggcct

SEQ ID NO: 422517 - DNA, 140 bp, Artificial Sequence
  Synthetic
aggccctggctgctgatatgagacaagatctgcattggatatcatgccaataattcaacaacacaagtggacactatacttgagaagaatgtcaccgtcacacactcagttgaattgctagaccttttgggacagcggtg

SEQ ID NO: 422518 - DNA, 140 bp, Artificial Sequence
  Synthetic
caccgctgtcccaaaaggtctagcaattcaactgagtgtgtgacggtgacattcttctcaagtatagtgtccacttgtgttgttgaattattggcatgatatccaatgcagatcttgtctcatatcagcagccagggcct

SEQ ID NO: 422519 - DNA, 140 bp, Artificial Sequence
  Synthetic
atacgccatgctgggtctcctccaaaaacaaaaaacatgaagaaaacaagccaattgaagtgggcacttggtgagaacatggcaccagagaaagtagactttgaggactgcaaagatgttcgtacttgggagtcggccat

SEQ ID NO: 422520 - DNA, 140 bp, Artificial Sequence
  Synthetic
atggccgactcccaagtacgaacatctttgcagtcctcaaagtctactttctctggtgccatgttctcaccaagtgcccacttcaattggcttgttttcttcatgttttttgtttttggaggagacccagcatggcgtat

SEQ ID NO: 422521 - DNA, 140 bp, Artificial Sequence
  Synthetic
atacgccatgctgggtctccatggactccaacactgtgtcaagctttcaggtagactgcttcctttggcatgtccgcaaacggtttgcagacaatggattgggtgatgccccatttcttgcgtacttgggagtcggccat

SEQ ID NO: 422522 - DNA, 140 bp, Artificial Sequence
  Synthetic
atggccgactcccaagtacgcaagaaatggggcatcacccaatccattgtctgcaaaccgtttgcggacatgccaaaggaagcagtctacctgaaagcttgacacagtgttggagtccatggagacccagcatggcgtat

SEQ ID NO: 422523 - DNA, 140 bp, Artificial Sequence
  Synthetic
aggccctggctgctgatatgaagctggatccagagcgaattcaacaaagcatgcgaattgacagattcaagttggattgaacttgatgaaataggggaagatgttgctccaattgagcacgaccttttgggacagcggtg

SEQ ID NO: 422524 - DNA, 140 bp, Artificial Sequence
  Synthetic
caccgctgtcccaaaaggtcgtgctcaattggagcaacatcttcccctatttcatcaagttcaatccaacttgaatctgtcaattcgcatgctttgttgaattcgctctggatccagcttcatatcagcagccagggcct

SEQ ID NO: 422525 - DNA, 140 bp, Artificial Sequence
  Synthetic
atacgccatgctgggtctcctcaccataaggcaagaaatggccagtaggagtctgtgggattcctttcgccagtcagagagaggcgaagagacaattgaagaaagatttgaaatcaaaggcgtacttgggagtcggccat

SEQ ID NO: 422526 - DNA, 140 bp, Artificial Sequence
  Synthetic
atggccgactcccaagtacgcctttgatttcaaatctttcttcaattgtctcttcgcctctctctgactggcgaaaggaatcccacagactcctactggccatttcttgccttatggtgaggagacccagcatggcgtat

SEQ ID NO: 422527 - DNA, 140 bp, Artificial Sequence
  Synthetic
atacgccatgctgggtctcctaaatggaaatggggacccgaataacatggatagagcagtcaaattatacaagaagctaaaaagggaaataacattccatggggccaaagaggtgtcactcgtacttgggagtcggccat

SEQ ID NO: 422528 - DNA, 140 bp, Artificial Sequence
  Synthetic
atggccgactcccaagtacgagtgacacctctttggccccatggaatgttatttccctttttagcttcttgtataatttgactgctctatccatgttattcgggtccccatttccatttaggagacccagcatggcgtat

SEQ ID NO: 422529 - DNA, 140 bp, Artificial Sequence
  Synthetic
atacgccatgctgggtctcccttctctaactgtgaacgtgaggggttcaggaatgagaatagttgtgagaggcaattctcctgtgttcaactacaacaaggcaaccaagaggcttacagtcgtacttgggagtcggccat

SEQ ID NO: 422530 - DNA, 140 bp, Artificial Sequence
  Synthetic
atggccgactcccaagtacgactgtaagcctcttggttgccttgttgtagttgaacacaggagaattgcctctcacaactattctcattcctgaacccctcacgttcacagttagagaagggagacccagcatggcgtat

SEQ ID NO: 422531 - DNA, 140 bp, Artificial Sequence
  Synthetic
aggccctggctgctgatatgggcaattctcctgtgttcaactacaacaaggcaaccaagaggcttacagtgcttggaaaggatgcaggtgcattgatggaagacccagatgagggaacaggaccttttgggacagcggtg

SEQ ID NO: 422532 - DNA, 140 bp, Artificial Sequence
  Synthetic
caccgctgtcccaaaaggtcctgttccctcatctgggtcttccatcaatgcacctgcatcctttccaagcactgtaagcctcttggttgccttgttgtagttgaacacaggagaattgcccatatcagcagccagggcct

SEQ ID NO: 422533 - DNA, 140 bp, Artificial Sequence
  Synthetic
aggccctggctgctgatatgtttgaactttgtcaacagagcgaaccagcggctaaatcccatgcatcaactcctgaggcatttccaaaaggatgcaaaggtcctgtttcaaaactggggagaccttttgggacagcggtg

SEQ ID NO: 422534 - DNA, 140 bp, Artificial Sequence
  Synthetic
caccgctgtcccaaaaggtctccccagttttgaaacaggacctttgcatccttttggaaatgcctcaggagttgatgcatgggatttagccgctggttcgctctgttgacaaagttcaaacatatcagcagccagggcct

SEQ ID NO: 422535 - DNA, 140 bp, Artificial Sequence
  Synthetic
aggccctggctgctgatatgatcggtagtaagcctgctgataggaattgccaatttgggcctaaacatcggactccattataaggtgggtgatacaccagatgtgagcatcccaaacatggaccttttgggacagcggtg

SEQ ID NO: 422536 - DNA, 140 bp, Artificial Sequence
  Synthetic
caccgctgtcccaaaaggtccatgtttgggatgctcacatctggtgtatcacccaccttataatggagtccgatgtttaggcccaaattggcaattcctatcagcaggcttactaccgatcatatcagcagccagggcct

SEQ ID NO: 422537 - DNA, 140 bp, Artificial Sequence
  Synthetic
atacgccatgctgggtctccagaaactaaagcaccccaactcaatccgattgatggaccgttgcctgataataatgaaccgagcgggtacgcacaaacggactgcgtgttggaagcaatgcgtacttgggagtcggccat

SEQ ID NO: 422538 - DNA, 140 bp, Artificial Sequence
  Synthetic
atggccgactcccaagtacgcattgcttccaacacgcagtccgtttgtgcgtacccgctcggttcattattatcaggcaacggtccatcaatcggattgagttggggtgctttagtttctggagacccagcatggcgtat

SEQ ID NO: 422539 - DNA, 140 bp, Artificial Sequence
  Synthetic
aggccctggctgctgatatgataatgaaccgagcgggtacgcacaaacggactgcgtgttggaagcaatggctttccttgaagaatcacacccagggatttttgaaaactcgtgtcttgagaccttttgggacagcggtg

SEQ ID NO: 422540 - DNA, 140 bp, Artificial Sequence
  Synthetic
caccgctgtcccaaaaggtctcaagacacgagttttcaaaaatccctgggtgtgattcttcaaggaaagccattgcttccaacacgcagtccgtttgtgcgtacccgctcggttcattatcatatcagcagccagggcct

SEQ ID NO: 422541 - DNA, 140 bp, Artificial Sequence
  Synthetic
atacgccatgctgggtctccgctaagggagcaattgagttcagtatcttcatttgagagattcgagatattccccaaagaaagctcatggcccaaccacactgtaaccggagtgtcagcacgtacttgggagtcggccat

SEQ ID NO: 422542 - DNA, 140 bp, Artificial Sequence
  Synthetic
atggccgactcccaagtacgtgctgacactccggttacagtgtggttgggccatgagctttctttggggaatatctcgaatctctcaaatgaagatactgaactcaattgctcccttagcggagacccagcatggcgtat

SEQ ID NO: 422543 - DNA, 140 bp, Artificial Sequence
  Synthetic
atacgccatgctgggtctccatcagggaggctaatagacttcctaaaggacgtgatggactcaatgaataaagaggaaatggaaataacgacacatttccagagaaagagaagagtaagacgtacttgggagtcggccat

SEQ ID NO: 422544 - DNA, 140 bp, Artificial Sequence
  Synthetic
atggccgactcccaagtacgtcttactcttctctttctctggaaatgtgtcgttatttccatttcctctttattcattgagtccatcacgtcctttaggaagtctattagcctccctgatggagacccagcatggcgtat

SEQ ID NO: 422545 - DNA, 140 bp, Artificial Sequence
  Synthetic
atacgccatgctgggtctccgcagaggctgaacagaaggagctatttaataagagcactgacactgaacacaatgacaaaggatgcagaaagaggcaaattgaaaaggagggcaattgcacgtacttgggagtcggccat

SEQ ID NO: 422546 - DNA, 140 bp, Artificial Sequence
  Synthetic
atggccgactcccaagtacgtgcaattgccctccttttcaatttgcctctttctgcatcctttgtcattgtgttcagtgtcagtgctcttattaaatagctccttctgttcagcctctgcggagacccagcatggcgtat

SEQ ID NO: 422547 - DNA, 140 bp, Artificial Sequence
  Synthetic
aggccctggctgctgatatgggaaacaatgctatcaatcacgattctgttcctgctcatagcagaggtatcctctcagaactacacaggaaatcctgtgatatgtctgggacaccatgctgaccttttgggacagcggtg

SEQ ID NO: 422548 - DNA, 140 bp, Artificial Sequence
  Synthetic
caccgctgtcccaaaaggtcagcatggtgtcccagacatatcacaggatttcctgtgtagttctgagaggatacctctgctatgagcaggaacagaatcgtgattgatagcattgtttcccatatcagcagccagggcct

SEQ ID NO: 422549 - DNA, 140 bp, Artificial Sequence
  Synthetic
aggccctggctgctgatatggctataaacagcagtcttcctttccagaatgtacacccagtcacaataggagaatgtccaaaatatgtcaggagtactaaattaaggatggttacaggacgaccttttgggacagcggtg

SEQ ID NO: 422550 - DNA, 140 bp, Artificial Sequence
  Synthetic
caccgctgtcccaaaaggtcgtcctgtaaccatccttaatttagtactcctgacatattttggacattctcctattgtgactgggtgtacattctggaaaggaagactgctgtttatagccatatcagcagccagggcct

SEQ ID NO: 422551 - DNA, 140 bp, Artificial Sequence
  Synthetic
atacgccatgctgggtctccctaggcagatggtgcaggcaatgaggacaattgggactcaccctaactctagtgctggtctgagagacaatcttcttgaaaatttgcaggcctaccagaacgtacttgggagtcggccat

SEQ ID NO: 422552 - DNA, 140 bp, Artificial Sequence
  Synthetic
atggccgactcccaagtacgttctggtaggcctgcaaattttcaagaagattgtctctcagaccagcactagagttagggtgagtcccaattgtcctcattgcctgcaccatctgcctagggagacccagcatggcgtat

SEQ ID NO: 422553 - DNA, 140 bp, Artificial Sequence
  Synthetic
aggccctggctgctgatatgacgagaagaaggctaaactggcaaatgtcgtgagaaagatgatgactaactcacaagatacagagctctcctttacaattactggggacaacaccaaatggaccttttgggacagcggtg

SEQ ID NO: 422554 - DNA, 140 bp, Artificial Sequence
  Synthetic
caccgctgtcccaaaaggtccatttggtgttgtccccagtaattgtaaaggagagctctgtatcttgtgagttagtcatcatctttctcacgacatttgccagtttagccttcttctcgtcatatcagcagccagggcct

SEQ ID NO: 422555 - DNA, 140 bp, Artificial Sequence
  Synthetic
atacgccatgctgggtctccctagccctttgagattagtagatggccaaacttgtgacatcgtcaatggtgctctgggaagcccgggctgtgatcacttaaatggtgcagaatgggatgtcgtacttgggagtcggccat

SEQ ID NO: 422556 - DNA, 140 bp, Artificial Sequence
  Synthetic
atggccgactcccaagtacgacatcccattctgcaccatttaagtgatcacagcccgggcttcccagagcaccattgacgatgtcacaagtttggccatctactaatctcaaagggctagggagacccagcatggcgtat

SEQ ID NO: 422557 - DNA, 140 bp, Artificial Sequence
  Synthetic
atacgccatgctgggtctcctcgaatggaccaggcgatcattgaaaagaacatcatactgaaagcgaacttcagtgtgatcttcaaccgattagagactttggttctactaagagctttccgtacttgggagtcggccat

SEQ ID NO: 422558 - DNA, 140 bp, Artificial Sequence
  Synthetic
atggccgactcccaagtacggaaagctcttagtagaaccaaagtctctaatcggttgaagatcacactgaagttcgctttcagtatgatgttcttttcaatgatcgcctggtccattcgaggagacccagcatggcgtat

SEQ ID NO: 422559 - DNA, 140 bp, Artificial Sequence
  Synthetic
aggccctggctgctgatatgcttctacggcaggagtacctgagtctatgagggaggaataccggcaggagcagcagagtgctgtggatgttgacgacggtcattttgtcaacatagagttgaccttttgggacagcggtg

SEQ ID NO: 422560 - DNA, 140 bp, Artificial Sequence
  Synthetic
caccgctgtcccaaaaggtcaactctatgttgacaaaatgaccgtcgtcaacatccacagcactctgctgctcctgccggtattcctccctcatagactcaggtactcctgccgtagaagcatatcagcagccagggcct

SEQ ID NO: 422561 - DNA, 140 bp, Artificial Sequence
  Synthetic
atacgccatgctgggtctccttcatcgcagaggaattccaatggaacacagtcaagcagaatgggaaatcaggagcatgtaaaagagcaaatgtgaatgactttttcaacagactgaactcgtacttgggagtcggccat

SEQ ID NO: 422562 - DNA, 140 bp, Artificial Sequence
  Synthetic
atggccgactcccaagtacgagttcagtctgttgaaaaagtcattcacatttgctcttttacatgctcctgatttcccattctgcttgactgtgttccattggaattcctctgcgatgaaggagacccagcatggcgtat

SEQ ID NO: 422563 - DNA, 140 bp, Artificial Sequence
  Synthetic
aggccctggctgctgatatgagaacagtcgggactcaccctaactccagtacaggtctaaaggatgatcttattgaaaatttgcaggcttaccagaaccggatgggagtgcaactgcagcgaccttttgggacagcggtg

SEQ ID NO: 422564 - DNA, 140 bp, Artificial Sequence
  Synthetic
caccgctgtcccaaaaggtcgctgcagttgcactcccatccggttctggtaagcctgcaaattttcaataagatcatcctttagacctgtactggagttagggtgagtcccgactgttctcatatcagcagccagggcct

SEQ ID NO: 422565 - DNA, 140 bp, Artificial Sequence
  Synthetic
aggccctggctgctgatatgtgcgatgatatgttttctcatgcagattgccatcttaacaacgaccatgacactacatttcaggcagaatgaatgcagcaatccatcgaataatcaagtggaccttttgggacagcggtg

SEQ ID NO: 422566 - DNA, 140 bp, Artificial Sequence
  Synthetic
caccgctgtcccaaaaggtccacttgattattcgatggattgctgcattcattctgcctgaaatgtagtgtcatggtcgttgttaagatggcaatctgcatgagaaaacatatcatcgcacatatcagcagccagggcct

SEQ ID NO: 422567 - DNA, 140 bp, Artificial Sequence
  Synthetic
aggccctggctgctgatatggtcaacaatggagactatgcaaggctttacatatggggagttcaccatccttcaactgacacagaacaaaccaacttgtataagaacaaccctggaaggggaccttttgggacagcggtg

SEQ ID NO: 422568 - DNA, 140 bp, Artificial Sequence
  Synthetic
caccgctgtcccaaaaggtccccttccagggttgttcttatacaagttggtttgttctgtgtcagttgaaggatggtgaactccccatatgtaaagccttgcatagtctccattgttgaccatatcagcagccagggcct

SEQ ID NO: 422569 - DNA, 140 bp, Artificial Sequence
  Synthetic
atacgccatgctgggtctccttgggcaaaagaggtacaccaaaaccacatactggtgggacggactccaatcctctgatgatttcgccctcatagtaaatgcaccaaatcatgagggaatcgtacttgggagtcggccat

SEQ ID NO: 422570 - DNA, 140 bp, Artificial Sequence
  Synthetic
atggccgactcccaagtacgattccctcatgatttggtgcatttactatgagggcgaaatcatcagaggattggagtccgtcccaccagtatgtggttttggtgtacctcttttgcccaaggagacccagcatggcgtat

SEQ ID NO: 422571 - DNA, 140 bp, Artificial Sequence
  Synthetic
atacgccatgctgggtctcccactaccatagagaaggaaatttgtcctaaagtggcagaatacaagaattggtcaaaaccacaatgtcaaattacagggttcgctcctttctcaaaggaccgtacttgggagtcggccat

SEQ ID NO: 422572 - DNA, 140 bp, Artificial Sequence
  Synthetic
atggccgactcccaagtacggtcctttgagaaaggagcgaaccctgtaatttgacattgtggttttgaccaattcttgtattctgccactttaggacaaatttccttctctatggtagtgggagacccagcatggcgtat

SEQ ID NO: 422573 - DNA, 140 bp, Artificial Sequence
  Synthetic
aggccctggctgctgatatgggtcaaaaccacaatgtcaaattacagggttcgctcctttctcaaaggacaactcaattaggctttctgcaggtggagatatctgggtgacaagagaaccgaccttttgggacagcggtg

SEQ ID NO: 422574 - DNA, 140 bp, Artificial Sequence
  Synthetic
caccgctgtcccaaaaggtcggttctcttgtcacccagatatctccacctgcagaaagcctaattgagttgtcctttgagaaaggagcgaaccctgtaatttgacattgtggttttgacccatatcagcagccagggcct

SEQ ID NO: 422575 - DNA, 140 bp, Artificial Sequence
  Synthetic
atacgccatgctgggtctccgtgaagatgaatccaaatcagaagataatatgcatctcagcaacaggaatgacactatccgtagtaagtctgctaataggattggccaacctgggactgacgtacttgggagtcggccat

SEQ ID NO: 422576 - DNA, 140 bp, Artificial Sequence
  Synthetic
atggccgactcccaagtacgtcagtcccaggttggccaatcctattagcagacttactacggatagtgtcattcctgttgctgagatgcatattatcttctgatttggattcatcttcacggagacccagcatggcgtat

SEQ ID NO: 422577 - DNA, 140 bp, Artificial Sequence
  Synthetic
aggccctggctgctgatatggcccagctttggagtgtctggggtcaatgaatcagctgacatgagcattggggttacagtaataaagaacaatatgataaataatgaccttggaccagcagaccttttgggacagcggtg

SEQ ID NO: 422578 - DNA, 140 bp, Artificial Sequence
  Synthetic
caccgctgtcccaaaaggtctgctggtccaaggtcattatttatcatattgttctttattactgtaaccccaatgctcatgtcagctgattcattgaccccagacactccaaagctgggccatatcagcagccagggcct

SEQ ID NO: 422579 - DNA, 140 bp, Artificial Sequence
  Synthetic
atacgccatgctgggtctccccgatgccacaggggtgatacgcaaattcaaacaaggagatcatttgagctgaagaagctgtgggagcagactcgttcgaaggcaggattgttggtatcacgtacttgggagtcggccat

SEQ ID NO: 422580 - DNA, 140 bp, Artificial Sequence
  Synthetic
atggccgactcccaagtacgtgataccaacaatcctgccttcgaacgagtctgctcccacagcttcttcagctcaaatgatctccttgtttgaatttgcgtatcacccctgtggcatcggggagacccagcatggcgtat

SEQ ID NO: 422581 - DNA, 140 bp, Artificial Sequence
  Synthetic
aggccctggctgctgatatgtgaagaagctgtgggagcagactcgttcgaaggcaggattgttggtatcagatggagggccaaatctatacaatatccggaatctccacattccagaggtgaccttttgggacagcggtg

SEQ ID NO: 422582 - DNA, 140 bp, Artificial Sequence
  Synthetic
caccgctgtcccaaaaggtcacctctggaatgtggagattccggatattgtatagatttggccctccatctgataccaacaatcctgccttcgaacgagtctgctcccacagcttcttcacatatcagcagccagggcct

SEQ ID NO: 422583 - DNA, 140 bp, Artificial Sequence
  Synthetic
atacgccatgctgggtctccatgggtttaggcaccagaatgcagaagggacaggaacggctgcagatctcaagtcgactcaggcagctattgaccaaatcaatgggaaattgaatcgtctcgtacttgggagtcggccat

SEQ ID NO: 422584 - DNA, 140 bp, Artificial Sequence
  Synthetic
atggccgactcccaagtacgagacgattcaatttcccattgatttggtcaatagctgcctgagtcgacttgagatctgcagccgttcctgtcccttctgcattctggtgcctaaacccatggagacccagcatggcgtat

SEQ ID NO: 422585 - DNA, 140 bp, Artificial Sequence
  Synthetic
aggccctggctgctgatatggagagtttggcgccaagcaaacaatggtgaagatgcaacagctggccttactcatatcatgatttggcattccaatctgaatgatgccacgtaccagagagaccttttgggacagcggtg

SEQ ID NO: 422586 - DNA, 140 bp, Artificial Sequence
  Synthetic
caccgctgtcccaaaaggtctctctggtacgtggcatcattcagattggaatgccaaatcatgatatgagtaaggccagctgttgcatcttcaccattgtttgcttggcgccaaactctccatatcagcagccagggcct

SEQ ID NO: 422587 - DNA, 140 bp, Artificial Sequence
  Synthetic
aggccctggctgctgatatgaagtagagggaagaatccaagacttggagaagtatgttgaagacacaaagattgacctgtggtcttacaatgctgaattgctggtggcattagaaaatcagaccttttgggacagcggtg

SEQ ID NO: 422588 - DNA, 140 bp, Artificial Sequence
  Synthetic
caccgctgtcccaaaaggtctgattttctaatgccaccagcaattcagcattgtaagaccacaggtcaatctttgtgtcttcaacatacttctccaagtcttggattcttccctctacttcatatcagcagccagggcct

SEQ ID NO: 422589 - DNA, 140 bp, Artificial Sequence
  Synthetic
atacgccatgctgggtctcctatataaatatggaagattatagtattgagtccaattatgtatgctcaggacttgttggcgacacaccaagagatgatgatagctccagcagcagcaactcgtacttgggagtcggccat

SEQ ID NO: 422590 - DNA, 140 bp, Artificial Sequence
  Synthetic
atggccgactcccaagtacgagttgctgctgctggagctatcatcatctcttggtgtgtcgccaacaagtcctgagcatacataattggactcaatactataatcttccatatttatataggagacccagcatggcgtat

SEQ ID NO: 422591 - DNA, 140 bp, Artificial Sequence
  Synthetic
aggccctggctgctgatatgttaggcgccaactaagagagaatgctgaggacaaaggaaatggatgttttgaaattttccatcagtgtgacaacaactgcatcgaaagcataagaaatgggaccttttgggacagcggtg

SEQ ID NO: 422592 - DNA, 140 bp, Artificial Sequence
  Synthetic
caccgctgtcccaaaaggtcccatttcttatgctttcgatgcagttgttgtcacactgatggaaaatttcaaaacatccatttcctttgtcctcagcattctctcttagttggcgcctaacatatcagcagccagggcct

SEQ ID NO: 422593 - DNA, 140 bp, Artificial Sequence
  Synthetic
atacgccatgctgggtctcctttgacgatgggaatgacatttggatgggacgaacaatcaaaagtgattcacgctcaggttatgagacttttagggtcgttaatggttggaccacggctacgtacttgggagtcggccat

SEQ ID NO: 422594 - DNA, 140 bp, Artificial Sequence
  Synthetic
atggccgactcccaagtacgtagccgtggtccaaccattaacgaccctaaaagtctcataacctgagcgtgaatcacttttgattgttcgtcccatccaaatgtcattcccatcgtcaaaggagacccagcatggcgtat

SEQ ID NO: 422595 - DNA, 140 bp, Artificial Sequence
  Synthetic
aggccctggctgctgatatgagatacaaggggttaaattgactcaaggatacaaagacatcattctctggatttccttttccatatcatgctttttactcgttgcactacttttagccttgaccttttgggacagcggtg

SEQ ID NO: 422596 - DNA, 140 bp, Artificial Sequence
  Synthetic
caccgctgtcccaaaaggtcaaggctaaaagtagtgcaacgagtaaaaagcatgatatggaaaaggaaatccagagaatgatgtctttgtatccttgagtcaatttaaccccttgtatctcatatcagcagccagggcct

SEQ ID NO: 422597 - DNA, 140 bp, Artificial Sequence
  Synthetic
aggccctggctgctgatatggtccaaaagctggcagaagagttgcaaagcaacattggagtgctgagatctcttggggcaagtcaaaagaatggggaagggatcgcaaaggatgtaatgggaccttttgggacagcggtg

SEQ ID NO: 422598 - DNA, 140 bp, Artificial Sequence
  Synthetic
caccgctgtcccaaaaggtcccattacatcctttgcgatcccttccccattcttttgacttgccccaagagatctcagcactccaatgttgctttgcaactcttctgccagcttttggaccatatcagcagccagggcct

SEQ ID NO: 422599 - DNA, 140 bp, Artificial Sequence
  Synthetic
aggccctggctgctgatatggaaatatccaatcacagcagacaagagaataatggagatgattcctgaaaggaatgaacaagggcagacgctttggagcaagacaaatgatgctggatcagaccttttgggacagcggtg

SEQ ID NO: 422600 - DNA, 140 bp, Artificial Sequence
  Synthetic
caccgctgtcccaaaaggtctgatccagcatcatttgtcttgctccaaagcgtctgcccttgttcattcctttcaggaatcatctccattattctcttgtctgctgtgattggatatttccatatcagcagccagggcct

SEQ ID NO: 422601 - DNA, 140 bp, Artificial Sequence
  Synthetic
atacgccatgctgggtctccggaatgaacaagggcagacgctttggagcaagacaaatgatgctggatcagacagggtgatggtgtctcccctagctgtgacttggtggaacaggaatggcgtacttgggagtcggccat

SEQ ID NO: 422602 - DNA, 140 bp, Artificial Sequence
  Synthetic
atggccgactcccaagtacgccattcctgttccaccaagtcacagctaggggagacaccatcaccctgtctgatccagcatcatttgtcttgctccaaagcgtctgcccttgttcattccggagacccagcatggcgtat

SEQ ID NO: 422603 - DNA, 140 bp, Artificial Sequence
  Synthetic
aggccctggctgctgatatgatgaatccaaatcagaagataatagcaattggctctgtttctctaatcattgcgataatatgtctcctcatgcaaattgccatcttaacaacgactatgagaccttttgggacagcggtg

SEQ ID NO: 422604 - DNA, 140 bp, Artificial Sequence
  Synthetic
caccgctgtcccaaaaggtctcatagtcgttgttaagatggcaatttgcatgaggagacatattatcgcaatgattagagaaacagagccaattgctattatcttctgatttggattcatcatatcagcagccagggcct

SEQ ID NO: 422605 - DNA, 140 bp, Artificial Sequence
  Synthetic
aggccctggctgctgatatgagaaagttgaaaggttacaacatggaaccttcggtcctgtccatttcagaaaccaagttaaaatacgccgccgagttgatataaatccaggccatgcagagaccttttgggacagcggtg

SEQ ID NO: 422606 - DNA, 140 bp, Artificial Sequence
  Synthetic
caccgctgtcccaaaaggtctctgcatggcctggatttatatcaactcggcggcgtattttaacttggtttctgaaatggacaggaccgaaggttccatgttgtaacctttcaactttctcatatcagcagccagggcct

SEQ ID NO: 422607 - DNA, 140 bp, Artificial Sequence
  Synthetic
atacgccatgctgggtctccaaccaagttaaaatacgccgccgagttgatataaatccaggccatgcagatctcagtgctaaagaggcacaagatgtcatcatggaggtcgtcttcccaacgtacttgggagtcggccat

SEQ ID NO: 422608 - DNA, 140 bp, Artificial Sequence
  Synthetic
atggccgactcccaagtacgttgggaagacgacctccatgatgacatcttgtgcctctttagcactgagatctgcatggcctggatttatatcaactcggcggcgtattttaacttggttggagacccagcatggcgtat

SEQ ID NO: 422609 - DNA, 140 bp, Artificial Sequence
  Synthetic
aggccctggctgctgatatgacagaaatgaaaagtggcgagagcaattgggacagaaatttgaagaaataagatggttaattgaagaagtgcggcacagattgaaagcgacagagaataggaccttttgggacagcggtg

SEQ ID NO: 422610 - DNA, 140 bp, Artificial Sequence
  Synthetic
caccgctgtcccaaaaggtcctattctctgtcgctttcaatctgtgccgcacttcttcaattaaccatcttatttcttcaaatttctgtcccaattgctctcgccacttttcatttctgtcatatcagcagccagggcct

SEQ ID NO: 422611 - DNA, 140 bp, Artificial Sequence
  Synthetic
aggccctggctgctgatatgaaagagaaaaaagaagagctccaggattgtaagattgctcctttaatggtggcatacatgttggaaagggaactggttcgcaaaaccagattcctaccgggaccttttgggacagcggtg

SEQ ID NO: 422612 - DNA, 140 bp, Artificial Sequence
  Synthetic
caccgctgtcccaaaaggtcccggtaggaatctggttttgcgaaccagttccctttccaacatgtatgccaccattaaaggagcaatcttacaatcctggagctcttcttttttctctttcatatcagcagccagggcct

SEQ ID NO: 422613 - DNA, 140 bp, Artificial Sequence
  Synthetic
atacgccatgctgggtctcctcaccataagacaagagatggccagtaggggtctatgggattcctttcgtcagtccgagagaggcgaagagacaattgaagaaagatttgaaattacaggcgtacttgggagtcggccat

SEQ ID NO: 422614 - DNA, 140 bp, Artificial Sequence
  Synthetic
atggccgactcccaagtacgcctgtaatttcaaatctttcttcaattgtctcttcgcctctctcggactgacgaaaggaatcccatagacccctactggccatctcttgtcttatggtgaggagacccagcatggcgtat

SEQ ID NO: 422615 - DNA, 140 bp, Artificial Sequence
  Synthetic
aggccctggctgctgatatggggacctgctgggaacagatgtacacaccaggaggagaagtgagaaatgacgatgttgaccagagtttgatcatcgctgccagaaacattgttagaagaggaccttttgggacagcggtg

SEQ ID NO: 422616 - DNA, 140 bp, Artificial Sequence
  Synthetic
caccgctgtcccaaaaggtcctcttctaacaatgtttctggcagcgatgatcaaactctggtcaacatcgtcatttctcacttctcctcctggtgtgtacatctgttcccagcaggtccccatatcagcagccagggcct

SEQ ID NO: 422617 - DNA, 140 bp, Artificial Sequence
  Synthetic
atacgccatgctgggtctccacacaaattggtggaataaggatggtggacatccttaggcaaaatccaactgaggaacaagctgtggatatatgcaaagcagcaatgggtttgaggatcacgtacttgggagtcggccat

SEQ ID NO: 422618 - DNA, 140 bp, Artificial Sequence
  Synthetic
atggccgactcccaagtacgtgatcctcaaacccattgctgctttgcatatatccacagcttgttcctcagttggattttgcctaaggatgtccaccatccttattccaccaatttgtgtggagacccagcatggcgtat

SEQ ID NO: 422619 - DNA, 140 bp, Artificial Sequence
  Synthetic
atacgccatgctgggtctccatggagaaaataatgcttcttcttgcaataatcggtcttgttaaaagtgatcagatttgcgttggctaccatgcaaacaactcgacagagcaggttgacacgtacttgggagtcggccat

SEQ ID NO: 422620 - DNA, 140 bp, Artificial Sequence
  Synthetic
atggccgactcccaagtacgtgtcaacctgctctgtcgagttgtttgcatggtagccaacgcaaatctgatcacttttaacaagaccgattattgcaagaagaagcattattttctccatggagacccagcatggcgtat

SEQ ID NO: 422621 - DNA, 140 bp, Artificial Sequence
  Synthetic
aggccctggctgctgatatgagtgggagagacgaacaatcaatcgctgaagcaatcatcgtagctatggtgttctcacaggaggattgcatgataaaagcagtccgaggcgatctgaattgaccttttgggacagcggtg

SEQ ID NO: 422622 - DNA, 140 bp, Artificial Sequence
  Synthetic
caccgctgtcccaaaaggtcaattcagatcgcctcggactgcttttatcatgcaatcctcctgtgagaacaccatagctacgatgattgcttcagcgattgattgttcgtctctcccactcatatcagcagccagggcct

SEQ ID NO: 422623 - DNA, 140 bp, Artificial Sequence
  Synthetic
atacgccatgctgggtctccacaaatttctcaatgtgtcagaatggtcttacatagtggagaaggccagtccagccaatggcctttgttacccaggggatttcaatgattatgaagaactcgtacttgggagtcggccat

SEQ ID NO: 422624 - DNA, 140 bp, Artificial Sequence
  Synthetic
atggccgactcccaagtacgagttcttcataatcattgaaatcccctgggtaacaaaggccattggctggactggccttctccactatgtaagaccattctgacacattgagaaatttgtggagacccagcatggcgtat

SEQ ID NO: 422625 - DNA, 140 bp, Artificial Sequence
  Synthetic
aggccctggctgctgatatggcacagagatgtcactgagaggagtaagagttagtaaaatgggagtagatgaatactccagcactgagagagtagttgtaagtattgaccgtttcttaaggaccttttgggacagcggtg

SEQ ID NO: 422626 - DNA, 140 bp, Artificial Sequence
  Synthetic
caccgctgtcccaaaaggtccttaagaaacggtcaatacttacaactactctctcagtgctggagtattcatctactcccattttactaactcttactcctctcagtgacatctctgtgccatatcagcagccagggcct

SEQ ID NO: 422627 - DNA, 140 bp, Artificial Sequence
  Synthetic
aggccctggctgctgatatgcaataacaaaagaaaagaaggaggagctccaggactgtaagattgctcctttgatggtggcatacatgttggaaagagaactagttcgcaaaaccagattgaccttttgggacagcggtg

SEQ ID NO: 422628 - DNA, 140 bp, Artificial Sequence
  Synthetic
caccgctgtcccaaaaggtcaatctggttttgcgaactagttctctttccaacatgtatgccaccatcaaaggagcaatcttacagtcctggagctcctccttcttttcttttgttattgcatatcagcagccagggcct

SEQ ID NO: 422629 - DNA, 140 bp, Artificial Sequence
  Synthetic
atacgccatgctgggtctccaaagaacaatacatacccaccaataaaggtgaactacaccaatgccaatcaaaaagatcttctggtactgtggggaatccaccaccccaataatgaggcacgtacttgggagtcggccat

SEQ ID NO: 422630 - DNA, 140 bp, Artificial Sequence
  Synthetic
atggccgactcccaagtacgtgcctcattattggggtggtggattccccacagtaccagaagatctttttgattggcattggtgtagttcacctttattggtgggtatgtattgttctttggagacccagcatggcgtat

SEQ ID NO: 422631 - DNA, 140 bp, Artificial Sequence
  Synthetic
aggccctggctgctgatatgaaaaagatcttctggtactgtggggaatccaccaccccaataatgaggcagagcagaaaatgatctatcaaaacctaaacacttatgtttccgttggaacgaccttttgggacagcggtg

SEQ ID NO: 422632 - DNA, 140 bp, Artificial Sequence
  Synthetic
caccgctgtcccaaaaggtcgttccaacggaaacataagtgtttaggttttgatagatcattttctgctctgcctcattattggggtggtggattccccacagtaccagaagatctttttcatatcagcagccagggcct

SEQ ID NO: 422633 - DNA, 140 bp, Artificial Sequence
  Synthetic
aggccctggctgctgatatggctgccagaggtcaatacagtggatttgtgagaacactattccaacaaatgcgcgacgtgctggggacattcgacactgtccagataataaagctgctacgaccttttgggacagcggtg
